United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 45

SEQ ID NO: 1886050 - DNA, 20 bp, Homo sapiens
tgcctggaagagcagcccta

SEQ ID NO: 1886051 - DNA, 22 bp, Homo sapiens
tgccttctcaactccaaactga

SEQ ID NO: 1886052 - DNA, 20 bp, Homo sapiens
tgccttctcactagctgtct

SEQ ID NO: 1886053 - DNA, 17 bp, Homo sapiens
tgccttttcccaactcc

SEQ ID NO: 1886054 - DNA, 19 bp, Homo sapiens
tgccttttcccaactccag

SEQ ID NO: 1886055 - DNA, 13 bp, Homo sapiens
tgcggtaggtgct

SEQ ID NO: 1886056 - DNA, 15 bp, Homo sapiens
tgctaagcattccaa

SEQ ID NO: 1886057 - DNA, 18 bp, Homo sapiens
tgctaccctccctgctgt

SEQ ID NO: 1886058 - DNA, 16 bp, Homo sapiens
tgctatgcattttctt

SEQ ID NO: 1886059 - DNA, 14 bp, Homo sapiens
tgctcgggcccagg

SEQ ID NO: 1886060 - DNA, 16 bp, Homo sapiens
tgctcgggcccaggcc

SEQ ID NO: 1886061 - DNA, 20 bp, Homo sapiens
acactcgggttaagaaatac

SEQ ID NO: 1886062 - DNA, 20 bp, Homo sapiens
acactctcaaagcaaataat

SEQ ID NO: 1886063 - DNA, 21 bp, Homo sapiens
acactctcactatgctgctat

SEQ ID NO: 1886064 - DNA, 12 bp, Homo sapiens
acactgaagaag

SEQ ID NO: 1886065 - DNA, 14 bp, Homo sapiens
acactgaagaagca

SEQ ID NO: 1886066 - DNA, 12 bp, Homo sapiens
acagaagcagct

SEQ ID NO: 1886067 - DNA, 13 bp, Homo sapiens
acagaagcagctc

SEQ ID NO: 1886068 - DNA, 14 bp, Homo sapiens
acagaagcagctct

SEQ ID NO: 1886069 - DNA, 17 bp, Homo sapiens
acagaatgctgttttaa

SEQ ID NO: 1886070 - DNA, 18 bp, Homo sapiens
acagaattgactgcagtt

SEQ ID NO: 1886071 - DNA, 18 bp, Homo sapiens
acagcaaggaggctggct

SEQ ID NO: 1886072 - DNA, 19 bp, Homo sapiens
acagcaaggaggctggctg

SEQ ID NO: 1886073 - DNA, 18 bp, Homo sapiens
acagcaaggcacctgcag

SEQ ID NO: 1886074 - DNA, 16 bp, Homo sapiens
acagccacgaggtggt

SEQ ID NO: 1886075 - DNA, 19 bp, Homo sapiens
acagctgtatgattcccag

SEQ ID NO: 1886076 - DNA, 19 bp, Homo sapiens
acaggcctcacacacaatg

SEQ ID NO: 1886077 - DNA, 15 bp, Homo sapiens
acagtaaataaattg

SEQ ID NO: 1886078 - DNA, 16 bp, Homo sapiens
acagtcatggtggcca

SEQ ID NO: 1886079 - DNA, 21 bp, Homo sapiens
acagtcatggtggccacggcc

SEQ ID NO: 1886080 - DNA, 21 bp, Homo sapiens
acagtgcagcttgcagtccgt

SEQ ID NO: 1886081 - DNA, 13 bp, Homo sapiens
acagtggccacgg

SEQ ID NO: 1886082 - DNA, 15 bp, Homo sapiens
acagtgtctgggctg

SEQ ID NO: 1886083 - DNA, 19 bp, Homo sapiens
acagtgtctgggctgactg

SEQ ID NO: 1886084 - DNA, 19 bp, Homo sapiens
acagtgttaggcctggcac

SEQ ID NO: 1886085 - DNA, 17 bp, Homo sapiens
acagtgttctgagcccc

SEQ ID NO: 1886086 - DNA, 12 bp, Homo sapiens
acagttcagttc

SEQ ID NO: 1886087 - DNA, 20 bp, Homo sapiens
acagttgtgtcataaattac

SEQ ID NO: 1886088 - DNA, 16 bp, Homo sapiens
acatcaccacagttta

SEQ ID NO: 1886089 - DNA, 20 bp, Homo sapiens
acatcccactcacaacagct

SEQ ID NO: 1886090 - DNA, 20 bp, Homo sapiens
acatctagcagtaaatactt

SEQ ID NO: 1886091 - DNA, 18 bp, Homo sapiens
acatgaattgcattttac

SEQ ID NO: 1886092 - DNA, 21 bp, Homo sapiens
acatgcccgctgtcccagggg

SEQ ID NO: 1886093 - DNA, 21 bp, Homo sapiens
acatgctggttacctgttcca

SEQ ID NO: 1886094 - DNA, 15 bp, Homo sapiens
acattcagaaaactt

SEQ ID NO: 1886095 - DNA, 22 bp, Homo sapiens
acattcagaaaacttcaagaca

SEQ ID NO: 1886096 - DNA, 14 bp, Homo sapiens
acatttaacataat

SEQ ID NO: 1886097 - DNA, 18 bp, Homo sapiens
acatttgctcatggaatt

SEQ ID NO: 1886098 - DNA, 12 bp, Homo sapiens
accaagctgtgc

SEQ ID NO: 1886099 - DNA, 13 bp, Homo sapiens
accaagctgtgcc

SEQ ID NO: 1886100 - DNA, 18 bp, Homo sapiens
accaagctgtgccaccct

SEQ ID NO: 1886101 - DNA, 19 bp, Homo sapiens
accaagctgtgccaccctg

SEQ ID NO: 1886102 - DNA, 17 bp, Homo sapiens
accaagcttaaggagag

SEQ ID NO: 1886103 - DNA, 16 bp, Homo sapiens
accacaagactgcaca

SEQ ID NO: 1886104 - DNA, 17 bp, Homo sapiens
accacaatgcagtgcct

SEQ ID NO: 1886105 - DNA, 18 bp, Homo sapiens
accacttgtgttttgcaa

SEQ ID NO: 1886106 - DNA, 16 bp, Homo sapiens
accagagtctggagct

SEQ ID NO: 1886107 - DNA, 18 bp, Homo sapiens
accagagtctggagctga

SEQ ID NO: 1886108 - DNA, 18 bp, Homo sapiens
accagctccactggcctg

SEQ ID NO: 1886109 - DNA, 17 bp, Homo sapiens
accaggacttgtgcaga

SEQ ID NO: 1886110 - DNA, 17 bp, Homo sapiens
accagggccccggggcc

SEQ ID NO: 1886111 - DNA, 20 bp, Homo sapiens
accaggtctcctccaccgcc

SEQ ID NO: 1886112 - DNA, 21 bp, Homo sapiens
accaggtgctagggtgcctgc

SEQ ID NO: 1886113 - DNA, 22 bp, Homo sapiens
accagttgaactgcaggaagag

SEQ ID NO: 1886114 - DNA, 20 bp, Homo sapiens
accatgaagagatttttcat

SEQ ID NO: 1886115 - DNA, 14 bp, Homo sapiens
accattgtctcaga

SEQ ID NO: 1886116 - DNA, 15 bp, Homo sapiens
accattgtctcagag

SEQ ID NO: 1886117 - DNA, 18 bp, Homo sapiens
acccacaggcccacagta

SEQ ID NO: 1886118 - DNA, 18 bp, Homo sapiens
acccacgaggaggaacca

SEQ ID NO: 1886119 - DNA, 23 bp, Homo sapiens
acccaggaggcggaggttgcagt

SEQ ID NO: 1886120 - DNA, 21 bp, Homo sapiens
accccaggccataccaggtgc

SEQ ID NO: 1886121 - DNA, 16 bp, Homo sapiens
accccatctgcccagg

SEQ ID NO: 1886122 - DNA, 13 bp, Homo sapiens
acccccactctgc

SEQ ID NO: 1886123 - DNA, 22 bp, Homo sapiens
acccccagcacccgggctcagg

SEQ ID NO: 1886124 - DNA, 15 bp, Homo sapiens
accccctcctgctgc

SEQ ID NO: 1886125 - DNA, 16 bp, Homo sapiens
accccctcctgctgca

SEQ ID NO: 1886126 - DNA, 13 bp, Homo sapiens
acccctcccctcc

SEQ ID NO: 1886127 - DNA, 16 bp, Homo sapiens
accccttttcagcttc

SEQ ID NO: 1886128 - DNA, 19 bp, Homo sapiens
acccgccttttataaacct

SEQ ID NO: 1886129 - DNA, 12 bp, Homo sapiens
acccgggctcag

SEQ ID NO: 1886130 - DNA, 23 bp, Homo sapiens
acccgggctcagggaccacagca

SEQ ID NO: 1886131 - DNA, 21 bp, Homo sapiens
accctacacctctgggccctg

SEQ ID NO: 1886132 - DNA, 12 bp, Homo sapiens
accctccctgct

SEQ ID NO: 1886133 - DNA, 15 bp, Homo sapiens
accctccgttgacag

SEQ ID NO: 1886134 - DNA, 19 bp, Homo sapiens
accctcgaggcggatcttt

SEQ ID NO: 1886135 - DNA, 20 bp, Homo sapiens
accctgcctctacccaacca

SEQ ID NO: 1886136 - DNA, 18 bp, Homo sapiens
accctgtttctgtagaaa

SEQ ID NO: 1886137 - DNA, 15 bp, Homo sapiens
acccttggacttgag

SEQ ID NO: 1886138 - DNA, 19 bp, Homo sapiens
accgatgatactgtttctt

SEQ ID NO: 1886139 - DNA, 13 bp, Homo sapiens
accggtcagtgcc

SEQ ID NO: 1886140 - DNA, 16 bp, Homo sapiens
accggtcagtgccttt

SEQ ID NO: 1886141 - DNA, 16 bp, Homo sapiens
acctagggtgatatta

SEQ ID NO: 1886142 - DNA, 14 bp, Homo sapiens
acctatttcctcag

SEQ ID NO: 1886143 - DNA, 20 bp, Homo sapiens
acctcactattcaagtatta

SEQ ID NO: 1886144 - DNA, 22 bp, Homo sapiens
acctctgggccctgcaggaggc

SEQ ID NO: 1886145 - DNA, 22 bp, Homo sapiens
acctctgtatttgaatcagcct

SEQ ID NO: 1886146 - DNA, 20 bp, Homo sapiens
acctctgtccctcaaaattg

SEQ ID NO: 1886147 - DNA, 22 bp, Homo sapiens
acctgcaggttgggccatactg

SEQ ID NO: 1886148 - DNA, 22 bp, Homo sapiens
acctgcctgaccatcccatgag

SEQ ID NO: 1886149 - DNA, 15 bp, Homo sapiens
acctgggctgggaga

SEQ ID NO: 1886150 - DNA, 17 bp, Homo sapiens
acctgggctgggagaag

SEQ ID NO: 1886151 - DNA, 17 bp, Homo sapiens
acctgtcatctgggcca

SEQ ID NO: 1886152 - DNA, 13 bp, Homo sapiens
acctgttccattg

SEQ ID NO: 1886153 - DNA, 22 bp, Homo sapiens
accttctcaaaagattgtttta

SEQ ID NO: 1886154 - DNA, 19 bp, Homo sapiens
accttctgaacatgagtgt

SEQ ID NO: 1886155 - DNA, 16 bp, Homo sapiens
accttggtaaattgta

SEQ ID NO: 1886156 - DNA, 18 bp, Homo sapiens
accttggtaaattgtaaa

SEQ ID NO: 1886157 - DNA, 21 bp, Homo sapiens
acctttaaatttaggtaaata

SEQ ID NO: 1886158 - DNA, 22 bp, Homo sapiens
acctttaaatttaggtaaataa

SEQ ID NO: 1886159 - DNA, 14 bp, Homo sapiens
acgaggaggaacca

SEQ ID NO: 1886160 - DNA, 16 bp, Homo sapiens
acggatggaaggagag

SEQ ID NO: 1886161 - DNA, 15 bp, Homo sapiens
acggatttatttttc

SEQ ID NO: 1886162 - DNA, 15 bp, Homo sapiens
acggggtggacgagg

SEQ ID NO: 1886163 - DNA, 22 bp, Homo sapiens
acgtgagctccggaatagatgt

SEQ ID NO: 1886164 - DNA, 15 bp, Homo sapiens
acgtgtatgtttctt

SEQ ID NO: 1886165 - DNA, 18 bp, Homo sapiens
actaaatggtgttacatt

SEQ ID NO: 1886166 - DNA, 20 bp, Homo sapiens
actaactcctaggaaaatac

SEQ ID NO: 1886167 - DNA, 15 bp, Homo sapiens
actaagagagaatga

SEQ ID NO: 1886168 - DNA, 23 bp, Homo sapiens
actaataaaaaactgtgaaccct

SEQ ID NO: 1886169 - DNA, 20 bp, Homo sapiens
actaccctacacctctgggc

SEQ ID NO: 1886170 - DNA, 16 bp, Homo sapiens
actagctgtctcagga

SEQ ID NO: 1886171 - DNA, 17 bp, Homo sapiens
actagctgtctcaggag

SEQ ID NO: 1886172 - DNA, 19 bp, Homo sapiens
actagtatttctatgaaat

SEQ ID NO: 1886173 - DNA, 21 bp, Homo sapiens
actatagtccagctttgttct

SEQ ID NO: 1886174 - DNA, 18 bp, Homo sapiens
actatgcgtttttataaa

SEQ ID NO: 1886175 - DNA, 13 bp, Homo sapiens
actattcaagtat

SEQ ID NO: 1886176 - DNA, 18 bp, Homo sapiens
actatttaacttgagggt

SEQ ID NO: 1886177 - DNA, 20 bp, Homo sapiens
actcagtgttgactgtaggc

SEQ ID NO: 1886178 - DNA, 22 bp, Homo sapiens
actcatgctggatgaccccatg

SEQ ID NO: 1886179 - DNA, 17 bp, Homo sapiens
actccacagtgtttata

SEQ ID NO: 1886180 - DNA, 20 bp, Homo sapiens
actccatgttggctagcctc

SEQ ID NO: 1886181 - DNA, 14 bp, Homo sapiens
actcccacttccct

SEQ ID NO: 1886182 - DNA, 20 bp, Homo sapiens
actcccacttccctgacact

SEQ ID NO: 1886183 - DNA, 18 bp, Homo sapiens
actcctcacttttcaatt

SEQ ID NO: 1886184 - DNA, 14 bp, Homo sapiens
actcctcttatttg

SEQ ID NO: 1886185 - DNA, 21 bp, Homo sapiens
actcgggagcattctgcctgc

SEQ ID NO: 1886186 - DNA, 18 bp, Homo sapiens
actcgggttaagaaatac

SEQ ID NO: 1886187 - DNA, 15 bp, Homo sapiens
actctacactgaaac

SEQ ID NO: 1886188 - DNA, 17 bp, Homo sapiens
actctcactatgctgct

SEQ ID NO: 1886189 - DNA, 18 bp, Homo sapiens
actctcactatgctgcta

SEQ ID NO: 1886190 - DNA, 19 bp, Homo sapiens
actctcactatgctgctat

SEQ ID NO: 1886191 - DNA, 17 bp, Homo sapiens
actctccatcagatgtg

SEQ ID NO: 1886192 - DNA, 18 bp, Homo sapiens
actctggaccccaggcca

SEQ ID NO: 1886193 - DNA, 13 bp, Homo sapiens
actctgtgcccat

SEQ ID NO: 1886194 - DNA, 18 bp, Homo sapiens
actctgtgcccatgggca

SEQ ID NO: 1886195 - DNA, 12 bp, Homo sapiens
actctgtgtaaa

SEQ ID NO: 1886196 - DNA, 20 bp, Homo sapiens
actcttaagaagactgcatt

SEQ ID NO: 1886197 - DNA, 19 bp, Homo sapiens
actcttatggccaaattca

SEQ ID NO: 1886198 - DNA, 12 bp, Homo sapiens
actgaatatata

SEQ ID NO: 1886199 - DNA, 13 bp, Homo sapiens
actgactcttaag

SEQ ID NO: 1886200 - DNA, 14 bp, Homo sapiens
actgactcttaaga

SEQ ID NO: 1886201 - DNA, 16 bp, Homo sapiens
actgactcttaagaag

SEQ ID NO: 1886202 - DNA, 16 bp, Homo sapiens
actgcaccccctcctg

SEQ ID NO: 1886203 - DNA, 17 bp, Homo sapiens
actgcaccccctcctgc

SEQ ID NO: 1886204 - DNA, 18 bp, Homo sapiens
actgcaccccctcctgct

SEQ ID NO: 1886205 - DNA, 19 bp, Homo sapiens
actgcaccccctcctgctg

SEQ ID NO: 1886206 - DNA, 22 bp, Homo sapiens
actgcaccccctcctgctgcag

SEQ ID NO: 1886207 - DNA, 20 bp, Homo sapiens
actgcagaggagccacctgg

SEQ ID NO: 1886208 - DNA, 22 bp, Homo sapiens
actgcagaggagccacctgggc

SEQ ID NO: 1886209 - DNA, 13 bp, Homo sapiens
actgcaggaagag

SEQ ID NO: 1886210 - DNA, 15 bp, Homo sapiens
actgcattatattta

SEQ ID NO: 1886211 - DNA, 17 bp, Homo sapiens
actgctgggtggcccat

SEQ ID NO: 1886212 - DNA, 14 bp, Homo sapiens
actggccagaggca

SEQ ID NO: 1886213 - DNA, 16 bp, Homo sapiens
actggcctcgcctggc

SEQ ID NO: 1886214 - DNA, 13 bp, Homo sapiens
actggcctgcccg

SEQ ID NO: 1886215 - DNA, 16 bp, Homo sapiens
actggctgcctccact

SEQ ID NO: 1886216 - DNA, 17 bp, Homo sapiens
actggctgcctccactc

SEQ ID NO: 1886217 - DNA, 19 bp, Homo sapiens
actgtaagaaaatatcact

SEQ ID NO: 1886218 - DNA, 18 bp, Homo sapiens
actgtaggcgcccctggg

SEQ ID NO: 1886219 - DNA, 18 bp, Homo sapiens
actgtcctgctccacagt

SEQ ID NO: 1886220 - DNA, 20 bp, Homo sapiens
actgtcctgctccacagtgt

SEQ ID NO: 1886221 - DNA, 19 bp, Homo sapiens
actgtttcttgcactgaat

SEQ ID NO: 1886222 - DNA, 20 bp, Homo sapiens
actgtttcttgcactgaata

SEQ ID NO: 1886223 - DNA, 14 bp, Homo sapiens
acttaattgctaca

SEQ ID NO: 1886224 - DNA, 16 bp, Homo sapiens
acttagcaagacctga

SEQ ID NO: 1886225 - DNA, 14 bp, Homo sapiens
acttagctctgagg

SEQ ID NO: 1886226 - DNA, 16 bp, Homo sapiens
acttagctctgaggag

SEQ ID NO: 1886227 - DNA, 13 bp, Homo sapiens
acttatattttga

SEQ ID NO: 1886228 - DNA, 15 bp, Homo sapiens
acttatattttgatt

SEQ ID NO: 1886229 - DNA, 19 bp, Homo sapiens
acttcaaatccttgaagat

SEQ ID NO: 1886230 - DNA, 22 bp, Homo sapiens
acttcaggggctgcccgctccc

SEQ ID NO: 1886231 - DNA, 20 bp, Homo sapiens
acttccagatcctggaaatc

SEQ ID NO: 1886232 - DNA, 22 bp, Homo sapiens
acttccctgacactgcggggct

SEQ ID NO: 1886233 - DNA, 19 bp, Homo sapiens
acttgaattttcccactgc

SEQ ID NO: 1886234 - DNA, 17 bp, Homo sapiens
acttgagggtaataaac

SEQ ID NO: 1886235 - DNA, 13 bp, Homo sapiens
acttgcagttgtg

SEQ ID NO: 1886236 - DNA, 17 bp, Homo sapiens
acttgcagttgtgatat

SEQ ID NO: 1886237 - DNA, 22 bp, Homo sapiens
acttgctgcagtatgaaaataa

SEQ ID NO: 1886238 - DNA, 19 bp, Homo sapiens
acttgcttccaagcccttc

SEQ ID NO: 1886239 - DNA, 16 bp, Homo sapiens
acttgtgttttgcaag

SEQ ID NO: 1886240 - DNA, 20 bp, Homo sapiens
actttaaacatctagcagta

SEQ ID NO: 1886241 - DNA, 15 bp, Homo sapiens
actttctagattaag

SEQ ID NO: 1886242 - DNA, 10 bp, Homo sapiens
actttcttct

SEQ ID NO: 1886243 - DNA, 10 bp, Homo sapiens
agcacagccc

SEQ ID NO: 1886244 - DNA, 13 bp, Homo sapiens
agcacagccctcc

SEQ ID NO: 1886245 - DNA, 21 bp, Homo sapiens
agcacagccctcccgcccctt

SEQ ID NO: 1886246 - DNA, 13 bp, Homo sapiens
agcacctggtggg

SEQ ID NO: 1886247 - DNA, 13 bp, Homo sapiens
agcagcagtgagc

SEQ ID NO: 1886248 - DNA, 23 bp, Homo sapiens
agcagctctgctatgagtgtgtg

SEQ ID NO: 1886249 - DNA, 16 bp, Homo sapiens
agcagcttcagttgtt

SEQ ID NO: 1886250 - DNA, 22 bp, Homo sapiens
agcagcttctgccacttcccag

SEQ ID NO: 1886251 - DNA, 13 bp, Homo sapiens
agcaggcagagga

SEQ ID NO: 1886252 - DNA, 18 bp, Homo sapiens
agcaggcagaggagagta

SEQ ID NO: 1886253 - DNA, 20 bp, Homo sapiens
agcaggctgcagcaggcaga

SEQ ID NO: 1886254 - DNA, 20 bp, Homo sapiens
agcagtaaatacttgcagtt

SEQ ID NO: 1886255 - DNA, 21 bp, Homo sapiens
agcagtaaatacttgcagttg

SEQ ID NO: 1886256 - DNA, 20 bp, Homo sapiens
agcatgagttatctgatttt

SEQ ID NO: 1886257 - DNA, 16 bp, Homo sapiens
agcatgtgggggaagg

SEQ ID NO: 1886258 - DNA, 21 bp, Homo sapiens
agccacctgggctgggagaag

SEQ ID NO: 1886259 - DNA, 21 bp, Homo sapiens
agccagttggcttctgtgcct

SEQ ID NO: 1886260 - DNA, 17 bp, Homo sapiens
agccatttaactggagc

SEQ ID NO: 1886261 - DNA, 21 bp, Homo sapiens
agccatttaactggagctccg

SEQ ID NO: 1886262 - DNA, 19 bp, Homo sapiens
agcccaacacacactcggg

SEQ ID NO: 1886263 - DNA, 17 bp, Homo sapiens
agcccacgtcctgtcag

SEQ ID NO: 1886264 - DNA, 21 bp, Homo sapiens
agcccacgtcctgtcagtgcc

SEQ ID NO: 1886265 - DNA, 11 bp, Homo sapiens
agccccacagc

SEQ ID NO: 1886266 - DNA, 14 bp, Homo sapiens
agccccacagccca

SEQ ID NO: 1886267 - DNA, 15 bp, Homo sapiens
agccccacagcccac

SEQ ID NO: 1886268 - DNA, 20 bp, Homo sapiens
agccccacagcccacgtcct

SEQ ID NO: 1886269 - DNA, 18 bp, Homo sapiens
agcccctgtgtgggaggg

SEQ ID NO: 1886270 - DNA, 21 bp, Homo sapiens
agccctgaacaaagcacctca

SEQ ID NO: 1886271 - DNA, 17 bp, Homo sapiens
agcccttctttccacag

SEQ ID NO: 1886272 - DNA, 17 bp, Homo sapiens
agccgctgcccggcgcc

SEQ ID NO: 1886273 - DNA, 14 bp, Homo sapiens
agcctacaggcctc

SEQ ID NO: 1886274 - DNA, 21 bp, Homo sapiens
agcctcaagtcttatttcctc

SEQ ID NO: 1886275 - DNA, 23 bp, Homo sapiens
agcctccgttcccacctctgagg

SEQ ID NO: 1886276 - DNA, 15 bp, Homo sapiens
agcctctgtgtcact

SEQ ID NO: 1886277 - DNA, 21 bp, Homo sapiens
agcctctgtgtcactggctgc

SEQ ID NO: 1886278 - DNA, 23 bp, Homo sapiens
agcctctgtgtcactggctgcct

SEQ ID NO: 1886279 - DNA, 10 bp, Homo sapiens
agcctggagc

SEQ ID NO: 1886280 - DNA, 13 bp, Homo sapiens
agcctggagcccc

SEQ ID NO: 1886281 - DNA, 14 bp, Homo sapiens
agcctggagcccct

SEQ ID NO: 1886282 - DNA, 12 bp, Homo sapiens
agcctggcccag

SEQ ID NO: 1886283 - DNA, 14 bp, Homo sapiens
agcctggcccagct

SEQ ID NO: 1886284 - DNA, 17 bp, Homo sapiens
agcctggcccagctccc

SEQ ID NO: 1886285 - DNA, 22 bp, Homo sapiens
agcctggctccaaaccctcgag

SEQ ID NO: 1886286 - DNA, 16 bp, Homo sapiens
agcgctggccgggacc

SEQ ID NO: 1886287 - DNA, 15 bp, Homo sapiens
agctacctggggtgg

SEQ ID NO: 1886288 - DNA, 23 bp, Homo sapiens
agctcccccgggaggggcccgct

SEQ ID NO: 1886289 - DNA, 11 bp, Homo sapiens
agctctgagcc

SEQ ID NO: 1886290 - DNA, 12 bp, Homo sapiens
agctctgcatta

SEQ ID NO: 1886291 - DNA, 13 bp, Homo sapiens
agctctgcattat

SEQ ID NO: 1886292 - DNA, 12 bp, Homo sapiens
agctgaaaatat

SEQ ID NO: 1886293 - DNA, 14 bp, Homo sapiens
agctgacagtcctc

SEQ ID NO: 1886294 - DNA, 16 bp, Homo sapiens
agctgagagaaaataa

SEQ ID NO: 1886295 - DNA, 19 bp, Homo sapiens
agctgcagagagcacctgg

SEQ ID NO: 1886296 - DNA, 23 bp, Homo sapiens
agctgcagagagcacctggtggg

SEQ ID NO: 1886297 - DNA, 16 bp, Homo sapiens
agctggacctcaccaa

SEQ ID NO: 1886298 - DNA, 14 bp, Homo sapiens
agctggctgtactg

SEQ ID NO: 1886299 - DNA, 14 bp, Homo sapiens
agctgtctcaggag

SEQ ID NO: 1886300 - DNA, 13 bp, Homo sapiens
agctgtgccaccc

SEQ ID NO: 1886301 - DNA, 18 bp, Homo sapiens
agtagcaccctggattga

SEQ ID NO: 1886302 - DNA, 15 bp, Homo sapiens
agtatatttctgaaa

SEQ ID NO: 1886303 - DNA, 23 bp, Homo sapiens
agtatctcggacctttcagctgt

SEQ ID NO: 1886304 - DNA, 13 bp, Homo sapiens
agtatgaaaataa

SEQ ID NO: 1886305 - DNA, 23 bp, Homo sapiens
agtatgcttgaaaagataaatta

SEQ ID NO: 1886306 - DNA, 18 bp, Homo sapiens
agtatgttagtgcaaatt

SEQ ID NO: 1886307 - DNA, 13 bp, Homo sapiens
agtatttctatga

SEQ ID NO: 1886308 - DNA, 16 bp, Homo sapiens
agtatttctatgaaat

SEQ ID NO: 1886309 - DNA, 18 bp, Homo sapiens
agtatttctatgaaatat

SEQ ID NO: 1886310 - DNA, 17 bp, Homo sapiens
agtcaggtgcagtccca

SEQ ID NO: 1886311 - DNA, 20 bp, Homo sapiens
agtcatgtaagctgaaaata

SEQ ID NO: 1886312 - DNA, 16 bp, Homo sapiens
agtccaagcatttaga

SEQ ID NO: 1886313 - DNA, 21 bp, Homo sapiens
agtccaagcatttagatgtat

SEQ ID NO: 1886314 - DNA, 14 bp, Homo sapiens
agtctaaagtttac

SEQ ID NO: 1886315 - DNA, 13 bp, Homo sapiens
agtctccccagat

SEQ ID NO: 1886316 - DNA, 16 bp, Homo sapiens
agtctgctatattttc

SEQ ID NO: 1886317 - DNA, 17 bp, Homo sapiens
agtctgctatattttca

SEQ ID NO: 1886318 - DNA, 21 bp, Homo sapiens
agtctgtgagattcattcatg

SEQ ID NO: 1886319 - DNA, 20 bp, Homo sapiens
agtctgtgtaactttaaaca

SEQ ID NO: 1886320 - DNA, 21 bp, Homo sapiens
agtctgtgtaactttaaacat

SEQ ID NO: 1886321 - DNA, 21 bp, Homo sapiens
agtgagcagtcaggaaagaga

SEQ ID NO: 1886322 - DNA, 16 bp, Homo sapiens
agtgattgtatgaatt

SEQ ID NO: 1886323 - DNA, 18 bp, Homo sapiens
agtgcaaattgtcacagg

SEQ ID NO: 1886324 - DNA, 22 bp, Homo sapiens
agtgcaaattgtcacaggacag

SEQ ID NO: 1886325 - DNA, 19 bp, Homo sapiens
agtgctggctccacgccct

SEQ ID NO: 1886326 - DNA, 22 bp, Homo sapiens
agtgctggctccacgccctggg

SEQ ID NO: 1886327 - DNA, 23 bp, Homo sapiens
agtgctggctccacgccctgggg

SEQ ID NO: 1886328 - DNA, 23 bp, Homo sapiens
agtggaggaggtggcttcatgtg

SEQ ID NO: 1886329 - DNA, 18 bp, Homo sapiens
agtggccaagatcacagt

SEQ ID NO: 1886330 - DNA, 12 bp, Homo sapiens
agtggctgtcca

SEQ ID NO: 1886331 - DNA, 23 bp, Homo sapiens
agtggctgtccagtgcccattcc

SEQ ID NO: 1886332 - DNA, 22 bp, Homo sapiens
agtggtctggaatggactgggt

SEQ ID NO: 1886333 - DNA, 19 bp, Homo sapiens
agtgtctgggctgactggg

SEQ ID NO: 1886334 - DNA, 13 bp, Homo sapiens
agtgtgcccccca

SEQ ID NO: 1886335 - DNA, 21 bp, Homo sapiens
agtgtgtggctttcagagcct

SEQ ID NO: 1886336 - DNA, 17 bp, Homo sapiens
agtgttaggcctggcac

SEQ ID NO: 1886337 - DNA, 20 bp, Homo sapiens
agtgttaggcctggcacagt

SEQ ID NO: 1886338 - DNA, 19 bp, Homo sapiens
agttatgccgctagataca

SEQ ID NO: 1886339 - DNA, 21 bp, Homo sapiens
agttattgttttatgttctag

SEQ ID NO: 1886340 - DNA, 20 bp, Homo sapiens
agttcagttcctctttgcat

SEQ ID NO: 1886341 - DNA, 24 bp, Homo sapiens
agttcagttcctctttgcatggaa

SEQ ID NO: 1886342 - DNA, 17 bp, Homo sapiens
agttcatccattctatt

SEQ ID NO: 1886343 - DNA, 21 bp, Homo sapiens
agttcctctttgcatggaatt

SEQ ID NO: 1886344 - DNA, 16 bp, Homo sapiens
agttctgaagaagatg

SEQ ID NO: 1886345 - DNA, 20 bp, Homo sapiens
agttgaacactagtctgtgt

SEQ ID NO: 1886346 - DNA, 21 bp, Homo sapiens
agttgatatgccttttcccaa

SEQ ID NO: 1886347 - DNA, 16 bp, Homo sapiens
agttgcgtttaagttg

SEQ ID NO: 1886348 - DNA, 17 bp, Homo sapiens
agttggcttctgtgcct

SEQ ID NO: 1886349 - DNA, 15 bp, Homo sapiens
agttgtgatataaag

SEQ ID NO: 1886350 - DNA, 22 bp, Homo sapiens
agtttacagtaaataaattgtt

SEQ ID NO: 1886351 - DNA, 16 bp, Homo sapiens
agtttagctggaaaag

SEQ ID NO: 1886352 - DNA, 21 bp, Homo sapiens
agtttatgtctaaagagcttt

SEQ ID NO: 1886353 - DNA, 12 bp, Homo sapiens
agtttgttgaaa

SEQ ID NO: 1886354 - DNA, 15 bp, Homo sapiens
ataaaagttgcgttt

SEQ ID NO: 1886355 - DNA, 21 bp, Homo sapiens
ataaaataatttttatatttg

SEQ ID NO: 1886356 - DNA, 18 bp, Homo sapiens
ataaaatccatacatttg

SEQ ID NO: 1886357 - DNA, 11 bp, Homo sapiens
ataaaattgta

SEQ ID NO: 1886358 - DNA, 20 bp, Homo sapiens
ataaacactccacagtgttt

SEQ ID NO: 1886359 - DNA, 17 bp, Homo sapiens
ataaacagttgttactt

SEQ ID NO: 1886360 - DNA, 14 bp, Homo sapiens
ataaacttagaata

SEQ ID NO: 1886361 - DNA, 15 bp, Homo sapiens
ataaagcagtcctgt

SEQ ID NO: 1886362 - DNA, 20 bp, Homo sapiens
ataaattacacaataaagca

SEQ ID NO: 1886363 - DNA, 19 bp, Homo sapiens
ataacaatgctgtatttta

SEQ ID NO: 1886364 - DNA, 12 bp, Homo sapiens
ataactggaaac

SEQ ID NO: 1886365 - DNA, 19 bp, Homo sapiens
ataagaaaaaattctttca

SEQ ID NO: 1886366 - DNA, 22 bp, Homo sapiens
ataagaaaaaattctttcactt

SEQ ID NO: 1886367 - DNA, 17 bp, Homo sapiens
ataagcaaattagtaat

SEQ ID NO: 1886368 - DNA, 19 bp, Homo sapiens
tcaacccctcccctccatc

SEQ ID NO: 1886369 - DNA, 21 bp, Homo sapiens
tcaacccctcccctccatccc

SEQ ID NO: 1886370 - DNA, 16 bp, Homo sapiens
tcaaggcctcccacag

SEQ ID NO: 1886371 - DNA, 17 bp, Homo sapiens
tcaaggcctcccacagt

SEQ ID NO: 1886372 - DNA, 19 bp, Homo sapiens
tcaagtcctgcctcttaaa

SEQ ID NO: 1886373 - DNA, 13 bp, Homo sapiens
tcaagtgcaagga

SEQ ID NO: 1886374 - DNA, 14 bp, Homo sapiens
tcaataaaatccat

SEQ ID NO: 1886375 - DNA, 15 bp, Homo sapiens
tcaatatttcagata

SEQ ID NO: 1886376 - DNA, 23 bp, Homo sapiens
tcaatatttcagataatcacaat

SEQ ID NO: 1886377 - DNA, 13 bp, Homo sapiens
tcaattaccacac

SEQ ID NO: 1886378 - DNA, 16 bp, Homo sapiens
tcacaaggtcaggagt

SEQ ID NO: 1886379 - DNA, 23 bp, Homo sapiens
tcacaggacagcccttctttcca

SEQ ID NO: 1886380 - DNA, 23 bp, Homo sapiens
tcacaggtagacagtatataact

SEQ ID NO: 1886381 - DNA, 18 bp, Homo sapiens
tcacagtggccacggcca

SEQ ID NO: 1886382 - DNA, 21 bp, Homo sapiens
tcacatgcccgctgtcccagg

SEQ ID NO: 1886383 - DNA, 15 bp, Homo sapiens
tcaccaggggcaggc

SEQ ID NO: 1886384 - DNA, 18 bp, Homo sapiens
tcaccaggggcaggcaca

SEQ ID NO: 1886385 - DNA, 18 bp, Homo sapiens
tcaccagtgtgtggcttt

SEQ ID NO: 1886386 - DNA, 23 bp, Homo sapiens
tcaccagtgtgtggctttcagag

SEQ ID NO: 1886387 - DNA, 16 bp, Homo sapiens
tcaccggtcagtgcct

SEQ ID NO: 1886388 - DNA, 17 bp, Homo sapiens
tcaccggtcagtgcctt

SEQ ID NO: 1886389 - DNA, 14 bp, Homo sapiens
tcacctcatggaat

SEQ ID NO: 1886390 - DNA, 14 bp, Homo sapiens
tcactgctcacact

SEQ ID NO: 1886391 - DNA, 14 bp, Homo sapiens
tcactggctgcctc

SEQ ID NO: 1886392 - DNA, 17 bp, Homo sapiens
tcactggctgcctccac

SEQ ID NO: 1886393 - DNA, 18 bp, Homo sapiens
tcactggctgcctccact

SEQ ID NO: 1886394 - DNA, 20 bp, Homo sapiens
tcactggctgcctccactcc

SEQ ID NO: 1886395 - DNA, 21 bp, Homo sapiens
tcactggctgcctccactccc

SEQ ID NO: 1886396 - DNA, 16 bp, Homo sapiens
tcacttaattgctaca

SEQ ID NO: 1886397 - DNA, 15 bp, Homo sapiens
tcacttcttccactg

SEQ ID NO: 1886398 - DNA, 16 bp, Homo sapiens
tcagatccccagcttt

SEQ ID NO: 1886399 - DNA, 22 bp, Homo sapiens
tcagatccccagctttctcctc

SEQ ID NO: 1886400 - DNA, 13 bp, Homo sapiens
tcagatcgttcat

SEQ ID NO: 1886401 - DNA, 16 bp, Homo sapiens
tcagatcgttcattgc

SEQ ID NO: 1886402 - DNA, 19 bp, Homo sapiens
tcagatcgttcattgcctt

SEQ ID NO: 1886403 - DNA, 12 bp, Homo sapiens
tcagctgtgaac

SEQ ID NO: 1886404 - DNA, 17 bp, Homo sapiens
tcagcttctgctgggct

SEQ ID NO: 1886405 - DNA, 16 bp, Homo sapiens
tcaggaaaagcctctg

SEQ ID NO: 1886406 - DNA, 19 bp, Homo sapiens
tcaggaaagagaacttcca

SEQ ID NO: 1886407 - DNA, 13 bp, Homo sapiens
tcaggctagatgt

SEQ ID NO: 1886408 - DNA, 15 bp, Homo sapiens
tcagggaccacagca

SEQ ID NO: 1886409 - DNA, 13 bp, Homo sapiens
tcagggctgggca

SEQ ID NO: 1886410 - DNA, 20 bp, Homo sapiens
tcaggggctgcccgctccca

SEQ ID NO: 1886411 - DNA, 22 bp, Homo sapiens
tcaggggctgcccgctcccagt

SEQ ID NO: 1886412 - DNA, 17 bp, Homo sapiens
tcaggtgcagtcccagt

SEQ ID NO: 1886413 - DNA, 15 bp, Homo sapiens
tcagtcatattctta

SEQ ID NO: 1886414 - DNA, 15 bp, Homo sapiens
tcagtgactcatgct

SEQ ID NO: 1886415 - DNA, 17 bp, Homo sapiens
tcagtgactcatgctgg

SEQ ID NO: 1886416 - DNA, 20 bp, Homo sapiens
tcagtgtacccccgcccagg

SEQ ID NO: 1886417 - DNA, 14 bp, Homo sapiens
tcatccattctatt

SEQ ID NO: 1886418 - DNA, 19 bp, Homo sapiens
tcatccattctattgttaa

SEQ ID NO: 1886419 - DNA, 12 bp, Homo sapiens
tcatctgggcca

SEQ ID NO: 1886420 - DNA, 17 bp, Homo sapiens
tcatctgttgttctgtg

SEQ ID NO: 1886421 - DNA, 19 bp, Homo sapiens
tcatgaagatatttttcca

SEQ ID NO: 1886422 - DNA, 14 bp, Homo sapiens
tcatgattttgaaa

SEQ ID NO: 1886423 - DNA, 21 bp, Homo sapiens
tcatgattttgaaatcatgaa

SEQ ID NO: 1886424 - DNA, 19 bp, Homo sapiens
tcatggaattggagctcgt

SEQ ID NO: 1886425 - DNA, 15 bp, Homo sapiens
tcatgtaacagttgt

SEQ ID NO: 1886426 - DNA, 20 bp, Homo sapiens
tcatgtaacttccctgaaaa

SEQ ID NO: 1886427 - DNA, 21 bp, Homo sapiens
tcatgttactaaatggtgtta

SEQ ID NO: 1886428 - DNA, 14 bp, Homo sapiens
tcattcttatttca

SEQ ID NO: 1886429 - DNA, 18 bp, Homo sapiens
tcattcttatttcatgaa

SEQ ID NO: 1886430 - DNA, 15 bp, Homo sapiens
tcattgcctttccag

SEQ ID NO: 1886431 - DNA, 23 bp, Homo sapiens
tccaaactgactcttaagaagac

SEQ ID NO: 1886432 - DNA, 22 bp, Homo sapiens
tccaaaggaggatggcatataa

SEQ ID NO: 1886433 - DNA, 20 bp, Homo sapiens
tccaagcatttagatgtata

SEQ ID NO: 1886434 - DNA, 23 bp, Homo sapiens
tccaataaaaacattttgaagtg

SEQ ID NO: 1886435 - DNA, 17 bp, Homo sapiens
tccacagtgtttatatt

SEQ ID NO: 1886436 - DNA, 20 bp, Homo sapiens
tccacctagtggctgtccag

SEQ ID NO: 1886437 - DNA, 13 bp, Homo sapiens
tccactcccactt

SEQ ID NO: 1886438 - DNA, 12 bp, Homo sapiens
tccactggcctg

SEQ ID NO: 1886439 - DNA, 21 bp, Homo sapiens
tactctgaaattgtaactaaa

SEQ ID NO: 1886440 - DNA, 14 bp, Homo sapiens
tactgaggtggtgg

SEQ ID NO: 1886441 - DNA, 19 bp, Homo sapiens
tactggcctcgcctggcct

SEQ ID NO: 1886442 - DNA, 21 bp, Homo sapiens
tactggcctcgcctggcctga

SEQ ID NO: 1886443 - DNA, 14 bp, Homo sapiens
tactgtttcttgca

SEQ ID NO: 1886444 - DNA, 16 bp, Homo sapiens
tactgtttcttgcact

SEQ ID NO: 1886445 - DNA, 17 bp, Homo sapiens
tactgtttcttgcactg

SEQ ID NO: 1886446 - DNA, 21 bp, Homo sapiens
tactgtttcttgcactgaata

SEQ ID NO: 1886447 - DNA, 21 bp, Homo sapiens
tacttagcaagacctgaaaat

SEQ ID NO: 1886448 - DNA, 21 bp, Homo sapiens
tacttcaaatccttgaagatt

SEQ ID NO: 1886449 - DNA, 19 bp, Homo sapiens
tacttcttagggttatgat

SEQ ID NO: 1886450 - DNA, 12 bp, Homo sapiens
tacttgcagttg

SEQ ID NO: 1886451 - DNA, 16 bp, Homo sapiens
tacttgcagttgtgat

SEQ ID NO: 1886452 - DNA, 23 bp, Homo sapiens
tagaaaagaaaacatttaacata

SEQ ID NO: 1886453 - DNA, 22 bp, Homo sapiens
tagaagcccaaattcatataaa

SEQ ID NO: 1886454 - DNA, 22 bp, Homo sapiens
tagaatacattgatacaaagta

SEQ ID NO: 1886455 - DNA, 23 bp, Homo sapiens
tagaataccacaggaaccacaag

SEQ ID NO: 1886456 - DNA, 16 bp, Homo sapiens
tagaggaccaggactt

SEQ ID NO: 1886457 - DNA, 22 bp, Homo sapiens
tagatattattttagcttcagt

SEQ ID NO: 1886458 - DNA, 14 bp, Homo sapiens
tagatgtcttcatc

SEQ ID NO: 1886459 - DNA, 19 bp, Homo sapiens
tagatgtcttcatcacttc

SEQ ID NO: 1886460 - DNA, 21 bp, Homo sapiens
tagatgtcttcatcacttctt

SEQ ID NO: 1886461 - DNA, 21 bp, Homo sapiens
tagcagactttcccaaatgta

SEQ ID NO: 1886462 - DNA, 15 bp, Homo sapiens
tagcagtaaatactt

SEQ ID NO: 1886463 - DNA, 23 bp, Homo sapiens
tagcagtaaatacttgcagttgt

SEQ ID NO: 1886464 - DNA, 14 bp, Homo sapiens
tagctacatagcag

SEQ ID NO: 1886465 - DNA, 15 bp, Homo sapiens
tagctctgagccctc

SEQ ID NO: 1886466 - DNA, 17 bp, Homo sapiens
tagcttcagttgttctt

SEQ ID NO: 1886467 - DNA, 19 bp, Homo sapiens
taggaaatatttattttaa

SEQ ID NO: 1886468 - DNA, 19 bp, Homo sapiens
taggactttagggatctgg

SEQ ID NO: 1886469 - DNA, 22 bp, Homo sapiens
taggactttagggatctgggga

SEQ ID NO: 1886470 - DNA, 19 bp, Homo sapiens
taggcagggatttgaggag

SEQ ID NO: 1886471 - DNA, 17 bp, Homo sapiens
taggcctggcacagtgt

SEQ ID NO: 1886472 - DNA, 19 bp, Homo sapiens
tagggagatgagttgcagt

SEQ ID NO: 1886473 - DNA, 21 bp, Homo sapiens
taggggctggggccaaataaa

SEQ ID NO: 1886474 - DNA, 23 bp, Homo sapiens
taggggtaatatattgctgctgg

SEQ ID NO: 1886475 - DNA, 12 bp, Homo sapiens
taggtaaataaa

SEQ ID NO: 1886476 - DNA, 15 bp, Homo sapiens
taggtaaataaagct

SEQ ID NO: 1886477 - DNA, 22 bp, Homo sapiens
taggtgatggccagtcatgtgc

SEQ ID NO: 1886478 - DNA, 15 bp, Homo sapiens
taggtgctggcctca

SEQ ID NO: 1886479 - DNA, 23 bp, Homo sapiens
taggttttaataattttttaatt

SEQ ID NO: 1886480 - DNA, 14 bp, Homo sapiens
tagtactaactcct

SEQ ID NO: 1886481 - DNA, 14 bp, Homo sapiens
tagtatcttttaaa

SEQ ID NO: 1886482 - DNA, 17 bp, Homo sapiens
tagtattgtccaggtct

SEQ ID NO: 1886483 - DNA, 18 bp, Homo sapiens
tagtatttctatgaaata

SEQ ID NO: 1886484 - DNA, 14 bp, Homo sapiens
tagtcaaattgtgt

SEQ ID NO: 1886485 - DNA, 18 bp, Homo sapiens
tagtcaaattgtgtgaaa

SEQ ID NO: 1886486 - DNA, 23 bp, Homo sapiens
tagtccagctttgttcttcttaa

SEQ ID NO: 1886487 - DNA, 19 bp, Homo sapiens
tagtctgtgtaactttaaa

SEQ ID NO: 1886488 - DNA, 15 bp, Homo sapiens
tagtgtaataatgtt

SEQ ID NO: 1886489 - DNA, 16 bp, Homo sapiens
tagtgttggagaagaa

SEQ ID NO: 1886490 - DNA, 23 bp, Homo sapiens
tagtgttggagaagaactgaaat

SEQ ID NO: 1886491 - DNA, 22 bp, Homo sapiens
tataaaataatttttatatttg

SEQ ID NO: 1886492 - DNA, 19 bp, Homo sapiens
tataaacactccacagtgt

SEQ ID NO: 1886493 - DNA, 19 bp, Homo sapiens
tataaacctctaatttatt

SEQ ID NO: 1886494 - DNA, 22 bp, Homo sapiens
tataaacctctaatttattttg

SEQ ID NO: 1886495 - DNA, 16 bp, Homo sapiens
tataaaggaccctgtt

SEQ ID NO: 1886496 - DNA, 20 bp, Homo sapiens
tataagccctgcataatgtt

SEQ ID NO: 1886497 - DNA, 19 bp, Homo sapiens
tataattttgtgaagcaaa

SEQ ID NO: 1886498 - DNA, 21 bp, Homo sapiens
tatagagatatgcagaaggaa

SEQ ID NO: 1886499 - DNA, 17 bp, Homo sapiens
tatagatttgtatttta

SEQ ID NO: 1886500 - DNA, 22 bp, Homo sapiens
tatataaacactccacagtgtt

SEQ ID NO: 1886501 - DNA, 23 bp, Homo sapiens
tatatattttaagccttcatttg

SEQ ID NO: 1886502 - DNA, 13 bp, Homo sapiens
tatatgcttctgt

SEQ ID NO: 1886503 - DNA, 14 bp, Homo sapiens
tatatgcttctgtt

SEQ ID NO: 1886504 - DNA, 16 bp, Homo sapiens
tatatggtctgtgtgt

SEQ ID NO: 1886505 - DNA, 20 bp, Homo sapiens
gttgggccatactggcctcg

SEQ ID NO: 1886506 - DNA, 19 bp, Homo sapiens
gttgtctccctggccctca

SEQ ID NO: 1886507 - DNA, 15 bp, Homo sapiens
gttgtgaaatgtaac

SEQ ID NO: 1886508 - DNA, 20 bp, Homo sapiens
gtttaaagtgcagtcatttg

SEQ ID NO: 1886509 - DNA, 20 bp, Homo sapiens
gtttagctggaaaagtatgt

SEQ ID NO: 1886510 - DNA, 15 bp, Homo sapiens
gtttatgtctaaaga

SEQ ID NO: 1886511 - DNA, 16 bp, Homo sapiens
gtttcatccttttcat

SEQ ID NO: 1886512 - DNA, 18 bp, Homo sapiens
gtttcttctttcttttaa

SEQ ID NO: 1886513 - DNA, 22 bp, Homo sapiens
gtttcttttttttttttttaca

SEQ ID NO: 1886514 - DNA, 19 bp, Homo sapiens
gtttgcacagtggtctgga

SEQ ID NO: 1886515 - DNA, 14 bp, Homo sapiens
gtttgttttttcat

SEQ ID NO: 1886516 - DNA, 22 bp, Homo sapiens
gttttataattttgtgaagcaa

SEQ ID NO: 1886517 - DNA, 20 bp, Homo sapiens
gttttcaggggctttggaag

SEQ ID NO: 1886518 - DNA, 23 bp, Homo sapiens
gttttcccgagcaaagtctaaag

SEQ ID NO: 1886519 - DNA, 18 bp, Homo sapiens
gtttttataaaaaatggt

SEQ ID NO: 1886520 - DNA, 15 bp, Homo sapiens
taaaaaatggtgcct

SEQ ID NO: 1886521 - DNA, 18 bp, Homo sapiens
taaaaacattttgaagtg

SEQ ID NO: 1886522 - DNA, 13 bp, Homo sapiens
taaaaagacactt

SEQ ID NO: 1886523 - DNA, 21 bp, Homo sapiens
taaaagttgcgtttaagttgt

SEQ ID NO: 1886524 - DNA, 22 bp, Homo sapiens
taaaagttgcgtttaagttgta

SEQ ID NO: 1886525 - DNA, 22 bp, Homo sapiens
taaaatagaatgatagaacttt

SEQ ID NO: 1886526 - DNA, 19 bp, Homo sapiens
taaaattgtaaaattgtat

SEQ ID NO: 1886527 - DNA, 20 bp, Homo sapiens
taaacatctagcagtaaata

SEQ ID NO: 1886528 - DNA, 14 bp, Homo sapiens
taaagacttgagaa

SEQ ID NO: 1886529 - DNA, 15 bp, Homo sapiens
taaagccctgtgtta

SEQ ID NO: 1886530 - DNA, 16 bp, Homo sapiens
taaaggaccctgtttc

SEQ ID NO: 1886531 - DNA, 18 bp, Homo sapiens
taaaggaccctgtttctg

SEQ ID NO: 1886532 - DNA, 20 bp, Homo sapiens
taaaggaccctgtttctgta

SEQ ID NO: 1886533 - DNA, 20 bp, Homo sapiens
taaagtatcaggatactata

SEQ ID NO: 1886534 - DNA, 15 bp, Homo sapiens
taaagtgatatttcc

SEQ ID NO: 1886535 - DNA, 13 bp, Homo sapiens
taaagtgcagtca

SEQ ID NO: 1886536 - DNA, 17 bp, Homo sapiens
taaagtgcagtcatttg

SEQ ID NO: 1886537 - DNA, 15 bp, Homo sapiens
taaagtttgttcact

SEQ ID NO: 1886538 - DNA, 15 bp, Homo sapiens
taaagtttgttgaaa

SEQ ID NO: 1886539 - DNA, 14 bp, Homo sapiens
taaataaagctcaa

SEQ ID NO: 1886540 - DNA, 15 bp, Homo sapiens
taaataaagctcaag

SEQ ID NO: 1886541 - DNA, 13 bp, Homo sapiens
taacaatgctgta

SEQ ID NO: 1886542 - DNA, 16 bp, Homo sapiens
taacagttgtgtcata

SEQ ID NO: 1886543 - DNA, 21 bp, Homo sapiens
taacagttgtgtcataaatta

SEQ ID NO: 1886544 - DNA, 13 bp, Homo sapiens
taacatctttgtt

SEQ ID NO: 1886545 - DNA, 17 bp, Homo sapiens
taacatgaagcaaacta

SEQ ID NO: 1886546 - DNA, 20 bp, Homo sapiens
taacatgaagcaaactaact

SEQ ID NO: 1886547 - DNA, 17 bp, Homo sapiens
taaccaggggccatgaa

SEQ ID NO: 1886548 - DNA, 21 bp, Homo sapiens
taacttccctgaaaaatctaa

SEQ ID NO: 1886549 - DNA, 15 bp, Homo sapiens
taactttaaacatct

SEQ ID NO: 1886550 - DNA, 16 bp, Homo sapiens
taactttaaacatcta

SEQ ID NO: 1886551 - DNA, 21 bp, Homo sapiens
taacttttttttttttaacat

SEQ ID NO: 1886552 - DNA, 11 bp, Homo sapiens
taagaaatacc

SEQ ID NO: 1886553 - DNA, 23 bp, Homo sapiens
taagaagcacgtggtaaaacact

SEQ ID NO: 1886554 - DNA, 20 bp, Homo sapiens
taagacggatttatttttcc

SEQ ID NO: 1886555 - DNA, 19 bp, Homo sapiens
taagatatgggacattttt

SEQ ID NO: 1886556 - DNA, 18 bp, Homo sapiens
taagatatttttcatgat

SEQ ID NO: 1886557 - DNA, 16 bp, Homo sapiens
taagccctgcataatg

SEQ ID NO: 1886558 - DNA, 19 bp, Homo sapiens
taagccttcatttgcaatt

SEQ ID NO: 1886559 - DNA, 22 bp, Homo sapiens
taagcgctagaggaagcagcca

SEQ ID NO: 1886560 - DNA, 15 bp, Homo sapiens
taagctgtaaaaaga

SEQ ID NO: 1886561 - DNA, 14 bp, Homo sapiens
taaggagaggagag

SEQ ID NO: 1886562 - DNA, 19 bp, Homo sapiens
taaggatggagccagctct

SEQ ID NO: 1886563 - DNA, 17 bp, Homo sapiens
taagtttatgtctaaag

SEQ ID NO: 1886564 - DNA, 17 bp, Homo sapiens
taataaacttagaataa

SEQ ID NO: 1886565 - DNA, 15 bp, Homo sapiens
taataatgtttcaaa

SEQ ID NO: 1886566 - DNA, 16 bp, Homo sapiens
taataattttttaatt

SEQ ID NO: 1886567 - DNA, 14 bp, Homo sapiens
taatacaaaggctt

SEQ ID NO: 1886568 - DNA, 13 bp, Homo sapiens
gcgcccctggggt

SEQ ID NO: 1886569 - DNA, 16 bp, Homo sapiens
gcgggcagcacagcaa

SEQ ID NO: 1886570 - DNA, 17 bp, Homo sapiens
gcggggctggaggtggc

SEQ ID NO: 1886571 - DNA, 13 bp, Homo sapiens
gcgggggagcctg

SEQ ID NO: 1886572 - DNA, 17 bp, Homo sapiens
gcggtaggtgctggcct

SEQ ID NO: 1886573 - DNA, 19 bp, Homo sapiens
gcggtggctcttgcctgta

SEQ ID NO: 1886574 - DNA, 16 bp, Homo sapiens
gctaccctccctgctg

SEQ ID NO: 1886575 - DNA, 17 bp, Homo sapiens
gctaccctccctgctgt

SEQ ID NO: 1886576 - DNA, 19 bp, Homo sapiens
gctaccctccctgctgtcc

SEQ ID NO: 1886577 - DNA, 23 bp, Homo sapiens
gctaccctccctgctgtcccctc

SEQ ID NO: 1886578 - DNA, 18 bp, Homo sapiens
gctagatgtatgtacttc

SEQ ID NO: 1886579 - DNA, 16 bp, Homo sapiens
gctaggggctggggcc

SEQ ID NO: 1886580 - DNA, 15 bp, Homo sapiens
gctagggtgcctgct

SEQ ID NO: 1886581 - DNA, 21 bp, Homo sapiens
gctagtaattggaaaggcagc

SEQ ID NO: 1886582 - DNA, 19 bp, Homo sapiens
gctatcagagcctctccca

SEQ ID NO: 1886583 - DNA, 20 bp, Homo sapiens
gctatcagagcctctcccac

SEQ ID NO: 1886584 - DNA, 17 bp, Homo sapiens
gctatgcattttcttca

SEQ ID NO: 1886585 - DNA, 16 bp, Homo sapiens
gctcagggaccacagc

SEQ ID NO: 1886586 - DNA, 17 bp, Homo sapiens
gctcagggaccacagca

SEQ ID NO: 1886587 - DNA, 17 bp, Homo sapiens
gctccaaaccctcgagg

SEQ ID NO: 1886588 - DNA, 12 bp, Homo sapiens
gctccacagtgt

SEQ ID NO: 1886589 - DNA, 17 bp, Homo sapiens
gctccagttgaacacta

SEQ ID NO: 1886590 - DNA, 14 bp, Homo sapiens
gctcccaagggagg

SEQ ID NO: 1886591 - DNA, 15 bp, Homo sapiens
gctcccccgggaggg

SEQ ID NO: 1886592 - DNA, 21 bp, Homo sapiens
gctcctcaacccctcccctcc

SEQ ID NO: 1886593 - DNA, 22 bp, Homo sapiens
gctcctcaacccctcccctcca

SEQ ID NO: 1886594 - DNA, 14 bp, Homo sapiens
gctcctgctgcacc

SEQ ID NO: 1886595 - DNA, 22 bp, Homo sapiens
gctcctgctgcaccaacccagc

SEQ ID NO: 1886596 - DNA, 13 bp, Homo sapiens
gctcctgtgccct

SEQ ID NO: 1886597 - DNA, 12 bp, Homo sapiens
gctcgggcccag

SEQ ID NO: 1886598 - DNA, 13 bp, Homo sapiens
gctcgggcccagg

SEQ ID NO: 1886599 - DNA, 16 bp, Homo sapiens
gctctccttgccctgg

SEQ ID NO: 1886600 - DNA, 21 bp, Homo sapiens
gctctccttgccctgggccag

SEQ ID NO: 1886601 - DNA, 23 bp, Homo sapiens
gctctgagacggatggaaggaga

SEQ ID NO: 1886602 - DNA, 11 bp, Homo sapiens
gctctgagccc

SEQ ID NO: 1886603 - DNA, 13 bp, Homo sapiens
gctctgagccctc

SEQ ID NO: 1886604 - DNA, 24 bp, Homo sapiens
gctctgtgggctgcactctgtgcc

SEQ ID NO: 1886605 - DNA, 16 bp, Homo sapiens
gctctgttgcaggtgt

SEQ ID NO: 1886606 - DNA, 16 bp, Homo sapiens
gctcttgcctgtaatc

SEQ ID NO: 1886607 - DNA, 21 bp, Homo sapiens
gctgagactgcagaggagcca

SEQ ID NO: 1886608 - DNA, 15 bp, Homo sapiens
gctgagagaaaataa

SEQ ID NO: 1886609 - DNA, 15 bp, Homo sapiens
gctgagctacctggg

SEQ ID NO: 1886610 - DNA, 14 bp, Homo sapiens
gctgatgctgggct

SEQ ID NO: 1886611 - DNA, 15 bp, Homo sapiens
gctgatgctgggctg

SEQ ID NO: 1886612 - DNA, 16 bp, Homo sapiens
gctgatgctgggctgg

SEQ ID NO: 1886613 - DNA, 16 bp, Homo sapiens
gctgcaccaacccagc

SEQ ID NO: 1886614 - DNA, 17 bp, Homo sapiens
gctgcaccaacccagcc

SEQ ID NO: 1886615 - DNA, 19 bp, Homo sapiens
gctgcaccaacccagccgc

SEQ ID NO: 1886616 - DNA, 23 bp, Homo sapiens
gctgcaccaacccagccgctgcc

SEQ ID NO: 1886617 - DNA, 14 bp, Homo sapiens
gctgcactctgtgc

SEQ ID NO: 1886618 - DNA, 13 bp, Homo sapiens
gctgcagaggggc

SEQ ID NO: 1886619 - DNA, 22 bp, Homo sapiens
gctgcagaggggcaggccctgc

SEQ ID NO: 1886620 - DNA, 21 bp, Homo sapiens
gctgcagcaggcagaggagag

SEQ ID NO: 1886621 - DNA, 13 bp, Homo sapiens
gctgcccgctccc

SEQ ID NO: 1886622 - DNA, 15 bp, Homo sapiens
gctgcccgctcccag

SEQ ID NO: 1886623 - DNA, 16 bp, Homo sapiens
gctgcccgctcccagt

SEQ ID NO: 1886624 - DNA, 23 bp, Homo sapiens
gctgcccggcgccctctgtcctg

SEQ ID NO: 1886625 - DNA, 20 bp, Homo sapiens
gctgcctccactcccacttc

SEQ ID NO: 1886626 - DNA, 17 bp, Homo sapiens
gctgctaccctccctgc

SEQ ID NO: 1886627 - DNA, 22 bp, Homo sapiens
gctgctaccctccctgctgtcc

SEQ ID NO: 1886628 - DNA, 15 bp, Homo sapiens
gctgcttctgggcct

SEQ ID NO: 1886629 - DNA, 17 bp, Homo sapiens
gctggaggggacgctgg

SEQ ID NO: 1886630 - DNA, 13 bp, Homo sapiens
gctggagtgctgg

SEQ ID NO: 1886631 - DNA, 18 bp, Homo sapiens
gctggagtgctggctcca

SEQ ID NO: 1886632 - DNA, 13 bp, Homo sapiens
gctggccagcccc

SEQ ID NO: 1886633 - DNA, 18 bp, Homo sapiens
gctggccagccccacagc

SEQ ID NO: 1886634 - DNA, 13 bp, Homo sapiens
gctggccgggacc

SEQ ID NO: 1886635 - DNA, 23 bp, Homo sapiens
gctggcctcaaacagccacgagg

SEQ ID NO: 1886636 - DNA, 18 bp, Homo sapiens
gctggctccacgccctgg

SEQ ID NO: 1886637 - DNA, 22 bp, Homo sapiens
gctggctccacgccctggggag

SEQ ID NO: 1886638 - DNA, 14 bp, Homo sapiens
gctggctggggcct

SEQ ID NO: 1886639 - DNA, 19 bp, Homo sapiens
gctgggcaggtcctgggga

SEQ ID NO: 1886640 - DNA, 12 bp, Homo sapiens
gctgggctgggg

SEQ ID NO: 1886641 - DNA, 16 bp, Homo sapiens
gctggggccaaataaa

SEQ ID NO: 1886642 - DNA, 21 bp, Homo sapiens
gctggggcctatcagtgtgcc

SEQ ID NO: 1886643 - DNA, 19 bp, Homo sapiens
gctggggcctgatggggag

SEQ ID NO: 1886644 - DNA, 21 bp, Homo sapiens
gctgggtgcgaccccatctgc

SEQ ID NO: 1886645 - DNA, 18 bp, Homo sapiens
gctgggttttcaggggct

SEQ ID NO: 1886646 - DNA, 18 bp, Homo sapiens
gctgtattttaaaagaat

SEQ ID NO: 1886647 - DNA, 16 bp, Homo sapiens
ggcctatcagtgtgcc

SEQ ID NO: 1886648 - DNA, 18 bp, Homo sapiens
ggcctatcagtgtgcccc

SEQ ID NO: 1886649 - DNA, 16 bp, Homo sapiens
ggcctatctaaactgg

SEQ ID NO: 1886650 - DNA, 13 bp, Homo sapiens
ggcctcccacagt

SEQ ID NO: 1886651 - DNA, 15 bp, Homo sapiens
ggcctcccacagtga

SEQ ID NO: 1886652 - DNA, 16 bp, Homo sapiens
ggcctcgcctggcctg

SEQ ID NO: 1886653 - DNA, 18 bp, Homo sapiens
ggcctcgcctggcctgag

SEQ ID NO: 1886654 - DNA, 12 bp, Homo sapiens
ggcctgactccc

SEQ ID NO: 1886655 - DNA, 16 bp, Homo sapiens
ggcctgactcccatgc

SEQ ID NO: 1886656 - DNA, 19 bp, Homo sapiens
ggcctgactcccatgcaag

SEQ ID NO: 1886657 - DNA, 18 bp, Homo sapiens
ggcctgaggtctcgctga

SEQ ID NO: 1886658 - DNA, 22 bp, Homo sapiens
ggcctgaggtctcgctgatgct

SEQ ID NO: 1886659 - DNA, 15 bp, Homo sapiens
ggcctggactgtcct

SEQ ID NO: 1886660 - DNA, 13 bp, Homo sapiens
ggcctgggagggc

SEQ ID NO: 1886661 - DNA, 16 bp, Homo sapiens
ggcctgttctgtagga

SEQ ID NO: 1886662 - DNA, 13 bp, Homo sapiens
ggccttgctgtca

SEQ ID NO: 1886663 - DNA, 15 bp, Homo sapiens
ggccttgctgtcatg

SEQ ID NO: 1886664 - DNA, 13 bp, Homo sapiens
ggcgactggaggc

SEQ ID NO: 1886665 - DNA, 18 bp, Homo sapiens
ggcgaggcgggggagcct

SEQ ID NO: 1886666 - DNA, 19 bp, Homo sapiens
ggcgagggaggggaggtgg

SEQ ID NO: 1886667 - DNA, 13 bp, Homo sapiens
ggcgccctctgtc

SEQ ID NO: 1886668 - DNA, 16 bp, Homo sapiens
ggcgccctctgtcctg

SEQ ID NO: 1886669 - DNA, 18 bp, Homo sapiens
ggcggggctggaggtggc

SEQ ID NO: 1886670 - DNA, 23 bp, Homo sapiens
ggcgggggatcctggagcccctg

SEQ ID NO: 1886671 - DNA, 22 bp, Homo sapiens
ggctatttaaaagtataaaact

SEQ ID NO: 1886672 - DNA, 14 bp, Homo sapiens
ggctcagggaccac

SEQ ID NO: 1886673 - DNA, 17 bp, Homo sapiens
ggctcagggaccacagc

SEQ ID NO: 1886674 - DNA, 15 bp, Homo sapiens
ggctccacgccctgg

SEQ ID NO: 1886675 - DNA, 16 bp, Homo sapiens
ggctccacgccctggg

SEQ ID NO: 1886676 - DNA, 18 bp, Homo sapiens
ggctccacgccctgggga

SEQ ID NO: 1886677 - DNA, 16 bp, Homo sapiens
ggctcccaagggaggc

SEQ ID NO: 1886678 - DNA, 20 bp, Homo sapiens
ggctcccatgggctaggagc

SEQ ID NO: 1886679 - DNA, 12 bp, Homo sapiens
ggctcctgctgc

SEQ ID NO: 1886680 - DNA, 14 bp, Homo sapiens
ggctcctgctgcac

SEQ ID NO: 1886681 - DNA, 21 bp, Homo sapiens
ggctcctgctgcaccaaccca

SEQ ID NO: 1886682 - DNA, 20 bp, Homo sapiens
ggctgagactgcagaggagc

SEQ ID NO: 1886683 - DNA, 17 bp, Homo sapiens
ggctgagagagtggcat

SEQ ID NO: 1886684 - DNA, 17 bp, Homo sapiens
ggctgcagcaggcagag

SEQ ID NO: 1886685 - DNA, 18 bp, Homo sapiens
ggctgcagcaggcagagg

SEQ ID NO: 1886686 - DNA, 17 bp, Homo sapiens
ggctgcccgctcccagt

SEQ ID NO: 1886687 - DNA, 12 bp, Homo sapiens
ggctgcctccac

SEQ ID NO: 1886688 - DNA, 17 bp, Homo sapiens
ggctgcctccactccca

SEQ ID NO: 1886689 - DNA, 13 bp, Homo sapiens
ggctgctggaggg

SEQ ID NO: 1886690 - DNA, 12 bp, Homo sapiens
ggctggctgggg

SEQ ID NO: 1886691 - DNA, 13 bp, Homo sapiens
ggctggctggggc

SEQ ID NO: 1886692 - DNA, 21 bp, Homo sapiens
ggctggggcctatcagtgtgc

SEQ ID NO: 1886693 - DNA, 16 bp, Homo sapiens
ttattttagcttcagt

SEQ ID NO: 1886694 - DNA, 13 bp, Homo sapiens
ttattttgtaatt

SEQ ID NO: 1886695 - DNA, 20 bp, Homo sapiens
ttatttttttaagctgtaaa

SEQ ID NO: 1886696 - DNA, 19 bp, Homo sapiens
ttcaatttgtcatgttact

SEQ ID NO: 1886697 - DNA, 16 bp, Homo sapiens
ttcacttgatgtttgt

SEQ ID NO: 1886698 - DNA, 20 bp, Homo sapiens
ttcagataatcacaatacat

SEQ ID NO: 1886699 - DNA, 19 bp, Homo sapiens
ttcagctcttaaaaagaca

SEQ ID NO: 1886700 - DNA, 20 bp, Homo sapiens
ttcagctgtgaacatggact

SEQ ID NO: 1886701 - DNA, 19 bp, Homo sapiens
ttcaggaaaagcctctgtg

SEQ ID NO: 1886702 - DNA, 16 bp, Homo sapiens
ttcagtgctttttcct

SEQ ID NO: 1886703 - DNA, 20 bp, Homo sapiens
ttcatcacttcttccactgt

SEQ ID NO: 1886704 - DNA, 14 bp, Homo sapiens
ttcatctccagtgt

SEQ ID NO: 1886705 - DNA, 14 bp, Homo sapiens
ttcatctgttgttc

SEQ ID NO: 1886706 - DNA, 15 bp, Homo sapiens
ttcatgattttgaaa

SEQ ID NO: 1886707 - DNA, 21 bp, Homo sapiens
ttcatgtaacagttgtgtcat

SEQ ID NO: 1886708 - DNA, 15 bp, Homo sapiens
ttcattgcctttcca

SEQ ID NO: 1886709 - DNA, 19 bp, Homo sapiens
ttcatttgcaattcatgta

SEQ ID NO: 1886710 - DNA, 18 bp, Homo sapiens
ttccagatcctggaaatc

SEQ ID NO: 1886711 - DNA, 22 bp, Homo sapiens
ttccagggtcaaagtacagaat

SEQ ID NO: 1886712 - DNA, 21 bp, Homo sapiens
ttccattgttgtcaaatgccc

SEQ ID NO: 1886713 - DNA, 22 bp, Homo sapiens
ttcccgagcaaagtctaaagtt

SEQ ID NO: 1886714 - DNA, 16 bp, Homo sapiens
ttcccgtggccccagc

SEQ ID NO: 1886715 - DNA, 14 bp, Homo sapiens
ttcctccattttct

SEQ ID NO: 1886716 - DNA, 16 bp, Homo sapiens
ttcctttttgcagtat

SEQ ID NO: 1886717 - DNA, 19 bp, Homo sapiens
ttcgtctgtttataaacat

SEQ ID NO: 1886718 - DNA, 18 bp, Homo sapiens
ttctacaaaatcctgatg

SEQ ID NO: 1886719 - DNA, 21 bp, Homo sapiens
ttctagctgagctttaaatca

SEQ ID NO: 1886720 - DNA, 17 bp, Homo sapiens
ttctagtgatttcctgt

SEQ ID NO: 1886721 - DNA, 14 bp, Homo sapiens
ttctatgaaatatt

SEQ ID NO: 1886722 - DNA, 21 bp, Homo sapiens
ttctatgaaatattatgttaa

SEQ ID NO: 1886723 - DNA, 23 bp, Homo sapiens
ttctcccaattcatcctcactca

SEQ ID NO: 1886724 - DNA, 23 bp, Homo sapiens
ttctctcctctccccatgatgtt

SEQ ID NO: 1886725 - DNA, 12 bp, Homo sapiens
ttctgaagaaga

SEQ ID NO: 1886726 - DNA, 21 bp, Homo sapiens
ttctgagcccccacctgcctg

SEQ ID NO: 1886727 - DNA, 15 bp, Homo sapiens
ttctgccttttttat

SEQ ID NO: 1886728 - DNA, 22 bp, Homo sapiens
ttctgtagaaaagaaaacattt

SEQ ID NO: 1886729 - DNA, 14 bp, Homo sapiens
ttctgtaggagaga

SEQ ID NO: 1886730 - DNA, 21 bp, Homo sapiens
ttctgtaggagagactggcca

SEQ ID NO: 1886731 - DNA, 16 bp, Homo sapiens
ttcttatttcatgaaa

SEQ ID NO: 1886732 - DNA, 14 bp, Homo sapiens
ttcttccactgtgt

SEQ ID NO: 1886733 - DNA, 13 bp, Homo sapiens
ttcttgccctgag

SEQ ID NO: 1886734 - DNA, 14 bp, Homo sapiens
ttcttgccctgagc

SEQ ID NO: 1886735 - DNA, 16 bp, Homo sapiens
ttcttgccctgagctt

SEQ ID NO: 1886736 - DNA, 16 bp, Homo sapiens
ttcttgctgttcagtg

SEQ ID NO: 1886737 - DNA, 20 bp, Homo sapiens
ttcttgctgttcagtgcttt

SEQ ID NO: 1886738 - DNA, 12 bp, Homo sapiens
ttctttttaaag

SEQ ID NO: 1886739 - DNA, 22 bp, Homo sapiens
ttctttttaaagtttgttcact

SEQ ID NO: 1886740 - DNA, 18 bp, Homo sapiens
ttgaactgcaggaagaga

SEQ ID NO: 1886741 - DNA, 16 bp, Homo sapiens
ttgaattttcccactg

SEQ ID NO: 1886742 - DNA, 18 bp, Homo sapiens
ttgacactgttttcctta

SEQ ID NO: 1886743 - DNA, 19 bp, Homo sapiens
ttgacagtatatgtcatgc

SEQ ID NO: 1886744 - DNA, 22 bp, Homo sapiens
ttgactagaaaatttaaaacat

SEQ ID NO: 1886745 - DNA, 13 bp, Homo sapiens
ttgactgcagttg

SEQ ID NO: 1886746 - DNA, 22 bp, Homo sapiens
ttgactgtaggcgcccctgggg

SEQ ID NO: 1886747 - DNA, 12 bp, Homo sapiens
ttgactttttat

SEQ ID NO: 1886748 - DNA, 17 bp, Homo sapiens
ttgaggattttgagtat

SEQ ID NO: 1886749 - DNA, 12 bp, Homo sapiens
ttgatgaagaag

SEQ ID NO: 1886750 - DNA, 22 bp, Homo sapiens
ttgcaagccagattttcctgaa

SEQ ID NO: 1886751 - DNA, 15 bp, Homo sapiens
ttgcaattcatgtaa

SEQ ID NO: 1886752 - DNA, 17 bp, Homo sapiens
ttgcactgaatatataa

SEQ ID NO: 1886753 - DNA, 21 bp, Homo sapiens
ttgcactgaatatataaacac

SEQ ID NO: 1886754 - DNA, 17 bp, Homo sapiens
ttgcagttgtgatataa

SEQ ID NO: 1886755 - DNA, 21 bp, Homo sapiens
ttgccccaacccccagcaccc

SEQ ID NO: 1886756 - DNA, 20 bp, Homo sapiens
ttgccctgagctttccgggg

SEQ ID NO: 1886757 - DNA, 12 bp, Homo sapiens
ttgccctgggcc

SEQ ID NO: 1886758 - DNA, 13 bp, Homo sapiens
ttgccgggcctgg

SEQ ID NO: 1886759 - DNA, 22 bp, Homo sapiens
ttgcctcggctcctgctgcacc

SEQ ID NO: 1886760 - DNA, 12 bp, Homo sapiens
ttgctgttcagt

SEQ ID NO: 1886761 - DNA, 14 bp, Homo sapiens
ttgctgttcagtgc

SEQ ID NO: 1886762 - DNA, 16 bp, Homo sapiens
ttggacagaagcagct

SEQ ID NO: 1886763 - DNA, 15 bp, Homo sapiens
ttggagaagaactga

SEQ ID NO: 1886764 - DNA, 12 bp, Homo sapiens
ttggcagcaggt

SEQ ID NO: 1886765 - DNA, 23 bp, Homo sapiens
ttggctgggggcatgggggaggc

SEQ ID NO: 1886766 - DNA, 17 bp, Homo sapiens
ttggcttaatttaatgt

SEQ ID NO: 1886767 - DNA, 15 bp, Homo sapiens
ttggcttctgtgcct

SEQ ID NO: 1886768 - DNA, 17 bp, Homo sapiens
ttggcttctgtgcctga

SEQ ID NO: 1886769 - DNA, 19 bp, Homo sapiens
ttgggccatactggcctcg

SEQ ID NO: 1886770 - DNA, 20 bp, Homo sapiens
ttggtaaggggaattgagga

SEQ ID NO: 1886771 - DNA, 21 bp, Homo sapiens
ttggtggtgcagccccaggac

SEQ ID NO: 1886772 - DNA, 18 bp, Homo sapiens
ttgtaaaacattcacacc

SEQ ID NO: 1886773 - DNA, 12 bp, Homo sapiens
ttgtaagtttat

SEQ ID NO: 1886774 - DNA, 18 bp, Homo sapiens
ttgtaattattgtgattt

SEQ ID NO: 1886775 - DNA, 11 bp, Homo sapiens
ttgtacagttc

SEQ ID NO: 1886776 - DNA, 13 bp, Homo sapiens
ttgtacgtgggag

SEQ ID NO: 1886777 - DNA, 21 bp, Homo sapiens
ttgtacgtgggagaggcagaa

SEQ ID NO: 1886778 - DNA, 18 bp, Homo sapiens
ttgtattttaaaacataa

SEQ ID NO: 1886779 - DNA, 23 bp, Homo sapiens
ttgtcaaatgcccactctccatc

SEQ ID NO: 1886780 - DNA, 16 bp, Homo sapiens
ttgtctaaaatgtcag

SEQ ID NO: 1886781 - DNA, 12 bp, Homo sapiens
ttgtctccctgg

SEQ ID NO: 1886782 - DNA, 14 bp, Homo sapiens
ttgtctccctggcc

SEQ ID NO: 1886783 - DNA, 16 bp, Homo sapiens
ttgtctccctggccct

SEQ ID NO: 1886784 - DNA, 18 bp, Homo sapiens
ttgtctccctggccctca

SEQ ID NO: 1886785 - DNA, 20 bp, Homo sapiens
ttgtgaaatgtaacatgaag

SEQ ID NO: 1886786 - DNA, 18 bp, Homo sapiens
ttgtgaagcaaaattttt

SEQ ID NO: 1886787 - DNA, 22 bp, Homo sapiens
ttgtgaagtacccgttcacatt

SEQ ID NO: 1886788 - DNA, 17 bp, Homo sapiens
ttgtggggatgatgaaa

SEQ ID NO: 1886789 - DNA, 15 bp, Homo sapiens
ttgtggttagaatct

SEQ ID NO: 1886790 - DNA, 15 bp, Homo sapiens
ttgtgtacagttatt

SEQ ID NO: 1886791 - DNA, 17 bp, Homo sapiens
ttgttagaccagaaagt

SEQ ID NO: 1886792 - DNA, 15 bp, Homo sapiens
ttgttatttgtacag

SEQ ID NO: 1886793 - DNA, 21 bp, Homo sapiens
tgtcactggctgcctccactc

SEQ ID NO: 1886794 - DNA, 16 bp, Homo sapiens
tgtcagatcgttcatt

SEQ ID NO: 1886795 - DNA, 13 bp, Homo sapiens
tgtcatctgggcc

SEQ ID NO: 1886796 - DNA, 14 bp, Homo sapiens
tgtcatctgggcca

SEQ ID NO: 1886797 - DNA, 20 bp, Homo sapiens
tgtcatctgggccaccagct

SEQ ID NO: 1886798 - DNA, 19 bp, Homo sapiens
tgtcatgcctcactttctt

SEQ ID NO: 1886799 - DNA, 21 bp, Homo sapiens
tgtcatgcctcactttcttct

SEQ ID NO: 1886800 - DNA, 19 bp, Homo sapiens
tgtcatgtgaatccctcaa

SEQ ID NO: 1886801 - DNA, 14 bp, Homo sapiens
tgtccagtgcccat

SEQ ID NO: 1886802 - DNA, 16 bp, Homo sapiens
tgtccagtgcccattc

SEQ ID NO: 1886803 - DNA, 17 bp, Homo sapiens
tgtccagtgcccattcc

SEQ ID NO: 1886804 - DNA, 21 bp, Homo sapiens
tgtcccaggggtctccctgag

SEQ ID NO: 1886805 - DNA, 21 bp, Homo sapiens
tgtcccctcttgccccaaccc

SEQ ID NO: 1886806 - DNA, 17 bp, Homo sapiens
tgtccttccctcaaaga

SEQ ID NO: 1886807 - DNA, 22 bp, Homo sapiens
tgtctacactaagagagaatga

SEQ ID NO: 1886808 - DNA, 14 bp, Homo sapiens
tgtctagaggcaac

SEQ ID NO: 1886809 - DNA, 23 bp, Homo sapiens
tgtctagaggcaacagtgttctg

SEQ ID NO: 1886810 - DNA, 14 bp, Homo sapiens
tgtctgacacatta

SEQ ID NO: 1886811 - DNA, 13 bp, Homo sapiens
tgtcttcctgtgg

SEQ ID NO: 1886812 - DNA, 17 bp, Homo sapiens
tgtcttggctgtggggc

SEQ ID NO: 1886813 - DNA, 18 bp, Homo sapiens
tgtgaaatgtaacatgaa

SEQ ID NO: 1886814 - DNA, 14 bp, Homo sapiens
tgtgaacatggact

SEQ ID NO: 1886815 - DNA, 24 bp, Homo sapiens
tgtgatttcccgtggccccagcct

SEQ ID NO: 1886816 - DNA, 16 bp, Homo sapiens
tgtgatttcttctccc

SEQ ID NO: 1886817 - DNA, 14 bp, Homo sapiens
tgtgccaccctggg

SEQ ID NO: 1886818 - DNA, 16 bp, Homo sapiens
tgtgccaccctgggct

SEQ ID NO: 1886819 - DNA, 18 bp, Homo sapiens
tgtgcccatgggcactgc

SEQ ID NO: 1886820 - DNA, 21 bp, Homo sapiens
tgtgcccatgggcactgctgg

SEQ ID NO: 1886821 - DNA, 19 bp, Homo sapiens
tgtgctagtaattggaaag

SEQ ID NO: 1886822 - DNA, 14 bp, Homo sapiens
tgtgctggtaaatg

SEQ ID NO: 1886823 - DNA, 16 bp, Homo sapiens
tgtgggctgcactctg

SEQ ID NO: 1886824 - DNA, 22 bp, Homo sapiens
tgtgggctgcactctgtgccca

SEQ ID NO: 1886825 - DNA, 14 bp, Homo sapiens
tgtggtcacagtga

SEQ ID NO: 1886826 - DNA, 18 bp, Homo sapiens
tgtgtaaagacttgagaa

SEQ ID NO: 1886827 - DNA, 18 bp, Homo sapiens
tgtgtcactggctgcctc

SEQ ID NO: 1886828 - DNA, 19 bp, Homo sapiens
tgtgtcggggggcgaggga

SEQ ID NO: 1886829 - DNA, 20 bp, Homo sapiens
tgtgtcggggggcgagggag

SEQ ID NO: 1886830 - DNA, 22 bp, Homo sapiens
tgtgtcggggggcgagggaggg

SEQ ID NO: 1886831 - DNA, 22 bp, Homo sapiens
tgtgtgaaaggtacttcaaatc

SEQ ID NO: 1886832 - DNA, 14 bp, Homo sapiens
tgtgtgtgttctgt

SEQ ID NO: 1886833 - DNA, 15 bp, Homo sapiens
tgtgtgtgttctgta

SEQ ID NO: 1886834 - DNA, 16 bp, Homo sapiens
tgtgtgttctgtagct

SEQ ID NO: 1886835 - DNA, 14 bp, Homo sapiens
tgtgtgttgacact

SEQ ID NO: 1886836 - DNA, 16 bp, Homo sapiens
tgtgttcctccatttt

SEQ ID NO: 1886837 - DNA, 19 bp, Homo sapiens
tgtgttcctccattttctt

SEQ ID NO: 1886838 - DNA, 13 bp, Homo sapiens
tgtgttttgcaag

SEQ ID NO: 1886839 - DNA, 22 bp, Homo sapiens
tgttactaaatggtgttacatt

SEQ ID NO: 1886840 - DNA, 16 bp, Homo sapiens
tgttaggcctggcaca

SEQ ID NO: 1886841 - DNA, 15 bp, Homo sapiens
tgttataatctttca

SEQ ID NO: 1886842 - DNA, 22 bp, Homo sapiens
tgttatgtcaaactgtcttggc

SEQ ID NO: 1886843 - DNA, 16 bp, Homo sapiens
tgttatttgtacagtt

SEQ ID NO: 1886844 - DNA, 13 bp, Homo sapiens
tgttcacttaaat

SEQ ID NO: 1886845 - DNA, 15 bp, Homo sapiens
tgttcctccattttc

SEQ ID NO: 1886846 - DNA, 12 bp, Homo sapiens
tgttctgagccc

SEQ ID NO: 1886847 - DNA, 16 bp, Homo sapiens
tgttggagaagaactg

SEQ ID NO: 1886848 - DNA, 20 bp, Homo sapiens
tgttggagaagaactgaaat

SEQ ID NO: 1886849 - DNA, 14 bp, Homo sapiens
tgttggctagcctc

SEQ ID NO: 1886850 - DNA, 16 bp, Homo sapiens
tgtttataaacattgt

SEQ ID NO: 1886851 - DNA, 19 bp, Homo sapiens
tgtttgctaagcattccaa

SEQ ID NO: 1886852 - DNA, 15 bp, Homo sapiens
tgtttgtgcaaacat

SEQ ID NO: 1886853 - DNA, 13 bp, Homo sapiens
tgttttataattt

SEQ ID NO: 1886854 - DNA, 23 bp, Homo sapiens
tgttttcccgagcaaagtctaaa

SEQ ID NO: 1886855 - DNA, 17 bp, Homo sapiens
tgttttccttacctatt

SEQ ID NO: 1886856 - DNA, 14 bp, Homo sapiens
tgttttgcaagcca

SEQ ID NO: 1886857 - DNA, 22 bp, Homo sapiens
tgtttttaaaatagaatgatag

SEQ ID NO: 1886858 - DNA, 19 bp, Homo sapiens
ttaaaaaagaaacatttgg

SEQ ID NO: 1886859 - DNA, 17 bp, Homo sapiens
ttaaacctatactcact

SEQ ID NO: 1886860 - DNA, 17 bp, Homo sapiens
ttaaatcattagagctt

SEQ ID NO: 1886861 - DNA, 23 bp, Homo sapiens
ttaaatcattagagcttaaattg

SEQ ID NO: 1886862 - DNA, 15 bp, Homo sapiens
ttaaatccaataaaa

SEQ ID NO: 1886863 - DNA, 22 bp, Homo sapiens
ttaaatgtctgacacattaatg

SEQ ID NO: 1886864 - DNA, 15 bp, Homo sapiens
ttaaattcttttgag

SEQ ID NO: 1886865 - DNA, 11 bp, Homo sapiens
ttaacataatg

SEQ ID NO: 1886866 - DNA, 18 bp, Homo sapiens
ttaacataatggttgtga

SEQ ID NO: 1886867 - DNA, 17 bp, Homo sapiens
ttaacatctttgttttt

SEQ ID NO: 1886868 - DNA, 18 bp, Homo sapiens
ttaacatctttgttttta

SEQ ID NO: 1886869 - DNA, 19 bp, Homo sapiens
ttaacatctttgtttttaa

SEQ ID NO: 1886870 - DNA, 22 bp, Homo sapiens
ttaagaagactgcattatattt

SEQ ID NO: 1886871 - DNA, 17 bp, Homo sapiens
ttaagagcttgatctgt

SEQ ID NO: 1886872 - DNA, 21 bp, Homo sapiens
ttaagagcttgatctgtgatt

SEQ ID NO: 1886873 - DNA, 19 bp, Homo sapiens
ttaagatcttggcttaatt

SEQ ID NO: 1886874 - DNA, 18 bp, Homo sapiens
ttaagctttattgtgatt

SEQ ID NO: 1886875 - DNA, 14 bp, Homo sapiens
ttaaggagaggaga

SEQ ID NO: 1886876 - DNA, 18 bp, Homo sapiens
ttaataatgtttcaaaca

SEQ ID NO: 1886877 - DNA, 15 bp, Homo sapiens
ttaataccacagctt

SEQ ID NO: 1886878 - DNA, 13 bp, Homo sapiens
ttaatgtgtatta

SEQ ID NO: 1886879 - DNA, 15 bp, Homo sapiens
ttaatttaatgtatt

SEQ ID NO: 1886880 - DNA, 15 bp, Homo sapiens
ttacaaataaacagt

SEQ ID NO: 1886881 - DNA, 17 bp, Homo sapiens
ttacagtaaataaattg

SEQ ID NO: 1886882 - DNA, 17 bp, Homo sapiens
ttacatgaattgcattt

SEQ ID NO: 1886883 - DNA, 13 bp, Homo sapiens
ttacattctgaat

SEQ ID NO: 1886884 - DNA, 12 bp, Homo sapiens
ttacctgggaaa

SEQ ID NO: 1886885 - DNA, 16 bp, Homo sapiens
ttacgtgtatgtttct

SEQ ID NO: 1886886 - DNA, 20 bp, Homo sapiens
ttactaaatggtgttacatt

SEQ ID NO: 1886887 - DNA, 16 bp, Homo sapiens
ttactctacactgaaa

SEQ ID NO: 1886888 - DNA, 16 bp, Homo sapiens
tggagaaacaggccca

SEQ ID NO: 1886889 - DNA, 16 bp, Homo sapiens
tggagaagaactgaaa

SEQ ID NO: 1886890 - DNA, 12 bp, Homo sapiens
tggagaggagaa

SEQ ID NO: 1886891 - DNA, 22 bp, Homo sapiens
tggagctgagctacctggggtg

SEQ ID NO: 1886892 - DNA, 21 bp, Homo sapiens
tggaggaggtggcttcatgtg

SEQ ID NO: 1886893 - DNA, 12 bp, Homo sapiens
tggagtgctggc

SEQ ID NO: 1886894 - DNA, 14 bp, Homo sapiens
tggagtgctggctc

SEQ ID NO: 1886895 - DNA, 15 bp, Homo sapiens
tggagtgctggctcc

SEQ ID NO: 1886896 - DNA, 23 bp, Homo sapiens
tggagtgctggctccacgccctg

SEQ ID NO: 1886897 - DNA, 13 bp, Homo sapiens
tggcagggaagct

SEQ ID NO: 1886898 - DNA, 14 bp, Homo sapiens
tggccacggccaca

SEQ ID NO: 1886899 - DNA, 20 bp, Homo sapiens
tggccacggccacggccaca

SEQ ID NO: 1886900 - DNA, 20 bp, Homo sapiens
tggccagccccacagcccac

SEQ ID NO: 1886901 - DNA, 13 bp, Homo sapiens
tggcccagctccc

SEQ ID NO: 1886902 - DNA, 14 bp, Homo sapiens
tggcccagctcccc

SEQ ID NO: 1886903 - DNA, 22 bp, Homo sapiens
tggcccatcagtgtacccccgc

SEQ ID NO: 1886904 - DNA, 20 bp, Homo sapiens
tggcccatcccccctcacca

SEQ ID NO: 1886905 - DNA, 21 bp, Homo sapiens
tggcccatcccccctcaccag

SEQ ID NO: 1886906 - DNA, 12 bp, Homo sapiens
tggccccagcct

SEQ ID NO: 1886907 - DNA, 13 bp, Homo sapiens
tggccccagcctg

SEQ ID NO: 1886908 - DNA, 18 bp, Homo sapiens
tggccccagcctggccca

SEQ ID NO: 1886909 - DNA, 21 bp, Homo sapiens
tggccccagcctggcccagct

SEQ ID NO: 1886910 - DNA, 20 bp, Homo sapiens
tggccgagctgaagaactgg

SEQ ID NO: 1886911 - DNA, 17 bp, Homo sapiens
tggccgggaccccgagc

SEQ ID NO: 1886912 - DNA, 14 bp, Homo sapiens
tggcctcgcctggc

SEQ ID NO: 1886913 - DNA, 16 bp, Homo sapiens
tggcctgttctgtagg

SEQ ID NO: 1886914 - DNA, 18 bp, Homo sapiens
tggcctgttctgtaggag

SEQ ID NO: 1886915 - DNA, 23 bp, Homo sapiens
tggcctgttctgtaggagagact

SEQ ID NO: 1886916 - DNA, 15 bp, Homo sapiens
tggcgcaccctcccc

SEQ ID NO: 1886917 - DNA, 16 bp, Homo sapiens
tggcgcaccctcccct

SEQ ID NO: 1886918 - DNA, 18 bp, Homo sapiens
tggcgcaccctcccctcc

SEQ ID NO: 1886919 - DNA, 15 bp, Homo sapiens
tggcgccccctggtg

SEQ ID NO: 1886920 - DNA, 17 bp, Homo sapiens
tggcgccccctggtggg

SEQ ID NO: 1886921 - DNA, 20 bp, Homo sapiens
tggctgagagagtggcattg

SEQ ID NO: 1886922 - DNA, 14 bp, Homo sapiens
tggctgcctccact

SEQ ID NO: 1886923 - DNA, 16 bp, Homo sapiens
tggctgcctccactcc

SEQ ID NO: 1886924 - DNA, 18 bp, Homo sapiens
tggctgcctccactccca

SEQ ID NO: 1886925 - DNA, 20 bp, Homo sapiens
tggctgcctccactcccact

SEQ ID NO: 1886926 - DNA, 20 bp, Homo sapiens
tggctggggcctatcagtgt

SEQ ID NO: 1886927 - DNA, 21 bp, Homo sapiens
tggctggggcctatcagtgtg

SEQ ID NO: 1886928 - DNA, 22 bp, Homo sapiens
tggctggggcctatcagtgtgc

SEQ ID NO: 1886929 - DNA, 22 bp, Homo sapiens
tggctgggggcatgggggaggc

SEQ ID NO: 1886930 - DNA, 19 bp, Homo sapiens
tggctgtactgccaaggta

SEQ ID NO: 1886931 - DNA, 23 bp, Homo sapiens
tggctgtggggctaggggctggg

SEQ ID NO: 1886932 - DNA, 12 bp, Homo sapiens
tggcttcatgtg

SEQ ID NO: 1886933 - DNA, 15 bp, Homo sapiens
tggcttgctgatggc

SEQ ID NO: 1886934 - DNA, 13 bp, Homo sapiens
tggcttgtagaat

SEQ ID NO: 1886935 - DNA, 13 bp, Homo sapiens
tggctttggaagc

SEQ ID NO: 1886936 - DNA, 15 bp, Homo sapiens
tgggaaggaaatata

SEQ ID NO: 1886937 - DNA, 17 bp, Homo sapiens
tgggaaggaaatatatt

SEQ ID NO: 1886938 - DNA, 21 bp, Homo sapiens
tgggacaacaaagaggacacc

SEQ ID NO: 1886939 - DNA, 22 bp, Homo sapiens
tgggacaacaaagaggacacca

SEQ ID NO: 1886940 - DNA, 14 bp, Homo sapiens
tgggagaaggtgct

SEQ ID NO: 1886941 - DNA, 14 bp, Homo sapiens
tgggagaggcagaa

SEQ ID NO: 1886942 - DNA, 16 bp, Homo sapiens
tgggagaggcagaaag

SEQ ID NO: 1886943 - DNA, 17 bp, Homo sapiens
tgggagaggcagaaagg

SEQ ID NO: 1886944 - DNA, 18 bp, Homo sapiens
tgggcaggtcctggggag

SEQ ID NO: 1886945 - DNA, 19 bp, Homo sapiens
tgggcaggtcctggggagg

SEQ ID NO: 1886946 - DNA, 16 bp, Homo sapiens
tgggccatactggcct

SEQ ID NO: 1886947 - DNA, 17 bp, Homo sapiens
tgggccatactggcctc

SEQ ID NO: 1886948 - DNA, 11 bp, Homo sapiens
tgggccctgca

SEQ ID NO: 1886949 - DNA, 17 bp, Homo sapiens
tgggccctgcaggaggc

SEQ ID NO: 1886950 - DNA, 13 bp, Homo sapiens
tgggcgggcagca

SEQ ID NO: 1886951 - DNA, 17 bp, Homo sapiens
tgggctctgtgggctgc

SEQ ID NO: 1886952 - DNA, 18 bp, Homo sapiens
tgggctgcactctgtgcc

SEQ ID NO: 1886953 - DNA, 19 bp, Homo sapiens
tgggctgcactctgtgccc

SEQ ID NO: 1886954 - DNA, 20 bp, Homo sapiens
tgggctgcactctgtgccca

SEQ ID NO: 1886955 - DNA, 22 bp, Homo sapiens
tgggctgcactctgtgcccatg

SEQ ID NO: 1886956 - DNA, 14 bp, Homo sapiens
tgggctgggagaag

SEQ ID NO: 1886957 - DNA, 23 bp, Homo sapiens
tgggctgggagaaggtgcttggg

SEQ ID NO: 1886958 - DNA, 20 bp, Homo sapiens
tgggctgggtgcgaccccat

SEQ ID NO: 1886959 - DNA, 19 bp, Homo sapiens
tgggctgttggctgggggc

SEQ ID NO: 1886960 - DNA, 20 bp, Homo sapiens
tgggctgttggctgggggca

SEQ ID NO: 1886961 - DNA, 22 bp, Homo sapiens
tgggcttctgcggtgaggcagg

SEQ ID NO: 1886962 - DNA, 23 bp, Homo sapiens
tgggcttctgcggtgaggcaggg

SEQ ID NO: 1886963 - DNA, 20 bp, Homo sapiens
tggggcctatcagtgtgccc

SEQ ID NO: 1886964 - DNA, 17 bp, Homo sapiens
tggggctaggggctggg

SEQ ID NO: 1886965 - DNA, 20 bp, Homo sapiens
tggggctaggggctggggcc

SEQ ID NO: 1886966 - DNA, 21 bp, Homo sapiens
tgggggaagagcacagccctc

SEQ ID NO: 1886967 - DNA, 23 bp, Homo sapiens
tgggggaagagcacagccctccc

SEQ ID NO: 1886968 - DNA, 12 bp, Homo sapiens
tgggggagcctg

SEQ ID NO: 1886969 - DNA, 13 bp, Homo sapiens
tgggggagcctgg

SEQ ID NO: 1886970 - DNA, 14 bp, Homo sapiens
tgggggagcctgga

SEQ ID NO: 1886971 - DNA, 15 bp, Homo sapiens
tgggggagcctggag

SEQ ID NO: 1886972 - DNA, 13 bp, Homo sapiens
tgggggaggctct

SEQ ID NO: 1886973 - DNA, 15 bp, Homo sapiens
tgggggaggctctga

SEQ ID NO: 1886974 - DNA, 22 bp, Homo sapiens
tgggggcatgggggaggctctg

SEQ ID NO: 1886975 - DNA, 16 bp, Homo sapiens
tggggtctcagtccag

SEQ ID NO: 1886976 - DNA, 23 bp, Homo sapiens
tggggtgggtttagcaggctgca

SEQ ID NO: 1886977 - DNA, 17 bp, Homo sapiens
tgggtcccacttcccct

SEQ ID NO: 1886978 - DNA, 20 bp, Homo sapiens
tgggtcccacttcccctcct

SEQ ID NO: 1886979 - DNA, 22 bp, Homo sapiens
tgggtcccacttcccctcctac

SEQ ID NO: 1886980 - DNA, 19 bp, Homo sapiens
tgggtgcgaccccatctgc

SEQ ID NO: 1886981 - DNA, 23 bp, Homo sapiens
tgggtgcgaccccatctgcccag

SEQ ID NO: 1886982 - DNA, 21 bp, Homo sapiens
tgggtggcccatcccccctca

SEQ ID NO: 1886983 - DNA, 13 bp, Homo sapiens
tgggtgtgccctg

SEQ ID NO: 1886984 - DNA, 14 bp, Homo sapiens
tgggtgtgccctgg

SEQ ID NO: 1886985 - DNA, 22 bp, Homo sapiens
tgggttggcgcaccctcccctc

SEQ ID NO: 1886986 - DNA, 20 bp, Homo sapiens
tgggttggcttgctgatggc

SEQ ID NO: 1886987 - DNA, 23 bp, Homo sapiens
tgggtttagcaggctgcagcagg

SEQ ID NO: 1886988 - DNA, 20 bp, Homo sapiens
tggtaaggggaattgaggac

SEQ ID NO: 1886989 - DNA, 19 bp, Homo sapiens
tggtaatttgtatctgaag

SEQ ID NO: 1886990 - DNA, 21 bp, Homo sapiens
tggtaatttgtatctgaagga

SEQ ID NO: 1886991 - DNA, 22 bp, Homo sapiens
tggtaatttgtatctgaaggag

SEQ ID NO: 1886992 - DNA, 18 bp, Homo sapiens
tggtaccaggtctcctcc

SEQ ID NO: 1886993 - DNA, 18 bp, Homo sapiens
tggtagctctgagccctc

SEQ ID NO: 1886994 - DNA, 13 bp, Homo sapiens
tggtattgtaaaa

SEQ ID NO: 1886995 - DNA, 16 bp, Homo sapiens
tggtattgtaaaacat

SEQ ID NO: 1886996 - DNA, 21 bp, Homo sapiens
tggtattgtaaaacattcaca

SEQ ID NO: 1886997 - DNA, 13 bp, Homo sapiens
tggtccagagtca

SEQ ID NO: 1886998 - DNA, 18 bp, Homo sapiens
tggtgacatgtgcctgta

SEQ ID NO: 1886999 - DNA, 20 bp, Homo sapiens
tggtgcggtaggtgctggcc

SEQ ID NO: 1887000 - DNA, 22 bp, Homo sapiens
tggtgcggtaggtgctggcctc

SEQ ID NO: 1887001 - DNA, 16 bp, Homo sapiens
tggttacctgttccat

SEQ ID NO: 1887002 - DNA, 16 bp, Homo sapiens
tggttagaatcttgtt

SEQ ID NO: 1887003 - DNA, 17 bp, Homo sapiens
tggttagaatcttgttt

SEQ ID NO: 1887004 - DNA, 20 bp, Homo sapiens
tggttcccttgatgaagaag

SEQ ID NO: 1887005 - DNA, 22 bp, Homo sapiens
tggttcttttttcagttatttt

SEQ ID NO: 1887006 - DNA, 18 bp, Homo sapiens
tggttgtgaaatgtaaca

SEQ ID NO: 1887007 - DNA, 22 bp, Homo sapiens
tgtaaaaagagagaaaacttat

SEQ ID NO: 1887008 - DNA, 15 bp, Homo sapiens
tgatggtggtatgtt

SEQ ID NO: 1887009 - DNA, 20 bp, Homo sapiens
tgattacgtgtatgtttctt

SEQ ID NO: 1887010 - DNA, 22 bp, Homo sapiens
tgattacgtgtatgtttcttct

SEQ ID NO: 1887011 - DNA, 22 bp, Homo sapiens
tgattatgaattacatttgtat

SEQ ID NO: 1887012 - DNA, 22 bp, Homo sapiens
tgattccttgatggagatattt

SEQ ID NO: 1887013 - DNA, 23 bp, Homo sapiens
tgatttcccgtggccccagcctg

SEQ ID NO: 1887014 - DNA, 15 bp, Homo sapiens
tgcaagccagatttt

SEQ ID NO: 1887015 - DNA, 19 bp, Homo sapiens
tgcaattcatgtaacagtt

SEQ ID NO: 1887016 - DNA, 18 bp, Homo sapiens
tgcaccccctcctgctgc

SEQ ID NO: 1887017 - DNA, 19 bp, Homo sapiens
tgcaccccctcctgctgca

SEQ ID NO: 1887018 - DNA, 15 bp, Homo sapiens
tgcactctgtgccca

SEQ ID NO: 1887019 - DNA, 16 bp, Homo sapiens
tgcactctgtgcccat

SEQ ID NO: 1887020 - DNA, 21 bp, Homo sapiens
tgcactctgtgcccatgggca

SEQ ID NO: 1887021 - DNA, 15 bp, Homo sapiens
tgcactgaatatata

SEQ ID NO: 1887022 - DNA, 20 bp, Homo sapiens
tgcactgaatatataaacac

SEQ ID NO: 1887023 - DNA, 15 bp, Homo sapiens
tgcactgtcctgctc

SEQ ID NO: 1887024 - DNA, 23 bp, Homo sapiens
tgcactgtcctgctccacagtgt

SEQ ID NO: 1887025 - DNA, 23 bp, Homo sapiens
tgcagaaggaagggcatccttct

SEQ ID NO: 1887026 - DNA, 19 bp, Homo sapiens
tgcagacgccacagtctcc

SEQ ID NO: 1887027 - DNA, 13 bp, Homo sapiens
tgcagaggggcag

SEQ ID NO: 1887028 - DNA, 12 bp, Homo sapiens
tgcaggaagaga

SEQ ID NO: 1887029 - DNA, 15 bp, Homo sapiens
tgcaggaggcctggg

SEQ ID NO: 1887030 - DNA, 22 bp, Homo sapiens
tgcaggtttctccttgaagcaa

SEQ ID NO: 1887031 - DNA, 17 bp, Homo sapiens
tgcagttctgaagaaga

SEQ ID NO: 1887032 - DNA, 22 bp, Homo sapiens
tgcagttctgaagaagatggta

SEQ ID NO: 1887033 - DNA, 20 bp, Homo sapiens
tgcagttgtgatataaagga

SEQ ID NO: 1887034 - DNA, 20 bp, Homo sapiens
tgcattatatttattactgt

SEQ ID NO: 1887035 - DNA, 21 bp, Homo sapiens
tgcattatatttattactgta

SEQ ID NO: 1887036 - DNA, 15 bp, Homo sapiens
tgcatttccagaaat

SEQ ID NO: 1887037 - DNA, 17 bp, Homo sapiens
tgcatttccagaaatct

SEQ ID NO: 1887038 - DNA, 17 bp, Homo sapiens
tgcattttcttcacagt

SEQ ID NO: 1887039 - DNA, 19 bp, Homo sapiens
tgcattttcttcacagtgc

SEQ ID NO: 1887040 - DNA, 15 bp, Homo sapiens
tgccaactcgggagc

SEQ ID NO: 1887041 - DNA, 16 bp, Homo sapiens
tgccaactcgggagca

SEQ ID NO: 1887042 - DNA, 16 bp, Homo sapiens
tcttatttcatgaaaa

SEQ ID NO: 1887043 - DNA, 13 bp, Homo sapiens
tcttccactgtgt

SEQ ID NO: 1887044 - DNA, 15 bp, Homo sapiens
tcttccactgtgtgt

SEQ ID NO: 1887045 - DNA, 19 bp, Homo sapiens
tcttccaggtggggtgagg

SEQ ID NO: 1887046 - DNA, 13 bp, Homo sapiens
tcttcctgtgggg

SEQ ID NO: 1887047 - DNA, 19 bp, Homo sapiens
tcttctccatcctaccaca

SEQ ID NO: 1887048 - DNA, 15 bp, Homo sapiens
tcttcttttgtgaag

SEQ ID NO: 1887049 - DNA, 20 bp, Homo sapiens
tcttgccccaacccccagca

SEQ ID NO: 1887050 - DNA, 14 bp, Homo sapiens
tcttgctgttcagt

SEQ ID NO: 1887051 - DNA, 23 bp, Homo sapiens
tcttgttttgtttgcttccatta

SEQ ID NO: 1887052 - DNA, 20 bp, Homo sapiens
tctttagaggctttcaaatg

SEQ ID NO: 1887053 - DNA, 19 bp, Homo sapiens
tctttcacttgatgtttgt

SEQ ID NO: 1887054 - DNA, 16 bp, Homo sapiens
tctttcttttaagcag

SEQ ID NO: 1887055 - DNA, 12 bp, Homo sapiens
tcttttaagcag

SEQ ID NO: 1887056 - DNA, 15 bp, Homo sapiens
tcttttactctgtgt

SEQ ID NO: 1887057 - DNA, 20 bp, Homo sapiens
tcttttttcagttattttga

SEQ ID NO: 1887058 - DNA, 20 bp, Homo sapiens
tgaaaatatgtctgcaggtt

SEQ ID NO: 1887059 - DNA, 16 bp, Homo sapiens
tgaaacgtattcagag

SEQ ID NO: 1887060 - DNA, 18 bp, Homo sapiens
tgaacactagtctgtgta

SEQ ID NO: 1887061 - DNA, 17 bp, Homo sapiens
tgaactgcaggaagaga

SEQ ID NO: 1887062 - DNA, 19 bp, Homo sapiens
tgaaggctgtatctatttt

SEQ ID NO: 1887063 - DNA, 23 bp, Homo sapiens
tgaagtacccgttcacatttttg

SEQ ID NO: 1887064 - DNA, 15 bp, Homo sapiens
tgaattacatttgta

SEQ ID NO: 1887065 - DNA, 16 bp, Homo sapiens
tgaattacatttgtat

SEQ ID NO: 1887066 - DNA, 20 bp, Homo sapiens
tgaattttcccactgcaccc

SEQ ID NO: 1887067 - DNA, 12 bp, Homo sapiens
tgacaagctcac

SEQ ID NO: 1887068 - DNA, 15 bp, Homo sapiens
tgacaggggctcagg

SEQ ID NO: 1887069 - DNA, 17 bp, Homo sapiens
tgacaggggctcaggat

SEQ ID NO: 1887070 - DNA, 16 bp, Homo sapiens
tgacagtcctctccac

SEQ ID NO: 1887071 - DNA, 13 bp, Homo sapiens
tgacatgaagcat

SEQ ID NO: 1887072 - DNA, 14 bp, Homo sapiens
tgacatgtgcctgt

SEQ ID NO: 1887073 - DNA, 14 bp, Homo sapiens
tgacattcagaaaa

SEQ ID NO: 1887074 - DNA, 15 bp, Homo sapiens
tgaccagcagcagct

SEQ ID NO: 1887075 - DNA, 15 bp, Homo sapiens
tgaccatcccatgag

SEQ ID NO: 1887076 - DNA, 12 bp, Homo sapiens
tgacccagccct

SEQ ID NO: 1887077 - DNA, 22 bp, Homo sapiens
tgactaataaaaaactgtgaac

SEQ ID NO: 1887078 - DNA, 19 bp, Homo sapiens
tgactcgggctcctgtgcc

SEQ ID NO: 1887079 - DNA, 21 bp, Homo sapiens
tgactgtaggcgcccctgggg

SEQ ID NO: 1887080 - DNA, 21 bp, Homo sapiens
tgacttcaggggctgcccgct

SEQ ID NO: 1887081 - DNA, 19 bp, Homo sapiens
tgacttttccatgtatcta

SEQ ID NO: 1887082 - DNA, 22 bp, Homo sapiens
tgacttttccatgtatctacct

SEQ ID NO: 1887083 - DNA, 19 bp, Homo sapiens
tgagaagtctaattcacag

SEQ ID NO: 1887084 - DNA, 20 bp, Homo sapiens
tgagacggatggaaggagag

SEQ ID NO: 1887085 - DNA, 12 bp, Homo sapiens
tgagcagtccag

SEQ ID NO: 1887086 - DNA, 14 bp, Homo sapiens
tgagcagtccagag

SEQ ID NO: 1887087 - DNA, 18 bp, Homo sapiens
tgagcccccacctgcctg

SEQ ID NO: 1887088 - DNA, 22 bp, Homo sapiens
tgagccctccttcttgccctga

SEQ ID NO: 1887089 - DNA, 18 bp, Homo sapiens
tgagcctgccccagctgg

SEQ ID NO: 1887090 - DNA, 18 bp, Homo sapiens
tgagctggacctcaccaa

SEQ ID NO: 1887091 - DNA, 12 bp, Homo sapiens
tgagctgtgccc

SEQ ID NO: 1887092 - DNA, 18 bp, Homo sapiens
tgagcttctattaaatgt

SEQ ID NO: 1887093 - DNA, 20 bp, Homo sapiens
tgagctttccggggaggagc

SEQ ID NO: 1887094 - DNA, 20 bp, Homo sapiens
tgaggagcagcttcagttgt

SEQ ID NO: 1887095 - DNA, 15 bp, Homo sapiens
tgaggatgcactggc

SEQ ID NO: 1887096 - DNA, 18 bp, Homo sapiens
tgaggatgcactggcctg

SEQ ID NO: 1887097 - DNA, 14 bp, Homo sapiens
tgaggcaggggagt

SEQ ID NO: 1887098 - DNA, 15 bp, Homo sapiens
tgaggcaggggagtc

SEQ ID NO: 1887099 - DNA, 17 bp, Homo sapiens
tgaggcaggggagtctg

SEQ ID NO: 1887100 - DNA, 21 bp, Homo sapiens
tgaggcagtgggtcccacttc

SEQ ID NO: 1887101 - DNA, 23 bp, Homo sapiens
tgaggcagtgggtcccacttccc

SEQ ID NO: 1887102 - DNA, 13 bp, Homo sapiens
tgaggccccaggt

SEQ ID NO: 1887103 - DNA, 18 bp, Homo sapiens
tgaggtctcgctgatgct

SEQ ID NO: 1887104 - DNA, 13 bp, Homo sapiens
tgaggtggtggac

SEQ ID NO: 1887105 - DNA, 14 bp, Homo sapiens
tgagtgattatttg

SEQ ID NO: 1887106 - DNA, 12 bp, Homo sapiens
tgagttgcagtt

SEQ ID NO: 1887107 - DNA, 15 bp, Homo sapiens
tgagttgcagttttt

SEQ ID NO: 1887108 - DNA, 19 bp, Homo sapiens
tgatacaaagtacagaaaa

SEQ ID NO: 1887109 - DNA, 13 bp, Homo sapiens
tgatactgtttct

SEQ ID NO: 1887110 - DNA, 18 bp, Homo sapiens
tgatactgtttcttgcac

SEQ ID NO: 1887111 - DNA, 21 bp, Homo sapiens
tgatagaactttgccagtctt

SEQ ID NO: 1887112 - DNA, 12 bp, Homo sapiens
tgatatgggtct

SEQ ID NO: 1887113 - DNA, 17 bp, Homo sapiens
tgatcagcttattgtct

SEQ ID NO: 1887114 - DNA, 18 bp, Homo sapiens
tgatcggagcctcctctc

SEQ ID NO: 1887115 - DNA, 14 bp, Homo sapiens
tgatctgtgatttc

SEQ ID NO: 1887116 - DNA, 18 bp, Homo sapiens
tgatctgtgatttcttct

SEQ ID NO: 1887117 - DNA, 20 bp, Homo sapiens
tgatgatttagagtgctgtc

SEQ ID NO: 1887118 - DNA, 22 bp, Homo sapiens
tgatgccacaccaagctgtgcc

SEQ ID NO: 1887119 - DNA, 15 bp, Homo sapiens
tgatgctgggctggg

SEQ ID NO: 1887120 - DNA, 18 bp, Homo sapiens
tgatgctgggctgggtgc

SEQ ID NO: 1887121 - DNA, 14 bp, Homo sapiens
tgatggagaggaga

SEQ ID NO: 1887122 - DNA, 16 bp, Homo sapiens
tgatggagaggagaac

SEQ ID NO: 1887123 - DNA, 20 bp, Homo sapiens
tccctggccccctccctgga

SEQ ID NO: 1887124 - DNA, 22 bp, Homo sapiens
tccctgtttcttccacagtgcc

SEQ ID NO: 1887125 - DNA, 21 bp, Homo sapiens
tccgacttgaattttcccact

SEQ ID NO: 1887126 - DNA, 22 bp, Homo sapiens
tccgacttgaattttcccactg

SEQ ID NO: 1887127 - DNA, 20 bp, Homo sapiens
tccgttcccacctctgagga

SEQ ID NO: 1887128 - DNA, 16 bp, Homo sapiens
tcctaattttgagaaa

SEQ ID NO: 1887129 - DNA, 12 bp, Homo sapiens
tcctacccctcc

SEQ ID NO: 1887130 - DNA, 16 bp, Homo sapiens
tcctacccctcccagc

SEQ ID NO: 1887131 - DNA, 18 bp, Homo sapiens
tcctacccctcccagctg

SEQ ID NO: 1887132 - DNA, 15 bp, Homo sapiens
tcctagaggacctga

SEQ ID NO: 1887133 - DNA, 15 bp, Homo sapiens
tcctaggtgacccca

SEQ ID NO: 1887134 - DNA, 19 bp, Homo sapiens
tcctaggtgaccccatctc

SEQ ID NO: 1887135 - DNA, 19 bp, Homo sapiens
tcctcaacccctcccctcc

SEQ ID NO: 1887136 - DNA, 22 bp, Homo sapiens
tcctcaacccctcccctccatc

SEQ ID NO: 1887137 - DNA, 24 bp, Homo sapiens
tcctcacttttcaatttgtcatgt

SEQ ID NO: 1887138 - DNA, 13 bp, Homo sapiens
tcctccattttct

SEQ ID NO: 1887139 - DNA, 17 bp, Homo sapiens
tcctctctccaggcccc

SEQ ID NO: 1887140 - DNA, 17 bp, Homo sapiens
tcctctttgcatggaat

SEQ ID NO: 1887141 - DNA, 23 bp, Homo sapiens
tcctgactcggtcaaaatatttt

SEQ ID NO: 1887142 - DNA, 21 bp, Homo sapiens
tcctgacttcaggggctgccc

SEQ ID NO: 1887143 - DNA, 13 bp, Homo sapiens
tcctgctccacag

SEQ ID NO: 1887144 - DNA, 18 bp, Homo sapiens
tcctgctccacagtgttg

SEQ ID NO: 1887145 - DNA, 13 bp, Homo sapiens
tcctgctgcacca

SEQ ID NO: 1887146 - DNA, 19 bp, Homo sapiens
tcctgctgcaccaacccag

SEQ ID NO: 1887147 - DNA, 16 bp, Homo sapiens
tcctgctgcagagggg

SEQ ID NO: 1887148 - DNA, 18 bp, Homo sapiens
tcctgctgcagaggggca

SEQ ID NO: 1887149 - DNA, 21 bp, Homo sapiens
tcctgctgcagaggggcaggc

SEQ ID NO: 1887150 - DNA, 18 bp, Homo sapiens
tcctggcccatcagtgta

SEQ ID NO: 1887151 - DNA, 21 bp, Homo sapiens
tcctggggaggctgagactgc

SEQ ID NO: 1887152 - DNA, 13 bp, Homo sapiens
tcctggtagaata

SEQ ID NO: 1887153 - DNA, 22 bp, Homo sapiens
tcctgttcaaatttttttttaa

SEQ ID NO: 1887154 - DNA, 17 bp, Homo sapiens
tccttatcgaaactcat

SEQ ID NO: 1887155 - DNA, 22 bp, Homo sapiens
tccttcctacacccttggactt

SEQ ID NO: 1887156 - DNA, 12 bp, Homo sapiens
tccttctgcctt

SEQ ID NO: 1887157 - DNA, 15 bp, Homo sapiens
tccttcttgccctga

SEQ ID NO: 1887158 - DNA, 12 bp, Homo sapiens
tccttgccctgg

SEQ ID NO: 1887159 - DNA, 14 bp, Homo sapiens
tccttgccctgggc

SEQ ID NO: 1887160 - DNA, 15 bp, Homo sapiens
tccttgccctgggcc

SEQ ID NO: 1887161 - DNA, 13 bp, Homo sapiens
tcctttctggctt

SEQ ID NO: 1887162 - DNA, 17 bp, Homo sapiens
tccttttcatctgttgt

SEQ ID NO: 1887163 - DNA, 20 bp, Homo sapiens
tcgaatttttattatttgtt

SEQ ID NO: 1887164 - DNA, 16 bp, Homo sapiens
tcgcccaccgcatgcc

SEQ ID NO: 1887165 - DNA, 22 bp, Homo sapiens
tcgctcctcaacccctcccctc

SEQ ID NO: 1887166 - DNA, 17 bp, Homo sapiens
tcgctgatgctgggctg

SEQ ID NO: 1887167 - DNA, 20 bp, Homo sapiens
tcgctgatgctgggctgggt

SEQ ID NO: 1887168 - DNA, 13 bp, Homo sapiens
tcggctcctgctg

SEQ ID NO: 1887169 - DNA, 16 bp, Homo sapiens
tcggctcctgctgcac

SEQ ID NO: 1887170 - DNA, 17 bp, Homo sapiens
tcggctcctgctgcacc

SEQ ID NO: 1887171 - DNA, 17 bp, Homo sapiens
tcgggcccaggccatct

SEQ ID NO: 1887172 - DNA, 16 bp, Homo sapiens
tcgggctcctgtgccc

SEQ ID NO: 1887173 - DNA, 20 bp, Homo sapiens
tcggggggcgagggagggga

SEQ ID NO: 1887174 - DNA, 18 bp, Homo sapiens
tcgtctgtttataaacat

SEQ ID NO: 1887175 - DNA, 19 bp, Homo sapiens
tcgtgccagtcgcgctgcc

SEQ ID NO: 1887176 - DNA, 23 bp, Homo sapiens
tcgtgccagtcgcgctgcctgtg

SEQ ID NO: 1887177 - DNA, 13 bp, Homo sapiens
tcgttaatttgta

SEQ ID NO: 1887178 - DNA, 19 bp, Homo sapiens
tcgttcattgcctttccag

SEQ ID NO: 1887179 - DNA, 14 bp, Homo sapiens
tctacttttaaaga

SEQ ID NO: 1887180 - DNA, 23 bp, Homo sapiens
tctagcagtaaatacttgcagtt

SEQ ID NO: 1887181 - DNA, 19 bp, Homo sapiens
tctagtgagcagtcaggaa

SEQ ID NO: 1887182 - DNA, 13 bp, Homo sapiens
tctatgaaatatt

SEQ ID NO: 1887183 - DNA, 17 bp, Homo sapiens
tctatgtgcttgtaaaa

SEQ ID NO: 1887184 - DNA, 16 bp, Homo sapiens
tctcactagctgtctc

SEQ ID NO: 1887185 - DNA, 15 bp, Homo sapiens
tctccacctagtggc

SEQ ID NO: 1887186 - DNA, 20 bp, Homo sapiens
tctcccccccggggctgggt

SEQ ID NO: 1887187 - DNA, 14 bp, Homo sapiens
tctccctgagcctg

SEQ ID NO: 1887188 - DNA, 21 bp, Homo sapiens
tctccctgagcctgccccagc

SEQ ID NO: 1887189 - DNA, 13 bp, Homo sapiens
tctccctggccct

SEQ ID NO: 1887190 - DNA, 13 bp, Homo sapiens
tctccttgaagca

SEQ ID NO: 1887191 - DNA, 19 bp, Homo sapiens
tctccttgaagcaaatgtg

SEQ ID NO: 1887192 - DNA, 20 bp, Homo sapiens
tctccttgaagcaaatgtgt

SEQ ID NO: 1887193 - DNA, 15 bp, Homo sapiens
tctccttgccctggg

SEQ ID NO: 1887194 - DNA, 16 bp, Homo sapiens
tctccttgccctgggc

SEQ ID NO: 1887195 - DNA, 13 bp, Homo sapiens
tctctccagtgca

SEQ ID NO: 1887196 - DNA, 14 bp, Homo sapiens
tctctgctgcttct

SEQ ID NO: 1887197 - DNA, 19 bp, Homo sapiens
tctctgctgcttctgggcc

SEQ ID NO: 1887198 - DNA, 12 bp, Homo sapiens
tctgaagaagat

SEQ ID NO: 1887199 - DNA, 16 bp, Homo sapiens
gtgtccgggggtctag

SEQ ID NO: 1887200 - DNA, 16 bp, Homo sapiens
gtgtctgagagattca

SEQ ID NO: 1887201 - DNA, 15 bp, Homo sapiens
gtgtctgatgtttgt

SEQ ID NO: 1887202 - DNA, 13 bp, Homo sapiens
gtgtctgggctga

SEQ ID NO: 1887203 - DNA, 16 bp, Homo sapiens
gtgtgccccccatcct

SEQ ID NO: 1887204 - DNA, 19 bp, Homo sapiens
gtgtgccccccatcctggc

SEQ ID NO: 1887205 - DNA, 20 bp, Homo sapiens
gtgtgccccccatcctggcc

SEQ ID NO: 1887206 - DNA, 23 bp, Homo sapiens
gtgtgccccccatcctggcccat

SEQ ID NO: 1887207 - DNA, 11 bp, Homo sapiens
gtgtgccctgg

SEQ ID NO: 1887208 - DNA, 14 bp, Homo sapiens
gtgtgccctggctc

SEQ ID NO: 1887209 - DNA, 11 bp, Homo sapiens
aaaaatgttag

SEQ ID NO: 1887210 - DNA, 14 bp, Homo sapiens
aaaacaaggatgaa

SEQ ID NO: 1887211 - DNA, 14 bp, Homo sapiens
aaaacatttaacat

SEQ ID NO: 1887212 - DNA, 15 bp, Homo sapiens
aaaacatttaacata

SEQ ID NO: 1887213 - DNA, 23 bp, Homo sapiens
aaaacttcaagacatcaccatca

SEQ ID NO: 1887214 - DNA, 13 bp, Homo sapiens
aaaagaaaacatt

SEQ ID NO: 1887215 - DNA, 22 bp, Homo sapiens
aaaagaaaacatttaacataat

SEQ ID NO: 1887216 - DNA, 11 bp, Homo sapiens
aaaagaatgat

SEQ ID NO: 1887217 - DNA, 16 bp, Homo sapiens
aaaaggttttattttg

SEQ ID NO: 1887218 - DNA, 23 bp, Homo sapiens
aaaaggttttattttgtaattat

SEQ ID NO: 1887219 - DNA, 11 bp, Homo sapiens
aaaataatttt

SEQ ID NO: 1887220 - DNA, 16 bp, Homo sapiens
aaaattcagagtcctt

SEQ ID NO: 1887221 - DNA, 19 bp, Homo sapiens
aaaattttttctctaggaa

SEQ ID NO: 1887222 - DNA, 21 bp, Homo sapiens
aaacactctcactatgctgct

SEQ ID NO: 1887223 - DNA, 22 bp, Homo sapiens
aaacataataccaccatttaaa

SEQ ID NO: 1887224 - DNA, 21 bp, Homo sapiens
aaacatatataacaatgctgt

SEQ ID NO: 1887225 - DNA, 12 bp, Homo sapiens
aaacattctatc

SEQ ID NO: 1887226 - DNA, 23 bp, Homo sapiens
aaacatttaacataatggttgtg

SEQ ID NO: 1887227 - DNA, 15 bp, Homo sapiens
aaacattttgaagtg

SEQ ID NO: 1887228 - DNA, 18 bp, Homo sapiens
aaacctctaatttatttt

SEQ ID NO: 1887229 - DNA, 19 bp, Homo sapiens
aaacctctaatttattttg

SEQ ID NO: 1887230 - DNA, 20 bp, Homo sapiens
aaacctctaatttattttgt

SEQ ID NO: 1887231 - DNA, 17 bp, Homo sapiens
aaactgactcttaagaa

SEQ ID NO: 1887232 - DNA, 10 bp, Homo sapiens
aaacttattt

SEQ ID NO: 1887233 - DNA, 16 bp, Homo sapiens
aaagaatgattatgaa

SEQ ID NO: 1887234 - DNA, 13 bp, Homo sapiens
aaagacttgagaa

SEQ ID NO: 1887235 - DNA, 18 bp, Homo sapiens
aaagagaacttccagatc

SEQ ID NO: 1887236 - DNA, 13 bp, Homo sapiens
aaagagagaaaac

SEQ ID NO: 1887237 - DNA, 22 bp, Homo sapiens
aaagagagaaaacttatttgag

SEQ ID NO: 1887238 - DNA, 22 bp, Homo sapiens
aaagatagtatcttttaaaatg

SEQ ID NO: 1887239 - DNA, 17 bp, Homo sapiens
aaagcagtcctgttcaa

SEQ ID NO: 1887240 - DNA, 19 bp, Homo sapiens
aaaggaccctgtttctgta

SEQ ID NO: 1887241 - DNA, 14 bp, Homo sapiens
aaaggtacttcaaa

SEQ ID NO: 1887242 - DNA, 18 bp, Homo sapiens
aaaggttttattttgtaa

SEQ ID NO: 1887243 - DNA, 19 bp, Homo sapiens
aaagtacagaaaaatactt

SEQ ID NO: 1887244 - DNA, 17 bp, Homo sapiens
aaagtatgttagtgcaa

SEQ ID NO: 1887245 - DNA, 18 bp, Homo sapiens
aaagtcaatgttttcagt

SEQ ID NO: 1887246 - DNA, 12 bp, Homo sapiens
aaagtctaaagt

SEQ ID NO: 1887247 - DNA, 22 bp, Homo sapiens
aaagtctaaagtttacagtaaa

SEQ ID NO: 1887248 - DNA, 12 bp, Homo sapiens
actgaagaagca

SEQ ID NO: 1887249 - DNA, 13 bp, Homo sapiens
actgaatatataa

SEQ ID NO: 1887250 - DNA, 13 bp, Homo sapiens
actgacacacacg

SEQ ID NO: 1887251 - DNA, 20 bp, Homo sapiens
actgcaccccctcctgctgc

SEQ ID NO: 1887252 - DNA, 19 bp, Homo sapiens
actgccttctcaactccaa

SEQ ID NO: 1887253 - DNA, 20 bp, Homo sapiens
actgccttctcaactccaaa

SEQ ID NO: 1887254 - DNA, 12 bp, Homo sapiens
actgctgggtgg

SEQ ID NO: 1887255 - DNA, 13 bp, Homo sapiens
actgctgggtggc

SEQ ID NO: 1887256 - DNA, 16 bp, Homo sapiens
actgctgggtggccca

SEQ ID NO: 1887257 - DNA, 19 bp, Homo sapiens
actgctgggtggcccatcc

SEQ ID NO: 1887258 - DNA, 19 bp, Homo sapiens
actggaggcaggactcctg

SEQ ID NO: 1887259 - DNA, 17 bp, Homo sapiens
actggccagaggcagct

SEQ ID NO: 1887260 - DNA, 19 bp, Homo sapiens
actggcctcgcctggcctg

SEQ ID NO: 1887261 - DNA, 21 bp, Homo sapiens
actggcctgttctgtaggaga

SEQ ID NO: 1887262 - DNA, 12 bp, Homo sapiens
actggctgcctc

SEQ ID NO: 1887263 - DNA, 19 bp, Homo sapiens
actggctgcctccactccc

SEQ ID NO: 1887264 - DNA, 20 bp, Homo sapiens
actgggtatgaggctggggc

SEQ ID NO: 1887265 - DNA, 19 bp, Homo sapiens
actgtaggcgcccctgggg

SEQ ID NO: 1887266 - DNA, 10 bp, Homo sapiens
actgtcctgc

SEQ ID NO: 1887267 - DNA, 13 bp, Homo sapiens
actgtgggtagac

SEQ ID NO: 1887268 - DNA, 18 bp, Homo sapiens
actgtgggtagacacaca

SEQ ID NO: 1887269 - DNA, 14 bp, Homo sapiens
actgtgtgttgaca

SEQ ID NO: 1887270 - DNA, 18 bp, Homo sapiens
actgtgtgttgacactgt

SEQ ID NO: 1887271 - DNA, 22 bp, Homo sapiens
acttagaataaaattgtaaaat

SEQ ID NO: 1887272 - DNA, 16 bp, Homo sapiens
acttattatcttcagg

SEQ ID NO: 1887273 - DNA, 17 bp, Homo sapiens
acttcaaatccttgaag

SEQ ID NO: 1887274 - DNA, 15 bp, Homo sapiens
acttcagcctgtgca

SEQ ID NO: 1887275 - DNA, 19 bp, Homo sapiens
acttcaggggctgcccgct

SEQ ID NO: 1887276 - DNA, 12 bp, Homo sapiens
acttcccctcct

SEQ ID NO: 1887277 - DNA, 16 bp, Homo sapiens
acttcccctcctaccc

SEQ ID NO: 1887278 - DNA, 21 bp, Homo sapiens
acttcccctcctacccctccc

SEQ ID NO: 1887279 - DNA, 18 bp, Homo sapiens
acttgaattttcccactg

SEQ ID NO: 1887280 - DNA, 18 bp, Homo sapiens
acttgaggattttgagta

SEQ ID NO: 1887281 - DNA, 19 bp, Homo sapiens
acttgagggtaataaactt

SEQ ID NO: 1887282 - DNA, 14 bp, Homo sapiens
acttgatgtttgtt

SEQ ID NO: 1887283 - DNA, 15 bp, Homo sapiens
acttgcagttgtgat

SEQ ID NO: 1887284 - DNA, 15 bp, Homo sapiens
acttgtcaataaaat

SEQ ID NO: 1887285 - DNA, 15 bp, Homo sapiens
acttgtgttctatta

SEQ ID NO: 1887286 - DNA, 23 bp, Homo sapiens
actttagggatctggggaaggac

SEQ ID NO: 1887287 - DNA, 18 bp, Homo sapiens
actttcccaaatgtattg

SEQ ID NO: 1887288 - DNA, 21 bp, Homo sapiens
actttcttctagctgagcttt

SEQ ID NO: 1887289 - DNA, 19 bp, Homo sapiens
acttttttttttttaacat

SEQ ID NO: 1887290 - DNA, 19 bp, Homo sapiens
agaaaacatttaacataat

SEQ ID NO: 1887291 - DNA, 18 bp, Homo sapiens
agaaaagaaaacatttaa

SEQ ID NO: 1887292 - DNA, 17 bp, Homo sapiens
agaaaataatcattctt

SEQ ID NO: 1887293 - DNA, 16 bp, Homo sapiens
agaaacaggcccagag

SEQ ID NO: 1887294 - DNA, 22 bp, Homo sapiens
agaaagtcttatttattcatat

SEQ ID NO: 1887295 - DNA, 12 bp, Homo sapiens
agaaagttgatt

SEQ ID NO: 1887296 - DNA, 21 bp, Homo sapiens
agaactgcccatttccatggt

SEQ ID NO: 1887297 - DNA, 21 bp, Homo sapiens
agaagaactgaaatcatactt

SEQ ID NO: 1887298 - DNA, 18 bp, Homo sapiens
agaagatggtaccaccag

SEQ ID NO: 1887299 - DNA, 19 bp, Homo sapiens
agaagcaccaatcatgaat

SEQ ID NO: 1887300 - DNA, 14 bp, Homo sapiens
agaagctccaggta

SEQ ID NO: 1887301 - DNA, 13 bp, Homo sapiens
agaaggaagggca

SEQ ID NO: 1887302 - DNA, 16 bp, Homo sapiens
agaaggtgcttgggct

SEQ ID NO: 1887303 - DNA, 21 bp, Homo sapiens
agaaggtgcttgggcttctgc

SEQ ID NO: 1887304 - DNA, 13 bp, Homo sapiens
agaagttgatatg

SEQ ID NO: 1887305 - DNA, 12 bp, Homo sapiens
agaataaaattg

SEQ ID NO: 1887306 - DNA, 13 bp, Homo sapiens
agaataaaattgt

SEQ ID NO: 1887307 - DNA, 16 bp, Homo sapiens
agaatagaatacattg

SEQ ID NO: 1887308 - DNA, 22 bp, Homo sapiens
agaatgagagacacactgaaga

SEQ ID NO: 1887309 - DNA, 19 bp, Homo sapiens
agaatgatagaactttgcc

SEQ ID NO: 1887310 - DNA, 17 bp, Homo sapiens
agaattgactgcagttg

SEQ ID NO: 1887311 - DNA, 19 bp, Homo sapiens
agaattgactgcagttgaa

SEQ ID NO: 1887312 - DNA, 21 bp, Homo sapiens
agaattgactgcagttgaaca

SEQ ID NO: 1887313 - DNA, 17 bp, Homo sapiens
agacacactgaagaagc

SEQ ID NO: 1887314 - DNA, 15 bp, Homo sapiens
agaccagaaagtgtg

SEQ ID NO: 1887315 - DNA, 16 bp, Homo sapiens
agacggatggaaggag

SEQ ID NO: 1887316 - DNA, 20 bp, Homo sapiens
agacggatggaaggagagag

SEQ ID NO: 1887317 - DNA, 18 bp, Homo sapiens
agactatttaacttgagg

SEQ ID NO: 1887318 - DNA, 21 bp, Homo sapiens
agactctttttgtacctggtg

SEQ ID NO: 1887319 - DNA, 23 bp, Homo sapiens
agactctttttgtacctggtgac

SEQ ID NO: 1887320 - DNA, 15 bp, Homo sapiens
agactggccagaggc

SEQ ID NO: 1887321 - DNA, 15 bp, Homo sapiens
agagaatgagagaca

SEQ ID NO: 1887322 - DNA, 17 bp, Homo sapiens
agagacacactgaagaa

SEQ ID NO: 1887323 - DNA, 18 bp, Homo sapiens
agagacacactgaagaag

SEQ ID NO: 1887324 - DNA, 12 bp, Homo sapiens
agagactggcca

SEQ ID NO: 1887325 - DNA, 19 bp, Homo sapiens
agagactggccagaggcag

SEQ ID NO: 1887326 - DNA, 20 bp, Homo sapiens
agagactggccagaggcagc

SEQ ID NO: 1887327 - DNA, 14 bp, Homo sapiens
agagaggttgagga

SEQ ID NO: 1887328 - DNA, 19 bp, Homo sapiens
agagatgaacatctgggga

SEQ ID NO: 1887329 - DNA, 16 bp, Homo sapiens
agagcacagccctccc

SEQ ID NO: 1887330 - DNA, 15 bp, Homo sapiens
agagcacctggtggg

SEQ ID NO: 1887331 - DNA, 13 bp, Homo sapiens
agagcagcttctg

SEQ ID NO: 1887332 - DNA, 23 bp, Homo sapiens
agagcagcttctgccacttccca

SEQ ID NO: 1887333 - DNA, 14 bp, Homo sapiens
agagcatctgctct

SEQ ID NO: 1887334 - DNA, 23 bp, Homo sapiens
agagctgcagagagcacctggtg

SEQ ID NO: 1887335 - DNA, 15 bp, Homo sapiens
agaggaccaggactt

SEQ ID NO: 1887336 - DNA, 16 bp, Homo sapiens
agaggacccatcctgc

SEQ ID NO: 1887337 - DNA, 17 bp, Homo sapiens
agaggagagcatctgct

SEQ ID NO: 1887338 - DNA, 21 bp, Homo sapiens
agaggagagtacccccctgag

SEQ ID NO: 1887339 - DNA, 22 bp, Homo sapiens
agaggagagtacccccctgaga

SEQ ID NO: 1887340 - DNA, 22 bp, Homo sapiens
agaggcaacagtgttctgagcc

SEQ ID NO: 1887341 - DNA, 21 bp, Homo sapiens
agaggcagctaaggggcagga

SEQ ID NO: 1887342 - DNA, 14 bp, Homo sapiens
agaggctttcaaat

SEQ ID NO: 1887343 - DNA, 18 bp, Homo sapiens
agaggctttcaaatgtac

SEQ ID NO: 1887344 - DNA, 14 bp, Homo sapiens
agaggttgtctgtg

SEQ ID NO: 1887345 - DNA, 17 bp, Homo sapiens
agagtacccccctgaga

SEQ ID NO: 1887346 - DNA, 22 bp, Homo sapiens
agagtacccccctgagagcatg

SEQ ID NO: 1887347 - DNA, 19 bp, Homo sapiens
agagtgagactcgtctcaa

SEQ ID NO: 1887348 - DNA, 19 bp, Homo sapiens
agataatgtgatattatac

SEQ ID NO: 1887349 - DNA, 17 bp, Homo sapiens
agatatgggacattttt

SEQ ID NO: 1887350 - DNA, 21 bp, Homo sapiens
agatattattttagcttcagt

SEQ ID NO: 1887351 - DNA, 22 bp, Homo sapiens
agatattattttagcttcagtt

SEQ ID NO: 1887352 - DNA, 12 bp, Homo sapiens
agatatttttca

SEQ ID NO: 1887353 - DNA, 19 bp, Homo sapiens
agatatttttcatgatttt

SEQ ID NO: 1887354 - DNA, 13 bp, Homo sapiens
agatcctggaaat

SEQ ID NO: 1887355 - DNA, 15 bp, Homo sapiens
agatcgttcattgcc

SEQ ID NO: 1887356 - DNA, 17 bp, Homo sapiens
agatgaaggctgtatct

SEQ ID NO: 1887357 - DNA, 15 bp, Homo sapiens
agatgagttgcagtt

SEQ ID NO: 1887358 - DNA, 16 bp, Homo sapiens
agatgcagttctgaag

SEQ ID NO: 1887359 - DNA, 20 bp, Homo sapiens
agatgcagttctgaagaaga

SEQ ID NO: 1887360 - DNA, 13 bp, Homo sapiens
agatgtcttcatc

SEQ ID NO: 1887361 - DNA, 23 bp, Homo sapiens
agatgtgttcctccattttctta

SEQ ID NO: 1887362 - DNA, 13 bp, Homo sapiens
agattttccttcc

SEQ ID NO: 1887363 - DNA, 14 bp, Homo sapiens
agcaaagtctaaag

SEQ ID NO: 1887364 - DNA, 22 bp, Homo sapiens
agcaaagtctaaagtttacagt

SEQ ID NO: 1887365 - DNA, 23 bp, Homo sapiens
agcaaagtctaaagtttacagta

SEQ ID NO: 1887366 - DNA, 23 bp, Homo sapiens
ataaacactccacagtgtttata

SEQ ID NO: 1887367 - DNA, 13 bp, Homo sapiens
ataaacagttgtt

SEQ ID NO: 1887368 - DNA, 13 bp, Homo sapiens
ataaacattgtat

SEQ ID NO: 1887369 - DNA, 20 bp, Homo sapiens
ataaacctctaatttatttt

SEQ ID NO: 1887370 - DNA, 15 bp, Homo sapiens
ataaacttagaataa

SEQ ID NO: 1887371 - DNA, 19 bp, Homo sapiens
ataaaggaccctgtttctg

SEQ ID NO: 1887372 - DNA, 20 bp, Homo sapiens
ataaaggaccctgtttctgt

SEQ ID NO: 1887373 - DNA, 13 bp, Homo sapiens
ataaattacacaa

SEQ ID NO: 1887374 - DNA, 17 bp, Homo sapiens
ataacaatgctgtattt

SEQ ID NO: 1887375 - DNA, 21 bp, Homo sapiens
ataacaatgctgtattttaaa

SEQ ID NO: 1887376 - DNA, 21 bp, Homo sapiens
ataactaacaaccaaagacta

SEQ ID NO: 1887377 - DNA, 16 bp, Homo sapiens
ataagaaaaaattctt

SEQ ID NO: 1887378 - DNA, 17 bp, Homo sapiens
ataagacggatttattt

SEQ ID NO: 1887379 - DNA, 16 bp, Homo sapiens
ataagatatttttcat

SEQ ID NO: 1887380 - DNA, 18 bp, Homo sapiens
ataagatatttttcatga

SEQ ID NO: 1887381 - DNA, 12 bp, Homo sapiens
ataagtttattt

SEQ ID NO: 1887382 - DNA, 21 bp, Homo sapiens
ataataccaccatttaaaaat

SEQ ID NO: 1887383 - DNA, 21 bp, Homo sapiens
ataatagattttttttaaagt

SEQ ID NO: 1887384 - DNA, 19 bp, Homo sapiens
ataatatattttaaatatt

SEQ ID NO: 1887385 - DNA, 14 bp, Homo sapiens
ataatctttcacag

SEQ ID NO: 1887386 - DNA, 14 bp, Homo sapiens
ataatggttgtgaa

SEQ ID NO: 1887387 - DNA, 13 bp, Homo sapiens
ataatttaacagt

SEQ ID NO: 1887388 - DNA, 16 bp, Homo sapiens
ataatttttatatttg

SEQ ID NO: 1887389 - DNA, 15 bp, Homo sapiens
atacaaagtacagaa

SEQ ID NO: 1887390 - DNA, 22 bp, Homo sapiens
ataccaccatttaaaaatgtta

SEQ ID NO: 1887391 - DNA, 18 bp, Homo sapiens
ataccagagtctggagct

SEQ ID NO: 1887392 - DNA, 12 bp, Homo sapiens
atacctttccag

SEQ ID NO: 1887393 - DNA, 22 bp, Homo sapiens
atactggcctcgcctggcctga

SEQ ID NO: 1887394 - DNA, 13 bp, Homo sapiens
atactgtttcttg

SEQ ID NO: 1887395 - DNA, 20 bp, Homo sapiens
atactgtttcttgcactgaa

SEQ ID NO: 1887396 - DNA, 21 bp, Homo sapiens
atactgtttcttgcactgaat

SEQ ID NO: 1887397 - DNA, 19 bp, Homo sapiens
atagaactttgccagtctt

SEQ ID NO: 1887398 - DNA, 22 bp, Homo sapiens
atagaactttgccagtctttaa

SEQ ID NO: 1887399 - DNA, 15 bp, Homo sapiens
atagaatacattgat

SEQ ID NO: 1887400 - DNA, 15 bp, Homo sapiens
atagacccatctgga

SEQ ID NO: 1887401 - DNA, 14 bp, Homo sapiens
atagatgtcttcat

SEQ ID NO: 1887402 - DNA, 16 bp, Homo sapiens
atagatgtcttcatca

SEQ ID NO: 1887403 - DNA, 13 bp, Homo sapiens
atagtgtaataat

SEQ ID NO: 1887404 - DNA, 13 bp, Homo sapiens
atagttgtaacta

SEQ ID NO: 1887405 - DNA, 17 bp, Homo sapiens
atataacaatgctgtat

SEQ ID NO: 1887406 - DNA, 19 bp, Homo sapiens
atatactcactttctagat

SEQ ID NO: 1887407 - DNA, 22 bp, Homo sapiens
atatataaacactccacagtgt

SEQ ID NO: 1887408 - DNA, 17 bp, Homo sapiens
atatataacaatgctgt

SEQ ID NO: 1887409 - DNA, 12 bp, Homo sapiens
atatattgctgc

SEQ ID NO: 1887410 - DNA, 20 bp, Homo sapiens
atatgctctgatttatctga

SEQ ID NO: 1887411 - DNA, 23 bp, Homo sapiens
atatgcttctgttttataatttt

SEQ ID NO: 1887412 - DNA, 16 bp, Homo sapiens
atatggcagggaagct

SEQ ID NO: 1887413 - DNA, 17 bp, Homo sapiens
atatgggacatttttga

SEQ ID NO: 1887414 - DNA, 17 bp, Homo sapiens
atatgtctgcaggtttc

SEQ ID NO: 1887415 - DNA, 14 bp, Homo sapiens
atattaatattcct

SEQ ID NO: 1887416 - DNA, 19 bp, Homo sapiens
atattattttagcttcagt

SEQ ID NO: 1887417 - DNA, 14 bp, Homo sapiens
atattgtttgctaa

SEQ ID NO: 1887418 - DNA, 13 bp, Homo sapiens
atatttattttaa

SEQ ID NO: 1887419 - DNA, 17 bp, Homo sapiens
atatttattttaataat

SEQ ID NO: 1887420 - DNA, 18 bp, Homo sapiens
atatttattttaataatg

SEQ ID NO: 1887421 - DNA, 13 bp, Homo sapiens
atatttgaaatat

SEQ ID NO: 1887422 - DNA, 23 bp, Homo sapiens
atatttgaaatattgacttttta

SEQ ID NO: 1887423 - DNA, 23 bp, Homo sapiens
atatttgctggagtgctggctcc

SEQ ID NO: 1887424 - DNA, 13 bp, Homo sapiens
atcaaggagcctc

SEQ ID NO: 1887425 - DNA, 13 bp, Homo sapiens
atcaccacagttt

SEQ ID NO: 1887426 - DNA, 22 bp, Homo sapiens
atcacttgtcaataaaatccat

SEQ ID NO: 1887427 - DNA, 21 bp, Homo sapiens
atcagatgtgttcctccattt

SEQ ID NO: 1887428 - DNA, 22 bp, Homo sapiens
atcagatgtgttcctccatttt

SEQ ID NO: 1887429 - DNA, 13 bp, Homo sapiens
atcagtgtgcccc

SEQ ID NO: 1887430 - DNA, 17 bp, Homo sapiens
atcatagacccatctgg

SEQ ID NO: 1887431 - DNA, 21 bp, Homo sapiens
atcatgaattagttttatatg

SEQ ID NO: 1887432 - DNA, 19 bp, Homo sapiens
atcattcttatttcatgaa

SEQ ID NO: 1887433 - DNA, 20 bp, Homo sapiens
atcattcttatttcatgaaa

SEQ ID NO: 1887434 - DNA, 12 bp, Homo sapiens
atcattgcattt

SEQ ID NO: 1887435 - DNA, 15 bp, Homo sapiens
atccatttcttttac

SEQ ID NO: 1887436 - DNA, 14 bp, Homo sapiens
atccccagctttct

SEQ ID NO: 1887437 - DNA, 11 bp, Homo sapiens
atccctggccc

SEQ ID NO: 1887438 - DNA, 19 bp, Homo sapiens
atccgttcccttctgccac

SEQ ID NO: 1887439 - DNA, 21 bp, Homo sapiens
atccgttcccttctgccacct

SEQ ID NO: 1887440 - DNA, 17 bp, Homo sapiens
atcctgattaaatgtct

SEQ ID NO: 1887441 - DNA, 12 bp, Homo sapiens
atcctggcccat

SEQ ID NO: 1887442 - DNA, 13 bp, Homo sapiens
atcctggcccatc

SEQ ID NO: 1887443 - DNA, 11 bp, Homo sapiens
atccttctgcc

SEQ ID NO: 1887444 - DNA, 20 bp, Homo sapiens
atcgatttttaaaaattaaa

SEQ ID NO: 1887445 - DNA, 15 bp, Homo sapiens
atcggagcctcctct

SEQ ID NO: 1887446 - DNA, 16 bp, Homo sapiens
atcggagcctcctctc

SEQ ID NO: 1887447 - DNA, 20 bp, Homo sapiens
atctatttttttttcttttt

SEQ ID NO: 1887448 - DNA, 16 bp, Homo sapiens
atctctgctgcttctg

SEQ ID NO: 1887449 - DNA, 18 bp, Homo sapiens
atctctgctgcttctggg

SEQ ID NO: 1887450 - DNA, 15 bp, Homo sapiens
atctgaaggagattt

SEQ ID NO: 1887451 - DNA, 23 bp, Homo sapiens
atctggggaaggaccaacccatg

SEQ ID NO: 1887452 - DNA, 14 bp, Homo sapiens
atctgtgatttctt

SEQ ID NO: 1887453 - DNA, 17 bp, Homo sapiens
atctgtgatttcttctc

SEQ ID NO: 1887454 - DNA, 15 bp, Homo sapiens
atcttaagagcttga

SEQ ID NO: 1887455 - DNA, 20 bp, Homo sapiens
atcttaagagcttgatctgt

SEQ ID NO: 1887456 - DNA, 16 bp, Homo sapiens
atcttaattattgtac

SEQ ID NO: 1887457 - DNA, 18 bp, Homo sapiens
atcttccaggtggggtga

SEQ ID NO: 1887458 - DNA, 14 bp, Homo sapiens
atcttgtccccaac

SEQ ID NO: 1887459 - DNA, 22 bp, Homo sapiens
atcttgttttgtttgcttccat

SEQ ID NO: 1887460 - DNA, 23 bp, Homo sapiens
atctttggacagaagcagctctt

SEQ ID NO: 1887461 - DNA, 17 bp, Homo sapiens
atgaaatattatgttaa

SEQ ID NO: 1887462 - DNA, 20 bp, Homo sapiens
atgaaatattatgttaaaac

SEQ ID NO: 1887463 - DNA, 15 bp, Homo sapiens
atgaattacatttgt

SEQ ID NO: 1887464 - DNA, 16 bp, Homo sapiens
atgaattacatttgta

SEQ ID NO: 1887465 - DNA, 17 bp, Homo sapiens
atgaattacatttgtat

SEQ ID NO: 1887466 - DNA, 19 bp, Homo sapiens
atgaattacatttgtataa

SEQ ID NO: 1887467 - DNA, 21 bp, Homo sapiens
atgacacccctggcctgactc

SEQ ID NO: 1887468 - DNA, 18 bp, Homo sapiens
atgacatcaccacagttt

SEQ ID NO: 1887469 - DNA, 22 bp, Homo sapiens
atgacattaaagaagggttgag

SEQ ID NO: 1887470 - DNA, 20 bp, Homo sapiens
atgacttttccatgtatcta

SEQ ID NO: 1887471 - DNA, 17 bp, Homo sapiens
atgagagacacactgaa

SEQ ID NO: 1887472 - DNA, 23 bp, Homo sapiens
atgagagacacactgaagaagca

SEQ ID NO: 1887473 - DNA, 16 bp, Homo sapiens
atgagatattaaacca

SEQ ID NO: 1887474 - DNA, 22 bp, Homo sapiens
atgaggctggggcggggctgga

SEQ ID NO: 1887475 - DNA, 13 bp, Homo sapiens
atgagggctgagt

SEQ ID NO: 1887476 - DNA, 21 bp, Homo sapiens
atgagtgtcaactccaggact

SEQ ID NO: 1887477 - DNA, 12 bp, Homo sapiens
atgagttgcagt

SEQ ID NO: 1887478 - DNA, 14 bp, Homo sapiens
atgagttgcagttt

SEQ ID NO: 1887479 - DNA, 12 bp, Homo sapiens
atgatgccacac

SEQ ID NO: 1887480 - DNA, 22 bp, Homo sapiens
atgattccttgatggagatatt

SEQ ID NO: 1887481 - DNA, 13 bp, Homo sapiens
atgcagaaggaag

SEQ ID NO: 1887482 - DNA, 17 bp, Homo sapiens
atgcatacactctcaaa

SEQ ID NO: 1887483 - DNA, 17 bp, Homo sapiens
atgcattttcttcacag

SEQ ID NO: 1887484 - DNA, 21 bp, Homo sapiens
atgccacaccaagctgtgcca

SEQ ID NO: 1887485 - DNA, 18 bp, Homo sapiens
caggtcctggggaggctg

SEQ ID NO: 1887486 - DNA, 20 bp, Homo sapiens
caggtgctagggtgcctgct

SEQ ID NO: 1887487 - DNA, 13 bp, Homo sapiens
caggtgctgctac

SEQ ID NO: 1887488 - DNA, 19 bp, Homo sapiens
caggtgctgctaccctccc

SEQ ID NO: 1887489 - DNA, 21 bp, Homo sapiens
caggtgctgctaccctccctg

SEQ ID NO: 1887490 - DNA, 22 bp, Homo sapiens
caggtgctgctaccctccctgc

SEQ ID NO: 1887491 - DNA, 17 bp, Homo sapiens
caggtggggtgaggcag

SEQ ID NO: 1887492 - DNA, 21 bp, Homo sapiens
caggtttatattgggaagctg

SEQ ID NO: 1887493 - DNA, 16 bp, Homo sapiens
cagtcacctcatggaa

SEQ ID NO: 1887494 - DNA, 18 bp, Homo sapiens
cagtcaggaaagagaact

SEQ ID NO: 1887495 - DNA, 22 bp, Homo sapiens
cagtcaggaaagagaacttcca

SEQ ID NO: 1887496 - DNA, 20 bp, Homo sapiens
cagtcatttgtggttagaat

SEQ ID NO: 1887497 - DNA, 16 bp, Homo sapiens
cagtccgttgctgaaa

SEQ ID NO: 1887498 - DNA, 18 bp, Homo sapiens
cagtcctcacatgcccgc

SEQ ID NO: 1887499 - DNA, 13 bp, Homo sapiens
cagtcctctccac

SEQ ID NO: 1887500 - DNA, 14 bp, Homo sapiens
cagtcctgttcaaa

SEQ ID NO: 1887501 - DNA, 15 bp, Homo sapiens
cagtcgcgctgcctg

SEQ ID NO: 1887502 - DNA, 17 bp, Homo sapiens
cagtcgcgctgcctgtg

SEQ ID NO: 1887503 - DNA, 13 bp, Homo sapiens
cagtctttaagat

SEQ ID NO: 1887504 - DNA, 20 bp, Homo sapiens
cagtgaattgtgtaggagag

SEQ ID NO: 1887505 - DNA, 23 bp, Homo sapiens
cagtgactcgggctcctgtgccc

SEQ ID NO: 1887506 - DNA, 17 bp, Homo sapiens
cagtgcacctgtcatat

SEQ ID NO: 1887507 - DNA, 17 bp, Homo sapiens
cagtgccgccgcctcgc

SEQ ID NO: 1887508 - DNA, 22 bp, Homo sapiens
cagtgccgccgcctcgcccacc

SEQ ID NO: 1887509 - DNA, 20 bp, Homo sapiens
cagtgctttttccttttcat

SEQ ID NO: 1887510 - DNA, 15 bp, Homo sapiens
cagtggggtctcagt

SEQ ID NO: 1887511 - DNA, 20 bp, Homo sapiens
cagtgggtcccacttcccct

SEQ ID NO: 1887512 - DNA, 16 bp, Homo sapiens
cagtgtacccccgccc

SEQ ID NO: 1887513 - DNA, 15 bp, Homo sapiens
cagtgtctgggctga

SEQ ID NO: 1887514 - DNA, 15 bp, Homo sapiens
cagtgtgccccccat

SEQ ID NO: 1887515 - DNA, 19 bp, Homo sapiens
cagtgtgccccccatcctg

SEQ ID NO: 1887516 - DNA, 18 bp, Homo sapiens
cagtgttaggcctggcac

SEQ ID NO: 1887517 - DNA, 19 bp, Homo sapiens
cagtgttaggcctggcaca

SEQ ID NO: 1887518 - DNA, 20 bp, Homo sapiens
cagtgttaggcctggcacag

SEQ ID NO: 1887519 - DNA, 23 bp, Homo sapiens
cagtgttaggcctggcacagtgt

SEQ ID NO: 1887520 - DNA, 13 bp, Homo sapiens
cagtgttctgagc

SEQ ID NO: 1887521 - DNA, 15 bp, Homo sapiens
cagtgttctgagccc

SEQ ID NO: 1887522 - DNA, 22 bp, Homo sapiens
cagtgttctgagcccccacctg

SEQ ID NO: 1887523 - DNA, 18 bp, Homo sapiens
cagtgttgactgtaggcg

SEQ ID NO: 1887524 - DNA, 21 bp, Homo sapiens
cagttacctctgcctcagaaa

SEQ ID NO: 1887525 - DNA, 14 bp, Homo sapiens
cagttctgaagaag

SEQ ID NO: 1887526 - DNA, 18 bp, Homo sapiens
cagttggcttctgtgcct

SEQ ID NO: 1887527 - DNA, 14 bp, Homo sapiens
cagttgttttcccg

SEQ ID NO: 1887528 - DNA, 18 bp, Homo sapiens
cagtttttataatagatt

SEQ ID NO: 1887529 - DNA, 17 bp, Homo sapiens
cataatggttgtgaaat

SEQ ID NO: 1887530 - DNA, 18 bp, Homo sapiens
cataatggttgtgaaatg

SEQ ID NO: 1887531 - DNA, 21 bp, Homo sapiens
cataatggttgtgaaatgtaa

SEQ ID NO: 1887532 - DNA, 13 bp, Homo sapiens
cataatgttaagc

SEQ ID NO: 1887533 - DNA, 11 bp, Homo sapiens
cataccaggtg

SEQ ID NO: 1887534 - DNA, 23 bp, Homo sapiens
cataccaggtgctagggtgcctg

SEQ ID NO: 1887535 - DNA, 14 bp, Homo sapiens
catacctttccagg

SEQ ID NO: 1887536 - DNA, 16 bp, Homo sapiens
catacctttccagggt

SEQ ID NO: 1887537 - DNA, 13 bp, Homo sapiens
catactggcctcg

SEQ ID NO: 1887538 - DNA, 15 bp, Homo sapiens
catactggcctcgcc

SEQ ID NO: 1887539 - DNA, 20 bp, Homo sapiens
catatataacaatgctgtat

SEQ ID NO: 1887540 - DNA, 13 bp, Homo sapiens
catcaccacagtt

SEQ ID NO: 1887541 - DNA, 19 bp, Homo sapiens
catcacttcttccactgtg

SEQ ID NO: 1887542 - DNA, 21 bp, Homo sapiens
catcagtgtacccccgcccag

SEQ ID NO: 1887543 - DNA, 15 bp, Homo sapiens
catccagtggggtct

SEQ ID NO: 1887544 - DNA, 18 bp, Homo sapiens
catcccttacctgggaaa

SEQ ID NO: 1887545 - DNA, 13 bp, Homo sapiens
catcctggcccat

SEQ ID NO: 1887546 - DNA, 19 bp, Homo sapiens
catcctggcccatcagtgt

SEQ ID NO: 1887547 - DNA, 19 bp, Homo sapiens
catctagcagtaaatactt

SEQ ID NO: 1887548 - DNA, 13 bp, Homo sapiens
catctctgctgct

SEQ ID NO: 1887549 - DNA, 21 bp, Homo sapiens
catctctgctgcttctgggcc

SEQ ID NO: 1887550 - DNA, 14 bp, Homo sapiens
catctgcccaggac

SEQ ID NO: 1887551 - DNA, 22 bp, Homo sapiens
catctgcccaggacggggccgg

SEQ ID NO: 1887552 - DNA, 22 bp, Homo sapiens
catctgggccaccagctccact

SEQ ID NO: 1887553 - DNA, 16 bp, Homo sapiens
catctgttgttctgtg

SEQ ID NO: 1887554 - DNA, 14 bp, Homo sapiens
catcttccaggtgg

SEQ ID NO: 1887555 - DNA, 19 bp, Homo sapiens
catcttgcccgctcaggct

SEQ ID NO: 1887556 - DNA, 19 bp, Homo sapiens
catctttgtttttaaaata

SEQ ID NO: 1887557 - DNA, 18 bp, Homo sapiens
catgaagagatttttcat

SEQ ID NO: 1887558 - DNA, 17 bp, Homo sapiens
catgaagatatttttcc

SEQ ID NO: 1887559 - DNA, 16 bp, Homo sapiens
catgaagcatgagtta

SEQ ID NO: 1887560 - DNA, 21 bp, Homo sapiens
catgacttttccatgtatcta

SEQ ID NO: 1887561 - DNA, 14 bp, Homo sapiens
catgatgtttagaa

SEQ ID NO: 1887562 - DNA, 15 bp, Homo sapiens
catgcaagtagctgg

SEQ ID NO: 1887563 - DNA, 17 bp, Homo sapiens
catgccaactcgggagc

SEQ ID NO: 1887564 - DNA, 17 bp, Homo sapiens
catgcccgctgtcccag

SEQ ID NO: 1887565 - DNA, 23 bp, Homo sapiens
catgccctgccaagcctggagcc

SEQ ID NO: 1887566 - DNA, 18 bp, Homo sapiens
catgcctcactttcttct

SEQ ID NO: 1887567 - DNA, 14 bp, Homo sapiens
catgctaattatat

SEQ ID NO: 1887568 - DNA, 15 bp, Homo sapiens
catgctggttacctg

SEQ ID NO: 1887569 - DNA, 23 bp, Homo sapiens
catgctggttacctgttccattg

SEQ ID NO: 1887570 - DNA, 22 bp, Homo sapiens
catggccacttgggtcttccct

SEQ ID NO: 1887571 - DNA, 14 bp, Homo sapiens
catgggcactgctg

SEQ ID NO: 1887572 - DNA, 16 bp, Homo sapiens
catgggcactgctggg

SEQ ID NO: 1887573 - DNA, 17 bp, Homo sapiens
catgggcactgctgggt

SEQ ID NO: 1887574 - DNA, 18 bp, Homo sapiens
catgggcactgctgggtg

SEQ ID NO: 1887575 - DNA, 23 bp, Homo sapiens
catgggcactgctgggtggccca

SEQ ID NO: 1887576 - DNA, 17 bp, Homo sapiens
catgggggaggctctga

SEQ ID NO: 1887577 - DNA, 20 bp, Homo sapiens
catgggggaggctctgaaga

SEQ ID NO: 1887578 - DNA, 22 bp, Homo sapiens
catgtgggggaaggccttgctg

SEQ ID NO: 1887579 - DNA, 23 bp, Homo sapiens
catgttactaaatggtgttacat

SEQ ID NO: 1887580 - DNA, 23 bp, Homo sapiens
cattaatgaatgaccagcagcag

SEQ ID NO: 1887581 - DNA, 22 bp, Homo sapiens
cattagagcttaaattgtcaga

SEQ ID NO: 1887582 - DNA, 19 bp, Homo sapiens
cattatatttattactgta

SEQ ID NO: 1887583 - DNA, 12 bp, Homo sapiens
cattattgagtt

SEQ ID NO: 1887584 - DNA, 16 bp, Homo sapiens
cattctgcctgcctgg

SEQ ID NO: 1887585 - DNA, 15 bp, Homo sapiens
cattgcctttccagg

SEQ ID NO: 1887586 - DNA, 24 bp, Homo sapiens
cattggcagcaggtgctgctaccc

SEQ ID NO: 1887587 - DNA, 22 bp, Homo sapiens
cattgtatagttggaatcatat

SEQ ID NO: 1887588 - DNA, 14 bp, Homo sapiens
cattgtctcagagc

SEQ ID NO: 1887589 - DNA, 13 bp, Homo sapiens
catttaacataat

SEQ ID NO: 1887590 - DNA, 14 bp, Homo sapiens
catttaactggagc

SEQ ID NO: 1887591 - DNA, 21 bp, Homo sapiens
catttcttttactctgtgtaa

SEQ ID NO: 1887592 - DNA, 20 bp, Homo sapiens
catttgacaggggctcagga

SEQ ID NO: 1887593 - DNA, 14 bp, Homo sapiens
catttgtataaaat

SEQ ID NO: 1887594 - DNA, 17 bp, Homo sapiens
cattttcttcacagtgc

SEQ ID NO: 1887595 - DNA, 12 bp, Homo sapiens
cattttgaagtg

SEQ ID NO: 1887596 - DNA, 19 bp, Homo sapiens
catttttccagagctgcag

SEQ ID NO: 1887597 - DNA, 20 bp, Homo sapiens
ccaaaatcataagatatttt

SEQ ID NO: 1887598 - DNA, 18 bp, Homo sapiens
ccaaagggggccctggct

SEQ ID NO: 1887599 - DNA, 20 bp, Homo sapiens
ccaacagtgttaggcctggc

SEQ ID NO: 1887600 - DNA, 21 bp, Homo sapiens
ccaacagtgttaggcctggca

SEQ ID NO: 1887601 - DNA, 12 bp, Homo sapiens
ccaacccagccg

SEQ ID NO: 1887602 - DNA, 15 bp, Homo sapiens
ccaacccatgccctg

SEQ ID NO: 1887603 - DNA, 16 bp, Homo sapiens
ctaacaaccaaagact

SEQ ID NO: 1887604 - DNA, 22 bp, Homo sapiens
ctaatgacatcaccacagttta

SEQ ID NO: 1887605 - DNA, 16 bp, Homo sapiens
ctaattatataatatt

SEQ ID NO: 1887606 - DNA, 16 bp, Homo sapiens
ctacacccttggactt

SEQ ID NO: 1887607 - DNA, 15 bp, Homo sapiens
ctacacctctgggcc

SEQ ID NO: 1887608 - DNA, 19 bp, Homo sapiens
ctacacctctgggccctgc

SEQ ID NO: 1887609 - DNA, 20 bp, Homo sapiens
ctacacctctgggccctgca

SEQ ID NO: 1887610 - DNA, 20 bp, Homo sapiens
ctacaggcctcacacacaat

SEQ ID NO: 1887611 - DNA, 16 bp, Homo sapiens
ctacccaaccagggcc

SEQ ID NO: 1887612 - DNA, 11 bp, Homo sapiens
ctacccctccc

SEQ ID NO: 1887613 - DNA, 13 bp, Homo sapiens
ctaccctccctgc

SEQ ID NO: 1887614 - DNA, 15 bp, Homo sapiens
ctaccctccctgctg

SEQ ID NO: 1887615 - DNA, 23 bp, Homo sapiens
ctaccctccctgctgtcccctct

SEQ ID NO: 1887616 - DNA, 21 bp, Homo sapiens
ctacggagggaccaggtgtct

SEQ ID NO: 1887617 - DNA, 16 bp, Homo sapiens
ctactcattccccggg

SEQ ID NO: 1887618 - DNA, 16 bp, Homo sapiens
ctagaggaagcagcca

SEQ ID NO: 1887619 - DNA, 21 bp, Homo sapiens
ctagaggcaacagtgttctga

SEQ ID NO: 1887620 - DNA, 19 bp, Homo sapiens
ctagagtttagctggaaaa

SEQ ID NO: 1887621 - DNA, 16 bp, Homo sapiens
ctagctgtctcaggag

SEQ ID NO: 1887622 - DNA, 14 bp, Homo sapiens
ctaggaaatattta

SEQ ID NO: 1887623 - DNA, 19 bp, Homo sapiens
ctaggaaatatttatttta

SEQ ID NO: 1887624 - DNA, 20 bp, Homo sapiens
ctaggagttaactaccctac

SEQ ID NO: 1887625 - DNA, 13 bp, Homo sapiens
ctaggggctgggg

SEQ ID NO: 1887626 - DNA, 18 bp, Homo sapiens
ctagtatctggctgggtt

SEQ ID NO: 1887627 - DNA, 20 bp, Homo sapiens
ctagtatttctatgaaatat

SEQ ID NO: 1887628 - DNA, 23 bp, Homo sapiens
ctagtctgtgtaactttaaacat

SEQ ID NO: 1887629 - DNA, 20 bp, Homo sapiens
ctagtgaaactcgttaattt

SEQ ID NO: 1887630 - DNA, 21 bp, Homo sapiens
ctagtgagcagtcaggaaaga

SEQ ID NO: 1887631 - DNA, 20 bp, Homo sapiens
ctagtggctgtccagtgccc

SEQ ID NO: 1887632 - DNA, 23 bp, Homo sapiens
ctagttgatcagcttattgtcta

SEQ ID NO: 1887633 - DNA, 21 bp, Homo sapiens
ctatagtccagctttgttctt

SEQ ID NO: 1887634 - DNA, 17 bp, Homo sapiens
ctatagttattgtttta

SEQ ID NO: 1887635 - DNA, 12 bp, Homo sapiens
ctatcagtgtgc

SEQ ID NO: 1887636 - DNA, 17 bp, Homo sapiens
ctatgcattttcttcac

SEQ ID NO: 1887637 - DNA, 18 bp, Homo sapiens
ctatgcattttcttcaca

SEQ ID NO: 1887638 - DNA, 19 bp, Homo sapiens
ctatgcattttcttcacag

SEQ ID NO: 1887639 - DNA, 19 bp, Homo sapiens
ctatgctgctatggacgac

SEQ ID NO: 1887640 - DNA, 23 bp, Homo sapiens
ctatttttttttctttttaaagt

SEQ ID NO: 1887641 - DNA, 19 bp, Homo sapiens
ctcaacccctcccctccat

SEQ ID NO: 1887642 - DNA, 21 bp, Homo sapiens
ctcaacccctcccctccatcc

SEQ ID NO: 1887643 - DNA, 18 bp, Homo sapiens
ctcaacgttgctccccat

SEQ ID NO: 1887644 - DNA, 16 bp, Homo sapiens
ctcaaggcctcccaca

SEQ ID NO: 1887645 - DNA, 18 bp, Homo sapiens
ctcaaggcctcccacagt

SEQ ID NO: 1887646 - DNA, 15 bp, Homo sapiens
ctcacatgcccgctg

SEQ ID NO: 1887647 - DNA, 22 bp, Homo sapiens
ctcacatgcccgctgtcccagg

SEQ ID NO: 1887648 - DNA, 13 bp, Homo sapiens
ctcaccaggggca

SEQ ID NO: 1887649 - DNA, 23 bp, Homo sapiens
ctcaccaggggcaggcacagcac

SEQ ID NO: 1887650 - DNA, 16 bp, Homo sapiens
ctcaccttttcccggg

SEQ ID NO: 1887651 - DNA, 18 bp, Homo sapiens
ctcactagctgtctcagg

SEQ ID NO: 1887652 - DNA, 15 bp, Homo sapiens
ctcactatgctgcta

SEQ ID NO: 1887653 - DNA, 22 bp, Homo sapiens
ctcagactctttttgtacctgg

SEQ ID NO: 1887654 - DNA, 17 bp, Homo sapiens
ctcagggaccacagcaa

SEQ ID NO: 1887655 - DNA, 18 bp, Homo sapiens
ctcagggaccacagcaag

SEQ ID NO: 1887656 - DNA, 19 bp, Homo sapiens
ctcagtgttgactgtaggc

SEQ ID NO: 1887657 - DNA, 20 bp, Homo sapiens
ctcagttcatccattctatt

SEQ ID NO: 1887658 - DNA, 14 bp, Homo sapiens
ctcattccccgggg

SEQ ID NO: 1887659 - DNA, 17 bp, Homo sapiens
ctcatttccaagcaagt

SEQ ID NO: 1887660 - DNA, 15 bp, Homo sapiens
ctccaaaccctcgag

SEQ ID NO: 1887661 - DNA, 23 bp, Homo sapiens
ctccaatccgttcccttctgcca

SEQ ID NO: 1887662 - DNA, 22 bp, Homo sapiens
ctccacctagtggctgtccagt

SEQ ID NO: 1887663 - DNA, 13 bp, Homo sapiens
ctccactcccact

SEQ ID NO: 1887664 - DNA, 20 bp, Homo sapiens
ctccaggacttgcttccaag

SEQ ID NO: 1887665 - DNA, 16 bp, Homo sapiens
ctccaggccccaggtc

SEQ ID NO: 1887666 - DNA, 22 bp, Homo sapiens
ctccagttgaacactagtctgt

SEQ ID NO: 1887667 - DNA, 11 bp, Homo sapiens
ctccatccctg

SEQ ID NO: 1887668 - DNA, 12 bp, Homo sapiens
ctccatccctgg

SEQ ID NO: 1887669 - DNA, 16 bp, Homo sapiens
ctccatcctaccacaa

SEQ ID NO: 1887670 - DNA, 14 bp, Homo sapiens
ctcccaagggaggc

SEQ ID NO: 1887671 - DNA, 22 bp, Homo sapiens
ctcccaagggaggcccatgtga

SEQ ID NO: 1887672 - DNA, 22 bp, Homo sapiens
ctcccacagtgactcgggctcc

SEQ ID NO: 1887673 - DNA, 18 bp, Homo sapiens
ctcccacttccctgacac

SEQ ID NO: 1887674 - DNA, 11 bp, Homo sapiens
ctcccagctga

SEQ ID NO: 1887675 - DNA, 18 bp, Homo sapiens
ctcccagctgacagtcct

SEQ ID NO: 1887676 - DNA, 21 bp, Homo sapiens
ctcccagctgacagtcctctc

SEQ ID NO: 1887677 - DNA, 17 bp, Homo sapiens
ctcccagtgtcttcctg

SEQ ID NO: 1887678 - DNA, 19 bp, Homo sapiens
ctcccagtgtcttcctgtg

SEQ ID NO: 1887679 - DNA, 20 bp, Homo sapiens
ctcccagtgtcttcctgtgg

SEQ ID NO: 1887680 - DNA, 22 bp, Homo sapiens
ctcccatgcaagtagctggctg

SEQ ID NO: 1887681 - DNA, 18 bp, Homo sapiens
ctcccccccggggctggg

SEQ ID NO: 1887682 - DNA, 21 bp, Homo sapiens
ctcccccccggggctgggttg

SEQ ID NO: 1887683 - DNA, 22 bp, Homo sapiens
ctcccccgggaggggcccgctt

SEQ ID NO: 1887684 - DNA, 15 bp, Homo sapiens
ctcccctccatccct

SEQ ID NO: 1887685 - DNA, 17 bp, Homo sapiens
ctccctagttccttcat

SEQ ID NO: 1887686 - DNA, 19 bp, Homo sapiens
ctccctgagcctgccccag

SEQ ID NO: 1887687 - DNA, 20 bp, Homo sapiens
ctccctgagcctgccccagc

SEQ ID NO: 1887688 - DNA, 23 bp, Homo sapiens
ctccctgagcctgccccagctgg

SEQ ID NO: 1887689 - DNA, 16 bp, Homo sapiens
ctccctgctgtcccct

SEQ ID NO: 1887690 - DNA, 18 bp, Homo sapiens
ctccctgctgtcccctct

SEQ ID NO: 1887691 - DNA, 12 bp, Homo sapiens
ctccctggatga

SEQ ID NO: 1887692 - DNA, 14 bp, Homo sapiens
ctccctggccctca

SEQ ID NO: 1887693 - DNA, 15 bp, Homo sapiens
ctccgttcccacctc

SEQ ID NO: 1887694 - DNA, 19 bp, Homo sapiens
ctccgttcccacctctgag

SEQ ID NO: 1887695 - DNA, 22 bp, Homo sapiens
ctcctagtactaactcctagga

SEQ ID NO: 1887696 - DNA, 15 bp, Homo sapiens
ctcctcaacccctcc

SEQ ID NO: 1887697 - DNA, 21 bp, Homo sapiens
ctcctcaacccctcccctcca

SEQ ID NO: 1887698 - DNA, 14 bp, Homo sapiens
ctcctgctgcacca

SEQ ID NO: 1887699 - DNA, 19 bp, Homo sapiens
ctcctgctgcaccaaccca

SEQ ID NO: 1887700 - DNA, 11 bp, Homo sapiens
ctcctgtgccc

SEQ ID NO: 1887701 - DNA, 14 bp, Homo sapiens
ctccttcttgccct

SEQ ID NO: 1887702 - DNA, 17 bp, Homo sapiens
ctcgcctggcctgaggt

SEQ ID NO: 1887703 - DNA, 20 bp, Homo sapiens
ctcgcctggcctgaggtctc

SEQ ID NO: 1887704 - DNA, 17 bp, Homo sapiens
ctcgctgatgctgggct

SEQ ID NO: 1887705 - DNA, 18 bp, Homo sapiens
ctcgctgatgctgggctg

SEQ ID NO: 1887706 - DNA, 20 bp, Homo sapiens
ctcgctgatgctgggctggg

SEQ ID NO: 1887707 - DNA, 21 bp, Homo sapiens
ctcgctgatgctgggctgggt

SEQ ID NO: 1887708 - DNA, 22 bp, Homo sapiens
ctcgctgatgctgggctgggtg

SEQ ID NO: 1887709 - DNA, 14 bp, Homo sapiens
ctcggctcctgctg

SEQ ID NO: 1887710 - DNA, 23 bp, Homo sapiens
ctcgggcccaggccatcttccag

SEQ ID NO: 1887711 - DNA, 16 bp, Homo sapiens
ctcgggttaagaaata

SEQ ID NO: 1887712 - DNA, 14 bp, Homo sapiens
ctcgttaatttgta

SEQ ID NO: 1887713 - DNA, 17 bp, Homo sapiens
ctctaggaaatatttat

SEQ ID NO: 1887714 - DNA, 17 bp, Homo sapiens
ctctcaaagcaaataat

SEQ ID NO: 1887715 - DNA, 15 bp, Homo sapiens
ctctcactatgctgc

SEQ ID NO: 1887716 - DNA, 20 bp, Homo sapiens
ctctccacctagtggctgtc

SEQ ID NO: 1887717 - DNA, 19 bp, Homo sapiens
ctctccttgccctgggcca

SEQ ID NO: 1887718 - DNA, 15 bp, Homo sapiens
ctctgcataccctca

SEQ ID NO: 1887719 - DNA, 15 bp, Homo sapiens
ctctgctatgcattt

SEQ ID NO: 1887720 - DNA, 19 bp, Homo sapiens
gacttgaattttcccactg

SEQ ID NO: 1887721 - DNA, 16 bp, Homo sapiens
gactttcccaaatgta

SEQ ID NO: 1887722 - DNA, 18 bp, Homo sapiens
gacttttccatgtatcta

SEQ ID NO: 1887723 - DNA, 16 bp, Homo sapiens
gagaaaacttatttga

SEQ ID NO: 1887724 - DNA, 21 bp, Homo sapiens
gagaacctagggtgatattaa

SEQ ID NO: 1887725 - DNA, 17 bp, Homo sapiens
gagaatgagagacacac

SEQ ID NO: 1887726 - DNA, 17 bp, Homo sapiens
gagacggatggaaggag

SEQ ID NO: 1887727 - DNA, 19 bp, Homo sapiens
gagacggatggaaggagag

SEQ ID NO: 1887728 - DNA, 18 bp, Homo sapiens
gagactatgcgtttttat

SEQ ID NO: 1887729 - DNA, 20 bp, Homo sapiens
gagactatgcgtttttataa

SEQ ID NO: 1887730 - DNA, 13 bp, Homo sapiens
gagagaaaactta

SEQ ID NO: 1887731 - DNA, 19 bp, Homo sapiens
gagagacacactgaagaag

SEQ ID NO: 1887732 - DNA, 14 bp, Homo sapiens
gagagcacctggtg

SEQ ID NO: 1887733 - DNA, 14 bp, Homo sapiens
gagaggagagcatc

SEQ ID NO: 1887734 - DNA, 19 bp, Homo sapiens
gagaggttgaggatgcact

SEQ ID NO: 1887735 - DNA, 22 bp, Homo sapiens
gagaggttgaggatgcactggc

SEQ ID NO: 1887736 - DNA, 16 bp, Homo sapiens
gagatatgcagaagga

SEQ ID NO: 1887737 - DNA, 21 bp, Homo sapiens
gagatcaccagtgtgtggctt

SEQ ID NO: 1887738 - DNA, 15 bp, Homo sapiens
gagatccttatcgaa

SEQ ID NO: 1887739 - DNA, 15 bp, Homo sapiens
gagatgagttgcagt

SEQ ID NO: 1887740 - DNA, 16 bp, Homo sapiens
gagatgagttgcagtt

SEQ ID NO: 1887741 - DNA, 17 bp, Homo sapiens
gagatgagttgcagttt

SEQ ID NO: 1887742 - DNA, 12 bp, Homo sapiens
gagatttttcat

SEQ ID NO: 1887743 - DNA, 16 bp, Homo sapiens
gagcaaagtctaaagt

SEQ ID NO: 1887744 - DNA, 13 bp, Homo sapiens
gagcacagccctc

SEQ ID NO: 1887745 - DNA, 15 bp, Homo sapiens
gagcacagccctccc

SEQ ID NO: 1887746 - DNA, 18 bp, Homo sapiens
gagcacagccctcccgcc

SEQ ID NO: 1887747 - DNA, 14 bp, Homo sapiens
gagcatctgctctg

SEQ ID NO: 1887748 - DNA, 15 bp, Homo sapiens
gagcatctgctctga

SEQ ID NO: 1887749 - DNA, 19 bp, Homo sapiens
gagcatgtgggggaaggcc

SEQ ID NO: 1887750 - DNA, 15 bp, Homo sapiens
gagcattctgcctgc

SEQ ID NO: 1887751 - DNA, 20 bp, Homo sapiens
gagcattctgcctgcctggg

SEQ ID NO: 1887752 - DNA, 21 bp, Homo sapiens
gagccctccttcttgccctga

SEQ ID NO: 1887753 - DNA, 16 bp, Homo sapiens
gagcctgccccagctg

SEQ ID NO: 1887754 - DNA, 14 bp, Homo sapiens
gagcctggagcccc

SEQ ID NO: 1887755 - DNA, 13 bp, Homo sapiens
gagctacctgggg

SEQ ID NO: 1887756 - DNA, 21 bp, Homo sapiens
gagctgcagagagcacctggt

SEQ ID NO: 1887757 - DNA, 17 bp, Homo sapiens
gagctttccggggagga

SEQ ID NO: 1887758 - DNA, 20 bp, Homo sapiens
gagctttccggggaggagcc

SEQ ID NO: 1887759 - DNA, 21 bp, Homo sapiens
gaggagagcatctgctctgag

SEQ ID NO: 1887760 - DNA, 21 bp, Homo sapiens
gaggagagtacccccctgaga

SEQ ID NO: 1887761 - DNA, 16 bp, Homo sapiens
gaggagccacctgggc

SEQ ID NO: 1887762 - DNA, 20 bp, Homo sapiens
gaggagccacctgggctggg

SEQ ID NO: 1887763 - DNA, 14 bp, Homo sapiens
gaggagccttggag

SEQ ID NO: 1887764 - DNA, 16 bp, Homo sapiens
gaggatgcactggcct

SEQ ID NO: 1887765 - DNA, 17 bp, Homo sapiens
gaggatgcactggcctg

SEQ ID NO: 1887766 - DNA, 18 bp, Homo sapiens
gaggatgcactggcctgt

SEQ ID NO: 1887767 - DNA, 21 bp, Homo sapiens
gaggatgggatgtatttttct

SEQ ID NO: 1887768 - DNA, 22 bp, Homo sapiens
gaggatgggatgtatttttctt

SEQ ID NO: 1887769 - DNA, 13 bp, Homo sapiens
gaggattttgagt

SEQ ID NO: 1887770 - DNA, 21 bp, Homo sapiens
gaggcaacagtgttctgagcc

SEQ ID NO: 1887771 - DNA, 21 bp, Homo sapiens
gaggcaggactcctgggtccc

SEQ ID NO: 1887772 - DNA, 13 bp, Homo sapiens
gaggcctgggagg

SEQ ID NO: 1887773 - DNA, 19 bp, Homo sapiens
gaggcgggggatcctggag

SEQ ID NO: 1887774 - DNA, 19 bp, Homo sapiens
gaggctgagactgcagagg

SEQ ID NO: 1887775 - DNA, 21 bp, Homo sapiens
gaggctgagactgcagaggag

SEQ ID NO: 1887776 - DNA, 13 bp, Homo sapiens
gaggctggctggg

SEQ ID NO: 1887777 - DNA, 23 bp, Homo sapiens
gaggctggggcggggctggaggt

SEQ ID NO: 1887778 - DNA, 19 bp, Homo sapiens
gagggaccaggtgtctaga

SEQ ID NO: 1887779 - DNA, 14 bp, Homo sapiens
gagggaggggaggt

SEQ ID NO: 1887780 - DNA, 17 bp, Homo sapiens
gagggaggggaggtggc

SEQ ID NO: 1887781 - DNA, 19 bp, Homo sapiens
gagggctgagtttgcacag

SEQ ID NO: 1887782 - DNA, 14 bp, Homo sapiens
gaggggcaggccct

SEQ ID NO: 1887783 - DNA, 17 bp, Homo sapiens
gagggtactaggggccc

SEQ ID NO: 1887784 - DNA, 22 bp, Homo sapiens
gaggtctcgctgatgctgggct

SEQ ID NO: 1887785 - DNA, 21 bp, Homo sapiens
gaggtggcgccccctggtggg

SEQ ID NO: 1887786 - DNA, 22 bp, Homo sapiens
gagtacccccctgagagcatgt

SEQ ID NO: 1887787 - DNA, 15 bp, Homo sapiens
gagtctatcaatcaa

SEQ ID NO: 1887788 - DNA, 21 bp, Homo sapiens
gagtctgctatattttcatga

SEQ ID NO: 1887789 - DNA, 18 bp, Homo sapiens
gagtctgcttgtcttaga

SEQ ID NO: 1887790 - DNA, 13 bp, Homo sapiens
gagtctggagctg

SEQ ID NO: 1887791 - DNA, 15 bp, Homo sapiens
gagtgacatgaagca

SEQ ID NO: 1887792 - DNA, 13 bp, Homo sapiens
gagtgctggctcc

SEQ ID NO: 1887793 - DNA, 22 bp, Homo sapiens
gagtgctggctccacgccctgg

SEQ ID NO: 1887794 - DNA, 20 bp, Homo sapiens
gagtgtcaactccaggactt

SEQ ID NO: 1887795 - DNA, 21 bp, Homo sapiens
gataatgtgatattatacata

SEQ ID NO: 1887796 - DNA, 19 bp, Homo sapiens
gataattacgtttaaagtg

SEQ ID NO: 1887797 - DNA, 14 bp, Homo sapiens
gatactgtttcttg

SEQ ID NO: 1887798 - DNA, 17 bp, Homo sapiens
gatactgtttcttgcac

SEQ ID NO: 1887799 - DNA, 22 bp, Homo sapiens
gatataaaggaccctgtttctg

SEQ ID NO: 1887800 - DNA, 14 bp, Homo sapiens
gatatgcagaagga

SEQ ID NO: 1887801 - DNA, 17 bp, Homo sapiens
gatatggcagggaagct

SEQ ID NO: 1887802 - DNA, 22 bp, Homo sapiens
gatatttgctggagtgctggct

SEQ ID NO: 1887803 - DNA, 18 bp, Homo sapiens
gatatttttccatttttt

SEQ ID NO: 1887804 - DNA, 19 bp, Homo sapiens
gatcacagtggccacggcc

SEQ ID NO: 1887805 - DNA, 12 bp, Homo sapiens
gatcattgcatt

SEQ ID NO: 1887806 - DNA, 17 bp, Homo sapiens
gatccccagctttctcc

SEQ ID NO: 1887807 - DNA, 14 bp, Homo sapiens
gatcctggagcccc

SEQ ID NO: 1887808 - DNA, 14 bp, Homo sapiens
gatctggggaagga

SEQ ID NO: 1887809 - DNA, 15 bp, Homo sapiens
gatctggggaaggac

SEQ ID NO: 1887810 - DNA, 18 bp, Homo sapiens
gatgaaggctgtatctat

SEQ ID NO: 1887811 - DNA, 16 bp, Homo sapiens
gatgagttgcagtttt

SEQ ID NO: 1887812 - DNA, 18 bp, Homo sapiens
gatgagttgcagttttta

SEQ ID NO: 1887813 - DNA, 15 bp, Homo sapiens
gatgatactgtttct

SEQ ID NO: 1887814 - DNA, 13 bp, Homo sapiens
gatgctgggctgg

SEQ ID NO: 1887815 - DNA, 20 bp, Homo sapiens
gatggagccagctctgcatt

SEQ ID NO: 1887816 - DNA, 17 bp, Homo sapiens
gatgtttgttgctagga

SEQ ID NO: 1887817 - DNA, 19 bp, Homo sapiens
gattacgtgtatgtttctt

SEQ ID NO: 1887818 - DNA, 22 bp, Homo sapiens
gattgatcggagcctcctctct

SEQ ID NO: 1887819 - DNA, 18 bp, Homo sapiens
gatttcccgtggccccag

SEQ ID NO: 1887820 - DNA, 14 bp, Homo sapiens
gatttcttctccct

SEQ ID NO: 1887821 - DNA, 14 bp, Homo sapiens
gattttgagtatct

SEQ ID NO: 1887822 - DNA, 18 bp, Homo sapiens
gatttttatccatttctt

SEQ ID NO: 1887823 - DNA, 15 bp, Homo sapiens
gattttttttaaagt

SEQ ID NO: 1887824 - DNA, 12 bp, Homo sapiens
gcaaattagtaa

SEQ ID NO: 1887825 - DNA, 15 bp, Homo sapiens
gcaacagtgttctga

SEQ ID NO: 1887826 - DNA, 10 bp, Homo sapiens
gcaagccaga

SEQ ID NO: 1887827 - DNA, 18 bp, Homo sapiens
gcaaggtgggggagcctg

SEQ ID NO: 1887828 - DNA, 22 bp, Homo sapiens
gcaaggtgggggagcctggagc

SEQ ID NO: 1887829 - DNA, 21 bp, Homo sapiens
gcaagtcctaagcctgttagc

SEQ ID NO: 1887830 - DNA, 16 bp, Homo sapiens
gcaattcatgtaacag

SEQ ID NO: 1887831 - DNA, 14 bp, Homo sapiens
gcacagcaaggagg

SEQ ID NO: 1887832 - DNA, 19 bp, Homo sapiens
gcacagcaaggaggctggc

SEQ ID NO: 1887833 - DNA, 22 bp, Homo sapiens
gcacagcaaggaggctggctgg

SEQ ID NO: 1887834 - DNA, 23 bp, Homo sapiens
gcacagcaaggaggctggctggg

SEQ ID NO: 1887835 - DNA, 13 bp, Homo sapiens
gcacagccctccc

SEQ ID NO: 1887836 - DNA, 21 bp, Homo sapiens
gcacagccctcccgccccttc

SEQ ID NO: 1887837 - DNA, 22 bp, Homo sapiens
gcacagccctcccgccccttcc

SEQ ID NO: 1887838 - DNA, 20 bp, Homo sapiens
gggcccaggccatcttccag

SEQ ID NO: 1887839 - DNA, 14 bp, Homo sapiens
gggcccgcttgcct

SEQ ID NO: 1887840 - DNA, 21 bp, Homo sapiens
gggcccgcttgcctcggctcc

SEQ ID NO: 1887841 - DNA, 21 bp, Homo sapiens
gggcccgttgtctccctggcc

SEQ ID NO: 1887842 - DNA, 22 bp, Homo sapiens
gggcccgttgtctccctggccc

SEQ ID NO: 1887843 - DNA, 23 bp, Homo sapiens
gggcccgttgtctccctggccct

SEQ ID NO: 1887844 - DNA, 20 bp, Homo sapiens
gggccctgcaggaggcctgg

SEQ ID NO: 1887845 - DNA, 14 bp, Homo sapiens
gggccggccaggtg

SEQ ID NO: 1887846 - DNA, 15 bp, Homo sapiens
gggccggccaggtgg

SEQ ID NO: 1887847 - DNA, 23 bp, Homo sapiens
gggcctatcagtgtgccccccat

SEQ ID NO: 1887848 - DNA, 20 bp, Homo sapiens
gggcctgatggagaggagaa

SEQ ID NO: 1887849 - DNA, 12 bp, Homo sapiens
gggcctggactg

SEQ ID NO: 1887850 - DNA, 21 bp, Homo sapiens
gggcgaggcgggggagcctgg

SEQ ID NO: 1887851 - DNA, 12 bp, Homo sapiens
gggcgagggagg

SEQ ID NO: 1887852 - DNA, 14 bp, Homo sapiens
gggctcctgtgccc

SEQ ID NO: 1887853 - DNA, 14 bp, Homo sapiens
gggctctgtgggct

SEQ ID NO: 1887854 - DNA, 18 bp, Homo sapiens
gggctgcccgctcccagt

SEQ ID NO: 1887855 - DNA, 16 bp, Homo sapiens
gggctggaggtggcgc

SEQ ID NO: 1887856 - DNA, 17 bp, Homo sapiens
gggctgggcaggtcctg

SEQ ID NO: 1887857 - DNA, 19 bp, Homo sapiens
gggctgggcaggtcctggg

SEQ ID NO: 1887858 - DNA, 22 bp, Homo sapiens
gggctgggtgcgaccccatctg

SEQ ID NO: 1887859 - DNA, 16 bp, Homo sapiens
gggctgggttggcgca

SEQ ID NO: 1887860 - DNA, 19 bp, Homo sapiens
gggctgggttggcgcaccc

SEQ ID NO: 1887861 - DNA, 21 bp, Homo sapiens
gggctgggttggcgcaccctc

SEQ ID NO: 1887862 - DNA, 22 bp, Homo sapiens
gggctgggttggcgcaccctcc

SEQ ID NO: 1887863 - DNA, 19 bp, Homo sapiens
gggcttctgcggtgaggca

SEQ ID NO: 1887864 - DNA, 21 bp, Homo sapiens
gggcttctgcggtgaggcagg

SEQ ID NO: 1887865 - DNA, 19 bp, Homo sapiens
ggggaattgaggacactga

SEQ ID NO: 1887866 - DNA, 13 bp, Homo sapiens
ggggagcctggag

SEQ ID NO: 1887867 - DNA, 15 bp, Homo sapiens
ggggagcctggagcc

SEQ ID NO: 1887868 - DNA, 18 bp, Homo sapiens
ggggagcctggagcccct

SEQ ID NO: 1887869 - DNA, 13 bp, Homo sapiens
ggggaggctctga

SEQ ID NO: 1887870 - DNA, 21 bp, Homo sapiens
ggggagtctgcttgtcttaga

SEQ ID NO: 1887871 - DNA, 14 bp, Homo sapiens
ggggatcctggagc

SEQ ID NO: 1887872 - DNA, 17 bp, Homo sapiens
ggggcaaggtgggggag

SEQ ID NO: 1887873 - DNA, 20 bp, Homo sapiens
ggggcaaggtgggggagcct

SEQ ID NO: 1887874 - DNA, 18 bp, Homo sapiens
ggggcaggccctgcactg

SEQ ID NO: 1887875 - DNA, 23 bp, Homo sapiens
ggggcccgcttgcctcggctcct

SEQ ID NO: 1887876 - DNA, 21 bp, Homo sapiens
ggggcccgttgtctccctggc

SEQ ID NO: 1887877 - DNA, 23 bp, Homo sapiens
ggggcccgttgtctccctggccc

SEQ ID NO: 1887878 - DNA, 12 bp, Homo sapiens
ggggcgagggag

SEQ ID NO: 1887879 - DNA, 15 bp, Homo sapiens
ggggctgcccgctcc

SEQ ID NO: 1887880 - DNA, 10 bp, Homo sapiens
ggggctgggt

SEQ ID NO: 1887881 - DNA, 23 bp, Homo sapiens
ggggctgggttggcgcaccctcc

SEQ ID NO: 1887882 - DNA, 12 bp, Homo sapiens
gggggagcctgg

SEQ ID NO: 1887883 - DNA, 14 bp, Homo sapiens
gggggccctggctt

SEQ ID NO: 1887884 - DNA, 14 bp, Homo sapiens
gggtctccctgagc

SEQ ID NO: 1887885 - DNA, 16 bp, Homo sapiens
gggtctccctgagcct

SEQ ID NO: 1887886 - DNA, 22 bp, Homo sapiens
gggtgcgaccccatctgcccag

SEQ ID NO: 1887887 - DNA, 11 bp, Homo sapiens
gggtggcccat

SEQ ID NO: 1887888 - DNA, 16 bp, Homo sapiens
gggtgtgccctggctc

SEQ ID NO: 1887889 - DNA, 17 bp, Homo sapiens
gggtgtgccctggctcc

SEQ ID NO: 1887890 - DNA, 22 bp, Homo sapiens
gggttggcgcaccctcccctcc

SEQ ID NO: 1887891 - DNA, 12 bp, Homo sapiens
ggtaaataaagc

SEQ ID NO: 1887892 - DNA, 14 bp, Homo sapiens
ggtaaataaagctc

SEQ ID NO: 1887893 - DNA, 17 bp, Homo sapiens
ggtaaataaagctcaag

SEQ ID NO: 1887894 - DNA, 17 bp, Homo sapiens
ggtagaggatgaggaaa

SEQ ID NO: 1887895 - DNA, 18 bp, Homo sapiens
ggtattgcgaaacaactt

SEQ ID NO: 1887896 - DNA, 17 bp, Homo sapiens
ggtcaaagtacagaata

SEQ ID NO: 1887897 - DNA, 12 bp, Homo sapiens
ggtccagagtca

SEQ ID NO: 1887898 - DNA, 17 bp, Homo sapiens
ggtcccacttcccctcc

SEQ ID NO: 1887899 - DNA, 15 bp, Homo sapiens
ggtcctggggaggct

SEQ ID NO: 1887900 - DNA, 16 bp, Homo sapiens
ggtcctggggaggctg

SEQ ID NO: 1887901 - DNA, 15 bp, Homo sapiens
ggtctccctgagcct

SEQ ID NO: 1887902 - DNA, 16 bp, Homo sapiens
ggtctccctgagcctg

SEQ ID NO: 1887903 - DNA, 18 bp, Homo sapiens
ggtctccctgagcctgcc

SEQ ID NO: 1887904 - DNA, 20 bp, Homo sapiens
ggtgaggcagtgggtcccac

SEQ ID NO: 1887905 - DNA, 12 bp, Homo sapiens
ggtgatggccag

SEQ ID NO: 1887906 - DNA, 22 bp, Homo sapiens
ggtgccaacagtgttaggcctg

SEQ ID NO: 1887907 - DNA, 16 bp, Homo sapiens
ggtgcctgctctcctt

SEQ ID NO: 1887908 - DNA, 16 bp, Homo sapiens
ggtgcggtaggtgctg

SEQ ID NO: 1887909 - DNA, 21 bp, Homo sapiens
ggtgcggtaggtgctggcctc

SEQ ID NO: 1887910 - DNA, 17 bp, Homo sapiens
ggtgctagggtgcctgc

SEQ ID NO: 1887911 - DNA, 14 bp, Homo sapiens
ggtgcttgggcttc

SEQ ID NO: 1887912 - DNA, 20 bp, Homo sapiens
ggtgggcgggcagcacagca

SEQ ID NO: 1887913 - DNA, 17 bp, Homo sapiens
ggtgggggagcctggag

SEQ ID NO: 1887914 - DNA, 15 bp, Homo sapiens
ggtggtaccaggtct

SEQ ID NO: 1887915 - DNA, 17 bp, Homo sapiens
ggtggtgcagccccagg

SEQ ID NO: 1887916 - DNA, 17 bp, Homo sapiens
ggtgtcgcgccttctcc

SEQ ID NO: 1887917 - DNA, 21 bp, Homo sapiens
ggtgtcgcgccttctcccccc

SEQ ID NO: 1887918 - DNA, 16 bp, Homo sapiens
ggtgtctagaggcaac

SEQ ID NO: 1887919 - DNA, 14 bp, Homo sapiens
ggtgtgccctggct

SEQ ID NO: 1887920 - DNA, 16 bp, Homo sapiens
ggttaagaaatacctt

SEQ ID NO: 1887921 - DNA, 17 bp, Homo sapiens
ggttgtgaaatgtaaca

SEQ ID NO: 1887922 - DNA, 15 bp, Homo sapiens
ggtttagcaggctgc

SEQ ID NO: 1887923 - DNA, 14 bp, Homo sapiens
ggtttgttttttca

SEQ ID NO: 1887924 - DNA, 13 bp, Homo sapiens
gtaaataaagctc

SEQ ID NO: 1887925 - DNA, 14 bp, Homo sapiens
gtaaataaattgtt

SEQ ID NO: 1887926 - DNA, 18 bp, Homo sapiens
gtaaataaattgtttgac

SEQ ID NO: 1887927 - DNA, 16 bp, Homo sapiens
gtaaatacttgcagtt

SEQ ID NO: 1887928 - DNA, 19 bp, Homo sapiens
gtaagtttatgtctaaaga

SEQ ID NO: 1887929 - DNA, 15 bp, Homo sapiens
gtaatatattgctgc

SEQ ID NO: 1887930 - DNA, 16 bp, Homo sapiens
gtaatatattgctgct

SEQ ID NO: 1887931 - DNA, 12 bp, Homo sapiens
gtaattattgtg

SEQ ID NO: 1887932 - DNA, 15 bp, Homo sapiens
gtaattggaaaggca

SEQ ID NO: 1887933 - DNA, 13 bp, Homo sapiens
gtaatttgtatct

SEQ ID NO: 1887934 - DNA, 21 bp, Homo sapiens
gtaatttgtatctgaaggaga

SEQ ID NO: 1887935 - DNA, 23 bp, Homo sapiens
gtacactgccttctcaactccaa

SEQ ID NO: 1887936 - DNA, 21 bp, Homo sapiens
gtacagttatttatgcctctg

SEQ ID NO: 1887937 - DNA, 18 bp, Homo sapiens
gtaccaggtctcctccac

SEQ ID NO: 1887938 - DNA, 14 bp, Homo sapiens
gtacccccctgaga

SEQ ID NO: 1887939 - DNA, 19 bp, Homo sapiens
gtacccccgcccaggctgg

SEQ ID NO: 1887940 - DNA, 20 bp, Homo sapiens
gtacccccgcccaggctggc

SEQ ID NO: 1887941 - DNA, 17 bp, Homo sapiens
gtacctggtgacccctt

SEQ ID NO: 1887942 - DNA, 13 bp, Homo sapiens
gtacgtgggagag

SEQ ID NO: 1887943 - DNA, 18 bp, Homo sapiens
gtactcctcacttttcaa

SEQ ID NO: 1887944 - DNA, 16 bp, Homo sapiens
gtagaaaagaaaacat

SEQ ID NO: 1887945 - DNA, 21 bp, Homo sapiens
gtagaatttttaaaaaagtga

SEQ ID NO: 1887946 - DNA, 18 bp, Homo sapiens
gtagacagtatataacta

SEQ ID NO: 1887947 - DNA, 14 bp, Homo sapiens
gtagctctgagccc

SEQ ID NO: 1887948 - DNA, 20 bp, Homo sapiens
gtagctggctgtactgccaa

SEQ ID NO: 1887949 - DNA, 14 bp, Homo sapiens
gtaggtgctggcct

SEQ ID NO: 1887950 - DNA, 16 bp, Homo sapiens
gtaggtgctggcctca

SEQ ID NO: 1887951 - DNA, 17 bp, Homo sapiens
gtagtgttggagaagaa

SEQ ID NO: 1887952 - DNA, 15 bp, Homo sapiens
gtataaaataatttt

SEQ ID NO: 1887953 - DNA, 16 bp, Homo sapiens
gtatagactcctgaaa

SEQ ID NO: 1887954 - DNA, 15 bp, Homo sapiens
gtatagagatatgca

SEQ ID NO: 1887955 - DNA, 14 bp, Homo sapiens
gtatatgtcattta

SEQ ID NO: 1887956 - DNA, 11 bp, Homo sapiens
gtatctgaagg

SEQ ID NO: 1887957 - DNA, 13 bp, Homo sapiens
tcctacccctccc

SEQ ID NO: 1887958 - DNA, 14 bp, Homo sapiens
tcctacggagggac

SEQ ID NO: 1887959 - DNA, 14 bp, Homo sapiens
tcctaggaaaatac

SEQ ID NO: 1887960 - DNA, 14 bp, Homo sapiens
tcctcacatgcccg

SEQ ID NO: 1887961 - DNA, 16 bp, Homo sapiens
tcctcacatgcccgct

SEQ ID NO: 1887962 - DNA, 23 bp, Homo sapiens
tcctcacatgcccgctgtcccag

SEQ ID NO: 1887963 - DNA, 19 bp, Homo sapiens
tcctcaccttttcccgggg

SEQ ID NO: 1887964 - DNA, 17 bp, Homo sapiens
tcctctccacctagtgg

SEQ ID NO: 1887965 - DNA, 19 bp, Homo sapiens
tcctctccacctagtggct

SEQ ID NO: 1887966 - DNA, 22 bp, Homo sapiens
tcctctgctatgcattttcttc

SEQ ID NO: 1887967 - DNA, 21 bp, Homo sapiens
tcctgaaaacccttgccatgt

SEQ ID NO: 1887968 - DNA, 16 bp, Homo sapiens
tcctgacttcaggggc

SEQ ID NO: 1887969 - DNA, 19 bp, Homo sapiens
tcctgacttcaggggctgc

SEQ ID NO: 1887970 - DNA, 22 bp, Homo sapiens
tcctgacttcaggggctgcccg

SEQ ID NO: 1887971 - DNA, 23 bp, Homo sapiens
tcctgattaaatgtctgacacat

SEQ ID NO: 1887972 - DNA, 13 bp, Homo sapiens
tcctgccacagga

SEQ ID NO: 1887973 - DNA, 14 bp, Homo sapiens
tcctgctccacagt

SEQ ID NO: 1887974 - DNA, 12 bp, Homo sapiens
tcctgctgcacc

SEQ ID NO: 1887975 - DNA, 20 bp, Homo sapiens
tcctgctgcaccaacccagc

SEQ ID NO: 1887976 - DNA, 21 bp, Homo sapiens
tcctgctgcaccaacccagcc

SEQ ID NO: 1887977 - DNA, 14 bp, Homo sapiens
tcctggcccatcag

SEQ ID NO: 1887978 - DNA, 17 bp, Homo sapiens
tcctggggaggctgaga

SEQ ID NO: 1887979 - DNA, 12 bp, Homo sapiens
tcctgtcagtgc

SEQ ID NO: 1887980 - DNA, 14 bp, Homo sapiens
tcctgtcagtgccg

SEQ ID NO: 1887981 - DNA, 23 bp, Homo sapiens
tcctgtgggggaagagcacagcc

SEQ ID NO: 1887982 - DNA, 20 bp, Homo sapiens
tccttacctatttcctcaga

SEQ ID NO: 1887983 - DNA, 22 bp, Homo sapiens
tccttcaccctccgttgacagt

SEQ ID NO: 1887984 - DNA, 19 bp, Homo sapiens
tccttgccctgggccagcc

SEQ ID NO: 1887985 - DNA, 23 bp, Homo sapiens
tcctttttgcagtatatttctga

SEQ ID NO: 1887986 - DNA, 21 bp, Homo sapiens
tcgcaccactgtgtatttaac

SEQ ID NO: 1887987 - DNA, 14 bp, Homo sapiens
tcgcccaccgcatg

SEQ ID NO: 1887988 - DNA, 12 bp, Homo sapiens
tcgcgctgcctg

SEQ ID NO: 1887989 - DNA, 15 bp, Homo sapiens
tcgcgctgcctgtgt

SEQ ID NO: 1887990 - DNA, 16 bp, Homo sapiens
tcgcgctgcctgtgtg

SEQ ID NO: 1887991 - DNA, 16 bp, Homo sapiens
tcgctcctcaacccct

SEQ ID NO: 1887992 - DNA, 18 bp, Homo sapiens
tcgctcctcaacccctcc

SEQ ID NO: 1887993 - DNA, 14 bp, Homo sapiens
tcgctgatgctggg

SEQ ID NO: 1887994 - DNA, 14 bp, Homo sapiens
tcggctcctgctgc

SEQ ID NO: 1887995 - DNA, 19 bp, Homo sapiens
tcggggggcgagggagggg

SEQ ID NO: 1887996 - DNA, 14 bp, Homo sapiens
tcgggttaagaaat

SEQ ID NO: 1887997 - DNA, 15 bp, Homo sapiens
tcgggttaagaaata

SEQ ID NO: 1887998 - DNA, 21 bp, Homo sapiens
tcgtggaacagttacctctgc

SEQ ID NO: 1887999 - DNA, 12 bp, Homo sapiens
tctaaagtttac

SEQ ID NO: 1888000 - DNA, 18 bp, Homo sapiens
tctaaagtttacagtaaa

SEQ ID NO: 1888001 - DNA, 18 bp, Homo sapiens
tctacaaaatcctgatga

SEQ ID NO: 1888002 - DNA, 17 bp, Homo sapiens
tctacactaagagagaa

SEQ ID NO: 1888003 - DNA, 18 bp, Homo sapiens
tctactcattccccgggg

SEQ ID NO: 1888004 - DNA, 15 bp, Homo sapiens
tctagcagtaaatac

SEQ ID NO: 1888005 - DNA, 15 bp, Homo sapiens
tctagtgatttcctg

SEQ ID NO: 1888006 - DNA, 14 bp, Homo sapiens
tctatgaaatatta

SEQ ID NO: 1888007 - DNA, 18 bp, Homo sapiens
tctatgaaatattatgtt

SEQ ID NO: 1888008 - DNA, 12 bp, Homo sapiens
tctattttaatt

SEQ ID NO: 1888009 - DNA, 24 bp, Homo sapiens
tctattttgtaactttctctatga

SEQ ID NO: 1888010 - DNA, 21 bp, Homo sapiens
tctatttttttttctttttaa

SEQ ID NO: 1888011 - DNA, 16 bp, Homo sapiens
tctcactatgctgcta

SEQ ID NO: 1888012 - DNA, 16 bp, Homo sapiens
tctccacctagtggct

SEQ ID NO: 1888013 - DNA, 15 bp, Homo sapiens
tctccagtgcacctg

SEQ ID NO: 1888014 - DNA, 21 bp, Homo sapiens
tctcccccccggggctgggtt

SEQ ID NO: 1888015 - DNA, 13 bp, Homo sapiens
tctccctgagcct

SEQ ID NO: 1888016 - DNA, 23 bp, Homo sapiens
tctccctgagcctgccccagctg

SEQ ID NO: 1888017 - DNA, 14 bp, Homo sapiens
tctccctggccctc

SEQ ID NO: 1888018 - DNA, 20 bp, Homo sapiens
tctcctccaccgccatggct

SEQ ID NO: 1888019 - DNA, 13 bp, Homo sapiens
tctccttgccctg

SEQ ID NO: 1888020 - DNA, 23 bp, Homo sapiens
tctccttgccctgggccagccca

SEQ ID NO: 1888021 - DNA, 18 bp, Homo sapiens
tctcgctgatgctgggct

SEQ ID NO: 1888022 - DNA, 20 bp, Homo sapiens
tctcgctgatgctgggctgg

SEQ ID NO: 1888023 - DNA, 22 bp, Homo sapiens
tctcgctgatgctgggctgggt

SEQ ID NO: 1888024 - DNA, 21 bp, Homo sapiens
tctcggacctttcagctgtga

SEQ ID NO: 1888025 - DNA, 14 bp, Homo sapiens
tctcggtggtacca

SEQ ID NO: 1888026 - DNA, 17 bp, Homo sapiens
tctctgctgcttctggg

SEQ ID NO: 1888027 - DNA, 20 bp, Homo sapiens
tctctgctgcttctgggcct

SEQ ID NO: 1888028 - DNA, 12 bp, Homo sapiens
tctcttgatttt

SEQ ID NO: 1888029 - DNA, 17 bp, Homo sapiens
tctgagcccccacctgc

SEQ ID NO: 1888030 - DNA, 21 bp, Homo sapiens
tctgagcccccacctgcctga

SEQ ID NO: 1888031 - DNA, 16 bp, Homo sapiens
tctgccacttcccagg

SEQ ID NO: 1888032 - DNA, 12 bp, Homo sapiens
tctgcccaggac

SEQ ID NO: 1888033 - DNA, 15 bp, Homo sapiens
tctgcctgcctggga

SEQ ID NO: 1888034 - DNA, 16 bp, Homo sapiens
tctgcctgcctgggaa

SEQ ID NO: 1888035 - DNA, 20 bp, Homo sapiens
tctgctatgcattttcttca

SEQ ID NO: 1888036 - DNA, 22 bp, Homo sapiens
tctgctcgggcccaggccatct

SEQ ID NO: 1888037 - DNA, 13 bp, Homo sapiens
tctgctctgagac

SEQ ID NO: 1888038 - DNA, 16 bp, Homo sapiens
tctgctgcttctgggc

SEQ ID NO: 1888039 - DNA, 18 bp, Homo sapiens
tctgctgcttctgggcct

SEQ ID NO: 1888040 - DNA, 12 bp, Homo sapiens
tctggagctgag

SEQ ID NO: 1888041 - DNA, 14 bp, Homo sapiens
tctggagctgagct

SEQ ID NO: 1888042 - DNA, 13 bp, Homo sapiens
tctgggaggcttc

SEQ ID NO: 1888043 - DNA, 17 bp, Homo sapiens
tctgggccctgcaggag

SEQ ID NO: 1888044 - DNA, 21 bp, Homo sapiens
tctgtagaaaagaaaacattt

SEQ ID NO: 1888045 - DNA, 22 bp, Homo sapiens
tctgtagaaaagaaaacattta

SEQ ID NO: 1888046 - DNA, 13 bp, Homo sapiens
tctgtaggagaga

SEQ ID NO: 1888047 - DNA, 20 bp, Homo sapiens
tctgtatttccccaacatgt

SEQ ID NO: 1888048 - DNA, 22 bp, Homo sapiens
tctgtgcccatgggcactgctg

SEQ ID NO: 1888049 - DNA, 20 bp, Homo sapiens
tctgtgcctgactctgtgct

SEQ ID NO: 1888050 - DNA, 15 bp, Homo sapiens
tctgtgggctgcact

SEQ ID NO: 1888051 - DNA, 20 bp, Homo sapiens
tctgtgggctgcactctgtg

SEQ ID NO: 1888052 - DNA, 21 bp, Homo sapiens
tctgtgggctgcactctgtgc

SEQ ID NO: 1888053 - DNA, 22 bp, Homo sapiens
tctgtgtcactggctgcctcca

SEQ ID NO: 1888054 - DNA, 18 bp, Homo sapiens
tctgttttataattttgt

SEQ ID NO: 1888055 - DNA, 20 bp, Homo sapiens
tctgttttataattttgtga

SEQ ID NO: 1888056 - DNA, 16 bp, Homo sapiens
tcttaaaaagacactt

SEQ ID NO: 1888057 - DNA, 13 bp, Homo sapiens
tcttaaaactcct

SEQ ID NO: 1888058 - DNA, 12 bp, Homo sapiens
tcttaagaagac

SEQ ID NO: 1888059 - DNA, 18 bp, Homo sapiens
tcttaagaagactgcatt

SEQ ID NO: 1888060 - DNA, 20 bp, Homo sapiens
tcttacttattatcttcagg

SEQ ID NO: 1888061 - DNA, 14 bp, Homo sapiens
tcttatttcatgaa

SEQ ID NO: 1888062 - DNA, 22 bp, Homo sapiens
tcttcatcacttcttccactgt

SEQ ID NO: 1888063 - DNA, 20 bp, Homo sapiens
tcttccactgtgtgttgaca

SEQ ID NO: 1888064 - DNA, 18 bp, Homo sapiens
tcttcccccactcctctt

SEQ ID NO: 1888065 - DNA, 12 bp, Homo sapiens
tcttcctgtggg

SEQ ID NO: 1888066 - DNA, 14 bp, Homo sapiens
tcttctaccaccca

SEQ ID NO: 1888067 - DNA, 13 bp, Homo sapiens
tcttgcactgaat

SEQ ID NO: 1888068 - DNA, 18 bp, Homo sapiens
tcttgccccaacccccag

SEQ ID NO: 1888069 - DNA, 22 bp, Homo sapiens
tcttgccccaacccccagcacc

SEQ ID NO: 1888070 - DNA, 17 bp, Homo sapiens
tcttgcccgctcaggct

SEQ ID NO: 1888071 - DNA, 13 bp, Homo sapiens
tcttgccctgagc

SEQ ID NO: 1888072 - DNA, 14 bp, Homo sapiens
tcttgccctgagct

SEQ ID NO: 1888073 - DNA, 15 bp, Homo sapiens
tcttgccctgagctt

SEQ ID NO: 1888074 - DNA, 15 bp, Homo sapiens
tcttgctgttcagtg

SEQ ID NO: 1888075 - DNA, 19 bp, Homo sapiens
tcttgctgttcagtgcttt

SEQ ID NO: 1888076 - DNA, 23 bp, Homo sapiens
tgttaagccatttaactggagct

SEQ ID NO: 1888077 - DNA, 14 bp, Homo sapiens
tgttagtgcaaatt

SEQ ID NO: 1888078 - DNA, 22 bp, Homo sapiens
tgttattattactctacactga

SEQ ID NO: 1888079 - DNA, 15 bp, Homo sapiens
tgttcagtgcttttt

SEQ ID NO: 1888080 - DNA, 17 bp, Homo sapiens
tgttcagtgctttttcc

SEQ ID NO: 1888081 - DNA, 18 bp, Homo sapiens
tgttccccatggccactt

SEQ ID NO: 1888082 - DNA, 16 bp, Homo sapiens
tgttcctccattttct

SEQ ID NO: 1888083 - DNA, 17 bp, Homo sapiens
tgttcctccattttctt

SEQ ID NO: 1888084 - DNA, 22 bp, Homo sapiens
tgttcctccattttcttatcca

SEQ ID NO: 1888085 - DNA, 10 bp, Homo sapiens
tgttctgagc

SEQ ID NO: 1888086 - DNA, 13 bp, Homo sapiens
tgttctgagcccc

SEQ ID NO: 1888087 - DNA, 20 bp, Homo sapiens
tgttgacatgggacatttgc

SEQ ID NO: 1888088 - DNA, 15 bp, Homo sapiens
tgttggcgagaggag

SEQ ID NO: 1888089 - DNA, 20 bp, Homo sapiens
tgttggcgagaggaggggcc

SEQ ID NO: 1888090 - DNA, 15 bp, Homo sapiens
tgtttaagtggcttt

SEQ ID NO: 1888091 - DNA, 19 bp, Homo sapiens
tgtttagtaaactcaataa

SEQ ID NO: 1888092 - DNA, 19 bp, Homo sapiens
tgtttcaaacatatataac

SEQ ID NO: 1888093 - DNA, 22 bp, Homo sapiens
tgtttcaaacatatataacaat

SEQ ID NO: 1888094 - DNA, 18 bp, Homo sapiens
tgtttcttctttctttta

SEQ ID NO: 1888095 - DNA, 23 bp, Homo sapiens
tgtttcttctttcttttaagcag

SEQ ID NO: 1888096 - DNA, 20 bp, Homo sapiens
tgtttgctcagcttctccaa

SEQ ID NO: 1888097 - DNA, 14 bp, Homo sapiens
tgtttgcttccatt

SEQ ID NO: 1888098 - DNA, 20 bp, Homo sapiens
tgttttataattttgtgaag

SEQ ID NO: 1888099 - DNA, 22 bp, Homo sapiens
tgttttcccgagcaaagtctaa

SEQ ID NO: 1888100 - DNA, 15 bp, Homo sapiens
ttaaaaaagaaacat

SEQ ID NO: 1888101 - DNA, 16 bp, Homo sapiens
ttaaaaaagtgatctt

SEQ ID NO: 1888102 - DNA, 21 bp, Homo sapiens
ttaaacatctagcagtaaata

SEQ ID NO: 1888103 - DNA, 17 bp, Homo sapiens
ttaaagtgcagtcattt

SEQ ID NO: 1888104 - DNA, 18 bp, Homo sapiens
ttaaagtgcagtcatttg

SEQ ID NO: 1888105 - DNA, 19 bp, Homo sapiens
ttaaatttaggtaaataaa

SEQ ID NO: 1888106 - DNA, 13 bp, Homo sapiens
ttaacataatggt

SEQ ID NO: 1888107 - DNA, 10 bp, Homo sapiens
ttaacatctt

SEQ ID NO: 1888108 - DNA, 13 bp, Homo sapiens
ttaacatctttgt

SEQ ID NO: 1888109 - DNA, 20 bp, Homo sapiens
ttaagaagactgcattatat

SEQ ID NO: 1888110 - DNA, 22 bp, Homo sapiens
ttaagagcttgatctgtgattt

SEQ ID NO: 1888111 - DNA, 16 bp, Homo sapiens
ttaagccttcatttgc

SEQ ID NO: 1888112 - DNA, 15 bp, Homo sapiens
ttaaggagaggagag

SEQ ID NO: 1888113 - DNA, 18 bp, Homo sapiens
ttaagtaatgataactgg

SEQ ID NO: 1888114 - DNA, 17 bp, Homo sapiens
ttaatgtattaatctgt

SEQ ID NO: 1888115 - DNA, 21 bp, Homo sapiens
ttaatgtattaatctgtttgt

SEQ ID NO: 1888116 - DNA, 14 bp, Homo sapiens
ttaattattgtaca

SEQ ID NO: 1888117 - DNA, 14 bp, Homo sapiens
ttaatttaatgtat

SEQ ID NO: 1888118 - DNA, 15 bp, Homo sapiens
ttacacaataaagca

SEQ ID NO: 1888119 - DNA, 21 bp, Homo sapiens
ttaccacttgtgttttgcaag

SEQ ID NO: 1888120 - DNA, 19 bp, Homo sapiens
ttacctgtcatctgggcca

SEQ ID NO: 1888121 - DNA, 18 bp, Homo sapiens
ttacctgttccattgttg

SEQ ID NO: 1888122 - DNA, 14 bp, Homo sapiens
ttacgtgtatgttt

SEQ ID NO: 1888123 - DNA, 17 bp, Homo sapiens
ttacgtgtatgtttctt

SEQ ID NO: 1888124 - DNA, 15 bp, Homo sapiens
ttacgtttaaagtgc

SEQ ID NO: 1888125 - DNA, 15 bp, Homo sapiens
ttactctacactgaa

SEQ ID NO: 1888126 - DNA, 15 bp, Homo sapiens
ttactgtaagaaaat

SEQ ID NO: 1888127 - DNA, 14 bp, Homo sapiens
ttacttgacctcct

SEQ ID NO: 1888128 - DNA, 23 bp, Homo sapiens
ttagatgcagttctgaagaagat

SEQ ID NO: 1888129 - DNA, 20 bp, Homo sapiens
ttagctacatagcagacttt

SEQ ID NO: 1888130 - DNA, 12 bp, Homo sapiens
ttagctggaaaa

SEQ ID NO: 1888131 - DNA, 13 bp, Homo sapiens
ttagctggaaaag

SEQ ID NO: 1888132 - DNA, 18 bp, Homo sapiens
ttagcttcagttgttctt

SEQ ID NO: 1888133 - DNA, 18 bp, Homo sapiens
ttaggcagggatttgagg

SEQ ID NO: 1888134 - DNA, 17 bp, Homo sapiens
ttataaacctctaattt

SEQ ID NO: 1888135 - DNA, 18 bp, Homo sapiens
ttataattttgtgaagca

SEQ ID NO: 1888136 - DNA, 15 bp, Homo sapiens
ttatagttgtaacta

SEQ ID NO: 1888137 - DNA, 12 bp, Homo sapiens
ttatatttgaaa

SEQ ID NO: 1888138 - DNA, 19 bp, Homo sapiens
ttatatttgaaatattgac

SEQ ID NO: 1888139 - DNA, 21 bp, Homo sapiens
ttatattttgattttacatgc

SEQ ID NO: 1888140 - DNA, 17 bp, Homo sapiens
ttatccatttcttttac

SEQ ID NO: 1888141 - DNA, 20 bp, Homo sapiens
ttatcttcaggacactcact

SEQ ID NO: 1888142 - DNA, 16 bp, Homo sapiens
ttatgaattacatttg

SEQ ID NO: 1888143 - DNA, 19 bp, Homo sapiens
ttatgattaagtaatgata

SEQ ID NO: 1888144 - DNA, 22 bp, Homo sapiens
ttatgtcaaactgtcttggctg

SEQ ID NO: 1888145 - DNA, 19 bp, Homo sapiens
ttattactctacactgaaa

SEQ ID NO: 1888146 - DNA, 17 bp, Homo sapiens
ttattactgtaagaaaa

SEQ ID NO: 1888147 - DNA, 20 bp, Homo sapiens
ttattcaggaaaagcctctg

SEQ ID NO: 1888148 - DNA, 23 bp, Homo sapiens
ttattcaggaaaagcctctgtgt

SEQ ID NO: 1888149 - DNA, 20 bp, Homo sapiens
ttatttatgcctctgtattt

SEQ ID NO: 1888150 - DNA, 15 bp, Homo sapiens
ttatttcatgaaaat

SEQ ID NO: 1888151 - DNA, 18 bp, Homo sapiens
ttattttagcttcagttg

SEQ ID NO: 1888152 - DNA, 21 bp, Homo sapiens
ttattttagcttcagttgttc

SEQ ID NO: 1888153 - DNA, 21 bp, Homo sapiens
ttattttgtaattattgtgat

SEQ ID NO: 1888154 - DNA, 15 bp, Homo sapiens
ttcaaacatatataa

SEQ ID NO: 1888155 - DNA, 20 bp, Homo sapiens
ttcaagaaaggcaagagctc

SEQ ID NO: 1888156 - DNA, 21 bp, Homo sapiens
ttcaagtattaggggtaatat

SEQ ID NO: 1888157 - DNA, 15 bp, Homo sapiens
ttcaatttgtcatgt

SEQ ID NO: 1888158 - DNA, 20 bp, Homo sapiens
ttcaatttgtcatgttacta

SEQ ID NO: 1888159 - DNA, 23 bp, Homo sapiens
ttcaatttgtcatgttactaaat

SEQ ID NO: 1888160 - DNA, 17 bp, Homo sapiens
ttcagctcttaaaaaga

SEQ ID NO: 1888161 - DNA, 16 bp, Homo sapiens
ttcagcttctgctggg

SEQ ID NO: 1888162 - DNA, 18 bp, Homo sapiens
ttcagcttctgctgggct

SEQ ID NO: 1888163 - DNA, 22 bp, Homo sapiens
ttcagcttctgctgggctgggg

SEQ ID NO: 1888164 - DNA, 20 bp, Homo sapiens
ttcaggaaaagcctctgtgt

SEQ ID NO: 1888165 - DNA, 11 bp, Homo sapiens
ttcagttattt

SEQ ID NO: 1888166 - DNA, 17 bp, Homo sapiens
ttcagttcctctttgca

SEQ ID NO: 1888167 - DNA, 21 bp, Homo sapiens
ttcatataaaagttgcgttta

SEQ ID NO: 1888168 - DNA, 17 bp, Homo sapiens
ttcatctgttgttctgt

SEQ ID NO: 1888169 - DNA, 17 bp, Homo sapiens
ttcatgtaacagttgtg

SEQ ID NO: 1888170 - DNA, 16 bp, Homo sapiens
ttcattgcctttccag

SEQ ID NO: 1888171 - DNA, 18 bp, Homo sapiens
ttcatttgcaattcatgt

SEQ ID NO: 1888172 - DNA, 13 bp, Homo sapiens
ttccaagcccttc

SEQ ID NO: 1888173 - DNA, 19 bp, Homo sapiens
ttccaagcccttccctctg

SEQ ID NO: 1888174 - DNA, 13 bp, Homo sapiens
ttccactgtgtgt

SEQ ID NO: 1888175 - DNA, 15 bp, Homo sapiens
ttccaggtggggtga

SEQ ID NO: 1888176 - DNA, 18 bp, Homo sapiens
ttcccaactccagaaagt

SEQ ID NO: 1888177 - DNA, 18 bp, Homo sapiens
ttcccactgcaccccctc

SEQ ID NO: 1888178 - DNA, 23 bp, Homo sapiens
ttcccactgcaccccctcctgct

SEQ ID NO: 1888179 - DNA, 23 bp, Homo sapiens
ttccccatggttttaatctgtat

SEQ ID NO: 1888180 - DNA, 16 bp, Homo sapiens
ttccccgagggatgat

SEQ ID NO: 1888181 - DNA, 23 bp, Homo sapiens
ttccccgagggatgatgccacac

SEQ ID NO: 1888182 - DNA, 16 bp, Homo sapiens
ttcccctcctacccct

SEQ ID NO: 1888183 - DNA, 22 bp, Homo sapiens
ttcccctcctacccctcccagc

SEQ ID NO: 1888184 - DNA, 23 bp, Homo sapiens
ttcccgagcaaagtctaaagttt

SEQ ID NO: 1888185 - DNA, 17 bp, Homo sapiens
ttcccttgatgaagaag

SEQ ID NO: 1888186 - DNA, 18 bp, Homo sapiens
ttccggggaggagccttg

SEQ ID NO: 1888187 - DNA, 16 bp, Homo sapiens
ttcctcagatccccag

SEQ ID NO: 1888188 - DNA, 16 bp, Homo sapiens
ttcctccattttctta

SEQ ID NO: 1888189 - DNA, 15 bp, Homo sapiens
ttcctctttgcatgg

SEQ ID NO: 1888190 - DNA, 15 bp, Homo sapiens
ttctacttttaaaga

SEQ ID NO: 1888191 - DNA, 15 bp, Homo sapiens
ttctccatcctacca

SEQ ID NO: 1888192 - DNA, 17 bp, Homo sapiens
ttctcccccccggggct

SEQ ID NO: 1888193 - DNA, 20 bp, Homo sapiens
ttctcccccccggggctggg

SEQ ID NO: 1888194 - DNA, 15 bp, Homo sapiens
aggccctgcactgtc

SEQ ID NO: 1888195 - DNA, 19 bp, Homo sapiens
aggccctgcactgtcctgc

SEQ ID NO: 1888196 - DNA, 12 bp, Homo sapiens
aggcctcccaca

SEQ ID NO: 1888197 - DNA, 16 bp, Homo sapiens
aggcctcccacagtga

SEQ ID NO: 1888198 - DNA, 13 bp, Homo sapiens
aggcctggcacag

SEQ ID NO: 1888199 - DNA, 14 bp, Homo sapiens
aggcctgggagggc

SEQ ID NO: 1888200 - DNA, 13 bp, Homo sapiens
aggcgcccctggg

SEQ ID NO: 1888201 - DNA, 14 bp, Homo sapiens
aggcgcccctgggg

SEQ ID NO: 1888202 - DNA, 18 bp, Homo sapiens
aggcgcccctggggtggg

SEQ ID NO: 1888203 - DNA, 17 bp, Homo sapiens
aggcgggggagcctgga

SEQ ID NO: 1888204 - DNA, 21 bp, Homo sapiens
aggcgggggagcctggagccc

SEQ ID NO: 1888205 - DNA, 22 bp, Homo sapiens
aggcgggggagcctggagcccc

SEQ ID NO: 1888206 - DNA, 18 bp, Homo sapiens
aggcgggggatcctggag

SEQ ID NO: 1888207 - DNA, 17 bp, Homo sapiens
aggctagatgtatgtac

SEQ ID NO: 1888208 - DNA, 13 bp, Homo sapiens
aggctatttaaaa

SEQ ID NO: 1888209 - DNA, 15 bp, Homo sapiens
aggctcccatgggct

SEQ ID NO: 1888210 - DNA, 13 bp, Homo sapiens
aggctggccagcc

SEQ ID NO: 1888211 - DNA, 17 bp, Homo sapiens
aggctggccagccccac

SEQ ID NO: 1888212 - DNA, 18 bp, Homo sapiens
aggctggccagccccaca

SEQ ID NO: 1888213 - DNA, 20 bp, Homo sapiens
aggctggccagccccacagc

SEQ ID NO: 1888214 - DNA, 17 bp, Homo sapiens
aggctggctggggccta

SEQ ID NO: 1888215 - DNA, 20 bp, Homo sapiens
aggcttcagttaccgctggc

SEQ ID NO: 1888216 - DNA, 23 bp, Homo sapiens
aggcttccacgtactgcagcctc

SEQ ID NO: 1888217 - DNA, 13 bp, Homo sapiens
agggaccacagca

SEQ ID NO: 1888218 - DNA, 14 bp, Homo sapiens
agggaggggaggtg

SEQ ID NO: 1888219 - DNA, 22 bp, Homo sapiens
agggatcctctctccaggcccc

SEQ ID NO: 1888220 - DNA, 13 bp, Homo sapiens
agggatctgggga

SEQ ID NO: 1888221 - DNA, 17 bp, Homo sapiens
agggatctggggaagga

SEQ ID NO: 1888222 - DNA, 18 bp, Homo sapiens
agggatctggggaaggac

SEQ ID NO: 1888223 - DNA, 18 bp, Homo sapiens
agggcccacccatgtcac

SEQ ID NO: 1888224 - DNA, 21 bp, Homo sapiens
agggcgaggcgggggatcctg

SEQ ID NO: 1888225 - DNA, 16 bp, Homo sapiens
aggggaattgaggaca

SEQ ID NO: 1888226 - DNA, 14 bp, Homo sapiens
aggggacgctggct

SEQ ID NO: 1888227 - DNA, 12 bp, Homo sapiens
aggggaggtggc

SEQ ID NO: 1888228 - DNA, 18 bp, Homo sapiens
aggggagtctgcttgtct

SEQ ID NO: 1888229 - DNA, 14 bp, Homo sapiens
aggggcaggcacag

SEQ ID NO: 1888230 - DNA, 16 bp, Homo sapiens
aggggcaggcacagca

SEQ ID NO: 1888231 - DNA, 16 bp, Homo sapiens
aggggcccgcttgcct

SEQ ID NO: 1888232 - DNA, 15 bp, Homo sapiens
aggggctcaggatat

SEQ ID NO: 1888233 - DNA, 12 bp, Homo sapiens
aggggctgcccg

SEQ ID NO: 1888234 - DNA, 17 bp, Homo sapiens
agggggccctggcttgg

SEQ ID NO: 1888235 - DNA, 18 bp, Homo sapiens
agggggccctggcttgga

SEQ ID NO: 1888236 - DNA, 20 bp, Homo sapiens
aggggtctccctgagcctgc

SEQ ID NO: 1888237 - DNA, 15 bp, Homo sapiens
agggtgcctgctctc

SEQ ID NO: 1888238 - DNA, 17 bp, Homo sapiens
agggtgcctgctctcct

SEQ ID NO: 1888239 - DNA, 14 bp, Homo sapiens
aggtaaataaagct

SEQ ID NO: 1888240 - DNA, 17 bp, Homo sapiens
aggtaaataaagctcaa

SEQ ID NO: 1888241 - DNA, 22 bp, Homo sapiens
aggtacctaggttggagtccag

SEQ ID NO: 1888242 - DNA, 23 bp, Homo sapiens
aggtcaatgacacccctggcctg

SEQ ID NO: 1888243 - DNA, 17 bp, Homo sapiens
aggtcctggggaggctg

SEQ ID NO: 1888244 - DNA, 18 bp, Homo sapiens
aggtctcctccaccgcca

SEQ ID NO: 1888245 - DNA, 17 bp, Homo sapiens
agtgtgccccccatcct

SEQ ID NO: 1888246 - DNA, 23 bp, Homo sapiens
agtgtgccccccatcctggccca

SEQ ID NO: 1888247 - DNA, 15 bp, Homo sapiens
agtgttaggcctggc

SEQ ID NO: 1888248 - DNA, 16 bp, Homo sapiens
agtgttaggcctggca

SEQ ID NO: 1888249 - DNA, 19 bp, Homo sapiens
agtgttaggcctggcacag

SEQ ID NO: 1888250 - DNA, 13 bp, Homo sapiens
agtgttctgagcc

SEQ ID NO: 1888251 - DNA, 14 bp, Homo sapiens
agtgttctgagccc

SEQ ID NO: 1888252 - DNA, 15 bp, Homo sapiens
agtgttctgagcccc

SEQ ID NO: 1888253 - DNA, 14 bp, Homo sapiens
agtgttggagaaga

SEQ ID NO: 1888254 - DNA, 18 bp, Homo sapiens
agtgttggagaagaactg

SEQ ID NO: 1888255 - DNA, 14 bp, Homo sapiens
agttatctgatttt

SEQ ID NO: 1888256 - DNA, 23 bp, Homo sapiens
agttcagttcctctttgcatgga

SEQ ID NO: 1888257 - DNA, 18 bp, Homo sapiens
agttcccagacagctttt

SEQ ID NO: 1888258 - DNA, 15 bp, Homo sapiens
agttcctctttgcat

SEQ ID NO: 1888259 - DNA, 13 bp, Homo sapiens
agttctgaagaag

SEQ ID NO: 1888260 - DNA, 14 bp, Homo sapiens
agttctgaagaaga

SEQ ID NO: 1888261 - DNA, 15 bp, Homo sapiens
agttctgaagaagat

SEQ ID NO: 1888262 - DNA, 18 bp, Homo sapiens
agttgaacactagtctgt

SEQ ID NO: 1888263 - DNA, 21 bp, Homo sapiens
agttgaacactagtctgtgta

SEQ ID NO: 1888264 - DNA, 14 bp, Homo sapiens
agttgcagttttta

SEQ ID NO: 1888265 - DNA, 14 bp, Homo sapiens
agttgtgatataaa

SEQ ID NO: 1888266 - DNA, 18 bp, Homo sapiens
agttgtgatataaaggac

SEQ ID NO: 1888267 - DNA, 17 bp, Homo sapiens
agttgtgtcataaatta

SEQ ID NO: 1888268 - DNA, 13 bp, Homo sapiens
agtttacagtaaa

SEQ ID NO: 1888269 - DNA, 16 bp, Homo sapiens
agtttatgtctaaaga

SEQ ID NO: 1888270 - DNA, 20 bp, Homo sapiens
agtttggtattgtaaaacat

SEQ ID NO: 1888271 - DNA, 21 bp, Homo sapiens
agtttgttcacttaaattctt

SEQ ID NO: 1888272 - DNA, 16 bp, Homo sapiens
agttttatatgcttct

SEQ ID NO: 1888273 - DNA, 17 bp, Homo sapiens
agtttttataatagatt

SEQ ID NO: 1888274 - DNA, 18 bp, Homo sapiens
ataaaaaatggtgcctga

SEQ ID NO: 1888275 - DNA, 19 bp, Homo sapiens
ataaaaacattttgaagtg

SEQ ID NO: 1888276 - DNA, 12 bp, Homo sapiens
ataaaataattt

SEQ ID NO: 1888277 - DNA, 21 bp, Homo sapiens
ataaaattgtaaaattgtata

SEQ ID NO: 1888278 - DNA, 21 bp, Homo sapiens
ataaacactccacagtgttta

SEQ ID NO: 1888279 - DNA, 14 bp, Homo sapiens
ataaacagttgtta

SEQ ID NO: 1888280 - DNA, 21 bp, Homo sapiens
ataaacttagaataaaattgt

SEQ ID NO: 1888281 - DNA, 18 bp, Homo sapiens
ataaaggaccctgtttct

SEQ ID NO: 1888282 - DNA, 14 bp, Homo sapiens
ataaattacacaat

SEQ ID NO: 1888283 - DNA, 19 bp, Homo sapiens
ataaattacacaataaagc

SEQ ID NO: 1888284 - DNA, 13 bp, Homo sapiens
ataaattgtttga

SEQ ID NO: 1888285 - DNA, 17 bp, Homo sapiens
ataaattgtttgaccat

SEQ ID NO: 1888286 - DNA, 15 bp, Homo sapiens
ataacaatgctgtat

SEQ ID NO: 1888287 - DNA, 15 bp, Homo sapiens
ataagatatttttca

SEQ ID NO: 1888288 - DNA, 20 bp, Homo sapiens
ataagcaaattagtaattgt

SEQ ID NO: 1888289 - DNA, 18 bp, Homo sapiens
ataagtttatttcttaaa

SEQ ID NO: 1888290 - DNA, 22 bp, Homo sapiens
ataagtttatttcttaaatcta

SEQ ID NO: 1888291 - DNA, 21 bp, Homo sapiens
ataatctttcacaggggacag

SEQ ID NO: 1888292 - DNA, 15 bp, Homo sapiens
ataatggttgtgaaa

SEQ ID NO: 1888293 - DNA, 19 bp, Homo sapiens
ataatggttgtgaaatgta

SEQ ID NO: 1888294 - DNA, 23 bp, Homo sapiens
ataatggttgtgaaatgtaacat

SEQ ID NO: 1888295 - DNA, 14 bp, Homo sapiens
ataattttgtgaag

SEQ ID NO: 1888296 - DNA, 15 bp, Homo sapiens
ataattttgtgaagc

SEQ ID NO: 1888297 - DNA, 14 bp, Homo sapiens
ataatttttatatt

SEQ ID NO: 1888298 - DNA, 19 bp, Homo sapiens
ataatttttatatttgaaa

SEQ ID NO: 1888299 - DNA, 22 bp, Homo sapiens
ataatttttatatttgaaatat

SEQ ID NO: 1888300 - DNA, 16 bp, Homo sapiens
atacagaattgactgc

SEQ ID NO: 1888301 - DNA, 20 bp, Homo sapiens
atacatcccttacctgggaa

SEQ ID NO: 1888302 - DNA, 19 bp, Homo sapiens
ataccagagtctggagctg

SEQ ID NO: 1888303 - DNA, 17 bp, Homo sapiens
atactggcctcgcctgg

SEQ ID NO: 1888304 - DNA, 12 bp, Homo sapiens
atactgtttctt

SEQ ID NO: 1888305 - DNA, 22 bp, Homo sapiens
atactgtttcttgcactgaata

SEQ ID NO: 1888306 - DNA, 13 bp, Homo sapiens
atacttgcagttg

SEQ ID NO: 1888307 - DNA, 12 bp, Homo sapiens
atagaatacatt

SEQ ID NO: 1888308 - DNA, 17 bp, Homo sapiens
atagatttgtattttaa

SEQ ID NO: 1888309 - DNA, 23 bp, Homo sapiens
atagatttgtattttaaaacata

SEQ ID NO: 1888310 - DNA, 16 bp, Homo sapiens
atagattttttttaaa

SEQ ID NO: 1888311 - DNA, 23 bp, Homo sapiens
atagattttttttaaagtttggt

SEQ ID NO: 1888312 - DNA, 14 bp, Homo sapiens
atagtcaaattgtg

SEQ ID NO: 1888313 - DNA, 17 bp, Homo sapiens
atagtcaaattgtgtga

SEQ ID NO: 1888314 - DNA, 18 bp, Homo sapiens
atagtcaaattgtgtgaa

SEQ ID NO: 1888315 - DNA, 16 bp, Homo sapiens
atagtgtaataatgtt

SEQ ID NO: 1888316 - DNA, 21 bp, Homo sapiens
atataaaagttgcgtttaagt

SEQ ID NO: 1888317 - DNA, 22 bp, Homo sapiens
atataaacactccacagtgttt

SEQ ID NO: 1888318 - DNA, 20 bp, Homo sapiens
atataaaggaccctgtttct

SEQ ID NO: 1888319 - DNA, 21 bp, Homo sapiens
atataaaggaccctgtttctg

SEQ ID NO: 1888320 - DNA, 15 bp, Homo sapiens
atataacaatgctgt

SEQ ID NO: 1888321 - DNA, 14 bp, Homo sapiens
atatataacaatgc

SEQ ID NO: 1888322 - DNA, 18 bp, Homo sapiens
atatataacaatgctgta

SEQ ID NO: 1888323 - DNA, 21 bp, Homo sapiens
atatatggtctgtgtgtctga

SEQ ID NO: 1888324 - DNA, 20 bp, Homo sapiens
atatatttgtaaaagatgaa

SEQ ID NO: 1888325 - DNA, 18 bp, Homo sapiens
atatcacttgtcaataaa

SEQ ID NO: 1888326 - DNA, 20 bp, Homo sapiens
atatgcttctgttttataat

SEQ ID NO: 1888327 - DNA, 21 bp, Homo sapiens
atatgtctgcaggtttctcct

SEQ ID NO: 1888328 - DNA, 14 bp, Homo sapiens
atattatgttaaaa

SEQ ID NO: 1888329 - DNA, 16 bp, Homo sapiens
atattatgttaaaact

SEQ ID NO: 1888330 - DNA, 22 bp, Homo sapiens
atattcactctgtggtccagag

SEQ ID NO: 1888331 - DNA, 13 bp, Homo sapiens
atattgggaagct

SEQ ID NO: 1888332 - DNA, 14 bp, Homo sapiens
atattgggaagctg

SEQ ID NO: 1888333 - DNA, 20 bp, Homo sapiens
atattgggaaggaaatatat

SEQ ID NO: 1888334 - DNA, 21 bp, Homo sapiens
atatttacatgaattgcattt

SEQ ID NO: 1888335 - DNA, 19 bp, Homo sapiens
atatttattactgtaagaa

SEQ ID NO: 1888336 - DNA, 22 bp, Homo sapiens
atatttgctggagtgctggctc

SEQ ID NO: 1888337 - DNA, 18 bp, Homo sapiens
atattttaagccttcatt

SEQ ID NO: 1888338 - DNA, 16 bp, Homo sapiens
atattttgattttaca

SEQ ID NO: 1888339 - DNA, 15 bp, Homo sapiens
atattttttaaagtc

SEQ ID NO: 1888340 - DNA, 14 bp, Homo sapiens
atcaaggagcctcc

SEQ ID NO: 1888341 - DNA, 16 bp, Homo sapiens
atcaagggtacactgc

SEQ ID NO: 1888342 - DNA, 21 bp, Homo sapiens
atcaagggtacactgccttct

SEQ ID NO: 1888343 - DNA, 13 bp, Homo sapiens
atcaatcaactta

SEQ ID NO: 1888344 - DNA, 13 bp, Homo sapiens
atcacttcttcca

SEQ ID NO: 1888345 - DNA, 15 bp, Homo sapiens
atcacttcttccact

SEQ ID NO: 1888346 - DNA, 16 bp, Homo sapiens
atcacttcttccactg

SEQ ID NO: 1888347 - DNA, 19 bp, Homo sapiens
atcacttcttccactgtgt

SEQ ID NO: 1888348 - DNA, 14 bp, Homo sapiens
atcagatgtgttcc

SEQ ID NO: 1888349 - DNA, 20 bp, Homo sapiens
atcagcaggctccagttgaa

SEQ ID NO: 1888350 - DNA, 16 bp, Homo sapiens
atcagcctacaggcct

SEQ ID NO: 1888351 - DNA, 19 bp, Homo sapiens
atcagggatcctctctcca

SEQ ID NO: 1888352 - DNA, 14 bp, Homo sapiens
atcagtgtgccccc

SEQ ID NO: 1888353 - DNA, 18 bp, Homo sapiens
atcatagacccatctgga

SEQ ID NO: 1888354 - DNA, 22 bp, Homo sapiens
atcattagagcttaaattgtca

SEQ ID NO: 1888355 - DNA, 23 bp, Homo sapiens
atcattcttatttcatgaaaatt

SEQ ID NO: 1888356 - DNA, 13 bp, Homo sapiens
atcattgcatttc

SEQ ID NO: 1888357 - DNA, 14 bp, Homo sapiens
atccatacatttgt

SEQ ID NO: 1888358 - DNA, 16 bp, Homo sapiens
atccccagctttctcc

SEQ ID NO: 1888359 - DNA, 14 bp, Homo sapiens
atcccccctcacca

SEQ ID NO: 1888360 - DNA, 22 bp, Homo sapiens
atccctggccccctccctggat

SEQ ID NO: 1888361 - DNA, 18 bp, Homo sapiens
atccgttcccttctgcca

SEQ ID NO: 1888362 - DNA, 22 bp, Homo sapiens
atcctaccacaatgcagtgcct

SEQ ID NO: 1888363 - DNA, 16 bp, Homo sapiens
atcctatctctccaac

SEQ ID NO: 1888364 - DNA, 22 bp, Homo sapiens
atcctctctccaggccccaggt

SEQ ID NO: 1888365 - DNA, 23 bp, Homo sapiens
acagtgactcgggctcctgtgcc

SEQ ID NO: 1888366 - DNA, 17 bp, Homo sapiens
acagtgttaggcctggc

SEQ ID NO: 1888367 - DNA, 14 bp, Homo sapiens
acagtgttctgagc

SEQ ID NO: 1888368 - DNA, 21 bp, Homo sapiens
acagttacctctgcctcagaa

SEQ ID NO: 1888369 - DNA, 22 bp, Homo sapiens
acataatggttgtgaaatgtaa

SEQ ID NO: 1888370 - DNA, 15 bp, Homo sapiens
acatctttgttttta

SEQ ID NO: 1888371 - DNA, 16 bp, Homo sapiens
acatgaagtccaagca

SEQ ID NO: 1888372 - DNA, 23 bp, Homo sapiens
acatgctggttacctgttccatt

SEQ ID NO: 1888373 - DNA, 21 bp, Homo sapiens
acatgggacatttgctcatgg

SEQ ID NO: 1888374 - DNA, 13 bp, Homo sapiens
acatgtgcctgta

SEQ ID NO: 1888375 - DNA, 15 bp, Homo sapiens
acatttgctcatgga

SEQ ID NO: 1888376 - DNA, 16 bp, Homo sapiens
acatttgctcatggaa

SEQ ID NO: 1888377 - DNA, 14 bp, Homo sapiens
acatttgtataaaa

SEQ ID NO: 1888378 - DNA, 16 bp, Homo sapiens
acatttgtataaaata

SEQ ID NO: 1888379 - DNA, 19 bp, Homo sapiens
acatttgtataaaataatt

SEQ ID NO: 1888380 - DNA, 12 bp, Homo sapiens
acattttgaagt

SEQ ID NO: 1888381 - DNA, 19 bp, Homo sapiens
accaacccagccgctgccc

SEQ ID NO: 1888382 - DNA, 23 bp, Homo sapiens
accaagctgtgccaccctgggct

SEQ ID NO: 1888383 - DNA, 18 bp, Homo sapiens
accaagcttaaggagagg

SEQ ID NO: 1888384 - DNA, 21 bp, Homo sapiens
accaagcttaaggagaggaga

SEQ ID NO: 1888385 - DNA, 15 bp, Homo sapiens
accaatcatgaatta

SEQ ID NO: 1888386 - DNA, 22 bp, Homo sapiens
accactatagtgtaataatgtt

SEQ ID NO: 1888387 - DNA, 17 bp, Homo sapiens
accagagtctggagctg

SEQ ID NO: 1888388 - DNA, 14 bp, Homo sapiens
accagcctctgctc

SEQ ID NO: 1888389 - DNA, 14 bp, Homo sapiens
accagctccactgg

SEQ ID NO: 1888390 - DNA, 19 bp, Homo sapiens
accagctccactggcctgc

SEQ ID NO: 1888391 - DNA, 16 bp, Homo sapiens
accaggacttgtgcag

SEQ ID NO: 1888392 - DNA, 21 bp, Homo sapiens
accagggatgatgcaacatcc

SEQ ID NO: 1888393 - DNA, 15 bp, Homo sapiens
accaggggcaggcac

SEQ ID NO: 1888394 - DNA, 16 bp, Homo sapiens
accaggggcaggcaca

SEQ ID NO: 1888395 - DNA, 19 bp, Homo sapiens
accaggtctcctccaccgc

SEQ ID NO: 1888396 - DNA, 23 bp, Homo sapiens
accagtgtgtggctttcagagcc

SEQ ID NO: 1888397 - DNA, 21 bp, Homo sapiens
accatgtaaagaacataaata

SEQ ID NO: 1888398 - DNA, 19 bp, Homo sapiens
accattgtctcagagcagg

SEQ ID NO: 1888399 - DNA, 14 bp, Homo sapiens
accatttaaaaatg

SEQ ID NO: 1888400 - DNA, 23 bp, Homo sapiens
acccaaccacatcccactcacaa

SEQ ID NO: 1888401 - DNA, 12 bp, Homo sapiens
acccatgccctg

SEQ ID NO: 1888402 - DNA, 13 bp, Homo sapiens
acccatgccctgc

SEQ ID NO: 1888403 - DNA, 12 bp, Homo sapiens
acccatgtcacc

SEQ ID NO: 1888404 - DNA, 22 bp, Homo sapiens
accccaggccataccaggtgct

SEQ ID NO: 1888405 - DNA, 17 bp, Homo sapiens
accccatctgcccagga

SEQ ID NO: 1888406 - DNA, 13 bp, Homo sapiens
acccccagcaccc

SEQ ID NO: 1888407 - DNA, 21 bp, Homo sapiens
acccccagcacccgggctcag

SEQ ID NO: 1888408 - DNA, 13 bp, Homo sapiens
acccccctgagag

SEQ ID NO: 1888409 - DNA, 19 bp, Homo sapiens
acccccgcccaggctggcc

SEQ ID NO: 1888410 - DNA, 21 bp, Homo sapiens
acccccgcccaggctggccag

SEQ ID NO: 1888411 - DNA, 14 bp, Homo sapiens
accccctcctgctg

SEQ ID NO: 1888412 - DNA, 12 bp, Homo sapiens
acccctcccagc

SEQ ID NO: 1888413 - DNA, 15 bp, Homo sapiens
acccctcccagctga

SEQ ID NO: 1888414 - DNA, 16 bp, Homo sapiens
acccctcccagctgac

SEQ ID NO: 1888415 - DNA, 14 bp, Homo sapiens
acccctcccctcca

SEQ ID NO: 1888416 - DNA, 20 bp, Homo sapiens
acccctcccctccatccctg

SEQ ID NO: 1888417 - DNA, 16 bp, Homo sapiens
acccgccttttataaa

SEQ ID NO: 1888418 - DNA, 15 bp, Homo sapiens
accctacacctctgg

SEQ ID NO: 1888419 - DNA, 13 bp, Homo sapiens
accctccctgctg

SEQ ID NO: 1888420 - DNA, 15 bp, Homo sapiens
accctccctgctgtc

SEQ ID NO: 1888421 - DNA, 20 bp, Homo sapiens
accctccctgctgtcccctc

SEQ ID NO: 1888422 - DNA, 21 bp, Homo sapiens
accctccctgctgtcccctct

SEQ ID NO: 1888423 - DNA, 14 bp, Homo sapiens
accctcgaggcgga

SEQ ID NO: 1888424 - DNA, 17 bp, Homo sapiens
accctgggctctgtggg

SEQ ID NO: 1888425 - DNA, 20 bp, Homo sapiens
accctgggctctgtgggctg

SEQ ID NO: 1888426 - DNA, 17 bp, Homo sapiens
accctgtttctgtagaa

SEQ ID NO: 1888427 - DNA, 13 bp, Homo sapiens
acccttggacttg

SEQ ID NO: 1888428 - DNA, 14 bp, Homo sapiens
accgcatgccccct

SEQ ID NO: 1888429 - DNA, 22 bp, Homo sapiens
accggtcagtgccttttggaac

SEQ ID NO: 1888430 - DNA, 17 bp, Homo sapiens
acctagtggctgtccag

SEQ ID NO: 1888431 - DNA, 19 bp, Homo sapiens
acctagtggctgtccagtg

SEQ ID NO: 1888432 - DNA, 21 bp, Homo sapiens
acctagtggctgtccagtgcc

SEQ ID NO: 1888433 - DNA, 23 bp, Homo sapiens
acctagtggctgtccagtgccca

SEQ ID NO: 1888434 - DNA, 17 bp, Homo sapiens
acctcaccaagctgctg

SEQ ID NO: 1888435 - DNA, 16 bp, Homo sapiens
acctccagctctcagt

SEQ ID NO: 1888436 - DNA, 18 bp, Homo sapiens
acctctaatttattttgt

SEQ ID NO: 1888437 - DNA, 10 bp, Homo sapiens
acctctgagg

SEQ ID NO: 1888438 - DNA, 17 bp, Homo sapiens
acctctgcctcagaaaa

SEQ ID NO: 1888439 - DNA, 15 bp, Homo sapiens
acctctgggccctgc

SEQ ID NO: 1888440 - DNA, 21 bp, Homo sapiens
acctctgtatttgaatcagcc

SEQ ID NO: 1888441 - DNA, 13 bp, Homo sapiens
acctgtcatctgg

SEQ ID NO: 1888442 - DNA, 21 bp, Homo sapiens
accttctcaaaagattgtttt

SEQ ID NO: 1888443 - DNA, 20 bp, Homo sapiens
accttttggtctggagggaa

SEQ ID NO: 1888444 - DNA, 20 bp, Homo sapiens
acgaggtggtagctctgagc

SEQ ID NO: 1888445 - DNA, 20 bp, Homo sapiens
acgccttttcttggttcttt

SEQ ID NO: 1888446 - DNA, 22 bp, Homo sapiens
acgccttttcttggttcttttt

SEQ ID NO: 1888447 - DNA, 14 bp, Homo sapiens
acggatggaaggag

SEQ ID NO: 1888448 - DNA, 15 bp, Homo sapiens
acggggccggccagg

SEQ ID NO: 1888449 - DNA, 15 bp, Homo sapiens
acgtcctgtcagtgc

SEQ ID NO: 1888450 - DNA, 18 bp, Homo sapiens
acgtcctgtcagtgccgc

SEQ ID NO: 1888451 - DNA, 21 bp, Homo sapiens
acgtcctgtcagtgccgccgc

SEQ ID NO: 1888452 - DNA, 22 bp, Homo sapiens
acgtggcttgtagaatttttaa

SEQ ID NO: 1888453 - DNA, 13 bp, Homo sapiens
acgtgggagaggc

SEQ ID NO: 1888454 - DNA, 14 bp, Homo sapiens
acgtgggagaggca

SEQ ID NO: 1888455 - DNA, 18 bp, Homo sapiens
acgtgtatgtttcttctt

SEQ ID NO: 1888456 - DNA, 13 bp, Homo sapiens
acgttgctcccca

SEQ ID NO: 1888457 - DNA, 22 bp, Homo sapiens
actaaagttagaaagttgattt

SEQ ID NO: 1888458 - DNA, 18 bp, Homo sapiens
actaacaaccaaagacta

SEQ ID NO: 1888459 - DNA, 13 bp, Homo sapiens
actaagagagaat

SEQ ID NO: 1888460 - DNA, 21 bp, Homo sapiens
actaataaaaaactgtgaacc

SEQ ID NO: 1888461 - DNA, 18 bp, Homo sapiens
actatagtgtaataatgt

SEQ ID NO: 1888462 - DNA, 17 bp, Homo sapiens
actatctcatttccaag

SEQ ID NO: 1888463 - DNA, 14 bp, Homo sapiens
actatgcgttttta

SEQ ID NO: 1888464 - DNA, 16 bp, Homo sapiens
actcaccagcctctgc

SEQ ID NO: 1888465 - DNA, 11 bp, Homo sapiens
actcagtgttg

SEQ ID NO: 1888466 - DNA, 14 bp, Homo sapiens
actccagaaagtga

SEQ ID NO: 1888467 - DNA, 14 bp, Homo sapiens
actccatgttggct

SEQ ID NO: 1888468 - DNA, 14 bp, Homo sapiens
actcctttctcatc

SEQ ID NO: 1888469 - DNA, 14 bp, Homo sapiens
actcgggctcctgt

SEQ ID NO: 1888470 - DNA, 13 bp, Homo sapiens
actctacactgaa

SEQ ID NO: 1888471 - DNA, 14 bp, Homo sapiens
actctacactgaaa

SEQ ID NO: 1888472 - DNA, 20 bp, Homo sapiens
actctatagttattgtttta

SEQ ID NO: 1888473 - DNA, 16 bp, Homo sapiens
actctgcataccctca

SEQ ID NO: 1888474 - DNA, 12 bp, Homo sapiens
actctgtgccca

SEQ ID NO: 1888475 - DNA, 15 bp, Homo sapiens
actctgtgcccatgg

SEQ ID NO: 1888476 - DNA, 23 bp, Homo sapiens
actctgtgcccatgggcactgct

SEQ ID NO: 1888477 - DNA, 13 bp, Homo sapiens
actctgtgctgag

SEQ ID NO: 1888478 - DNA, 17 bp, Homo sapiens
actctgtggtccagagt

SEQ ID NO: 1888479 - DNA, 14 bp, Homo sapiens
actcttaagaagac

SEQ ID NO: 1888480 - DNA, 20 bp, Homo sapiens
actcttcccccactcctctt

SEQ ID NO: 1888481 - DNA, 13 bp, Homo sapiens
actctttttgtac

SEQ ID NO: 1888482 - DNA, 20 bp, Homo sapiens
actctttttgtacctggtga

SEQ ID NO: 1888483 - DNA, 18 bp, Homo sapiens
actgaatatataaacact

SEQ ID NO: 1888484 - DNA, 20 bp, Homo sapiens
actgactcttaagaagactg

SEQ ID NO: 1888485 - DNA, 15 bp, Homo sapiens
actgcaccccctcct

SEQ ID NO: 1888486 - DNA, 10 bp, Homo sapiens
agctgctata

SEQ ID NO: 1888487 - DNA, 17 bp, Homo sapiens
agctggctgtactgcca

SEQ ID NO: 1888488 - DNA, 19 bp, Homo sapiens
agctgtaaaaagagagaaa

SEQ ID NO: 1888489 - DNA, 16 bp, Homo sapiens
agctgtagaggaccag

SEQ ID NO: 1888490 - DNA, 17 bp, Homo sapiens
agctgtatgattcccag

SEQ ID NO: 1888491 - DNA, 18 bp, Homo sapiens
agctgtatgattcccagc

SEQ ID NO: 1888492 - DNA, 13 bp, Homo sapiens
agctgtctcagga

SEQ ID NO: 1888493 - DNA, 12 bp, Homo sapiens
agctgtgccacc

SEQ ID NO: 1888494 - DNA, 20 bp, Homo sapiens
agctgtgccaccctgggctc

SEQ ID NO: 1888495 - DNA, 20 bp, Homo sapiens
agctgtgccctattgtgtgg

SEQ ID NO: 1888496 - DNA, 17 bp, Homo sapiens
agcttaaggagaggaga

SEQ ID NO: 1888497 - DNA, 13 bp, Homo sapiens
agcttcagttgtt

SEQ ID NO: 1888498 - DNA, 14 bp, Homo sapiens
agcttcagttgttc

SEQ ID NO: 1888499 - DNA, 19 bp, Homo sapiens
agcttcagttgttttcccg

SEQ ID NO: 1888500 - DNA, 12 bp, Homo sapiens
agcttctccaac

SEQ ID NO: 1888501 - DNA, 23 bp, Homo sapiens
agcttgatctgtgatttcttctc

SEQ ID NO: 1888502 - DNA, 20 bp, Homo sapiens
agcttgcagtccgttgctga

SEQ ID NO: 1888503 - DNA, 13 bp, Homo sapiens
agctttaaatcat

SEQ ID NO: 1888504 - DNA, 16 bp, Homo sapiens
agctttaaatcattag

SEQ ID NO: 1888505 - DNA, 21 bp, Homo sapiens
agctttccggggaggagcctt

SEQ ID NO: 1888506 - DNA, 17 bp, Homo sapiens
agctttctcctctgcta

SEQ ID NO: 1888507 - DNA, 12 bp, Homo sapiens
agctttgttctt

SEQ ID NO: 1888508 - DNA, 18 bp, Homo sapiens
agctttgttcttcttaaa

SEQ ID NO: 1888509 - DNA, 17 bp, Homo sapiens
aggaaaagcctctgtgt

SEQ ID NO: 1888510 - DNA, 13 bp, Homo sapiens
aggaaagagaact

SEQ ID NO: 1888511 - DNA, 13 bp, Homo sapiens
aggaaatatttat

SEQ ID NO: 1888512 - DNA, 14 bp, Homo sapiens
aggaagcagccaag

SEQ ID NO: 1888513 - DNA, 18 bp, Homo sapiens
aggaagggcatccttctg

SEQ ID NO: 1888514 - DNA, 23 bp, Homo sapiens
aggacagcccttctttccacaga

SEQ ID NO: 1888515 - DNA, 22 bp, Homo sapiens
aggaccaaagggggccctggct

SEQ ID NO: 1888516 - DNA, 19 bp, Homo sapiens
aggaccaagcttaaggaga

SEQ ID NO: 1888517 - DNA, 23 bp, Homo sapiens
aggaccaagcttaaggagaggag

SEQ ID NO: 1888518 - DNA, 22 bp, Homo sapiens
aggacttgcttccaagcccttc

SEQ ID NO: 1888519 - DNA, 16 bp, Homo sapiens
aggactttagggatct

SEQ ID NO: 1888520 - DNA, 20 bp, Homo sapiens
aggactttatagatcagcca

SEQ ID NO: 1888521 - DNA, 23 bp, Homo sapiens
aggagagactggccagaggcagc

SEQ ID NO: 1888522 - DNA, 18 bp, Homo sapiens
aggagagcatctgctctg

SEQ ID NO: 1888523 - DNA, 20 bp, Homo sapiens
aggagagcatctgctctgag

SEQ ID NO: 1888524 - DNA, 18 bp, Homo sapiens
aggagaggagagcatctg

SEQ ID NO: 1888525 - DNA, 23 bp, Homo sapiens
aggagagtacccccctgagagca

SEQ ID NO: 1888526 - DNA, 16 bp, Homo sapiens
aggagccacctgggct

SEQ ID NO: 1888527 - DNA, 21 bp, Homo sapiens
aggagccacctgggctgggag

SEQ ID NO: 1888528 - DNA, 14 bp, Homo sapiens
aggaggcctgggag

SEQ ID NO: 1888529 - DNA, 15 bp, Homo sapiens
aggaggcctgggagg

SEQ ID NO: 1888530 - DNA, 18 bp, Homo sapiens
aggaggcctgggagggca

SEQ ID NO: 1888531 - DNA, 20 bp, Homo sapiens
aggaggcggaggttgcagtg

SEQ ID NO: 1888532 - DNA, 13 bp, Homo sapiens
aggaggctggctg

SEQ ID NO: 1888533 - DNA, 15 bp, Homo sapiens
aggaggtgccaacag

SEQ ID NO: 1888534 - DNA, 16 bp, Homo sapiens
aggaggtgccaacagt

SEQ ID NO: 1888535 - DNA, 15 bp, Homo sapiens
aggagtgacatgaag

SEQ ID NO: 1888536 - DNA, 17 bp, Homo sapiens
aggatattcactctgtg

SEQ ID NO: 1888537 - DNA, 17 bp, Homo sapiens
aggatggagccagctct

SEQ ID NO: 1888538 - DNA, 23 bp, Homo sapiens
aggatggttcccttgatgaagaa

SEQ ID NO: 1888539 - DNA, 20 bp, Homo sapiens
aggatgtggaaacctccttc

SEQ ID NO: 1888540 - DNA, 19 bp, Homo sapiens
aggattgtacgtgggagag

SEQ ID NO: 1888541 - DNA, 12 bp, Homo sapiens
aggcacagcaca

SEQ ID NO: 1888542 - DNA, 20 bp, Homo sapiens
aggcagctctaaatgtcaat

SEQ ID NO: 1888543 - DNA, 14 bp, Homo sapiens
aggcagggatttga

SEQ ID NO: 1888544 - DNA, 15 bp, Homo sapiens
aggcagggatttgag

SEQ ID NO: 1888545 - DNA, 15 bp, Homo sapiens
aggcaggggagtctg

SEQ ID NO: 1888546 - DNA, 18 bp, Homo sapiens
aggcaggggagtctgctt

SEQ ID NO: 1888547 - DNA, 19 bp, Homo sapiens
aggcagtgggtcccacttc

SEQ ID NO: 1888548 - DNA, 15 bp, Homo sapiens
aggccaccctgcctc

SEQ ID NO: 1888549 - DNA, 18 bp, Homo sapiens
aggccataccaggtgcta

SEQ ID NO: 1888550 - DNA, 13 bp, Homo sapiens
aggccctgcactg

SEQ ID NO: 1888551 - DNA, 23 bp, Homo sapiens
aagtactcctcacttttcaattt

SEQ ID NO: 1888552 - DNA, 18 bp, Homo sapiens
aagtcaatgttttcagtt

SEQ ID NO: 1888553 - DNA, 18 bp, Homo sapiens
aagtcaggtgcagtccca

SEQ ID NO: 1888554 - DNA, 14 bp, Homo sapiens
aagtcggttagtgg

SEQ ID NO: 1888555 - DNA, 13 bp, Homo sapiens
aagtctaaagttt

SEQ ID NO: 1888556 - DNA, 14 bp, Homo sapiens
aagtctaaagttta

SEQ ID NO: 1888557 - DNA, 15 bp, Homo sapiens
aagtctaaagtttac

SEQ ID NO: 1888558 - DNA, 17 bp, Homo sapiens
aagtctaaagtttacag

SEQ ID NO: 1888559 - DNA, 19 bp, Homo sapiens
aagtctaaagtttacagta

SEQ ID NO: 1888560 - DNA, 22 bp, Homo sapiens
aagtctgtgagattcattcatg

SEQ ID NO: 1888561 - DNA, 13 bp, Homo sapiens
aagtgattgtatg

SEQ ID NO: 1888562 - DNA, 14 bp, Homo sapiens
aagtgcaaggacca

SEQ ID NO: 1888563 - DNA, 18 bp, Homo sapiens
aagtgcagtcatttgtgg

SEQ ID NO: 1888564 - DNA, 17 bp, Homo sapiens
aagtgggtaggccttgg

SEQ ID NO: 1888565 - DNA, 22 bp, Homo sapiens
aagttgatatgccttttcccaa

SEQ ID NO: 1888566 - DNA, 19 bp, Homo sapiens
aagtttacagtaaataaat

SEQ ID NO: 1888567 - DNA, 18 bp, Homo sapiens
aagtttggtattgtaaaa

SEQ ID NO: 1888568 - DNA, 14 bp, Homo sapiens
aataaaatcctgct

SEQ ID NO: 1888569 - DNA, 17 bp, Homo sapiens
aataaacttagaataaa

SEQ ID NO: 1888570 - DNA, 16 bp, Homo sapiens
aataaagcagtcctgt

SEQ ID NO: 1888571 - DNA, 14 bp, Homo sapiens
aataaggttgaaca

SEQ ID NO: 1888572 - DNA, 12 bp, Homo sapiens
aataatgtttca

SEQ ID NO: 1888573 - DNA, 19 bp, Homo sapiens
aataatgtttcaaacatat

SEQ ID NO: 1888574 - DNA, 20 bp, Homo sapiens
aataatttttatatttgaaa

SEQ ID NO: 1888575 - DNA, 23 bp, Homo sapiens
aataccacaggaaccacaagact

SEQ ID NO: 1888576 - DNA, 21 bp, Homo sapiens
aatacccatgtctacacagat

SEQ ID NO: 1888577 - DNA, 13 bp, Homo sapiens
aatacttgcagtt

SEQ ID NO: 1888578 - DNA, 15 bp, Homo sapiens
aatacttgcagttgt

SEQ ID NO: 1888579 - DNA, 13 bp, Homo sapiens
aatagaatgatag

SEQ ID NO: 1888580 - DNA, 13 bp, Homo sapiens
aatatataaacac

SEQ ID NO: 1888581 - DNA, 15 bp, Homo sapiens
aatatataaacactc

SEQ ID NO: 1888582 - DNA, 12 bp, Homo sapiens
aatatatttgta

SEQ ID NO: 1888583 - DNA, 17 bp, Homo sapiens
aatatatttgtaaaaga

SEQ ID NO: 1888584 - DNA, 12 bp, Homo sapiens
aatatcacttgt

SEQ ID NO: 1888585 - DNA, 24 bp, Homo sapiens
aatatgccccattcaacatctagt

SEQ ID NO: 1888586 - DNA, 14 bp, Homo sapiens
aatatttcagataa

SEQ ID NO: 1888587 - DNA, 15 bp, Homo sapiens
aatatttcagataat

SEQ ID NO: 1888588 - DNA, 20 bp, Homo sapiens
aatattttgctagtttttga

SEQ ID NO: 1888589 - DNA, 18 bp, Homo sapiens
aatattttttcttttcta

SEQ ID NO: 1888590 - DNA, 21 bp, Homo sapiens
aatcagggttagtattgtcca

SEQ ID NO: 1888591 - DNA, 15 bp, Homo sapiens
aatcatgaattagtt

SEQ ID NO: 1888592 - DNA, 23 bp, Homo sapiens
aatcatgaattagttttatatgc

SEQ ID NO: 1888593 - DNA, 14 bp, Homo sapiens
aatcattagagctt

SEQ ID NO: 1888594 - DNA, 13 bp, Homo sapiens
aatccatacattt

SEQ ID NO: 1888595 - DNA, 13 bp, Homo sapiens
aatccttgaagat

SEQ ID NO: 1888596 - DNA, 17 bp, Homo sapiens
aatctattttgtaactt

SEQ ID NO: 1888597 - DNA, 12 bp, Homo sapiens
aatctgtttgtg

SEQ ID NO: 1888598 - DNA, 19 bp, Homo sapiens
aatctgtttgtgcaaacat

SEQ ID NO: 1888599 - DNA, 15 bp, Homo sapiens
aatgaaatgtttttg

SEQ ID NO: 1888600 - DNA, 18 bp, Homo sapiens
aatgacatcaccacagtt

SEQ ID NO: 1888601 - DNA, 14 bp, Homo sapiens
aatgaccagcagca

SEQ ID NO: 1888602 - DNA, 22 bp, Homo sapiens
aatgagagacacactgaagaag

SEQ ID NO: 1888603 - DNA, 14 bp, Homo sapiens
aatgataactggaa

SEQ ID NO: 1888604 - DNA, 22 bp, Homo sapiens
aatgattataagccctgcataa

SEQ ID NO: 1888605 - DNA, 23 bp, Homo sapiens
aatgattatgaattacatttgta

SEQ ID NO: 1888606 - DNA, 18 bp, Homo sapiens
aatggtgttacattaaag

SEQ ID NO: 1888607 - DNA, 16 bp, Homo sapiens
aatgtaacatgaagca

SEQ ID NO: 1888608 - DNA, 17 bp, Homo sapiens
aatgtaacatgaagcaa

SEQ ID NO: 1888609 - DNA, 16 bp, Homo sapiens
aatgtctgacacatta

SEQ ID NO: 1888610 - DNA, 17 bp, Homo sapiens
aatgtctgacacattaa

SEQ ID NO: 1888611 - DNA, 18 bp, Homo sapiens
aatgtctgacacattaat

SEQ ID NO: 1888612 - DNA, 15 bp, Homo sapiens
aatgttaagctttat

SEQ ID NO: 1888613 - DNA, 18 bp, Homo sapiens
aatgttgacatgggacat

SEQ ID NO: 1888614 - DNA, 17 bp, Homo sapiens
aattaaatccaataaaa

SEQ ID NO: 1888615 - DNA, 22 bp, Homo sapiens
aattacctgtcatctgggccac

SEQ ID NO: 1888616 - DNA, 18 bp, Homo sapiens
aattacgtttaaagtgca

SEQ ID NO: 1888617 - DNA, 17 bp, Homo sapiens
aattagttttatatgct

SEQ ID NO: 1888618 - DNA, 21 bp, Homo sapiens
aattattgtacatttatagtt

SEQ ID NO: 1888619 - DNA, 22 bp, Homo sapiens
aattcatataaaagttgcgttt

SEQ ID NO: 1888620 - DNA, 22 bp, Homo sapiens
aattctttcacttgatgtttgt

SEQ ID NO: 1888621 - DNA, 18 bp, Homo sapiens
aattgaggacactgatat

SEQ ID NO: 1888622 - DNA, 22 bp, Homo sapiens
aattgctttaccttttttctta

SEQ ID NO: 1888623 - DNA, 18 bp, Homo sapiens
aattgtaaaattgtatag

SEQ ID NO: 1888624 - DNA, 13 bp, Homo sapiens
aattgtatagaga

SEQ ID NO: 1888625 - DNA, 17 bp, Homo sapiens
aattgtctaaaatgtca

SEQ ID NO: 1888626 - DNA, 18 bp, Homo sapiens
aattgtctaaaatgtcag

SEQ ID NO: 1888627 - DNA, 23 bp, Homo sapiens
aattgtgtgaaaggtacttcaaa

SEQ ID NO: 1888628 - DNA, 20 bp, Homo sapiens
aatttaatgtattaatctgt

SEQ ID NO: 1888629 - DNA, 20 bp, Homo sapiens
aatttaggtaaataaagctc

SEQ ID NO: 1888630 - DNA, 17 bp, Homo sapiens
aatttgtatctgaagga

SEQ ID NO: 1888631 - DNA, 19 bp, Homo sapiens
aatttgtatctgaaggaga

SEQ ID NO: 1888632 - DNA, 20 bp, Homo sapiens
aatttgtatctgaaggagat

SEQ ID NO: 1888633 - DNA, 22 bp, Homo sapiens
aattttttctctaggaaatatt

SEQ ID NO: 1888634 - DNA, 22 bp, Homo sapiens
acaaaagtttcatccttttcat

SEQ ID NO: 1888635 - DNA, 14 bp, Homo sapiens
acaaagaggacacc

SEQ ID NO: 1888636 - DNA, 18 bp, Homo sapiens
acaaaggcttattaattt

SEQ ID NO: 1888637 - DNA, 17 bp, Homo sapiens
acaacaaagaggacacc

SEQ ID NO: 1888638 - DNA, 14 bp, Homo sapiens
acaatgctgtattt

SEQ ID NO: 1888639 - DNA, 14 bp, Homo sapiens
acacaactatattg

SEQ ID NO: 1888640 - DNA, 22 bp, Homo sapiens
acacacaaattatcttaaaact

SEQ ID NO: 1888641 - DNA, 11 bp, Homo sapiens
acacactcggg

SEQ ID NO: 1888642 - DNA, 14 bp, Homo sapiens
acacactgaagaag

SEQ ID NO: 1888643 - DNA, 14 bp, Homo sapiens
acacattaatgaat

SEQ ID NO: 1888644 - DNA, 21 bp, Homo sapiens
acaccaagctgtgccaccctg

SEQ ID NO: 1888645 - DNA, 18 bp, Homo sapiens
acacccttggacttgagg

SEQ ID NO: 1888646 - DNA, 15 bp, Homo sapiens
acacctctgggccct

SEQ ID NO: 1888647 - DNA, 22 bp, Homo sapiens
acacctctgggccctgcaggag

SEQ ID NO: 1888648 - DNA, 18 bp, Homo sapiens
acactagtctgtgtaact

SEQ ID NO: 1888649 - DNA, 17 bp, Homo sapiens
acactcgggttaagaaa

SEQ ID NO: 1888650 - DNA, 18 bp, Homo sapiens
acactcgggttaagaaat

SEQ ID NO: 1888651 - DNA, 19 bp, Homo sapiens
acactgcggggcttggctg

SEQ ID NO: 1888652 - DNA, 13 bp, Homo sapiens
acactgttttcct

SEQ ID NO: 1888653 - DNA, 17 bp, Homo sapiens
acacttcagcctgtgca

SEQ ID NO: 1888654 - DNA, 13 bp, Homo sapiens
acagaacactaaa

SEQ ID NO: 1888655 - DNA, 15 bp, Homo sapiens
acagaagcagctctt

SEQ ID NO: 1888656 - DNA, 19 bp, Homo sapiens
acagaattgactgcagttg

SEQ ID NO: 1888657 - DNA, 14 bp, Homo sapiens
acagacctttgaac

SEQ ID NO: 1888658 - DNA, 17 bp, Homo sapiens
acagcaaggaggctggc

SEQ ID NO: 1888659 - DNA, 20 bp, Homo sapiens
acagcaaggaggctggctgg

SEQ ID NO: 1888660 - DNA, 17 bp, Homo sapiens
acagcccacgtcctgtc

SEQ ID NO: 1888661 - DNA, 19 bp, Homo sapiens
acagcccacgtcctgtcag

SEQ ID NO: 1888662 - DNA, 20 bp, Homo sapiens
acagcccacgtcctgtcagt

SEQ ID NO: 1888663 - DNA, 15 bp, Homo sapiens
acagccctcccgccc

SEQ ID NO: 1888664 - DNA, 14 bp, Homo sapiens
acagctgtatgatt

SEQ ID NO: 1888665 - DNA, 22 bp, Homo sapiens
acaggaaccacaagactgcaca

SEQ ID NO: 1888666 - DNA, 22 bp, Homo sapiens
acaggatggttcccttgatgaa

SEQ ID NO: 1888667 - DNA, 12 bp, Homo sapiens
acaggcccagag

SEQ ID NO: 1888668 - DNA, 14 bp, Homo sapiens
acaggggctcagga

SEQ ID NO: 1888669 - DNA, 13 bp, Homo sapiens
acagtaaataaat

SEQ ID NO: 1888670 - DNA, 18 bp, Homo sapiens
acagtaaataaattgttt

SEQ ID NO: 1888671 - DNA, 21 bp, Homo sapiens
acagtatatgtcatgcctcac

SEQ ID NO: 1888672 - DNA, 16 bp, Homo sapiens
aaaaacattttgaagt

SEQ ID NO: 1888673 - DNA, 22 bp, Homo sapiens
aaaaaccttgtatatcttgttt

SEQ ID NO: 1888674 - DNA, 20 bp, Homo sapiens
aaaaatgttctattttaatt

SEQ ID NO: 1888675 - DNA, 20 bp, Homo sapiens
aaaacaaaaacgccttttct

SEQ ID NO: 1888676 - DNA, 21 bp, Homo sapiens
aaaactcttatggccaaattc

SEQ ID NO: 1888677 - DNA, 16 bp, Homo sapiens
aaaagaaaacatttaa

SEQ ID NO: 1888678 - DNA, 20 bp, Homo sapiens
aaaagaccacagacttctgg

SEQ ID NO: 1888679 - DNA, 19 bp, Homo sapiens
aaaaggttttattttgtaa

SEQ ID NO: 1888680 - DNA, 19 bp, Homo sapiens
aaaagtatgttagtgcaaa

SEQ ID NO: 1888681 - DNA, 22 bp, Homo sapiens
aaaagtgatcttaggtttgttt

SEQ ID NO: 1888682 - DNA, 16 bp, Homo sapiens
aaaataatttttatat

SEQ ID NO: 1888683 - DNA, 17 bp, Homo sapiens
aaaataatttttatatt

SEQ ID NO: 1888684 - DNA, 21 bp, Homo sapiens
aaaataatttttatatttgaa

SEQ ID NO: 1888685 - DNA, 23 bp, Homo sapiens
aaaataatttttatatttgaaat

SEQ ID NO: 1888686 - DNA, 12 bp, Homo sapiens
aaaatactttga

SEQ ID NO: 1888687 - DNA, 18 bp, Homo sapiens
aaaatactttgattttta

SEQ ID NO: 1888688 - DNA, 15 bp, Homo sapiens
aaaatgaaatgtttt

SEQ ID NO: 1888689 - DNA, 17 bp, Homo sapiens
aaaatgaaatgtttttg

SEQ ID NO: 1888690 - DNA, 14 bp, Homo sapiens
aaaatggtgcctga

SEQ ID NO: 1888691 - DNA, 13 bp, Homo sapiens
aaaattgtataga

SEQ ID NO: 1888692 - DNA, 16 bp, Homo sapiens
aaaattgtatagagat

SEQ ID NO: 1888693 - DNA, 12 bp, Homo sapiens
aaacaacttgtg

SEQ ID NO: 1888694 - DNA, 17 bp, Homo sapiens
aaacaaggatgaattaa

SEQ ID NO: 1888695 - DNA, 20 bp, Homo sapiens
aaacactccacagtgtttat

SEQ ID NO: 1888696 - DNA, 13 bp, Homo sapiens
aaaccctcgaggc

SEQ ID NO: 1888697 - DNA, 16 bp, Homo sapiens
aaactggggcctccct

SEQ ID NO: 1888698 - DNA, 22 bp, Homo sapiens
aaacttagaataaaattgtaaa

SEQ ID NO: 1888699 - DNA, 12 bp, Homo sapiens
aaacttatttga

SEQ ID NO: 1888700 - DNA, 13 bp, Homo sapiens
aaagaaacatttg

SEQ ID NO: 1888701 - DNA, 18 bp, Homo sapiens
aaagagagaaaacttatt

SEQ ID NO: 1888702 - DNA, 13 bp, Homo sapiens
aaagaggacacca

SEQ ID NO: 1888703 - DNA, 21 bp, Homo sapiens
aaagataaattatatcaattt

SEQ ID NO: 1888704 - DNA, 18 bp, Homo sapiens
aaagatagtatcttttaa

SEQ ID NO: 1888705 - DNA, 20 bp, Homo sapiens
aaagatgaaggctgtatcta

SEQ ID NO: 1888706 - DNA, 19 bp, Homo sapiens
aaagcagtcctgttcaaat

SEQ ID NO: 1888707 - DNA, 23 bp, Homo sapiens
aaagccagttggcttctgtgcct

SEQ ID NO: 1888708 - DNA, 13 bp, Homo sapiens
aaagcccaacaca

SEQ ID NO: 1888709 - DNA, 15 bp, Homo sapiens
aaaggaccctgtttc

SEQ ID NO: 1888710 - DNA, 18 bp, Homo sapiens
aaaggaccctgtttctgt

SEQ ID NO: 1888711 - DNA, 18 bp, Homo sapiens
aaagtatgttagtgcaaa

SEQ ID NO: 1888712 - DNA, 17 bp, Homo sapiens
aaagtctattgtttgtt

SEQ ID NO: 1888713 - DNA, 16 bp, Homo sapiens
aaagtgcagtcatttg

SEQ ID NO: 1888714 - DNA, 19 bp, Homo sapiens
aaagtgtgtgtgttctgta

SEQ ID NO: 1888715 - DNA, 18 bp, Homo sapiens
aaagtttggtattgtaaa

SEQ ID NO: 1888716 - DNA, 11 bp, Homo sapiens
aaagtttgttg

SEQ ID NO: 1888717 - DNA, 16 bp, Homo sapiens
aaataaacagttgtta

SEQ ID NO: 1888718 - DNA, 11 bp, Homo sapiens
aaataaagctc

SEQ ID NO: 1888719 - DNA, 11 bp, Homo sapiens
aaataaagtct

SEQ ID NO: 1888720 - DNA, 23 bp, Homo sapiens
aaataagacggatttatttttcc

SEQ ID NO: 1888721 - DNA, 18 bp, Homo sapiens
aaataatttttatatttg

SEQ ID NO: 1888722 - DNA, 20 bp, Homo sapiens
aaataatttttatatttgaa

SEQ ID NO: 1888723 - DNA, 17 bp, Homo sapiens
aaatacttgcagttgtg

SEQ ID NO: 1888724 - DNA, 15 bp, Homo sapiens
aaatactttgatttt

SEQ ID NO: 1888725 - DNA, 21 bp, Homo sapiens
aaatagccctgcaaaaattca

SEQ ID NO: 1888726 - DNA, 22 bp, Homo sapiens
aaatatcacttgtcaataaaat

SEQ ID NO: 1888727 - DNA, 20 bp, Homo sapiens
aaatatttattttaataatg

SEQ ID NO: 1888728 - DNA, 21 bp, Homo sapiens
aaatattttttcttttctatt

SEQ ID NO: 1888729 - DNA, 22 bp, Homo sapiens
aaatgattataagccctgcata

SEQ ID NO: 1888730 - DNA, 19 bp, Homo sapiens
aaatggcttcctggcaata

SEQ ID NO: 1888731 - DNA, 16 bp, Homo sapiens
aaatggtgttacatta

SEQ ID NO: 1888732 - DNA, 13 bp, Homo sapiens
aaatgtaacatga

SEQ ID NO: 1888733 - DNA, 19 bp, Homo sapiens
aaatgtcagtgtttgggaa

SEQ ID NO: 1888734 - DNA, 18 bp, Homo sapiens
aaatgtctgacacattaa

SEQ ID NO: 1888735 - DNA, 22 bp, Homo sapiens
aaatgttgacatgggacatttg

SEQ ID NO: 1888736 - DNA, 18 bp, Homo sapiens
aaattacacaataaagca

SEQ ID NO: 1888737 - DNA, 19 bp, Homo sapiens
aaattacacaataaagcag

SEQ ID NO: 1888738 - DNA, 22 bp, Homo sapiens
aaattacacaataaagcagtcc

SEQ ID NO: 1888739 - DNA, 21 bp, Homo sapiens
aaattagttagccaatatttt

SEQ ID NO: 1888740 - DNA, 15 bp, Homo sapiens
aaattatatcaattt

SEQ ID NO: 1888741 - DNA, 22 bp, Homo sapiens
aaattctttcacttgatgtttg

SEQ ID NO: 1888742 - DNA, 18 bp, Homo sapiens
aaattgggtgtgccctgg

SEQ ID NO: 1888743 - DNA, 13 bp, Homo sapiens
aacaaagcacctc

SEQ ID NO: 1888744 - DNA, 15 bp, Homo sapiens
aacaaggatgaatta

SEQ ID NO: 1888745 - DNA, 22 bp, Homo sapiens
aacaatcttaagagcttgatct

SEQ ID NO: 1888746 - DNA, 22 bp, Homo sapiens
aacaatgctgtattttaaaaga

SEQ ID NO: 1888747 - DNA, 17 bp, Homo sapiens
aacacaactatattgtt

SEQ ID NO: 1888748 - DNA, 15 bp, Homo sapiens
aacagactagaagta

SEQ ID NO: 1888749 - DNA, 20 bp, Homo sapiens
aacagactagaagtatttgt

SEQ ID NO: 1888750 - DNA, 21 bp, Homo sapiens
aacagactagaagtatttgtg

SEQ ID NO: 1888751 - DNA, 17 bp, Homo sapiens
aacagactatttaactt

SEQ ID NO: 1888752 - DNA, 16 bp, Homo sapiens
aacagcttctcaattt

SEQ ID NO: 1888753 - DNA, 14 bp, Homo sapiens
aacaggcccagaga

SEQ ID NO: 1888754 - DNA, 22 bp, Homo sapiens
aacagtgttaggcctggcacag

SEQ ID NO: 1888755 - DNA, 18 bp, Homo sapiens
aacataatggttgtgaaa

SEQ ID NO: 1888756 - DNA, 12 bp, Homo sapiens
aacatatataac

SEQ ID NO: 1888757 - DNA, 17 bp, Homo sapiens
aacatgatgtcaacttc

SEQ ID NO: 1888758 - DNA, 21 bp, Homo sapiens
aacattactctgaaattgtaa

SEQ ID NO: 1888759 - DNA, 15 bp, Homo sapiens
aacatttaacataat

SEQ ID NO: 1888760 - DNA, 18 bp, Homo sapiens
aacatttggtaaggggaa

SEQ ID NO: 1888761 - DNA, 21 bp, Homo sapiens
aaccatgaagagatttttcat

SEQ ID NO: 1888762 - DNA, 10 bp, Homo sapiens
aacccagccg

SEQ ID NO: 1888763 - DNA, 14 bp, Homo sapiens
aacccagccgctgc

SEQ ID NO: 1888764 - DNA, 19 bp, Homo sapiens
aacccccagcacccgggct

SEQ ID NO: 1888765 - DNA, 21 bp, Homo sapiens
aacccctcccctccatccctg

SEQ ID NO: 1888766 - DNA, 22 bp, Homo sapiens
aactaacttttttttttttaac

SEQ ID NO: 1888767 - DNA, 18 bp, Homo sapiens
aactcaccagcctctgct

SEQ ID NO: 1888768 - DNA, 13 bp, Homo sapiens
aactcgggagcat

SEQ ID NO: 1888769 - DNA, 20 bp, Homo sapiens
aactgaaatcatacttctta

SEQ ID NO: 1888770 - DNA, 18 bp, Homo sapiens
aactgactcttaagaaga

SEQ ID NO: 1888771 - DNA, 20 bp, Homo sapiens
aactgactcttaagaagact

SEQ ID NO: 1888772 - DNA, 17 bp, Homo sapiens
aactgggacaggggaga

SEQ ID NO: 1888773 - DNA, 21 bp, Homo sapiens
aacttagaataaaattgtaaa

SEQ ID NO: 1888774 - DNA, 18 bp, Homo sapiens
aacttcagcggtttatat

SEQ ID NO: 1888775 - DNA, 18 bp, Homo sapiens
aacttccagatcctggaa

SEQ ID NO: 1888776 - DNA, 22 bp, Homo sapiens
aacttgctgcagtatgaaaata

SEQ ID NO: 1888777 - DNA, 13 bp, Homo sapiens
aacttgtgttcta

SEQ ID NO: 1888778 - DNA, 18 bp, Homo sapiens
aactttgccagtctttaa

SEQ ID NO: 1888779 - DNA, 16 bp, Homo sapiens
aagaacgtcattttgg

SEQ ID NO: 1888780 - DNA, 20 bp, Homo sapiens
aagaagactgcattatattt

SEQ ID NO: 1888781 - DNA, 16 bp, Homo sapiens
aagaatgattatgaat

SEQ ID NO: 1888782 - DNA, 18 bp, Homo sapiens
aagacacttatattttga

SEQ ID NO: 1888783 - DNA, 15 bp, Homo sapiens
aagagatttttcatg

SEQ ID NO: 1888784 - DNA, 14 bp, Homo sapiens
aagagcacagccct

SEQ ID NO: 1888785 - DNA, 12 bp, Homo sapiens
aagagctcaagg

SEQ ID NO: 1888786 - DNA, 16 bp, Homo sapiens
aagatatgggacattt

SEQ ID NO: 1888787 - DNA, 13 bp, Homo sapiens
aagatatttttcc

SEQ ID NO: 1888788 - DNA, 17 bp, Homo sapiens
aagatcttggcttaatt

SEQ ID NO: 1888789 - DNA, 16 bp, Homo sapiens
aagcaagtattagaat

SEQ ID NO: 1888790 - DNA, 14 bp, Homo sapiens
aagcagtcctgttc

SEQ ID NO: 1888791 - DNA, 18 bp, Homo sapiens
aagcatgtattcagcttt

SEQ ID NO: 1888792 - DNA, 13 bp, Homo sapiens
aagccagattttc

SEQ ID NO: 1888793 - DNA, 19 bp, Homo sapiens
aagccagattttcctgaaa

SEQ ID NO: 1888794 - DNA, 23 bp, Homo sapiens
aagccagttggcttctgtgcctg

SEQ ID NO: 1888795 - DNA, 19 bp, Homo sapiens
aagccctgcataatgttaa

SEQ ID NO: 1888796 - DNA, 18 bp, Homo sapiens
aagcctggagcccctgtg

SEQ ID NO: 1888797 - DNA, 21 bp, Homo sapiens
aagccttggggctgatgcagt

SEQ ID NO: 1888798 - DNA, 22 bp, Homo sapiens
aagcgctagaggaagcagccaa

SEQ ID NO: 1888799 - DNA, 13 bp, Homo sapiens
aagctccaggtag

SEQ ID NO: 1888800 - DNA, 11 bp, Homo sapiens
aagctctgttg

SEQ ID NO: 1888801 - DNA, 16 bp, Homo sapiens
aagctgtgccaccctg

SEQ ID NO: 1888802 - DNA, 23 bp, Homo sapiens
aagcttgtattcctttttctctc

SEQ ID NO: 1888803 - DNA, 22 bp, Homo sapiens
aaggaccaacccatgccctgcc

SEQ ID NO: 1888804 - DNA, 15 bp, Homo sapiens
aaggaggctggctgg

SEQ ID NO: 1888805 - DNA, 20 bp, Homo sapiens
aaggcagctctaaatgtcaa

SEQ ID NO: 1888806 - DNA, 17 bp, Homo sapiens
aaggggaattgaggaca

SEQ ID NO: 1888807 - DNA, 21 bp, Homo sapiens
aagggtcctacggagggacca

SEQ ID NO: 1888808 - DNA, 16 bp, Homo sapiens
aaggtgggggagcctg

SEQ ID NO: 1888809 - DNA, 20 bp, Homo sapiens
aaggtgggggagcctggagc

SEQ ID NO: 1888810 - DNA, 15 bp, Homo sapiens
aaggttttattttgt

SEQ ID NO: 1888811 - DNA, 16 bp, Homo sapiens
aaggttttattttgta

SEQ ID NO: 1888812 - DNA, 14 bp, Homo sapiens
aagtaatgataact

SEQ ID NO: 1888813 - DNA, 13 bp, Homo sapiens
caggccatcttcc

SEQ ID NO: 1888814 - DNA, 15 bp, Homo sapiens
caggccatcttccag

SEQ ID NO: 1888815 - DNA, 19 bp, Homo sapiens
caggccatcttccaggtgg

SEQ ID NO: 1888816 - DNA, 19 bp, Homo sapiens
caggccctgcactgtcctg

SEQ ID NO: 1888817 - DNA, 17 bp, Homo sapiens
caggcctggcaagtggg

SEQ ID NO: 1888818 - DNA, 15 bp, Homo sapiens
caggcgactggaggc

SEQ ID NO: 1888819 - DNA, 23 bp, Homo sapiens
caggcgactggaggcaggactcc

SEQ ID NO: 1888820 - DNA, 14 bp, Homo sapiens
caggctccagttga

SEQ ID NO: 1888821 - DNA, 17 bp, Homo sapiens
caggctgcagcaggcag

SEQ ID NO: 1888822 - DNA, 18 bp, Homo sapiens
caggctgcagcaggcaga

SEQ ID NO: 1888823 - DNA, 19 bp, Homo sapiens
caggctgcagcaggcagag

SEQ ID NO: 1888824 - DNA, 20 bp, Homo sapiens
caggctgcagcaggcagagg

SEQ ID NO: 1888825 - DNA, 22 bp, Homo sapiens
caggctgcagcaggcagaggag

SEQ ID NO: 1888826 - DNA, 23 bp, Homo sapiens
caggctggccagccccacagccc

SEQ ID NO: 1888827 - DNA, 13 bp, Homo sapiens
cagggaccacagc

SEQ ID NO: 1888828 - DNA, 20 bp, Homo sapiens
cagggaccacagcaaggcac

SEQ ID NO: 1888829 - DNA, 20 bp, Homo sapiens
cagggatcctctctccaggc

SEQ ID NO: 1888830 - DNA, 22 bp, Homo sapiens
cagggctgggcaggtcctgggg

SEQ ID NO: 1888831 - DNA, 22 bp, Homo sapiens
caggggcaggcacagcacaggg

SEQ ID NO: 1888832 - DNA, 15 bp, Homo sapiens
caggggctcaggata

SEQ ID NO: 1888833 - DNA, 16 bp, Homo sapiens
caggggctgcccgctc

SEQ ID NO: 1888834 - DNA, 13 bp, Homo sapiens
caggggtctccct

SEQ ID NO: 1888835 - DNA, 15 bp, Homo sapiens
caggtcctggggagg

SEQ ID NO: 1888836 - DNA, 17 bp, Homo sapiens
caggtcctggggaggct

SEQ ID NO: 1888837 - DNA, 19 bp, Homo sapiens
caggtcctggggaggctga

SEQ ID NO: 1888838 - DNA, 21 bp, Homo sapiens
caggtcctggggaggctgaga

SEQ ID NO: 1888839 - DNA, 23 bp, Homo sapiens
caggtcctggggaggctgagact

SEQ ID NO: 1888840 - DNA, 22 bp, Homo sapiens
caggtgctagggtgcctgctct

SEQ ID NO: 1888841 - DNA, 16 bp, Homo sapiens
caggtgctgctaccct

SEQ ID NO: 1888842 - DNA, 22 bp, Homo sapiens
caggtggggtgaggcagtgggt

SEQ ID NO: 1888843 - DNA, 20 bp, Homo sapiens
caggtttatattgggaagct

SEQ ID NO: 1888844 - DNA, 15 bp, Homo sapiens
cagtaaataaattgt

SEQ ID NO: 1888845 - DNA, 19 bp, Homo sapiens
cagtaaataaattgtttga

SEQ ID NO: 1888846 - DNA, 15 bp, Homo sapiens
cagtactgaggtggt

SEQ ID NO: 1888847 - DNA, 14 bp, Homo sapiens
cagtatatttctga

SEQ ID NO: 1888848 - DNA, 13 bp, Homo sapiens
cagtatgaaaata

SEQ ID NO: 1888849 - DNA, 14 bp, Homo sapiens
cagtatgaaaataa

SEQ ID NO: 1888850 - DNA, 15 bp, Homo sapiens
cagtcaggaaagaga

SEQ ID NO: 1888851 - DNA, 20 bp, Homo sapiens
cagtcatggtggccacggcc

SEQ ID NO: 1888852 - DNA, 13 bp, Homo sapiens
cagtcatttgtgg

SEQ ID NO: 1888853 - DNA, 15 bp, Homo sapiens
cagtcatttgtggtt

SEQ ID NO: 1888854 - DNA, 13 bp, Homo sapiens
cagtcctgttcaa

SEQ ID NO: 1888855 - DNA, 14 bp, Homo sapiens
cagtcgcgctgcct

SEQ ID NO: 1888856 - DNA, 20 bp, Homo sapiens
cagtcgcgctgcctgtgtgg

SEQ ID NO: 1888857 - DNA, 13 bp, Homo sapiens
cagtctccccaga

SEQ ID NO: 1888858 - DNA, 17 bp, Homo sapiens
cagtgactcatgctgga

SEQ ID NO: 1888859 - DNA, 20 bp, Homo sapiens
cagtgactcatgctggatga

SEQ ID NO: 1888860 - DNA, 17 bp, Homo sapiens
cagtgactcgggctcct

SEQ ID NO: 1888861 - DNA, 19 bp, Homo sapiens
cagtgactcgggctcctgt

SEQ ID NO: 1888862 - DNA, 21 bp, Homo sapiens
cagtgactcgggctcctgtgc

SEQ ID NO: 1888863 - DNA, 20 bp, Homo sapiens
cagtgcagcttgcagtccgt

SEQ ID NO: 1888864 - DNA, 18 bp, Homo sapiens
cagtgcccattcctcacc

SEQ ID NO: 1888865 - DNA, 22 bp, Homo sapiens
cagtggccaagatcacagtggc

SEQ ID NO: 1888866 - DNA, 14 bp, Homo sapiens
cagtggggtctcag

SEQ ID NO: 1888867 - DNA, 18 bp, Homo sapiens
cagtgggtcccacttccc

SEQ ID NO: 1888868 - DNA, 22 bp, Homo sapiens
cagtgggtcccacttcccctcc

SEQ ID NO: 1888869 - DNA, 23 bp, Homo sapiens
cagtgggtcccacttcccctcct

SEQ ID NO: 1888870 - DNA, 17 bp, Homo sapiens
cagtgtacccccgccca

SEQ ID NO: 1888871 - DNA, 19 bp, Homo sapiens
cagtgtacccccgcccagg

SEQ ID NO: 1888872 - DNA, 22 bp, Homo sapiens
cagtgtacccccgcccaggctg

SEQ ID NO: 1888873 - DNA, 14 bp, Homo sapiens
cagtgtctgggctg

SEQ ID NO: 1888874 - DNA, 18 bp, Homo sapiens
cagtgtctgggctgactg

SEQ ID NO: 1888875 - DNA, 14 bp, Homo sapiens
cagtgtgcccccca

SEQ ID NO: 1888876 - DNA, 20 bp, Homo sapiens
cagtgtgccccccatcctgg

SEQ ID NO: 1888877 - DNA, 22 bp, Homo sapiens
cagtgtgccccccatcctggcc

SEQ ID NO: 1888878 - DNA, 22 bp, Homo sapiens
cagtgtgtggctttcagagcct

SEQ ID NO: 1888879 - DNA, 14 bp, Homo sapiens
cagtgttctgagcc

SEQ ID NO: 1888880 - DNA, 10 bp, Homo sapiens
cagttatttt

SEQ ID NO: 1888881 - DNA, 17 bp, Homo sapiens
cagttcctctttgcatg

SEQ ID NO: 1888882 - DNA, 15 bp, Homo sapiens
cagttctgaagaaga

SEQ ID NO: 1888883 - DNA, 14 bp, Homo sapiens
cagttgaatttcat

SEQ ID NO: 1888884 - DNA, 16 bp, Homo sapiens
cagttgtgtcataaat

SEQ ID NO: 1888885 - DNA, 19 bp, Homo sapiens
cagtttaggtgatggccag

SEQ ID NO: 1888886 - DNA, 15 bp, Homo sapiens
cataatggttgtgaa

SEQ ID NO: 1888887 - DNA, 18 bp, Homo sapiens
cataatgttaagctttat

SEQ ID NO: 1888888 - DNA, 16 bp, Homo sapiens
catactggcctcgcct

SEQ ID NO: 1888889 - DNA, 19 bp, Homo sapiens
catactggcctcgcctggc

SEQ ID NO: 1888890 - DNA, 20 bp, Homo sapiens
catactggcctcgcctggcc

SEQ ID NO: 1888891 - DNA, 21 bp, Homo sapiens
catactggcctcgcctggcct

SEQ ID NO: 1888892 - DNA, 21 bp, Homo sapiens
catagacccatctggaggctc

SEQ ID NO: 1888893 - DNA, 23 bp, Homo sapiens
catagcagactttcccaaatgta

SEQ ID NO: 1888894 - DNA, 23 bp, Homo sapiens
catagtcatgtaagctgaaaata

SEQ ID NO: 1888895 - DNA, 17 bp, Homo sapiens
catataaaagttgcgtt

SEQ ID NO: 1888896 - DNA, 18 bp, Homo sapiens
catatccagtattgttcc

SEQ ID NO: 1888897 - DNA, 16 bp, Homo sapiens
catcagatgtgttcct

SEQ ID NO: 1888898 - DNA, 23 bp, Homo sapiens
catcagtgtacccccgcccaggc

SEQ ID NO: 1888899 - DNA, 23 bp, Homo sapiens
catcccactcacaacagctgcct

SEQ ID NO: 1888900 - DNA, 12 bp, Homo sapiens
catcccccctca

SEQ ID NO: 1888901 - DNA, 14 bp, Homo sapiens
catcccccctcacc

SEQ ID NO: 1888902 - DNA, 18 bp, Homo sapiens
catcccccctcaccaggg

SEQ ID NO: 1888903 - DNA, 12 bp, Homo sapiens
catccctggccc

SEQ ID NO: 1888904 - DNA, 20 bp, Homo sapiens
catccctggccccctccctg

SEQ ID NO: 1888905 - DNA, 23 bp, Homo sapiens
catcctaccacaatgcagtgcct

SEQ ID NO: 1888906 - DNA, 14 bp, Homo sapiens
catcctggcccatc

SEQ ID NO: 1888907 - DNA, 16 bp, Homo sapiens
catcctggcccatcag

SEQ ID NO: 1888908 - DNA, 15 bp, Homo sapiens
catccttctgccttt

SEQ ID NO: 1888909 - DNA, 14 bp, Homo sapiens
catctagtgagcag

SEQ ID NO: 1888910 - DNA, 14 bp, Homo sapiens
catctctgctgctt

SEQ ID NO: 1888911 - DNA, 22 bp, Homo sapiens
catctctgctgcttctgggcct

SEQ ID NO: 1888912 - DNA, 23 bp, Homo sapiens
catctctgctgcttctgggcctg

SEQ ID NO: 1888913 - DNA, 12 bp, Homo sapiens
catctgcccagg

SEQ ID NO: 1888914 - DNA, 13 bp, Homo sapiens
catctgctctgag

SEQ ID NO: 1888915 - DNA, 14 bp, Homo sapiens
catctgctctgaga

SEQ ID NO: 1888916 - DNA, 16 bp, Homo sapiens
catctgctctgagacg

SEQ ID NO: 1888917 - DNA, 16 bp, Homo sapiens
catcttccaggtgggg

SEQ ID NO: 1888918 - DNA, 18 bp, Homo sapiens
catctttgtttttaaaat

SEQ ID NO: 1888919 - DNA, 16 bp, Homo sapiens
catgaattagttttat

SEQ ID NO: 1888920 - DNA, 17 bp, Homo sapiens
catgagaaaatcagtaa

SEQ ID NO: 1888921 - DNA, 22 bp, Homo sapiens
catgagtgtcaactccaggact

SEQ ID NO: 1888922 - DNA, 15 bp, Homo sapiens
catgcatacactctc

SEQ ID NO: 1888923 - DNA, 19 bp, Homo sapiens
catgcccgctgtcccaggg

SEQ ID NO: 1888924 - DNA, 19 bp, Homo sapiens
catggaatttgtaagttta

SEQ ID NO: 1888925 - DNA, 18 bp, Homo sapiens
catgggggaggctctgaa

SEQ ID NO: 1888926 - DNA, 21 bp, Homo sapiens
catgggggaggctctgaagag

SEQ ID NO: 1888927 - DNA, 22 bp, Homo sapiens
catggtcacccccactctgcat

SEQ ID NO: 1888928 - DNA, 14 bp, Homo sapiens
catgtaacagttgt

SEQ ID NO: 1888929 - DNA, 15 bp, Homo sapiens
catgtaacagttgtg

SEQ ID NO: 1888930 - DNA, 16 bp, Homo sapiens
catgtaacagttgtgt

SEQ ID NO: 1888931 - DNA, 17 bp, Homo sapiens
catgtaagctgaaaata

SEQ ID NO: 1888932 - DNA, 14 bp, Homo sapiens
catgtatctacctc

SEQ ID NO: 1888933 - DNA, 14 bp, Homo sapiens
atcctggagcccct

SEQ ID NO: 1888934 - DNA, 12 bp, Homo sapiens
atccttgaagat

SEQ ID NO: 1888935 - DNA, 19 bp, Homo sapiens
atcgtctctgccactcctg

SEQ ID NO: 1888936 - DNA, 23 bp, Homo sapiens
atctatttttttttctttttaaa

SEQ ID NO: 1888937 - DNA, 14 bp, Homo sapiens
atctcatttccaag

SEQ ID NO: 1888938 - DNA, 21 bp, Homo sapiens
atctcatttccaagcaagtat

SEQ ID NO: 1888939 - DNA, 23 bp, Homo sapiens
atctcatttccaagcaagtatta

SEQ ID NO: 1888940 - DNA, 21 bp, Homo sapiens
atctctgctgcttctgggcct

SEQ ID NO: 1888941 - DNA, 22 bp, Homo sapiens
atctctgctgcttctgggcctg

SEQ ID NO: 1888942 - DNA, 17 bp, Homo sapiens
atctgattttttttgta

SEQ ID NO: 1888943 - DNA, 13 bp, Homo sapiens
atctgctctgaga

SEQ ID NO: 1888944 - DNA, 18 bp, Homo sapiens
atctggaggctcccatgg

SEQ ID NO: 1888945 - DNA, 11 bp, Homo sapiens
atctgggccac

SEQ ID NO: 1888946 - DNA, 17 bp, Homo sapiens
atctggggaaggaccaa

SEQ ID NO: 1888947 - DNA, 18 bp, Homo sapiens
atctggggaaggaccaac

SEQ ID NO: 1888948 - DNA, 13 bp, Homo sapiens
atctgtgatttct

SEQ ID NO: 1888949 - DNA, 14 bp, Homo sapiens
atctgttgttctgt

SEQ ID NO: 1888950 - DNA, 18 bp, Homo sapiens
atcttaagagcttgatct

SEQ ID NO: 1888951 - DNA, 21 bp, Homo sapiens
atcttaagagcttgatctgtg

SEQ ID NO: 1888952 - DNA, 22 bp, Homo sapiens
atcttaagagcttgatctgtga

SEQ ID NO: 1888953 - DNA, 19 bp, Homo sapiens
atcttgcccgctcaggctg

SEQ ID NO: 1888954 - DNA, 21 bp, Homo sapiens
atcttggcttaatttaatgta

SEQ ID NO: 1888955 - DNA, 18 bp, Homo sapiens
atgaaatattatgttaaa

SEQ ID NO: 1888956 - DNA, 20 bp, Homo sapiens
atgaagagatttttcatgat

SEQ ID NO: 1888957 - DNA, 16 bp, Homo sapiens
atgaaggctgtatcta

SEQ ID NO: 1888958 - DNA, 20 bp, Homo sapiens
atgaagtccaagcatttaga

SEQ ID NO: 1888959 - DNA, 22 bp, Homo sapiens
atgaattacatttgtataaaat

SEQ ID NO: 1888960 - DNA, 17 bp, Homo sapiens
atgacaggatgtttgct

SEQ ID NO: 1888961 - DNA, 23 bp, Homo sapiens
atgaccagcagcagctttcagct

SEQ ID NO: 1888962 - DNA, 17 bp, Homo sapiens
atgacttttccatgtat

SEQ ID NO: 1888963 - DNA, 17 bp, Homo sapiens
atgagggtttcattgtg

SEQ ID NO: 1888964 - DNA, 19 bp, Homo sapiens
atgagtgtcaactccagga

SEQ ID NO: 1888965 - DNA, 16 bp, Homo sapiens
atgagttgcagttttt

SEQ ID NO: 1888966 - DNA, 23 bp, Homo sapiens
atgagttgcagtttttataatag

SEQ ID NO: 1888967 - DNA, 14 bp, Homo sapiens
atgatactgtttct

SEQ ID NO: 1888968 - DNA, 18 bp, Homo sapiens
atgattaagtaatgataa

SEQ ID NO: 1888969 - DNA, 12 bp, Homo sapiens
atgattataagc

SEQ ID NO: 1888970 - DNA, 22 bp, Homo sapiens
atgattatgaattacatttgta

SEQ ID NO: 1888971 - DNA, 17 bp, Homo sapiens
atgcaagtagctggctg

SEQ ID NO: 1888972 - DNA, 13 bp, Homo sapiens
atgcactggcctg

SEQ ID NO: 1888973 - DNA, 23 bp, Homo sapiens
atgcactggcctgttctgtagga

SEQ ID NO: 1888974 - DNA, 14 bp, Homo sapiens
atgcagggtattgc

SEQ ID NO: 1888975 - DNA, 17 bp, Homo sapiens
atgcagtgcctttcttc

SEQ ID NO: 1888976 - DNA, 13 bp, Homo sapiens
atgcagttctgaa

SEQ ID NO: 1888977 - DNA, 17 bp, Homo sapiens
ccaagcatttagatgta

SEQ ID NO: 1888978 - DNA, 19 bp, Homo sapiens
ccaagcccttccctctgtt

SEQ ID NO: 1888979 - DNA, 14 bp, Homo sapiens
ccaagcctggagcc

SEQ ID NO: 1888980 - DNA, 22 bp, Homo sapiens
ccaagcctggagcccctgtgtt

SEQ ID NO: 1888981 - DNA, 15 bp, Homo sapiens
ccaagctgtgccacc

SEQ ID NO: 1888982 - DNA, 17 bp, Homo sapiens
ccaagcttaaggagagg

SEQ ID NO: 1888983 - DNA, 14 bp, Homo sapiens
ccaaggtacctagg

SEQ ID NO: 1888984 - DNA, 15 bp, Homo sapiens
ccaaggtggtctgct

SEQ ID NO: 1888985 - DNA, 21 bp, Homo sapiens
ccaataaaaacattttgaagt

SEQ ID NO: 1888986 - DNA, 12 bp, Homo sapiens
ccacaccaagct

SEQ ID NO: 1888987 - DNA, 16 bp, Homo sapiens
ccacagaagctccagg

SEQ ID NO: 1888988 - DNA, 17 bp, Homo sapiens
ccacagcccacgtcctg

SEQ ID NO: 1888989 - DNA, 19 bp, Homo sapiens
ccacagcccacgtcctgtc

SEQ ID NO: 1888990 - DNA, 21 bp, Homo sapiens
ccacagcccacgtcctgtcag

SEQ ID NO: 1888991 - DNA, 22 bp, Homo sapiens
ccacagctttttaccaagtttc

SEQ ID NO: 1888992 - DNA, 20 bp, Homo sapiens
ccacaggaaccacaagactg

SEQ ID NO: 1888993 - DNA, 16 bp, Homo sapiens
ccacaggcccacagta

SEQ ID NO: 1888994 - DNA, 21 bp, Homo sapiens
ccacagtgactcgggctcctg

SEQ ID NO: 1888995 - DNA, 22 bp, Homo sapiens
ccacagtgactcgggctcctgt

SEQ ID NO: 1888996 - DNA, 23 bp, Homo sapiens
ccacagtgactcgggctcctgtg

SEQ ID NO: 1888997 - DNA, 17 bp, Homo sapiens
ccacagtgtttatattg

SEQ ID NO: 1888998 - DNA, 20 bp, Homo sapiens
ccaccatttaaaaatgttag

SEQ ID NO: 1888999 - DNA, 18 bp, Homo sapiens
ccaccctgcctctaccca

SEQ ID NO: 1889000 - DNA, 12 bp, Homo sapiens
ccaccctgggct

SEQ ID NO: 1889001 - DNA, 17 bp, Homo sapiens
ccaccctgggctctgtg

SEQ ID NO: 1889002 - DNA, 18 bp, Homo sapiens
ccaccctgggctctgtgg

SEQ ID NO: 1889003 - DNA, 20 bp, Homo sapiens
ccaccctgggctctgtgggc

SEQ ID NO: 1889004 - DNA, 18 bp, Homo sapiens
ccaccgcatgccccctcg

SEQ ID NO: 1889005 - DNA, 17 bp, Homo sapiens
ccaccgccatggcttcc

SEQ ID NO: 1889006 - DNA, 19 bp, Homo sapiens
ccacctagtggctgtccag

SEQ ID NO: 1889007 - DNA, 20 bp, Homo sapiens
ccacctagtggctgtccagt

SEQ ID NO: 1889008 - DNA, 21 bp, Homo sapiens
ccacctagtggctgtccagtg

SEQ ID NO: 1889009 - DNA, 13 bp, Homo sapiens
ccacctgggctgg

SEQ ID NO: 1889010 - DNA, 20 bp, Homo sapiens
ccacgaggtggtagctctga

SEQ ID NO: 1889011 - DNA, 13 bp, Homo sapiens
ccacgccctgggg

SEQ ID NO: 1889012 - DNA, 14 bp, Homo sapiens
ccacgccctgggga

SEQ ID NO: 1889013 - DNA, 15 bp, Homo sapiens
ccacgccctggggag

SEQ ID NO: 1889014 - DNA, 18 bp, Homo sapiens
ccacgccctggggagtga

SEQ ID NO: 1889015 - DNA, 21 bp, Homo sapiens
ccacggtggacttagctctga

SEQ ID NO: 1889016 - DNA, 22 bp, Homo sapiens
ccacggtggacttagctctgag

SEQ ID NO: 1889017 - DNA, 17 bp, Homo sapiens
ccacgtactgcagcctc

SEQ ID NO: 1889018 - DNA, 11 bp, Homo sapiens
ccactcccact

SEQ ID NO: 1889019 - DNA, 12 bp, Homo sapiens
ccactcccactt

SEQ ID NO: 1889020 - DNA, 11 bp, Homo sapiens
ccactgcaccc

SEQ ID NO: 1889021 - DNA, 13 bp, Homo sapiens
ccactgcaccccc

SEQ ID NO: 1889022 - DNA, 17 bp, Homo sapiens
ccactgcaccccctcct

SEQ ID NO: 1889023 - DNA, 18 bp, Homo sapiens
ccactgcaccccctcctg

SEQ ID NO: 1889024 - DNA, 21 bp, Homo sapiens
ccactgcaccccctcctgctg

SEQ ID NO: 1889025 - DNA, 17 bp, Homo sapiens
ccacttcaagtgaccac

SEQ ID NO: 1889026 - DNA, 14 bp, Homo sapiens
ccacttcccaggta

SEQ ID NO: 1889027 - DNA, 19 bp, Homo sapiens
ccacttcccctcctacccc

SEQ ID NO: 1889028 - DNA, 15 bp, Homo sapiens
ccacttccctgacac

SEQ ID NO: 1889029 - DNA, 17 bp, Homo sapiens
ccacttgggtcttccct

SEQ ID NO: 1889030 - DNA, 18 bp, Homo sapiens
ccagaccattgtctcaga

SEQ ID NO: 1889031 - DNA, 21 bp, Homo sapiens
ccagaccattgtctcagagca

SEQ ID NO: 1889032 - DNA, 17 bp, Homo sapiens
ccagcacccgggctcag

SEQ ID NO: 1889033 - DNA, 22 bp, Homo sapiens
ccagccccacagcccacgtcct

SEQ ID NO: 1889034 - DNA, 16 bp, Homo sapiens
ccagccgctgcccggc

SEQ ID NO: 1889035 - DNA, 17 bp, Homo sapiens
ccagcctggcccagctc

SEQ ID NO: 1889036 - DNA, 20 bp, Homo sapiens
ccagcctggcccagctcccc

SEQ ID NO: 1889037 - DNA, 16 bp, Homo sapiens
ccagctccactggcct

SEQ ID NO: 1889038 - DNA, 17 bp, Homo sapiens
ccagctcccccgggagg

SEQ ID NO: 1889039 - DNA, 21 bp, Homo sapiens
ccagctcccccgggaggggcc

SEQ ID NO: 1889040 - DNA, 18 bp, Homo sapiens
ccagctgggctgttggct

SEQ ID NO: 1889041 - DNA, 19 bp, Homo sapiens
ccaggacggggccggccag

SEQ ID NO: 1889042 - DNA, 20 bp, Homo sapiens
ccaggattgtacgtgggaga

SEQ ID NO: 1889043 - DNA, 21 bp, Homo sapiens
ccaggattgtacgtgggagag

SEQ ID NO: 1889044 - DNA, 23 bp, Homo sapiens
ccaggattgtacgtgggagaggc

SEQ ID NO: 1889045 - DNA, 12 bp, Homo sapiens
ccaggctggcca

SEQ ID NO: 1889046 - DNA, 14 bp, Homo sapiens
ccaggctggccagc

SEQ ID NO: 1889047 - DNA, 17 bp, Homo sapiens
ccaggctggccagcccc

SEQ ID NO: 1889048 - DNA, 19 bp, Homo sapiens
ccaggggcaggcacagcac

SEQ ID NO: 1889049 - DNA, 15 bp, Homo sapiens
ccaggggccatgaat

SEQ ID NO: 1889050 - DNA, 17 bp, Homo sapiens
ccaggggtctccctgag

SEQ ID NO: 1889051 - DNA, 18 bp, Homo sapiens
ccaggggtctccctgagc

SEQ ID NO: 1889052 - DNA, 22 bp, Homo sapiens
ccaggggtctccctgagcctgc

SEQ ID NO: 1889053 - DNA, 20 bp, Homo sapiens
ccaggtagagggtgtgtaag

SEQ ID NO: 1889054 - DNA, 16 bp, Homo sapiens
ccaggtctcctccacc

SEQ ID NO: 1889055 - DNA, 21 bp, Homo sapiens
ccaggtctcctccaccgccat

SEQ ID NO: 1889056 - DNA, 23 bp, Homo sapiens
ccaggtgggcgggcagcacagca

SEQ ID NO: 1889057 - DNA, 18 bp, Homo sapiens
ccagtcgcgctgcctgtg

SEQ ID NO: 1889058 - DNA, 20 bp, Homo sapiens
ccagtcgcgctgcctgtgtg

SEQ ID NO: 1889059 - DNA, 16 bp, Homo sapiens
ccagtgtgtggctttc

SEQ ID NO: 1889060 - DNA, 18 bp, Homo sapiens
ccagttgatcaatgaata

SEQ ID NO: 1889061 - DNA, 19 bp, Homo sapiens
ccagttggcttctgtgcct

SEQ ID NO: 1889062 - DNA, 13 bp, Homo sapiens
ccatacatttgtg

SEQ ID NO: 1889063 - DNA, 14 bp, Homo sapiens
ccatacatttgtgt

SEQ ID NO: 1889064 - DNA, 16 bp, Homo sapiens
ccatacctttccaggg

SEQ ID NO: 1889065 - DNA, 14 bp, Homo sapiens
ccatactggcctcg

SEQ ID NO: 1889066 - DNA, 18 bp, Homo sapiens
ccatcagtgtacccccgc

SEQ ID NO: 1889067 - DNA, 22 bp, Homo sapiens
ccatcagtgtacccccgcccag

SEQ ID NO: 1889068 - DNA, 22 bp, Homo sapiens
ccatccctggccccctccctgg

SEQ ID NO: 1889069 - DNA, 22 bp, Homo sapiens
ccatctctgctgcttctgggcc

SEQ ID NO: 1889070 - DNA, 21 bp, Homo sapiens
cccactgcaccccctcctgct

SEQ ID NO: 1889071 - DNA, 22 bp, Homo sapiens
cccactgcaccccctcctgctg

SEQ ID NO: 1889072 - DNA, 14 bp, Homo sapiens
cccacttcccctcc

SEQ ID NO: 1889073 - DNA, 15 bp, Homo sapiens
cccacttcccctcct

SEQ ID NO: 1889074 - DNA, 17 bp, Homo sapiens
cccacttcccctcctac

SEQ ID NO: 1889075 - DNA, 20 bp, Homo sapiens
cccacttccctgacactgcg

SEQ ID NO: 1889076 - DNA, 24 bp, Homo sapiens
cccacttccctgacactgcggggc

SEQ ID NO: 1889077 - DNA, 14 bp, Homo sapiens
cccagaaaaaaagc

SEQ ID NO: 1889078 - DNA, 12 bp, Homo sapiens
cccagcacccgg

SEQ ID NO: 1889079 - DNA, 21 bp, Homo sapiens
cccagcacccgggctcaggga

SEQ ID NO: 1889080 - DNA, 23 bp, Homo sapiens
cccagcccaagagatgaacatct

SEQ ID NO: 1889081 - DNA, 14 bp, Homo sapiens
cccagccgctgccc

SEQ ID NO: 1889082 - DNA, 19 bp, Homo sapiens
cccagcctggcccagctcc

SEQ ID NO: 1889083 - DNA, 16 bp, Homo sapiens
cccagctcccccggga

SEQ ID NO: 1889084 - DNA, 19 bp, Homo sapiens
cccagctcccccgggaggg

SEQ ID NO: 1889085 - DNA, 17 bp, Homo sapiens
cccagctgacagtcctc

SEQ ID NO: 1889086 - DNA, 22 bp, Homo sapiens
cccagctgacagtcctctccac

SEQ ID NO: 1889087 - DNA, 23 bp, Homo sapiens
cccaggaccaagcttaaggagag

SEQ ID NO: 1889088 - DNA, 17 bp, Homo sapiens
cccaggacggggccggc

SEQ ID NO: 1889089 - DNA, 19 bp, Homo sapiens
cccaggacggggccggcca

SEQ ID NO: 1889090 - DNA, 20 bp, Homo sapiens
cccaggccataccaggtgct

SEQ ID NO: 1889091 - DNA, 14 bp, Homo sapiens
cccaggccatcttc

SEQ ID NO: 1889092 - DNA, 16 bp, Homo sapiens
cccaggctggccagcc

SEQ ID NO: 1889093 - DNA, 17 bp, Homo sapiens
cccaggctggccagccc

SEQ ID NO: 1889094 - DNA, 22 bp, Homo sapiens
cccaggctggccagccccacag

SEQ ID NO: 1889095 - DNA, 17 bp, Homo sapiens
cccagtgtcttcctgtg

SEQ ID NO: 1889096 - DNA, 23 bp, Homo sapiens
cccatcagtgtacccccgcccag

SEQ ID NO: 1889097 - DNA, 15 bp, Homo sapiens
cccatcccccctcac

SEQ ID NO: 1889098 - DNA, 16 bp, Homo sapiens
cccatcccccctcacc

SEQ ID NO: 1889099 - DNA, 14 bp, Homo sapiens
cccatcctgccaca

SEQ ID NO: 1889100 - DNA, 13 bp, Homo sapiens
cccatctctgctg

SEQ ID NO: 1889101 - DNA, 15 bp, Homo sapiens
cccatctctgctgct

SEQ ID NO: 1889102 - DNA, 13 bp, Homo sapiens
cccatctgcccag

SEQ ID NO: 1889103 - DNA, 15 bp, Homo sapiens
cccatctgcccagga

SEQ ID NO: 1889104 - DNA, 16 bp, Homo sapiens
cccatctgcccaggac

SEQ ID NO: 1889105 - DNA, 13 bp, Homo sapiens
cccatgccctgcc

SEQ ID NO: 1889106 - DNA, 23 bp, Homo sapiens
cccatgccctgccaagcctggag

SEQ ID NO: 1889107 - DNA, 18 bp, Homo sapiens
cccatgggcactgctggg

SEQ ID NO: 1889108 - DNA, 11 bp, Homo sapiens
ccccacagccc

SEQ ID NO: 1889109 - DNA, 15 bp, Homo sapiens
ccccacagcccacgt

SEQ ID NO: 1889110 - DNA, 15 bp, Homo sapiens
ccccacctgcctgac

SEQ ID NO: 1889111 - DNA, 19 bp, Homo sapiens
ccccagcacccgggctcag

SEQ ID NO: 1889112 - DNA, 16 bp, Homo sapiens
ccccagcctggcccag

SEQ ID NO: 1889113 - DNA, 19 bp, Homo sapiens
ccccagcctggcccagctc

SEQ ID NO: 1889114 - DNA, 16 bp, Homo sapiens
ccccatcctggcccat

SEQ ID NO: 1889115 - DNA, 14 bp, Homo sapiens
ccccatctctgctg

SEQ ID NO: 1889116 - DNA, 20 bp, Homo sapiens
ccccatctctgctgcttctg

SEQ ID NO: 1889117 - DNA, 22 bp, Homo sapiens
ccccatctctgctgcttctggg

SEQ ID NO: 1889118 - DNA, 13 bp, Homo sapiens
ccccatctgccca

SEQ ID NO: 1889119 - DNA, 14 bp, Homo sapiens
cccccctcaccagg

SEQ ID NO: 1889120 - DNA, 11 bp, Homo sapiens
cccccctgaga

SEQ ID NO: 1889121 - DNA, 14 bp, Homo sapiens
ccccctccctggat

SEQ ID NO: 1889122 - DNA, 12 bp, Homo sapiens
ccccctcctgct

SEQ ID NO: 1889123 - DNA, 16 bp, Homo sapiens
ccccctcctgctgcag

SEQ ID NO: 1889124 - DNA, 13 bp, Homo sapiens
ccccctcgtgcca

SEQ ID NO: 1889125 - DNA, 18 bp, Homo sapiens
ccccctcgtgccagtcgc

SEQ ID NO: 1889126 - DNA, 14 bp, Homo sapiens
ccccgcccaggctg

SEQ ID NO: 1889127 - DNA, 23 bp, Homo sapiens
cccctaatgacatcaccacagtt

SEQ ID NO: 1889128 - DNA, 12 bp, Homo sapiens
cccctcccagct

SEQ ID NO: 1889129 - DNA, 13 bp, Homo sapiens
cccctcccagctg

SEQ ID NO: 1889130 - DNA, 22 bp, Homo sapiens
cccctcccgtctactcattccc

SEQ ID NO: 1889131 - DNA, 23 bp, Homo sapiens
cccctcctacccctcccagctga

SEQ ID NO: 1889132 - DNA, 14 bp, Homo sapiens
cccctcctgctgca

SEQ ID NO: 1889133 - DNA, 12 bp, Homo sapiens
cccctcttgccc

SEQ ID NO: 1889134 - DNA, 14 bp, Homo sapiens
cccctcttgcccca

SEQ ID NO: 1889135 - DNA, 15 bp, Homo sapiens
cccctcttgccccaa

SEQ ID NO: 1889136 - DNA, 20 bp, Homo sapiens
cccctggcctgactcccatg

SEQ ID NO: 1889137 - DNA, 11 bp, Homo sapiens
cccctggtggg

SEQ ID NO: 1889138 - DNA, 13 bp, Homo sapiens
cccgagcctggct

SEQ ID NO: 1889139 - DNA, 22 bp, Homo sapiens
cccgagggatgatgccacacca

SEQ ID NO: 1889140 - DNA, 15 bp, Homo sapiens
cccgcccaggctggc

SEQ ID NO: 1889141 - DNA, 20 bp, Homo sapiens
cccgcccaggctggccagcc

SEQ ID NO: 1889142 - DNA, 13 bp, Homo sapiens
cccgctcaggctg

SEQ ID NO: 1889143 - DNA, 13 bp, Homo sapiens
cccgctcccagtg

SEQ ID NO: 1889144 - DNA, 16 bp, Homo sapiens
cccgctgtcccagggg

SEQ ID NO: 1889145 - DNA, 11 bp, Homo sapiens
cccgcttgcct

SEQ ID NO: 1889146 - DNA, 12 bp, Homo sapiens
cccgcttgcctc

SEQ ID NO: 1889147 - DNA, 21 bp, Homo sapiens
cccgcttgcctcggctcctgc

SEQ ID NO: 1889148 - DNA, 12 bp, Homo sapiens
cccggatccagg

SEQ ID NO: 1889149 - DNA, 13 bp, Homo sapiens
cccgggaggggcc

SEQ ID NO: 1889150 - DNA, 15 bp, Homo sapiens
cccgggaggggcccg

SEQ ID NO: 1889151 - DNA, 23 bp, Homo sapiens
cccgggaggggcccgcttgcctc

SEQ ID NO: 1889152 - DNA, 13 bp, Homo sapiens
cccgtggccccag

SEQ ID NO: 1889153 - DNA, 15 bp, Homo sapiens
cccgtggccccagcc

SEQ ID NO: 1889154 - DNA, 17 bp, Homo sapiens
cccgtggccccagcctg

SEQ ID NO: 1889155 - DNA, 22 bp, Homo sapiens
cccgttgtctccctggccctca

SEQ ID NO: 1889156 - DNA, 20 bp, Homo sapiens
ccctacacctctgggccctg

SEQ ID NO: 1889157 - DNA, 16 bp, Homo sapiens
ccctagtatctggctg

SEQ ID NO: 1889158 - DNA, 17 bp, Homo sapiens
ccctagtatctggctgg

SEQ ID NO: 1889159 - DNA, 18 bp, Homo sapiens
ccctcaaggcctcccaca

SEQ ID NO: 1889160 - DNA, 19 bp, Homo sapiens
ccctcaaggcctcccacag

SEQ ID NO: 1889161 - DNA, 20 bp, Homo sapiens
ccctcaaggcctcccacagt

SEQ ID NO: 1889162 - DNA, 12 bp, Homo sapiens
ccctcccacagc

SEQ ID NO: 1889163 - DNA, 15 bp, Homo sapiens
ccctcctacccctcc

SEQ ID NO: 1889164 - DNA, 11 bp, Homo sapiens
ccctcctgctg

SEQ ID NO: 1889165 - DNA, 13 bp, Homo sapiens
ccctcctgctgca

SEQ ID NO: 1889166 - DNA, 21 bp, Homo sapiens
ccctccttcttgccctgagct

SEQ ID NO: 1889167 - DNA, 23 bp, Homo sapiens
ccctcgaggcggatctttggaca

SEQ ID NO: 1889168 - DNA, 12 bp, Homo sapiens
ccctgagcctgc

SEQ ID NO: 1889169 - DNA, 13 bp, Homo sapiens
ccctgagcctgcc

SEQ ID NO: 1889170 - DNA, 19 bp, Homo sapiens
ccctgagctttccggggag

SEQ ID NO: 1889171 - DNA, 10 bp, Homo sapiens
ccctgcactg

SEQ ID NO: 1889172 - DNA, 15 bp, Homo sapiens
ccctgcactgtcctg

SEQ ID NO: 1889173 - DNA, 18 bp, Homo sapiens
ccctgcactgtcctgctc

SEQ ID NO: 1889174 - DNA, 19 bp, Homo sapiens
ccctgcactgtcctgctcc

SEQ ID NO: 1889175 - DNA, 21 bp, Homo sapiens
ccctgcactgtcctgctccac

SEQ ID NO: 1889176 - DNA, 23 bp, Homo sapiens
ccctgcactgtcctgctccacag

SEQ ID NO: 1889177 - DNA, 10 bp, Homo sapiens
ccctgctgtc

SEQ ID NO: 1889178 - DNA, 18 bp, Homo sapiens
ccctgctgtcccctcttg

SEQ ID NO: 1889179 - DNA, 19 bp, Homo sapiens
ccctgctgtcccctcttgc

SEQ ID NO: 1889180 - DNA, 23 bp, Homo sapiens
ccctgctgtcccctcttgcccca

SEQ ID NO: 1889181 - DNA, 9 bp, Homo sapiens
ccctggccc

SEQ ID NO: 1889182 - DNA, 21 bp, Homo sapiens
ccctggccccctccctggatg

SEQ ID NO: 1889183 - DNA, 13 bp, Homo sapiens
ccctggccctcaa

SEQ ID NO: 1889184 - DNA, 22 bp, Homo sapiens
ccctggccctcaaggcctccca

SEQ ID NO: 1889185 - DNA, 23 bp, Homo sapiens
ccctggccctcaaggcctcccac

SEQ ID NO: 1889186 - DNA, 17 bp, Homo sapiens
ccctgggccagcccagg

SEQ ID NO: 1889187 - DNA, 18 bp, Homo sapiens
ccctgggccagcccagga

SEQ ID NO: 1889188 - DNA, 16 bp, Homo sapiens
ccctgtgtgggagggc

SEQ ID NO: 1889189 - DNA, 14 bp, Homo sapiens
ctaccctccctgct

SEQ ID NO: 1889190 - DNA, 16 bp, Homo sapiens
ctaccctccctgctgt

SEQ ID NO: 1889191 - DNA, 12 bp, Homo sapiens
ctagaagtattt

SEQ ID NO: 1889192 - DNA, 20 bp, Homo sapiens
ctaggaaatatttattttaa

SEQ ID NO: 1889193 - DNA, 17 bp, Homo sapiens
ctaggactttagggatc

SEQ ID NO: 1889194 - DNA, 15 bp, Homo sapiens
ctagggtgcctgctc

SEQ ID NO: 1889195 - DNA, 16 bp, Homo sapiens
ctagggtgcctgctct

SEQ ID NO: 1889196 - DNA, 16 bp, Homo sapiens
ctagtaattggaaagg

SEQ ID NO: 1889197 - DNA, 16 bp, Homo sapiens
ctagtactaactccta

SEQ ID NO: 1889198 - DNA, 22 bp, Homo sapiens
ctagtatttctatgaaatatta

SEQ ID NO: 1889199 - DNA, 15 bp, Homo sapiens
ctagtggctgtccag

SEQ ID NO: 1889200 - DNA, 18 bp, Homo sapiens
ctagtggctgtccagtgc

SEQ ID NO: 1889201 - DNA, 19 bp, Homo sapiens
ctataaacatgatgtcaac

SEQ ID NO: 1889202 - DNA, 16 bp, Homo sapiens
ctatagtgtaataatg

SEQ ID NO: 1889203 - DNA, 18 bp, Homo sapiens
ctatattgtttgctaagc

SEQ ID NO: 1889204 - DNA, 19 bp, Homo sapiens
ctatattgtttgctaagca

SEQ ID NO: 1889205 - DNA, 16 bp, Homo sapiens
ctatcagtgtgccccc

SEQ ID NO: 1889206 - DNA, 18 bp, Homo sapiens
ctatcagtgtgcccccca

SEQ ID NO: 1889207 - DNA, 18 bp, Homo sapiens
ctatctcatttccaagca

SEQ ID NO: 1889208 - DNA, 13 bp, Homo sapiens
ctatgaaatatta

SEQ ID NO: 1889209 - DNA, 16 bp, Homo sapiens
ctatgcattttcttca

SEQ ID NO: 1889210 - DNA, 22 bp, Homo sapiens
ctatgcattttcttcacagtgc

SEQ ID NO: 1889211 - DNA, 22 bp, Homo sapiens
ctatgtaggaaagaccattttt

SEQ ID NO: 1889212 - DNA, 23 bp, Homo sapiens
ctatgtaggaaagaccatttttc

SEQ ID NO: 1889213 - DNA, 18 bp, Homo sapiens
ctatgttttgacattttt

SEQ ID NO: 1889214 - DNA, 14 bp, Homo sapiens
ctattgtgtggtcg

SEQ ID NO: 1889215 - DNA, 17 bp, Homo sapiens
ctatttaaaagtataaa

SEQ ID NO: 1889216 - DNA, 14 bp, Homo sapiens
ctatttaacttgag

SEQ ID NO: 1889217 - DNA, 18 bp, Homo sapiens
ctatttttttttcttttt

SEQ ID NO: 1889218 - DNA, 17 bp, Homo sapiens
ctcaaggcctcccacag

SEQ ID NO: 1889219 - DNA, 13 bp, Homo sapiens
ctcacatgcccgc

SEQ ID NO: 1889220 - DNA, 23 bp, Homo sapiens
ctcacatgcccgctgtcccaggg

SEQ ID NO: 1889221 - DNA, 15 bp, Homo sapiens
ctcaccagcctctgc

SEQ ID NO: 1889222 - DNA, 16 bp, Homo sapiens
ctcaccagcctctgct

SEQ ID NO: 1889223 - DNA, 22 bp, Homo sapiens
ctcaccaggggcaggcacagca

SEQ ID NO: 1889224 - DNA, 20 bp, Homo sapiens
ctcactagctgtctcaggag

SEQ ID NO: 1889225 - DNA, 19 bp, Homo sapiens
ctcactatgctgctatgga

SEQ ID NO: 1889226 - DNA, 23 bp, Homo sapiens
ctcacttttcaatttgtcatgtt

SEQ ID NO: 1889227 - DNA, 19 bp, Homo sapiens
ctcagaaaacaaggatgaa

SEQ ID NO: 1889228 - DNA, 14 bp, Homo sapiens
ctcagctttctaag

SEQ ID NO: 1889229 - DNA, 12 bp, Homo sapiens
ctcagggaccac

SEQ ID NO: 1889230 - DNA, 16 bp, Homo sapiens
ctcagggaccacagca

SEQ ID NO: 1889231 - DNA, 19 bp, Homo sapiens
ctcagggaccacagcaagg

SEQ ID NO: 1889232 - DNA, 16 bp, Homo sapiens
ctcagtcatattctta

SEQ ID NO: 1889233 - DNA, 19 bp, Homo sapiens
ctcatgctggatgacccca

SEQ ID NO: 1889234 - DNA, 23 bp, Homo sapiens
ctcattccccggggcgtttcttt

SEQ ID NO: 1889235 - DNA, 13 bp, Homo sapiens
ctcatttccaagc

SEQ ID NO: 1889236 - DNA, 21 bp, Homo sapiens
ctcatttccaagcaagtatta

SEQ ID NO: 1889237 - DNA, 21 bp, Homo sapiens
ctccaaaccctcgaggcggat

SEQ ID NO: 1889238 - DNA, 12 bp, Homo sapiens
ctccaacaataa

SEQ ID NO: 1889239 - DNA, 13 bp, Homo sapiens
ctccacgccctgg

SEQ ID NO: 1889240 - DNA, 14 bp, Homo sapiens
ctccacgccctggg

SEQ ID NO: 1889241 - DNA, 23 bp, Homo sapiens
ctccagtgtgaatatatggtctg

SEQ ID NO: 1889242 - DNA, 15 bp, Homo sapiens
ctccagttgaacact

SEQ ID NO: 1889243 - DNA, 22 bp, Homo sapiens
ctccatcagatgtgttcctcca

SEQ ID NO: 1889244 - DNA, 16 bp, Homo sapiens
ctccatccctggcccc

SEQ ID NO: 1889245 - DNA, 24 bp, Homo sapiens
ctccatccctggccccctccctgg

SEQ ID NO: 1889246 - DNA, 14 bp, Homo sapiens
ctcccacagtgact

SEQ ID NO: 1889247 - DNA, 19 bp, Homo sapiens
ctcccacttccctgacact

SEQ ID NO: 1889248 - DNA, 23 bp, Homo sapiens
ctcccatgcaagtagctggctgt

SEQ ID NO: 1889249 - DNA, 15 bp, Homo sapiens
ctcccatgggctagg

SEQ ID NO: 1889250 - DNA, 19 bp, Homo sapiens
ctccccatgatgtttagaa

SEQ ID NO: 1889251 - DNA, 13 bp, Homo sapiens
ctcccccccgggg

SEQ ID NO: 1889252 - DNA, 13 bp, Homo sapiens
ctcccccgggagg

SEQ ID NO: 1889253 - DNA, 23 bp, Homo sapiens
ctccgatttaactgggaacccct

SEQ ID NO: 1889254 - DNA, 17 bp, Homo sapiens
ctcctacccctcccagc

SEQ ID NO: 1889255 - DNA, 19 bp, Homo sapiens
ctcctacccctcccagctg

SEQ ID NO: 1889256 - DNA, 15 bp, Homo sapiens
ctcctaggaaaatac

SEQ ID NO: 1889257 - DNA, 20 bp, Homo sapiens
ctcctcaacccctcccctcc

SEQ ID NO: 1889258 - DNA, 13 bp, Homo sapiens
ctcctccaccgcc

SEQ ID NO: 1889259 - DNA, 21 bp, Homo sapiens
ctcctctgctatgcattttct

SEQ ID NO: 1889260 - DNA, 13 bp, Homo sapiens
ctcctgctgcacc

SEQ ID NO: 1889261 - DNA, 23 bp, Homo sapiens
ctccttcaccctccgttgacagt

SEQ ID NO: 1889262 - DNA, 16 bp, Homo sapiens
ctccttcttgccctga

SEQ ID NO: 1889263 - DNA, 20 bp, Homo sapiens
ctccttcttgccctgagctt

SEQ ID NO: 1889264 - DNA, 22 bp, Homo sapiens
ctccttgagggcaagagccaca

SEQ ID NO: 1889265 - DNA, 16 bp, Homo sapiens
ctccttgccctgggcc

SEQ ID NO: 1889266 - DNA, 18 bp, Homo sapiens
ctcgcccaccgcatgccc

SEQ ID NO: 1889267 - DNA, 22 bp, Homo sapiens
ctcgcccaccgcatgccccctc

SEQ ID NO: 1889268 - DNA, 23 bp, Homo sapiens
ctcgcccaccgcatgccccctcg

SEQ ID NO: 1889269 - DNA, 19 bp, Homo sapiens
ctcggctcctgctgcacca

SEQ ID NO: 1889270 - DNA, 20 bp, Homo sapiens
ctcgggagcattctgcctgc

SEQ ID NO: 1889271 - DNA, 12 bp, Homo sapiens
ctcgggcccagg

SEQ ID NO: 1889272 - DNA, 15 bp, Homo sapiens
ctcgggctcctgtgc

SEQ ID NO: 1889273 - DNA, 22 bp, Homo sapiens
ctcgtgccagtcgcgctgcctg

SEQ ID NO: 1889274 - DNA, 24 bp, Homo sapiens
ctcgtgccagtcgcgctgcctgtg

SEQ ID NO: 1889275 - DNA, 13 bp, Homo sapiens
ctctacactgaaa

SEQ ID NO: 1889276 - DNA, 20 bp, Homo sapiens
ctctatgaactctgttttct

SEQ ID NO: 1889277 - DNA, 22 bp, Homo sapiens
ctctccacctagtggctgtcca

SEQ ID NO: 1889278 - DNA, 16 bp, Homo sapiens
ctctccttgccctggg

SEQ ID NO: 1889279 - DNA, 17 bp, Homo sapiens
ctctccttgccctgggc

SEQ ID NO: 1889280 - DNA, 16 bp, Homo sapiens
ctctctccaggcccca

SEQ ID NO: 1889281 - DNA, 18 bp, Homo sapiens
ctctgaagagatacccac

SEQ ID NO: 1889282 - DNA, 21 bp, Homo sapiens
ctctgagacggatggaaggag

SEQ ID NO: 1889283 - DNA, 12 bp, Homo sapiens
ctctgagccctc

SEQ ID NO: 1889284 - DNA, 20 bp, Homo sapiens
ctctgaggagtacccccagc

SEQ ID NO: 1889285 - DNA, 16 bp, Homo sapiens
ctctgctgcttctggg

SEQ ID NO: 1889286 - DNA, 17 bp, Homo sapiens
ctctgctgcttctgggc

SEQ ID NO: 1889287 - DNA, 21 bp, Homo sapiens
ctctgctgcttctgggcctga

SEQ ID NO: 1889288 - DNA, 18 bp, Homo sapiens
ctctgggccctgcaggag

SEQ ID NO: 1889289 - DNA, 19 bp, Homo sapiens
ctctgggccctgcaggagg

SEQ ID NO: 1889290 - DNA, 16 bp, Homo sapiens
ctctgtgcccatgggc

SEQ ID NO: 1889291 - DNA, 20 bp, Homo sapiens
ctctgtgcccatgggcactg

SEQ ID NO: 1889292 - DNA, 23 bp, Homo sapiens
ctctgtgcccatgggcactgctg

SEQ ID NO: 1889293 - DNA, 19 bp, Homo sapiens
ctctgtgctgagcacagag

SEQ ID NO: 1889294 - DNA, 16 bp, Homo sapiens
ctctgtgggctgcact

SEQ ID NO: 1889295 - DNA, 13 bp, Homo sapiens
ctctgtgtcactg

SEQ ID NO: 1889296 - DNA, 16 bp, Homo sapiens
ctctgtgtcactggct

SEQ ID NO: 1889297 - DNA, 13 bp, Homo sapiens
cctgctccacagt

SEQ ID NO: 1889298 - DNA, 12 bp, Homo sapiens
cctgctgcacca

SEQ ID NO: 1889299 - DNA, 18 bp, Homo sapiens
cctgctgcagaggggcag

SEQ ID NO: 1889300 - DNA, 17 bp, Homo sapiens
cctggaagagcagccct

SEQ ID NO: 1889301 - DNA, 15 bp, Homo sapiens
cctggagcccctgtg

SEQ ID NO: 1889302 - DNA, 21 bp, Homo sapiens
cctggcacagtgtctgggctg

SEQ ID NO: 1889303 - DNA, 20 bp, Homo sapiens
cctggcccatcagtgtaccc

SEQ ID NO: 1889304 - DNA, 14 bp, Homo sapiens
cctgggccagccca

SEQ ID NO: 1889305 - DNA, 13 bp, Homo sapiens
cctgggctctgtg

SEQ ID NO: 1889306 - DNA, 14 bp, Homo sapiens
cctgggctctgtgg

SEQ ID NO: 1889307 - DNA, 15 bp, Homo sapiens
cctgggctctgtggg

SEQ ID NO: 1889308 - DNA, 13 bp, Homo sapiens
cctgggctgggag

SEQ ID NO: 1889309 - DNA, 21 bp, Homo sapiens
cctggggtgggtttagcaggc

SEQ ID NO: 1889310 - DNA, 14 bp, Homo sapiens
cctggtgacccctt

SEQ ID NO: 1889311 - DNA, 17 bp, Homo sapiens
cctggtgaccccttttc

SEQ ID NO: 1889312 - DNA, 20 bp, Homo sapiens
cctggtggggaggaagaagt

SEQ ID NO: 1889313 - DNA, 13 bp, Homo sapiens
cctgtcagtgccg

SEQ ID NO: 1889314 - DNA, 15 bp, Homo sapiens
cctgtcagtgccgcc

SEQ ID NO: 1889315 - DNA, 15 bp, Homo sapiens
cctgtgtcggggggc

SEQ ID NO: 1889316 - DNA, 22 bp, Homo sapiens
cctgtgtcggggggcgagggag

SEQ ID NO: 1889317 - DNA, 18 bp, Homo sapiens
cctgtgtgggagggcgag

SEQ ID NO: 1889318 - DNA, 14 bp, Homo sapiens
cctgttctgtagga

SEQ ID NO: 1889319 - DNA, 16 bp, Homo sapiens
cctgttctgtaggaga

SEQ ID NO: 1889320 - DNA, 18 bp, Homo sapiens
cctgttctgtaggagaga

SEQ ID NO: 1889321 - DNA, 16 bp, Homo sapiens
ccttatcgaaactcat

SEQ ID NO: 1889322 - DNA, 23 bp, Homo sapiens
ccttccccgagggatgatgccac

SEQ ID NO: 1889323 - DNA, 17 bp, Homo sapiens
ccttccgctcccaccag

SEQ ID NO: 1889324 - DNA, 14 bp, Homo sapiens
ccttctcccccccg

SEQ ID NO: 1889325 - DNA, 15 bp, Homo sapiens
ccttcttgccctgag

SEQ ID NO: 1889326 - DNA, 17 bp, Homo sapiens
ccttcttgccctgagct

SEQ ID NO: 1889327 - DNA, 19 bp, Homo sapiens
ccttgatggagatatttac

SEQ ID NO: 1889328 - DNA, 21 bp, Homo sapiens
ccttgccctgggccagcccag

SEQ ID NO: 1889329 - DNA, 19 bp, Homo sapiens
ccttggggctgatgcagtt

SEQ ID NO: 1889330 - DNA, 12 bp, Homo sapiens
cctttcagctgt

SEQ ID NO: 1889331 - DNA, 17 bp, Homo sapiens
ccttttcagcttctgct

SEQ ID NO: 1889332 - DNA, 20 bp, Homo sapiens
ccttttcagcttctgctggg

SEQ ID NO: 1889333 - DNA, 18 bp, Homo sapiens
ccttttcatctccagtgt

SEQ ID NO: 1889334 - DNA, 18 bp, Homo sapiens
ccttttcatctgttgttc

SEQ ID NO: 1889335 - DNA, 11 bp, Homo sapiens
ccttttggaac

SEQ ID NO: 1889336 - DNA, 18 bp, Homo sapiens
cgaaacaacttgtgttct

SEQ ID NO: 1889337 - DNA, 19 bp, Homo sapiens
cgacttgaattttcccact

SEQ ID NO: 1889338 - DNA, 21 bp, Homo sapiens
cgacttgaattttcccactgc

SEQ ID NO: 1889339 - DNA, 22 bp, Homo sapiens
cgacttgaattttcccactgca

SEQ ID NO: 1889340 - DNA, 13 bp, Homo sapiens
cgaggaggaacca

SEQ ID NO: 1889341 - DNA, 19 bp, Homo sapiens
cgaggcgggggatcctgga

SEQ ID NO: 1889342 - DNA, 11 bp, Homo sapiens
cgagggagggg

SEQ ID NO: 1889343 - DNA, 15 bp, Homo sapiens
cgagggaggggaggt

SEQ ID NO: 1889344 - DNA, 18 bp, Homo sapiens
cgagggaggggaggtggc

SEQ ID NO: 1889345 - DNA, 16 bp, Homo sapiens
cgcaccctcccctccc

SEQ ID NO: 1889346 - DNA, 14 bp, Homo sapiens
cgcatgccccctcg

SEQ ID NO: 1889347 - DNA, 20 bp, Homo sapiens
cgccatggcttccaaggtgg

SEQ ID NO: 1889348 - DNA, 16 bp, Homo sapiens
cgcccaccgcatgccc

SEQ ID NO: 1889349 - DNA, 16 bp, Homo sapiens
cgccccctggtgggac

SEQ ID NO: 1889350 - DNA, 18 bp, Homo sapiens
cgccgcctcgcccaccgc

SEQ ID NO: 1889351 - DNA, 14 bp, Homo sapiens
cgcctcgcccaccg

SEQ ID NO: 1889352 - DNA, 19 bp, Homo sapiens
cgcctcgcccaccgcatgc

SEQ ID NO: 1889353 - DNA, 12 bp, Homo sapiens
cgcctggcctga

SEQ ID NO: 1889354 - DNA, 13 bp, Homo sapiens
cgccttctccccc

SEQ ID NO: 1889355 - DNA, 19 bp, Homo sapiens
cgccttctcccccccgggg

SEQ ID NO: 1889356 - DNA, 21 bp, Homo sapiens
cgccttctcccccccggggct

SEQ ID NO: 1889357 - DNA, 19 bp, Homo sapiens
cgcgccttctcccccccgg

SEQ ID NO: 1889358 - DNA, 14 bp, Homo sapiens
cgctcccagtgtct

SEQ ID NO: 1889359 - DNA, 22 bp, Homo sapiens
cgctcccagtgtcttcctgtgg

SEQ ID NO: 1889360 - DNA, 12 bp, Homo sapiens
cgctgatgctgg

SEQ ID NO: 1889361 - DNA, 14 bp, Homo sapiens
cgctgatgctgggc

SEQ ID NO: 1889362 - DNA, 16 bp, Homo sapiens
cgctgatgctgggctg

SEQ ID NO: 1889363 - DNA, 17 bp, Homo sapiens
cgctgatgctgggctgg

SEQ ID NO: 1889364 - DNA, 19 bp, Homo sapiens
cgctgatgctgggctgggt

SEQ ID NO: 1889365 - DNA, 21 bp, Homo sapiens
cgctgatgctgggctgggtgc

SEQ ID NO: 1889366 - DNA, 21 bp, Homo sapiens
cgctggccgagctgaagaact

SEQ ID NO: 1889367 - DNA, 14 bp, Homo sapiens
cgcttgcctcggct

SEQ ID NO: 1889368 - DNA, 16 bp, Homo sapiens
cgcttgcctcggctcc

SEQ ID NO: 1889369 - DNA, 21 bp, Homo sapiens
cgcttgcctcggctcctgctg

SEQ ID NO: 1889370 - DNA, 15 bp, Homo sapiens
cggatggaaggagag

SEQ ID NO: 1889371 - DNA, 16 bp, Homo sapiens
cggatggaaggagaga

SEQ ID NO: 1889372 - DNA, 13 bp, Homo sapiens
cggccaggtgggc

SEQ ID NO: 1889373 - DNA, 14 bp, Homo sapiens
cggctcctgctgca

SEQ ID NO: 1889374 - DNA, 17 bp, Homo sapiens
cggctcctgctgcacca

SEQ ID NO: 1889375 - DNA, 16 bp, Homo sapiens
cggctgtctcagactc

SEQ ID NO: 1889376 - DNA, 23 bp, Homo sapiens
cgggagcattctgcctgcctggg

SEQ ID NO: 1889377 - DNA, 15 bp, Homo sapiens
cgggaggggcccgct

SEQ ID NO: 1889378 - DNA, 19 bp, Homo sapiens
cgggaggggcccgcttgcc

SEQ ID NO: 1889379 - DNA, 12 bp, Homo sapiens
cgggcagcacag

SEQ ID NO: 1889380 - DNA, 14 bp, Homo sapiens
cgggcagcacagca

SEQ ID NO: 1889381 - DNA, 13 bp, Homo sapiens
cgggcccaggcca

SEQ ID NO: 1889382 - DNA, 15 bp, Homo sapiens
cgggctcctgtgccc

SEQ ID NO: 1889383 - DNA, 15 bp, Homo sapiens
cggggaggagccttg

SEQ ID NO: 1889384 - DNA, 14 bp, Homo sapiens
cggggcgtttcttt

SEQ ID NO: 1889385 - DNA, 19 bp, Homo sapiens
cggggctggaggtggcgcc

SEQ ID NO: 1889386 - DNA, 21 bp, Homo sapiens
cggggctgggttggcgcaccc

SEQ ID NO: 1889387 - DNA, 14 bp, Homo sapiens
cggggcttggctga

SEQ ID NO: 1889388 - DNA, 17 bp, Homo sapiens
cgggggatcctggagcc

SEQ ID NO: 1889389 - DNA, 17 bp, Homo sapiens
cggggggcgagggaggg

SEQ ID NO: 1889390 - DNA, 18 bp, Homo sapiens
cgggttaagaaatacctt

SEQ ID NO: 1889391 - DNA, 16 bp, Homo sapiens
cggtaggtgctggcct

SEQ ID NO: 1889392 - DNA, 13 bp, Homo sapiens
cggtgaggcaggg

SEQ ID NO: 1889393 - DNA, 20 bp, Homo sapiens
cggtggctcttgcctgtaat

SEQ ID NO: 1889394 - DNA, 22 bp, Homo sapiens
cgtgccagtcgcgctgcctgtg

SEQ ID NO: 1889395 - DNA, 22 bp, Homo sapiens
cgtggccccagcctggcccagc

SEQ ID NO: 1889396 - DNA, 14 bp, Homo sapiens
cgtgtatgtttctt

SEQ ID NO: 1889397 - DNA, 17 bp, Homo sapiens
cgtgtatgtttcttctt

SEQ ID NO: 1889398 - DNA, 17 bp, Homo sapiens
cgttgccgggcctggac

SEQ ID NO: 1889399 - DNA, 16 bp, Homo sapiens
cgttgtctccctggcc

SEQ ID NO: 1889400 - DNA, 23 bp, Homo sapiens
cgtttttataaaaaatggtgcct

SEQ ID NO: 1889401 - DNA, 13 bp, Homo sapiens
ctaaagtttacag

SEQ ID NO: 1889402 - DNA, 18 bp, Homo sapiens
ctaaagtttacagtaaat

SEQ ID NO: 1889403 - DNA, 18 bp, Homo sapiens
ctctgtgtcactggctgc

SEQ ID NO: 1889404 - DNA, 17 bp, Homo sapiens
ctcttaaaaagacactt

SEQ ID NO: 1889405 - DNA, 19 bp, Homo sapiens
ctcttgccccaacccccag

SEQ ID NO: 1889406 - DNA, 20 bp, Homo sapiens
ctcttgccccaacccccagc

SEQ ID NO: 1889407 - DNA, 22 bp, Homo sapiens
ctgaaaatatgtctgcaggttt

SEQ ID NO: 1889408 - DNA, 20 bp, Homo sapiens
ctgaaacgtattcagagtta

SEQ ID NO: 1889409 - DNA, 15 bp, Homo sapiens
ctgaaagacaatata

SEQ ID NO: 1889410 - DNA, 19 bp, Homo sapiens
ctggccccctccctggatg

SEQ ID NO: 1889411 - DNA, 22 bp, Homo sapiens
ctggccctcaaggcctcccaca

SEQ ID NO: 1889412 - DNA, 17 bp, Homo sapiens
ctggcctcgcctggcct

SEQ ID NO: 1889413 - DNA, 20 bp, Homo sapiens
ctggcctgaggtctcgctga

SEQ ID NO: 1889414 - DNA, 14 bp, Homo sapiens
ctttcccaaatgta

SEQ ID NO: 1889415 - DNA, 15 bp, Homo sapiens
ctttccggggaggag

SEQ ID NO: 1889416 - DNA, 23 bp, Homo sapiens
ctttgatttttatccatttcttt

SEQ ID NO: 1889417 - DNA, 21 bp, Homo sapiens
ctttgcatggaatttgtaagt

SEQ ID NO: 1889418 - DNA, 21 bp, Homo sapiens
ctttggacagaagcagctctt

SEQ ID NO: 1889419 - DNA, 21 bp, Homo sapiens
ctttgtttttaaaatagaatg

SEQ ID NO: 1889420 - DNA, 11 bp, Homo sapiens
cttttaaaatg

SEQ ID NO: 1889421 - DNA, 17 bp, Homo sapiens
cttttaaaatgaaatgt

SEQ ID NO: 1889422 - DNA, 18 bp, Homo sapiens
cttttaaaatgaaatgtt

SEQ ID NO: 1889423 - DNA, 20 bp, Homo sapiens
cttttcaatttgtcatgtta

SEQ ID NO: 1889424 - DNA, 14 bp, Homo sapiens
cttttcagcttctg

SEQ ID NO: 1889425 - DNA, 18 bp, Homo sapiens
cttttcagcttctgctgg

SEQ ID NO: 1889426 - DNA, 21 bp, Homo sapiens
cttttcatctccagtgtgaat

SEQ ID NO: 1889427 - DNA, 20 bp, Homo sapiens
cttttcatctgttgttctgt

SEQ ID NO: 1889428 - DNA, 22 bp, Homo sapiens
cttttgaggatgggatgtattt

SEQ ID NO: 1889429 - DNA, 17 bp, Homo sapiens
ctttttaaagtttgttc

SEQ ID NO: 1889430 - DNA, 16 bp, Homo sapiens
ctttttgtacctggtg

SEQ ID NO: 1889431 - DNA, 16 bp, Homo sapiens
gaaaacatttaacata

SEQ ID NO: 1889432 - DNA, 18 bp, Homo sapiens
gaaaacatttaacataat

SEQ ID NO: 1889433 - DNA, 14 bp, Homo sapiens
gaaaagcctctgtg

SEQ ID NO: 1889434 - DNA, 12 bp, Homo sapiens
gaaaatatcact

SEQ ID NO: 1889435 - DNA, 11 bp, Homo sapiens
gaaaatcatat

SEQ ID NO: 1889436 - DNA, 18 bp, Homo sapiens
gaaaggcaagagctcaag

SEQ ID NO: 1889437 - DNA, 21 bp, Homo sapiens
gaaagtgatatcccccagcct

SEQ ID NO: 1889438 - DNA, 13 bp, Homo sapiens
gaaatatatttgt

SEQ ID NO: 1889439 - DNA, 15 bp, Homo sapiens
gaaatatatttgtaa

SEQ ID NO: 1889440 - DNA, 17 bp, Homo sapiens
gaaatatatttgtaaaa

SEQ ID NO: 1889441 - DNA, 16 bp, Homo sapiens
gaaatatttattttaa

SEQ ID NO: 1889442 - DNA, 18 bp, Homo sapiens
gaaatatttattttaata

SEQ ID NO: 1889443 - DNA, 18 bp, Homo sapiens
gaaattgggtgtgccctg

SEQ ID NO: 1889444 - DNA, 16 bp, Homo sapiens
gaacactagtctgtgt

SEQ ID NO: 1889445 - DNA, 24 bp, Homo sapiens
gaacagttacctctgcctcagaaa

SEQ ID NO: 1889446 - DNA, 14 bp, Homo sapiens
gaaccacaagactg

SEQ ID NO: 1889447 - DNA, 21 bp, Homo sapiens
gaaccttggtaaattgtaaac

SEQ ID NO: 1889448 - DNA, 20 bp, Homo sapiens
gaacggggtggacgagggag

SEQ ID NO: 1889449 - DNA, 22 bp, Homo sapiens
gaactgggtatgaggctggggc

SEQ ID NO: 1889450 - DNA, 22 bp, Homo sapiens
gaacttccagatcctggaaatc

SEQ ID NO: 1889451 - DNA, 17 bp, Homo sapiens
gaagaactgggtatgag

SEQ ID NO: 1889452 - DNA, 21 bp, Homo sapiens
gaagaagcaccaatcatgaat

SEQ ID NO: 1889453 - DNA, 14 bp, Homo sapiens
gaagagcacagccc

SEQ ID NO: 1889454 - DNA, 15 bp, Homo sapiens
gaagagcacagccct

SEQ ID NO: 1889455 - DNA, 12 bp, Homo sapiens
gaagagcagccc

SEQ ID NO: 1889456 - DNA, 14 bp, Homo sapiens
gaagatatttttcc

SEQ ID NO: 1889457 - DNA, 14 bp, Homo sapiens
gaagcaaaattttt

SEQ ID NO: 1889458 - DNA, 14 bp, Homo sapiens
gaaggaaatatatt

SEQ ID NO: 1889459 - DNA, 15 bp, Homo sapiens
gaaggccttgctgtc

SEQ ID NO: 1889460 - DNA, 19 bp, Homo sapiens
gaagggcatccttctgcct

SEQ ID NO: 1889461 - DNA, 18 bp, Homo sapiens
gaaggtggcttaccaaga

SEQ ID NO: 1889462 - DNA, 23 bp, Homo sapiens
gaagtccaagcatttagatgtat

SEQ ID NO: 1889463 - DNA, 15 bp, Homo sapiens
gaatagatgtcttca

SEQ ID NO: 1889464 - DNA, 22 bp, Homo sapiens
gaatggactgggtgccacggtg

SEQ ID NO: 1889465 - DNA, 15 bp, Homo sapiens
gaattacatttgtat

SEQ ID NO: 1889466 - DNA, 16 bp, Homo sapiens
gaattggagctcgtgg

SEQ ID NO: 1889467 - DNA, 18 bp, Homo sapiens
gacaacaaagaggacacc

SEQ ID NO: 1889468 - DNA, 12 bp, Homo sapiens
gacacacatgaa

SEQ ID NO: 1889469 - DNA, 13 bp, Homo sapiens
gacacactgaaga

SEQ ID NO: 1889470 - DNA, 14 bp, Homo sapiens
gacacactgaagaa

SEQ ID NO: 1889471 - DNA, 15 bp, Homo sapiens
gacacactgaagaag

SEQ ID NO: 1889472 - DNA, 16 bp, Homo sapiens
gacacactgaagaagc

SEQ ID NO: 1889473 - DNA, 16 bp, Homo sapiens
gacactgcggggcttg

SEQ ID NO: 1889474 - DNA, 20 bp, Homo sapiens
gacactgcggggcttggctg

SEQ ID NO: 1889475 - DNA, 14 bp, Homo sapiens
gacagtatataact

SEQ ID NO: 1889476 - DNA, 14 bp, Homo sapiens
gacagtatatgtca

SEQ ID NO: 1889477 - DNA, 24 bp, Homo sapiens
gacagtcctctccacctagtggct

SEQ ID NO: 1889478 - DNA, 18 bp, Homo sapiens
gacatataccttctcaaa

SEQ ID NO: 1889479 - DNA, 12 bp, Homo sapiens
gacatgaagcat

SEQ ID NO: 1889480 - DNA, 17 bp, Homo sapiens
gacatgggacatttgct

SEQ ID NO: 1889481 - DNA, 18 bp, Homo sapiens
gaccaacccatgccctgc

SEQ ID NO: 1889482 - DNA, 18 bp, Homo sapiens
gaccaagcttaaggagag

SEQ ID NO: 1889483 - DNA, 21 bp, Homo sapiens
gaccaggtgtctagaggcaac

SEQ ID NO: 1889484 - DNA, 16 bp, Homo sapiens
gaccattgtctcagag

SEQ ID NO: 1889485 - DNA, 17 bp, Homo sapiens
gacccatacctttccag

SEQ ID NO: 1889486 - DNA, 19 bp, Homo sapiens
gacccatacctttccaggg

SEQ ID NO: 1889487 - DNA, 18 bp, Homo sapiens
gaccccatctgcccagga

SEQ ID NO: 1889488 - DNA, 17 bp, Homo sapiens
gaccccttttcagcttc

SEQ ID NO: 1889489 - DNA, 20 bp, Homo sapiens
gaccccttttcagcttctgc

SEQ ID NO: 1889490 - DNA, 16 bp, Homo sapiens
gaccctgtttctgtag

SEQ ID NO: 1889491 - DNA, 21 bp, Homo sapiens
gacctcaccaagctgctgtgg

SEQ ID NO: 1889492 - DNA, 17 bp, Homo sapiens
gacctcctaacaagtag

SEQ ID NO: 1889493 - DNA, 18 bp, Homo sapiens
gacggatggaaggagaga

SEQ ID NO: 1889494 - DNA, 20 bp, Homo sapiens
gactagaaaatttaaaacat

SEQ ID NO: 1889495 - DNA, 16 bp, Homo sapiens
gactatttaacttgag

SEQ ID NO: 1889496 - DNA, 17 bp, Homo sapiens
gactcgggctcctgtgc

SEQ ID NO: 1889497 - DNA, 15 bp, Homo sapiens
gactgcagaggagcc

SEQ ID NO: 1889498 - DNA, 14 bp, Homo sapiens
gactgcattatatt

SEQ ID NO: 1889499 - DNA, 17 bp, Homo sapiens
gactggccagaggcagc

SEQ ID NO: 1889500 - DNA, 17 bp, Homo sapiens
gacttagctctgaggag

SEQ ID NO: 1889501 - DNA, 21 bp, Homo sapiens
gacttgaattttcccactgca

SEQ ID NO: 1889502 - DNA, 16 bp, Homo sapiens
gactttagggatctgg

SEQ ID NO: 1889503 - DNA, 23 bp, Homo sapiens
gactttagggatctggggaagga

SEQ ID NO: 1889504 - DNA, 15 bp, Homo sapiens
gactttcccaaatgt

SEQ ID NO: 1889505 - DNA, 17 bp, Homo sapiens
gactttcccaaatgtat

SEQ ID NO: 1889506 - DNA, 22 bp, Homo sapiens
gactttttatggcactagtatt

SEQ ID NO: 1889507 - DNA, 18 bp, Homo sapiens
gagaaaacttatttgagt

SEQ ID NO: 1889508 - DNA, 22 bp, Homo sapiens
gagaaaacttatttgagtgatt

SEQ ID NO: 1889509 - DNA, 22 bp, Homo sapiens
gagaacctagggtgatattaac

SEQ ID NO: 1889510 - DNA, 22 bp, Homo sapiens
gagaacttccagatcctggaaa

SEQ ID NO: 1889511 - DNA, 13 bp, Homo sapiens
gagaagaactgaa

SEQ ID NO: 1889512 - DNA, 16 bp, Homo sapiens
gagaagaactgaaatc

SEQ ID NO: 1889513 - DNA, 20 bp, Homo sapiens
gagaatgagagacacactga

SEQ ID NO: 1889514 - DNA, 21 bp, Homo sapiens
gagaatgagagacacactgaa

SEQ ID NO: 1889515 - DNA, 14 bp, Homo sapiens
gagactgcagagga

SEQ ID NO: 1889516 - DNA, 16 bp, Homo sapiens
gagactggccagaggc

SEQ ID NO: 1889517 - DNA, 18 bp, Homo sapiens
gagactggccagaggcag

SEQ ID NO: 1889518 - DNA, 20 bp, Homo sapiens
gagagaaaacttatttgagt

SEQ ID NO: 1889519 - DNA, 17 bp, Homo sapiens
gagagactggccagagg

SEQ ID NO: 1889520 - DNA, 19 bp, Homo sapiens
gagagagcagcttctgcca

SEQ ID NO: 1889521 - DNA, 16 bp, Homo sapiens
gagagcacctggtggg

SEQ ID NO: 1889522 - DNA, 16 bp, Homo sapiens
gagagcagcttctgcc

SEQ ID NO: 1889523 - DNA, 15 bp, Homo sapiens
gagagcatctgctct

SEQ ID NO: 1889524 - DNA, 11 bp, Homo sapiens
gagaggcagaa

SEQ ID NO: 1889525 - DNA, 15 bp, Homo sapiens
gagaggcagaaaggg

SEQ ID NO: 1889526 - DNA, 21 bp, Homo sapiens
gagaggttgaggatgcactgg

SEQ ID NO: 1889527 - DNA, 19 bp, Homo sapiens
gagagtacccccctgagag

SEQ ID NO: 1889528 - DNA, 22 bp, Homo sapiens
gagatatttacatgaattgcat

SEQ ID NO: 1889529 - DNA, 20 bp, Homo sapiens
gagatgagttgcagttttta

SEQ ID NO: 1889530 - DNA, 21 bp, Homo sapiens
gagattgcaccactgcactcc

SEQ ID NO: 1889531 - DNA, 14 bp, Homo sapiens
gagcaaagtctaaa

SEQ ID NO: 1889532 - DNA, 20 bp, Homo sapiens
gcagactttcccaaatgtat

SEQ ID NO: 1889533 - DNA, 22 bp, Homo sapiens
gcagactttcccaaatgtattg

SEQ ID NO: 1889534 - DNA, 17 bp, Homo sapiens
gcagaggagccacctgg

SEQ ID NO: 1889535 - DNA, 22 bp, Homo sapiens
gctgtcccaggggtctccctga

SEQ ID NO: 1889536 - DNA, 16 bp, Homo sapiens
gctgtcccctcttgcc

SEQ ID NO: 1889537 - DNA, 20 bp, Homo sapiens
gctgtcccctcttgccccaa

SEQ ID NO: 1889538 - DNA, 23 bp, Homo sapiens
gctgtcccctcttgccccaaccc

SEQ ID NO: 1889539 - DNA, 15 bp, Homo sapiens
gctgtgccaccctgg

SEQ ID NO: 1889540 - DNA, 20 bp, Homo sapiens
gctgttcagtgctttttcct

SEQ ID NO: 1889541 - DNA, 18 bp, Homo sapiens
gctgttggctgggggcat

SEQ ID NO: 1889542 - DNA, 18 bp, Homo sapiens
gcttcagttgttttcccg

SEQ ID NO: 1889543 - DNA, 22 bp, Homo sapiens
gcttcattcaagtcagctcttc

SEQ ID NO: 1889544 - DNA, 12 bp, Homo sapiens
gcttccaagccc

SEQ ID NO: 1889545 - DNA, 21 bp, Homo sapiens
gcttccacgtactgcagcctc

SEQ ID NO: 1889546 - DNA, 13 bp, Homo sapiens
gcttctgccactt

SEQ ID NO: 1889547 - DNA, 14 bp, Homo sapiens
gcttctgccacttc

SEQ ID NO: 1889548 - DNA, 19 bp, Homo sapiens
gcttctgccacttcccagg

SEQ ID NO: 1889549 - DNA, 21 bp, Homo sapiens
gcttctgccacttcccaggta

SEQ ID NO: 1889550 - DNA, 18 bp, Homo sapiens
gcttctgcggtgaggcag

SEQ ID NO: 1889551 - DNA, 19 bp, Homo sapiens
gcttctgcggtgaggcagg

SEQ ID NO: 1889552 - DNA, 21 bp, Homo sapiens
gcttctgcggtgaggcagggg

SEQ ID NO: 1889553 - DNA, 15 bp, Homo sapiens
gcttctgctgggctg

SEQ ID NO: 1889554 - DNA, 22 bp, Homo sapiens
gcttctgctgggctggggcctg

SEQ ID NO: 1889555 - DNA, 19 bp, Homo sapiens
gcttctgggcctgatggag

SEQ ID NO: 1889556 - DNA, 12 bp, Homo sapiens
gcttctgtgcct

SEQ ID NO: 1889557 - DNA, 19 bp, Homo sapiens
gcttctgttttataatttt

SEQ ID NO: 1889558 - DNA, 14 bp, Homo sapiens
gcttgatctgtgat

SEQ ID NO: 1889559 - DNA, 15 bp, Homo sapiens
gcttgatctgtgatt

SEQ ID NO: 1889560 - DNA, 14 bp, Homo sapiens
gcttgcctcggctc

SEQ ID NO: 1889561 - DNA, 16 bp, Homo sapiens
gcttgcctcggctcct

SEQ ID NO: 1889562 - DNA, 20 bp, Homo sapiens
gcttgcctcggctcctgctg

SEQ ID NO: 1889563 - DNA, 21 bp, Homo sapiens
gcttgcctcggctcctgctgc

SEQ ID NO: 1889564 - DNA, 22 bp, Homo sapiens
gcttgcctcggctcctgctgca

SEQ ID NO: 1889565 - DNA, 23 bp, Homo sapiens
gcttgcctcggctcctgctgcac

SEQ ID NO: 1889566 - DNA, 20 bp, Homo sapiens
gcttgctgatggctgctgga

SEQ ID NO: 1889567 - DNA, 23 bp, Homo sapiens
gcttgctgatggctgctggaggg

SEQ ID NO: 1889568 - DNA, 21 bp, Homo sapiens
gcttggtgcggtaggtgctgg

SEQ ID NO: 1889569 - DNA, 23 bp, Homo sapiens
gcttggtgcggtaggtgctggcc

SEQ ID NO: 1889570 - DNA, 23 bp, Homo sapiens
gcttgtagaatttttaaaaaagt

SEQ ID NO: 1889571 - DNA, 23 bp, Homo sapiens
gctttagtcctagaggacctgag

SEQ ID NO: 1889572 - DNA, 14 bp, Homo sapiens
gctttattgtgatt

SEQ ID NO: 1889573 - DNA, 13 bp, Homo sapiens
gctttcaaatgta

SEQ ID NO: 1889574 - DNA, 14 bp, Homo sapiens
gctttcaaatgtac

SEQ ID NO: 1889575 - DNA, 13 bp, Homo sapiens
gctttcaccagcc

SEQ ID NO: 1889576 - DNA, 15 bp, Homo sapiens
gctttcaccagccac

SEQ ID NO: 1889577 - DNA, 14 bp, Homo sapiens
gctttccggggagg

SEQ ID NO: 1889578 - DNA, 14 bp, Homo sapiens
gctttggaagccat

SEQ ID NO: 1889579 - DNA, 12 bp, Homo sapiens
gctttttccttt

SEQ ID NO: 1889580 - DNA, 23 bp, Homo sapiens
gctttttccttttcatctgttgt

SEQ ID NO: 1889581 - DNA, 15 bp, Homo sapiens
ggaaatatttatttt

SEQ ID NO: 1889582 - DNA, 18 bp, Homo sapiens
ggaagagcacagccctcc

SEQ ID NO: 1889583 - DNA, 22 bp, Homo sapiens
ggaaggaccaacccatgccctg

SEQ ID NO: 1889584 - DNA, 13 bp, Homo sapiens
ggaaggccttgct

SEQ ID NO: 1889585 - DNA, 22 bp, Homo sapiens
ggaaggtggcttaccaagatca

SEQ ID NO: 1889586 - DNA, 21 bp, Homo sapiens
ggacaccatttttccagagct

SEQ ID NO: 1889587 - DNA, 16 bp, Homo sapiens
ggacagaagcagctct

SEQ ID NO: 1889588 - DNA, 17 bp, Homo sapiens
ggacagaagcagctctt

SEQ ID NO: 1889589 - DNA, 16 bp, Homo sapiens
ggacatttgctcatgg

SEQ ID NO: 1889590 - DNA, 20 bp, Homo sapiens
ggaccacagcaaggcacctg

SEQ ID NO: 1889591 - DNA, 22 bp, Homo sapiens
ggacccacgaggaggaaccagg

SEQ ID NO: 1889592 - DNA, 15 bp, Homo sapiens
ggaccccgagcctgg

SEQ ID NO: 1889593 - DNA, 15 bp, Homo sapiens
ggacctttcagctgt

SEQ ID NO: 1889594 - DNA, 19 bp, Homo sapiens
ggactgtcctaggtgaccc

SEQ ID NO: 1889595 - DNA, 15 bp, Homo sapiens
ggagaaacaggccca

SEQ ID NO: 1889596 - DNA, 14 bp, Homo sapiens
ggagaagaactgaa

SEQ ID NO: 1889597 - DNA, 13 bp, Homo sapiens
ggagaaggtgctt

SEQ ID NO: 1889598 - DNA, 16 bp, Homo sapiens
ggagaaggtgcttggg

SEQ ID NO: 1889599 - DNA, 14 bp, Homo sapiens
ggagagactggcca

SEQ ID NO: 1889600 - DNA, 18 bp, Homo sapiens
ggagagcatctgctctga

SEQ ID NO: 1889601 - DNA, 12 bp, Homo sapiens
ggagaggagaac

SEQ ID NO: 1889602 - DNA, 16 bp, Homo sapiens
ggagaggttgtctgtg

SEQ ID NO: 1889603 - DNA, 20 bp, Homo sapiens
ggagagtacccccctgagag

SEQ ID NO: 1889604 - DNA, 16 bp, Homo sapiens
ggagatgagttgcagt

SEQ ID NO: 1889605 - DNA, 19 bp, Homo sapiens
ggagatggaggaaagtgat

SEQ ID NO: 1889606 - DNA, 21 bp, Homo sapiens
ggagcattctgcctgcctggg

SEQ ID NO: 1889607 - DNA, 19 bp, Homo sapiens
ggagccacctgggctggga

SEQ ID NO: 1889608 - DNA, 20 bp, Homo sapiens
ggagccagtgtgaggctgta

SEQ ID NO: 1889609 - DNA, 14 bp, Homo sapiens
ggaggcaggactcc

SEQ ID NO: 1889610 - DNA, 15 bp, Homo sapiens
ggaggcctgggaggg

SEQ ID NO: 1889611 - DNA, 19 bp, Homo sapiens
ggaggctcccatgggctag

SEQ ID NO: 1889612 - DNA, 22 bp, Homo sapiens
ggagggcgaggcgggggagcct

SEQ ID NO: 1889613 - DNA, 14 bp, Homo sapiens
ggaggttgcagtga

SEQ ID NO: 1889614 - DNA, 17 bp, Homo sapiens
ggagtacccccagccca

SEQ ID NO: 1889615 - DNA, 21 bp, Homo sapiens
ggagtgtaattacctgtcatc

SEQ ID NO: 1889616 - DNA, 20 bp, Homo sapiens
ggatcctctctccaggcccc

SEQ ID NO: 1889617 - DNA, 17 bp, Homo sapiens
ggatcctggagcccctg

SEQ ID NO: 1889618 - DNA, 21 bp, Homo sapiens
ggatctttggacagaagcagc

SEQ ID NO: 1889619 - DNA, 15 bp, Homo sapiens
ggatgaccccatgct

SEQ ID NO: 1889620 - DNA, 14 bp, Homo sapiens
ggatgatgccacac

SEQ ID NO: 1889621 - DNA, 15 bp, Homo sapiens
ggatgcactggcctg

SEQ ID NO: 1889622 - DNA, 19 bp, Homo sapiens
ggatggaaggagagaggtt

SEQ ID NO: 1889623 - DNA, 14 bp, Homo sapiens
ggatttatttttcc

SEQ ID NO: 1889624 - DNA, 18 bp, Homo sapiens
ggcaacagtgttctgagc

SEQ ID NO: 1889625 - DNA, 14 bp, Homo sapiens
ggcaaggtggggga

SEQ ID NO: 1889626 - DNA, 20 bp, Homo sapiens
ggcaaggtgggggagcctgg

SEQ ID NO: 1889627 - DNA, 22 bp, Homo sapiens
ggcaaggtgggggagcctggag

SEQ ID NO: 1889628 - DNA, 15 bp, Homo sapiens
ggcacagtgtctggg

SEQ ID NO: 1889629 - DNA, 16 bp, Homo sapiens
ggcacctgcaggttgg

SEQ ID NO: 1889630 - DNA, 20 bp, Homo sapiens
ggcacctgcaggttgggcca

SEQ ID NO: 1889631 - DNA, 13 bp, Homo sapiens
ggcagaggagagt

SEQ ID NO: 1889632 - DNA, 16 bp, Homo sapiens
ggcagcaggtgctgct

SEQ ID NO: 1889633 - DNA, 21 bp, Homo sapiens
ggcagcaggtgctgctaccct

SEQ ID NO: 1889634 - DNA, 17 bp, Homo sapiens
ggcaggaatcaaggagc

SEQ ID NO: 1889635 - DNA, 18 bp, Homo sapiens
ggcaggaatcaaggagcc

SEQ ID NO: 1889636 - DNA, 18 bp, Homo sapiens
ggcaggcacagcacaggg

SEQ ID NO: 1889637 - DNA, 14 bp, Homo sapiens
ggcaggccctgcac

SEQ ID NO: 1889638 - DNA, 15 bp, Homo sapiens
ggcaggccctgcact

SEQ ID NO: 1889639 - DNA, 21 bp, Homo sapiens
ggcaggccctgcactgtcctg

SEQ ID NO: 1889640 - DNA, 16 bp, Homo sapiens
gtagtctcatatcagg

SEQ ID NO: 1889641 - DNA, 16 bp, Homo sapiens
gtatatgtcatttatt

SEQ ID NO: 1889642 - DNA, 14 bp, Homo sapiens
gtatctggctgggt

SEQ ID NO: 1889643 - DNA, 15 bp, Homo sapiens
gtatctggctgggtt

SEQ ID NO: 1889644 - DNA, 18 bp, Homo sapiens
gtatgtttcttctttctt

SEQ ID NO: 1889645 - DNA, 23 bp, Homo sapiens
gtattaatctgtttgtgcaaaca

SEQ ID NO: 1889646 - DNA, 22 bp, Homo sapiens
gtattaggggtaatatattgct

SEQ ID NO: 1889647 - DNA, 13 bp, Homo sapiens
gtattgattacaa

SEQ ID NO: 1889648 - DNA, 20 bp, Homo sapiens
gtattgattacaaataaaca

SEQ ID NO: 1889649 - DNA, 18 bp, Homo sapiens
gtattgtaaaacattcac

SEQ ID NO: 1889650 - DNA, 16 bp, Homo sapiens
gtattgtgattatcaa

SEQ ID NO: 1889651 - DNA, 18 bp, Homo sapiens
gtattttaaaagaatgat

SEQ ID NO: 1889652 - DNA, 20 bp, Homo sapiens
gtattttaaaagaatgatta

SEQ ID NO: 1889653 - DNA, 23 bp, Homo sapiens
gtcaataaaatccatacatttgt

SEQ ID NO: 1889654 - DNA, 17 bp, Homo sapiens
gtcacaggttggccaga

SEQ ID NO: 1889655 - DNA, 17 bp, Homo sapiens
gtcaccggtcagtgcct

SEQ ID NO: 1889656 - DNA, 19 bp, Homo sapiens
gtcactggctgcctccact

SEQ ID NO: 1889657 - DNA, 21 bp, Homo sapiens
gtcagcaagtcctaagcctgt

SEQ ID NO: 1889658 - DNA, 13 bp, Homo sapiens
gtcaggaaagaga

SEQ ID NO: 1889659 - DNA, 14 bp, Homo sapiens
gtcaggaaagagaa

SEQ ID NO: 1889660 - DNA, 23 bp, Homo sapiens
gtcataaattacacaataaagca

SEQ ID NO: 1889661 - DNA, 19 bp, Homo sapiens
gtcatgcctcactttcttc

SEQ ID NO: 1889662 - DNA, 22 bp, Homo sapiens
gtccagagcttcagggctgggc

SEQ ID NO: 1889663 - DNA, 22 bp, Homo sapiens
gttgactgtaggcgcccctggg

SEQ ID NO: 1889664 - DNA, 16 bp, Homo sapiens
gttgaggatgcactgg

SEQ ID NO: 1889665 - DNA, 20 bp, Homo sapiens
gttgatggtggtatgttttc

SEQ ID NO: 1889666 - DNA, 21 bp, Homo sapiens
gttgcctgctgagctgtgccc

SEQ ID NO: 1889667 - DNA, 23 bp, Homo sapiens
gttggaaattgggtgtgccctgg

SEQ ID NO: 1889668 - DNA, 23 bp, Homo sapiens
gttggccagaaaaccctggtaag

SEQ ID NO: 1889669 - DNA, 18 bp, Homo sapiens
gttggcgagaggaggggc

SEQ ID NO: 1889670 - DNA, 19 bp, Homo sapiens
gttggcgcaccctcccctc

SEQ ID NO: 1889671 - DNA, 12 bp, Homo sapiens
gttggctggggg

SEQ ID NO: 1889672 - DNA, 23 bp, Homo sapiens
gttggctgggggcatgggggagg

SEQ ID NO: 1889673 - DNA, 13 bp, Homo sapiens
gttgtctccctgg

SEQ ID NO: 1889674 - DNA, 14 bp, Homo sapiens
gttgtctccctggc

SEQ ID NO: 1889675 - DNA, 16 bp, Homo sapiens
gttgtctccctggccc

SEQ ID NO: 1889676 - DNA, 22 bp, Homo sapiens
gttgtgcttgctggtactaaga

SEQ ID NO: 1889677 - DNA, 18 bp, Homo sapiens
gttgtgtcataaattaca

SEQ ID NO: 1889678 - DNA, 17 bp, Homo sapiens
gttgttctgtggtcaca

SEQ ID NO: 1889679 - DNA, 20 bp, Homo sapiens
gtttaagttgtattaaaaat

SEQ ID NO: 1889680 - DNA, 13 bp, Homo sapiens
gtttacagtaaat

SEQ ID NO: 1889681 - DNA, 15 bp, Homo sapiens
gtttacagtaaataa

SEQ ID NO: 1889682 - DNA, 14 bp, Homo sapiens
gtttagcaggctgc

SEQ ID NO: 1889683 - DNA, 21 bp, Homo sapiens
gtttagctggaaaagtatgtt

SEQ ID NO: 1889684 - DNA, 17 bp, Homo sapiens
gtttatattgggaagct

SEQ ID NO: 1889685 - DNA, 23 bp, Homo sapiens
gtttctgtagaaaagaaaacatt

SEQ ID NO: 1889686 - DNA, 16 bp, Homo sapiens
gtttcttgcactgaat

SEQ ID NO: 1889687 - DNA, 16 bp, Homo sapiens
gtttgttcacttaaat

SEQ ID NO: 1889688 - DNA, 18 bp, Homo sapiens
gttttcaggctagatgta

SEQ ID NO: 1889689 - DNA, 22 bp, Homo sapiens
gttttcccgagcaaagtctaaa

SEQ ID NO: 1889690 - DNA, 17 bp, Homo sapiens
gttttggtggttttagt

SEQ ID NO: 1889691 - DNA, 23 bp, Homo sapiens
gtttttataaaaaatggtgcctg

SEQ ID NO: 1889692 - DNA, 16 bp, Homo sapiens
taaaaaagaaacattt

SEQ ID NO: 1889693 - DNA, 21 bp, Homo sapiens
taaaaagacacttatattttg

SEQ ID NO: 1889694 - DNA, 18 bp, Homo sapiens
taaaaatagatatataag

SEQ ID NO: 1889695 - DNA, 16 bp, Homo sapiens
taaaactgctttgtat

SEQ ID NO: 1889696 - DNA, 13 bp, Homo sapiens
taaaagttgcgtt

SEQ ID NO: 1889697 - DNA, 23 bp, Homo sapiens
taaaagttgcgtttaagttgtat

SEQ ID NO: 1889698 - DNA, 17 bp, Homo sapiens
taaaatccatacatttg

SEQ ID NO: 1889699 - DNA, 19 bp, Homo sapiens
taaaatccatacatttgtg

SEQ ID NO: 1889700 - DNA, 15 bp, Homo sapiens
taaaattgtaaaatt

SEQ ID NO: 1889701 - DNA, 22 bp, Homo sapiens
taaaattgtaaaattgtataga

SEQ ID NO: 1889702 - DNA, 14 bp, Homo sapiens
taaaattgtataga

SEQ ID NO: 1889703 - DNA, 16 bp, Homo sapiens
taaaattgtatagaga

SEQ ID NO: 1889704 - DNA, 15 bp, Homo sapiens
taaacactccacagt

SEQ ID NO: 1889705 - DNA, 18 bp, Homo sapiens
taaacagctaataatgaa

SEQ ID NO: 1889706 - DNA, 19 bp, Homo sapiens
taaacatctagcagtaaat

SEQ ID NO: 1889707 - DNA, 19 bp, Homo sapiens
taaacccaggaggcggagg

SEQ ID NO: 1889708 - DNA, 19 bp, Homo sapiens
taaaggaccctgtttctgt

SEQ ID NO: 1889709 - DNA, 21 bp, Homo sapiens
taaaggaccctgtttctgtag

SEQ ID NO: 1889710 - DNA, 24 bp, Homo sapiens
taaaggaccctgtttctgtagaaa

SEQ ID NO: 1889711 - DNA, 23 bp, Homo sapiens
taaagtttggtattgtaaaacat

SEQ ID NO: 1889712 - DNA, 16 bp, Homo sapiens
taaagtttgttcactt

SEQ ID NO: 1889713 - DNA, 12 bp, Homo sapiens
taaataaagctc

SEQ ID NO: 1889714 - DNA, 15 bp, Homo sapiens
taaataaattgtttg

SEQ ID NO: 1889715 - DNA, 20 bp, Homo sapiens
taaataaattgtttgaccat

SEQ ID NO: 1889716 - DNA, 15 bp, Homo sapiens
taaatacttgcagtt

SEQ ID NO: 1889717 - DNA, 18 bp, Homo sapiens
taaatacttgcagttgtg

SEQ ID NO: 1889718 - DNA, 17 bp, Homo sapiens
taaatagaccattaatc

SEQ ID NO: 1889719 - DNA, 22 bp, Homo sapiens
taaatattttttcttttctatt

SEQ ID NO: 1889720 - DNA, 20 bp, Homo sapiens
taaatggcttcctggcaata

SEQ ID NO: 1889721 - DNA, 16 bp, Homo sapiens
taaatggtgttacatt

SEQ ID NO: 1889722 - DNA, 15 bp, Homo sapiens
taaatgtctgacaca

SEQ ID NO: 1889723 - DNA, 15 bp, Homo sapiens
taaatgttgacatgg

SEQ ID NO: 1889724 - DNA, 22 bp, Homo sapiens
taaattgtcagatcgttcattg

SEQ ID NO: 1889725 - DNA, 15 bp, Homo sapiens
taacaatgctgtatt

SEQ ID NO: 1889726 - DNA, 17 bp, Homo sapiens
taacaatgctgtatttt

SEQ ID NO: 1889727 - DNA, 19 bp, Homo sapiens
taacaatgctgtattttaa

SEQ ID NO: 1889728 - DNA, 15 bp, Homo sapiens
taacagttgtgtcat

SEQ ID NO: 1889729 - DNA, 22 bp, Homo sapiens
taacagttgtgtcataaattac

SEQ ID NO: 1889730 - DNA, 23 bp, Homo sapiens
taacataatggttgtgaaatgta

SEQ ID NO: 1889731 - DNA, 12 bp, Homo sapiens
taacatctttgt

SEQ ID NO: 1889732 - DNA, 15 bp, Homo sapiens
taacatctttgtttt

SEQ ID NO: 1889733 - DNA, 18 bp, Homo sapiens
taacatctttgtttttaa

SEQ ID NO: 1889734 - DNA, 21 bp, Homo sapiens
taactaaggtcccataataaa

SEQ ID NO: 1889735 - DNA, 23 bp, Homo sapiens
taactatagtccagctttgttct

SEQ ID NO: 1889736 - DNA, 22 bp, Homo sapiens
taactctatagttattgtttta

SEQ ID NO: 1889737 - DNA, 19 bp, Homo sapiens
taactgggaaccccttctt

SEQ ID NO: 1889738 - DNA, 20 bp, Homo sapiens
taacttccctgaaaaatcta

SEQ ID NO: 1889739 - DNA, 14 bp, Homo sapiens
taactttaaacatc

SEQ ID NO: 1889740 - DNA, 17 bp, Homo sapiens
taactttaaacatctag

SEQ ID NO: 1889741 - DNA, 22 bp, Homo sapiens
taacttttttttttttaacatc

SEQ ID NO: 1889742 - DNA, 14 bp, Homo sapiens
taagagagaatgag

SEQ ID NO: 1889743 - DNA, 23 bp, Homo sapiens
taagagagaatgagagacacact

SEQ ID NO: 1889744 - DNA, 18 bp, Homo sapiens
taagcaggaggaggtgcc

SEQ ID NO: 1889745 - DNA, 16 bp, Homo sapiens
taagcattccaactat

SEQ ID NO: 1889746 - DNA, 18 bp, Homo sapiens
taagcattccaactatct

SEQ ID NO: 1889747 - DNA, 20 bp, Homo sapiens
taagcattccaactatctca

SEQ ID NO: 1889748 - DNA, 18 bp, Homo sapiens
taagccatttaactggag

SEQ ID NO: 1889749 - DNA, 16 bp, Homo sapiens
taagccttcatttgca

SEQ ID NO: 1889750 - DNA, 13 bp, Homo sapiens
taagctgaaaata

SEQ ID NO: 1889751 - DNA, 14 bp, Homo sapiens
taagctgaaaatat

SEQ ID NO: 1889752 - DNA, 17 bp, Homo sapiens
gcagaggggcaggccct

SEQ ID NO: 1889753 - DNA, 13 bp, Homo sapiens
gcagcaggtgctg

SEQ ID NO: 1889754 - DNA, 18 bp, Homo sapiens
gcagcaggtgctgctacc

SEQ ID NO: 1889755 - DNA, 13 bp, Homo sapiens
gcagcagtgagct

SEQ ID NO: 1889756 - DNA, 14 bp, Homo sapiens
gcagcttctgccac

SEQ ID NO: 1889757 - DNA, 18 bp, Homo sapiens
gcaggaatcaaggagcct

SEQ ID NO: 1889758 - DNA, 15 bp, Homo sapiens
gcaggaggaggtgcc

SEQ ID NO: 1889759 - DNA, 13 bp, Homo sapiens
gcaggaggcctgg

SEQ ID NO: 1889760 - DNA, 14 bp, Homo sapiens
gcaggaggcctggg

SEQ ID NO: 1889761 - DNA, 12 bp, Homo sapiens
gcaggcacagca

SEQ ID NO: 1889762 - DNA, 13 bp, Homo sapiens
gcaggcacagcac

SEQ ID NO: 1889763 - DNA, 18 bp, Homo sapiens
gcaggcacagcacaggga

SEQ ID NO: 1889764 - DNA, 14 bp, Homo sapiens
gcaggccctgcact

SEQ ID NO: 1889765 - DNA, 20 bp, Homo sapiens
gcaggccctgcactgtcctg

SEQ ID NO: 1889766 - DNA, 21 bp, Homo sapiens
gcaggccctgcactgtcctgc

SEQ ID NO: 1889767 - DNA, 18 bp, Homo sapiens
gcaggctgcagcaggcag

SEQ ID NO: 1889768 - DNA, 14 bp, Homo sapiens
gcagggatttgagg

SEQ ID NO: 1889769 - DNA, 15 bp, Homo sapiens
gcagggatttgagga

SEQ ID NO: 1889770 - DNA, 15 bp, Homo sapiens
gcaggtcctggggag

SEQ ID NO: 1889771 - DNA, 21 bp, Homo sapiens
gcaggtgctgctaccctccct

SEQ ID NO: 1889772 - DNA, 23 bp, Homo sapiens
gcaggttgggccatactggcctc

SEQ ID NO: 1889773 - DNA, 15 bp, Homo sapiens
gcagtatgaaaataa

SEQ ID NO: 1889774 - DNA, 22 bp, Homo sapiens
gcagtccagagcttcagggctg

SEQ ID NO: 1889775 - DNA, 16 bp, Homo sapiens
gcagtgagcttctatt

SEQ ID NO: 1889776 - DNA, 11 bp, Homo sapiens
gcagtgggtcc

SEQ ID NO: 1889777 - DNA, 19 bp, Homo sapiens
gcagtgggtcccacttccc

SEQ ID NO: 1889778 - DNA, 14 bp, Homo sapiens
gcagttctgaagaa

SEQ ID NO: 1889779 - DNA, 22 bp, Homo sapiens
gcagttgttgcccacagctgta

SEQ ID NO: 1889780 - DNA, 14 bp, Homo sapiens
gcatgggggaggct

SEQ ID NO: 1889781 - DNA, 19 bp, Homo sapiens
gcatgggggaggctctgaa

SEQ ID NO: 1889782 - DNA, 16 bp, Homo sapiens
gcatgtgggggaaggc

SEQ ID NO: 1889783 - DNA, 17 bp, Homo sapiens
gcattctgcctgcctgg

SEQ ID NO: 1889784 - DNA, 20 bp, Homo sapiens
gcattggcagcaggtgctgc

SEQ ID NO: 1889785 - DNA, 21 bp, Homo sapiens
gccaacagtgttaggcctggc

SEQ ID NO: 1889786 - DNA, 23 bp, Homo sapiens
gccaacagtgttaggcctggcac

SEQ ID NO: 1889787 - DNA, 16 bp, Homo sapiens
gccaactcgggagcat

SEQ ID NO: 1889788 - DNA, 15 bp, Homo sapiens
gccaagatcacagtg

SEQ ID NO: 1889789 - DNA, 21 bp, Homo sapiens
gccaagatcacagtggccacg

SEQ ID NO: 1889790 - DNA, 12 bp, Homo sapiens
gccaagcctgga

SEQ ID NO: 1889791 - DNA, 13 bp, Homo sapiens
gccaagcctggag

SEQ ID NO: 1889792 - DNA, 14 bp, Homo sapiens
gccaagcctggagc

SEQ ID NO: 1889793 - DNA, 22 bp, Homo sapiens
gccacaccaagctgtgccaccc

SEQ ID NO: 1889794 - DNA, 23 bp, Homo sapiens
gccacaccaagctgtgccaccct

SEQ ID NO: 1889795 - DNA, 17 bp, Homo sapiens
gccacagtctccccaga

SEQ ID NO: 1889796 - DNA, 19 bp, Homo sapiens
gccacagtctccccagata

SEQ ID NO: 1889797 - DNA, 21 bp, Homo sapiens
gccaccagctccactggcctg

SEQ ID NO: 1889798 - DNA, 20 bp, Homo sapiens
gccacctgggctgggagaag

SEQ ID NO: 1889799 - DNA, 20 bp, Homo sapiens
gccacgaggtggtagctctg

SEQ ID NO: 1889800 - DNA, 23 bp, Homo sapiens
gccacgaggtggtagctctgagc

SEQ ID NO: 1889801 - DNA, 21 bp, Homo sapiens
gccacggtggacttagctctg

SEQ ID NO: 1889802 - DNA, 15 bp, Homo sapiens
gccacttcccaggta

SEQ ID NO: 1889803 - DNA, 15 bp, Homo sapiens
gccagccccacagcc

SEQ ID NO: 1889804 - DNA, 18 bp, Homo sapiens
gccaggtgggcgggcagc

SEQ ID NO: 1889805 - DNA, 14 bp, Homo sapiens
gccagtcgcgctgc

SEQ ID NO: 1889806 - DNA, 16 bp, Homo sapiens
gccagtcgcgctgcct

SEQ ID NO: 1889807 - DNA, 15 bp, Homo sapiens
gccataccaggtgct

SEQ ID NO: 1889808 - DNA, 15 bp, Homo sapiens
gccatactggcctcg

SEQ ID NO: 1889809 - DNA, 17 bp, Homo sapiens
gccatttaactggagct

SEQ ID NO: 1889810 - DNA, 17 bp, Homo sapiens
gcccaaattcatataaa

SEQ ID NO: 1889811 - DNA, 17 bp, Homo sapiens
gcccaccgcatgccccc

SEQ ID NO: 1889812 - DNA, 15 bp, Homo sapiens
gcccacgtcctgtca

SEQ ID NO: 1889813 - DNA, 17 bp, Homo sapiens
gcccagagaggaaggtg

SEQ ID NO: 1889814 - DNA, 13 bp, Homo sapiens
gcccagctccccc

SEQ ID NO: 1889815 - DNA, 16 bp, Homo sapiens
gcccagctcccccggg

SEQ ID NO: 1889816 - DNA, 21 bp, Homo sapiens
gcccaggacggggccggccag

SEQ ID NO: 1889817 - DNA, 19 bp, Homo sapiens
gcccaggccatcttccagg

SEQ ID NO: 1889818 - DNA, 13 bp, Homo sapiens
gcccaggctggcc

SEQ ID NO: 1889819 - DNA, 15 bp, Homo sapiens
gcccaggctggccag

SEQ ID NO: 1889820 - DNA, 20 bp, Homo sapiens
gcccaggctggccagcccca

SEQ ID NO: 1889821 - DNA, 22 bp, Homo sapiens
gcccaggctggccagccccaca

SEQ ID NO: 1889822 - DNA, 20 bp, Homo sapiens
gcccatcagtgtacccccgc

SEQ ID NO: 1889823 - DNA, 12 bp, Homo sapiens
gcccatcccccc

SEQ ID NO: 1889824 - DNA, 16 bp, Homo sapiens
gcccatgggcactgct

SEQ ID NO: 1889825 - DNA, 19 bp, Homo sapiens
gcccatgggcactgctggg

SEQ ID NO: 1889826 - DNA, 22 bp, Homo sapiens
gcccatgggcactgctgggtgg

SEQ ID NO: 1889827 - DNA, 23 bp, Homo sapiens
gcccatgggcactgctgggtggc

SEQ ID NO: 1889828 - DNA, 11 bp, Homo sapiens
gccccacagcc

SEQ ID NO: 1889829 - DNA, 13 bp, Homo sapiens
gccccacagccca

SEQ ID NO: 1889830 - DNA, 18 bp, Homo sapiens
gccccacagcccacgtcc

SEQ ID NO: 1889831 - DNA, 15 bp, Homo sapiens
gccccagcctggccc

SEQ ID NO: 1889832 - DNA, 15 bp, Homo sapiens
gccccagctgggctg

SEQ ID NO: 1889833 - DNA, 16 bp, Homo sapiens
gccccccatcctggcc

SEQ ID NO: 1889834 - DNA, 20 bp, Homo sapiens
gccccccatcctggcccatc

SEQ ID NO: 1889835 - DNA, 15 bp, Homo sapiens
gccccctccctggat

SEQ ID NO: 1889836 - DNA, 13 bp, Homo sapiens
gccccctggtggg

SEQ ID NO: 1889837 - DNA, 18 bp, Homo sapiens
gcccctgtgtcggggggc

SEQ ID NO: 1889838 - DNA, 16 bp, Homo sapiens
gcccctgtgtgggagg

SEQ ID NO: 1889839 - DNA, 21 bp, Homo sapiens
gcccctgtgtgggagggcgag

SEQ ID NO: 1889840 - DNA, 14 bp, Homo sapiens
gcccctgtgttggg

SEQ ID NO: 1889841 - DNA, 14 bp, Homo sapiens
gcccgcttgcctcg

SEQ ID NO: 1889842 - DNA, 19 bp, Homo sapiens
gcccgcttgcctcggctcc

SEQ ID NO: 1889843 - DNA, 23 bp, Homo sapiens
gcccgcttgcctcggctcctgct

SEQ ID NO: 1889844 - DNA, 17 bp, Homo sapiens
gcccggcgccctctgtc

SEQ ID NO: 1889845 - DNA, 18 bp, Homo sapiens
gccctcaaggcctcccac

SEQ ID NO: 1889846 - DNA, 20 bp, Homo sapiens
gccctccttcttgccctgag

SEQ ID NO: 1889847 - DNA, 15 bp, Homo sapiens
gccctctgtcctgac

SEQ ID NO: 1889848 - DNA, 21 bp, Homo sapiens
gccctgagctttccggggagg

SEQ ID NO: 1889849 - DNA, 14 bp, Homo sapiens
gccctgcactgtcc

SEQ ID NO: 1889850 - DNA, 20 bp, Homo sapiens
gccctgcactgtcctgctcc

SEQ ID NO: 1889851 - DNA, 21 bp, Homo sapiens
gccctgcactgtcctgctcca

SEQ ID NO: 1889852 - DNA, 13 bp, Homo sapiens
gccctgcaggagg

SEQ ID NO: 1889853 - DNA, 16 bp, Homo sapiens
gccctgccaagcctgg

SEQ ID NO: 1889854 - DNA, 22 bp, Homo sapiens
gccctgccaagcctggagcccc

SEQ ID NO: 1889855 - DNA, 20 bp, Homo sapiens
gccctggctcccaagggagg

SEQ ID NO: 1889856 - DNA, 13 bp, Homo sapiens
gccctggcttgga

SEQ ID NO: 1889857 - DNA, 20 bp, Homo sapiens
gccctgggccagcccaggat

SEQ ID NO: 1889858 - DNA, 19 bp, Homo sapiens
gccctggggagtgagcttg

SEQ ID NO: 1889859 - DNA, 19 bp, Homo sapiens
gcccttctttccacagaag

SEQ ID NO: 1889860 - DNA, 24 bp, Homo sapiens
gccgccgcctcgcccaccgcatgc

SEQ ID NO: 1889861 - DNA, 13 bp, Homo sapiens
gccgcctcgccca

SEQ ID NO: 1889862 - DNA, 17 bp, Homo sapiens
gccgcctcgcccaccgc

SEQ ID NO: 1889863 - DNA, 19 bp, Homo sapiens
gccgctgcccggcgccctc

SEQ ID NO: 1889864 - DNA, 18 bp, Homo sapiens
gccgggaccccgagcctg

SEQ ID NO: 1889865 - DNA, 15 bp, Homo sapiens
ggctgtactgccaag

SEQ ID NO: 1889866 - DNA, 17 bp, Homo sapiens
ggctgtactgccaaggt

SEQ ID NO: 1889867 - DNA, 19 bp, Homo sapiens
ggctgtccagtgcccattc

SEQ ID NO: 1889868 - DNA, 14 bp, Homo sapiens
ggcttccaaggtgg

SEQ ID NO: 1889869 - DNA, 22 bp, Homo sapiens
ggcttccaaggtggtctgctcg

SEQ ID NO: 1889870 - DNA, 21 bp, Homo sapiens
ggcttctgcggtgaggcaggg

SEQ ID NO: 1889871 - DNA, 17 bp, Homo sapiens
ggcttgtagaattttta

SEQ ID NO: 1889872 - DNA, 14 bp, Homo sapiens
gggaagagcacagc

SEQ ID NO: 1889873 - DNA, 19 bp, Homo sapiens
gggaagctgtagaggacca

SEQ ID NO: 1889874 - DNA, 20 bp, Homo sapiens
gggacaacaaagaggacacc

SEQ ID NO: 1889875 - DNA, 22 bp, Homo sapiens
gggaccacagcaaggcacctgc

SEQ ID NO: 1889876 - DNA, 16 bp, Homo sapiens
gggaccccgagcctgg

SEQ ID NO: 1889877 - DNA, 20 bp, Homo sapiens
gggaccccgagcctggctcc

SEQ ID NO: 1889878 - DNA, 18 bp, Homo sapiens
gggagcattctgcctgcc

SEQ ID NO: 1889879 - DNA, 12 bp, Homo sapiens
gggagcctggag

SEQ ID NO: 1889880 - DNA, 13 bp, Homo sapiens
gggagcctggagc

SEQ ID NO: 1889881 - DNA, 18 bp, Homo sapiens
gggagcctggagcccctg

SEQ ID NO: 1889882 - DNA, 13 bp, Homo sapiens
gggaggagccttg

SEQ ID NO: 1889883 - DNA, 13 bp, Homo sapiens
gggaggctctgaa

SEQ ID NO: 1889884 - DNA, 13 bp, Homo sapiens
gggaggggcccgc

SEQ ID NO: 1889885 - DNA, 22 bp, Homo sapiens
gggaggtggccgtcgagttgac

SEQ ID NO: 1889886 - DNA, 14 bp, Homo sapiens
gggagtgagcttgg

SEQ ID NO: 1889887 - DNA, 21 bp, Homo sapiens
gggatcctggagcccctgtgt

SEQ ID NO: 1889888 - DNA, 13 bp, Homo sapiens
gggcactgctggg

SEQ ID NO: 1889889 - DNA, 20 bp, Homo sapiens
gggcactgctgggtggccca

SEQ ID NO: 1889890 - DNA, 18 bp, Homo sapiens
gggcaggaatcaaggagc

SEQ ID NO: 1889891 - DNA, 13 bp, Homo sapiens
gggcaggcacagc

SEQ ID NO: 1889892 - DNA, 14 bp, Homo sapiens
gggcaggcacagca

SEQ ID NO: 1889893 - DNA, 19 bp, Homo sapiens
gggcaggtcctggggaggc

SEQ ID NO: 1889894 - DNA, 23 bp, Homo sapiens
gggcaggtcctggggaggctgag

SEQ ID NO: 1889895 - DNA, 15 bp, Homo sapiens
gggcatgggggaggc

SEQ ID NO: 1889896 - DNA, 18 bp, Homo sapiens
gggccaccagctccactg

SEQ ID NO: 1889897 - DNA, 19 bp, Homo sapiens
gggccaccagctccactgg

SEQ ID NO: 1889898 - DNA, 23 bp, Homo sapiens
gggccaccagctccactggcctg

SEQ ID NO: 1889899 - DNA, 18 bp, Homo sapiens
gggcccacccatgtcacc

SEQ ID NO: 1889900 - DNA, 20 bp, Homo sapiens
gggcccgcttgcctcggctc

SEQ ID NO: 1889901 - DNA, 13 bp, Homo sapiens
gggccctgcagga

SEQ ID NO: 1889902 - DNA, 15 bp, Homo sapiens
gggccctgcaggagg

SEQ ID NO: 1889903 - DNA, 22 bp, Homo sapiens
gggccctgcaggaggcctggga

SEQ ID NO: 1889904 - DNA, 13 bp, Homo sapiens
gggcgagggaggg

SEQ ID NO: 1889905 - DNA, 20 bp, Homo sapiens
gggcgggcagcacagcaagg

SEQ ID NO: 1889906 - DNA, 17 bp, Homo sapiens
gggctcagggaccacag

SEQ ID NO: 1889907 - DNA, 15 bp, Homo sapiens
gggctgcccgctccc

SEQ ID NO: 1889908 - DNA, 22 bp, Homo sapiens
gggctgcccgctcccagtgtct

SEQ ID NO: 1889909 - DNA, 11 bp, Homo sapiens
gggctgggaga

SEQ ID NO: 1889910 - DNA, 23 bp, Homo sapiens
gggctgggcaggtcctggggagg

SEQ ID NO: 1889911 - DNA, 23 bp, Homo sapiens
gggctgggttggcgcaccctccc

SEQ ID NO: 1889912 - DNA, 14 bp, Homo sapiens
ggggaagagcacag

SEQ ID NO: 1889913 - DNA, 18 bp, Homo sapiens
ggggaagagcacagccct

SEQ ID NO: 1889914 - DNA, 23 bp, Homo sapiens
ggggactaatatcatagacccat

SEQ ID NO: 1889915 - DNA, 12 bp, Homo sapiens
ggggagcctgga

SEQ ID NO: 1889916 - DNA, 18 bp, Homo sapiens
ggggatcctggagcccct

SEQ ID NO: 1889917 - DNA, 22 bp, Homo sapiens
ggggcaaggtgggggagcctgg

SEQ ID NO: 1889918 - DNA, 13 bp, Homo sapiens
ggggcaggcacag

SEQ ID NO: 1889919 - DNA, 14 bp, Homo sapiens
ggggcaggcacagc

SEQ ID NO: 1889920 - DNA, 17 bp, Homo sapiens
ggggcaggcacagcaca

SEQ ID NO: 1889921 - DNA, 13 bp, Homo sapiens
ggggcaggccctg

SEQ ID NO: 1889922 - DNA, 22 bp, Homo sapiens
ggggcaggccctgcactgtcct

SEQ ID NO: 1889923 - DNA, 23 bp, Homo sapiens
ggggcaggccctgcactgtcctg

SEQ ID NO: 1889924 - DNA, 15 bp, Homo sapiens
ggggcatgggggagg

SEQ ID NO: 1889925 - DNA, 19 bp, Homo sapiens
ggggcccgttgtctccctg

SEQ ID NO: 1889926 - DNA, 20 bp, Homo sapiens
ggggcccgttgtctccctgg

SEQ ID NO: 1889927 - DNA, 19 bp, Homo sapiens
ggggcctatcagtgtgccc

SEQ ID NO: 1889928 - DNA, 12 bp, Homo sapiens
ggggcctccctg

SEQ ID NO: 1889929 - DNA, 16 bp, Homo sapiens
aaaaagaaacatttgg

SEQ ID NO: 1889930 - DNA, 15 bp, Homo sapiens
aaaaatggtgcctga

SEQ ID NO: 1889931 - DNA, 21 bp, Homo sapiens
aaaaattcagagtccttgcaa

SEQ ID NO: 1889932 - DNA, 11 bp, Homo sapiens
aaaacttattt

SEQ ID NO: 1889933 - DNA, 15 bp, Homo sapiens
aaaacttatttgagt

SEQ ID NO: 1889934 - DNA, 19 bp, Homo sapiens
aaaagagagaaaacttatt

SEQ ID NO: 1889935 - DNA, 14 bp, Homo sapiens
aaaagcccaacaca

SEQ ID NO: 1889936 - DNA, 14 bp, Homo sapiens
aaaagcctctgtgt

SEQ ID NO: 1889937 - DNA, 17 bp, Homo sapiens
aaaaggttttattttgt

SEQ ID NO: 1889938 - DNA, 15 bp, Homo sapiens
aaaatactattctga

SEQ ID NO: 1889939 - DNA, 19 bp, Homo sapiens
aaaatccatacatttgtgt

SEQ ID NO: 1889940 - DNA, 16 bp, Homo sapiens
aaaatctcaatatttc

SEQ ID NO: 1889941 - DNA, 22 bp, Homo sapiens
aaaatgaaatgtttttgctata

SEQ ID NO: 1889942 - DNA, 22 bp, Homo sapiens
aaaatgagactatgcgttttta

SEQ ID NO: 1889943 - DNA, 15 bp, Homo sapiens
aaaattctttcactt

SEQ ID NO: 1889944 - DNA, 14 bp, Homo sapiens
aaaattgataatta

SEQ ID NO: 1889945 - DNA, 15 bp, Homo sapiens
aaaattgtatagaga

SEQ ID NO: 1889946 - DNA, 21 bp, Homo sapiens
aaaattgtatagagatatgca

SEQ ID NO: 1889947 - DNA, 22 bp, Homo sapiens
aaaattttttctctaggaaata

SEQ ID NO: 1889948 - DNA, 16 bp, Homo sapiens
aaacactccacagtgt

SEQ ID NO: 1889949 - DNA, 17 bp, Homo sapiens
aaacactccacagtgtt

SEQ ID NO: 1889950 - DNA, 19 bp, Homo sapiens
aaacactccacagtgttta

SEQ ID NO: 1889951 - DNA, 23 bp, Homo sapiens
aaacactctcactatgctgctat

SEQ ID NO: 1889952 - DNA, 24 bp, Homo sapiens
aaacacttgcggatattctggact

SEQ ID NO: 1889953 - DNA, 13 bp, Homo sapiens
aaacatatataac

SEQ ID NO: 1889954 - DNA, 16 bp, Homo sapiens
aaacatatataacaat

SEQ ID NO: 1889955 - DNA, 19 bp, Homo sapiens
aaacatatataacaatgct

SEQ ID NO: 1889956 - DNA, 16 bp, Homo sapiens
aaacatctagcagtaa

SEQ ID NO: 1889957 - DNA, 13 bp, Homo sapiens
aaacatttaacat

SEQ ID NO: 1889958 - DNA, 15 bp, Homo sapiens
aaacatttaacataa

SEQ ID NO: 1889959 - DNA, 16 bp, Homo sapiens
aaacgtattcagagtt

SEQ ID NO: 1889960 - DNA, 15 bp, Homo sapiens
aaactcgttaatttg

SEQ ID NO: 1889961 - DNA, 14 bp, Homo sapiens
aaacttatttgagt

SEQ ID NO: 1889962 - DNA, 23 bp, Homo sapiens
aaacttcagcggtttatataagc

SEQ ID NO: 1889963 - DNA, 15 bp, Homo sapiens
aaagaaaacatttaa

SEQ ID NO: 1889964 - DNA, 15 bp, Homo sapiens
aaagaccatttttcc

SEQ ID NO: 1889965 - DNA, 16 bp, Homo sapiens
aaaggaccctgtttct

SEQ ID NO: 1889966 - DNA, 22 bp, Homo sapiens
aaaggaccctgtttctgtagaa

SEQ ID NO: 1889967 - DNA, 20 bp, Homo sapiens
aaaggctatgattgtctttg

SEQ ID NO: 1889968 - DNA, 20 bp, Homo sapiens
aaagggctgttataatcttt

SEQ ID NO: 1889969 - DNA, 22 bp, Homo sapiens
aaagggctgttataatctttca

SEQ ID NO: 1889970 - DNA, 16 bp, Homo sapiens
aaaggttttattttgt

SEQ ID NO: 1889971 - DNA, 17 bp, Homo sapiens
aaaggttttattttgta

SEQ ID NO: 1889972 - DNA, 19 bp, Homo sapiens
aaagtactcctcacttttc

SEQ ID NO: 1889973 - DNA, 17 bp, Homo sapiens
aaagtcaatgttttcag

SEQ ID NO: 1889974 - DNA, 16 bp, Homo sapiens
aaagtctaaagtttac

SEQ ID NO: 1889975 - DNA, 19 bp, Homo sapiens
aaagtctaaagtttacagt

SEQ ID NO: 1889976 - DNA, 18 bp, Homo sapiens
aaagtgcagtcatttgtg

SEQ ID NO: 1889977 - DNA, 15 bp, Homo sapiens
aaagtgtgtgtgttc

SEQ ID NO: 1889978 - DNA, 18 bp, Homo sapiens
aaagtgtgtgtgttctgt

SEQ ID NO: 1889979 - DNA, 15 bp, Homo sapiens
aaataaacagttgtt

SEQ ID NO: 1889980 - DNA, 12 bp, Homo sapiens
aaataaattgtt

SEQ ID NO: 1889981 - DNA, 13 bp, Homo sapiens
aaataaattgttt

SEQ ID NO: 1889982 - DNA, 23 bp, Homo sapiens
aaataacaaatctcaagcaaaca

SEQ ID NO: 1889983 - DNA, 14 bp, Homo sapiens
aaataatcattctt

SEQ ID NO: 1889984 - DNA, 15 bp, Homo sapiens
aaataatttttatat

SEQ ID NO: 1889985 - DNA, 22 bp, Homo sapiens
aaataatttttatatttgaaat

SEQ ID NO: 1889986 - DNA, 13 bp, Homo sapiens
aaatacttgcagt

SEQ ID NO: 1889987 - DNA, 14 bp, Homo sapiens
aaatacttgcagtt

SEQ ID NO: 1889988 - DNA, 12 bp, Homo sapiens
aaatatatttgt

SEQ ID NO: 1889989 - DNA, 19 bp, Homo sapiens
aaatatgtctgcaggtttc

SEQ ID NO: 1889990 - DNA, 21 bp, Homo sapiens
aaatatttattttaataatgt

SEQ ID NO: 1889991 - DNA, 13 bp, Homo sapiens
aaatcagtaattg

SEQ ID NO: 1889992 - DNA, 14 bp, Homo sapiens
aaatccttgaagat

SEQ ID NO: 1889993 - DNA, 18 bp, Homo sapiens
aaatggcttcctggcaat

SEQ ID NO: 1889994 - DNA, 18 bp, Homo sapiens
aaatgtaacatgaagcaa

SEQ ID NO: 1889995 - DNA, 13 bp, Homo sapiens
aaattagtaattg

SEQ ID NO: 1889996 - DNA, 14 bp, Homo sapiens
aaattagtaattgt

SEQ ID NO: 1889997 - DNA, 15 bp, Homo sapiens
aaattcatataaaag

SEQ ID NO: 1889998 - DNA, 11 bp, Homo sapiens
aaattcttttg

SEQ ID NO: 1889999 - DNA, 20 bp, Homo sapiens
aacaaagaaataaaatcctg

SEQ ID NO: 1890000 - DNA, 14 bp, Homo sapiens
aacaatgctgtatt

SEQ ID NO: 1890001 - DNA, 15 bp, Homo sapiens
aacaatgctgtattt

SEQ ID NO: 1890002 - DNA, 16 bp, Homo sapiens
aacacaactatattgt

SEQ ID NO: 1890003 - DNA, 20 bp, Homo sapiens
aacacccagtctgttcccca

SEQ ID NO: 1890004 - DNA, 15 bp, Homo sapiens
aacactagtctgtgt

SEQ ID NO: 1890005 - DNA, 17 bp, Homo sapiens
aacactccacagtgttt

SEQ ID NO: 1890006 - DNA, 13 bp, Homo sapiens
aacagactattta

SEQ ID NO: 1890007 - DNA, 17 bp, Homo sapiens
aacagtgttctgagccc

SEQ ID NO: 1890008 - DNA, 14 bp, Homo sapiens
aacagttgtgtcat

SEQ ID NO: 1890009 - DNA, 18 bp, Homo sapiens
aacagttgtgtcataaat

SEQ ID NO: 1890010 - DNA, 20 bp, Homo sapiens
aacagttgtgtcataaatta

SEQ ID NO: 1890011 - DNA, 17 bp, Homo sapiens
aacataatggttgtgaa

SEQ ID NO: 1890012 - DNA, 22 bp, Homo sapiens
aacataatggttgtgaaatgta

SEQ ID NO: 1890013 - DNA, 17 bp, Homo sapiens
aacatctagcagtaaat

SEQ ID NO: 1890014 - DNA, 16 bp, Homo sapiens
aacatctttgttttta

SEQ ID NO: 1890015 - DNA, 12 bp, Homo sapiens
aacatgagtgtc

SEQ ID NO: 1890016 - DNA, 11 bp, Homo sapiens
aacattcacac

SEQ ID NO: 1890017 - DNA, 14 bp, Homo sapiens
aacatttaacataa

SEQ ID NO: 1890018 - DNA, 16 bp, Homo sapiens
aacatttaacataatg

SEQ ID NO: 1890019 - DNA, 15 bp, Homo sapiens
aacattttgaagtgt

SEQ ID NO: 1890020 - DNA, 16 bp, Homo sapiens
aaccaatacagaattg

SEQ ID NO: 1890021 - DNA, 22 bp, Homo sapiens
aaccatacaaaaattccttttc

SEQ ID NO: 1890022 - DNA, 19 bp, Homo sapiens
aacccacaggcccacagta

SEQ ID NO: 1890023 - DNA, 22 bp, Homo sapiens
aacccatgccctgccaagcctg

SEQ ID NO: 1890024 - DNA, 17 bp, Homo sapiens
aacctagggtgatatta

SEQ ID NO: 1890025 - DNA, 20 bp, Homo sapiens
aacctagggtgatattaacc

SEQ ID NO: 1890026 - DNA, 22 bp, Homo sapiens
aacgtattcagagttagatatt

SEQ ID NO: 1890027 - DNA, 17 bp, Homo sapiens
aacgtggcttgtagaat

SEQ ID NO: 1890028 - DNA, 21 bp, Homo sapiens
aactaccctacacctctgggc

SEQ ID NO: 1890029 - DNA, 23 bp, Homo sapiens
aactatctcatttccaagcaagt

SEQ ID NO: 1890030 - DNA, 22 bp, Homo sapiens
aactctatagttattgttttat

SEQ ID NO: 1890031 - DNA, 13 bp, Homo sapiens
aactgaaatcata

SEQ ID NO: 1890032 - DNA, 17 bp, Homo sapiens
aacttagaataaaattg

SEQ ID NO: 1890033 - DNA, 19 bp, Homo sapiens
aacttatttgagtgattat

SEQ ID NO: 1890034 - DNA, 15 bp, Homo sapiens
aacttgtgttctatt

SEQ ID NO: 1890035 - DNA, 21 bp, Homo sapiens
aagaaaacatttaacataatg

SEQ ID NO: 1890036 - DNA, 13 bp, Homo sapiens
aagaaaatatcac

SEQ ID NO: 1890037 - DNA, 11 bp, Homo sapiens
aagaaacattt

SEQ ID NO: 1890038 - DNA, 12 bp, Homo sapiens
aagaactgaaat

SEQ ID NO: 1890039 - DNA, 13 bp, Homo sapiens
aagaactgaaatc

SEQ ID NO: 1890040 - DNA, 15 bp, Homo sapiens
aagaactgaaatcat

SEQ ID NO: 1890041 - DNA, 18 bp, Homo sapiens
aagaatgattatgaatta

SEQ ID NO: 1890042 - DNA, 13 bp, Homo sapiens
aagaccatttttc

SEQ ID NO: 1890043 - DNA, 17 bp, Homo sapiens
aagactgcattatattt

SEQ ID NO: 1890044 - DNA, 20 bp, Homo sapiens
aagagaacccacgaacattc

SEQ ID NO: 1890045 - DNA, 23 bp, Homo sapiens
aagagaggacccatcctgccaca

SEQ ID NO: 1890046 - DNA, 15 bp, Homo sapiens
aagagcacagccctc

SEQ ID NO: 1890047 - DNA, 19 bp, Homo sapiens
aagagcacagccctcccgc

SEQ ID NO: 1890048 - DNA, 15 bp, Homo sapiens
aagagtgaaaaatga

SEQ ID NO: 1890049 - DNA, 19 bp, Homo sapiens
aagatatgggacatttttg

SEQ ID NO: 1890050 - DNA, 19 bp, Homo sapiens
aagatcttggcttaattta

SEQ ID NO: 1890051 - DNA, 21 bp, Homo sapiens
aagcacctcaagtgcaaggac

SEQ ID NO: 1890052 - DNA, 21 bp, Homo sapiens
aagcagtcctgttcaaatttt

SEQ ID NO: 1890053 - DNA, 21 bp, Homo sapiens
aagcctctgtgtcactggctg

SEQ ID NO: 1890054 - DNA, 23 bp, Homo sapiens
aagcctctgtgtcactggctgcc

SEQ ID NO: 1890055 - DNA, 24 bp, Homo sapiens
aagcctctgtgtcactggctgcct

SEQ ID NO: 1890056 - DNA, 11 bp, Homo sapiens
aagcctggagc

SEQ ID NO: 1890057 - DNA, 16 bp, Homo sapiens
aagcctggagcccctg

SEQ ID NO: 1890058 - DNA, 15 bp, Homo sapiens
aagccttcatttgca

SEQ ID NO: 1890059 - DNA, 14 bp, Homo sapiens
aagctccaggtaga

SEQ ID NO: 1890060 - DNA, 12 bp, Homo sapiens
aagctgaaaata

SEQ ID NO: 1890061 - DNA, 18 bp, Homo sapiens
aagctgtaaaaagagaga

SEQ ID NO: 1890062 - DNA, 15 bp, Homo sapiens
aagctgtagaggacc

SEQ ID NO: 1890063 - DNA, 20 bp, Homo sapiens
aattacacaataaagcagtc

SEQ ID NO: 1890064 - DNA, 13 bp, Homo sapiens
aattacatttgta

SEQ ID NO: 1890065 - DNA, 14 bp, Homo sapiens
aattacatttgtat

SEQ ID NO: 1890066 - DNA, 21 bp, Homo sapiens
aattaccacaccatctcccat

SEQ ID NO: 1890067 - DNA, 20 bp, Homo sapiens
aattagttttatatgcttct

SEQ ID NO: 1890068 - DNA, 16 bp, Homo sapiens
aattattgtgatttcc

SEQ ID NO: 1890069 - DNA, 18 bp, Homo sapiens
aattcatataaaagttgc

SEQ ID NO: 1890070 - DNA, 18 bp, Homo sapiens
aattcatgtaacagttgt

SEQ ID NO: 1890071 - DNA, 20 bp, Homo sapiens
aattcatgtaacagttgtgt

SEQ ID NO: 1890072 - DNA, 22 bp, Homo sapiens
aattgaatcactgctcacactg

SEQ ID NO: 1890073 - DNA, 22 bp, Homo sapiens
aattgggtgtgccctggctccc

SEQ ID NO: 1890074 - DNA, 20 bp, Homo sapiens
aattgtcagatcgttcattg

SEQ ID NO: 1890075 - DNA, 19 bp, Homo sapiens
aattgtctaaaatgtcagt

SEQ ID NO: 1890076 - DNA, 15 bp, Homo sapiens
aatttaggtaaataa

SEQ ID NO: 1890077 - DNA, 16 bp, Homo sapiens
aatttaggtaaataaa

SEQ ID NO: 1890078 - DNA, 14 bp, Homo sapiens
aatttgtaagttta

SEQ ID NO: 1890079 - DNA, 15 bp, Homo sapiens
aatttgtaagtttat

SEQ ID NO: 1890080 - DNA, 14 bp, Homo sapiens
aatttgtcatgtta

SEQ ID NO: 1890081 - DNA, 16 bp, Homo sapiens
aatttttattatttgt

SEQ ID NO: 1890082 - DNA, 21 bp, Homo sapiens
aatttttattatttgttttcc

SEQ ID NO: 1890083 - DNA, 19 bp, Homo sapiens
aattttttctctaggaaat

SEQ ID NO: 1890084 - DNA, 17 bp, Homo sapiens
acaaagtacagaaaaat

SEQ ID NO: 1890085 - DNA, 21 bp, Homo sapiens
acaaagtactcctcacttttc

SEQ ID NO: 1890086 - DNA, 14 bp, Homo sapiens
acaaataaacagtt

SEQ ID NO: 1890087 - DNA, 15 bp, Homo sapiens
acaaattatcttaaa

SEQ ID NO: 1890088 - DNA, 13 bp, Homo sapiens
acaactatattgt

SEQ ID NO: 1890089 - DNA, 14 bp, Homo sapiens
acaagactgcacat

SEQ ID NO: 1890090 - DNA, 20 bp, Homo sapiens
acaataaagcagtcctgttc

SEQ ID NO: 1890091 - DNA, 21 bp, Homo sapiens
acaataaagcagtcctgttca

SEQ ID NO: 1890092 - DNA, 23 bp, Homo sapiens
acaatacatcccttacctgggaa

SEQ ID NO: 1890093 - DNA, 18 bp, Homo sapiens
acacaaattatcttaaaa

SEQ ID NO: 1890094 - DNA, 13 bp, Homo sapiens
acacaactatatt

SEQ ID NO: 1890095 - DNA, 14 bp, Homo sapiens
acacaataaagcag

SEQ ID NO: 1890096 - DNA, 14 bp, Homo sapiens
acacaatgtgtctg

SEQ ID NO: 1890097 - DNA, 22 bp, Homo sapiens
acacactcgggttaagaaatac

SEQ ID NO: 1890098 - DNA, 13 bp, Homo sapiens
acacactgaagaa

SEQ ID NO: 1890099 - DNA, 20 bp, Homo sapiens
acaccaagctgtgccaccct

SEQ ID NO: 1890100 - DNA, 16 bp, Homo sapiens
acaccactatagtgta

SEQ ID NO: 1890101 - DNA, 18 bp, Homo sapiens
acacccctggcctgactc

SEQ ID NO: 1890102 - DNA, 16 bp, Homo sapiens
acacggggtattttag

SEQ ID NO: 1890103 - DNA, 17 bp, Homo sapiens
acacggggtattttagg

SEQ ID NO: 1890104 - DNA, 20 bp, Homo sapiens
acactaaacagactatttaa

SEQ ID NO: 1890105 - DNA, 13 bp, Homo sapiens
acactaagagaga

SEQ ID NO: 1890106 - DNA, 14 bp, Homo sapiens
acactaagagagaa

SEQ ID NO: 1890107 - DNA, 18 bp, Homo sapiens
acactaagagagaatgag

SEQ ID NO: 1890108 - DNA, 23 bp, Homo sapiens
acactagtctgtgtaactttaaa

SEQ ID NO: 1890109 - DNA, 15 bp, Homo sapiens
acactcgggttaaga

SEQ ID NO: 1890110 - DNA, 21 bp, Homo sapiens
aaaaaattctttcacttgatg

SEQ ID NO: 1890111 - DNA, 17 bp, Homo sapiens
aaaacaaggatgaatta

SEQ ID NO: 1890112 - DNA, 15 bp, Homo sapiens
aaaacattttgaagt

SEQ ID NO: 1890113 - DNA, 14 bp, Homo sapiens
aaaagaaaacattt

SEQ ID NO: 1890114 - DNA, 21 bp, Homo sapiens
aaaagagagaaaacttatttg

SEQ ID NO: 1890115 - DNA, 15 bp, Homo sapiens
aaaaggttttatttt

SEQ ID NO: 1890116 - DNA, 21 bp, Homo sapiens
aaaagttgcgtttaagttgta

SEQ ID NO: 1890117 - DNA, 20 bp, Homo sapiens
aaaataatttttatatttga

SEQ ID NO: 1890118 - DNA, 15 bp, Homo sapiens
aaaatactttgattt

SEQ ID NO: 1890119 - DNA, 15 bp, Homo sapiens
aaaatagatatataa

SEQ ID NO: 1890120 - DNA, 13 bp, Homo sapiens
aaaatagccctgc

SEQ ID NO: 1890121 - DNA, 20 bp, Homo sapiens
aaaatctattttgtaacttt

SEQ ID NO: 1890122 - DNA, 17 bp, Homo sapiens
aaaatctcaatatttca

SEQ ID NO: 1890123 - DNA, 17 bp, Homo sapiens
aaaattaaatcaacctt

SEQ ID NO: 1890124 - DNA, 12 bp, Homo sapiens
aaaattagtaat

SEQ ID NO: 1890125 - DNA, 20 bp, Homo sapiens
aaaattctttcacttgatgt

SEQ ID NO: 1890126 - DNA, 15 bp, Homo sapiens
aaaattgtaaaattg

SEQ ID NO: 1890127 - DNA, 20 bp, Homo sapiens
aaaattgtctaaaatgtcag

SEQ ID NO: 1890128 - DNA, 14 bp, Homo sapiens
aaacacaactatat

SEQ ID NO: 1890129 - DNA, 21 bp, Homo sapiens
aaacactccacagtgtttata

SEQ ID NO: 1890130 - DNA, 13 bp, Homo sapiens
aaacagactattt

SEQ ID NO: 1890131 - DNA, 19 bp, Homo sapiens
aaacatctagcagtaaata

SEQ ID NO: 1890132 - DNA, 16 bp, Homo sapiens
aaacatgatgtcaact

SEQ ID NO: 1890133 - DNA, 12 bp, Homo sapiens
aaacatttaaca

SEQ ID NO: 1890134 - DNA, 14 bp, Homo sapiens
aaacatttaacata

SEQ ID NO: 1890135 - DNA, 17 bp, Homo sapiens
aaacatttaacataatg

SEQ ID NO: 1890136 - DNA, 17 bp, Homo sapiens
aaacattttgaagtgtg

SEQ ID NO: 1890137 - DNA, 23 bp, Homo sapiens
aaaccatgaagagatttttcatg

SEQ ID NO: 1890138 - DNA, 24 bp, Homo sapiens
aaaccctcgaggcggatctttgga

SEQ ID NO: 1890139 - DNA, 19 bp, Homo sapiens
aaacccttgccatgtgcta

SEQ ID NO: 1890140 - DNA, 21 bp, Homo sapiens
aaacctcagtcatattcttat

SEQ ID NO: 1890141 - DNA, 24 bp, Homo sapiens
aaacctctaatttattttgtcgaa

SEQ ID NO: 1890142 - DNA, 15 bp, Homo sapiens
aaacgtattcagagt

SEQ ID NO: 1890143 - DNA, 16 bp, Homo sapiens
aaactgactcttaaga

SEQ ID NO: 1890144 - DNA, 17 bp, Homo sapiens
aaacttagaataaaatt

SEQ ID NO: 1890145 - DNA, 18 bp, Homo sapiens
aaacttagaataaaattg

SEQ ID NO: 1890146 - DNA, 14 bp, Homo sapiens
aaagaaaacattta

SEQ ID NO: 1890147 - DNA, 22 bp, Homo sapiens
aaagagctttagtcctagagga

SEQ ID NO: 1890148 - DNA, 13 bp, Homo sapiens
aaagccctgtgtt

SEQ ID NO: 1890149 - DNA, 17 bp, Homo sapiens
aaagccctgtgttaagt

SEQ ID NO: 1890150 - DNA, 13 bp, Homo sapiens
aaagcctctgtgt

SEQ ID NO: 1890151 - DNA, 21 bp, Homo sapiens
aaagcctctgtgtcactggct

SEQ ID NO: 1890152 - DNA, 24 bp, Homo sapiens
aaagcctctgtgtcactggctgcc

SEQ ID NO: 1890153 - DNA, 17 bp, Homo sapiens
aaaggaccctgtttctg

SEQ ID NO: 1890154 - DNA, 22 bp, Homo sapiens
aaaggttgtgttgcctgctgag

SEQ ID NO: 1890155 - DNA, 21 bp, Homo sapiens
aaagtacagaaaaatactttg

SEQ ID NO: 1890156 - DNA, 13 bp, Homo sapiens
aaagtacagaata

SEQ ID NO: 1890157 - DNA, 21 bp, Homo sapiens
aaagtgatcttaggtttgttt

SEQ ID NO: 1890158 - DNA, 15 bp, Homo sapiens
aaagtttacagtaaa

SEQ ID NO: 1890159 - DNA, 21 bp, Homo sapiens
aaagtttacagtaaataaatt

SEQ ID NO: 1890160 - DNA, 22 bp, Homo sapiens
aaagtttacagtaaataaattg

SEQ ID NO: 1890161 - DNA, 19 bp, Homo sapiens
aaataaacagttgttactt

SEQ ID NO: 1890162 - DNA, 13 bp, Homo sapiens
aaataaagtctct

SEQ ID NO: 1890163 - DNA, 21 bp, Homo sapiens
aaataatttttatatttgaaa

SEQ ID NO: 1890164 - DNA, 15 bp, Homo sapiens
aaatacctttaaatt

SEQ ID NO: 1890165 - DNA, 15 bp, Homo sapiens
aaatacttgcagttg

SEQ ID NO: 1890166 - DNA, 18 bp, Homo sapiens
aaatacttgcagttgtga

SEQ ID NO: 1890167 - DNA, 14 bp, Homo sapiens
aaatatatttgtaa

SEQ ID NO: 1890168 - DNA, 14 bp, Homo sapiens
aaatattagaaaca

SEQ ID NO: 1890169 - DNA, 17 bp, Homo sapiens
aaatattagaaacagct

SEQ ID NO: 1890170 - DNA, 13 bp, Homo sapiens
aaatatttatttt

SEQ ID NO: 1890171 - DNA, 17 bp, Homo sapiens
aaatattttttaaagtc

SEQ ID NO: 1890172 - DNA, 21 bp, Homo sapiens
aaatcatgaagatatttttcc

SEQ ID NO: 1890173 - DNA, 15 bp, Homo sapiens
aaatccatacatttg

SEQ ID NO: 1890174 - DNA, 18 bp, Homo sapiens
aaatctcaatatttcaga

SEQ ID NO: 1890175 - DNA, 23 bp, Homo sapiens
aaatggagaaacaggcccagaga

SEQ ID NO: 1890176 - DNA, 17 bp, Homo sapiens
aaatggtgttacattaa

SEQ ID NO: 1890177 - DNA, 15 bp, Homo sapiens
aaatgtaacatgaag

SEQ ID NO: 1890178 - DNA, 22 bp, Homo sapiens
aaatgtaccgatgatactgttt

SEQ ID NO: 1890179 - DNA, 23 bp, Homo sapiens
aaatgttgacatgggacatttgc

SEQ ID NO: 1890180 - DNA, 23 bp, Homo sapiens
aaattacacaataaagcagtcct

SEQ ID NO: 1890181 - DNA, 22 bp, Homo sapiens
aaattgggtgtgccctggctcc

SEQ ID NO: 1890182 - DNA, 16 bp, Homo sapiens
aaattgtcagatcgtt

SEQ ID NO: 1890183 - DNA, 18 bp, Homo sapiens
aaattgtctaaaatgtca

SEQ ID NO: 1890184 - DNA, 20 bp, Homo sapiens
aaatttaggtaaataaagct

SEQ ID NO: 1890185 - DNA, 20 bp, Homo sapiens
aaattttttctctaggaaat

SEQ ID NO: 1890186 - DNA, 19 bp, Homo sapiens
aacactaaacagactattt

SEQ ID NO: 1890187 - DNA, 20 bp, Homo sapiens
aacactctcactatgctgct

SEQ ID NO: 1890188 - DNA, 20 bp, Homo sapiens
aacagtgttaggcctggcac

SEQ ID NO: 1890189 - DNA, 19 bp, Homo sapiens
aacataatggttgtgaaat

SEQ ID NO: 1890190 - DNA, 23 bp, Homo sapiens
aacataatggttgtgaaatgtaa

SEQ ID NO: 1890191 - DNA, 14 bp, Homo sapiens
aacatctagcagta

SEQ ID NO: 1890192 - DNA, 11 bp, Homo sapiens
aacatctttgt

SEQ ID NO: 1890193 - DNA, 16 bp, Homo sapiens
aacatgaagcaaacta

SEQ ID NO: 1890194 - DNA, 14 bp, Homo sapiens
aaccaatacagaat

SEQ ID NO: 1890195 - DNA, 15 bp, Homo sapiens
aaccaatacagaatt

SEQ ID NO: 1890196 - DNA, 21 bp, Homo sapiens
aaccagggccccggggcctgt

SEQ ID NO: 1890197 - DNA, 15 bp, Homo sapiens
aacccatgccctgcc

SEQ ID NO: 1890198 - DNA, 23 bp, Homo sapiens
aacccctcccctccatccctggc

SEQ ID NO: 1890199 - DNA, 19 bp, Homo sapiens
aacctctaatttattttgt

SEQ ID NO: 1890200 - DNA, 20 bp, Homo sapiens
aacctctaatttattttgtc

SEQ ID NO: 1890201 - DNA, 21 bp, Homo sapiens
aacctctaatttattttgtcg

SEQ ID NO: 1890202 - DNA, 23 bp, Homo sapiens
aacgccttttcttggttcttttt

SEQ ID NO: 1890203 - DNA, 21 bp, Homo sapiens
aacggggtggacgagggagtg

SEQ ID NO: 1890204 - DNA, 15 bp, Homo sapiens
aacgtggcttgtaga

SEQ ID NO: 1890205 - DNA, 13 bp, Homo sapiens
aactatattgttt

SEQ ID NO: 1890206 - DNA, 20 bp, Homo sapiens
aactatctcatttccaagca

SEQ ID NO: 1890207 - DNA, 14 bp, Homo sapiens
aactccagaaagtg

SEQ ID NO: 1890208 - DNA, 21 bp, Homo sapiens
aactccagaaagtgacaagct

SEQ ID NO: 1890209 - DNA, 21 bp, Homo sapiens
aactcgggagcattctgcctg

SEQ ID NO: 1890210 - DNA, 18 bp, Homo sapiens
aactcgttaatttgtagt

SEQ ID NO: 1890211 - DNA, 12 bp, Homo sapiens
aactgaaatcat

SEQ ID NO: 1890212 - DNA, 19 bp, Homo sapiens
aactgactcttaagaagac

SEQ ID NO: 1890213 - DNA, 14 bp, Homo sapiens
aactgcaggaagag

SEQ ID NO: 1890214 - DNA, 15 bp, Homo sapiens
aactgcaggaagaga

SEQ ID NO: 1890215 - DNA, 18 bp, Homo sapiens
aacttagaataaaattgt

SEQ ID NO: 1890216 - DNA, 14 bp, Homo sapiens
tctccacctagtgg

SEQ ID NO: 1890217 - DNA, 22 bp, Homo sapiens
tctccacctagtggctgtccag

SEQ ID NO: 1890218 - DNA, 22 bp, Homo sapiens
tctccatcagatgtgttcctcc

SEQ ID NO: 1890219 - DNA, 13 bp, Homo sapiens
tctcccccccggg

SEQ ID NO: 1890220 - DNA, 14 bp, Homo sapiens
tctcctccaccgcc

SEQ ID NO: 1890221 - DNA, 21 bp, Homo sapiens
tctccttgaagcaaatgtgtg

SEQ ID NO: 1890222 - DNA, 14 bp, Homo sapiens
tctccttgccctgg

SEQ ID NO: 1890223 - DNA, 13 bp, Homo sapiens
tctctaggaaata

SEQ ID NO: 1890224 - DNA, 19 bp, Homo sapiens
tctctaggaaatatttatt

SEQ ID NO: 1890225 - DNA, 20 bp, Homo sapiens
tctgagacggatggaaggag

SEQ ID NO: 1890226 - DNA, 22 bp, Homo sapiens
tctgagacggatggaaggagag

SEQ ID NO: 1890227 - DNA, 23 bp, Homo sapiens
tctgagacggatggaaggagaga

SEQ ID NO: 1890228 - DNA, 23 bp, Homo sapiens
tctgagccctccttcttgccctg

SEQ ID NO: 1890229 - DNA, 18 bp, Homo sapiens
tctgcataccctcatcaa

SEQ ID NO: 1890230 - DNA, 23 bp, Homo sapiens
tctgcccaggacggggccggcca

SEQ ID NO: 1890231 - DNA, 13 bp, Homo sapiens
tctgcctccttca

SEQ ID NO: 1890232 - DNA, 15 bp, Homo sapiens
tctgcggtgaggcag

SEQ ID NO: 1890233 - DNA, 17 bp, Homo sapiens
tctgctatgcattttct

SEQ ID NO: 1890234 - DNA, 17 bp, Homo sapiens
tctgctgcttctgggcc

SEQ ID NO: 1890235 - DNA, 19 bp, Homo sapiens
tctgctgcttctgggcctg

SEQ ID NO: 1890236 - DNA, 13 bp, Homo sapiens
tctgctgggctgg

SEQ ID NO: 1890237 - DNA, 24 bp, Homo sapiens
tctgctgggctggggcctgatggg

SEQ ID NO: 1890238 - DNA, 16 bp, Homo sapiens
tctggaccccaggcca

SEQ ID NO: 1890239 - DNA, 22 bp, Homo sapiens
tctggagcaggtggcttgttaa

SEQ ID NO: 1890240 - DNA, 16 bp, Homo sapiens
tctgggcctgatggag

SEQ ID NO: 1890241 - DNA, 13 bp, Homo sapiens
tctggggaaggac

SEQ ID NO: 1890242 - DNA, 20 bp, Homo sapiens
tctgtagaaaagaaaacatt

SEQ ID NO: 1890243 - DNA, 14 bp, Homo sapiens
tctgtagctcagtt

SEQ ID NO: 1890244 - DNA, 13 bp, Homo sapiens
tctgtgatttctt

SEQ ID NO: 1890245 - DNA, 16 bp, Homo sapiens
tctgtgcccatgggca

SEQ ID NO: 1890246 - DNA, 14 bp, Homo sapiens
tctgtgtcactggc

SEQ ID NO: 1890247 - DNA, 23 bp, Homo sapiens
tctgtgtcactggctgcctccac

SEQ ID NO: 1890248 - DNA, 19 bp, Homo sapiens
tctgtgtgtctgatgtttg

SEQ ID NO: 1890249 - DNA, 20 bp, Homo sapiens
tctgttccccatggccactt

SEQ ID NO: 1890250 - DNA, 13 bp, Homo sapiens
tctgttgttctgt

SEQ ID NO: 1890251 - DNA, 16 bp, Homo sapiens
tctgttgttctgtggt

SEQ ID NO: 1890252 - DNA, 22 bp, Homo sapiens
tcttagatgcagttctgaagaa

SEQ ID NO: 1890253 - DNA, 23 bp, Homo sapiens
tcttagatgcagttctgaagaag

SEQ ID NO: 1890254 - DNA, 20 bp, Homo sapiens
tcttaggtttgttttttcat

SEQ ID NO: 1890255 - DNA, 14 bp, Homo sapiens
tcttatccacaaag

SEQ ID NO: 1890256 - DNA, 18 bp, Homo sapiens
tcttatttcatgaaaatt

SEQ ID NO: 1890257 - DNA, 15 bp, Homo sapiens
tcttcacagtgcagc

SEQ ID NO: 1890258 - DNA, 23 bp, Homo sapiens
tcttcacagtgcagcttgcagtc

SEQ ID NO: 1890259 - DNA, 23 bp, Homo sapiens
tcttcatcacttcttccactgtg

SEQ ID NO: 1890260 - DNA, 16 bp, Homo sapiens
tcttccactgtgtgtt

SEQ ID NO: 1890261 - DNA, 13 bp, Homo sapiens
tcttccaggtggg

SEQ ID NO: 1890262 - DNA, 19 bp, Homo sapiens
tcttcctgtgggggaagag

SEQ ID NO: 1890263 - DNA, 16 bp, Homo sapiens
tcttctcccaattcat

SEQ ID NO: 1890264 - DNA, 19 bp, Homo sapiens
tcttgcactgaatatataa

SEQ ID NO: 1890265 - DNA, 12 bp, Homo sapiens
tcttgccctgag

SEQ ID NO: 1890266 - DNA, 22 bp, Homo sapiens
tcttgctgttcagtgctttttc

SEQ ID NO: 1890267 - DNA, 22 bp, Homo sapiens
tcttgttttgtttgcttccatt

SEQ ID NO: 1890268 - DNA, 14 bp, Homo sapiens
tctttagaggcttt

SEQ ID NO: 1890269 - DNA, 17 bp, Homo sapiens
tctttagaggctttcaa

SEQ ID NO: 1890270 - DNA, 19 bp, Homo sapiens
tctttccacagaagctcca

SEQ ID NO: 1890271 - DNA, 21 bp, Homo sapiens
tcttttaaaatgaaatgtttt

SEQ ID NO: 1890272 - DNA, 12 bp, Homo sapiens
tctttttaaagt

SEQ ID NO: 1890273 - DNA, 21 bp, Homo sapiens
tctttttaaagtttgttcact

SEQ ID NO: 1890274 - DNA, 23 bp, Homo sapiens
tcttttttttttttttacagtat

SEQ ID NO: 1890275 - DNA, 23 bp, Homo sapiens
tgaaaatatgtctgcaggtttct

SEQ ID NO: 1890276 - DNA, 18 bp, Homo sapiens
tgaaaatgattataagcc

SEQ ID NO: 1890277 - DNA, 14 bp, Homo sapiens
tgaaaccctgtctc

SEQ ID NO: 1890278 - DNA, 17 bp, Homo sapiens
tgaaacgtattcagagt

SEQ ID NO: 1890279 - DNA, 19 bp, Homo sapiens
tgaaactcgttaatttgta

SEQ ID NO: 1890280 - DNA, 15 bp, Homo sapiens
tgaaaggtacttcaa

SEQ ID NO: 1890281 - DNA, 16 bp, Homo sapiens
tgaaaggtacttcaaa

SEQ ID NO: 1890282 - DNA, 17 bp, Homo sapiens
tgaaatgacagaatgct

SEQ ID NO: 1890283 - DNA, 12 bp, Homo sapiens
tgaaatgtaaca

SEQ ID NO: 1890284 - DNA, 18 bp, Homo sapiens
tgaacaaagcacctcaag

SEQ ID NO: 1890285 - DNA, 19 bp, Homo sapiens
tgaacaaagcacctcaagt

SEQ ID NO: 1890286 - DNA, 15 bp, Homo sapiens
tgaacactagtctgt

SEQ ID NO: 1890287 - DNA, 17 bp, Homo sapiens
tgaacactagtctgtgt

SEQ ID NO: 1890288 - DNA, 19 bp, Homo sapiens
tgaacactagtctgtgtaa

SEQ ID NO: 1890289 - DNA, 22 bp, Homo sapiens
tgaacagactagaagtatttgt

SEQ ID NO: 1890290 - DNA, 16 bp, Homo sapiens
tgaactgcaggaagag

SEQ ID NO: 1890291 - DNA, 14 bp, Homo sapiens
tgaagaagatggta

SEQ ID NO: 1890292 - DNA, 20 bp, Homo sapiens
tgaagaagcaccaatcatga

SEQ ID NO: 1890293 - DNA, 22 bp, Homo sapiens
tgaagaagcaccaatcatgaat

SEQ ID NO: 1890294 - DNA, 20 bp, Homo sapiens
tgaagcaaactaactttttt

SEQ ID NO: 1890295 - DNA, 11 bp, Homo sapiens
tgaagcaaatg

SEQ ID NO: 1890296 - DNA, 14 bp, Homo sapiens
tgaagcaaatgtgt

SEQ ID NO: 1890297 - DNA, 15 bp, Homo sapiens
tgaaggctgtatcta

SEQ ID NO: 1890298 - DNA, 18 bp, Homo sapiens
tgaagtacccgttcacat

SEQ ID NO: 1890299 - DNA, 13 bp, Homo sapiens
tgaagtccaagca

SEQ ID NO: 1890300 - DNA, 21 bp, Homo sapiens
tgaagtccaagcatttagatg

SEQ ID NO: 1890301 - DNA, 22 bp, Homo sapiens
tgaagtccaagcatttagatgt

SEQ ID NO: 1890302 - DNA, 21 bp, Homo sapiens
tgaatgaccagcagcagcttt

SEQ ID NO: 1890303 - DNA, 15 bp, Homo sapiens
tgacaagctcacaga

SEQ ID NO: 1890304 - DNA, 16 bp, Homo sapiens
tgacacattaatgaat

SEQ ID NO: 1890305 - DNA, 23 bp, Homo sapiens
tgacactgcggggcttggctgag

SEQ ID NO: 1890306 - DNA, 16 bp, Homo sapiens
tgacaggggctcagga

SEQ ID NO: 1890307 - DNA, 18 bp, Homo sapiens
tgacaggggctcaggata

SEQ ID NO: 1890308 - DNA, 15 bp, Homo sapiens
tgacagtcctctcca

SEQ ID NO: 1890309 - DNA, 17 bp, Homo sapiens
tgacagtcctctccacc

SEQ ID NO: 1890310 - DNA, 18 bp, Homo sapiens
tgacagtcctctccacct

SEQ ID NO: 1890311 - DNA, 15 bp, Homo sapiens
tgacatgtgcctgta

SEQ ID NO: 1890312 - DNA, 18 bp, Homo sapiens
tgacattcagaaaacttc

SEQ ID NO: 1890313 - DNA, 20 bp, Homo sapiens
tgaccagcagcagctttcag

SEQ ID NO: 1890314 - DNA, 13 bp, Homo sapiens
tgaccatcccatg

SEQ ID NO: 1890315 - DNA, 14 bp, Homo sapiens
tgaccatcccatga

SEQ ID NO: 1890316 - DNA, 14 bp, Homo sapiens
tgaccttctgaaca

SEQ ID NO: 1890317 - DNA, 15 bp, Homo sapiens
tgactcgggctcctg

SEQ ID NO: 1890318 - DNA, 12 bp, Homo sapiens
tgactcttaaga

SEQ ID NO: 1890319 - DNA, 14 bp, Homo sapiens
tgactcttaagaag

SEQ ID NO: 1890320 - DNA, 15 bp, Homo sapiens
tgactcttaagaaga

SEQ ID NO: 1890321 - DNA, 18 bp, Homo sapiens
tcatgtaagctgaaaata

SEQ ID NO: 1890322 - DNA, 19 bp, Homo sapiens
tcatgtaagctgaaaatat

SEQ ID NO: 1890323 - DNA, 24 bp, Homo sapiens
tcatgtggcacttgggcatttata

SEQ ID NO: 1890324 - DNA, 20 bp, Homo sapiens
tcatgtgtacaaaagtttca

SEQ ID NO: 1890325 - DNA, 15 bp, Homo sapiens
tcattagagcttaaa

SEQ ID NO: 1890326 - DNA, 21 bp, Homo sapiens
ctttccagggtcaaagtacag

SEQ ID NO: 1890327 - DNA, 17 bp, Homo sapiens
ctttccagggttattta

SEQ ID NO: 1890328 - DNA, 17 bp, Homo sapiens
ctttcccaaatgtattg

SEQ ID NO: 1890329 - DNA, 19 bp, Homo sapiens
ctttccggggaggagcctt

SEQ ID NO: 1890330 - DNA, 23 bp, Homo sapiens
ctttccggggaggagccttggag

SEQ ID NO: 1890331 - DNA, 18 bp, Homo sapiens
ctttctcaataagcctca

SEQ ID NO: 1890332 - DNA, 19 bp, Homo sapiens
ctttctcctctgctatgca

SEQ ID NO: 1890333 - DNA, 23 bp, Homo sapiens
ctttctcctctgctatgcatttt

SEQ ID NO: 1890334 - DNA, 19 bp, Homo sapiens
ctttggacagaagcagctc

SEQ ID NO: 1890335 - DNA, 20 bp, Homo sapiens
ctttggacagaagcagctct

SEQ ID NO: 1890336 - DNA, 12 bp, Homo sapiens
cttttaagcaga

SEQ ID NO: 1890337 - DNA, 23 bp, Homo sapiens
cttttaagcagacccataccttt

SEQ ID NO: 1890338 - DNA, 14 bp, Homo sapiens
cttttataaacctc

SEQ ID NO: 1890339 - DNA, 16 bp, Homo sapiens
cttttataaacctcta

SEQ ID NO: 1890340 - DNA, 23 bp, Homo sapiens
cttttcagcttctgctgggctgg

SEQ ID NO: 1890341 - DNA, 18 bp, Homo sapiens
cttttcatctgttgttct

SEQ ID NO: 1890342 - DNA, 17 bp, Homo sapiens
cttttcttggttctttt

SEQ ID NO: 1890343 - DNA, 20 bp, Homo sapiens
ctttttaccaagtttcaggt

SEQ ID NO: 1890344 - DNA, 13 bp, Homo sapiens
cttttttcagtta

SEQ ID NO: 1890345 - DNA, 18 bp, Homo sapiens
cttttttttttttaacat

SEQ ID NO: 1890346 - DNA, 18 bp, Homo sapiens
cttttttttttttttaca

SEQ ID NO: 1890347 - DNA, 15 bp, Homo sapiens
gaaaaatactttgat

SEQ ID NO: 1890348 - DNA, 22 bp, Homo sapiens
gaaaacaaaaacgccttttctt

SEQ ID NO: 1890349 - DNA, 14 bp, Homo sapiens
gaaaacatttaaca

SEQ ID NO: 1890350 - DNA, 14 bp, Homo sapiens
gaaaacttatttga

SEQ ID NO: 1890351 - DNA, 16 bp, Homo sapiens
gaaaacttatttgagt

SEQ ID NO: 1890352 - DNA, 19 bp, Homo sapiens
gaaaagaaaacatttaaca

SEQ ID NO: 1890353 - DNA, 15 bp, Homo sapiens
gaaaagcctctgtgt

SEQ ID NO: 1890354 - DNA, 12 bp, Homo sapiens
gaaaattagtaa

SEQ ID NO: 1890355 - DNA, 18 bp, Homo sapiens
gaaacaacttgtgttcta

SEQ ID NO: 1890356 - DNA, 11 bp, Homo sapiens
gaaacatttgg

SEQ ID NO: 1890357 - DNA, 23 bp, Homo sapiens
gaaactcgttaatttgtagtgtt

SEQ ID NO: 1890358 - DNA, 17 bp, Homo sapiens
gaaagaaaattagtaat

SEQ ID NO: 1890359 - DNA, 17 bp, Homo sapiens
gaaagagaacttccaga

SEQ ID NO: 1890360 - DNA, 12 bp, Homo sapiens
gaaatatatttg

SEQ ID NO: 1890361 - DNA, 13 bp, Homo sapiens
gaaatattatgtt

SEQ ID NO: 1890362 - DNA, 14 bp, Homo sapiens
gaaatgtaacatga

SEQ ID NO: 1890363 - DNA, 19 bp, Homo sapiens
gaaatgtaacatgaagcaa

SEQ ID NO: 1890364 - DNA, 18 bp, Homo sapiens
gaaattaaatccaataaa

SEQ ID NO: 1890365 - DNA, 17 bp, Homo sapiens
gaaattgggtgtgccct

SEQ ID NO: 1890366 - DNA, 19 bp, Homo sapiens
gaacatctggggactaata

SEQ ID NO: 1890367 - DNA, 15 bp, Homo sapiens
gaaccacaagactgc

SEQ ID NO: 1890368 - DNA, 15 bp, Homo sapiens
gaacgtcttatctaa

SEQ ID NO: 1890369 - DNA, 16 bp, Homo sapiens
gaactgcaggaagaga

SEQ ID NO: 1890370 - DNA, 17 bp, Homo sapiens
gaagactgcattatatt

SEQ ID NO: 1890371 - DNA, 19 bp, Homo sapiens
gaagactgcattatattta

SEQ ID NO: 1890372 - DNA, 18 bp, Homo sapiens
gaagagatttttcatgat

SEQ ID NO: 1890373 - DNA, 20 bp, Homo sapiens
gaagatattgggaaggaaat

SEQ ID NO: 1890374 - DNA, 12 bp, Homo sapiens
gaagcagctctt

SEQ ID NO: 1890375 - DNA, 21 bp, Homo sapiens
gaagccttggggctgatgcag

SEQ ID NO: 1890376 - DNA, 20 bp, Homo sapiens
gaaggaccaacccatgccct

SEQ ID NO: 1890377 - DNA, 22 bp, Homo sapiens
gaaggaccaacccatgccctgc

SEQ ID NO: 1890378 - DNA, 16 bp, Homo sapiens
gaaggccttgctgtca

SEQ ID NO: 1890379 - DNA, 18 bp, Homo sapiens
gaaggccttgctgtcatg

SEQ ID NO: 1890380 - DNA, 21 bp, Homo sapiens
gaagtacccgttcacattttt

SEQ ID NO: 1890381 - DNA, 15 bp, Homo sapiens
gaagtctaattcaca

SEQ ID NO: 1890382 - DNA, 14 bp, Homo sapiens
gaatagatgtcttc

SEQ ID NO: 1890383 - DNA, 14 bp, Homo sapiens
gaatatataaacac

SEQ ID NO: 1890384 - DNA, 18 bp, Homo sapiens
gaatcagcctacaggcct

SEQ ID NO: 1890385 - DNA, 22 bp, Homo sapiens
gaatgagagacacactgaagaa

SEQ ID NO: 1890386 - DNA, 23 bp, Homo sapiens
gaatgagagacacactgaagaag

SEQ ID NO: 1890387 - DNA, 14 bp, Homo sapiens
gaatgattatgaat

SEQ ID NO: 1890388 - DNA, 22 bp, Homo sapiens
gaatgattatgaattacatttg

SEQ ID NO: 1890389 - DNA, 17 bp, Homo sapiens
gaatgtgattttaaaga

SEQ ID NO: 1890390 - DNA, 19 bp, Homo sapiens
gaatgtgattttaaagagt

SEQ ID NO: 1890391 - DNA, 20 bp, Homo sapiens
gaattacatttgtataaaat

SEQ ID NO: 1890392 - DNA, 14 bp, Homo sapiens
gaatttgtaagttt

SEQ ID NO: 1890393 - DNA, 14 bp, Homo sapiens
gaattttcccactg

SEQ ID NO: 1890394 - DNA, 19 bp, Homo sapiens
gacactgcggggcttggct

SEQ ID NO: 1890395 - DNA, 16 bp, Homo sapiens
gacactgttttcctta

SEQ ID NO: 1890396 - DNA, 21 bp, Homo sapiens
gacagcccttctttccacaga

SEQ ID NO: 1890397 - DNA, 23 bp, Homo sapiens
gacaggatggttcccttgatgaa

SEQ ID NO: 1890398 - DNA, 13 bp, Homo sapiens
gacaggggctcag

SEQ ID NO: 1890399 - DNA, 16 bp, Homo sapiens
gacaggggctcaggat

SEQ ID NO: 1890400 - DNA, 17 bp, Homo sapiens
gacagtcacctcatgga

SEQ ID NO: 1890401 - DNA, 16 bp, Homo sapiens
gacagtcctctccacc

SEQ ID NO: 1890402 - DNA, 17 bp, Homo sapiens
gacagtcctctccacct

SEQ ID NO: 1890403 - DNA, 17 bp, Homo sapiens
gaccaacccatgccctg

SEQ ID NO: 1890404 - DNA, 19 bp, Homo sapiens
gaccaacccatgccctgcc

SEQ ID NO: 1890405 - DNA, 19 bp, Homo sapiens
gaccaagcttaaggagagg

SEQ ID NO: 1890406 - DNA, 20 bp, Homo sapiens
gaccacagcaaggcacctgc

SEQ ID NO: 1890407 - DNA, 17 bp, Homo sapiens
gaccaggacttgtgcag

SEQ ID NO: 1890408 - DNA, 16 bp, Homo sapiens
gacccatctggaggct

SEQ ID NO: 1890409 - DNA, 18 bp, Homo sapiens
gaccccatctctgctgct

SEQ ID NO: 1890410 - DNA, 23 bp, Homo sapiens
gaccccatctctgctgcttctgg

SEQ ID NO: 1890411 - DNA, 15 bp, Homo sapiens
gaccccatctgccca

SEQ ID NO: 1890412 - DNA, 16 bp, Homo sapiens
gaccccatctgcccag

SEQ ID NO: 1890413 - DNA, 18 bp, Homo sapiens
gaccccttttcagcttct

SEQ ID NO: 1890414 - DNA, 13 bp, Homo sapiens
gaccctgtttctg

SEQ ID NO: 1890415 - DNA, 14 bp, Homo sapiens
gacggatggaagga

SEQ ID NO: 1890416 - DNA, 16 bp, Homo sapiens
gacggatggaaggaga

SEQ ID NO: 1890417 - DNA, 17 bp, Homo sapiens
gacggatggaaggagag

SEQ ID NO: 1890418 - DNA, 21 bp, Homo sapiens
gacggatggaaggagagaggt

SEQ ID NO: 1890419 - DNA, 19 bp, Homo sapiens
gactatgcgtttttataaa

SEQ ID NO: 1890420 - DNA, 11 bp, Homo sapiens
gactcccatgc

SEQ ID NO: 1890421 - DNA, 20 bp, Homo sapiens
gactcccatgcaagtagctg

SEQ ID NO: 1890422 - DNA, 15 bp, Homo sapiens
gactcgggctcctgt

SEQ ID NO: 1890423 - DNA, 18 bp, Homo sapiens
gactcgggctcctgtgcc

SEQ ID NO: 1890424 - DNA, 20 bp, Homo sapiens
gactcgggctcctgtgccct

SEQ ID NO: 1890425 - DNA, 15 bp, Homo sapiens
gactcttaagaagac

SEQ ID NO: 1890426 - DNA, 16 bp, Homo sapiens
gactcttaagaagact

SEQ ID NO: 1890427 - DNA, 17 bp, Homo sapiens
gactcttaagaagactg

SEQ ID NO: 1890428 - DNA, 18 bp, Homo sapiens
gactcttaagaagactgc

SEQ ID NO: 1890429 - DNA, 12 bp, Homo sapiens
gactgaatagaa

SEQ ID NO: 1890430 - DNA, 16 bp, Homo sapiens
gactgcattatattta

SEQ ID NO: 1890431 - DNA, 24 bp, Homo sapiens
gactgcattatatttattactgta

SEQ ID NO: 1890432 - DNA, 16 bp, Homo sapiens
gactggccagaggcag

SEQ ID NO: 1890433 - DNA, 17 bp, Homo sapiens
gacttcaggggctgccc

SEQ ID NO: 1890434 - DNA, 23 bp, Homo sapiens
gacttcaggggctgcccgctccc

SEQ ID NO: 1890435 - DNA, 20 bp, Homo sapiens
gacttgaattttcccactgc

SEQ ID NO: 1890436 - DNA, 19 bp, Homo sapiens
gacttgaggattttgagta

SEQ ID NO: 1890437 - DNA, 13 bp, Homo sapiens
gagaaacaggccc

SEQ ID NO: 1890438 - DNA, 18 bp, Homo sapiens
gagacacactgaagaagc

SEQ ID NO: 1890439 - DNA, 22 bp, Homo sapiens
gagacggatggaaggagagagg

SEQ ID NO: 1890440 - DNA, 15 bp, Homo sapiens
gagactgcagaggag

SEQ ID NO: 1890441 - DNA, 20 bp, Homo sapiens
gagactggccagaggcagct

SEQ ID NO: 1890442 - DNA, 18 bp, Homo sapiens
gagagcagcttctgccac

SEQ ID NO: 1890443 - DNA, 19 bp, Homo sapiens
gagagcagcttctgccact

SEQ ID NO: 1890444 - DNA, 19 bp, Homo sapiens
gccccagcctggcccagct

SEQ ID NO: 1890445 - DNA, 16 bp, Homo sapiens
gcccccacctgcctga

SEQ ID NO: 1890446 - DNA, 16 bp, Homo sapiens
gccccctcgtgccagt

SEQ ID NO: 1890447 - DNA, 15 bp, Homo sapiens
gccccggggcctgtt

SEQ ID NO: 1890448 - DNA, 18 bp, Homo sapiens
gcccctgtgtgggagggc

SEQ ID NO: 1890449 - DNA, 16 bp, Homo sapiens
gcccgctgtcccaggg

SEQ ID NO: 1890450 - DNA, 14 bp, Homo sapiens
gcccggatccagga

SEQ ID NO: 1890451 - DNA, 15 bp, Homo sapiens
gcccggcgccctctg

SEQ ID NO: 1890452 - DNA, 16 bp, Homo sapiens
gcccgttgtctccctg

SEQ ID NO: 1890453 - DNA, 18 bp, Homo sapiens
gcccgttgtctccctggc

SEQ ID NO: 1890454 - DNA, 23 bp, Homo sapiens
gcccgttgtctccctggccctca

SEQ ID NO: 1890455 - DNA, 15 bp, Homo sapiens
gccctcaaggcctcc

SEQ ID NO: 1890456 - DNA, 19 bp, Homo sapiens
gccctcaaggcctcccaca

SEQ ID NO: 1890457 - DNA, 13 bp, Homo sapiens
gccctcccgcccc

SEQ ID NO: 1890458 - DNA, 15 bp, Homo sapiens
gccctcccgcccctt

SEQ ID NO: 1890459 - DNA, 17 bp, Homo sapiens
gccctccttcttgccct

SEQ ID NO: 1890460 - DNA, 19 bp, Homo sapiens
gccctccttcttgccctga

SEQ ID NO: 1890461 - DNA, 22 bp, Homo sapiens
gccctccttcttgccctgagct

SEQ ID NO: 1890462 - DNA, 13 bp, Homo sapiens
gccctctgtcctg

SEQ ID NO: 1890463 - DNA, 23 bp, Homo sapiens
gccctgcactgtcctgctccaca

SEQ ID NO: 1890464 - DNA, 17 bp, Homo sapiens
gccctgcaggaggcctg

SEQ ID NO: 1890465 - DNA, 21 bp, Homo sapiens
gccctgcaggaggcctgggag

SEQ ID NO: 1890466 - DNA, 23 bp, Homo sapiens
gccctgcaggaggcctgggaggg

SEQ ID NO: 1890467 - DNA, 14 bp, Homo sapiens
gccctgccaagcct

SEQ ID NO: 1890468 - DNA, 17 bp, Homo sapiens
gccctgccaagcctgga

SEQ ID NO: 1890469 - DNA, 18 bp, Homo sapiens
gccctgccaagcctggag

SEQ ID NO: 1890470 - DNA, 19 bp, Homo sapiens
gccctgccaagcctggagc

SEQ ID NO: 1890471 - DNA, 19 bp, Homo sapiens
gccctggctcccaagggag

SEQ ID NO: 1890472 - DNA, 21 bp, Homo sapiens
gccctggctcccaagggaggc

SEQ ID NO: 1890473 - DNA, 16 bp, Homo sapiens
gccctggggagtgagc

SEQ ID NO: 1890474 - DNA, 18 bp, Homo sapiens
gccctggggagtgagctt

SEQ ID NO: 1890475 - DNA, 15 bp, Homo sapiens
gccgccgcctcgccc

SEQ ID NO: 1890476 - DNA, 15 bp, Homo sapiens
gccgcctcgcccacc

SEQ ID NO: 1890477 - DNA, 13 bp, Homo sapiens
gccggccaggtgg

SEQ ID NO: 1890478 - DNA, 15 bp, Homo sapiens
gccgggcctggactg

SEQ ID NO: 1890479 - DNA, 13 bp, Homo sapiens
gcctatcagtgtg

SEQ ID NO: 1890480 - DNA, 15 bp, Homo sapiens
gcctatcagtgtgcc

SEQ ID NO: 1890481 - DNA, 23 bp, Homo sapiens
gcctatcagtgtgccccccatcc

SEQ ID NO: 1890482 - DNA, 12 bp, Homo sapiens
gcctccactccc

SEQ ID NO: 1890483 - DNA, 15 bp, Homo sapiens
gcctccactcccact

SEQ ID NO: 1890484 - DNA, 16 bp, Homo sapiens
gcctccactcccactt

SEQ ID NO: 1890485 - DNA, 21 bp, Homo sapiens
gcctccactcccacttccctg

SEQ ID NO: 1890486 - DNA, 22 bp, Homo sapiens
gcctccgttcccacctctgagg

SEQ ID NO: 1890487 - DNA, 16 bp, Homo sapiens
gcctcgcccaccgcat

SEQ ID NO: 1890488 - DNA, 15 bp, Homo sapiens
gcctcgcctggcctg

SEQ ID NO: 1890489 - DNA, 18 bp, Homo sapiens
gcctcggctcctgctgca

SEQ ID NO: 1890490 - DNA, 16 bp, Homo sapiens
gcctctacccaaccag

SEQ ID NO: 1890491 - DNA, 21 bp, Homo sapiens
gcctctacccaaccagggccc

SEQ ID NO: 1890492 - DNA, 19 bp, Homo sapiens
gcctctcgctcctcaaccc

SEQ ID NO: 1890493 - DNA, 16 bp, Homo sapiens
gcctctgtgtcactgg

SEQ ID NO: 1890494 - DNA, 22 bp, Homo sapiens
gcctctgtgtcactggctgcct

SEQ ID NO: 1890495 - DNA, 13 bp, Homo sapiens
gcctgactctgtg

SEQ ID NO: 1890496 - DNA, 20 bp, Homo sapiens
gcctgactctgtgctgagca

SEQ ID NO: 1890497 - DNA, 16 bp, Homo sapiens
gcctgatggagaggag

SEQ ID NO: 1890498 - DNA, 17 bp, Homo sapiens
gcctgatggagaggaga

SEQ ID NO: 1890499 - DNA, 17 bp, Homo sapiens
gcctgattcggctgtct

SEQ ID NO: 1890500 - DNA, 14 bp, Homo sapiens
gcctgcctgggaac

SEQ ID NO: 1890501 - DNA, 18 bp, Homo sapiens
gcctgctgagctgtgccc

SEQ ID NO: 1890502 - DNA, 13 bp, Homo sapiens
gcctggagcccct

SEQ ID NO: 1890503 - DNA, 21 bp, Homo sapiens
gcctggagcccctgtgtggga

SEQ ID NO: 1890504 - DNA, 18 bp, Homo sapiens
gcctggcaagtgggtgaa

SEQ ID NO: 1890505 - DNA, 22 bp, Homo sapiens
gcctggcacagtgtctgggctg

SEQ ID NO: 1890506 - DNA, 15 bp, Homo sapiens
gcctggcccagctcc

SEQ ID NO: 1890507 - DNA, 16 bp, Homo sapiens
gcctggcccagctccc

SEQ ID NO: 1890508 - DNA, 17 bp, Homo sapiens
gcctggcccagctcccc

SEQ ID NO: 1890509 - DNA, 14 bp, Homo sapiens
gcctggcctgaggt

SEQ ID NO: 1890510 - DNA, 19 bp, Homo sapiens
gcctgttctgtaggagaga

SEQ ID NO: 1890511 - DNA, 20 bp, Homo sapiens
gccttccgctcccaccagcc

SEQ ID NO: 1890512 - DNA, 12 bp, Homo sapiens
gccttgctgtca

SEQ ID NO: 1890513 - DNA, 22 bp, Homo sapiens
gcgaaacaacttgtgttctatt

SEQ ID NO: 1890514 - DNA, 14 bp, Homo sapiens
gcgaccccatctgc

SEQ ID NO: 1890515 - DNA, 15 bp, Homo sapiens
gcgaccccatctgcc

SEQ ID NO: 1890516 - DNA, 16 bp, Homo sapiens
gcgagaggaggggccc

SEQ ID NO: 1890517 - DNA, 18 bp, Homo sapiens
gcgaggcgggggagcctg

SEQ ID NO: 1890518 - DNA, 17 bp, Homo sapiens
gcgcaccctcccctccc

SEQ ID NO: 1890519 - DNA, 15 bp, Homo sapiens
gcgctgcctgtgtgg

SEQ ID NO: 1890520 - DNA, 19 bp, Homo sapiens
gcgctggccgggaccccga

SEQ ID NO: 1890521 - DNA, 14 bp, Homo sapiens
gcgggggagcctgg

SEQ ID NO: 1890522 - DNA, 15 bp, Homo sapiens
gcggtaggtgctggc

SEQ ID NO: 1890523 - DNA, 14 bp, Homo sapiens
gctaccctccctgc

SEQ ID NO: 1890524 - DNA, 18 bp, Homo sapiens
gctagaggaagcagccaa

SEQ ID NO: 1890525 - DNA, 12 bp, Homo sapiens
gctaggggctgg

SEQ ID NO: 1890526 - DNA, 13 bp, Homo sapiens
gctagggtgcctg

SEQ ID NO: 1890527 - DNA, 18 bp, Homo sapiens
gctagggtgcctgctctc

SEQ ID NO: 1890528 - DNA, 18 bp, Homo sapiens
gctatgcattttcttcac

SEQ ID NO: 1890529 - DNA, 19 bp, Homo sapiens
gctccaaaccctcgaggcg

SEQ ID NO: 1890530 - DNA, 16 bp, Homo sapiens
gctccacgccctgggg

SEQ ID NO: 1890531 - DNA, 17 bp, Homo sapiens
gctccacgccctgggga

SEQ ID NO: 1890532 - DNA, 14 bp, Homo sapiens
gctccactggcctg

SEQ ID NO: 1890533 - DNA, 15 bp, Homo sapiens
gctccactggcctgc

SEQ ID NO: 1890534 - DNA, 15 bp, Homo sapiens
gctcccaagggaggc

SEQ ID NO: 1890535 - DNA, 13 bp, Homo sapiens
gggatcctggagc

SEQ ID NO: 1890536 - DNA, 18 bp, Homo sapiens
gggatcctggagcccctg

SEQ ID NO: 1890537 - DNA, 15 bp, Homo sapiens
gggatctggggaagg

SEQ ID NO: 1890538 - DNA, 16 bp, Homo sapiens
gggatctggggaagga

SEQ ID NO: 1890539 - DNA, 22 bp, Homo sapiens
gggatgatgccacaccaagctg

SEQ ID NO: 1890540 - DNA, 14 bp, Homo sapiens
gggcactgctgggt

SEQ ID NO: 1890541 - DNA, 15 bp, Homo sapiens
gggcaggcacagcac

SEQ ID NO: 1890542 - DNA, 17 bp, Homo sapiens
gggcaggcacagcacag

SEQ ID NO: 1890543 - DNA, 14 bp, Homo sapiens
gggcaggccctgca

SEQ ID NO: 1890544 - DNA, 17 bp, Homo sapiens
gggcaggccctgcactg

SEQ ID NO: 1890545 - DNA, 16 bp, Homo sapiens
gggcatgggggaggct

SEQ ID NO: 1890546 - DNA, 12 bp, Homo sapiens
gggccagcccag

SEQ ID NO: 1890547 - DNA, 16 bp, Homo sapiens
gggccatactggcctc

SEQ ID NO: 1890548 - DNA, 13 bp, Homo sapiens
gggcccgcttgcc

SEQ ID NO: 1890549 - DNA, 23 bp, Homo sapiens
gggcccgcttgcctcggctcctg

SEQ ID NO: 1890550 - DNA, 18 bp, Homo sapiens
gggcccgttgtctccctg

SEQ ID NO: 1890551 - DNA, 10 bp, Homo sapiens
gggccctgca

SEQ ID NO: 1890552 - DNA, 18 bp, Homo sapiens
gggccctgcaggaggcct

SEQ ID NO: 1890553 - DNA, 21 bp, Homo sapiens
gggccggccaggtgggcgggc

SEQ ID NO: 1890554 - DNA, 14 bp, Homo sapiens
gggcctatcagtgt

SEQ ID NO: 1890555 - DNA, 18 bp, Homo sapiens
gggcctatcagtgtgccc

SEQ ID NO: 1890556 - DNA, 20 bp, Homo sapiens
gggcctatcagtgtgccccc

SEQ ID NO: 1890557 - DNA, 16 bp, Homo sapiens
gggcctgatggagagg

SEQ ID NO: 1890558 - DNA, 11 bp, Homo sapiens
gggcctggact

SEQ ID NO: 1890559 - DNA, 18 bp, Homo sapiens
gggctaggggctggggcc

SEQ ID NO: 1890560 - DNA, 14 bp, Homo sapiens
gggctgactgggac

SEQ ID NO: 1890561 - DNA, 18 bp, Homo sapiens
gggctgcactctgtgccc

SEQ ID NO: 1890562 - DNA, 19 bp, Homo sapiens
gggctgcactctgtgccca

SEQ ID NO: 1890563 - DNA, 20 bp, Homo sapiens
gggctgcactctgtgcccat

SEQ ID NO: 1890564 - DNA, 19 bp, Homo sapiens
gggctgcccgctcccagtg

SEQ ID NO: 1890565 - DNA, 21 bp, Homo sapiens
gggctgggagaaggtgcttgg

SEQ ID NO: 1890566 - DNA, 20 bp, Homo sapiens
gggctgggcaggtcctgggg

SEQ ID NO: 1890567 - DNA, 22 bp, Homo sapiens
gggctggggccaaataaagtct

SEQ ID NO: 1890568 - DNA, 17 bp, Homo sapiens
gggctgttggctggggg

SEQ ID NO: 1890569 - DNA, 17 bp, Homo sapiens
ggggaaggccttgctgt

SEQ ID NO: 1890570 - DNA, 16 bp, Homo sapiens
ggggagcctggagccc

SEQ ID NO: 1890571 - DNA, 13 bp, Homo sapiens
ggggaggctgaga

SEQ ID NO: 1890572 - DNA, 12 bp, Homo sapiens
ggggagtgagct

SEQ ID NO: 1890573 - DNA, 16 bp, Homo sapiens
ggggatcctggagccc

SEQ ID NO: 1890574 - DNA, 23 bp, Homo sapiens
ggggcaggaatcaaggagcctcc

SEQ ID NO: 1890575 - DNA, 15 bp, Homo sapiens
ggggcaggcacagca

SEQ ID NO: 1890576 - DNA, 21 bp, Homo sapiens
ggggcaggccctgcactgtcc

SEQ ID NO: 1890577 - DNA, 20 bp, Homo sapiens
ggggcatgggggaggctctg

SEQ ID NO: 1890578 - DNA, 14 bp, Homo sapiens
ggggcgagggaggg

SEQ ID NO: 1890579 - DNA, 19 bp, Homo sapiens
ggggctaggggctggggcc

SEQ ID NO: 1890580 - DNA, 16 bp, Homo sapiens
ggggctgcccgctccc

SEQ ID NO: 1890581 - DNA, 15 bp, Homo sapiens
ggggctggaggtggc

SEQ ID NO: 1890582 - DNA, 13 bp, Homo sapiens
ggggctgggttgg

SEQ ID NO: 1890583 - DNA, 14 bp, Homo sapiens
gggggcaaggtggg

SEQ ID NO: 1890584 - DNA, 18 bp, Homo sapiens
ggggtattttaggcaggg

SEQ ID NO: 1890585 - DNA, 18 bp, Homo sapiens
ggggtctccctgagcctg

SEQ ID NO: 1890586 - DNA, 19 bp, Homo sapiens
ggggtctccctgagcctgc

SEQ ID NO: 1890587 - DNA, 18 bp, Homo sapiens
gggtctccctgagcctgc

SEQ ID NO: 1890588 - DNA, 20 bp, Homo sapiens
gggtgccacggtggacttag

SEQ ID NO: 1890589 - DNA, 21 bp, Homo sapiens
gggtgcgaccccatctgccca

SEQ ID NO: 1890590 - DNA, 15 bp, Homo sapiens
gggtggacgagggag

SEQ ID NO: 1890591 - DNA, 13 bp, Homo sapiens
gggtggcccatcc

SEQ ID NO: 1890592 - DNA, 18 bp, Homo sapiens
gggtggcccatcccccct

SEQ ID NO: 1890593 - DNA, 12 bp, Homo sapiens
gggtgtgccctg

SEQ ID NO: 1890594 - DNA, 17 bp, Homo sapiens
gggtttagcaggctgca

SEQ ID NO: 1890595 - DNA, 19 bp, Homo sapiens
gggtttagcaggctgcagc

SEQ ID NO: 1890596 - DNA, 22 bp, Homo sapiens
gggtttagcaggctgcagcagg

SEQ ID NO: 1890597 - DNA, 13 bp, Homo sapiens
ggtaaaacacttg

SEQ ID NO: 1890598 - DNA, 19 bp, Homo sapiens
ggtaaattgtaaacagcta

SEQ ID NO: 1890599 - DNA, 20 bp, Homo sapiens
ggtaagtaatgagggctgag

SEQ ID NO: 1890600 - DNA, 20 bp, Homo sapiens
ggtaccaggtctcctccacc

SEQ ID NO: 1890601 - DNA, 22 bp, Homo sapiens
ggtacttcaaatccttgaagat

SEQ ID NO: 1890602 - DNA, 15 bp, Homo sapiens
ggtagacacacatga

SEQ ID NO: 1890603 - DNA, 12 bp, Homo sapiens
ggtagctctgag

SEQ ID NO: 1890604 - DNA, 13 bp, Homo sapiens
ggtagctctgagc

SEQ ID NO: 1890605 - DNA, 15 bp, Homo sapiens
ggtagctctgagccc

SEQ ID NO: 1890606 - DNA, 22 bp, Homo sapiens
ggtattttaggcagggatttga

SEQ ID NO: 1890607 - DNA, 12 bp, Homo sapiens
ggtcccacttcc

SEQ ID NO: 1890608 - DNA, 13 bp, Homo sapiens
ggtcccacttccc

SEQ ID NO: 1890609 - DNA, 17 bp, Homo sapiens
ggtctccctgagcctgc

SEQ ID NO: 1890610 - DNA, 22 bp, Homo sapiens
ggtctcctccaccgccatggct

SEQ ID NO: 1890611 - DNA, 19 bp, Homo sapiens
ggtctcgctgatgctgggc

SEQ ID NO: 1890612 - DNA, 18 bp, Homo sapiens
ggtctggaatggactggg

SEQ ID NO: 1890613 - DNA, 18 bp, Homo sapiens
ggtgaaaccctgtctcta

SEQ ID NO: 1890614 - DNA, 16 bp, Homo sapiens
ggtgcagccccaggac

SEQ ID NO: 1890615 - DNA, 20 bp, Homo sapiens
ggtgcagccccaggaccaag

SEQ ID NO: 1890616 - DNA, 18 bp, Homo sapiens
ggtgcctgattcggctgt

SEQ ID NO: 1890617 - DNA, 19 bp, Homo sapiens
ggtgcgaccccatctgccc

SEQ ID NO: 1890618 - DNA, 22 bp, Homo sapiens
ggtgcgaccccatctgcccagg

SEQ ID NO: 1890619 - DNA, 17 bp, Homo sapiens
ggtgctgctaccctccc

SEQ ID NO: 1890620 - DNA, 22 bp, Homo sapiens
ggtgctgctaccctccctgctg

SEQ ID NO: 1890621 - DNA, 13 bp, Homo sapiens
ggtggcccatccc

SEQ ID NO: 1890622 - DNA, 13 bp, Homo sapiens
ggtgggggagcct

SEQ ID NO: 1890623 - DNA, 16 bp, Homo sapiens
ggtggtagctctgagc

SEQ ID NO: 1890624 - DNA, 13 bp, Homo sapiens
ggtggtctgctcg

SEQ ID NO: 1890625 - DNA, 19 bp, Homo sapiens
ggtggtctgctcgggccca

SEQ ID NO: 1890626 - DNA, 20 bp, Homo sapiens
ggtggtctgctcgggcccag

SEQ ID NO: 1890627 - DNA, 23 bp, Homo sapiens
ggtggtgcagccccaggaccaag

SEQ ID NO: 1890628 - DNA, 20 bp, Homo sapiens
ggtgtcgcgccttctccccc

SEQ ID NO: 1890629 - DNA, 16 bp, Homo sapiens
ggtgtgccctggctcc

SEQ ID NO: 1890630 - DNA, 13 bp, Homo sapiens
ggttaagaaatac

SEQ ID NO: 1890631 - DNA, 14 bp, Homo sapiens
ggttaagaaatacc

SEQ ID NO: 1890632 - DNA, 23 bp, Homo sapiens
ggttacctgttccattgttgtca

SEQ ID NO: 1890633 - DNA, 17 bp, Homo sapiens
ggttggcgcaccctccc

SEQ ID NO: 1890634 - DNA, 18 bp, Homo sapiens
ggttggcgcaccctcccc

SEQ ID NO: 1890635 - DNA, 17 bp, Homo sapiens
ggttggcttgctgatgg

SEQ ID NO: 1890636 - DNA, 15 bp, Homo sapiens
ggttttcaggggctt

SEQ ID NO: 1890637 - DNA, 19 bp, Homo sapiens
gtaaagtttgttgaaaaca

SEQ ID NO: 1890638 - DNA, 11 bp, Homo sapiens
gtaaataaagc

SEQ ID NO: 1890639 - DNA, 14 bp, Homo sapiens
cggacctttcagct

SEQ ID NO: 1890640 - DNA, 12 bp, Homo sapiens
cggagggaccag

SEQ ID NO: 1890641 - DNA, 16 bp, Homo sapiens
cggatctttggacaga

SEQ ID NO: 1890642 - DNA, 19 bp, Homo sapiens
cggatctttggacagaagc

SEQ ID NO: 1890643 - DNA, 19 bp, Homo sapiens
cggatggaaggagagaggt

SEQ ID NO: 1890644 - DNA, 17 bp, Homo sapiens
cggcgccctctgtcctg

SEQ ID NO: 1890645 - DNA, 23 bp, Homo sapiens
cggctcctgctgcaccaacccag

SEQ ID NO: 1890646 - DNA, 14 bp, Homo sapiens
cgggaggggcccgc

SEQ ID NO: 1890647 - DNA, 15 bp, Homo sapiens
cgggcagcacagcaa

SEQ ID NO: 1890648 - DNA, 15 bp, Homo sapiens
cgggcccaggccatc

SEQ ID NO: 1890649 - DNA, 21 bp, Homo sapiens
cgggcctggactgtcctaggt

SEQ ID NO: 1890650 - DNA, 17 bp, Homo sapiens
cgggctcctgtgccctt

SEQ ID NO: 1890651 - DNA, 22 bp, Homo sapiens
cggggaggagagagcagcttct

SEQ ID NO: 1890652 - DNA, 17 bp, Homo sapiens
cggggaggagccttgga

SEQ ID NO: 1890653 - DNA, 17 bp, Homo sapiens
cggggcgtttctttgcc

SEQ ID NO: 1890654 - DNA, 14 bp, Homo sapiens
cgggggagcctgga

SEQ ID NO: 1890655 - DNA, 17 bp, Homo sapiens
cgggggagcctggagcc

SEQ ID NO: 1890656 - DNA, 19 bp, Homo sapiens
cgggggagcctggagcccc

SEQ ID NO: 1890657 - DNA, 16 bp, Homo sapiens
cggggtattttaggca

SEQ ID NO: 1890658 - DNA, 17 bp, Homo sapiens
cggggtggacgagggag

SEQ ID NO: 1890659 - DNA, 18 bp, Homo sapiens
cggggtggacgagggagt

SEQ ID NO: 1890660 - DNA, 16 bp, Homo sapiens
cgggttaagaaatacc

SEQ ID NO: 1890661 - DNA, 22 bp, Homo sapiens
cggtcaaaatattttttaaagt

SEQ ID NO: 1890662 - DNA, 14 bp, Homo sapiens
cggtgaggcagggg

SEQ ID NO: 1890663 - DNA, 21 bp, Homo sapiens
cgtctactcattccccggggc

SEQ ID NO: 1890664 - DNA, 20 bp, Homo sapiens
cgtggccccagcctggccca

SEQ ID NO: 1890665 - DNA, 23 bp, Homo sapiens
cgtggccccagcctggcccagct

SEQ ID NO: 1890666 - DNA, 14 bp, Homo sapiens
cgtgggagaggcag

SEQ ID NO: 1890667 - DNA, 19 bp, Homo sapiens
cgttcattgcctttccagg

SEQ ID NO: 1890668 - DNA, 16 bp, Homo sapiens
cgttgccgggcctgga

SEQ ID NO: 1890669 - DNA, 13 bp, Homo sapiens
cgttgtctccctg

SEQ ID NO: 1890670 - DNA, 17 bp, Homo sapiens
cgttgtctccctggccc

SEQ ID NO: 1890671 - DNA, 14 bp, Homo sapiens
cgtttaagttgtat

SEQ ID NO: 1890672 - DNA, 16 bp, Homo sapiens
ctaaacagactattta

SEQ ID NO: 1890673 - DNA, 18 bp, Homo sapiens
ctaaacagactatttaac

SEQ ID NO: 1890674 - DNA, 22 bp, Homo sapiens
ctaactaaggtcccataataaa

SEQ ID NO: 1890675 - DNA, 14 bp, Homo sapiens
ctaagagagaatga

SEQ ID NO: 1890676 - DNA, 15 bp, Homo sapiens
ctaagagagaatgag

SEQ ID NO: 1890677 - DNA, 14 bp, Homo sapiens
ctaatcatgaaact

SEQ ID NO: 1890678 - DNA, 20 bp, Homo sapiens
ctacacccttggacttgagg

SEQ ID NO: 1890679 - DNA, 14 bp, Homo sapiens
ctacacctctgggc

SEQ ID NO: 1890680 - DNA, 21 bp, Homo sapiens
ctacacctctgggccctgcag

SEQ ID NO: 1890681 - DNA, 12 bp, Homo sapiens
ctacactgaaac

SEQ ID NO: 1890682 - DNA, 16 bp, Homo sapiens
ctacaggcctcacaca

SEQ ID NO: 1890683 - DNA, 18 bp, Homo sapiens
ctaccctacacctctggg

SEQ ID NO: 1890684 - DNA, 22 bp, Homo sapiens
ctaccctacacctctgggccct

SEQ ID NO: 1890685 - DNA, 20 bp, Homo sapiens
ctaccctccctgctgtcccc

SEQ ID NO: 1890686 - DNA, 22 bp, Homo sapiens
ctacctcactattcaagtatta

SEQ ID NO: 1890687 - DNA, 20 bp, Homo sapiens
ctacctggggtgggggccaa

SEQ ID NO: 1890688 - DNA, 18 bp, Homo sapiens
ctacggagggaccaggtg

SEQ ID NO: 1890689 - DNA, 14 bp, Homo sapiens
ctagaatttcttta

SEQ ID NO: 1890690 - DNA, 23 bp, Homo sapiens
ctagaggcaacagtgttctgagc

SEQ ID NO: 1890691 - DNA, 18 bp, Homo sapiens
ctagagtttagctggaaa

SEQ ID NO: 1890692 - DNA, 22 bp, Homo sapiens
ctagcagtaaatacttgcagtt

SEQ ID NO: 1890693 - DNA, 23 bp, Homo sapiens
ctagcagtaaatacttgcagttg

SEQ ID NO: 1890694 - DNA, 15 bp, Homo sapiens
ctaggaaatatttat

SEQ ID NO: 1890695 - DNA, 20 bp, Homo sapiens
ctaggactttagggatctgg

SEQ ID NO: 1890696 - DNA, 12 bp, Homo sapiens
ctaggggctggg

SEQ ID NO: 1890697 - DNA, 15 bp, Homo sapiens
ctaggggctggggcc

SEQ ID NO: 1890698 - DNA, 19 bp, Homo sapiens
ctagtatttctatgaaata

SEQ ID NO: 1890699 - DNA, 14 bp, Homo sapiens
ctagtggctgtcca

SEQ ID NO: 1890700 - DNA, 17 bp, Homo sapiens
ctagtggctgtccagtg

SEQ ID NO: 1890701 - DNA, 22 bp, Homo sapiens
ctagtggctgtccagtgcccat

SEQ ID NO: 1890702 - DNA, 12 bp, Homo sapiens
gctcccaccagc

SEQ ID NO: 1890703 - DNA, 19 bp, Homo sapiens
gctcccagtgtcttcctgt

SEQ ID NO: 1890704 - DNA, 17 bp, Homo sapiens
gctcccccgggaggggc

SEQ ID NO: 1890705 - DNA, 14 bp, Homo sapiens
gctccggaatagat

SEQ ID NO: 1890706 - DNA, 11 bp, Homo sapiens
gctcctgctgc

SEQ ID NO: 1890707 - DNA, 12 bp, Homo sapiens
gctcctgctgca

SEQ ID NO: 1890708 - DNA, 18 bp, Homo sapiens
gctcctgctgcaccaacc

SEQ ID NO: 1890709 - DNA, 14 bp, Homo sapiens
gctcgggcccaggc

SEQ ID NO: 1890710 - DNA, 18 bp, Homo sapiens
gctctccttgccctgggc

SEQ ID NO: 1890711 - DNA, 14 bp, Homo sapiens
gctctgtgggctgc

SEQ ID NO: 1890712 - DNA, 23 bp, Homo sapiens
gctctgtgggctgcactctgtgc

SEQ ID NO: 1890713 - DNA, 14 bp, Homo sapiens
gctctgttgcaggt

SEQ ID NO: 1890714 - DNA, 19 bp, Homo sapiens
gctctgttgcaggtgtccg

SEQ ID NO: 1890715 - DNA, 11 bp, Homo sapiens
gctgaaaatat

SEQ ID NO: 1890716 - DNA, 12 bp, Homo sapiens
gctgacagtcct

SEQ ID NO: 1890717 - DNA, 16 bp, Homo sapiens
gctgacagtcctctcc

SEQ ID NO: 1890718 - DNA, 18 bp, Homo sapiens
gctgagactgcagaggag

SEQ ID NO: 1890719 - DNA, 19 bp, Homo sapiens
gctgatgctgggctgggtg

SEQ ID NO: 1890720 - DNA, 14 bp, Homo sapiens
gctgatggctgctg

SEQ ID NO: 1890721 - DNA, 16 bp, Homo sapiens
gctgatggctgctgga

SEQ ID NO: 1890722 - DNA, 15 bp, Homo sapiens
gctgcactctgtgcc

SEQ ID NO: 1890723 - DNA, 18 bp, Homo sapiens
gctgcactctgtgcccat

SEQ ID NO: 1890724 - DNA, 20 bp, Homo sapiens
gctgcactctgtgcccatgg

SEQ ID NO: 1890725 - DNA, 22 bp, Homo sapiens
gctgcactctgtgcccatgggc

SEQ ID NO: 1890726 - DNA, 21 bp, Homo sapiens
gctgcagagagcacctggtgg

SEQ ID NO: 1890727 - DNA, 22 bp, Homo sapiens
gctgcagagagcacctggtggg

SEQ ID NO: 1890728 - DNA, 12 bp, Homo sapiens
gctgcagcaggc

SEQ ID NO: 1890729 - DNA, 12 bp, Homo sapiens
gctgcccgctcc

SEQ ID NO: 1890730 - DNA, 19 bp, Homo sapiens
gctgcccgctcccagtgtc

SEQ ID NO: 1890731 - DNA, 20 bp, Homo sapiens
gctgcccggcgccctctgtc

SEQ ID NO: 1890732 - DNA, 16 bp, Homo sapiens
gctgcctccactccca

SEQ ID NO: 1890733 - DNA, 17 bp, Homo sapiens
gctgcctccactcccac

SEQ ID NO: 1890734 - DNA, 16 bp, Homo sapiens
gctgctaccctccctg

SEQ ID NO: 1890735 - DNA, 16 bp, Homo sapiens
gctgcttctgggcctg

SEQ ID NO: 1890736 - DNA, 23 bp, Homo sapiens
gctggaaaagtatgttagtgcaa

SEQ ID NO: 1890737 - DNA, 12 bp, Homo sapiens
gctggaggtggc

SEQ ID NO: 1890738 - DNA, 13 bp, Homo sapiens
gctggaggtggcg

SEQ ID NO: 1890739 - DNA, 14 bp, Homo sapiens
gctggagtgctggc

SEQ ID NO: 1890740 - DNA, 15 bp, Homo sapiens
gctggccagccccac

SEQ ID NO: 1890741 - DNA, 16 bp, Homo sapiens
gctggccagccccaca

SEQ ID NO: 1890742 - DNA, 21 bp, Homo sapiens
gctggccagccccacagccca

SEQ ID NO: 1890743 - DNA, 19 bp, Homo sapiens
gctggctccacgccctggg

SEQ ID NO: 1890744 - DNA, 18 bp, Homo sapiens
gctggctgtactgccaag

SEQ ID NO: 1890745 - DNA, 13 bp, Homo sapiens
gctgggagaaggt

SEQ ID NO: 1890746 - DNA, 15 bp, Homo sapiens
gctgggagaaggtgc

SEQ ID NO: 1890747 - DNA, 21 bp, Homo sapiens
gctgggagaaggtgcttgggc

SEQ ID NO: 1890748 - DNA, 18 bp, Homo sapiens
gctgggcaggtcctgggg

SEQ ID NO: 1890749 - DNA, 14 bp, Homo sapiens
gctgggctggggcc

SEQ ID NO: 1890750 - DNA, 19 bp, Homo sapiens
gctggggccaaataaagtc

SEQ ID NO: 1890751 - DNA, 19 bp, Homo sapiens
gctgggggcatgggggagg

SEQ ID NO: 1890752 - DNA, 20 bp, Homo sapiens
gctgggggcatgggggaggc

SEQ ID NO: 1890753 - DNA, 21 bp, Homo sapiens
gctgggggcatgggggaggct

SEQ ID NO: 1890754 - DNA, 18 bp, Homo sapiens
gctgggtgcgaccccatc

SEQ ID NO: 1890755 - DNA, 23 bp, Homo sapiens
gctgggtgcgaccccatctgccc

SEQ ID NO: 1890756 - DNA, 13 bp, Homo sapiens
gctgggtggccca

SEQ ID NO: 1890757 - DNA, 22 bp, Homo sapiens
gctgggtggcccatcccccctc

SEQ ID NO: 1890758 - DNA, 17 bp, Homo sapiens
gctgggttggcgcaccc

SEQ ID NO: 1890759 - DNA, 23 bp, Homo sapiens
gctggtaatttgtatctgaagga

SEQ ID NO: 1890760 - DNA, 14 bp, Homo sapiens
gctgtccagtgccc

SEQ ID NO: 1890761 - DNA, 15 bp, Homo sapiens
gctgtcccctcttgc

SEQ ID NO: 1890762 - DNA, 15 bp, Homo sapiens
gctgtctcaggagta

SEQ ID NO: 1890763 - DNA, 12 bp, Homo sapiens
gctgtgccaccc

SEQ ID NO: 1890764 - DNA, 18 bp, Homo sapiens
gctgtgccaccctgggct

SEQ ID NO: 1890765 - DNA, 22 bp, Homo sapiens
gctgtgccaccctgggctctgt

SEQ ID NO: 1890766 - DNA, 21 bp, Homo sapiens
gctgtggggctaggggctggg

SEQ ID NO: 1890767 - DNA, 12 bp, Homo sapiens
gcttaatttaat

SEQ ID NO: 1890768 - DNA, 15 bp, Homo sapiens
gcttaatttaatgta

SEQ ID NO: 1890769 - DNA, 17 bp, Homo sapiens
gcttcagggctgggcag

SEQ ID NO: 1890770 - DNA, 16 bp, Homo sapiens
gcttccaaggtggtct

SEQ ID NO: 1890771 - DNA, 18 bp, Homo sapiens
gcttccaaggtggtctgc

SEQ ID NO: 1890772 - DNA, 18 bp, Homo sapiens
gcttctattaaatgtata

SEQ ID NO: 1890773 - DNA, 12 bp, Homo sapiens
gcttctgccact

SEQ ID NO: 1890774 - DNA, 20 bp, Homo sapiens
gcttctgcggtgaggcaggg

SEQ ID NO: 1890775 - DNA, 22 bp, Homo sapiens
gcttctgcggtgaggcagggga

SEQ ID NO: 1890776 - DNA, 16 bp, Homo sapiens
gcttctgctgggctgg

SEQ ID NO: 1890777 - DNA, 17 bp, Homo sapiens
gcttctgctgggctggg

SEQ ID NO: 1890778 - DNA, 13 bp, Homo sapiens
gcttgatctgtga

SEQ ID NO: 1890779 - DNA, 19 bp, Homo sapiens
gcttgatctgtgatttctt

SEQ ID NO: 1890780 - DNA, 21 bp, Homo sapiens
gcttgatctgtgatttcttct

SEQ ID NO: 1890781 - DNA, 18 bp, Homo sapiens
gcttgcctcggctcctgc

SEQ ID NO: 1890782 - DNA, 19 bp, Homo sapiens
gcttgcctcggctcctgct

SEQ ID NO: 1890783 - DNA, 15 bp, Homo sapiens
gcttgctgatggctg

SEQ ID NO: 1890784 - DNA, 23 bp, Homo sapiens
gcttgggcttctgcggtgaggca

SEQ ID NO: 1890785 - DNA, 19 bp, Homo sapiens
gcttggtgcggtaggtgct

SEQ ID NO: 1890786 - DNA, 16 bp, Homo sapiens
gctttccggggaggag

SEQ ID NO: 1890787 - DNA, 20 bp, Homo sapiens
gctttggaagctctgttgca

SEQ ID NO: 1890788 - DNA, 21 bp, Homo sapiens
gctttttccttttcatctgtt

SEQ ID NO: 1890789 - DNA, 14 bp, Homo sapiens
ggaaaagcctctgt

SEQ ID NO: 1890790 - DNA, 18 bp, Homo sapiens
ggaaaaggttttattttg

SEQ ID NO: 1890791 - DNA, 21 bp, Homo sapiens
ggaaattgggtgtgccctggc

SEQ ID NO: 1890792 - DNA, 22 bp, Homo sapiens
ggaaattgggtgtgccctggct

SEQ ID NO: 1890793 - DNA, 19 bp, Homo sapiens
ggaagagaggacccatcct

SEQ ID NO: 1890794 - DNA, 14 bp, Homo sapiens
ggaagagcacagcc

SEQ ID NO: 1890795 - DNA, 16 bp, Homo sapiens
ggaagagcacagccct

SEQ ID NO: 1890796 - DNA, 17 bp, Homo sapiens
ggaagagcacagccctc

SEQ ID NO: 1890797 - DNA, 23 bp, Homo sapiens
ggaagctgtagaggaccaggact

SEQ ID NO: 1890798 - DNA, 14 bp, Homo sapiens
ggaatcaaggagcc

SEQ ID NO: 1890799 - DNA, 16 bp, Homo sapiens
ggaatggactgggtgc

SEQ ID NO: 1890800 - DNA, 20 bp, Homo sapiens
ggacaacaaagaggacacca

SEQ ID NO: 1890801 - DNA, 17 bp, Homo sapiens
ggacagtcacctcatgg

SEQ ID NO: 1890802 - DNA, 19 bp, Homo sapiens
ggacatcgtctctgccact

SEQ ID NO: 1890803 - DNA, 17 bp, Homo sapiens
ggacatttgctcatgga

SEQ ID NO: 1890804 - DNA, 19 bp, Homo sapiens
ggaccaacccatgccctgc

SEQ ID NO: 1890805 - DNA, 20 bp, Homo sapiens
ggaccaacccatgccctgcc

SEQ ID NO: 1890806 - DNA, 19 bp, Homo sapiens
ggaccaagcttaaggagag

SEQ ID NO: 1890807 - DNA, 22 bp, Homo sapiens
ggaccaagcttaaggagaggag

SEQ ID NO: 1890808 - DNA, 20 bp, Homo sapiens
ggaccaggtgtctagaggca

SEQ ID NO: 1890809 - DNA, 16 bp, Homo sapiens
ggacccatcctgccac

SEQ ID NO: 1890810 - DNA, 21 bp, Homo sapiens
ggaccccgagcctggctccaa

SEQ ID NO: 1890811 - DNA, 13 bp, Homo sapiens
ggacctcaccaag

SEQ ID NO: 1890812 - DNA, 17 bp, Homo sapiens
ggacctgagtctgctat

SEQ ID NO: 1890813 - DNA, 19 bp, Homo sapiens
ggagagcatctgctctgag

SEQ ID NO: 1890814 - DNA, 19 bp, Homo sapiens
ggagagtacccccctgaga

SEQ ID NO: 1890815 - DNA, 17 bp, Homo sapiens
ggagatgagttgcagtt

SEQ ID NO: 1890816 - DNA, 15 bp, Homo sapiens
ggagcattctgcctg

SEQ ID NO: 1890817 - DNA, 23 bp, Homo sapiens
ggagcattctgcctgcctgggaa

SEQ ID NO: 1890818 - DNA, 16 bp, Homo sapiens
ggagccacctgggctg

SEQ ID NO: 1890819 - DNA, 23 bp, Homo sapiens
ggagccacctgggctgggagaag

SEQ ID NO: 1890820 - DNA, 21 bp, Homo sapiens
ggagccagtgtgaggctgtaa

SEQ ID NO: 1890821 - DNA, 19 bp, Homo sapiens
ggagcccctgtgtgggagg

SEQ ID NO: 1890822 - DNA, 11 bp, Homo sapiens
ggagcctggag

SEQ ID NO: 1890823 - DNA, 12 bp, Homo sapiens
ggagcctggagc

SEQ ID NO: 1890824 - DNA, 14 bp, Homo sapiens
ggagcctggagccc

SEQ ID NO: 1890825 - DNA, 17 bp, Homo sapiens
ggagcctggagcccctg

SEQ ID NO: 1890826 - DNA, 18 bp, Homo sapiens
ggagcctggagcccctgt

SEQ ID NO: 1890827 - DNA, 23 bp, Homo sapiens
ggagctccgatttaactgggaac

SEQ ID NO: 1890828 - DNA, 21 bp, Homo sapiens
ggagctgagctacctggggtg

SEQ ID NO: 1890829 - DNA, 15 bp, Homo sapiens
ggaggaggtgccaac

SEQ ID NO: 1890830 - DNA, 17 bp, Homo sapiens
ggaggaggtgccaacag

SEQ ID NO: 1890831 - DNA, 20 bp, Homo sapiens
ggaggcggaggttgcagtga

SEQ ID NO: 1890832 - DNA, 15 bp, Homo sapiens
ggaggctggctgggg

SEQ ID NO: 1890833 - DNA, 16 bp, Homo sapiens
ggaggtggcgccccct

SEQ ID NO: 1890834 - DNA, 22 bp, Homo sapiens
ggaggtggcgccccctggtggg

SEQ ID NO: 1890835 - DNA, 15 bp, Homo sapiens
ggagtctgcttgtct

SEQ ID NO: 1890836 - DNA, 23 bp, Homo sapiens
ggagtctgcttgtcttagatgtt

SEQ ID NO: 1890837 - DNA, 12 bp, Homo sapiens
ggagtgctggct

SEQ ID NO: 1890838 - DNA, 12 bp, Homo sapiens
ggatcattgcat

SEQ ID NO: 1890839 - DNA, 12 bp, Homo sapiens
ggatcctggagc

SEQ ID NO: 1890840 - DNA, 14 bp, Homo sapiens
ggatggaaggagag

SEQ ID NO: 1890841 - DNA, 22 bp, Homo sapiens
ggatggttcccttgatgaagaa

SEQ ID NO: 1890842 - DNA, 23 bp, Homo sapiens
ggatggttcccttgatgaagaag

SEQ ID NO: 1890843 - DNA, 12 bp, Homo sapiens
ggattctgggag

SEQ ID NO: 1890844 - DNA, 20 bp, Homo sapiens
ggattgatcggagcctcctc

SEQ ID NO: 1890845 - DNA, 17 bp, Homo sapiens
ggattgtacgtgggaga

SEQ ID NO: 1890846 - DNA, 18 bp, Homo sapiens
ggattgtacgtgggagag

SEQ ID NO: 1890847 - DNA, 20 bp, Homo sapiens
ggcaacagtgttctgagccc

SEQ ID NO: 1890848 - DNA, 17 bp, Homo sapiens
ggcaaggtgggggagcc

SEQ ID NO: 1890849 - DNA, 19 bp, Homo sapiens
ggcaaggtgggggagcctg

SEQ ID NO: 1890850 - DNA, 18 bp, Homo sapiens
ggcacagtgtctgggctg

SEQ ID NO: 1890851 - DNA, 14 bp, Homo sapiens
ggcactgctgggtg

SEQ ID NO: 1890852 - DNA, 16 bp, Homo sapiens
ggcactgctgggtggc

SEQ ID NO: 1890853 - DNA, 21 bp, Homo sapiens
ggcactgctgggtggcccatc

SEQ ID NO: 1890854 - DNA, 22 bp, Homo sapiens
ggcactgctgggtggcccatcc

SEQ ID NO: 1890855 - DNA, 23 bp, Homo sapiens
ggcagagtgagactcgtctcaaa

SEQ ID NO: 1890856 - DNA, 16 bp, Homo sapiens
ggcaggcacagcacag

SEQ ID NO: 1890857 - DNA, 13 bp, Homo sapiens
ggcaggccctgca

SEQ ID NO: 1890858 - DNA, 16 bp, Homo sapiens
ggcaggccctgcactg

SEQ ID NO: 1890859 - DNA, 19 bp, Homo sapiens
ggcaggccctgcactgtcc

SEQ ID NO: 1890860 - DNA, 22 bp, Homo sapiens
ggcaggccctgcactgtcctgc

SEQ ID NO: 1890861 - DNA, 12 bp, Homo sapiens
ggcagggaagct

SEQ ID NO: 1890862 - DNA, 14 bp, Homo sapiens
ggcatgggggaggc

SEQ ID NO: 1890863 - DNA, 20 bp, Homo sapiens
ggcatgggggaggctctgaa

SEQ ID NO: 1890864 - DNA, 18 bp, Homo sapiens
ggcattggcagcaggtgc

SEQ ID NO: 1890865 - DNA, 21 bp, Homo sapiens
ggcattggcagcaggtgctgc

SEQ ID NO: 1890866 - DNA, 15 bp, Homo sapiens
ggcatttatattcca

SEQ ID NO: 1890867 - DNA, 14 bp, Homo sapiens
ggccaaataaagtc

SEQ ID NO: 1890868 - DNA, 18 bp, Homo sapiens
ggccaccagctccactgg

SEQ ID NO: 1890869 - DNA, 14 bp, Homo sapiens
ggccagaggcagct

SEQ ID NO: 1890870 - DNA, 13 bp, Homo sapiens
ggccataccaggt

SEQ ID NO: 1890871 - DNA, 15 bp, Homo sapiens
ggccataccaggtgc

SEQ ID NO: 1890872 - DNA, 17 bp, Homo sapiens
ggccataccaggtgcta

SEQ ID NO: 1890873 - DNA, 20 bp, Homo sapiens
ggccataccaggtgctaggg

SEQ ID NO: 1890874 - DNA, 16 bp, Homo sapiens
ggccatactggcctcg

SEQ ID NO: 1890875 - DNA, 23 bp, Homo sapiens
ggccatactggcctcgcctggcc

SEQ ID NO: 1890876 - DNA, 17 bp, Homo sapiens
ggccatcttccaggtgg

SEQ ID NO: 1890877 - DNA, 16 bp, Homo sapiens
ggcccatcccccctca

SEQ ID NO: 1890878 - DNA, 11 bp, Homo sapiens
ggccccagcct

SEQ ID NO: 1890879 - DNA, 15 bp, Homo sapiens
ggccccagcctggcc

SEQ ID NO: 1890880 - DNA, 17 bp, Homo sapiens
ggccccagcctggccca

SEQ ID NO: 1890881 - DNA, 20 bp, Homo sapiens
ggccccagcctggcccagct

SEQ ID NO: 1890882 - DNA, 23 bp, Homo sapiens
ggccccagcctggcccagctccc

SEQ ID NO: 1890883 - DNA, 13 bp, Homo sapiens
ggcccgcttgcct

SEQ ID NO: 1890884 - DNA, 14 bp, Homo sapiens
ggcccgcttgcctc

SEQ ID NO: 1890885 - DNA, 19 bp, Homo sapiens
ggcccgttgtctccctggc

SEQ ID NO: 1890886 - DNA, 21 bp, Homo sapiens
ggcccgttgtctccctggccc

SEQ ID NO: 1890887 - DNA, 24 bp, Homo sapiens
ggcccgttgtctccctggccctca

SEQ ID NO: 1890888 - DNA, 20 bp, Homo sapiens
ggccctcaaggcctcccaca

SEQ ID NO: 1890889 - DNA, 17 bp, Homo sapiens
ggccctgcactgtcctg

SEQ ID NO: 1890890 - DNA, 23 bp, Homo sapiens
ggccctgcactgtcctgctccac

SEQ ID NO: 1890891 - DNA, 14 bp, Homo sapiens
ggccctgcaggagg

SEQ ID NO: 1890892 - DNA, 16 bp, Homo sapiens
ggccctgcaggaggcc

SEQ ID NO: 1890893 - DNA, 14 bp, Homo sapiens
ggcctcccacagtg

SEQ ID NO: 1890894 - DNA, 14 bp, Homo sapiens
ggcctcgcctggcc

SEQ ID NO: 1890895 - DNA, 21 bp, Homo sapiens
ggcctgaggtctcgctgatgc

SEQ ID NO: 1890896 - DNA, 14 bp, Homo sapiens
ggcctgatggagag

SEQ ID NO: 1890897 - DNA, 15 bp, Homo sapiens
ggcctgatggagagg

SEQ ID NO: 1890898 - DNA, 22 bp, Homo sapiens
ggcctgcccgttgccgggcctg

SEQ ID NO: 1890899 - DNA, 14 bp, Homo sapiens
ggcctgttctgtag

SEQ ID NO: 1890900 - DNA, 20 bp, Homo sapiens
ggcctgttctgtaggagaga

SEQ ID NO: 1890901 - DNA, 22 bp, Homo sapiens
ggcctgttctgtaggagagact

SEQ ID NO: 1890902 - DNA, 20 bp, Homo sapiens
ggcgaggcgggggagcctgg

SEQ ID NO: 1890903 - DNA, 18 bp, Homo sapiens
ggcgaggcgggggatcct

SEQ ID NO: 1890904 - DNA, 16 bp, Homo sapiens
ggcgcaccctcccctc

SEQ ID NO: 1890905 - DNA, 17 bp, Homo sapiens
ggcgcaccctcccctcc

SEQ ID NO: 1890906 - DNA, 18 bp, Homo sapiens
ggcgcaccctcccctccc

SEQ ID NO: 1890907 - DNA, 13 bp, Homo sapiens
ggcgcccctgggg

SEQ ID NO: 1890908 - DNA, 11 bp, Homo sapiens
ggcgccctctg

SEQ ID NO: 1890909 - DNA, 14 bp, Homo sapiens
ggcgccctctgtcc

SEQ ID NO: 1890910 - DNA, 15 bp, Homo sapiens
ggcgggcagcacagc

SEQ ID NO: 1890911 - DNA, 14 bp, Homo sapiens
ggcgggggagcctg

SEQ ID NO: 1890912 - DNA, 15 bp, Homo sapiens
ggcgggggagcctgg

SEQ ID NO: 1890913 - DNA, 15 bp, Homo sapiens
ggctaggggctgggg

SEQ ID NO: 1890914 - DNA, 18 bp, Homo sapiens
ggctcagggaccacagca

SEQ ID NO: 1890915 - DNA, 21 bp, Homo sapiens
ggctccacgccctggggagtg

SEQ ID NO: 1890916 - DNA, 17 bp, Homo sapiens
ggctcccaagggaggcc

SEQ ID NO: 1890917 - DNA, 17 bp, Homo sapiens
ggctcctgtgcccttat

SEQ ID NO: 1890918 - DNA, 14 bp, Homo sapiens
ggctctgtgggctg

SEQ ID NO: 1890919 - DNA, 15 bp, Homo sapiens
ggctctgtgggctgc

SEQ ID NO: 1890920 - DNA, 16 bp, Homo sapiens
ggctgcactctgtgcc

SEQ ID NO: 1890921 - DNA, 17 bp, Homo sapiens
ggctgcactctgtgccc

SEQ ID NO: 1890922 - DNA, 19 bp, Homo sapiens
ggctgcactctgtgcccat

SEQ ID NO: 1890923 - DNA, 18 bp, Homo sapiens
ggctgcccgctcccagtg

SEQ ID NO: 1890924 - DNA, 22 bp, Homo sapiens
ggctgcccgctcccagtgtctt

SEQ ID NO: 1890925 - DNA, 16 bp, Homo sapiens
ggctgcctccactccc

SEQ ID NO: 1890926 - DNA, 19 bp, Homo sapiens
ggctgcctccactcccact

SEQ ID NO: 1890927 - DNA, 14 bp, Homo sapiens
ggctggccagcccc

SEQ ID NO: 1890928 - DNA, 19 bp, Homo sapiens
ggctggccagccccacagc

SEQ ID NO: 1890929 - DNA, 10 bp, Homo sapiens
ggctgggtgc

SEQ ID NO: 1890930 - DNA, 20 bp, Homo sapiens
ggctgggttggcgcaccctc

SEQ ID NO: 1890931 - DNA, 15 bp, Homo sapiens
ggctgtccagtgccc

SEQ ID NO: 1890932 - DNA, 14 bp, Homo sapiens
ggctgttggctggg

SEQ ID NO: 1890933 - DNA, 15 bp, Homo sapiens
ggctgttggctgggg

SEQ ID NO: 1890934 - DNA, 19 bp, Homo sapiens
ggcttccaaggtggtctgc

SEQ ID NO: 1890935 - DNA, 20 bp, Homo sapiens
gggaagagcacagccctccc

SEQ ID NO: 1890936 - DNA, 22 bp, Homo sapiens
gggaagagcacagccctcccgc

SEQ ID NO: 1890937 - DNA, 20 bp, Homo sapiens
gggacagtcacctcatggaa

SEQ ID NO: 1890938 - DNA, 21 bp, Homo sapiens
gggacagtcacctcatggaat

SEQ ID NO: 1890939 - DNA, 19 bp, Homo sapiens
gggacatttgctcatggaa

SEQ ID NO: 1890940 - DNA, 20 bp, Homo sapiens
gggacatttgctcatggaat

SEQ ID NO: 1890941 - DNA, 21 bp, Homo sapiens
gggacatttgctcatggaatt

SEQ ID NO: 1890942 - DNA, 19 bp, Homo sapiens
gggaccacagcaaggcacc

SEQ ID NO: 1890943 - DNA, 13 bp, Homo sapiens
cccacagcgctgg

SEQ ID NO: 1890944 - DNA, 19 bp, Homo sapiens
cccacagcgctggccggga

SEQ ID NO: 1890945 - DNA, 23 bp, Homo sapiens
cccacagtgactcgggctcctgt

SEQ ID NO: 1890946 - DNA, 14 bp, Homo sapiens
cccaccagcccaca

SEQ ID NO: 1890947 - DNA, 22 bp, Homo sapiens
cccaccgcatgccccctcgtgc

SEQ ID NO: 1890948 - DNA, 16 bp, Homo sapiens
cccacctctgaggact

SEQ ID NO: 1890949 - DNA, 13 bp, Homo sapiens
cccacctgcctga

SEQ ID NO: 1890950 - DNA, 17 bp, Homo sapiens
cccacgtcctgtcagtg

SEQ ID NO: 1890951 - DNA, 17 bp, Homo sapiens
cccacttccctgacact

SEQ ID NO: 1890952 - DNA, 13 bp, Homo sapiens
cccagcctggccc

SEQ ID NO: 1890953 - DNA, 12 bp, Homo sapiens
cccagctgggct

SEQ ID NO: 1890954 - DNA, 23 bp, Homo sapiens
cccaggattgtacgtgggagagg

SEQ ID NO: 1890955 - DNA, 19 bp, Homo sapiens
cccaggccataccaggtgc

SEQ ID NO: 1890956 - DNA, 21 bp, Homo sapiens
cccaggccatcttccaggtgg

SEQ ID NO: 1890957 - DNA, 22 bp, Homo sapiens
cccaggccatcttccaggtggg

SEQ ID NO: 1890958 - DNA, 19 bp, Homo sapiens
cccaggctggccagcccca

SEQ ID NO: 1890959 - DNA, 19 bp, Homo sapiens
cccaggggtctccctgagc

SEQ ID NO: 1890960 - DNA, 23 bp, Homo sapiens
cccaggggtctccctgagcctgc

SEQ ID NO: 1890961 - DNA, 14 bp, Homo sapiens
cccaggtaagcagg

SEQ ID NO: 1890962 - DNA, 15 bp, Homo sapiens
cccagtgtcttcctg

SEQ ID NO: 1890963 - DNA, 16 bp, Homo sapiens
cccagtgtcttcctgt

SEQ ID NO: 1890964 - DNA, 12 bp, Homo sapiens
cccatcccccct

SEQ ID NO: 1890965 - DNA, 20 bp, Homo sapiens
cccatcccccctcaccaggg

SEQ ID NO: 1890966 - DNA, 16 bp, Homo sapiens
cccatcctggcccatc

SEQ ID NO: 1890967 - DNA, 15 bp, Homo sapiens
cacctctgggccctg

SEQ ID NO: 1890968 - DNA, 17 bp, Homo sapiens
cacctctgggccctgca

SEQ ID NO: 1890969 - DNA, 13 bp, Homo sapiens
cacctgaggcccc

SEQ ID NO: 1890970 - DNA, 16 bp, Homo sapiens
cacctgggctgggaga

SEQ ID NO: 1890971 - DNA, 22 bp, Homo sapiens
cacgaggtggtagctctgagcc

SEQ ID NO: 1890972 - DNA, 23 bp, Homo sapiens
cacgaggtggtagctctgagccc

SEQ ID NO: 1890973 - DNA, 12 bp, Homo sapiens
cacgccctgggg

SEQ ID NO: 1890974 - DNA, 13 bp, Homo sapiens
cacggccacagtc

SEQ ID NO: 1890975 - DNA, 13 bp, Homo sapiens
cactatagtgtaa

SEQ ID NO: 1890976 - DNA, 15 bp, Homo sapiens
cactcccacttccct

SEQ ID NO: 1890977 - DNA, 17 bp, Homo sapiens
cactcgggttaagaaat

SEQ ID NO: 1890978 - DNA, 19 bp, Homo sapiens
cactcgggttaagaaatac

SEQ ID NO: 1890979 - DNA, 23 bp, Homo sapiens
cactctcactatgctgctatgga

SEQ ID NO: 1890980 - DNA, 13 bp, Homo sapiens
cactctgtgccca

SEQ ID NO: 1890981 - DNA, 19 bp, Homo sapiens
cactgaaacgtattcagag

SEQ ID NO: 1890982 - DNA, 23 bp, Homo sapiens
cactgaagaagcaccaatcatga

SEQ ID NO: 1890983 - DNA, 14 bp, Homo sapiens
cactgcaccccctc

SEQ ID NO: 1890984 - DNA, 22 bp, Homo sapiens
cactgcaccccctcctgctgca

SEQ ID NO: 1890985 - DNA, 20 bp, Homo sapiens
cactgccttctcaactccaa

SEQ ID NO: 1890986 - DNA, 19 bp, Homo sapiens
cactgctgggtggcccatc

SEQ ID NO: 1890987 - DNA, 20 bp, Homo sapiens
cactgctgggtggcccatcc

SEQ ID NO: 1890988 - DNA, 11 bp, Homo sapiens
cactggcctgt

SEQ ID NO: 1890989 - DNA, 18 bp, Homo sapiens
cactggctgcctccactc

SEQ ID NO: 1890990 - DNA, 22 bp, Homo sapiens
cactggctgcctccactcccac

SEQ ID NO: 1890991 - DNA, 13 bp, Homo sapiens
cactgtcctgctc

SEQ ID NO: 1890992 - DNA, 20 bp, Homo sapiens
cactgtcctgctccacagtg

SEQ ID NO: 1890993 - DNA, 22 bp, Homo sapiens
cactgtgggtagacacacatga

SEQ ID NO: 1890994 - DNA, 24 bp, Homo sapiens
cactgtgggtagacacacatgaag

SEQ ID NO: 1890995 - DNA, 13 bp, Homo sapiens
cactgtgtgttga

SEQ ID NO: 1890996 - DNA, 12 bp, Homo sapiens
cacttcccctcc

SEQ ID NO: 1890997 - DNA, 15 bp, Homo sapiens
cacttcccctcctac

SEQ ID NO: 1890998 - DNA, 22 bp, Homo sapiens
cacttgcggatattctggactg

SEQ ID NO: 1890999 - DNA, 22 bp, Homo sapiens
cacttgtgttttgcaagccaga

SEQ ID NO: 1891000 - DNA, 21 bp, Homo sapiens
cagaaaaccctggtaagtaat

SEQ ID NO: 1891001 - DNA, 14 bp, Homo sapiens
cagaagcagctctt

SEQ ID NO: 1891002 - DNA, 14 bp, Homo sapiens
cagacgccacagtc

SEQ ID NO: 1891003 - DNA, 18 bp, Homo sapiens
cagactatttaacttgag

SEQ ID NO: 1891004 - DNA, 18 bp, Homo sapiens
cagagagcacctggtggg

SEQ ID NO: 1891005 - DNA, 15 bp, Homo sapiens
cagagcctctcccac

SEQ ID NO: 1891006 - DNA, 16 bp, Homo sapiens
cagaggagccacctgg

SEQ ID NO: 1891007 - DNA, 23 bp, Homo sapiens
cagaggagccacctgggctggga

SEQ ID NO: 1891008 - DNA, 19 bp, Homo sapiens
cagaggggcaggccctgca

SEQ ID NO: 1891009 - DNA, 21 bp, Homo sapiens
cagagtgtggtccctccacta

SEQ ID NO: 1891010 - DNA, 12 bp, Homo sapiens
cagatcctggaa

SEQ ID NO: 1891011 - DNA, 13 bp, Homo sapiens
cagatcgttcatt

SEQ ID NO: 1891012 - DNA, 22 bp, Homo sapiens
cagatgtgttcctccattttct

SEQ ID NO: 1891013 - DNA, 21 bp, Homo sapiens
cagcaaggaggctggctgggg

SEQ ID NO: 1891014 - DNA, 22 bp, Homo sapiens
cagcaaggaggctggctggggc

SEQ ID NO: 1891015 - DNA, 16 bp, Homo sapiens
cagcaaggcacctgca

SEQ ID NO: 1891016 - DNA, 17 bp, Homo sapiens
cagcaggtgctgctacc

SEQ ID NO: 1891017 - DNA, 19 bp, Homo sapiens
cagcaggtgctgctaccct

SEQ ID NO: 1891018 - DNA, 21 bp, Homo sapiens
cagccacgaggtggtagctct

SEQ ID NO: 1891019 - DNA, 15 bp, Homo sapiens
cagcccacgtcctgt

SEQ ID NO: 1891020 - DNA, 18 bp, Homo sapiens
cagcccacgtcctgtcag

SEQ ID NO: 1891021 - DNA, 19 bp, Homo sapiens
cagcccacgtcctgtcagt

SEQ ID NO: 1891022 - DNA, 11 bp, Homo sapiens
cagcccaggat

SEQ ID NO: 1891023 - DNA, 20 bp, Homo sapiens
cagccccacagcccacgtcc

SEQ ID NO: 1891024 - DNA, 11 bp, Homo sapiens
cagcctggccc

SEQ ID NO: 1891025 - DNA, 12 bp, Homo sapiens
cagcctggccca

SEQ ID NO: 1891026 - DNA, 14 bp, Homo sapiens
cagcctggcccagc

SEQ ID NO: 1891027 - DNA, 18 bp, Homo sapiens
cagcctggcccagctccc

SEQ ID NO: 1891028 - DNA, 20 bp, Homo sapiens
cagcctggcccagctccccc

SEQ ID NO: 1891029 - DNA, 21 bp, Homo sapiens
cagctgacagtcctctccacc

SEQ ID NO: 1891030 - DNA, 20 bp, Homo sapiens
cagctgggctgttggctggg

SEQ ID NO: 1891031 - DNA, 23 bp, Homo sapiens
cagctgggctgttggctgggggc

SEQ ID NO: 1891032 - DNA, 19 bp, Homo sapiens
cagctgtatgattcccagc

SEQ ID NO: 1891033 - DNA, 18 bp, Homo sapiens
cagctgtgaacatggact

SEQ ID NO: 1891034 - DNA, 18 bp, Homo sapiens
cagcttctgccacttccc

SEQ ID NO: 1891035 - DNA, 20 bp, Homo sapiens
cagcttctgccacttcccag

SEQ ID NO: 1891036 - DNA, 17 bp, Homo sapiens
cagcttctgctgggctg

SEQ ID NO: 1891037 - DNA, 22 bp, Homo sapiens
cagcttgcagtccgttgctgaa

SEQ ID NO: 1891038 - DNA, 16 bp, Homo sapiens
caggaaagagaacttc

SEQ ID NO: 1891039 - DNA, 18 bp, Homo sapiens
caggaaccacaagactgc

SEQ ID NO: 1891040 - DNA, 18 bp, Homo sapiens
caggaatcaaggagcctc

SEQ ID NO: 1891041 - DNA, 23 bp, Homo sapiens
caggacagcccttctttccacag

SEQ ID NO: 1891042 - DNA, 20 bp, Homo sapiens
caggaccaagcttaaggaga

SEQ ID NO: 1891043 - DNA, 21 bp, Homo sapiens
caggaccaagcttaaggagag

SEQ ID NO: 1891044 - DNA, 19 bp, Homo sapiens
caggacggggccggccagg

SEQ ID NO: 1891045 - DNA, 23 bp, Homo sapiens
caggacggggccggccaggtggg

SEQ ID NO: 1891046 - DNA, 24 bp, Homo sapiens
caggacggggccggccaggtgggc

SEQ ID NO: 1891047 - DNA, 15 bp, Homo sapiens
caggaggaggtgcca

SEQ ID NO: 1891048 - DNA, 20 bp, Homo sapiens
caggaggcggaggttgcagt

SEQ ID NO: 1891049 - DNA, 20 bp, Homo sapiens
caggattgtacgtgggagag

SEQ ID NO: 1891050 - DNA, 12 bp, Homo sapiens
caggcagaggag

SEQ ID NO: 1891051 - DNA, 15 bp, Homo sapiens
caggcagaggagagt

SEQ ID NO: 1891052 - DNA, 15 bp, Homo sapiens
caggccataccaggt

SEQ ID NO: 1891053 - DNA, 16 bp, Homo sapiens
caggccatcttccagg

SEQ ID NO: 1891054 - DNA, 13 bp, Homo sapiens
caggccccaggtc

SEQ ID NO: 1891055 - DNA, 14 bp, Homo sapiens
caggccctgcactg

SEQ ID NO: 1891056 - DNA, 17 bp, Homo sapiens
caggccctgcactgtcc

SEQ ID NO: 1891057 - DNA, 18 bp, Homo sapiens
caggccctgcactgtcct

SEQ ID NO: 1891058 - DNA, 20 bp, Homo sapiens
caggccctgcactgtcctgc

SEQ ID NO: 1891059 - DNA, 22 bp, Homo sapiens
caggccctgcactgtcctgctc

SEQ ID NO: 1891060 - DNA, 19 bp, Homo sapiens
caggctagatgtatgtact

SEQ ID NO: 1891061 - DNA, 19 bp, Homo sapiens
caggctccagttgaacact

SEQ ID NO: 1891062 - DNA, 13 bp, Homo sapiens
caggctgcagcag

SEQ ID NO: 1891063 - DNA, 23 bp, Homo sapiens
caggctgcagcaggcagaggaga

SEQ ID NO: 1891064 - DNA, 14 bp, Homo sapiens
caggctggccagcc

SEQ ID NO: 1891065 - DNA, 17 bp, Homo sapiens
caggctggccagcccca

SEQ ID NO: 1891066 - DNA, 19 bp, Homo sapiens
caggctggccagccccaca

SEQ ID NO: 1891067 - DNA, 21 bp, Homo sapiens
caggctggccagccccacagc

SEQ ID NO: 1891068 - DNA, 14 bp, Homo sapiens
cagggaagctttca

SEQ ID NO: 1891069 - DNA, 14 bp, Homo sapiens
cagggaccacagca

SEQ ID NO: 1891070 - DNA, 17 bp, Homo sapiens
cagggaccacagcaagg

SEQ ID NO: 1891071 - DNA, 22 bp, Homo sapiens
cagggatcctctctccaggccc

SEQ ID NO: 1891072 - DNA, 13 bp, Homo sapiens
cagggatttgagg

SEQ ID NO: 1891073 - DNA, 22 bp, Homo sapiens
cagggcctggggagatggagga

SEQ ID NO: 1891074 - DNA, 19 bp, Homo sapiens
ccgcctcgcccaccgcatg

SEQ ID NO: 1891075 - DNA, 19 bp, Homo sapiens
ccgctgcccggcgccctct

SEQ ID NO: 1891076 - DNA, 20 bp, Homo sapiens
ccgctgcccggcgccctctg

SEQ ID NO: 1891077 - DNA, 22 bp, Homo sapiens
ccgctggccgagctgaagaact

SEQ ID NO: 1891078 - DNA, 17 bp, Homo sapiens
ccgctgtcccaggggtc

SEQ ID NO: 1891079 - DNA, 18 bp, Homo sapiens
ccgcttgcctcggctcct

SEQ ID NO: 1891080 - DNA, 22 bp, Homo sapiens
ccggaatagatgtcttcatcac

SEQ ID NO: 1891081 - DNA, 15 bp, Homo sapiens
ccggcgccctctgtc

SEQ ID NO: 1891082 - DNA, 21 bp, Homo sapiens
ccggcgccctctgtcctgact

SEQ ID NO: 1891083 - DNA, 20 bp, Homo sapiens
ccgggctcagggaccacagc

SEQ ID NO: 1891084 - DNA, 13 bp, Homo sapiens
ccggggaggagcc

SEQ ID NO: 1891085 - DNA, 15 bp, Homo sapiens
ccggtcagtgccttt

SEQ ID NO: 1891086 - DNA, 19 bp, Homo sapiens
ccgtggccccagcctggcc

SEQ ID NO: 1891087 - DNA, 21 bp, Homo sapiens
ccgtggccccagcctggccca

SEQ ID NO: 1891088 - DNA, 13 bp, Homo sapiens
ccgttcccacctc

SEQ ID NO: 1891089 - DNA, 14 bp, Homo sapiens
ccgttcccttctgc

SEQ ID NO: 1891090 - DNA, 15 bp, Homo sapiens
ccgttgccgggcctg

SEQ ID NO: 1891091 - DNA, 18 bp, Homo sapiens
ccgttgccgggcctggac

SEQ ID NO: 1891092 - DNA, 14 bp, Homo sapiens
ccgttgtctccctg

SEQ ID NO: 1891093 - DNA, 15 bp, Homo sapiens
cctacacctctgggc

SEQ ID NO: 1891094 - DNA, 20 bp, Homo sapiens
cctatcagtgtgccccccat

SEQ ID NO: 1891095 - DNA, 16 bp, Homo sapiens
cctcaaggcctcccac

SEQ ID NO: 1891096 - DNA, 17 bp, Homo sapiens
cctcaaggcctcccaca

SEQ ID NO: 1891097 - DNA, 18 bp, Homo sapiens
cctcaaggcctcccacag

SEQ ID NO: 1891098 - DNA, 16 bp, Homo sapiens
cctcaatacccctagt

SEQ ID NO: 1891099 - DNA, 15 bp, Homo sapiens
cctcacatgcccgct

SEQ ID NO: 1891100 - DNA, 14 bp, Homo sapiens
cctcacttttcaat

SEQ ID NO: 1891101 - DNA, 13 bp, Homo sapiens
cctccactcccac

SEQ ID NO: 1891102 - DNA, 15 bp, Homo sapiens
cctccactcccactt

SEQ ID NO: 1891103 - DNA, 19 bp, Homo sapiens
cctccatgactgcacagta

SEQ ID NO: 1891104 - DNA, 13 bp, Homo sapiens
cctcccacagtga

SEQ ID NO: 1891105 - DNA, 12 bp, Homo sapiens
ccttcttgccct

SEQ ID NO: 1891106 - DNA, 17 bp, Homo sapiens
ccttgagggcaagagcc

SEQ ID NO: 1891107 - DNA, 11 bp, Homo sapiens
ccttgccctgg

SEQ ID NO: 1891108 - DNA, 14 bp, Homo sapiens
ccttgccctgggcc

SEQ ID NO: 1891109 - DNA, 11 bp, Homo sapiens
ccttgctgtca

SEQ ID NO: 1891110 - DNA, 15 bp, Homo sapiens
cctttcagctgtgaa

SEQ ID NO: 1891111 - DNA, 16 bp, Homo sapiens
ccttttcatctgttgt

SEQ ID NO: 1891112 - DNA, 17 bp, Homo sapiens
ccttttcatctgttgtt

SEQ ID NO: 1891113 - DNA, 21 bp, Homo sapiens
ccttttcccggggaggagaga

SEQ ID NO: 1891114 - DNA, 23 bp, Homo sapiens
cgaaggaaaagggctttctcaat

SEQ ID NO: 1891115 - DNA, 14 bp, Homo sapiens
cgaccccatctgcc

SEQ ID NO: 1891116 - DNA, 16 bp, Homo sapiens
cgaccccatctgccca

SEQ ID NO: 1891117 - DNA, 20 bp, Homo sapiens
cgacttgaattttcccactg

SEQ ID NO: 1891118 - DNA, 19 bp, Homo sapiens
cgagcaaagtctaaagttt

SEQ ID NO: 1891119 - DNA, 20 bp, Homo sapiens
cgagcaaagtctaaagttta

SEQ ID NO: 1891120 - DNA, 17 bp, Homo sapiens
cgagctgaagaactggg

SEQ ID NO: 1891121 - DNA, 17 bp, Homo sapiens
cgaggcgggggagcctg

SEQ ID NO: 1891122 - DNA, 21 bp, Homo sapiens
cgaggcgggggagcctggagc

SEQ ID NO: 1891123 - DNA, 15 bp, Homo sapiens
cgaggcgggggatcc

SEQ ID NO: 1891124 - DNA, 20 bp, Homo sapiens
cgaggcgggggatcctggag

SEQ ID NO: 1891125 - DNA, 22 bp, Homo sapiens
cgaggcgggggatcctggagcc

SEQ ID NO: 1891126 - DNA, 16 bp, Homo sapiens
cgagggaggggaggtg

SEQ ID NO: 1891127 - DNA, 13 bp, Homo sapiens
cgagggatgatgc

SEQ ID NO: 1891128 - DNA, 16 bp, Homo sapiens
cgaggtggtagctctg

SEQ ID NO: 1891129 - DNA, 18 bp, Homo sapiens
cgaggtggtagctctgag

SEQ ID NO: 1891130 - DNA, 21 bp, Homo sapiens
cgaggtggtagctctgagccc

SEQ ID NO: 1891131 - DNA, 16 bp, Homo sapiens
cgcatgccccctcgtg

SEQ ID NO: 1891132 - DNA, 21 bp, Homo sapiens
cgcatgccccctcgtgccagt

SEQ ID NO: 1891133 - DNA, 22 bp, Homo sapiens
cgcatgccccctcgtgccagtc

SEQ ID NO: 1891134 - DNA, 13 bp, Homo sapiens
cgcccaccgcatg

SEQ ID NO: 1891135 - DNA, 18 bp, Homo sapiens
cgcccaccgcatgccccc

SEQ ID NO: 1891136 - DNA, 14 bp, Homo sapiens
cgccccctggtggg

SEQ ID NO: 1891137 - DNA, 19 bp, Homo sapiens
cgcccctcccacagcgctg

SEQ ID NO: 1891138 - DNA, 14 bp, Homo sapiens
cgccctctgtcctg

SEQ ID NO: 1891139 - DNA, 17 bp, Homo sapiens
cgccctctgtcctgact

SEQ ID NO: 1891140 - DNA, 13 bp, Homo sapiens
cgccgcctcgccc

SEQ ID NO: 1891141 - DNA, 16 bp, Homo sapiens
cgccgcctcgcccacc

SEQ ID NO: 1891142 - DNA, 13 bp, Homo sapiens
cgcctcgcccacc

SEQ ID NO: 1891143 - DNA, 22 bp, Homo sapiens
cgcctcgcccaccgcatgcccc

SEQ ID NO: 1891144 - DNA, 17 bp, Homo sapiens
cgccttccgctcccacc

SEQ ID NO: 1891145 - DNA, 23 bp, Homo sapiens
cgcgccttctcccccccggggct

SEQ ID NO: 1891146 - DNA, 20 bp, Homo sapiens
cgcggtggctcttgcctgta

SEQ ID NO: 1891147 - DNA, 20 bp, Homo sapiens
cgctgcccggcgccctctgt

SEQ ID NO: 1891148 - DNA, 18 bp, Homo sapiens
cgctggccgggaccccga

SEQ ID NO: 1891149 - DNA, 15 bp, Homo sapiens
cgcttgcctcggctc

SEQ ID NO: 1891150 - DNA, 18 bp, Homo sapiens
cgcttgcctcggctcctg

SEQ ID NO: 1891151 - DNA, 22 bp, Homo sapiens
cgcttgcctcggctcctgctgc

SEQ ID NO: 1891152 - DNA, 14 bp, Homo sapiens
atttgtattttaaa

SEQ ID NO: 1891153 - DNA, 16 bp, Homo sapiens
attttaaaagaatgat

SEQ ID NO: 1891154 - DNA, 18 bp, Homo sapiens
attttaaaagaatgatta

SEQ ID NO: 1891155 - DNA, 17 bp, Homo sapiens
attttaagccttcattt

SEQ ID NO: 1891156 - DNA, 20 bp, Homo sapiens
attttaagccttcatttgca

SEQ ID NO: 1891157 - DNA, 18 bp, Homo sapiens
attttagcttcagttgtt

SEQ ID NO: 1891158 - DNA, 17 bp, Homo sapiens
attttaggcagggattt

SEQ ID NO: 1891159 - DNA, 19 bp, Homo sapiens
attttcatgacttttccat

SEQ ID NO: 1891160 - DNA, 17 bp, Homo sapiens
attttcccactgcaccc

SEQ ID NO: 1891161 - DNA, 13 bp, Homo sapiens
attttcctgaaaa

SEQ ID NO: 1891162 - DNA, 22 bp, Homo sapiens
attttcttcacagtgcagcttg

SEQ ID NO: 1891163 - DNA, 14 bp, Homo sapiens
attttctttcaaaa

SEQ ID NO: 1891164 - DNA, 21 bp, Homo sapiens
attttgagtatctcggacctt

SEQ ID NO: 1891165 - DNA, 22 bp, Homo sapiens
attttgtaattattgtgatttc

SEQ ID NO: 1891166 - DNA, 15 bp, Homo sapiens
attttgtttaaatta

SEQ ID NO: 1891167 - DNA, 20 bp, Homo sapiens
atttttaaaaaagtgatctt

SEQ ID NO: 1891168 - DNA, 16 bp, Homo sapiens
atttttacattctgaa

SEQ ID NO: 1891169 - DNA, 17 bp, Homo sapiens
atttttacattctgaat

SEQ ID NO: 1891170 - DNA, 18 bp, Homo sapiens
atttttatccatttcttt

SEQ ID NO: 1891171 - DNA, 15 bp, Homo sapiens
atttttattatttgt

SEQ ID NO: 1891172 - DNA, 19 bp, Homo sapiens
atttttccagagctgcaga

SEQ ID NO: 1891173 - DNA, 13 bp, Homo sapiens
atttttttaagct

SEQ ID NO: 1891174 - DNA, 15 bp, Homo sapiens
attttttttgtagct

SEQ ID NO: 1891175 - DNA, 21 bp, Homo sapiens
caaaattttttctctaggaaa

SEQ ID NO: 1891176 - DNA, 22 bp, Homo sapiens
caaacctcagtcatattcttat

SEQ ID NO: 1891177 - DNA, 13 bp, Homo sapiens
caaagaaataaaa

SEQ ID NO: 1891178 - DNA, 13 bp, Homo sapiens
caaagaggacacc

SEQ ID NO: 1891179 - DNA, 14 bp, Homo sapiens
caaagcaataatag

SEQ ID NO: 1891180 - DNA, 20 bp, Homo sapiens
caaagtacagaaaaatactt

SEQ ID NO: 1891181 - DNA, 17 bp, Homo sapiens
caaagtctaaagtttac

SEQ ID NO: 1891182 - DNA, 13 bp, Homo sapiens
caaataaacagtt

SEQ ID NO: 1891183 - DNA, 14 bp, Homo sapiens
caaataaagtctct

SEQ ID NO: 1891184 - DNA, 15 bp, Homo sapiens
caaataaagtctctt

SEQ ID NO: 1891185 - DNA, 13 bp, Homo sapiens
caaatgtattgat

SEQ ID NO: 1891186 - DNA, 15 bp, Homo sapiens
caaattgtgtgaaag

SEQ ID NO: 1891187 - DNA, 16 bp, Homo sapiens
caacagtgttctgagc

SEQ ID NO: 1891188 - DNA, 21 bp, Homo sapiens
caaccagaccattgtctcaga

SEQ ID NO: 1891189 - DNA, 19 bp, Homo sapiens
caaccagggccccggggcc

SEQ ID NO: 1891190 - DNA, 11 bp, Homo sapiens
caacccagccg

SEQ ID NO: 1891191 - DNA, 14 bp, Homo sapiens
caacccagccgctg

SEQ ID NO: 1891192 - DNA, 16 bp, Homo sapiens
caacccagccgctgcc

SEQ ID NO: 1891193 - DNA, 14 bp, Homo sapiens
caacccatgccctg

SEQ ID NO: 1891194 - DNA, 16 bp, Homo sapiens
caacccatgccctgcc

SEQ ID NO: 1891195 - DNA, 21 bp, Homo sapiens
caacccctcccctccatccct

SEQ ID NO: 1891196 - DNA, 19 bp, Homo sapiens
caactatctcatttccaag

SEQ ID NO: 1891197 - DNA, 21 bp, Homo sapiens
caactatctcatttccaagca

SEQ ID NO: 1891198 - DNA, 12 bp, Homo sapiens
caactccagaaa

SEQ ID NO: 1891199 - DNA, 22 bp, Homo sapiens
caactcgggagcattctgcctg

SEQ ID NO: 1891200 - DNA, 23 bp, Homo sapiens
caactcgggagcattctgcctgc

SEQ ID NO: 1891201 - DNA, 15 bp, Homo sapiens
caagcctggagcccc

SEQ ID NO: 1891202 - DNA, 14 bp, Homo sapiens
caagctgtgccacc

SEQ ID NO: 1891203 - DNA, 16 bp, Homo sapiens
caagctgtgccaccct

SEQ ID NO: 1891204 - DNA, 15 bp, Homo sapiens
caagcttaaggagag

SEQ ID NO: 1891205 - DNA, 23 bp, Homo sapiens
caaggagcctccgttcccacctc

SEQ ID NO: 1891206 - DNA, 22 bp, Homo sapiens
caaggaggctggctggggccta

SEQ ID NO: 1891207 - DNA, 15 bp, Homo sapiens
caaggcctcccacag

SEQ ID NO: 1891208 - DNA, 16 bp, Homo sapiens
caaggcctcccacagt

SEQ ID NO: 1891209 - DNA, 10 bp, Homo sapiens
caagggaggc

SEQ ID NO: 1891210 - DNA, 23 bp, Homo sapiens
caaggtcaatgacacccctggcc

SEQ ID NO: 1891211 - DNA, 15 bp, Homo sapiens
caaggtgggggagcc

SEQ ID NO: 1891212 - DNA, 19 bp, Homo sapiens
caaggtgggggagcctgga

SEQ ID NO: 1891213 - DNA, 20 bp, Homo sapiens
caaggtgggggagcctggag

SEQ ID NO: 1891214 - DNA, 21 bp, Homo sapiens
caaggtgggggagcctggagc

SEQ ID NO: 1891215 - DNA, 20 bp, Homo sapiens
caagtattaggggtaatata

SEQ ID NO: 1891216 - DNA, 23 bp, Homo sapiens
caagtattaggggtaatatattg

SEQ ID NO: 1891217 - DNA, 19 bp, Homo sapiens
caagtgcaggcgactggag

SEQ ID NO: 1891218 - DNA, 19 bp, Homo sapiens
caataaaaacattttgaag

SEQ ID NO: 1891219 - DNA, 20 bp, Homo sapiens
caataaaaacattttgaagt

SEQ ID NO: 1891220 - DNA, 20 bp, Homo sapiens
caataaaatccatacatttg

SEQ ID NO: 1891221 - DNA, 19 bp, Homo sapiens
caatagtcaaattgtgtga

SEQ ID NO: 1891222 - DNA, 12 bp, Homo sapiens
caatatttcaga

SEQ ID NO: 1891223 - DNA, 20 bp, Homo sapiens
caatatttcagataatcaca

SEQ ID NO: 1891224 - DNA, 16 bp, Homo sapiens
caatcttaagagcttg

SEQ ID NO: 1891225 - DNA, 18 bp, Homo sapiens
caatgacacccctggcct

SEQ ID NO: 1891226 - DNA, 23 bp, Homo sapiens
caatgacacccctggcctgactc

SEQ ID NO: 1891227 - DNA, 14 bp, Homo sapiens
caatgctgtatttt

SEQ ID NO: 1891228 - DNA, 16 bp, Homo sapiens
caatgctgtattttaa

SEQ ID NO: 1891229 - DNA, 23 bp, Homo sapiens
caatgctgtattttaaaagaatg

SEQ ID NO: 1891230 - DNA, 13 bp, Homo sapiens
caatgttcatcat

SEQ ID NO: 1891231 - DNA, 20 bp, Homo sapiens
caatttctacaaaatcctga

SEQ ID NO: 1891232 - DNA, 15 bp, Homo sapiens
cacaaattatcttaa

SEQ ID NO: 1891233 - DNA, 22 bp, Homo sapiens
cacaatgcagtgcctttcttct

SEQ ID NO: 1891234 - DNA, 18 bp, Homo sapiens
cacacaatgtgtctgaga

SEQ ID NO: 1891235 - DNA, 18 bp, Homo sapiens
cacaccaagctgtgccac

SEQ ID NO: 1891236 - DNA, 22 bp, Homo sapiens
cacaccagttgaactgcaggaa

SEQ ID NO: 1891237 - DNA, 18 bp, Homo sapiens
cacagcaaggaggctggc

SEQ ID NO: 1891238 - DNA, 21 bp, Homo sapiens
cacagcaaggaggctggctgg

SEQ ID NO: 1891239 - DNA, 22 bp, Homo sapiens
cacagcaaggaggctggctggg

SEQ ID NO: 1891240 - DNA, 19 bp, Homo sapiens
cacagcaaggcacctgcag

SEQ ID NO: 1891241 - DNA, 14 bp, Homo sapiens
cacagcccacgtcc

SEQ ID NO: 1891242 - DNA, 12 bp, Homo sapiens
cacagccctccc

SEQ ID NO: 1891243 - DNA, 15 bp, Homo sapiens
cacagccctcccgcc

SEQ ID NO: 1891244 - DNA, 17 bp, Homo sapiens
cacagccctcccgcccc

SEQ ID NO: 1891245 - DNA, 21 bp, Homo sapiens
cacagcctcttagatgcagtt

SEQ ID NO: 1891246 - DNA, 15 bp, Homo sapiens
cacagggatccgact

SEQ ID NO: 1891247 - DNA, 17 bp, Homo sapiens
cacagtctccccagata

SEQ ID NO: 1891248 - DNA, 21 bp, Homo sapiens
cacagtgactcgggctcctgt

SEQ ID NO: 1891249 - DNA, 13 bp, Homo sapiens
cacagtggccacg

SEQ ID NO: 1891250 - DNA, 21 bp, Homo sapiens
cacatgtcagcaagtcctaag

SEQ ID NO: 1891251 - DNA, 17 bp, Homo sapiens
caccaacccagccgctg

SEQ ID NO: 1891252 - DNA, 22 bp, Homo sapiens
caccaagctgtgccaccctggg

SEQ ID NO: 1891253 - DNA, 23 bp, Homo sapiens
caccaagctgtgccaccctgggc

SEQ ID NO: 1891254 - DNA, 13 bp, Homo sapiens
caccaggggcagg

SEQ ID NO: 1891255 - DNA, 18 bp, Homo sapiens
caccaggggcaggcacag

SEQ ID NO: 1891256 - DNA, 22 bp, Homo sapiens
cacccaccagttgaatttcatc

SEQ ID NO: 1891257 - DNA, 17 bp, Homo sapiens
caccccctcctgctgca

SEQ ID NO: 1891258 - DNA, 18 bp, Homo sapiens
cacccctggcctgactcc

SEQ ID NO: 1891259 - DNA, 16 bp, Homo sapiens
cacccgccttttataa

SEQ ID NO: 1891260 - DNA, 22 bp, Homo sapiens
caccctgcctctacccaaccag

SEQ ID NO: 1891261 - DNA, 17 bp, Homo sapiens
caccctgggctctgtgg

SEQ ID NO: 1891262 - DNA, 15 bp, Homo sapiens
caccgcatgccccct

SEQ ID NO: 1891263 - DNA, 19 bp, Homo sapiens
caccgcatgccccctcgtg

SEQ ID NO: 1891264 - DNA, 16 bp, Homo sapiens
caccggtcagtgcctt

SEQ ID NO: 1891265 - DNA, 19 bp, Homo sapiens
cacctagtggctgtccagt

SEQ ID NO: 1891266 - DNA, 21 bp, Homo sapiens
cacctagtggctgtccagtgc

SEQ ID NO: 1891267 - DNA, 20 bp, Homo sapiens
cacctcaagtgcaaggacca

SEQ ID NO: 1891268 - DNA, 11 bp, Homo sapiens
cacctcatgga

SEQ ID NO: 1891269 - DNA, 12 bp, Homo sapiens
atgctgggctgg

SEQ ID NO: 1891270 - DNA, 15 bp, Homo sapiens
atgctgggctgggtg

SEQ ID NO: 1891271 - DNA, 14 bp, Homo sapiens
atgctgtattttaa

SEQ ID NO: 1891272 - DNA, 22 bp, Homo sapiens
atgctgtctacactaagagaga

SEQ ID NO: 1891273 - DNA, 12 bp, Homo sapiens
atggaaggagag

SEQ ID NO: 1891274 - DNA, 17 bp, Homo sapiens
atggaatttgtaagttt

SEQ ID NO: 1891275 - DNA, 17 bp, Homo sapiens
atggactcttcccccac

SEQ ID NO: 1891276 - DNA, 17 bp, Homo sapiens
atggagaaacaggccca

SEQ ID NO: 1891277 - DNA, 18 bp, Homo sapiens
atggagaaacaggcccag

SEQ ID NO: 1891278 - DNA, 14 bp, Homo sapiens
atggagaggagaac

SEQ ID NO: 1891279 - DNA, 21 bp, Homo sapiens
atggagccagctctgcattat

SEQ ID NO: 1891280 - DNA, 22 bp, Homo sapiens
atggctgctggaggggacgctg

SEQ ID NO: 1891281 - DNA, 20 bp, Homo sapiens
atgggacatttgctcatgga

SEQ ID NO: 1891282 - DNA, 17 bp, Homo sapiens
atgggatgtatttttct

SEQ ID NO: 1891283 - DNA, 14 bp, Homo sapiens
atgggcactgctgg

SEQ ID NO: 1891284 - DNA, 13 bp, Homo sapiens
atgggggaggctc

SEQ ID NO: 1891285 - DNA, 15 bp, Homo sapiens
atgggggaggctctg

SEQ ID NO: 1891286 - DNA, 12 bp, Homo sapiens
atggttgtgaaa

SEQ ID NO: 1891287 - DNA, 17 bp, Homo sapiens
atgtaagctgaaaatat

SEQ ID NO: 1891288 - DNA, 15 bp, Homo sapiens
atgtattaatctgtt

SEQ ID NO: 1891289 - DNA, 21 bp, Homo sapiens
atgtatttttcttgctgttca

SEQ ID NO: 1891290 - DNA, 16 bp, Homo sapiens
atgtcaatcagcctag

SEQ ID NO: 1891291 - DNA, 21 bp, Homo sapiens
atgtcaatcagcctagttgat

SEQ ID NO: 1891292 - DNA, 18 bp, Homo sapiens
atgtcaccggtcagtgcc

SEQ ID NO: 1891293 - DNA, 24 bp, Homo sapiens
atgtcttcatcacttcttccactg

SEQ ID NO: 1891294 - DNA, 19 bp, Homo sapiens
atgtgctagtaattggaaa

SEQ ID NO: 1891295 - DNA, 21 bp, Homo sapiens
atgtgctagtaattggaaagg

SEQ ID NO: 1891296 - DNA, 23 bp, Homo sapiens
atgtgggggaaggccttgctgtc

SEQ ID NO: 1891297 - DNA, 12 bp, Homo sapiens
atgtgttcctcc

SEQ ID NO: 1891298 - DNA, 17 bp, Homo sapiens
atgttaagctttattgt

SEQ ID NO: 1891299 - DNA, 23 bp, Homo sapiens
atgttactaaatggtgttacatt

SEQ ID NO: 1891300 - DNA, 23 bp, Homo sapiens
atgttattattactctacactga

SEQ ID NO: 1891301 - DNA, 14 bp, Homo sapiens
atgtttagtaaact

SEQ ID NO: 1891302 - DNA, 20 bp, Homo sapiens
atgtttcttctttcttttaa

SEQ ID NO: 1891303 - DNA, 21 bp, Homo sapiens
atgttttcaggctagatgtat

SEQ ID NO: 1891304 - DNA, 14 bp, Homo sapiens
atgttttgacattt

SEQ ID NO: 1891305 - DNA, 16 bp, Homo sapiens
atgttttgacattttt

SEQ ID NO: 1891306 - DNA, 15 bp, Homo sapiens
attaaaaatagatat

SEQ ID NO: 1891307 - DNA, 15 bp, Homo sapiens
attaagaaaatctat

SEQ ID NO: 1891308 - DNA, 21 bp, Homo sapiens
attaagatatgggacattttt

SEQ ID NO: 1891309 - DNA, 24 bp, Homo sapiens
attaagtctgtgagattcattcat

SEQ ID NO: 1891310 - DNA, 16 bp, Homo sapiens
attacacaataaagca

SEQ ID NO: 1891311 - DNA, 17 bp, Homo sapiens
attacacaataaagcag

SEQ ID NO: 1891312 - DNA, 16 bp, Homo sapiens
attacatttgtataaa

SEQ ID NO: 1891313 - DNA, 18 bp, Homo sapiens
attacgtgtatgtttctt

SEQ ID NO: 1891314 - DNA, 16 bp, Homo sapiens
attactctacactgaa

SEQ ID NO: 1891315 - DNA, 15 bp, Homo sapiens
attactgtaagaaaa

SEQ ID NO: 1891316 - DNA, 18 bp, Homo sapiens
attataagccctgcataa

SEQ ID NO: 1891317 - DNA, 21 bp, Homo sapiens
attataagccctgcataatgt

SEQ ID NO: 1891318 - DNA, 19 bp, Homo sapiens
attatatcaatttcctcat

SEQ ID NO: 1891319 - DNA, 19 bp, Homo sapiens
attatcaattaccacacca

SEQ ID NO: 1891320 - DNA, 19 bp, Homo sapiens
attattgtgatttcccgtg

SEQ ID NO: 1891321 - DNA, 20 bp, Homo sapiens
attcaagtattaggggtaat

SEQ ID NO: 1891322 - DNA, 16 bp, Homo sapiens
attcatgtaacagttg

SEQ ID NO: 1891323 - DNA, 14 bp, Homo sapiens
attctgcctgcctg

SEQ ID NO: 1891324 - DNA, 15 bp, Homo sapiens
attctttcacttgat

SEQ ID NO: 1891325 - DNA, 17 bp, Homo sapiens
attctttcacttgatgt

SEQ ID NO: 1891326 - DNA, 13 bp, Homo sapiens
attgactgcagtt

SEQ ID NO: 1891327 - DNA, 20 bp, Homo sapiens
attgattacaaataaacagt

SEQ ID NO: 1891328 - DNA, 14 bp, Homo sapiens
attgcctttccagg

SEQ ID NO: 1891329 - DNA, 23 bp, Homo sapiens
attgcgaaacaacttgtgttcta

SEQ ID NO: 1891330 - DNA, 14 bp, Homo sapiens
attgggaagctgta

SEQ ID NO: 1891331 - DNA, 18 bp, Homo sapiens
attgtaaaacattcacac

SEQ ID NO: 1891332 - DNA, 15 bp, Homo sapiens
attgtaaaattgtat

SEQ ID NO: 1891333 - DNA, 22 bp, Homo sapiens
attgtatagagatatgcagaag

SEQ ID NO: 1891334 - DNA, 20 bp, Homo sapiens
attgtggggatgatgaaata

SEQ ID NO: 1891335 - DNA, 14 bp, Homo sapiens
attgttaaaggcta

SEQ ID NO: 1891336 - DNA, 21 bp, Homo sapiens
attgttgtacacagaaataca

SEQ ID NO: 1891337 - DNA, 18 bp, Homo sapiens
atttaacttgagggtaat

SEQ ID NO: 1891338 - DNA, 23 bp, Homo sapiens
atttaacttgagggtaataaact

SEQ ID NO: 1891339 - DNA, 13 bp, Homo sapiens
atttaatgtatta

SEQ ID NO: 1891340 - DNA, 20 bp, Homo sapiens
atttacatgaattgcatttt

SEQ ID NO: 1891341 - DNA, 15 bp, Homo sapiens
atttaccacttgtgt

SEQ ID NO: 1891342 - DNA, 17 bp, Homo sapiens
atttaggtaaataaagc

SEQ ID NO: 1891343 - DNA, 20 bp, Homo sapiens
atttatgcctctgtatttaa

SEQ ID NO: 1891344 - DNA, 19 bp, Homo sapiens
atttattactgtaagaaaa

SEQ ID NO: 1891345 - DNA, 14 bp, Homo sapiens
atttattttaataa

SEQ ID NO: 1891346 - DNA, 20 bp, Homo sapiens
atttattttaataatgtttc

SEQ ID NO: 1891347 - DNA, 21 bp, Homo sapiens
atttattttaataatgtttca

SEQ ID NO: 1891348 - DNA, 19 bp, Homo sapiens
atttcccgtggccccagcc

SEQ ID NO: 1891349 - DNA, 23 bp, Homo sapiens
atttcctcagatccccagctttc

SEQ ID NO: 1891350 - DNA, 14 bp, Homo sapiens
atttctatgaaata

SEQ ID NO: 1891351 - DNA, 20 bp, Homo sapiens
atttctatgaaatattatgt

SEQ ID NO: 1891352 - DNA, 16 bp, Homo sapiens
atttcttttactctgt

SEQ ID NO: 1891353 - DNA, 14 bp, Homo sapiens
atttgaatcagcct

SEQ ID NO: 1891354 - DNA, 22 bp, Homo sapiens
atttgaggagcagcttcagttg

SEQ ID NO: 1891355 - DNA, 18 bp, Homo sapiens
atttgagtgattatttgt

SEQ ID NO: 1891356 - DNA, 16 bp, Homo sapiens
atttgcaattcatgta

SEQ ID NO: 1891357 - DNA, 20 bp, Homo sapiens
atttgcaattcatgtaacag

SEQ ID NO: 1891358 - DNA, 19 bp, Homo sapiens
atttgctggagtgctggct

SEQ ID NO: 1891359 - DNA, 23 bp, Homo sapiens
atttgtaagtttatgtctaaaga

SEQ ID NO: 1891360 - DNA, 13 bp, Homo sapiens
atttgtacagttc

SEQ ID NO: 1891361 - DNA, 15 bp, Homo sapiens
atttgtacagttcag

SEQ ID NO: 1891362 - DNA, 19 bp, Homo sapiens
atttgtagtgttggagaag

SEQ ID NO: 1891363 - DNA, 18 bp, Homo sapiens
atttgtataaaataattt

SEQ ID NO: 1891364 - DNA, 17 bp, Homo sapiens
atttgtatctgaaggag

SEQ ID NO: 1891365 - DNA, 15 bp, Homo sapiens
agtttgttgaaaaca

SEQ ID NO: 1891366 - DNA, 23 bp, Homo sapiens
agttttattaataaacattctat

SEQ ID NO: 1891367 - DNA, 11 bp, Homo sapiens
ataaaaaatgg

SEQ ID NO: 1891368 - DNA, 19 bp, Homo sapiens
ataaaatccatacatttgt

SEQ ID NO: 1891369 - DNA, 23 bp, Homo sapiens
ataaaattgtaaaattgtataga

SEQ ID NO: 1891370 - DNA, 18 bp, Homo sapiens
ataaacactccacagtgt

SEQ ID NO: 1891371 - DNA, 22 bp, Homo sapiens
ataaacactccacagtgtttat

SEQ ID NO: 1891372 - DNA, 18 bp, Homo sapiens
ataaacctctaatttatt

SEQ ID NO: 1891373 - DNA, 19 bp, Homo sapiens
ataaacctctaatttattt

SEQ ID NO: 1891374 - DNA, 22 bp, Homo sapiens
ataaacctctaatttattttgt

SEQ ID NO: 1891375 - DNA, 22 bp, Homo sapiens
ataaagcagtcctgttcaaatt

SEQ ID NO: 1891376 - DNA, 12 bp, Homo sapiens
ataaagctcaag

SEQ ID NO: 1891377 - DNA, 15 bp, Homo sapiens
ataaattgtttgacc

SEQ ID NO: 1891378 - DNA, 20 bp, Homo sapiens
ataacaatgctgtattttaa

SEQ ID NO: 1891379 - DNA, 21 bp, Homo sapiens
ataagacggatttatttttcc

SEQ ID NO: 1891380 - DNA, 14 bp, Homo sapiens
ataagtttatttct

SEQ ID NO: 1891381 - DNA, 14 bp, Homo sapiens
ataataaaaagata

SEQ ID NO: 1891382 - DNA, 18 bp, Homo sapiens
ataatatttttaatatat

SEQ ID NO: 1891383 - DNA, 13 bp, Homo sapiens
ataatgtttcaaa

SEQ ID NO: 1891384 - DNA, 23 bp, Homo sapiens
ataatgtttcaaacatatataac

SEQ ID NO: 1891385 - DNA, 21 bp, Homo sapiens
ataatttttatatttgaaata

SEQ ID NO: 1891386 - DNA, 13 bp, Homo sapiens
atacacacagtta

SEQ ID NO: 1891387 - DNA, 21 bp, Homo sapiens
atacagaattgactgcagttg

SEQ ID NO: 1891388 - DNA, 17 bp, Homo sapiens
ataccagagtctggagc

SEQ ID NO: 1891389 - DNA, 15 bp, Homo sapiens
atactatattttagg

SEQ ID NO: 1891390 - DNA, 15 bp, Homo sapiens
atactgtttcttgca

SEQ ID NO: 1891391 - DNA, 12 bp, Homo sapiens
atacttgcagtt

SEQ ID NO: 1891392 - DNA, 18 bp, Homo sapiens
atagaatggtatcaataa

SEQ ID NO: 1891393 - DNA, 21 bp, Homo sapiens
atagacccatctggaggctcc

SEQ ID NO: 1891394 - DNA, 23 bp, Homo sapiens
atagatatataagaaaaaattct

SEQ ID NO: 1891395 - DNA, 18 bp, Homo sapiens
atagatttgtattttaaa

SEQ ID NO: 1891396 - DNA, 22 bp, Homo sapiens
atagtcatgtaagctgaaaata

SEQ ID NO: 1891397 - DNA, 17 bp, Homo sapiens
atagtccagctttgttc

SEQ ID NO: 1891398 - DNA, 22 bp, Homo sapiens
atataaaggaccctgtttctgt

SEQ ID NO: 1891399 - DNA, 16 bp, Homo sapiens
atataaatattagaaa

SEQ ID NO: 1891400 - DNA, 12 bp, Homo sapiens
atataacaatgc

SEQ ID NO: 1891401 - DNA, 13 bp, Homo sapiens
atataactaacaa

SEQ ID NO: 1891402 - DNA, 16 bp, Homo sapiens
atataagaaaaaattc

SEQ ID NO: 1891403 - DNA, 19 bp, Homo sapiens
atatataacaatgctgtat

SEQ ID NO: 1891404 - DNA, 15 bp, Homo sapiens
atatatttgtaaaag

SEQ ID NO: 1891405 - DNA, 13 bp, Homo sapiens
atatattttaagc

SEQ ID NO: 1891406 - DNA, 21 bp, Homo sapiens
atatattttaagccttcattt

SEQ ID NO: 1891407 - DNA, 15 bp, Homo sapiens
atatgggacattttt

SEQ ID NO: 1891408 - DNA, 20 bp, Homo sapiens
atatgtcatgcctcactttc

SEQ ID NO: 1891409 - DNA, 13 bp, Homo sapiens
atattatgttaaa

SEQ ID NO: 1891410 - DNA, 21 bp, Homo sapiens
atattgctgctggtaatttgt

SEQ ID NO: 1891411 - DNA, 16 bp, Homo sapiens
atattgggaaggaaat

SEQ ID NO: 1891412 - DNA, 14 bp, Homo sapiens
atatttattactgt

SEQ ID NO: 1891413 - DNA, 22 bp, Homo sapiens
atatttattactgtaagaaaat

SEQ ID NO: 1891414 - DNA, 14 bp, Homo sapiens
atatttattttaat

SEQ ID NO: 1891415 - DNA, 15 bp, Homo sapiens
atatttattttaata

SEQ ID NO: 1891416 - DNA, 23 bp, Homo sapiens
atatttcagataatcacaataca

SEQ ID NO: 1891417 - DNA, 14 bp, Homo sapiens
atatttgaaatatt

SEQ ID NO: 1891418 - DNA, 14 bp, Homo sapiens
atatttgctggagt

SEQ ID NO: 1891419 - DNA, 12 bp, Homo sapiens
atattttaaata

SEQ ID NO: 1891420 - DNA, 21 bp, Homo sapiens
atattttaagccttcatttgc

SEQ ID NO: 1891421 - DNA, 13 bp, Homo sapiens
atcaagcccttta

SEQ ID NO: 1891422 - DNA, 18 bp, Homo sapiens
atcacagtggccacggcc

SEQ ID NO: 1891423 - DNA, 14 bp, Homo sapiens
atcacttcttccac

SEQ ID NO: 1891424 - DNA, 23 bp, Homo sapiens
atcagcaggctccagttgaacac

SEQ ID NO: 1891425 - DNA, 13 bp, Homo sapiens
atcagccagtgac

SEQ ID NO: 1891426 - DNA, 17 bp, Homo sapiens
atcagggttagtattgt

SEQ ID NO: 1891427 - DNA, 22 bp, Homo sapiens
atcagtgtgccccccatcctgg

SEQ ID NO: 1891428 - DNA, 20 bp, Homo sapiens
atcattagagcttaaattgt

SEQ ID NO: 1891429 - DNA, 18 bp, Homo sapiens
atccaaaaatagccctgc

SEQ ID NO: 1891430 - DNA, 14 bp, Homo sapiens
atccatttctttta

SEQ ID NO: 1891431 - DNA, 18 bp, Homo sapiens
atcccactcacaacagct

SEQ ID NO: 1891432 - DNA, 17 bp, Homo sapiens
atccccagctttctcct

SEQ ID NO: 1891433 - DNA, 12 bp, Homo sapiens
atcccccagcct

SEQ ID NO: 1891434 - DNA, 10 bp, Homo sapiens
atccctggcc

SEQ ID NO: 1891435 - DNA, 12 bp, Homo sapiens
atccctggcccc

SEQ ID NO: 1891436 - DNA, 16 bp, Homo sapiens
atccctggccccctcc

SEQ ID NO: 1891437 - DNA, 23 bp, Homo sapiens
atccgacttgaattttcccactg

SEQ ID NO: 1891438 - DNA, 23 bp, Homo sapiens
atccgttcccttctgccacctgc

SEQ ID NO: 1891439 - DNA, 18 bp, Homo sapiens
atcctctctccaggcccc

SEQ ID NO: 1891440 - DNA, 19 bp, Homo sapiens
atcctgatgaggtttctac

SEQ ID NO: 1891441 - DNA, 10 bp, Homo sapiens
atcctggagc

SEQ ID NO: 1891442 - DNA, 15 bp, Homo sapiens
atcctggagcccctg

SEQ ID NO: 1891443 - DNA, 16 bp, Homo sapiens
atcctggagcccctgt

SEQ ID NO: 1891444 - DNA, 16 bp, Homo sapiens
atcctggcccatcagt

SEQ ID NO: 1891445 - DNA, 13 bp, Homo sapiens
atccttctgcctt

SEQ ID NO: 1891446 - DNA, 20 bp, Homo sapiens
atcgcaccactgtgtattta

SEQ ID NO: 1891447 - DNA, 21 bp, Homo sapiens
atctacctcactattcaagta

SEQ ID NO: 1891448 - DNA, 18 bp, Homo sapiens
atctagcagtaaatactt

SEQ ID NO: 1891449 - DNA, 19 bp, Homo sapiens
atctattcctggtagaata

SEQ ID NO: 1891450 - DNA, 14 bp, Homo sapiens
atctctgctgcttc

SEQ ID NO: 1891451 - DNA, 17 bp, Homo sapiens
atctctgctgcttctgg

SEQ ID NO: 1891452 - DNA, 12 bp, Homo sapiens
atctgcccagga

SEQ ID NO: 1891453 - DNA, 13 bp, Homo sapiens
atctgcccaggac

SEQ ID NO: 1891454 - DNA, 17 bp, Homo sapiens
atcttgtccccaacacc

SEQ ID NO: 1891455 - DNA, 16 bp, Homo sapiens
atgaagagatttttca

SEQ ID NO: 1891456 - DNA, 22 bp, Homo sapiens
atgaagatatttttccattttt

SEQ ID NO: 1891457 - DNA, 12 bp, Homo sapiens
tctacactgaaa

SEQ ID NO: 1891458 - DNA, 17 bp, Homo sapiens
tctagcagtaaatactt

SEQ ID NO: 1891459 - DNA, 22 bp, Homo sapiens
tctagcagtaaatacttgcagt

SEQ ID NO: 1891460 - DNA, 17 bp, Homo sapiens
tctatgaaatattatgt

SEQ ID NO: 1891461 - DNA, 22 bp, Homo sapiens
tctattgttgtacacagaaata

SEQ ID NO: 1891462 - DNA, 23 bp, Homo sapiens
tctattgttgtacacagaaatac

SEQ ID NO: 1891463 - DNA, 13 bp, Homo sapiens
tctattgtttgtt

SEQ ID NO: 1891464 - DNA, 14 bp, Homo sapiens
tctcaaactggggc

SEQ ID NO: 1891465 - DNA, 15 bp, Homo sapiens
tctcatttccaagca

SEQ ID NO: 1891466 - DNA, 16 bp, Homo sapiens
taagcttgtattcctt

SEQ ID NO: 1891467 - DNA, 20 bp, Homo sapiens
taaggatggagccagctctg

SEQ ID NO: 1891468 - DNA, 19 bp, Homo sapiens
taagtaatgataactggaa

SEQ ID NO: 1891469 - DNA, 20 bp, Homo sapiens
taagtaatgataactggaaa

SEQ ID NO: 1891470 - DNA, 20 bp, Homo sapiens
catgtcaccggtcagtgcct

SEQ ID NO: 1891471 - DNA, 21 bp, Homo sapiens
catgtcaccggtcagtgcctt

SEQ ID NO: 1891472 - DNA, 22 bp, Homo sapiens
catgttactaaatggtgttaca

SEQ ID NO: 1891473 - DNA, 19 bp, Homo sapiens
cattaaagccctgtgttaa

SEQ ID NO: 1891474 - DNA, 22 bp, Homo sapiens
cattaaagccctgtgttaagtg

SEQ ID NO: 1891475 - DNA, 16 bp, Homo sapiens
cattcaagtcagctct

SEQ ID NO: 1891476 - DNA, 13 bp, Homo sapiens
cattcctcacctt

SEQ ID NO: 1891477 - DNA, 14 bp, Homo sapiens
cattctattgttaa

SEQ ID NO: 1891478 - DNA, 12 bp, Homo sapiens
cattctgcctgc

SEQ ID NO: 1891479 - DNA, 15 bp, Homo sapiens
cattctgcctgcctg

SEQ ID NO: 1891480 - DNA, 16 bp, Homo sapiens
cattgatacaaagtac

SEQ ID NO: 1891481 - DNA, 11 bp, Homo sapiens
cattgcatttc

SEQ ID NO: 1891482 - DNA, 14 bp, Homo sapiens
cattgcctttccag

SEQ ID NO: 1891483 - DNA, 20 bp, Homo sapiens
cattggcagcaggtgctgct

SEQ ID NO: 1891484 - DNA, 11 bp, Homo sapiens
catttaacata

SEQ ID NO: 1891485 - DNA, 15 bp, Homo sapiens
catttaactggagct

SEQ ID NO: 1891486 - DNA, 13 bp, Homo sapiens
catttgctcatgg

SEQ ID NO: 1891487 - DNA, 16 bp, Homo sapiens
catttgctcatggaat

SEQ ID NO: 1891488 - DNA, 17 bp, Homo sapiens
catttgtataaaataat

SEQ ID NO: 1891489 - DNA, 20 bp, Homo sapiens
catttttgtattttgtttaa

SEQ ID NO: 1891490 - DNA, 22 bp, Homo sapiens
ccaaactgactcttaagaagac

SEQ ID NO: 1891491 - DNA, 14 bp, Homo sapiens
ccaaaggaggatgg

SEQ ID NO: 1891492 - DNA, 16 bp, Homo sapiens
ccaacccagccgctgc

SEQ ID NO: 1891493 - DNA, 19 bp, Homo sapiens
ccaacccagccgctgcccg

SEQ ID NO: 1891494 - DNA, 13 bp, Homo sapiens
ccaacccccagca

SEQ ID NO: 1891495 - DNA, 15 bp, Homo sapiens
ccaacccccagcacc

SEQ ID NO: 1891496 - DNA, 18 bp, Homo sapiens
ccaagatcacataccaga

SEQ ID NO: 1891497 - DNA, 13 bp, Homo sapiens
ccatctgcccagg

SEQ ID NO: 1891498 - DNA, 19 bp, Homo sapiens
ccatctggaggctcccatg

SEQ ID NO: 1891499 - DNA, 15 bp, Homo sapiens
ccatcttccaggtgg

SEQ ID NO: 1891500 - DNA, 18 bp, Homo sapiens
ccatgaagagatttttca

SEQ ID NO: 1891501 - DNA, 11 bp, Homo sapiens
ccatgccctgc

SEQ ID NO: 1891502 - DNA, 12 bp, Homo sapiens
ccatgccctgcc

SEQ ID NO: 1891503 - DNA, 16 bp, Homo sapiens
ccatgggcactgctgg

SEQ ID NO: 1891504 - DNA, 18 bp, Homo sapiens
ccatgggcactgtgggta

SEQ ID NO: 1891505 - DNA, 21 bp, Homo sapiens
ccatgtcaccggtcagtgcct

SEQ ID NO: 1891506 - DNA, 19 bp, Homo sapiens
ccattattgagttcctcct

SEQ ID NO: 1891507 - DNA, 17 bp, Homo sapiens
ccattgttgtcaaatgc

SEQ ID NO: 1891508 - DNA, 16 bp, Homo sapiens
cccaaccagggccccg

SEQ ID NO: 1891509 - DNA, 21 bp, Homo sapiens
cccaaggacggcaccatccag

SEQ ID NO: 1891510 - DNA, 12 bp, Homo sapiens
cccaagggaggc

SEQ ID NO: 1891511 - DNA, 11 bp, Homo sapiens
cccacagccca

SEQ ID NO: 1891512 - DNA, 22 bp, Homo sapiens
cccacagcccacgtcctgtcag

SEQ ID NO: 1891513 - DNA, 22 bp, Homo sapiens
cccacagtgactcgggctcctg

SEQ ID NO: 1891514 - DNA, 15 bp, Homo sapiens
cccacatccagtggg

SEQ ID NO: 1891515 - DNA, 20 bp, Homo sapiens
cccacctgaggccccaggtg

SEQ ID NO: 1891516 - DNA, 13 bp, Homo sapiens
cccacgtcctgtc

SEQ ID NO: 1891517 - DNA, 20 bp, Homo sapiens
cccactctccatcagatgtg

SEQ ID NO: 1891518 - DNA, 15 bp, Homo sapiens
cccactgcaccccct

SEQ ID NO: 1891519 - DNA, 16 bp, Homo sapiens
cccactgcaccccctc

SEQ ID NO: 1891520 - DNA, 17 bp, Homo sapiens
cccactgcaccccctcc

SEQ ID NO: 1891521 - DNA, 11 bp, Homo sapiens
ccctgtttctg

SEQ ID NO: 1891522 - DNA, 15 bp, Homo sapiens
cccttccctctgttg

SEQ ID NO: 1891523 - DNA, 15 bp, Homo sapiens
cccttttcagcttct

SEQ ID NO: 1891524 - DNA, 23 bp, Homo sapiens
ccgacttgaattttcccactgca

SEQ ID NO: 1891525 - DNA, 19 bp, Homo sapiens
ccgagcctggctccaaacc

SEQ ID NO: 1891526 - DNA, 16 bp, Homo sapiens
ccgagggatgatgcca

SEQ ID NO: 1891527 - DNA, 20 bp, Homo sapiens
ccgagggatgatgccacacc

SEQ ID NO: 1891528 - DNA, 18 bp, Homo sapiens
ccgatgatactgtttctt

SEQ ID NO: 1891529 - DNA, 23 bp, Homo sapiens
ccgcatgccccctcgtgccagtc

SEQ ID NO: 1891530 - DNA, 22 bp, Homo sapiens
ccgcccaggctggccagcccca

SEQ ID NO: 1891531 - DNA, 19 bp, Homo sapiens
ccgccccttccccgaggga

SEQ ID NO: 1891532 - DNA, 17 bp, Homo sapiens
ccgccgcctcgcccacc

SEQ ID NO: 1891533 - DNA, 17 bp, Homo sapiens
ccgcctcgcccaccgca

SEQ ID NO: 1891534 - DNA, 18 bp, Homo sapiens
ccgctcccaccagcccac

SEQ ID NO: 1891535 - DNA, 12 bp, Homo sapiens
ccgctcccagtg

SEQ ID NO: 1891536 - DNA, 14 bp, Homo sapiens
ccgctcccagtgtc

SEQ ID NO: 1891537 - DNA, 22 bp, Homo sapiens
ccgctgcccggcgccctctgtc

SEQ ID NO: 1891538 - DNA, 18 bp, Homo sapiens
ccggatccaggattctgg

SEQ ID NO: 1891539 - DNA, 15 bp, Homo sapiens
ccggccaggtgggcg

SEQ ID NO: 1891540 - DNA, 18 bp, Homo sapiens
ccggcgccctctgtcctg

SEQ ID NO: 1891541 - DNA, 18 bp, Homo sapiens
ccgggaccccgagcctgg

SEQ ID NO: 1891542 - DNA, 23 bp, Homo sapiens
ccggggaggagagagcagcttct

SEQ ID NO: 1891543 - DNA, 19 bp, Homo sapiens
ccggggaggagccttggag

SEQ ID NO: 1891544 - DNA, 13 bp, Homo sapiens
ccggggctgggtt

SEQ ID NO: 1891545 - DNA, 12 bp, Homo sapiens
ccggtcagtgcc

SEQ ID NO: 1891546 - DNA, 20 bp, Homo sapiens
ccggtcagtgccttttggaa

SEQ ID NO: 1891547 - DNA, 15 bp, Homo sapiens
ccgtggccccagcct

SEQ ID NO: 1891548 - DNA, 17 bp, Homo sapiens
ccgtggccccagcctgg

SEQ ID NO: 1891549 - DNA, 20 bp, Homo sapiens
ccgtggccccagcctggccc

SEQ ID NO: 1891550 - DNA, 14 bp, Homo sapiens
ccgttcacattttt

SEQ ID NO: 1891551 - DNA, 20 bp, Homo sapiens
ccgttgccgggcctggactg

SEQ ID NO: 1891552 - DNA, 17 bp, Homo sapiens
ccgttgctgaaaatgat

SEQ ID NO: 1891553 - DNA, 17 bp, Homo sapiens
cctacacccttggactt

SEQ ID NO: 1891554 - DNA, 14 bp, Homo sapiens
cctacacctctggg

SEQ ID NO: 1891555 - DNA, 16 bp, Homo sapiens
cctacacctctgggcc

SEQ ID NO: 1891556 - DNA, 21 bp, Homo sapiens
cctacacctctgggccctgca

SEQ ID NO: 1891557 - DNA, 21 bp, Homo sapiens
cctacccctcccagctgacag

SEQ ID NO: 1891558 - DNA, 16 bp, Homo sapiens
cctagtcatcgtttgt

SEQ ID NO: 1891559 - DNA, 15 bp, Homo sapiens
cctagtggctgtcca

SEQ ID NO: 1891560 - DNA, 19 bp, Homo sapiens
cctagtggctgtccagtgc

SEQ ID NO: 1891561 - DNA, 21 bp, Homo sapiens
cctagtggctgtccagtgccc

SEQ ID NO: 1891562 - DNA, 23 bp, Homo sapiens
cctagtggctgtccagtgcccat

SEQ ID NO: 1891563 - DNA, 12 bp, Homo sapiens
cctatcagtgtg

SEQ ID NO: 1891564 - DNA, 16 bp, Homo sapiens
cctatcagtgtgcccc

SEQ ID NO: 1891565 - DNA, 18 bp, Homo sapiens
cctcaaaattgataatta

SEQ ID NO: 1891566 - DNA, 15 bp, Homo sapiens
cctcaaagaggcctt

SEQ ID NO: 1891567 - DNA, 14 bp, Homo sapiens
cctcaacccctccc

SEQ ID NO: 1891568 - DNA, 23 bp, Homo sapiens
cctcacacacaatgtgtctgaga

SEQ ID NO: 1891569 - DNA, 14 bp, Homo sapiens
cctcacatgcccgc

SEQ ID NO: 1891570 - DNA, 13 bp, Homo sapiens
cctcaccaggggc

SEQ ID NO: 1891571 - DNA, 23 bp, Homo sapiens
cctcaccaggggcaggcacagca

SEQ ID NO: 1891572 - DNA, 19 bp, Homo sapiens
cctcaccttttcccgggga

SEQ ID NO: 1891573 - DNA, 17 bp, Homo sapiens
cctcactattcaagtat

SEQ ID NO: 1891574 - DNA, 14 bp, Homo sapiens
cctcactttcttct

SEQ ID NO: 1891575 - DNA, 23 bp, Homo sapiens
cctcatggaattggagctcgtgg

SEQ ID NO: 1891576 - DNA, 17 bp, Homo sapiens
cctccaccgccatggct

SEQ ID NO: 1891577 - DNA, 21 bp, Homo sapiens
cctccaccgccatggcttcca

SEQ ID NO: 1891578 - DNA, 18 bp, Homo sapiens
cctccactcccacttccc

SEQ ID NO: 1891579 - DNA, 12 bp, Homo sapiens
cctccatccctg

SEQ ID NO: 1891580 - DNA, 16 bp, Homo sapiens
cctccatccctggccc

SEQ ID NO: 1891581 - DNA, 12 bp, Homo sapiens
cctcccagctga

SEQ ID NO: 1891582 - DNA, 14 bp, Homo sapiens
cctcccctccatcc

SEQ ID NO: 1891583 - DNA, 13 bp, Homo sapiens
cctcccctcccgt

SEQ ID NO: 1891584 - DNA, 11 bp, Homo sapiens
cctcccgcccc

SEQ ID NO: 1891585 - DNA, 15 bp, Homo sapiens
cctccctgctgtccc

SEQ ID NO: 1891586 - DNA, 21 bp, Homo sapiens
cctccctgctgtcccctcttg

SEQ ID NO: 1891587 - DNA, 15 bp, Homo sapiens
cctccgttcccacct

SEQ ID NO: 1891588 - DNA, 23 bp, Homo sapiens
cctccgttcccacctctgaggac

SEQ ID NO: 1891589 - DNA, 24 bp, Homo sapiens
cctccgttcccacctctgaggact

SEQ ID NO: 1891590 - DNA, 12 bp, Homo sapiens
cctcctgctgca

SEQ ID NO: 1891591 - DNA, 21 bp, Homo sapiens
cctcctgctgcagaggggcag

SEQ ID NO: 1891592 - DNA, 19 bp, Homo sapiens
cctccttcttgccctgagc

SEQ ID NO: 1891593 - DNA, 20 bp, Homo sapiens
cctccttcttgccctgagct

SEQ ID NO: 1891594 - DNA, 13 bp, Homo sapiens
cctcgcccaccgc

SEQ ID NO: 1891595 - DNA, 16 bp, Homo sapiens
cctcgcctggcctgag

SEQ ID NO: 1891596 - DNA, 18 bp, Homo sapiens
cctcgcctggcctgaggt

SEQ ID NO: 1891597 - DNA, 13 bp, Homo sapiens
cctcggctcctgc

SEQ ID NO: 1891598 - DNA, 14 bp, Homo sapiens
cctcggctcctgct

SEQ ID NO: 1891599 - DNA, 18 bp, Homo sapiens
cctcggctcctgctgcac

SEQ ID NO: 1891600 - DNA, 23 bp, Homo sapiens
cctctccacctagtggctgtcca

SEQ ID NO: 1891601 - DNA, 16 bp, Homo sapiens
cctctctccaggcccc

SEQ ID NO: 1891602 - DNA, 14 bp, Homo sapiens
cctctgggccctgc

SEQ ID NO: 1891603 - DNA, 16 bp, Homo sapiens
cctctgggccctgcag

SEQ ID NO: 1891604 - DNA, 11 bp, Homo sapiens
cctctgtcctg

SEQ ID NO: 1891605 - DNA, 22 bp, Homo sapiens
cctctgtcctgacttcaggggc

SEQ ID NO: 1891606 - DNA, 18 bp, Homo sapiens
cctcttaaataaaccttt

SEQ ID NO: 1891607 - DNA, 23 bp, Homo sapiens
cctcttagatgcagttctgaaga

SEQ ID NO: 1891608 - DNA, 15 bp, Homo sapiens
cctcttgccccaacc

SEQ ID NO: 1891609 - DNA, 21 bp, Homo sapiens
cctcttgccccaacccccagc

SEQ ID NO: 1891610 - DNA, 14 bp, Homo sapiens
cctgaaaatatgtc

SEQ ID NO: 1891611 - DNA, 21 bp, Homo sapiens
cctgacttcaggggctgcccg

SEQ ID NO: 1891612 - DNA, 12 bp, Homo sapiens
cctgagcctgcc

SEQ ID NO: 1891613 - DNA, 17 bp, Homo sapiens
cctgaggccccaggtgg

SEQ ID NO: 1891614 - DNA, 16 bp, Homo sapiens
cctgaggtctcgctga

SEQ ID NO: 1891615 - DNA, 15 bp, Homo sapiens
cctgatggagaggag

SEQ ID NO: 1891616 - DNA, 13 bp, Homo sapiens
cctgattaaatgt

SEQ ID NO: 1891617 - DNA, 19 bp, Homo sapiens
cctgattcggctgtctcag

SEQ ID NO: 1891618 - DNA, 12 bp, Homo sapiens
cctgcactgtcc

SEQ ID NO: 1891619 - DNA, 15 bp, Homo sapiens
cctgcactgtcctgc

SEQ ID NO: 1891620 - DNA, 19 bp, Homo sapiens
cctgcactgtcctgctcca

SEQ ID NO: 1891621 - DNA, 20 bp, Homo sapiens
cctgcactgtcctgctccac

SEQ ID NO: 1891622 - DNA, 21 bp, Homo sapiens
cctgcactgtcctgctccaca

SEQ ID NO: 1891623 - DNA, 23 bp, Homo sapiens
cctgcactgtcctgctccacagt

SEQ ID NO: 1891624 - DNA, 16 bp, Homo sapiens
cctgcaggaggcctgg

SEQ ID NO: 1891625 - DNA, 19 bp, Homo sapiens
cctgcaggaggcctgggag

SEQ ID NO: 1891626 - DNA, 20 bp, Homo sapiens
cctgcaggaggcctgggagg

SEQ ID NO: 1891627 - DNA, 22 bp, Homo sapiens
cctgcaggaggcctgggagggc

SEQ ID NO: 1891628 - DNA, 16 bp, Homo sapiens
cctgcaggttgggcca

SEQ ID NO: 1891629 - DNA, 16 bp, Homo sapiens
cctgccaagcctggag

SEQ ID NO: 1891630 - DNA, 17 bp, Homo sapiens
cctgccaagcctggagc

SEQ ID NO: 1891631 - DNA, 16 bp, Homo sapiens
cctgccccagctgggc

SEQ ID NO: 1891632 - DNA, 18 bp, Homo sapiens
cctgccccagctgggctg

SEQ ID NO: 1891633 - DNA, 23 bp, Homo sapiens
cctgcccgttgccgggcctggac

SEQ ID NO: 1891634 - DNA, 21 bp, Homo sapiens
cctgcctcttaaataaacctt

SEQ ID NO: 1891635 - DNA, 12 bp, Homo sapiens
cctgctccacag

SEQ ID NO: 1891636 - DNA, 23 bp, Homo sapiens
ctaagcgctagaggaagcagcca

SEQ ID NO: 1891637 - DNA, 17 bp, Homo sapiens
ctaaggggcaggaatca

SEQ ID NO: 1891638 - DNA, 22 bp, Homo sapiens
ctaaggggcaggaatcaaggag

SEQ ID NO: 1891639 - DNA, 23 bp, Homo sapiens
ctaaggggcaggaatcaaggagc

SEQ ID NO: 1891640 - DNA, 19 bp, Homo sapiens
ctaaggtcccataataaaa

SEQ ID NO: 1891641 - DNA, 16 bp, Homo sapiens
ctaatcaagtcaaatg

SEQ ID NO: 1891642 - DNA, 18 bp, Homo sapiens
ctaattatataatatttt

SEQ ID NO: 1891643 - DNA, 14 bp, Homo sapiens
ctacactaagagag

SEQ ID NO: 1891644 - DNA, 11 bp, Homo sapiens
ctacactgaaa

SEQ ID NO: 1891645 - DNA, 22 bp, Homo sapiens
ctacatgatctagagccagtta

SEQ ID NO: 1891646 - DNA, 15 bp, Homo sapiens
ctacccctcccagct

SEQ ID NO: 1891647 - DNA, 16 bp, Homo sapiens
ctacccctcccagctg

SEQ ID NO: 1891648 - DNA, 18 bp, Homo sapiens
ctggcctgttctgtagga

SEQ ID NO: 1891649 - DNA, 19 bp, Homo sapiens
ctggctccaaaccctcgag

SEQ ID NO: 1891650 - DNA, 21 bp, Homo sapiens
ctggctccacgccctggggag

SEQ ID NO: 1891651 - DNA, 17 bp, Homo sapiens
ctggctcccaagggagg

SEQ ID NO: 1891652 - DNA, 15 bp, Homo sapiens
ctggctgcctccact

SEQ ID NO: 1891653 - DNA, 20 bp, Homo sapiens
ctggctgcctccactcccac

SEQ ID NO: 1891654 - DNA, 15 bp, Homo sapiens
ctgggagaaggtgct

SEQ ID NO: 1891655 - DNA, 16 bp, Homo sapiens
ctgggcaggtcctggg

SEQ ID NO: 1891656 - DNA, 18 bp, Homo sapiens
ctgggcaggtcctgggga

SEQ ID NO: 1891657 - DNA, 12 bp, Homo sapiens
ctgggccctgca

SEQ ID NO: 1891658 - DNA, 20 bp, Homo sapiens
ctgggccctgcaggaggcct

SEQ ID NO: 1891659 - DNA, 12 bp, Homo sapiens
ctgggcctgatg

SEQ ID NO: 1891660 - DNA, 14 bp, Homo sapiens
ctgggcctgatgga

SEQ ID NO: 1891661 - DNA, 15 bp, Homo sapiens
ctgggcctgatggag

SEQ ID NO: 1891662 - DNA, 23 bp, Homo sapiens
ctgggcctgatggagaggagaac

SEQ ID NO: 1891663 - DNA, 13 bp, Homo sapiens
ctgggctctgtgg

SEQ ID NO: 1891664 - DNA, 18 bp, Homo sapiens
ctgggctgggtgcgaccc

SEQ ID NO: 1891665 - DNA, 18 bp, Homo sapiens
ctgggctgttggctgggg

SEQ ID NO: 1891666 - DNA, 15 bp, Homo sapiens
ctggggaaggaccaa

SEQ ID NO: 1891667 - DNA, 14 bp, Homo sapiens
ctggggaggctgag

SEQ ID NO: 1891668 - DNA, 19 bp, Homo sapiens
ctggggaggctgagactgc

SEQ ID NO: 1891669 - DNA, 14 bp, Homo sapiens
ctggggagtgagct

SEQ ID NO: 1891670 - DNA, 19 bp, Homo sapiens
ctggggccaaataaagtct

SEQ ID NO: 1891671 - DNA, 21 bp, Homo sapiens
ctggggcggggctggaggtgg

SEQ ID NO: 1891672 - DNA, 15 bp, Homo sapiens
ctgggtatgaggctg

SEQ ID NO: 1891673 - DNA, 22 bp, Homo sapiens
ctgggtgcgaccccatctgccc

SEQ ID NO: 1891674 - DNA, 23 bp, Homo sapiens
ctgggtgcgaccccatctgccca

SEQ ID NO: 1891675 - DNA, 23 bp, Homo sapiens
ctggtgaccccttttcagcttct

SEQ ID NO: 1891676 - DNA, 22 bp, Homo sapiens
ctggtgggacaacaaagaggac

SEQ ID NO: 1891677 - DNA, 19 bp, Homo sapiens
ctgtagaaaagaaaacatt

SEQ ID NO: 1891678 - DNA, 15 bp, Homo sapiens
ctgtataatttaaca

SEQ ID NO: 1891679 - DNA, 20 bp, Homo sapiens
ctgtataatttaacagtgcc

SEQ ID NO: 1891680 - DNA, 13 bp, Homo sapiens
ctgtattttaaaa

SEQ ID NO: 1891681 - DNA, 23 bp, Homo sapiens
ctgtcccaggggtctccctgagc

SEQ ID NO: 1891682 - DNA, 19 bp, Homo sapiens
ctgtcccctcttgccccaa

SEQ ID NO: 1891683 - DNA, 20 bp, Homo sapiens
ctgtcctgacttcaggggct

SEQ ID NO: 1891684 - DNA, 19 bp, Homo sapiens
ctgtcctgctccacagtgt

SEQ ID NO: 1891685 - DNA, 18 bp, Homo sapiens
ctgtgaacatggactctt

SEQ ID NO: 1891686 - DNA, 15 bp, Homo sapiens
ctgtgatttcttctc

SEQ ID NO: 1891687 - DNA, 18 bp, Homo sapiens
ctgtgcccatgggcactg

SEQ ID NO: 1891688 - DNA, 21 bp, Homo sapiens
ctgtgcccatgggcactgctg

SEQ ID NO: 1891689 - DNA, 23 bp, Homo sapiens
ctgtgcctgactctgtgctgagc

SEQ ID NO: 1891690 - DNA, 14 bp, Homo sapiens
ctgtgggctgcact

SEQ ID NO: 1891691 - DNA, 22 bp, Homo sapiens
ctgtggggctaggggctggggc

SEQ ID NO: 1891692 - DNA, 19 bp, Homo sapiens
ctgtgggggaagagcacag

SEQ ID NO: 1891693 - DNA, 20 bp, Homo sapiens
ctgtgggggaagagcacagc

SEQ ID NO: 1891694 - DNA, 14 bp, Homo sapiens
ctgtgtcactggct

SEQ ID NO: 1891695 - DNA, 18 bp, Homo sapiens
ctgtgtcactggctgcct

SEQ ID NO: 1891696 - DNA, 22 bp, Homo sapiens
ctgtgtcggggggcgagggagg

SEQ ID NO: 1891697 - DNA, 22 bp, Homo sapiens
ctgtgtggtgtcgcgccttctc

SEQ ID NO: 1891698 - DNA, 15 bp, Homo sapiens
ctgtgtgttgacact

SEQ ID NO: 1891699 - DNA, 16 bp, Homo sapiens
ctgtgtgttgacactg

SEQ ID NO: 1891700 - DNA, 19 bp, Homo sapiens
ctgtgttggggggcaaggt

SEQ ID NO: 1891701 - DNA, 18 bp, Homo sapiens
ctgttaagcaattccttt

SEQ ID NO: 1891702 - DNA, 13 bp, Homo sapiens
ctgttataatctt

SEQ ID NO: 1891703 - DNA, 17 bp, Homo sapiens
ctgttctgtaggagaga

SEQ ID NO: 1891704 - DNA, 23 bp, Homo sapiens
ctgttggaaattgggtgtgccct

SEQ ID NO: 1891705 - DNA, 23 bp, Homo sapiens
ctgttgttctgtggtcacagtga

SEQ ID NO: 1891706 - DNA, 14 bp, Homo sapiens
ctgtttctgtagaa

SEQ ID NO: 1891707 - DNA, 18 bp, Homo sapiens
ctgtttcttgcactgaat

SEQ ID NO: 1891708 - DNA, 17 bp, Homo sapiens
cttaaggagaggagagc

SEQ ID NO: 1891709 - DNA, 21 bp, Homo sapiens
cttaaggatggagccagctct

SEQ ID NO: 1891710 - DNA, 14 bp, Homo sapiens
cttacctatttcct

SEQ ID NO: 1891711 - DNA, 21 bp, Homo sapiens
cttactgatttttaagttatt

SEQ ID NO: 1891712 - DNA, 18 bp, Homo sapiens
cttacttattatcttcag

SEQ ID NO: 1891713 - DNA, 11 bp, Homo sapiens
cttagaataaa

SEQ ID NO: 1891714 - DNA, 21 bp, Homo sapiens
cttagggttatgattaagtaa

SEQ ID NO: 1891715 - DNA, 23 bp, Homo sapiens
cttagttcaagtcctgcctctta

SEQ ID NO: 1891716 - DNA, 21 bp, Homo sapiens
cttatttattcatattttctt

SEQ ID NO: 1891717 - DNA, 17 bp, Homo sapiens
cttatttcatgaaaatt

SEQ ID NO: 1891718 - DNA, 17 bp, Homo sapiens
cttcaaatccttgaaga

SEQ ID NO: 1891719 - DNA, 17 bp, Homo sapiens
cttcacagtgcagcttg

SEQ ID NO: 1891720 - DNA, 14 bp, Homo sapiens
cttcagcctgtgca

SEQ ID NO: 1891721 - DNA, 16 bp, Homo sapiens
cttcagcggtttatat

SEQ ID NO: 1891722 - DNA, 14 bp, Homo sapiens
cttcaggggctgcc

SEQ ID NO: 1891723 - DNA, 16 bp, Homo sapiens
cttcaggggctgcccg

SEQ ID NO: 1891724 - DNA, 18 bp, Homo sapiens
cttcaggggctgcccgct

SEQ ID NO: 1891725 - DNA, 11 bp, Homo sapiens
cttcagttgtt

SEQ ID NO: 1891726 - DNA, 17 bp, Homo sapiens
cttcagttgttttcccg

SEQ ID NO: 1891727 - DNA, 23 bp, Homo sapiens
cttcatgctgtctacactaagag

SEQ ID NO: 1891728 - DNA, 21 bp, Homo sapiens
cttcatttgcaattcatgtaa

SEQ ID NO: 1891729 - DNA, 19 bp, Homo sapiens
cttccagatcctggaaatc

SEQ ID NO: 1891730 - DNA, 21 bp, Homo sapiens
cttccaggggaggttcagtga

SEQ ID NO: 1891731 - DNA, 22 bp, Homo sapiens
cttccctgtatgattccttgat

SEQ ID NO: 1891732 - DNA, 15 bp, Homo sapiens
cttctcccaattcat

SEQ ID NO: 1891733 - DNA, 20 bp, Homo sapiens
cttctcccccccggggctgg

SEQ ID NO: 1891734 - DNA, 14 bp, Homo sapiens
cttctgccacttcc

SEQ ID NO: 1891735 - DNA, 18 bp, Homo sapiens
cttctgcggtgaggcagg

SEQ ID NO: 1891736 - DNA, 17 bp, Homo sapiens
cttctgctgggctgggg

SEQ ID NO: 1891737 - DNA, 18 bp, Homo sapiens
cttctgggcctgatggag

SEQ ID NO: 1891738 - DNA, 15 bp, Homo sapiens
cttcttgccctgagc

SEQ ID NO: 1891739 - DNA, 15 bp, Homo sapiens
cttgaagcaaatgtg

SEQ ID NO: 1891740 - DNA, 17 bp, Homo sapiens
cttgaattttcccactg

SEQ ID NO: 1891741 - DNA, 21 bp, Homo sapiens
cttgaattttcccactgcacc

SEQ ID NO: 1891742 - DNA, 22 bp, Homo sapiens
cttgaattttcccactgcaccc

SEQ ID NO: 1891743 - DNA, 12 bp, Homo sapiens
cttgacctccta

SEQ ID NO: 1891744 - DNA, 18 bp, Homo sapiens
cttgatctgtgatttctt

SEQ ID NO: 1891745 - DNA, 12 bp, Homo sapiens
cttgatgaagaa

SEQ ID NO: 1891746 - DNA, 21 bp, Homo sapiens
cttgcagtccgttgctgaaaa

SEQ ID NO: 1891747 - DNA, 13 bp, Homo sapiens
cttgccccaaccc

SEQ ID NO: 1891748 - DNA, 20 bp, Homo sapiens
cttgccccaacccccagcac

SEQ ID NO: 1891749 - DNA, 17 bp, Homo sapiens
cttgcccgctcaggctg

SEQ ID NO: 1891750 - DNA, 12 bp, Homo sapiens
cttgccctgagc

SEQ ID NO: 1891751 - DNA, 13 bp, Homo sapiens
cttgccctgagct

SEQ ID NO: 1891752 - DNA, 22 bp, Homo sapiens
cttgccctgggccagcccagga

SEQ ID NO: 1891753 - DNA, 17 bp, Homo sapiens
cttgcctcggctcctgc

SEQ ID NO: 1891754 - DNA, 23 bp, Homo sapiens
cttgcctcggctcctgctgcacc

SEQ ID NO: 1891755 - DNA, 18 bp, Homo sapiens
cttgctgttcagtgcttt

SEQ ID NO: 1891756 - DNA, 16 bp, Homo sapiens
cttggtaaattgtaaa

SEQ ID NO: 1891757 - DNA, 20 bp, Homo sapiens
cttggttcttttttcagtta

SEQ ID NO: 1891758 - DNA, 17 bp, Homo sapiens
cttgtatatcttgtttt

SEQ ID NO: 1891759 - DNA, 23 bp, Homo sapiens
cttgtcaataaaatccatacatt

SEQ ID NO: 1891760 - DNA, 22 bp, Homo sapiens
cttgttttgtttgcttccatta

SEQ ID NO: 1891761 - DNA, 23 bp, Homo sapiens
ctttaaatttaggtaaataaagc

SEQ ID NO: 1891762 - DNA, 21 bp, Homo sapiens
ctttagaggctttcaaatgta

SEQ ID NO: 1891763 - DNA, 21 bp, Homo sapiens
ctttagggatctggggaagga

SEQ ID NO: 1891764 - DNA, 16 bp, Homo sapiens
ctttccagggttattt

SEQ ID NO: 1891765 - DNA, 20 bp, Homo sapiens
gagcacagccctcccgcccc

SEQ ID NO: 1891766 - DNA, 13 bp, Homo sapiens
gagcacctggtgg

SEQ ID NO: 1891767 - DNA, 16 bp, Homo sapiens
gagcagcttctgccac

SEQ ID NO: 1891768 - DNA, 17 bp, Homo sapiens
gagcagcttctgccact

SEQ ID NO: 1891769 - DNA, 21 bp, Homo sapiens
gagcagcttctgccacttccc

SEQ ID NO: 1891770 - DNA, 14 bp, Homo sapiens
gagcagtcaggaaa

SEQ ID NO: 1891771 - DNA, 13 bp, Homo sapiens
gagcagtccagag

SEQ ID NO: 1891772 - DNA, 16 bp, Homo sapiens
gagcattctgcctgcc

SEQ ID NO: 1891773 - DNA, 13 bp, Homo sapiens
gagccacctgggc

SEQ ID NO: 1891774 - DNA, 22 bp, Homo sapiens
gagccacctgggctgggagaag

SEQ ID NO: 1891775 - DNA, 16 bp, Homo sapiens
gagccagtgtgaggct

SEQ ID NO: 1891776 - DNA, 18 bp, Homo sapiens
gagcccccacctgcctga

SEQ ID NO: 1891777 - DNA, 19 bp, Homo sapiens
gagcccctgtgtgggaggg

SEQ ID NO: 1891778 - DNA, 18 bp, Homo sapiens
gagccctccttcttgccc

SEQ ID NO: 1891779 - DNA, 20 bp, Homo sapiens
gagccctccttcttgccctg

SEQ ID NO: 1891780 - DNA, 18 bp, Homo sapiens
gagcctcctttctggctt

SEQ ID NO: 1891781 - DNA, 19 bp, Homo sapiens
gagcctggagcccctgtgt

SEQ ID NO: 1891782 - DNA, 16 bp, Homo sapiens
gagctcgtgggacagt

SEQ ID NO: 1891783 - DNA, 17 bp, Homo sapiens
gagctgagctacctggg

SEQ ID NO: 1891784 - DNA, 20 bp, Homo sapiens
gaggagagagcagcttctgc

SEQ ID NO: 1891785 - DNA, 22 bp, Homo sapiens
gaggagagcatctgctctgaga

SEQ ID NO: 1891786 - DNA, 18 bp, Homo sapiens
gaggagccacctgggctg

SEQ ID NO: 1891787 - DNA, 17 bp, Homo sapiens
gaggatgggatgtattt

SEQ ID NO: 1891788 - DNA, 19 bp, Homo sapiens
gaggcaacagtgttctgag

SEQ ID NO: 1891789 - DNA, 22 bp, Homo sapiens
gaggcaacagtgttctgagccc

SEQ ID NO: 1891790 - DNA, 21 bp, Homo sapiens
gaggcaggggagtctgcttgt

SEQ ID NO: 1891791 - DNA, 22 bp, Homo sapiens
gaggcagtgggtcccacttccc

SEQ ID NO: 1891792 - DNA, 14 bp, Homo sapiens
gaggcctgggaggg

SEQ ID NO: 1891793 - DNA, 14 bp, Homo sapiens
gaggcgggggagcc

SEQ ID NO: 1891794 - DNA, 16 bp, Homo sapiens
gaggcgggggagcctg

SEQ ID NO: 1891795 - DNA, 18 bp, Homo sapiens
gaggcgggggagcctgga

SEQ ID NO: 1891796 - DNA, 19 bp, Homo sapiens
gaggcgggggagcctggag

SEQ ID NO: 1891797 - DNA, 22 bp, Homo sapiens
gaggcgggggatcctggagccc

SEQ ID NO: 1891798 - DNA, 18 bp, Homo sapiens
gaggctcccatgggctag

SEQ ID NO: 1891799 - DNA, 14 bp, Homo sapiens
gaggctgagactgc

SEQ ID NO: 1891800 - DNA, 16 bp, Homo sapiens
gaggctggctggggcc

SEQ ID NO: 1891801 - DNA, 17 bp, Homo sapiens
gagggatgatgccacac

SEQ ID NO: 1891802 - DNA, 13 bp, Homo sapiens
gagggcgaggcgg

SEQ ID NO: 1891803 - DNA, 14 bp, Homo sapiens
gagggcgaggcggg

SEQ ID NO: 1891804 - DNA, 17 bp, Homo sapiens
gaggggcaggccctgca

SEQ ID NO: 1891805 - DNA, 21 bp, Homo sapiens
gaggggcccgttgtctccctg

SEQ ID NO: 1891806 - DNA, 16 bp, Homo sapiens
gagggtaataaactta

SEQ ID NO: 1891807 - DNA, 20 bp, Homo sapiens
gaggtctcgctgatgctggg

SEQ ID NO: 1891808 - DNA, 23 bp, Homo sapiens
gaggtctcgctgatgctgggctg

SEQ ID NO: 1891809 - DNA, 19 bp, Homo sapiens
gaggtggcgccccctggtg

SEQ ID NO: 1891810 - DNA, 14 bp, Homo sapiens
gaggtggcttcatg

SEQ ID NO: 1891811 - DNA, 17 bp, Homo sapiens
gaggtggtagctctgag

SEQ ID NO: 1891812 - DNA, 19 bp, Homo sapiens
gaggtggtagctctgagcc

SEQ ID NO: 1891813 - DNA, 21 bp, Homo sapiens
gaggtggtagctctgagccct

SEQ ID NO: 1891814 - DNA, 17 bp, Homo sapiens
gaggttgaggatgcact

SEQ ID NO: 1891815 - DNA, 13 bp, Homo sapiens
gaggttgcagtga

SEQ ID NO: 1891816 - DNA, 23 bp, Homo sapiens
gagtatctcggacctttcagctg

SEQ ID NO: 1891817 - DNA, 11 bp, Homo sapiens
gagtgctggct

SEQ ID NO: 1891818 - DNA, 23 bp, Homo sapiens
gagtggcattggcagcaggtgct

SEQ ID NO: 1891819 - DNA, 16 bp, Homo sapiens
gagtttagctggaaaa

SEQ ID NO: 1891820 - DNA, 23 bp, Homo sapiens
gataattacgtttaaagtgcagt

SEQ ID NO: 1891821 - DNA, 22 bp, Homo sapiens
gatagaactttgccagtcttta

SEQ ID NO: 1891822 - DNA, 16 bp, Homo sapiens
gatatgggacattttt

SEQ ID NO: 1891823 - DNA, 17 bp, Homo sapiens
gatattgggaaggaaat

SEQ ID NO: 1891824 - DNA, 22 bp, Homo sapiens
gatattgggaaggaaatatatt

SEQ ID NO: 1891825 - DNA, 20 bp, Homo sapiens
gatatttgctggagtgctgg

SEQ ID NO: 1891826 - DNA, 13 bp, Homo sapiens
gatcacagtggcc

SEQ ID NO: 1891827 - DNA, 18 bp, Homo sapiens
gatcacataccagagtct

SEQ ID NO: 1891828 - DNA, 23 bp, Homo sapiens
gatcagcttattgtctagtgaaa

SEQ ID NO: 1891829 - DNA, 18 bp, Homo sapiens
gatcattgcatttccaga

SEQ ID NO: 1891830 - DNA, 23 bp, Homo sapiens
gatccgacttgaattttcccact

SEQ ID NO: 1891831 - DNA, 15 bp, Homo sapiens
gatcctggagcccct

SEQ ID NO: 1891832 - DNA, 19 bp, Homo sapiens
gatcctggagcccctgtgt

SEQ ID NO: 1891833 - DNA, 20 bp, Homo sapiens
gatcggagcctcctctctca

SEQ ID NO: 1891834 - DNA, 13 bp, Homo sapiens
gatctggggaagg

SEQ ID NO: 1891835 - DNA, 21 bp, Homo sapiens
gatctttggacagaagcagct

SEQ ID NO: 1891836 - DNA, 13 bp, Homo sapiens
gatgcactggcct

SEQ ID NO: 1891837 - DNA, 18 bp, Homo sapiens
gatgcagttctgaagaag

SEQ ID NO: 1891838 - DNA, 22 bp, Homo sapiens
gatgggatgtatttttcttgct

SEQ ID NO: 1891839 - DNA, 22 bp, Homo sapiens
gatggttcccttgatgaagaag

SEQ ID NO: 1891840 - DNA, 12 bp, Homo sapiens
gatgtaaagtga

SEQ ID NO: 1891841 - DNA, 20 bp, Homo sapiens
gattacgtgtatgtttcttc

SEQ ID NO: 1891842 - DNA, 16 bp, Homo sapiens
gatttaccacttgtgt

SEQ ID NO: 1891843 - DNA, 22 bp, Homo sapiens
gatttgaggagcagcttcagtt

SEQ ID NO: 1891844 - DNA, 15 bp, Homo sapiens
gattttcctgaaaac

SEQ ID NO: 1891845 - DNA, 22 bp, Homo sapiens
gcaaacctcagtcatattctta

SEQ ID NO: 1891846 - DNA, 22 bp, Homo sapiens
gcaaagtctaaagtttacagta

SEQ ID NO: 1891847 - DNA, 17 bp, Homo sapiens
gcaacagtgttctgagc

SEQ ID NO: 1891848 - DNA, 18 bp, Homo sapiens
gcaacagtgttctgagcc

SEQ ID NO: 1891849 - DNA, 20 bp, Homo sapiens
gcaacagtgttctgagcccc

SEQ ID NO: 1891850 - DNA, 19 bp, Homo sapiens
gcaaggaggctggctgggg

SEQ ID NO: 1891851 - DNA, 20 bp, Homo sapiens
gcaaggaggctggctggggc

SEQ ID NO: 1891852 - DNA, 19 bp, Homo sapiens
gcaaggtgggggagcctgg

SEQ ID NO: 1891853 - DNA, 23 bp, Homo sapiens
gcaaggtgggggagcctggagcc

SEQ ID NO: 1891854 - DNA, 12 bp, Homo sapiens
gcaagtagctgg

SEQ ID NO: 1891855 - DNA, 22 bp, Homo sapiens
gcaatagtcaaattgtgtgaaa

SEQ ID NO: 1891856 - DNA, 18 bp, Homo sapiens
gcaattcatgtaacagtt

SEQ ID NO: 1891857 - DNA, 11 bp, Homo sapiens
gcacagccctc

SEQ ID NO: 1891858 - DNA, 17 bp, Homo sapiens
gcacagccctcccgccc

SEQ ID NO: 1891859 - DNA, 20 bp, Homo sapiens
gcacagcctcttagatgcag

SEQ ID NO: 1891860 - DNA, 17 bp, Homo sapiens
gcacagtgtctgggctg

SEQ ID NO: 1891861 - DNA, 19 bp, Homo sapiens
gcacagtgtctgggctgac

SEQ ID NO: 1891862 - DNA, 20 bp, Homo sapiens
gcaccaacccagccgctgcc

SEQ ID NO: 1891863 - DNA, 18 bp, Homo sapiens
gcaccccctcctgctgca

SEQ ID NO: 1891864 - DNA, 16 bp, Homo sapiens
gcacccgggctcaggg

SEQ ID NO: 1891865 - DNA, 17 bp, Homo sapiens
gcacccgggctcaggga

SEQ ID NO: 1891866 - DNA, 13 bp, Homo sapiens
gcaccctcccctc

SEQ ID NO: 1891867 - DNA, 21 bp, Homo sapiens
gcacctgcaggttgggccata

SEQ ID NO: 1891868 - DNA, 21 bp, Homo sapiens
gcacctggtggggaggaagaa

SEQ ID NO: 1891869 - DNA, 11 bp, Homo sapiens
gcactctgtgc

SEQ ID NO: 1891870 - DNA, 19 bp, Homo sapiens
gcactctgtgcccatgggc

SEQ ID NO: 1891871 - DNA, 15 bp, Homo sapiens
gcactgctgggtggc

SEQ ID NO: 1891872 - DNA, 17 bp, Homo sapiens
gcactgctgggtggccc

SEQ ID NO: 1891873 - DNA, 21 bp, Homo sapiens
gcactgctgggtggcccatcc

SEQ ID NO: 1891874 - DNA, 12 bp, Homo sapiens
gcactgtcctgc

SEQ ID NO: 1891875 - DNA, 16 bp, Homo sapiens
gcactgtcctgctcca

SEQ ID NO: 1891876 - DNA, 20 bp, Homo sapiens
gcactgtcctgctccacagt

SEQ ID NO: 1891877 - DNA, 21 bp, Homo sapiens
gcactgtcctgctccacagtg

SEQ ID NO: 1891878 - DNA, 22 bp, Homo sapiens
gcactgtcctgctccacagtgt

SEQ ID NO: 1891879 - DNA, 15 bp, Homo sapiens
gcagaaagggtaggt

SEQ ID NO: 1891880 - DNA, 21 bp, Homo sapiens
gcagacccatacctttccagg

SEQ ID NO: 1891881 - DNA, 22 bp, Homo sapiens
ctgaacatgagtgtcaactcca

SEQ ID NO: 1891882 - DNA, 15 bp, Homo sapiens
ctgaccatcccatga

SEQ ID NO: 1891883 - DNA, 13 bp, Homo sapiens
ctgactcccatgc

SEQ ID NO: 1891884 - DNA, 18 bp, Homo sapiens
ctgactctgtgctgagca

SEQ ID NO: 1891885 - DNA, 19 bp, Homo sapiens
ctgacttcaggggctgccc

SEQ ID NO: 1891886 - DNA, 20 bp, Homo sapiens
ctgacttcaggggctgcccg

SEQ ID NO: 1891887 - DNA, 19 bp, Homo sapiens
ctgagacggatggaaggag

SEQ ID NO: 1891888 - DNA, 15 bp, Homo sapiens
ctgagactgcagagg

SEQ ID NO: 1891889 - DNA, 17 bp, Homo sapiens
ctgagactgcagaggag

SEQ ID NO: 1891890 - DNA, 18 bp, Homo sapiens
ctgagactgcagaggagc

SEQ ID NO: 1891891 - DNA, 14 bp, Homo sapiens
ctgagagagtggca

SEQ ID NO: 1891892 - DNA, 24 bp, Homo sapiens
ctgagagagtggcattggcagcag

SEQ ID NO: 1891893 - DNA, 22 bp, Homo sapiens
ctgagccctccttcttgccctg

SEQ ID NO: 1891894 - DNA, 18 bp, Homo sapiens
ctgagcctgccccagctg

SEQ ID NO: 1891895 - DNA, 23 bp, Homo sapiens
ctgagcctgccccagctgggctg

SEQ ID NO: 1891896 - DNA, 21 bp, Homo sapiens
ctgagctttaaatcattagag

SEQ ID NO: 1891897 - DNA, 19 bp, Homo sapiens
ctgagctttccggggagga

SEQ ID NO: 1891898 - DNA, 22 bp, Homo sapiens
ctgagctttccggggaggagcc

SEQ ID NO: 1891899 - DNA, 15 bp, Homo sapiens
ctgaggccccaggtg

SEQ ID NO: 1891900 - DNA, 13 bp, Homo sapiens
ctgatgctgggct

SEQ ID NO: 1891901 - DNA, 15 bp, Homo sapiens
ctgatgctgggctgg

SEQ ID NO: 1891902 - DNA, 16 bp, Homo sapiens
ctgatgctgggctggg

SEQ ID NO: 1891903 - DNA, 19 bp, Homo sapiens
ctgatgctgggctgggtgc

SEQ ID NO: 1891904 - DNA, 14 bp, Homo sapiens
ctgatggctgctgg

SEQ ID NO: 1891905 - DNA, 21 bp, Homo sapiens
ctgatggctgctggaggggac

SEQ ID NO: 1891906 - DNA, 21 bp, Homo sapiens
ctgattttttttgtagctgct

SEQ ID NO: 1891907 - DNA, 17 bp, Homo sapiens
ctgcaccaacccagccg

SEQ ID NO: 1891908 - DNA, 21 bp, Homo sapiens
ctgcaccaacccagccgctgc

SEQ ID NO: 1891909 - DNA, 13 bp, Homo sapiens
ctgcaccccctcc

SEQ ID NO: 1891910 - DNA, 17 bp, Homo sapiens
ctgcaccccctcctgct

SEQ ID NO: 1891911 - DNA, 20 bp, Homo sapiens
ctgcaccccctcctgctgca

SEQ ID NO: 1891912 - DNA, 13 bp, Homo sapiens
ctgcactctgtgc

SEQ ID NO: 1891913 - DNA, 17 bp, Homo sapiens
ctgcactctgtgcccat

SEQ ID NO: 1891914 - DNA, 18 bp, Homo sapiens
ctgcactctgtgcccatg

SEQ ID NO: 1891915 - DNA, 21 bp, Homo sapiens
ctgcactctgtgcccatgggc

SEQ ID NO: 1891916 - DNA, 16 bp, Homo sapiens
ctgcactgtcctgctc

SEQ ID NO: 1891917 - DNA, 20 bp, Homo sapiens
ctgcactgtcctgctccaca

SEQ ID NO: 1891918 - DNA, 23 bp, Homo sapiens
ctgcactgtcctgctccacagtg

SEQ ID NO: 1891919 - DNA, 15 bp, Homo sapiens
ctgcagaggagccac

SEQ ID NO: 1891920 - DNA, 20 bp, Homo sapiens
ctgcagaggagccacctggg

SEQ ID NO: 1891921 - DNA, 22 bp, Homo sapiens
ctgcagaggagccacctgggct

SEQ ID NO: 1891922 - DNA, 13 bp, Homo sapiens
ctgcagaggggca

SEQ ID NO: 1891923 - DNA, 15 bp, Homo sapiens
ctgcagaggggcagg

SEQ ID NO: 1891924 - DNA, 14 bp, Homo sapiens
ctgcagcaggcaga

SEQ ID NO: 1891925 - DNA, 19 bp, Homo sapiens
ctgcagcaggcagaggaga

SEQ ID NO: 1891926 - DNA, 14 bp, Homo sapiens
ctgcaggaggcctg

SEQ ID NO: 1891927 - DNA, 16 bp, Homo sapiens
ctgcaggaggcctggg

SEQ ID NO: 1891928 - DNA, 21 bp, Homo sapiens
ctgcaggaggcctgggagggc

SEQ ID NO: 1891929 - DNA, 20 bp, Homo sapiens
ctgcaggttgggccatactg

SEQ ID NO: 1891930 - DNA, 18 bp, Homo sapiens
ctgccacctgccttctca

SEQ ID NO: 1891931 - DNA, 16 bp, Homo sapiens
ctgccacttcccaggt

SEQ ID NO: 1891932 - DNA, 13 bp, Homo sapiens
ctgcccgctccca

SEQ ID NO: 1891933 - DNA, 19 bp, Homo sapiens
ctgcccgctcccagtgtct

SEQ ID NO: 1891934 - DNA, 15 bp, Homo sapiens
ctgcccggcgccctc

SEQ ID NO: 1891935 - DNA, 17 bp, Homo sapiens
ctgcccggcgccctctg

SEQ ID NO: 1891936 - DNA, 23 bp, Homo sapiens
ctgcccggcgccctctgtcctga

SEQ ID NO: 1891937 - DNA, 16 bp, Homo sapiens
ctgcccgttgccgggc

SEQ ID NO: 1891938 - DNA, 19 bp, Homo sapiens
ctgcccgttgccgggcctg

SEQ ID NO: 1891939 - DNA, 21 bp, Homo sapiens
ctgcccgttgccgggcctgga

SEQ ID NO: 1891940 - DNA, 23 bp, Homo sapiens
ctgcccgttgccgggcctggact

SEQ ID NO: 1891941 - DNA, 18 bp, Homo sapiens
ctgcctccactcccactt

SEQ ID NO: 1891942 - DNA, 19 bp, Homo sapiens
ctgcctctacccaaccagg

SEQ ID NO: 1891943 - DNA, 21 bp, Homo sapiens
ctgcctctcgctcctcaaccc

SEQ ID NO: 1891944 - DNA, 19 bp, Homo sapiens
ctgcctcttaaataaacct

SEQ ID NO: 1891945 - DNA, 11 bp, Homo sapiens
ctgcctgggaa

SEQ ID NO: 1891946 - DNA, 14 bp, Homo sapiens
ctgccttgtgtaca

SEQ ID NO: 1891947 - DNA, 13 bp, Homo sapiens
ctgctaccctccc

SEQ ID NO: 1891948 - DNA, 16 bp, Homo sapiens
ctgctaccctccctgc

SEQ ID NO: 1891949 - DNA, 17 bp, Homo sapiens
ctgctaccctccctgct

SEQ ID NO: 1891950 - DNA, 18 bp, Homo sapiens
ctgctaccctccctgctg

SEQ ID NO: 1891951 - DNA, 19 bp, Homo sapiens
ctgctaccctccctgctgt

SEQ ID NO: 1891952 - DNA, 16 bp, Homo sapiens
ctgctatgcattttct

SEQ ID NO: 1891953 - DNA, 20 bp, Homo sapiens
ctgctatgcattttcttcac

SEQ ID NO: 1891954 - DNA, 16 bp, Homo sapiens
ctgctccacagtgttg

SEQ ID NO: 1891955 - DNA, 14 bp, Homo sapiens
ctgctcgggcccag

SEQ ID NO: 1891956 - DNA, 17 bp, Homo sapiens
ctgctcgggcccaggcc

SEQ ID NO: 1891957 - DNA, 21 bp, Homo sapiens
ctgctctccttgccctgggcc

SEQ ID NO: 1891958 - DNA, 15 bp, Homo sapiens
ctgctgagctgtgcc

SEQ ID NO: 1891959 - DNA, 22 bp, Homo sapiens
ctgctgcagaggggcaggccct

SEQ ID NO: 1891960 - DNA, 12 bp, Homo sapiens
ctgctgggctgg

SEQ ID NO: 1891961 - DNA, 14 bp, Homo sapiens
ctgctgggctgggg

SEQ ID NO: 1891962 - DNA, 12 bp, Homo sapiens
ctgctgggtggc

SEQ ID NO: 1891963 - DNA, 18 bp, Homo sapiens
ctgctgggtggcccatcc

SEQ ID NO: 1891964 - DNA, 21 bp, Homo sapiens
ctgctgggtggcccatccccc

SEQ ID NO: 1891965 - DNA, 22 bp, Homo sapiens
ctgctggtaatttgtatctgaa

SEQ ID NO: 1891966 - DNA, 13 bp, Homo sapiens
ctgctgtcccctc

SEQ ID NO: 1891967 - DNA, 20 bp, Homo sapiens
ctgctgtcccctcttgcccc

SEQ ID NO: 1891968 - DNA, 21 bp, Homo sapiens
ctgctgtcccctcttgcccca

SEQ ID NO: 1891969 - DNA, 23 bp, Homo sapiens
ctgctgtcccctcttgccccaac

SEQ ID NO: 1891970 - DNA, 15 bp, Homo sapiens
ctgcttctgggcctg

SEQ ID NO: 1891971 - DNA, 17 bp, Homo sapiens
ctggaatggactgggtg

SEQ ID NO: 1891972 - DNA, 13 bp, Homo sapiens
ctggacctcacca

SEQ ID NO: 1891973 - DNA, 14 bp, Homo sapiens
ctggactgtcctag

SEQ ID NO: 1891974 - DNA, 17 bp, Homo sapiens
ctggagcccctgtgtgg

SEQ ID NO: 1891975 - DNA, 19 bp, Homo sapiens
ctggagcccctgtgtggga

SEQ ID NO: 1891976 - DNA, 23 bp, Homo sapiens
ctggagctccgatttaactggga

SEQ ID NO: 1891977 - DNA, 13 bp, Homo sapiens
ctggagctgagct

SEQ ID NO: 1891978 - DNA, 15 bp, Homo sapiens
ctggaggctcccatg

SEQ ID NO: 1891979 - DNA, 15 bp, Homo sapiens
ctggaggggacgctg

SEQ ID NO: 1891980 - DNA, 16 bp, Homo sapiens
ctggaggggacgctgg

SEQ ID NO: 1891981 - DNA, 21 bp, Homo sapiens
ctggaggtggcgccccctggt

SEQ ID NO: 1891982 - DNA, 14 bp, Homo sapiens
ctggagtgctggct

SEQ ID NO: 1891983 - DNA, 15 bp, Homo sapiens
ctggagtgctggctc

SEQ ID NO: 1891984 - DNA, 16 bp, Homo sapiens
ctggagtgctggctcc

SEQ ID NO: 1891985 - DNA, 16 bp, Homo sapiens
ctggatgaccccatgc

SEQ ID NO: 1891986 - DNA, 14 bp, Homo sapiens
ctggccagaggcag

SEQ ID NO: 1891987 - DNA, 14 bp, Homo sapiens
ctggccagccccac

SEQ ID NO: 1891988 - DNA, 18 bp, Homo sapiens
ctggccagccccacagcc

SEQ ID NO: 1891989 - DNA, 22 bp, Homo sapiens
ctggcccagctcccccgggagg

SEQ ID NO: 1891990 - DNA, 16 bp, Homo sapiens
ctggcccatcagtgta

SEQ ID NO: 1891991 - DNA, 13 bp, Homo sapiens
ctggccccctccc

SEQ ID NO: 1891992 - DNA, 16 bp, Homo sapiens
ctggccccctccctgg

SEQ ID NO: 1891993 - DNA, 17 bp, Homo sapiens
ctggccccctccctgga

SEQ ID NO: 1891994 - DNA, 19 bp, Homo sapiens
gccgggaccccgagcctgg

SEQ ID NO: 1891995 - DNA, 18 bp, Homo sapiens
gcctatcagtgtgccccc

SEQ ID NO: 1891996 - DNA, 23 bp, Homo sapiens
gcctcaaacagccacgaggtggt

SEQ ID NO: 1891997 - DNA, 23 bp, Homo sapiens
gcctccgttcccacctctgagga

SEQ ID NO: 1891998 - DNA, 14 bp, Homo sapiens
gcctcgcccaccgc

SEQ ID NO: 1891999 - DNA, 15 bp, Homo sapiens
gcctcgcccaccgca

SEQ ID NO: 1892000 - DNA, 13 bp, Homo sapiens
gcctcgcctggcc

SEQ ID NO: 1892001 - DNA, 19 bp, Homo sapiens
gcctctgtgtcactggctg

SEQ ID NO: 1892002 - DNA, 14 bp, Homo sapiens
gggctaggggctgg

SEQ ID NO: 1892003 - DNA, 16 bp, Homo sapiens
gggctaggggctgggg

SEQ ID NO: 1892004 - DNA, 20 bp, Homo sapiens
gggctcagggaccacagcaa

SEQ ID NO: 1892005 - DNA, 15 bp, Homo sapiens
gggctcctgtgccct

SEQ ID NO: 1892006 - DNA, 11 bp, Homo sapiens
gggctctgtgg

SEQ ID NO: 1892007 - DNA, 16 bp, Homo sapiens
gggctctgtgggctgc

SEQ ID NO: 1892008 - DNA, 19 bp, Homo sapiens
gggctctgtgggctgcact

SEQ ID NO: 1892009 - DNA, 16 bp, Homo sapiens
gggctgcactctgtgc

SEQ ID NO: 1892010 - DNA, 14 bp, Homo sapiens
gggctgcccgctcc

SEQ ID NO: 1892011 - DNA, 14 bp, Homo sapiens
ggggaaggaccaac

SEQ ID NO: 1892012 - DNA, 15 bp, Homo sapiens
ggggaaggccttgct

SEQ ID NO: 1892013 - DNA, 14 bp, Homo sapiens
ggggagcctggagc

SEQ ID NO: 1892014 - DNA, 13 bp, Homo sapiens
ggggaggagcctt

SEQ ID NO: 1892015 - DNA, 14 bp, Homo sapiens
ggggaggctctgaa

SEQ ID NO: 1892016 - DNA, 17 bp, Homo sapiens
ggggaggctgagactgc

SEQ ID NO: 1892017 - DNA, 15 bp, Homo sapiens
ggggatcctggagcc

SEQ ID NO: 1892018 - DNA, 21 bp, Homo sapiens
ggggcaggaatcaaggagcct

SEQ ID NO: 1892019 - DNA, 22 bp, Homo sapiens
ggggcaggaatcaaggagcctc

SEQ ID NO: 1892020 - DNA, 15 bp, Homo sapiens
ggggcaggccctgca

SEQ ID NO: 1892021 - DNA, 16 bp, Homo sapiens
ggggcaggccctgcac

SEQ ID NO: 1892022 - DNA, 17 bp, Homo sapiens
ggggcatgggggaggct

SEQ ID NO: 1892023 - DNA, 18 bp, Homo sapiens
ggggccaaataaagtctc

SEQ ID NO: 1892024 - DNA, 15 bp, Homo sapiens
ggggcccgcttgcct

SEQ ID NO: 1892025 - DNA, 20 bp, Homo sapiens
ggggcccgcttgcctcggct

SEQ ID NO: 1892026 - DNA, 21 bp, Homo sapiens
ggggcccgcttgcctcggctc

SEQ ID NO: 1892027 - DNA, 23 bp, Homo sapiens
ggggcccggatccaggattctgg

SEQ ID NO: 1892028 - DNA, 22 bp, Homo sapiens
ggggcccgttgtctccctggcc

SEQ ID NO: 1892029 - DNA, 23 bp, Homo sapiens
ggggcctatcagtgtgcccccca

SEQ ID NO: 1892030 - DNA, 16 bp, Homo sapiens
ggggctaggggctggg

SEQ ID NO: 1892031 - DNA, 12 bp, Homo sapiens
ggggctcaggat

SEQ ID NO: 1892032 - DNA, 13 bp, Homo sapiens
ggggctgcccgct

SEQ ID NO: 1892033 - DNA, 23 bp, Homo sapiens
ggggctgcccgctcccagtgtct

SEQ ID NO: 1892034 - DNA, 21 bp, Homo sapiens
ggggctggggccaaataaagt

SEQ ID NO: 1892035 - DNA, 22 bp, Homo sapiens
ggggctgggttggcgcaccctc

SEQ ID NO: 1892036 - DNA, 15 bp, Homo sapiens
ggggctttggaagct

SEQ ID NO: 1892037 - DNA, 19 bp, Homo sapiens
gggggaagagcacagccct

SEQ ID NO: 1892038 - DNA, 18 bp, Homo sapiens
gggggcatgggggaggct

SEQ ID NO: 1892039 - DNA, 21 bp, Homo sapiens
ggggtctcagtccagtcctca

SEQ ID NO: 1892040 - DNA, 17 bp, Homo sapiens
ggggtctccctgagcct

SEQ ID NO: 1892041 - DNA, 21 bp, Homo sapiens
gggtaataaacttagaataaa

SEQ ID NO: 1892042 - DNA, 16 bp, Homo sapiens
gggtcctacggaggga

SEQ ID NO: 1892043 - DNA, 18 bp, Homo sapiens
gggtcctacggagggacc

SEQ ID NO: 1892044 - DNA, 13 bp, Homo sapiens
gggtgtgccctgg

SEQ ID NO: 1892045 - DNA, 15 bp, Homo sapiens
gggtgtgccctggct

SEQ ID NO: 1892046 - DNA, 13 bp, Homo sapiens
gggttaagaaata

SEQ ID NO: 1892047 - DNA, 20 bp, Homo sapiens
gggttggcgcaccctcccct

SEQ ID NO: 1892048 - DNA, 21 bp, Homo sapiens
gggtttcattgtgtgttagca

SEQ ID NO: 1892049 - DNA, 15 bp, Homo sapiens
ggtaataaacttaga

SEQ ID NO: 1892050 - DNA, 22 bp, Homo sapiens
ggtagacacacatgaagtccaa

SEQ ID NO: 1892051 - DNA, 22 bp, Homo sapiens
ggtaggccttggcccacctgag

SEQ ID NO: 1892052 - DNA, 21 bp, Homo sapiens
ggtagtggaggaggtggcttc

SEQ ID NO: 1892053 - DNA, 22 bp, Homo sapiens
ggtcaatgacacccctggcctg

SEQ ID NO: 1892054 - DNA, 12 bp, Homo sapiens
ggtcagtgcctt

SEQ ID NO: 1892055 - DNA, 22 bp, Homo sapiens
ggtcagtgccttttggaactgt

SEQ ID NO: 1892056 - DNA, 22 bp, Homo sapiens
ggtctaggactttagggatctg

SEQ ID NO: 1892057 - DNA, 20 bp, Homo sapiens
ggtctcgctgatgctgggct

SEQ ID NO: 1892058 - DNA, 22 bp, Homo sapiens
ggtctcgctgatgctgggctgg

SEQ ID NO: 1892059 - DNA, 17 bp, Homo sapiens
ggtctgctcgggcccag

SEQ ID NO: 1892060 - DNA, 19 bp, Homo sapiens
ggtctgctcgggcccaggc

SEQ ID NO: 1892061 - DNA, 21 bp, Homo sapiens
ggtgaccccttttcagcttct

SEQ ID NO: 1892062 - DNA, 12 bp, Homo sapiens
ggtgaggcaggg

SEQ ID NO: 1892063 - DNA, 17 bp, Homo sapiens
ggtgaggcaggggagtc

SEQ ID NO: 1892064 - DNA, 14 bp, Homo sapiens
ggtgcgaccccatc

SEQ ID NO: 1892065 - DNA, 13 bp, Homo sapiens
ggtgctgctaccc

SEQ ID NO: 1892066 - DNA, 16 bp, Homo sapiens
ggtgctgctaccctcc

SEQ ID NO: 1892067 - DNA, 19 bp, Homo sapiens
ggtgctgctaccctccctg

SEQ ID NO: 1892068 - DNA, 17 bp, Homo sapiens
ggtggctcttgcctgta

SEQ ID NO: 1892069 - DNA, 14 bp, Homo sapiens
ggtgggggagcctg

SEQ ID NO: 1892070 - DNA, 15 bp, Homo sapiens
ggtgggggagcctgg

SEQ ID NO: 1892071 - DNA, 17 bp, Homo sapiens
ggtgggtttagcaggct

SEQ ID NO: 1892072 - DNA, 16 bp, Homo sapiens
ggtggtaccaggtctc

SEQ ID NO: 1892073 - DNA, 22 bp, Homo sapiens
ggtggtaccaggtctcctccac

SEQ ID NO: 1892074 - DNA, 15 bp, Homo sapiens
ggtggtagctctgag

SEQ ID NO: 1892075 - DNA, 22 bp, Homo sapiens
ggtggtctgctcgggcccaggc

SEQ ID NO: 1892076 - DNA, 15 bp, Homo sapiens
ggtgtcgcgccttct

SEQ ID NO: 1892077 - DNA, 11 bp, Homo sapiens
ggtgtgccctg

SEQ ID NO: 1892078 - DNA, 15 bp, Homo sapiens
ggtgtgccctggctc

SEQ ID NO: 1892079 - DNA, 17 bp, Homo sapiens
ggtgtgccctggctccc

SEQ ID NO: 1892080 - DNA, 23 bp, Homo sapiens
ggttatttagtaaagtttgttga

SEQ ID NO: 1892081 - DNA, 20 bp, Homo sapiens
ggttcttttttcagttattt

SEQ ID NO: 1892082 - DNA, 20 bp, Homo sapiens
ggttggcgcaccctcccctc

SEQ ID NO: 1892083 - DNA, 14 bp, Homo sapiens
ggttgtgaaatgta

SEQ ID NO: 1892084 - DNA, 15 bp, Homo sapiens
ggttgtgaaatgtaa

SEQ ID NO: 1892085 - DNA, 20 bp, Homo sapiens
ggttttattttgtaattatt

SEQ ID NO: 1892086 - DNA, 15 bp, Homo sapiens
gtaaaattgtataga

SEQ ID NO: 1892087 - DNA, 22 bp, Homo sapiens
gtaaagtatcaggatactatat

SEQ ID NO: 1892088 - DNA, 12 bp, Homo sapiens
gtaaataaagct

SEQ ID NO: 1892089 - DNA, 17 bp, Homo sapiens
gtaactcaccagcctct

SEQ ID NO: 1892090 - DNA, 14 bp, Homo sapiens
gtaactttaaacat

SEQ ID NO: 1892091 - DNA, 17 bp, Homo sapiens
gtaactttaaacatcta

SEQ ID NO: 1892092 - DNA, 20 bp, Homo sapiens
gtaactttaaacatctagca

SEQ ID NO: 1892093 - DNA, 13 bp, Homo sapiens
gtaatatattgct

SEQ ID NO: 1892094 - DNA, 18 bp, Homo sapiens
gtaatatattgctgctgg

SEQ ID NO: 1892095 - DNA, 19 bp, Homo sapiens
gtaatgataactggaaact

SEQ ID NO: 1892096 - DNA, 23 bp, Homo sapiens
gtaattattgtgatttcccgtgg

SEQ ID NO: 1892097 - DNA, 14 bp, Homo sapiens
gtaatttgtatctg

SEQ ID NO: 1892098 - DNA, 16 bp, Homo sapiens
gtacagttcagttcct

SEQ ID NO: 1892099 - DNA, 22 bp, Homo sapiens
gtacagttcagttcctctttgc

SEQ ID NO: 1892100 - DNA, 19 bp, Homo sapiens
gtaccaggtctcctccacc

SEQ ID NO: 1892101 - DNA, 19 bp, Homo sapiens
gtacccccagcccaagaga

SEQ ID NO: 1892102 - DNA, 21 bp, Homo sapiens
gtaccgatgatactgtttctt

SEQ ID NO: 1892103 - DNA, 16 bp, Homo sapiens
gtacgtgggagaggca

SEQ ID NO: 1892104 - DNA, 16 bp, Homo sapiens
gtactcctcacttttc

SEQ ID NO: 1892105 - DNA, 21 bp, Homo sapiens
gtactcctcacttttcaattt

SEQ ID NO: 1892106 - DNA, 15 bp, Homo sapiens
gtactgaggtggtgg

SEQ ID NO: 1892107 - DNA, 13 bp, Homo sapiens
gtactgcagcctc

SEQ ID NO: 1892108 - DNA, 14 bp, Homo sapiens
gtactgccaaggta

SEQ ID NO: 1892109 - DNA, 21 bp, Homo sapiens
gtacttcaaatccttgaagat

SEQ ID NO: 1892110 - DNA, 22 bp, Homo sapiens
gtacttcaaatccttgaagatt

SEQ ID NO: 1892111 - DNA, 18 bp, Homo sapiens
gtagaaaagaaaacattt

SEQ ID NO: 1892112 - DNA, 19 bp, Homo sapiens
gtagaatttttaaaaaagt

SEQ ID NO: 1892113 - DNA, 12 bp, Homo sapiens
gtagctctgagc

SEQ ID NO: 1892114 - DNA, 15 bp, Homo sapiens
gtagctctgagccct

SEQ ID NO: 1892115 - DNA, 17 bp, Homo sapiens
gtaggagagactggcca

SEQ ID NO: 1892116 - DNA, 13 bp, Homo sapiens
gtaggtgctggcc

SEQ ID NO: 1892117 - DNA, 19 bp, Homo sapiens
tatataagaaaaaattctt

SEQ ID NO: 1892118 - DNA, 12 bp, Homo sapiens
tatatcttgttt

SEQ ID NO: 1892119 - DNA, 23 bp, Homo sapiens
tatatttattactgtaagaaaat

SEQ ID NO: 1892120 - DNA, 14 bp, Homo sapiens
tatatttgaaatat

SEQ ID NO: 1892121 - DNA, 20 bp, Homo sapiens
tatatttgaaatattgactt

SEQ ID NO: 1892122 - DNA, 23 bp, Homo sapiens
tatattttaagccttcatttgca

SEQ ID NO: 1892123 - DNA, 20 bp, Homo sapiens
tatattttgattttacatgc

SEQ ID NO: 1892124 - DNA, 15 bp, Homo sapiens
tatcagggatcctct

SEQ ID NO: 1892125 - DNA, 15 bp, Homo sapiens
tatccacaaagtact

SEQ ID NO: 1892126 - DNA, 21 bp, Homo sapiens
tatctgaggcacatgtcagca

SEQ ID NO: 1892127 - DNA, 16 bp, Homo sapiens
tatgattaagtaatga

SEQ ID NO: 1892128 - DNA, 17 bp, Homo sapiens
tatgcattttcttcaca

SEQ ID NO: 1892129 - DNA, 20 bp, Homo sapiens
tatgcattttcttcacagtg

SEQ ID NO: 1892130 - DNA, 21 bp, Homo sapiens
tatgcattttcttcacagtgc

SEQ ID NO: 1892131 - DNA, 16 bp, Homo sapiens
tatgcctctgtattta

SEQ ID NO: 1892132 - DNA, 19 bp, Homo sapiens
tatgtcatgcctcactttc

SEQ ID NO: 1892133 - DNA, 17 bp, Homo sapiens
tatgtcatttattttgt

SEQ ID NO: 1892134 - DNA, 19 bp, Homo sapiens
tatgttagtgcaaattgtc

SEQ ID NO: 1892135 - DNA, 22 bp, Homo sapiens
tatgtttcttctttcttttaag

SEQ ID NO: 1892136 - DNA, 22 bp, Homo sapiens
tattaaatgtatatgtcattta

SEQ ID NO: 1892137 - DNA, 12 bp, Homo sapiens
tattaatctgtt

SEQ ID NO: 1892138 - DNA, 20 bp, Homo sapiens
tattattactctacactgaa

SEQ ID NO: 1892139 - DNA, 22 bp, Homo sapiens
tattattttagcttcagttgtt

SEQ ID NO: 1892140 - DNA, 22 bp, Homo sapiens
tattcagagttagatattattt

SEQ ID NO: 1892141 - DNA, 17 bp, Homo sapiens
tattcaggaaaagcctc

SEQ ID NO: 1892142 - DNA, 22 bp, Homo sapiens
tattcctgtggatgtaaagtga

SEQ ID NO: 1892143 - DNA, 10 bp, Homo sapiens
tattctagtc

SEQ ID NO: 1892144 - DNA, 23 bp, Homo sapiens
tattgattacaaataaacagttg

SEQ ID NO: 1892145 - DNA, 17 bp, Homo sapiens
tattgtctagtgaaact

SEQ ID NO: 1892146 - DNA, 21 bp, Homo sapiens
tatttacatgaattgcatttt

SEQ ID NO: 1892147 - DNA, 13 bp, Homo sapiens
tatttattactgt

SEQ ID NO: 1892148 - DNA, 14 bp, Homo sapiens
tatttattactgta

SEQ ID NO: 1892149 - DNA, 18 bp, Homo sapiens
tatttattttaataatgt

SEQ ID NO: 1892150 - DNA, 17 bp, Homo sapiens
tatttcatgaaaattgt

SEQ ID NO: 1892151 - DNA, 13 bp, Homo sapiens
tatttctatgaaa

SEQ ID NO: 1892152 - DNA, 15 bp, Homo sapiens
tatttctatgaaata

SEQ ID NO: 1892153 - DNA, 19 bp, Homo sapiens
tatttcttaaatctagtaa

SEQ ID NO: 1892154 - DNA, 12 bp, Homo sapiens
tccatataaata

SEQ ID NO: 1892155 - DNA, 14 bp, Homo sapiens
tccatccctggccc

SEQ ID NO: 1892156 - DNA, 24 bp, Homo sapiens
tccatccctggccccctccctgga

SEQ ID NO: 1892157 - DNA, 20 bp, Homo sapiens
tcccaattcatcctcactca

SEQ ID NO: 1892158 - DNA, 16 bp, Homo sapiens
tcccacctctgaggac

SEQ ID NO: 1892159 - DNA, 20 bp, Homo sapiens
tcccacctctgaggactctg

SEQ ID NO: 1892160 - DNA, 13 bp, Homo sapiens
tcccactgcaccc

SEQ ID NO: 1892161 - DNA, 20 bp, Homo sapiens
tcccactgcaccccctcctg

SEQ ID NO: 1892162 - DNA, 17 bp, Homo sapiens
tcccacttccctgacac

SEQ ID NO: 1892163 - DNA, 20 bp, Homo sapiens
tcccaggggtctccctgagc

SEQ ID NO: 1892164 - DNA, 22 bp, Homo sapiens
tcccaggggtctccctgagcct

SEQ ID NO: 1892165 - DNA, 18 bp, Homo sapiens
tccccaacatgtaataag

SEQ ID NO: 1892166 - DNA, 14 bp, Homo sapiens
tcccccccggggct

SEQ ID NO: 1892167 - DNA, 12 bp, Homo sapiens
tcccccctcacc

SEQ ID NO: 1892168 - DNA, 20 bp, Homo sapiens
tccccgagggatgatgccac

SEQ ID NO: 1892169 - DNA, 18 bp, Homo sapiens
tcccctccatccctggcc

SEQ ID NO: 1892170 - DNA, 20 bp, Homo sapiens
tcccctccatccctggcccc

SEQ ID NO: 1892171 - DNA, 15 bp, Homo sapiens
tcccctcttgcccca

SEQ ID NO: 1892172 - DNA, 24 bp, Homo sapiens
tcccctttgcttcattcaagtcag

SEQ ID NO: 1892173 - DNA, 13 bp, Homo sapiens
tcccgtggcccca

SEQ ID NO: 1892174 - DNA, 19 bp, Homo sapiens
tcccgtggccccagcctgg

SEQ ID NO: 1892175 - DNA, 24 bp, Homo sapiens
tcccgtggccccagcctggcccag

SEQ ID NO: 1892176 - DNA, 22 bp, Homo sapiens
tccctgacactgcggggcttgg

SEQ ID NO: 1892177 - DNA, 23 bp, Homo sapiens
tccctgacactgcggggcttggc

SEQ ID NO: 1892178 - DNA, 11 bp, Homo sapiens
tccctgagcct

SEQ ID NO: 1892179 - DNA, 13 bp, Homo sapiens
tccctggtccctt

SEQ ID NO: 1892180 - DNA, 19 bp, Homo sapiens
tccctggtcccttggagac

SEQ ID NO: 1892181 - DNA, 19 bp, Homo sapiens
tccgttcccacctctgagg

SEQ ID NO: 1892182 - DNA, 17 bp, Homo sapiens
tcctacacccttggact

SEQ ID NO: 1892183 - DNA, 20 bp, Homo sapiens
tcctacattaattatctagt

SEQ ID NO: 1892184 - DNA, 15 bp, Homo sapiens
tcctacccctcccag

SEQ ID NO: 1892185 - DNA, 13 bp, Homo sapiens
tcctagatgctct

SEQ ID NO: 1892186 - DNA, 22 bp, Homo sapiens
tcctcaccttttcccggggagg

SEQ ID NO: 1892187 - DNA, 21 bp, Homo sapiens
tcctcagatccccagctttct

SEQ ID NO: 1892188 - DNA, 22 bp, Homo sapiens
tcctcagatccccagctttctc

SEQ ID NO: 1892189 - DNA, 23 bp, Homo sapiens
tcctccaccgccatggcttccaa

SEQ ID NO: 1892190 - DNA, 20 bp, Homo sapiens
tcctctgctatgcattttct

SEQ ID NO: 1892191 - DNA, 22 bp, Homo sapiens
tcctgaaaacccttgccatgtg

SEQ ID NO: 1892192 - DNA, 16 bp, Homo sapiens
tcctgctccacagtgt

SEQ ID NO: 1892193 - DNA, 17 bp, Homo sapiens
tcctggcaatagtcaaa

SEQ ID NO: 1892194 - DNA, 13 bp, Homo sapiens
tgccccccatcct

SEQ ID NO: 1892195 - DNA, 14 bp, Homo sapiens
tgccccccatcctg

SEQ ID NO: 1892196 - DNA, 18 bp, Homo sapiens
tgccccccatcctggccc

SEQ ID NO: 1892197 - DNA, 19 bp, Homo sapiens
tgccccccatcctggccca

SEQ ID NO: 1892198 - DNA, 21 bp, Homo sapiens
tgccccccatcctggcccatc

SEQ ID NO: 1892199 - DNA, 15 bp, Homo sapiens
tgccccctcgtgcca

SEQ ID NO: 1892200 - DNA, 17 bp, Homo sapiens
tgccccctcgtgccagt

SEQ ID NO: 1892201 - DNA, 14 bp, Homo sapiens
tgcccgctcccagt

SEQ ID NO: 1892202 - DNA, 18 bp, Homo sapiens
tgcccgctgtcccagggg

SEQ ID NO: 1892203 - DNA, 18 bp, Homo sapiens
tgcccggcgccctctgtc

SEQ ID NO: 1892204 - DNA, 21 bp, Homo sapiens
tgcccggcgccctctgtcctg

SEQ ID NO: 1892205 - DNA, 21 bp, Homo sapiens
tgcccgttgccgggcctggac

SEQ ID NO: 1892206 - DNA, 15 bp, Homo sapiens
tgccctgccaagcct

SEQ ID NO: 1892207 - DNA, 16 bp, Homo sapiens
tgccctgccaagcctg

SEQ ID NO: 1892208 - DNA, 20 bp, Homo sapiens
tgccctgccaagcctggagc

SEQ ID NO: 1892209 - DNA, 13 bp, Homo sapiens
tgccctgggccag

SEQ ID NO: 1892210 - DNA, 21 bp, Homo sapiens
tgcccttttcatctccagtgt

SEQ ID NO: 1892211 - DNA, 23 bp, Homo sapiens
tgcccttttcatctccagtgtga

SEQ ID NO: 1892212 - DNA, 18 bp, Homo sapiens
tgccgccgcctcgcccac

SEQ ID NO: 1892213 - DNA, 13 bp, Homo sapiens
tgcctccactccc

SEQ ID NO: 1892214 - DNA, 17 bp, Homo sapiens
tgcctccactcccactt

SEQ ID NO: 1892215 - DNA, 14 bp, Homo sapiens
tgcctcggctcctg

SEQ ID NO: 1892216 - DNA, 18 bp, Homo sapiens
tgcctcggctcctgctgc

SEQ ID NO: 1892217 - DNA, 20 bp, Homo sapiens
tgcctctcgctcctcaaccc

SEQ ID NO: 1892218 - DNA, 18 bp, Homo sapiens
tgcctgaccatcccatga

SEQ ID NO: 1892219 - DNA, 23 bp, Homo sapiens
tgcctgaccatcccatgagcagt

SEQ ID NO: 1892220 - DNA, 21 bp, Homo sapiens
tgcctgactctgtgctgagca

SEQ ID NO: 1892221 - DNA, 18 bp, Homo sapiens
tgcctgattcggctgtct

SEQ ID NO: 1892222 - DNA, 19 bp, Homo sapiens
tgcctgattcggctgtctc

SEQ ID NO: 1892223 - DNA, 22 bp, Homo sapiens
tgcctgctctccttgccctggg

SEQ ID NO: 1892224 - DNA, 18 bp, Homo sapiens
tgcctggaagagcagccc

SEQ ID NO: 1892225 - DNA, 19 bp, Homo sapiens
tgcctggaagagcagccct

SEQ ID NO: 1892226 - DNA, 19 bp, Homo sapiens
tgccttgtgtacagttatt

SEQ ID NO: 1892227 - DNA, 11 bp, Homo sapiens
tgcctttccag

SEQ ID NO: 1892228 - DNA, 22 bp, Homo sapiens
tgcgaaacaacttgtgttctat

SEQ ID NO: 1892229 - DNA, 19 bp, Homo sapiens
tgcgaccccatctgcccag

SEQ ID NO: 1892230 - DNA, 14 bp, Homo sapiens
tgcggtgaggcagg

SEQ ID NO: 1892231 - DNA, 15 bp, Homo sapiens
tgcggtgaggcaggg

SEQ ID NO: 1892232 - DNA, 16 bp, Homo sapiens
tgcggtgaggcagggg

SEQ ID NO: 1892233 - DNA, 23 bp, Homo sapiens
tgcggtgaggcaggggagtctgc

SEQ ID NO: 1892234 - DNA, 19 bp, Homo sapiens
tgctagggtgcctgctctc

SEQ ID NO: 1892235 - DNA, 16 bp, Homo sapiens
tgctagtaattggaaa

SEQ ID NO: 1892236 - DNA, 23 bp, Homo sapiens
tgctatagatttgtattttaaaa

SEQ ID NO: 1892237 - DNA, 16 bp, Homo sapiens
tgctatattttcatga

SEQ ID NO: 1892238 - DNA, 22 bp, Homo sapiens
tgctatcgcaccactgtgtatt

SEQ ID NO: 1892239 - DNA, 20 bp, Homo sapiens
tgctcagcttctccaacaat

SEQ ID NO: 1892240 - DNA, 12 bp, Homo sapiens
tgctccacagtg

SEQ ID NO: 1892241 - DNA, 15 bp, Homo sapiens
tgctcgggcccaggc

SEQ ID NO: 1892242 - DNA, 15 bp, Homo sapiens
tgctctccttgccct

SEQ ID NO: 1892243 - DNA, 15 bp, Homo sapiens
tgctgagctgtgccc

SEQ ID NO: 1892244 - DNA, 17 bp, Homo sapiens
tgctgcaccaacccagc

SEQ ID NO: 1892245 - DNA, 22 bp, Homo sapiens
tgctgcagaggggcaggccctg

SEQ ID NO: 1892246 - DNA, 23 bp, Homo sapiens
tgctgcagaggggcaggccctgc

SEQ ID NO: 1892247 - DNA, 21 bp, Homo sapiens
tgctgctaccctccctgctgt

SEQ ID NO: 1892248 - DNA, 22 bp, Homo sapiens
tgctgctatggacgacctccag

SEQ ID NO: 1892249 - DNA, 15 bp, Homo sapiens
tgctgcttctgggcc

SEQ ID NO: 1892250 - DNA, 17 bp, Homo sapiens
tgctggctccacgccct

SEQ ID NO: 1892251 - DNA, 20 bp, Homo sapiens
tgctggctccacgccctggg

SEQ ID NO: 1892252 - DNA, 14 bp, Homo sapiens
tgctgggtggccca

SEQ ID NO: 1892253 - DNA, 16 bp, Homo sapiens
tgctgggtggcccatc

SEQ ID NO: 1892254 - DNA, 20 bp, Homo sapiens
tgctgggtggcccatccccc

SEQ ID NO: 1892255 - DNA, 18 bp, Homo sapiens
tgctggtgagccaagcag

SEQ ID NO: 1892256 - DNA, 22 bp, Homo sapiens
tgctgtattttaaaagaatgat

SEQ ID NO: 1892257 - DNA, 15 bp, Homo sapiens
tgctgtcatgtgaat

SEQ ID NO: 1892258 - DNA, 15 bp, Homo sapiens
tgctgtcccctcttg

SEQ ID NO: 1892259 - DNA, 20 bp, Homo sapiens
tgctgtcccctcttgcccca

SEQ ID NO: 1892260 - DNA, 21 bp, Homo sapiens
tgctgtcccctcttgccccaa

SEQ ID NO: 1892261 - DNA, 14 bp, Homo sapiens
tgcttccaagccct

SEQ ID NO: 1892262 - DNA, 22 bp, Homo sapiens
tgcttccaagcccttccctctg

SEQ ID NO: 1892263 - DNA, 15 bp, Homo sapiens
tgcttctgggcctga

SEQ ID NO: 1892264 - DNA, 16 bp, Homo sapiens
tgcttctgggcctgat

SEQ ID NO: 1892265 - DNA, 17 bp, Homo sapiens
tgcttctgttttataat

SEQ ID NO: 1892266 - DNA, 22 bp, Homo sapiens
tgcttgctggtactaagaggct

SEQ ID NO: 1892267 - DNA, 23 bp, Homo sapiens
tggaaacttcagcggtttatata

SEQ ID NO: 1892268 - DNA, 22 bp, Homo sapiens
tggaaattgggtgtgccctggc

SEQ ID NO: 1892269 - DNA, 23 bp, Homo sapiens
tggaagctctgttgcaggtgtcc

SEQ ID NO: 1892270 - DNA, 12 bp, Homo sapiens
tggaaggagaga

SEQ ID NO: 1892271 - DNA, 17 bp, Homo sapiens
tggacagaagcagctct

SEQ ID NO: 1892272 - DNA, 15 bp, Homo sapiens
tggactgggtgccac

SEQ ID NO: 1892273 - DNA, 15 bp, Homo sapiens
tggacttagctctga

SEQ ID NO: 1892274 - DNA, 17 bp, Homo sapiens
tggagaaacaggcccag

SEQ ID NO: 1892275 - DNA, 14 bp, Homo sapiens
tggagaggagaaca

SEQ ID NO: 1892276 - DNA, 15 bp, Homo sapiens
tggagcccctgtgtc

SEQ ID NO: 1892277 - DNA, 22 bp, Homo sapiens
tggagcccctgtgtgggagggc

SEQ ID NO: 1892278 - DNA, 21 bp, Homo sapiens
tggagctcgtggaacagttac

SEQ ID NO: 1892279 - DNA, 21 bp, Homo sapiens
tggagctcgtgggacagtcac

SEQ ID NO: 1892280 - DNA, 23 bp, Homo sapiens
tggaggtggcgccccctggtggg

SEQ ID NO: 1892281 - DNA, 16 bp, Homo sapiens
tggagtgctggctcca

SEQ ID NO: 1892282 - DNA, 20 bp, Homo sapiens
tggcaatagtcaaattgtgt

SEQ ID NO: 1892283 - DNA, 16 bp, Homo sapiens
tggcacagtgtctggg

SEQ ID NO: 1892284 - DNA, 18 bp, Homo sapiens
tggcacagtgtctgggct

SEQ ID NO: 1892285 - DNA, 20 bp, Homo sapiens
tggcacagtgtctgggctga

SEQ ID NO: 1892286 - DNA, 15 bp, Homo sapiens
tggcactagtatttc

SEQ ID NO: 1892287 - DNA, 15 bp, Homo sapiens
tggcagcaggtgctg

SEQ ID NO: 1892288 - DNA, 16 bp, Homo sapiens
tggcagcaggtgctgc

SEQ ID NO: 1892289 - DNA, 20 bp, Homo sapiens
tggcagcaggtgctgctacc

SEQ ID NO: 1892290 - DNA, 14 bp, Homo sapiens
tggcagggaagctt

SEQ ID NO: 1892291 - DNA, 13 bp, Homo sapiens
tggcattggcagc

SEQ ID NO: 1892292 - DNA, 20 bp, Homo sapiens
tggcattggcagcaggtgct

SEQ ID NO: 1892293 - DNA, 21 bp, Homo sapiens
tggcattggcagcaggtgctg

SEQ ID NO: 1892294 - DNA, 14 bp, Homo sapiens
tggccagaggcagc

SEQ ID NO: 1892295 - DNA, 15 bp, Homo sapiens
tggccagaggcagct

SEQ ID NO: 1892296 - DNA, 15 bp, Homo sapiens
tggccagccccacag

SEQ ID NO: 1892297 - DNA, 17 bp, Homo sapiens
tggccagccccacagcc

SEQ ID NO: 1892298 - DNA, 18 bp, Homo sapiens
tggccagccccacagccc

SEQ ID NO: 1892299 - DNA, 19 bp, Homo sapiens
tggccagccccacagccca

SEQ ID NO: 1892300 - DNA, 22 bp, Homo sapiens
tggcccagctcccccgggaggg

SEQ ID NO: 1892301 - DNA, 12 bp, Homo sapiens
tggcccatcagt

SEQ ID NO: 1892302 - DNA, 12 bp, Homo sapiens
tggcccatcccc

SEQ ID NO: 1892303 - DNA, 16 bp, Homo sapiens
tggcccatcccccctc

SEQ ID NO: 1892304 - DNA, 20 bp, Homo sapiens
tggccccagcctggcccagc

SEQ ID NO: 1892305 - DNA, 19 bp, Homo sapiens
tggccctcaaggcctccca

SEQ ID NO: 1892306 - DNA, 22 bp, Homo sapiens
tggccctcaaggcctcccacag

SEQ ID NO: 1892307 - DNA, 15 bp, Homo sapiens
tggccgggaccccga

SEQ ID NO: 1892308 - DNA, 17 bp, Homo sapiens
tggcctcgcctggcctg

SEQ ID NO: 1892309 - DNA, 13 bp, Homo sapiens
tggcgcaccctcc

SEQ ID NO: 1892310 - DNA, 20 bp, Homo sapiens
tggcgccccctggtgggaca

SEQ ID NO: 1892311 - DNA, 16 bp, Homo sapiens
tggctccacgccctgg

SEQ ID NO: 1892312 - DNA, 17 bp, Homo sapiens
tggctccacgccctggg

SEQ ID NO: 1892313 - DNA, 18 bp, Homo sapiens
tggctccacgccctgggg

SEQ ID NO: 1892314 - DNA, 11 bp, Homo sapiens
tcctggcccat

SEQ ID NO: 1892315 - DNA, 13 bp, Homo sapiens
tcctggcccatca

SEQ ID NO: 1892316 - DNA, 17 bp, Homo sapiens
tcctggcccatcagtgt

SEQ ID NO: 1892317 - DNA, 22 bp, Homo sapiens
tcctgtgggggaagagcacagc

SEQ ID NO: 1892318 - DNA, 18 bp, Homo sapiens
tccttcaccctccgttga

SEQ ID NO: 1892319 - DNA, 21 bp, Homo sapiens
tccttcctacacccttggact

SEQ ID NO: 1892320 - DNA, 23 bp, Homo sapiens
tccttcctacacccttggacttg

SEQ ID NO: 1892321 - DNA, 13 bp, Homo sapiens
tccttcttgccct

SEQ ID NO: 1892322 - DNA, 17 bp, Homo sapiens
tccttgaagcaaatgtg

SEQ ID NO: 1892323 - DNA, 13 bp, Homo sapiens
tccttgccctggg

SEQ ID NO: 1892324 - DNA, 22 bp, Homo sapiens
tccttgccctgggccagcccag

SEQ ID NO: 1892325 - DNA, 15 bp, Homo sapiens
tcctttttgcagtat

SEQ ID NO: 1892326 - DNA, 17 bp, Homo sapiens
tcgaggcggatctttgg

SEQ ID NO: 1892327 - DNA, 22 bp, Homo sapiens
tcgaggcggatctttggacaga

SEQ ID NO: 1892328 - DNA, 21 bp, Homo sapiens
tcgcccaccgcatgccccctc

SEQ ID NO: 1892329 - DNA, 22 bp, Homo sapiens
tcgcccaccgcatgccccctcg

SEQ ID NO: 1892330 - DNA, 14 bp, Homo sapiens
tcgcctggcctgag

SEQ ID NO: 1892331 - DNA, 15 bp, Homo sapiens
tcgcctggcctgagg

SEQ ID NO: 1892332 - DNA, 19 bp, Homo sapiens
tcgctcctcaacccctccc

SEQ ID NO: 1892333 - DNA, 17 bp, Homo sapiens
tcggacctttcagctgt

SEQ ID NO: 1892334 - DNA, 11 bp, Homo sapiens
tcggctcctgc

SEQ ID NO: 1892335 - DNA, 15 bp, Homo sapiens
tcggctcctgctgca

SEQ ID NO: 1892336 - DNA, 12 bp, Homo sapiens
tcgggctcctgt

SEQ ID NO: 1892337 - DNA, 18 bp, Homo sapiens
tcggggggcgagggaggg

SEQ ID NO: 1892338 - DNA, 22 bp, Homo sapiens
tcgtgggacagtcacctcatgg

SEQ ID NO: 1892339 - DNA, 12 bp, Homo sapiens
tctaaaatgtca

SEQ ID NO: 1892340 - DNA, 21 bp, Homo sapiens
tctaaactggattcacagctc

SEQ ID NO: 1892341 - DNA, 13 bp, Homo sapiens
tctaaagtttaca

SEQ ID NO: 1892342 - DNA, 16 bp, Homo sapiens
tctaaagtttacagta

SEQ ID NO: 1892343 - DNA, 17 bp, Homo sapiens
tctaaagtttacagtaa

SEQ ID NO: 1892344 - DNA, 21 bp, Homo sapiens
tctacactaagagagaatgag

SEQ ID NO: 1892345 - DNA, 17 bp, Homo sapiens
tctaccaaaaatctcaa

SEQ ID NO: 1892346 - DNA, 15 bp, Homo sapiens
tctagctgagcttta

SEQ ID NO: 1892347 - DNA, 22 bp, Homo sapiens
tctagctgagctttaaatcatt

SEQ ID NO: 1892348 - DNA, 16 bp, Homo sapiens
tctaggaaatatttat

SEQ ID NO: 1892349 - DNA, 17 bp, Homo sapiens
tctaggaaatatttatt

SEQ ID NO: 1892350 - DNA, 22 bp, Homo sapiens
tctagtgagcagtcaggaaaga

SEQ ID NO: 1892351 - DNA, 19 bp, Homo sapiens
tctagtgatttcctgtata

SEQ ID NO: 1892352 - DNA, 22 bp, Homo sapiens
tctagtttaattaatctgtaat

SEQ ID NO: 1892353 - DNA, 19 bp, Homo sapiens
tctatagttattgttttat

SEQ ID NO: 1892354 - DNA, 23 bp, Homo sapiens
tctatgaactctgttttctttct

SEQ ID NO: 1892355 - DNA, 15 bp, Homo sapiens
tctcaactccaaact

SEQ ID NO: 1892356 - DNA, 12 bp, Homo sapiens
tctcaatttcta

SEQ ID NO: 1892357 - DNA, 20 bp, Homo sapiens
tctcactagctgtctcagga

SEQ ID NO: 1892358 - DNA, 15 bp, Homo sapiens
tctcactatgctgct

SEQ ID NO: 1892359 - DNA, 21 bp, Homo sapiens
tctccacctagtggctgtcca

SEQ ID NO: 1892360 - DNA, 23 bp, Homo sapiens
tctccacctagtggctgtccagt

SEQ ID NO: 1892361 - DNA, 15 bp, Homo sapiens
tctccatcagatgtg

SEQ ID NO: 1892362 - DNA, 20 bp, Homo sapiens
tctccctgagcctgccccag

SEQ ID NO: 1892363 - DNA, 14 bp, Homo sapiens
tctcctctgctatg

SEQ ID NO: 1892364 - DNA, 20 bp, Homo sapiens
tctcctctgctatgcatttt

SEQ ID NO: 1892365 - DNA, 22 bp, Homo sapiens
tctcctctgctatgcattttct

SEQ ID NO: 1892366 - DNA, 23 bp, Homo sapiens
tctcctctgctatgcattttctt

SEQ ID NO: 1892367 - DNA, 18 bp, Homo sapiens
tctccttgccctgggcca

SEQ ID NO: 1892368 - DNA, 19 bp, Homo sapiens
tctcgctgatgctgggctg

SEQ ID NO: 1892369 - DNA, 19 bp, Homo sapiens
tctgaaggagattttcctt

SEQ ID NO: 1892370 - DNA, 14 bp, Homo sapiens
tctgacctccatga

SEQ ID NO: 1892371 - DNA, 16 bp, Homo sapiens
tctgagcccccacctg

SEQ ID NO: 1892372 - DNA, 18 bp, Homo sapiens
tctgatatttgctggagt

SEQ ID NO: 1892373 - DNA, 19 bp, Homo sapiens
tctgatatttgctggagtg

SEQ ID NO: 1892374 - DNA, 13 bp, Homo sapiens
tctgatgtttgtt

SEQ ID NO: 1892375 - DNA, 15 bp, Homo sapiens
tctgccacttcccag

SEQ ID NO: 1892376 - DNA, 13 bp, Homo sapiens
tctgcctttttta

SEQ ID NO: 1892377 - DNA, 16 bp, Homo sapiens
tctgcggtgaggcagg

SEQ ID NO: 1892378 - DNA, 20 bp, Homo sapiens
tctgcggtgaggcaggggag

SEQ ID NO: 1892379 - DNA, 15 bp, Homo sapiens
tctgctatgcatttt

SEQ ID NO: 1892380 - DNA, 16 bp, Homo sapiens
tctgctatgcattttc

SEQ ID NO: 1892381 - DNA, 23 bp, Homo sapiens
tctgctatgcattttcttcacag

SEQ ID NO: 1892382 - DNA, 16 bp, Homo sapiens
tctgctcgggcccagg

SEQ ID NO: 1892383 - DNA, 17 bp, Homo sapiens
tctgctcgggcccaggc

SEQ ID NO: 1892384 - DNA, 18 bp, Homo sapiens
tctgctcgggcccaggcc

SEQ ID NO: 1892385 - DNA, 12 bp, Homo sapiens
tctgctgggctg

SEQ ID NO: 1892386 - DNA, 16 bp, Homo sapiens
tctgggaggcttcagt

SEQ ID NO: 1892387 - DNA, 14 bp, Homo sapiens
tctgggccctgcag

SEQ ID NO: 1892388 - DNA, 19 bp, Homo sapiens
tctgggccctgcaggaggc

SEQ ID NO: 1892389 - DNA, 15 bp, Homo sapiens
tgattttgaaaccat

SEQ ID NO: 1892390 - DNA, 15 bp, Homo sapiens
tgattttgaaatcat

SEQ ID NO: 1892391 - DNA, 20 bp, Homo sapiens
tgcaaaaattcagagtcctt

SEQ ID NO: 1892392 - DNA, 21 bp, Homo sapiens
tgcaagtagctggctgtactg

SEQ ID NO: 1892393 - DNA, 15 bp, Homo sapiens
tgcacatcaaaatat

SEQ ID NO: 1892394 - DNA, 15 bp, Homo sapiens
tgcaccaacccagcc

SEQ ID NO: 1892395 - DNA, 20 bp, Homo sapiens
tgcaccaacccagccgctgc

SEQ ID NO: 1892396 - DNA, 22 bp, Homo sapiens
tgcaccaacccagccgctgccc

SEQ ID NO: 1892397 - DNA, 17 bp, Homo sapiens
tgcaccccctcctgctg

SEQ ID NO: 1892398 - DNA, 16 bp, Homo sapiens
tgcactgaatatataa

SEQ ID NO: 1892399 - DNA, 12 bp, Homo sapiens
tgcactgtcctg

SEQ ID NO: 1892400 - DNA, 14 bp, Homo sapiens
tgcactgtcctgct

SEQ ID NO: 1892401 - DNA, 20 bp, Homo sapiens
tgcactgtcctgctccacag

SEQ ID NO: 1892402 - DNA, 18 bp, Homo sapiens
tgcagaggagccacctgg

SEQ ID NO: 1892403 - DNA, 21 bp, Homo sapiens
tgcagaggagccacctgggct

SEQ ID NO: 1892404 - DNA, 22 bp, Homo sapiens
tgcagaggagccacctgggctg

SEQ ID NO: 1892405 - DNA, 18 bp, Homo sapiens
tgcagaggggcaggccct

SEQ ID NO: 1892406 - DNA, 22 bp, Homo sapiens
tgcagaggggcaggccctgcac

SEQ ID NO: 1892407 - DNA, 12 bp, Homo sapiens
tgcagcaggcag

SEQ ID NO: 1892408 - DNA, 17 bp, Homo sapiens
tgcagcaggcagaggag

SEQ ID NO: 1892409 - DNA, 11 bp, Homo sapiens
tgcagccccag

SEQ ID NO: 1892410 - DNA, 17 bp, Homo sapiens
tgcagccccaggaccaa

SEQ ID NO: 1892411 - DNA, 14 bp, Homo sapiens
tgcagcttgcagtc

SEQ ID NO: 1892412 - DNA, 13 bp, Homo sapiens
tgcaggaggcctg

SEQ ID NO: 1892413 - DNA, 16 bp, Homo sapiens
tgcaggaggcctggga

SEQ ID NO: 1892414 - DNA, 19 bp, Homo sapiens
tgcaggaggcctgggaggg

SEQ ID NO: 1892415 - DNA, 14 bp, Homo sapiens
tgcaggtttctcct

SEQ ID NO: 1892416 - DNA, 15 bp, Homo sapiens
tgcaggtttctcctt

SEQ ID NO: 1892417 - DNA, 15 bp, Homo sapiens
tgcagtatgaaaata

SEQ ID NO: 1892418 - DNA, 13 bp, Homo sapiens
tgcagtcatttgt

SEQ ID NO: 1892419 - DNA, 16 bp, Homo sapiens
tgcagttctgaagaag

SEQ ID NO: 1892420 - DNA, 18 bp, Homo sapiens
tgcagttctgaagaagat

SEQ ID NO: 1892421 - DNA, 12 bp, Homo sapiens
tgcagttgtgat

SEQ ID NO: 1892422 - DNA, 17 bp, Homo sapiens
tgcagttgtgatataaa

SEQ ID NO: 1892423 - DNA, 15 bp, Homo sapiens
tgcagtttttataat

SEQ ID NO: 1892424 - DNA, 15 bp, Homo sapiens
tgcattttcttcaca

SEQ ID NO: 1892425 - DNA, 16 bp, Homo sapiens
tgcattttcttcacag

SEQ ID NO: 1892426 - DNA, 21 bp, Homo sapiens
tgccaacagtgttaggcctgg

SEQ ID NO: 1892427 - DNA, 14 bp, Homo sapiens
tgccaagcctggag

SEQ ID NO: 1892428 - DNA, 23 bp, Homo sapiens
tgccacaccaagctgtgccaccc

SEQ ID NO: 1892429 - DNA, 17 bp, Homo sapiens
tgccaccctgggctctg

SEQ ID NO: 1892430 - DNA, 12 bp, Homo sapiens
tgccagtcgcgc

SEQ ID NO: 1892431 - DNA, 18 bp, Homo sapiens
tgccagtcgcgctgcctg

SEQ ID NO: 1892432 - DNA, 19 bp, Homo sapiens
tgcccactctccatcagat

SEQ ID NO: 1892433 - DNA, 21 bp, Homo sapiens
tgcccaggacggggccggcca

SEQ ID NO: 1892434 - DNA, 22 bp, Homo sapiens
tgcccaggacggggccggccag

SEQ ID NO: 1892435 - DNA, 15 bp, Homo sapiens
tgcccatgggcactg

SEQ ID NO: 1892436 - DNA, 15 bp, Homo sapiens
tgcccattcctcacc

SEQ ID NO: 1892437 - DNA, 15 bp, Homo sapiens
tgccccaacccccag

SEQ ID NO: 1892438 - DNA, 17 bp, Homo sapiens
tgccccaacccccagca

SEQ ID NO: 1892439 - DNA, 12 bp, Homo sapiens
tgccccagctgg

SEQ ID NO: 1892440 - DNA, 19 bp, Homo sapiens
tggctccacgccctgggga

SEQ ID NO: 1892441 - DNA, 17 bp, Homo sapiens
tggctcccaagggaggc

SEQ ID NO: 1892442 - DNA, 17 bp, Homo sapiens
tggctgcctccactccc

SEQ ID NO: 1892443 - DNA, 14 bp, Homo sapiens
tggctgctggaggg

SEQ ID NO: 1892444 - DNA, 19 bp, Homo sapiens
tggctgggggcatggggga

SEQ ID NO: 1892445 - DNA, 19 bp, Homo sapiens
tggctgggttttcaggggc

SEQ ID NO: 1892446 - DNA, 15 bp, Homo sapiens
tggctgtactgccaa

SEQ ID NO: 1892447 - DNA, 12 bp, Homo sapiens
tggctgtccagt

SEQ ID NO: 1892448 - DNA, 18 bp, Homo sapiens
tggctgtccagtgcccat

SEQ ID NO: 1892449 - DNA, 23 bp, Homo sapiens
tggctgtccagtgcccattcctc

SEQ ID NO: 1892450 - DNA, 14 bp, Homo sapiens
tggcttctgtgcct

SEQ ID NO: 1892451 - DNA, 15 bp, Homo sapiens
tggctttcagagcct

SEQ ID NO: 1892452 - DNA, 17 bp, Homo sapiens
tggctttcagagcctcc

SEQ ID NO: 1892453 - DNA, 21 bp, Homo sapiens
tgggaaattaaatccaataaa

SEQ ID NO: 1892454 - DNA, 22 bp, Homo sapiens
tgggaaattaaatccaataaaa

SEQ ID NO: 1892455 - DNA, 14 bp, Homo sapiens
tgggaagctgtaga

SEQ ID NO: 1892456 - DNA, 23 bp, Homo sapiens
tgggacaacaaagaggacaccat

SEQ ID NO: 1892457 - DNA, 18 bp, Homo sapiens
tgggacagtcacctcatg

SEQ ID NO: 1892458 - DNA, 20 bp, Homo sapiens
tgggacagtcacctcatgga

SEQ ID NO: 1892459 - DNA, 19 bp, Homo sapiens
tgggagaaggtgcttgggc

SEQ ID NO: 1892460 - DNA, 13 bp, Homo sapiens
tgggagaggcaga

SEQ ID NO: 1892461 - DNA, 18 bp, Homo sapiens
tgggagggcgaggcgggg

SEQ ID NO: 1892462 - DNA, 15 bp, Homo sapiens
tgggatcattgcatt

SEQ ID NO: 1892463 - DNA, 16 bp, Homo sapiens
tgggatcattgcattt

SEQ ID NO: 1892464 - DNA, 14 bp, Homo sapiens
tgggcactgctggg

SEQ ID NO: 1892465 - DNA, 23 bp, Homo sapiens
tgggcactgctgggtggcccatc

SEQ ID NO: 1892466 - DNA, 16 bp, Homo sapiens
tgggcaggtcctgggg

SEQ ID NO: 1892467 - DNA, 18 bp, Homo sapiens
tgggccatactggcctcg

SEQ ID NO: 1892468 - DNA, 20 bp, Homo sapiens
tgggccatactggcctcgcc

SEQ ID NO: 1892469 - DNA, 24 bp, Homo sapiens
tgggccatactggcctcgcctggc

SEQ ID NO: 1892470 - DNA, 23 bp, Homo sapiens
tgggccctgcaggaggcctggga

SEQ ID NO: 1892471 - DNA, 21 bp, Homo sapiens
tgggcctgatggagaggagaa

SEQ ID NO: 1892472 - DNA, 18 bp, Homo sapiens
tgggcgggcagcacagca

SEQ ID NO: 1892473 - DNA, 19 bp, Homo sapiens
tgggcgggcagcacagcaa

SEQ ID NO: 1892474 - DNA, 21 bp, Homo sapiens
tgggctgcactctgtgcccat

SEQ ID NO: 1892475 - DNA, 18 bp, Homo sapiens
tgggctgggagaaggtgc

SEQ ID NO: 1892476 - DNA, 14 bp, Homo sapiens
tggggaggaagaag

SEQ ID NO: 1892477 - DNA, 17 bp, Homo sapiens
tggggaggctgagactg

SEQ ID NO: 1892478 - DNA, 16 bp, Homo sapiens
tgggggagcctggagc

SEQ ID NO: 1892479 - DNA, 20 bp, Homo sapiens
tgggggagcctggagcccct

SEQ ID NO: 1892480 - DNA, 14 bp, Homo sapiens
tgggggaggctctg

SEQ ID NO: 1892481 - DNA, 23 bp, Homo sapiens
tgggggcatgggggaggctctga

SEQ ID NO: 1892482 - DNA, 14 bp, Homo sapiens
tgggtagacacaca

SEQ ID NO: 1892483 - DNA, 17 bp, Homo sapiens
tgggtagacacacatga

SEQ ID NO: 1892484 - DNA, 19 bp, Homo sapiens
tgggtcccacttcccctcc

SEQ ID NO: 1892485 - DNA, 19 bp, Homo sapiens
tgggtccctgggaaagagg

SEQ ID NO: 1892486 - DNA, 14 bp, Homo sapiens
tgggtggcccatcc

SEQ ID NO: 1892487 - DNA, 15 bp, Homo sapiens
tgggtggcccatccc

SEQ ID NO: 1892488 - DNA, 20 bp, Homo sapiens
tgggttttcaggggctttgg

SEQ ID NO: 1892489 - DNA, 14 bp, Homo sapiens
tggtaaattgtaaa

SEQ ID NO: 1892490 - DNA, 13 bp, Homo sapiens
tggtatgttttca

SEQ ID NO: 1892491 - DNA, 17 bp, Homo sapiens
tggtattgtaaaacatt

SEQ ID NO: 1892492 - DNA, 17 bp, Homo sapiens
tggtgacatgtgcctgt

SEQ ID NO: 1892493 - DNA, 22 bp, Homo sapiens
tggtgaccccttttcagcttct

SEQ ID NO: 1892494 - DNA, 21 bp, Homo sapiens
tggtgtcgcgccttctccccc

SEQ ID NO: 1892495 - DNA, 18 bp, Homo sapiens
tgtaactttaaacatcta

SEQ ID NO: 1892496 - DNA, 14 bp, Homo sapiens
tgtaagctgaaaat

SEQ ID NO: 1892497 - DNA, 16 bp, Homo sapiens
tgtaaggactcagtgt

SEQ ID NO: 1892498 - DNA, 18 bp, Homo sapiens
tgtaagtacccctgataa

SEQ ID NO: 1892499 - DNA, 14 bp, Homo sapiens
tgtaataatgttat

SEQ ID NO: 1892500 - DNA, 23 bp, Homo sapiens
tgtaattacctgtcatctgggcc

SEQ ID NO: 1892501 - DNA, 17 bp, Homo sapiens
tgtacagttatttatgc

SEQ ID NO: 1892502 - DNA, 14 bp, Homo sapiens
tgtacccccgccca

SEQ ID NO: 1892503 - DNA, 22 bp, Homo sapiens
tgtacccccgcccaggctggcc

SEQ ID NO: 1892504 - DNA, 17 bp, Homo sapiens
tgtacctggtgacccct

SEQ ID NO: 1892505 - DNA, 19 bp, Homo sapiens
tgtagaaaagaaaacattt

SEQ ID NO: 1892506 - DNA, 20 bp, Homo sapiens
tgtagaaaagaaaacattta

SEQ ID NO: 1892507 - DNA, 13 bp, Homo sapiens
tgtagaactgccc

SEQ ID NO: 1892508 - DNA, 13 bp, Homo sapiens
tgtaggagagact

SEQ ID NO: 1892509 - DNA, 15 bp, Homo sapiens
tgtaggagagactgg

SEQ ID NO: 1892510 - DNA, 18 bp, Homo sapiens
tgtaggagagactggcca

SEQ ID NO: 1892511 - DNA, 16 bp, Homo sapiens
tgtaggcgcccctggg

SEQ ID NO: 1892512 - DNA, 18 bp, Homo sapiens
tgtaggcgcccctggggt

SEQ ID NO: 1892513 - DNA, 14 bp, Homo sapiens
tgtagtgttggaga

SEQ ID NO: 1892514 - DNA, 16 bp, Homo sapiens
tgtagtgttggagaag

SEQ ID NO: 1892515 - DNA, 20 bp, Homo sapiens
tgtagtgttggagaagaact

SEQ ID NO: 1892516 - DNA, 21 bp, Homo sapiens
tgtagtgttggagaagaactg

SEQ ID NO: 1892517 - DNA, 17 bp, Homo sapiens
tgtataatttaacagtg

SEQ ID NO: 1892518 - DNA, 14 bp, Homo sapiens
tgtatatgtcattt

SEQ ID NO: 1892519 - DNA, 21 bp, Homo sapiens
tgtatctatttttttttcttt

SEQ ID NO: 1892520 - DNA, 15 bp, Homo sapiens
tgtatgattcccagc

SEQ ID NO: 1892521 - DNA, 16 bp, Homo sapiens
tgtatgattcccagcc

SEQ ID NO: 1892522 - DNA, 14 bp, Homo sapiens
tgtatgtttcttct

SEQ ID NO: 1892523 - DNA, 15 bp, Homo sapiens
tgtatgtttcttctt

SEQ ID NO: 1892524 - DNA, 22 bp, Homo sapiens
tgtatgtttcttctttctttta

SEQ ID NO: 1892525 - DNA, 23 bp, Homo sapiens
tgtatttccccaacatgtaataa

SEQ ID NO: 1892526 - DNA, 14 bp, Homo sapiens
tgtatttttcttgc

SEQ ID NO: 1892527 - DNA, 18 bp, Homo sapiens
tgtatttttcttgctgtt

SEQ ID NO: 1892528 - DNA, 20 bp, Homo sapiens
tgtcaaatgcccactctcca

SEQ ID NO: 1892529 - DNA, 14 bp, Homo sapiens
tgtcaactccagga

SEQ ID NO: 1892530 - DNA, 23 bp, Homo sapiens
tgtcaatacccctgttaagcaat

SEQ ID NO: 1892531 - DNA, 18 bp, Homo sapiens
tgtcaccggtcagtgcct

SEQ ID NO: 1892532 - DNA, 17 bp, Homo sapiens
tgtcactgacacacacg

SEQ ID NO: 1892533 - DNA, 19 bp, Homo sapiens
tgtcactggctgcctccac

SEQ ID NO: 1892534 - DNA, 16 bp, Homo sapiens
tgtcagtgccgccgcc

SEQ ID NO: 1892535 - DNA, 13 bp, Homo sapiens
tgtcataaattac

SEQ ID NO: 1892536 - DNA, 22 bp, Homo sapiens
tgtcatgcctcactttcttcta

SEQ ID NO: 1892537 - DNA, 23 bp, Homo sapiens
tgtccagtgcccattcctcacct

SEQ ID NO: 1892538 - DNA, 11 bp, Homo sapiens
tgtcccctctt

SEQ ID NO: 1892539 - DNA, 15 bp, Homo sapiens
tgtcctgctccacag

SEQ ID NO: 1892540 - DNA, 16 bp, Homo sapiens
tgtcctgctccacagt

SEQ ID NO: 1892541 - DNA, 20 bp, Homo sapiens
tgtcggggggcgagggaggg

SEQ ID NO: 1892542 - DNA, 14 bp, Homo sapiens
tgtctaaaatgtca

SEQ ID NO: 1892543 - DNA, 14 bp, Homo sapiens
tgtctccctggccc

SEQ ID NO: 1892544 - DNA, 15 bp, Homo sapiens
tgtctgcaggtttct

SEQ ID NO: 1892545 - DNA, 18 bp, Homo sapiens
tgtctgcaggtttctcct

SEQ ID NO: 1892546 - DNA, 16 bp, Homo sapiens
tgtcttcatcacttct

SEQ ID NO: 1892547 - DNA, 21 bp, Homo sapiens
tgtcttcatcacttcttccac

SEQ ID NO: 1892548 - DNA, 17 bp, Homo sapiens
tgtgaaatgtaacatga

SEQ ID NO: 1892549 - DNA, 14 bp, Homo sapiens
tgtgaagcaaaatt

SEQ ID NO: 1892550 - DNA, 13 bp, Homo sapiens
tgtgatataaagg

SEQ ID NO: 1892551 - DNA, 22 bp, Homo sapiens
tgtgattacgtgtatgtttctt

SEQ ID NO: 1892552 - DNA, 15 bp, Homo sapiens
tgtgatttcccgtgg

SEQ ID NO: 1892553 - DNA, 22 bp, Homo sapiens
tgtgatttcccgtggccccagc

SEQ ID NO: 1892554 - DNA, 23 bp, Homo sapiens
tgtgatttcccgtggccccagcc

SEQ ID NO: 1892555 - DNA, 12 bp, Homo sapiens
tgtgatttcttc

SEQ ID NO: 1892556 - DNA, 17 bp, Homo sapiens
tgtgatttcttctccct

SEQ ID NO: 1892557 - DNA, 13 bp, Homo sapiens
tgtgcaaacataa

SEQ ID NO: 1892558 - DNA, 15 bp, Homo sapiens
tgtgccaccctgggc

SEQ ID NO: 1892559 - DNA, 21 bp, Homo sapiens
tgtgccaccctgggctctgtg

SEQ ID NO: 1892560 - DNA, 21 bp, Homo sapiens
ttcccctcctacccctcccag

SEQ ID NO: 1892561 - DNA, 13 bp, Homo sapiens
ttcccgtggcccc

SEQ ID NO: 1892562 - DNA, 15 bp, Homo sapiens
ttcccgtggccccag

SEQ ID NO: 1892563 - DNA, 19 bp, Homo sapiens
ttcccgtggccccagcctg

SEQ ID NO: 1892564 - DNA, 18 bp, Homo sapiens
ttcccttgatgaagaagt

SEQ ID NO: 1892565 - DNA, 12 bp, Homo sapiens
ttccgctcccac

SEQ ID NO: 1892566 - DNA, 13 bp, Homo sapiens
ttcctaagtgatt

SEQ ID NO: 1892567 - DNA, 18 bp, Homo sapiens
ttcctacacccttggact

SEQ ID NO: 1892568 - DNA, 21 bp, Homo sapiens
ttcctacacccttggacttga

SEQ ID NO: 1892569 - DNA, 12 bp, Homo sapiens
ttcctctttgca

SEQ ID NO: 1892570 - DNA, 17 bp, Homo sapiens
ttcctctttgcatggaa

SEQ ID NO: 1892571 - DNA, 21 bp, Homo sapiens
ttcctgtggatgtaaagtgat

SEQ ID NO: 1892572 - DNA, 20 bp, Homo sapiens
ttccttacctatttcctcag

SEQ ID NO: 1892573 - DNA, 14 bp, Homo sapiens
ttccttttcatctg

SEQ ID NO: 1892574 - DNA, 15 bp, Homo sapiens
ttccttttcatctgt

SEQ ID NO: 1892575 - DNA, 14 bp, Homo sapiens
ttctaatagtttta

SEQ ID NO: 1892576 - DNA, 20 bp, Homo sapiens
ttctagtgatttcctgtata

SEQ ID NO: 1892577 - DNA, 22 bp, Homo sapiens
ttctagtgatttcctgtataat

SEQ ID NO: 1892578 - DNA, 15 bp, Homo sapiens
ttctattgttgtaca

SEQ ID NO: 1892579 - DNA, 14 bp, Homo sapiens
ttctcaactccaaa

SEQ ID NO: 1892580 - DNA, 18 bp, Homo sapiens
ttctcaactccaaactga

SEQ ID NO: 1892581 - DNA, 17 bp, Homo sapiens
ttctcactagctgtctc

SEQ ID NO: 1892582 - DNA, 12 bp, Homo sapiens
ttctctaggaaa

SEQ ID NO: 1892583 - DNA, 10 bp, Homo sapiens
ttctgagccc

SEQ ID NO: 1892584 - DNA, 11 bp, Homo sapiens
ttctgagcccc

SEQ ID NO: 1892585 - DNA, 14 bp, Homo sapiens
ttctgcctgcctgg

SEQ ID NO: 1892586 - DNA, 16 bp, Homo sapiens
ttctgcctgcctggga

SEQ ID NO: 1892587 - DNA, 18 bp, Homo sapiens
ttctgcctgcctgggaac

SEQ ID NO: 1892588 - DNA, 16 bp, Homo sapiens
ttctgcggtgaggcag

SEQ ID NO: 1892589 - DNA, 16 bp, Homo sapiens
ttctgttttataattt

SEQ ID NO: 1892590 - DNA, 17 bp, Homo sapiens
ttctgttttataatttt

SEQ ID NO: 1892591 - DNA, 19 bp, Homo sapiens
ttcttctagctgagcttta

SEQ ID NO: 1892592 - DNA, 14 bp, Homo sapiens
ttcttgctgttcag

SEQ ID NO: 1892593 - DNA, 15 bp, Homo sapiens
ttcttgctgttcagt

SEQ ID NO: 1892594 - DNA, 17 bp, Homo sapiens
ttcttgctgttcagtgc

SEQ ID NO: 1892595 - DNA, 15 bp, Homo sapiens
ttctttagaggcttt

SEQ ID NO: 1892596 - DNA, 19 bp, Homo sapiens
ttctttttaaagtttgttc

SEQ ID NO: 1892597 - DNA, 22 bp, Homo sapiens
ttcttttttttttttttacagt

SEQ ID NO: 1892598 - DNA, 19 bp, Homo sapiens
ttgaaatattgacttttta

SEQ ID NO: 1892599 - DNA, 13 bp, Homo sapiens
ttgaagcaaatgt

SEQ ID NO: 1892600 - DNA, 14 bp, Homo sapiens
ttgaagcaaatgtg

SEQ ID NO: 1892601 - DNA, 13 bp, Homo sapiens
ttgacactgtttt

SEQ ID NO: 1892602 - DNA, 18 bp, Homo sapiens
ttgaggatgcactggcct

SEQ ID NO: 1892603 - DNA, 18 bp, Homo sapiens
ttgagggtaataaactta

SEQ ID NO: 1892604 - DNA, 20 bp, Homo sapiens
ttgatatgccttttcccaac

SEQ ID NO: 1892605 - DNA, 19 bp, Homo sapiens
ttgatctgtgatttcttct

SEQ ID NO: 1892606 - DNA, 14 bp, Homo sapiens
ttgatgaagaagtt

SEQ ID NO: 1892607 - DNA, 23 bp, Homo sapiens
ttgatgaagaagttgatatgcct

SEQ ID NO: 1892608 - DNA, 17 bp, Homo sapiens
ttgcaattcatgtaaca

SEQ ID NO: 1892609 - DNA, 15 bp, Homo sapiens
ttgcagtatatttct

SEQ ID NO: 1892610 - DNA, 15 bp, Homo sapiens
ttgccccaaccccca

SEQ ID NO: 1892611 - DNA, 17 bp, Homo sapiens
ttgccccaacccccagc

SEQ ID NO: 1892612 - DNA, 14 bp, Homo sapiens
ttgccgggcctgga

SEQ ID NO: 1892613 - DNA, 15 bp, Homo sapiens
ttgccgggcctggac

SEQ ID NO: 1892614 - DNA, 18 bp, Homo sapiens
ttgccgggcctggactgt

SEQ ID NO: 1892615 - DNA, 17 bp, Homo sapiens
tttcagctcttaaaaag

SEQ ID NO: 1892616 - DNA, 18 bp, Homo sapiens
tttcagctcttaaaaaga

SEQ ID NO: 1892617 - DNA, 14 bp, Homo sapiens
tttcagcttctgct

SEQ ID NO: 1892618 - DNA, 13 bp, Homo sapiens
tttcagttatttt

SEQ ID NO: 1892619 - DNA, 14 bp, Homo sapiens
tttcataaatttga

SEQ ID NO: 1892620 - DNA, 15 bp, Homo sapiens
tttccacagaagctc

SEQ ID NO: 1892621 - DNA, 14 bp, Homo sapiens
tttcccaaatgtat

SEQ ID NO: 1892622 - DNA, 15 bp, Homo sapiens
tttcccaaatgtatt

SEQ ID NO: 1892623 - DNA, 12 bp, Homo sapiens
tttcccactgca

SEQ ID NO: 1892624 - DNA, 13 bp, Homo sapiens
tttcccgccaagc

SEQ ID NO: 1892625 - DNA, 19 bp, Homo sapiens
tttcccgtggccccagcct

SEQ ID NO: 1892626 - DNA, 15 bp, Homo sapiens
tttctcctctgctat

SEQ ID NO: 1892627 - DNA, 22 bp, Homo sapiens
tttctgtagaaaagaaaacatt

SEQ ID NO: 1892628 - DNA, 14 bp, Homo sapiens
tttgaaatattgac

SEQ ID NO: 1892629 - DNA, 15 bp, Homo sapiens
tttgaaatattgact

SEQ ID NO: 1892630 - DNA, 21 bp, Homo sapiens
tttgcagctgagagaaaataa

SEQ ID NO: 1892631 - DNA, 21 bp, Homo sapiens
tttgcatggaatttgtaagtt

SEQ ID NO: 1892632 - DNA, 18 bp, Homo sapiens
tttgctcagcttctccaa

SEQ ID NO: 1892633 - DNA, 19 bp, Homo sapiens
tttgctggagtgctggctc

SEQ ID NO: 1892634 - DNA, 12 bp, Homo sapiens
tttgtaattatt

SEQ ID NO: 1892635 - DNA, 14 bp, Homo sapiens
tttgtataaaataa

SEQ ID NO: 1892636 - DNA, 18 bp, Homo sapiens
tttgtataaaataatttt

SEQ ID NO: 1892637 - DNA, 21 bp, Homo sapiens
tttgtataaaataatttttat

SEQ ID NO: 1892638 - DNA, 14 bp, Homo sapiens
tttgtgtgtagtct

SEQ ID NO: 1892639 - DNA, 22 bp, Homo sapiens
tttgtgtttcagccatgtattt

SEQ ID NO: 1892640 - DNA, 13 bp, Homo sapiens
ttttaaaaaagaa

SEQ ID NO: 1892641 - DNA, 14 bp, Homo sapiens
ttttaaagtttgtt

SEQ ID NO: 1892642 - DNA, 18 bp, Homo sapiens
ttttacagtatccaaaaa

SEQ ID NO: 1892643 - DNA, 16 bp, Homo sapiens
ttttactctgtgtaaa

SEQ ID NO: 1892644 - DNA, 20 bp, Homo sapiens
ttttagcttcagttgttctt

SEQ ID NO: 1892645 - DNA, 18 bp, Homo sapiens
ttttaggcagggatttga

SEQ ID NO: 1892646 - DNA, 18 bp, Homo sapiens
ttttagtgattttaataa

SEQ ID NO: 1892647 - DNA, 14 bp, Homo sapiens
ttttataattttgt

SEQ ID NO: 1892648 - DNA, 21 bp, Homo sapiens
ttttataattttgtgaagcaa

SEQ ID NO: 1892649 - DNA, 15 bp, Homo sapiens
ttttatatgcttctg

SEQ ID NO: 1892650 - DNA, 22 bp, Homo sapiens
ttttatggcactagtatttcta

SEQ ID NO: 1892651 - DNA, 19 bp, Homo sapiens
ttttattaataaacattct

SEQ ID NO: 1892652 - DNA, 18 bp, Homo sapiens
ttttcaatttgtcatgtt

SEQ ID NO: 1892653 - DNA, 12 bp, Homo sapiens
ttttcagcttct

SEQ ID NO: 1892654 - DNA, 17 bp, Homo sapiens
ttttcagcttctgctgg

SEQ ID NO: 1892655 - DNA, 20 bp, Homo sapiens
ttttcaggctagatgtatgt

SEQ ID NO: 1892656 - DNA, 14 bp, Homo sapiens
ttttccatgtatct

SEQ ID NO: 1892657 - DNA, 23 bp, Homo sapiens
ttttcccgagcaaagtctaaagt

SEQ ID NO: 1892658 - DNA, 14 bp, Homo sapiens
ttttcctgaaaacc

SEQ ID NO: 1892659 - DNA, 13 bp, Homo sapiens
ttttcttgctgtt

SEQ ID NO: 1892660 - DNA, 22 bp, Homo sapiens
ttttcttggttcttttttcagt

SEQ ID NO: 1892661 - DNA, 21 bp, Homo sapiens
ttttgaaaccatgaagagatt

SEQ ID NO: 1892662 - DNA, 22 bp, Homo sapiens
tgtgccaccctgggctctgtgg

SEQ ID NO: 1892663 - DNA, 20 bp, Homo sapiens
tgtgcccatgggcactgctg

SEQ ID NO: 1892664 - DNA, 21 bp, Homo sapiens
tgtgccccccatcctggccca

SEQ ID NO: 1892665 - DNA, 22 bp, Homo sapiens
tgtgccccccatcctggcccat

SEQ ID NO: 1892666 - DNA, 11 bp, Homo sapiens
tgtgccctggc

SEQ ID NO: 1892667 - DNA, 14 bp, Homo sapiens
tgtgccctggctcc

SEQ ID NO: 1892668 - DNA, 17 bp, Homo sapiens
tgtggctttcagagcct

SEQ ID NO: 1892669 - DNA, 13 bp, Homo sapiens
tgtgggctgcact

SEQ ID NO: 1892670 - DNA, 21 bp, Homo sapiens
tgtgggctgcactctgtgccc

SEQ ID NO: 1892671 - DNA, 20 bp, Homo sapiens
tgtggtccctccactaggag

SEQ ID NO: 1892672 - DNA, 21 bp, Homo sapiens
tgtggtccctccactaggagt

SEQ ID NO: 1892673 - DNA, 19 bp, Homo sapiens
tgtgtaactttaaacatct

SEQ ID NO: 1892674 - DNA, 13 bp, Homo sapiens
tgtgtcactggct

SEQ ID NO: 1892675 - DNA, 15 bp, Homo sapiens
tgtgtcactggctgc

SEQ ID NO: 1892676 - DNA, 23 bp, Homo sapiens
tgtgtcactggctgcctccactc

SEQ ID NO: 1892677 - DNA, 18 bp, Homo sapiens
tgtgtcataaattacaca

SEQ ID NO: 1892678 - DNA, 20 bp, Homo sapiens
tgtgtgaaaggtacttcaaa

SEQ ID NO: 1892679 - DNA, 17 bp, Homo sapiens
tgtgtggctttcagagc

SEQ ID NO: 1892680 - DNA, 20 bp, Homo sapiens
tgtgtggctttcagagcctc

SEQ ID NO: 1892681 - DNA, 20 bp, Homo sapiens
tgtgtgggatcattgcattt

SEQ ID NO: 1892682 - DNA, 12 bp, Homo sapiens
tgtgtgttctgt

SEQ ID NO: 1892683 - DNA, 12 bp, Homo sapiens
tgtgttcctcca

SEQ ID NO: 1892684 - DNA, 17 bp, Homo sapiens
tgtgttgcctgctgagc

SEQ ID NO: 1892685 - DNA, 21 bp, Homo sapiens
tgttaagccatttaactggag

SEQ ID NO: 1892686 - DNA, 17 bp, Homo sapiens
tgttacattaaagccct

SEQ ID NO: 1892687 - DNA, 12 bp, Homo sapiens
tgttataatctt

SEQ ID NO: 1892688 - DNA, 19 bp, Homo sapiens
tgttctgtggtcacagtga

SEQ ID NO: 1892689 - DNA, 19 bp, Homo sapiens
tgttgacactgttttcctt

SEQ ID NO: 1892690 - DNA, 22 bp, Homo sapiens
tgttgactgtaggcgcccctgg

SEQ ID NO: 1892691 - DNA, 22 bp, Homo sapiens
tgttgcccacagctgtatgatt

SEQ ID NO: 1892692 - DNA, 22 bp, Homo sapiens
tgttgcctgctgagctgtgccc

SEQ ID NO: 1892693 - DNA, 23 bp, Homo sapiens
tgttggaaattgggtgtgccctg

SEQ ID NO: 1892694 - DNA, 21 bp, Homo sapiens
tgttggagaagaactgaaatc

SEQ ID NO: 1892695 - DNA, 20 bp, Homo sapiens
tgtttatattgggaagatat

SEQ ID NO: 1892696 - DNA, 13 bp, Homo sapiens
tgtttcaaacata

SEQ ID NO: 1892697 - DNA, 21 bp, Homo sapiens
tgtttcaaacatatataacaa

SEQ ID NO: 1892698 - DNA, 13 bp, Homo sapiens
tgtttctgtagaa

SEQ ID NO: 1892699 - DNA, 14 bp, Homo sapiens
tgtttctgtagaaa

SEQ ID NO: 1892700 - DNA, 23 bp, Homo sapiens
tgtttcttttttttttttttaca

SEQ ID NO: 1892701 - DNA, 15 bp, Homo sapiens
tgtttgctaagcatt

SEQ ID NO: 1892702 - DNA, 15 bp, Homo sapiens
tgtttgcttccatta

SEQ ID NO: 1892703 - DNA, 17 bp, Homo sapiens
tgtttgtgcaaacataa

SEQ ID NO: 1892704 - DNA, 13 bp, Homo sapiens
tgttttttcatgc

SEQ ID NO: 1892705 - DNA, 19 bp, Homo sapiens
ttaaaagaatgattatgaa

SEQ ID NO: 1892706 - DNA, 16 bp, Homo sapiens
ttaaagccctgtgtta

SEQ ID NO: 1892707 - DNA, 14 bp, Homo sapiens
ttaaagtgcagtca

SEQ ID NO: 1892708 - DNA, 16 bp, Homo sapiens
ttaaagtgcagtcatt

SEQ ID NO: 1892709 - DNA, 22 bp, Homo sapiens
ttaaagtgcagtcatttgtggt

SEQ ID NO: 1892710 - DNA, 20 bp, Homo sapiens
ttaacagtgcccttttcatc

SEQ ID NO: 1892711 - DNA, 22 bp, Homo sapiens
ttaacttgagggtaataaactt

SEQ ID NO: 1892712 - DNA, 11 bp, Homo sapiens
ttaagaaatac

SEQ ID NO: 1892713 - DNA, 12 bp, Homo sapiens
ttaagaaatacc

SEQ ID NO: 1892714 - DNA, 13 bp, Homo sapiens
ttaagccttcatt

SEQ ID NO: 1892715 - DNA, 19 bp, Homo sapiens
ttacaaataaacagttgtt

SEQ ID NO: 1892716 - DNA, 13 bp, Homo sapiens
ttacagtaaataa

SEQ ID NO: 1892717 - DNA, 20 bp, Homo sapiens
ttacattaaagccctgtgtt

SEQ ID NO: 1892718 - DNA, 14 bp, Homo sapiens
ttacatttgtataa

SEQ ID NO: 1892719 - DNA, 15 bp, Homo sapiens
ttacatttgtataaa

SEQ ID NO: 1892720 - DNA, 16 bp, Homo sapiens
aaagtgtgtgtgttct

SEQ ID NO: 1892721 - DNA, 21 bp, Homo sapiens
aaagttgcgtttaagttgtat

SEQ ID NO: 1892722 - DNA, 18 bp, Homo sapiens
aaagtttacagtaaataa

SEQ ID NO: 1892723 - DNA, 11 bp, Homo sapiens
aaagtttgttc

SEQ ID NO: 1892724 - DNA, 15 bp, Homo sapiens
aaagtttgttcactt

SEQ ID NO: 1892725 - DNA, 13 bp, Homo sapiens
aaagtttgttgaa

SEQ ID NO: 1892726 - DNA, 15 bp, Homo sapiens
aaataaattgtttga

SEQ ID NO: 1892727 - DNA, 23 bp, Homo sapiens
aaataatttttatatttgaaata

SEQ ID NO: 1892728 - DNA, 17 bp, Homo sapiens
aaatactttgattttta

SEQ ID NO: 1892729 - DNA, 10 bp, Homo sapiens
aaatatattt

SEQ ID NO: 1892730 - DNA, 13 bp, Homo sapiens
aaatatatttgta

SEQ ID NO: 1892731 - DNA, 17 bp, Homo sapiens
aaatattatgttaaaac

SEQ ID NO: 1892732 - DNA, 15 bp, Homo sapiens
aaatatttattttaa

SEQ ID NO: 1892733 - DNA, 16 bp, Homo sapiens
aaatattttgctagtt

SEQ ID NO: 1892734 - DNA, 22 bp, Homo sapiens
aaatcataagatatttttcatg

SEQ ID NO: 1892735 - DNA, 13 bp, Homo sapiens
aaatccaataaaa

SEQ ID NO: 1892736 - DNA, 18 bp, Homo sapiens
aaatccatacatttgtgt

SEQ ID NO: 1892737 - DNA, 14 bp, Homo sapiens
aaatggtgttacat

SEQ ID NO: 1892738 - DNA, 14 bp, Homo sapiens
aaatgtaacatgaa

SEQ ID NO: 1892739 - DNA, 21 bp, Homo sapiens
aaatgtcagtgtttgggaaat

SEQ ID NO: 1892740 - DNA, 23 bp, Homo sapiens
aaatgtgtgggatcattgcattt

SEQ ID NO: 1892741 - DNA, 15 bp, Homo sapiens
aaattagtaattgta

SEQ ID NO: 1892742 - DNA, 15 bp, Homo sapiens
aaattcagagtcctt

SEQ ID NO: 1892743 - DNA, 14 bp, Homo sapiens
aaattctttcactt

SEQ ID NO: 1892744 - DNA, 23 bp, Homo sapiens
aaattgagctggacctcaccaag

SEQ ID NO: 1892745 - DNA, 19 bp, Homo sapiens
aaattgggtgtgccctggc

SEQ ID NO: 1892746 - DNA, 19 bp, Homo sapiens
aaatttaggtaaataaagc

SEQ ID NO: 1892747 - DNA, 21 bp, Homo sapiens
aaatttaggtaaataaagctc

SEQ ID NO: 1892748 - DNA, 17 bp, Homo sapiens
aacaatgctgtatttta

SEQ ID NO: 1892749 - DNA, 15 bp, Homo sapiens
aacacaactatattg

SEQ ID NO: 1892750 - DNA, 18 bp, Homo sapiens
aacactagtctgtgtaac

SEQ ID NO: 1892751 - DNA, 22 bp, Homo sapiens
aacactctcactatgctgctat

SEQ ID NO: 1892752 - DNA, 18 bp, Homo sapiens
aacacttcagcctgtgca

SEQ ID NO: 1892753 - DNA, 20 bp, Homo sapiens
aacagactatttaacttgag

SEQ ID NO: 1892754 - DNA, 18 bp, Homo sapiens
aacaggcccagagaggaa

SEQ ID NO: 1892755 - DNA, 23 bp, Homo sapiens
aacagtgttaggcctggcacagt

SEQ ID NO: 1892756 - DNA, 15 bp, Homo sapiens
aacagttgttactta

SEQ ID NO: 1892757 - DNA, 18 bp, Homo sapiens
aacagttgttacttagca

SEQ ID NO: 1892758 - DNA, 16 bp, Homo sapiens
aacatatataacaatg

SEQ ID NO: 1892759 - DNA, 21 bp, Homo sapiens
aacatctagcagtaaatactt

SEQ ID NO: 1892760 - DNA, 17 bp, Homo sapiens
aacatctttgtttttaa

SEQ ID NO: 1892761 - DNA, 13 bp, Homo sapiens
aacatttaacata

SEQ ID NO: 1892762 - DNA, 18 bp, Homo sapiens
aaccagggccccggggcc

SEQ ID NO: 1892763 - DNA, 23 bp, Homo sapiens
aaccatgaagagatttttcatga

SEQ ID NO: 1892764 - DNA, 24 bp, Homo sapiens
aaccatgaagagatttttcatgat

SEQ ID NO: 1892765 - DNA, 20 bp, Homo sapiens
aaccatgtaaagaacataaa

SEQ ID NO: 1892766 - DNA, 16 bp, Homo sapiens
aacccagccgctgccc

SEQ ID NO: 1892767 - DNA, 14 bp, Homo sapiens
aacccatgccctgc

SEQ ID NO: 1892768 - DNA, 20 bp, Homo sapiens
aacccctcccctccatccct

SEQ ID NO: 1892769 - DNA, 20 bp, Homo sapiens
aacggggtggacgagggagt

SEQ ID NO: 1892770 - DNA, 20 bp, Homo sapiens
aacgtggcttgtagaatttt

SEQ ID NO: 1892771 - DNA, 18 bp, Homo sapiens
aacgttaagaattgttaa

SEQ ID NO: 1892772 - DNA, 14 bp, Homo sapiens
aacgttgctcccca

SEQ ID NO: 1892773 - DNA, 21 bp, Homo sapiens
aactagagtttagctggaaaa

SEQ ID NO: 1892774 - DNA, 15 bp, Homo sapiens
aactgactcttaaga

SEQ ID NO: 1892775 - DNA, 15 bp, Homo sapiens
aacttagaataaaat

SEQ ID NO: 1892776 - DNA, 16 bp, Homo sapiens
aacttagaataaaatt

SEQ ID NO: 1892777 - DNA, 19 bp, Homo sapiens
aacttagaataaaattgta

SEQ ID NO: 1892778 - DNA, 16 bp, Homo sapiens
aacttgagggtaataa

SEQ ID NO: 1892779 - DNA, 19 bp, Homo sapiens
aacttgagggtaataaact

SEQ ID NO: 1892780 - DNA, 22 bp, Homo sapiens
aacttgagggtaataaacttag

SEQ ID NO: 1892781 - DNA, 20 bp, Homo sapiens
aacttgctgcagtatgaaaa

SEQ ID NO: 1892782 - DNA, 12 bp, Homo sapiens
aactttaaacat

SEQ ID NO: 1892783 - DNA, 15 bp, Homo sapiens
aactttaaacatcta

SEQ ID NO: 1892784 - DNA, 12 bp, Homo sapiens
aagaaaacattt

SEQ ID NO: 1892785 - DNA, 17 bp, Homo sapiens
aagaaaacatttaacat

SEQ ID NO: 1892786 - DNA, 18 bp, Homo sapiens
aagaaaacatttaacata

SEQ ID NO: 1892787 - DNA, 22 bp, Homo sapiens
aagaaaatctattttgtaactt

SEQ ID NO: 1892788 - DNA, 11 bp, Homo sapiens
aagaactgaaa

SEQ ID NO: 1892789 - DNA, 15 bp, Homo sapiens
aagaagactgcatta

SEQ ID NO: 1892790 - DNA, 22 bp, Homo sapiens
aagaagcaccaatcatgaatta

SEQ ID NO: 1892791 - DNA, 16 bp, Homo sapiens
aagactgcacatcaaa

SEQ ID NO: 1892792 - DNA, 13 bp, Homo sapiens
aagacttgagaag

SEQ ID NO: 1892793 - DNA, 15 bp, Homo sapiens
aagagaacttccaga

SEQ ID NO: 1892794 - DNA, 13 bp, Homo sapiens
aagagatttttca

SEQ ID NO: 1892795 - DNA, 14 bp, Homo sapiens
aagagatttttcat

SEQ ID NO: 1892796 - DNA, 12 bp, Homo sapiens
aagagcacagcc

SEQ ID NO: 1892797 - DNA, 13 bp, Homo sapiens
aagagcacagccc

SEQ ID NO: 1892798 - DNA, 15 bp, Homo sapiens
aagatatttttcatg

SEQ ID NO: 1892799 - DNA, 15 bp, Homo sapiens
aagatcttggcttaa

SEQ ID NO: 1892800 - DNA, 13 bp, Homo sapiens
aagattgttttat

SEQ ID NO: 1892801 - DNA, 19 bp, Homo sapiens
aagcaaaattttttctcta

SEQ ID NO: 1892802 - DNA, 16 bp, Homo sapiens
aagcatttagatgtat

SEQ ID NO: 1892803 - DNA, 16 bp, Homo sapiens
aagccatttaactgga

SEQ ID NO: 1892804 - DNA, 12 bp, Homo sapiens
aagcccaacaca

SEQ ID NO: 1892805 - DNA, 14 bp, Homo sapiens
aagcccaacacaca

SEQ ID NO: 1892806 - DNA, 13 bp, Homo sapiens
aagcctctgtgtc

SEQ ID NO: 1892807 - DNA, 12 bp, Homo sapiens
aagcctggagcc

SEQ ID NO: 1892808 - DNA, 20 bp, Homo sapiens
aagctcacagacctttgaac

SEQ ID NO: 1892809 - DNA, 17 bp, Homo sapiens
aagctgtaaaaagagag

SEQ ID NO: 1892810 - DNA, 20 bp, Homo sapiens
aagctgtagaggaccaggac

SEQ ID NO: 1892811 - DNA, 21 bp, Homo sapiens
aagctgtagaggaccaggact

SEQ ID NO: 1892812 - DNA, 21 bp, Homo sapiens
aagctgtgccaccctgggctc

SEQ ID NO: 1892813 - DNA, 13 bp, Homo sapiens
aagcttaaggaga

SEQ ID NO: 1892814 - DNA, 14 bp, Homo sapiens
aagcttaaggagag

SEQ ID NO: 1892815 - DNA, 21 bp, Homo sapiens
aaggaaatatatttgtaaaag

SEQ ID NO: 1892816 - DNA, 21 bp, Homo sapiens
aaggaccaacccatgccctgc

SEQ ID NO: 1892817 - DNA, 15 bp, Homo sapiens
aaggaccctgtttct

SEQ ID NO: 1892818 - DNA, 22 bp, Homo sapiens
aaggagcctccgttcccacctc

SEQ ID NO: 1892819 - DNA, 18 bp, Homo sapiens
aaggaggctggctggggc

SEQ ID NO: 1892820 - DNA, 18 bp, Homo sapiens
aaggcaagagctcaaggt

SEQ ID NO: 1892821 - DNA, 17 bp, Homo sapiens
aaggctgtatctatttt

SEQ ID NO: 1892822 - DNA, 17 bp, Homo sapiens
aagggctgttataatct

SEQ ID NO: 1892823 - DNA, 22 bp, Homo sapiens
aaggtgcttgggcttctgcggt

SEQ ID NO: 1892824 - DNA, 17 bp, Homo sapiens
aaggtgggggagcctgg

SEQ ID NO: 1892825 - DNA, 22 bp, Homo sapiens
aaggtggtctgctcgggcccag

SEQ ID NO: 1892826 - DNA, 18 bp, Homo sapiens
aagtacccgttcacattt

SEQ ID NO: 1892827 - DNA, 20 bp, Homo sapiens
aagtacccgttcacattttt

SEQ ID NO: 1892828 - DNA, 19 bp, Homo sapiens
aagtactaagcgctagagg

SEQ ID NO: 1892829 - DNA, 19 bp, Homo sapiens
aagtactcctcacttttca

SEQ ID NO: 1892830 - DNA, 18 bp, Homo sapiens
aagtatgttagtgcaaat

SEQ ID NO: 1892831 - DNA, 22 bp, Homo sapiens
aagtattaggggtaatatattg

SEQ ID NO: 1892832 - DNA, 17 bp, Homo sapiens
aagtcaatgttttcagt

SEQ ID NO: 1892833 - DNA, 18 bp, Homo sapiens
aagtcagctcttctccat

SEQ ID NO: 1892834 - DNA, 11 bp, Homo sapiens
aagtctaaagt

SEQ ID NO: 1892835 - DNA, 21 bp, Homo sapiens
aagtctaaagtttacagtaaa

SEQ ID NO: 1892836 - DNA, 15 bp, Homo sapiens
aagtctaattcacag

SEQ ID NO: 1892837 - DNA, 16 bp, Homo sapiens
aagtctattgtttgtt

SEQ ID NO: 1892838 - DNA, 16 bp, Homo sapiens
aagtgcagtcatttgt

SEQ ID NO: 1892839 - DNA, 13 bp, Homo sapiens
aagtgctttcttc

SEQ ID NO: 1892840 - DNA, 18 bp, Homo sapiens
aagtgtgtgtgttctgta

SEQ ID NO: 1892841 - DNA, 18 bp, Homo sapiens
aagtttacagtaaataaa

SEQ ID NO: 1892842 - DNA, 22 bp, Homo sapiens
aagtttacagtaaataaattgt

SEQ ID NO: 1892843 - DNA, 22 bp, Homo sapiens
aagtttggtattgtaaaacatt

SEQ ID NO: 1892844 - DNA, 16 bp, Homo sapiens
aagtttgttgaaaaca

SEQ ID NO: 1892845 - DNA, 22 bp, Homo sapiens
aataaaatccatacatttgtgt

SEQ ID NO: 1892846 - DNA, 14 bp, Homo sapiens
aataaaattgtaaa

SEQ ID NO: 1892847 - DNA, 14 bp, Homo sapiens
aataaacagttgtt

SEQ ID NO: 1892848 - DNA, 22 bp, Homo sapiens
aataaacttagaataaaattgt

SEQ ID NO: 1892849 - DNA, 11 bp, Homo sapiens
aataaagtctc

SEQ ID NO: 1892850 - DNA, 18 bp, Homo sapiens
aataaagtctcttcctcc

SEQ ID NO: 1892851 - DNA, 13 bp, Homo sapiens
aataaattgtttg

SEQ ID NO: 1892852 - DNA, 18 bp, Homo sapiens
aataatgaagttattctt

SEQ ID NO: 1892853 - DNA, 14 bp, Homo sapiens
aataatgtttcaaa

SEQ ID NO: 1892854 - DNA, 16 bp, Homo sapiens
aataatttttatattt

SEQ ID NO: 1892855 - DNA, 22 bp, Homo sapiens
aataccaccatttaaaaatgtt

SEQ ID NO: 1892856 - DNA, 18 bp, Homo sapiens
aatagattttttttaaag

SEQ ID NO: 1892857 - DNA, 21 bp, Homo sapiens
aatatataaacactccacagt

SEQ ID NO: 1892858 - DNA, 21 bp, Homo sapiens
aatatattgctgctggtaatt

SEQ ID NO: 1892859 - DNA, 15 bp, Homo sapiens
aatatatttgtaaaa

SEQ ID NO: 1892860 - DNA, 15 bp, Homo sapiens
aatatcacttgtcaa

SEQ ID NO: 1892861 - DNA, 21 bp, Homo sapiens
aatatgccccattcaacatct

SEQ ID NO: 1892862 - DNA, 16 bp, Homo sapiens
aatatgtctgcaggtt

SEQ ID NO: 1892863 - DNA, 13 bp, Homo sapiens
aatattagaaaca

SEQ ID NO: 1892864 - DNA, 13 bp, Homo sapiens
aatcacaatacat

SEQ ID NO: 1892865 - DNA, 17 bp, Homo sapiens
aatcactaaaaatgatc

SEQ ID NO: 1892866 - DNA, 16 bp, Homo sapiens
aatcagggttagtatt

SEQ ID NO: 1892867 - DNA, 20 bp, Homo sapiens
aatcataagatatttttcat

SEQ ID NO: 1892868 - DNA, 17 bp, Homo sapiens
aatcatgaattagtttt

SEQ ID NO: 1892869 - DNA, 22 bp, Homo sapiens
aatccaataaaaacattttgaa

SEQ ID NO: 1892870 - DNA, 16 bp, Homo sapiens
aatccatacatttgtg

SEQ ID NO: 1892871 - DNA, 17 bp, Homo sapiens
aatccatacatttgtgt

SEQ ID NO: 1892872 - DNA, 23 bp, Homo sapiens
aatccgttcccttctgccacctg

SEQ ID NO: 1892873 - DNA, 23 bp, Homo sapiens
aatctgtttgtgcaaacataata

SEQ ID NO: 1892874 - DNA, 13 bp, Homo sapiens
aatcttgttttgt

SEQ ID NO: 1892875 - DNA, 14 bp, Homo sapiens
aatgacagaatgct

SEQ ID NO: 1892876 - DNA, 16 bp, Homo sapiens
aatgacagaatgctgt

SEQ ID NO: 1892877 - DNA, 16 bp, Homo sapiens
aatgataactggaaac

SEQ ID NO: 1892878 - DNA, 15 bp, Homo sapiens
aatgattatgaatta

SEQ ID NO: 1892879 - DNA, 21 bp, Homo sapiens
aatgattatgaattacatttg

SEQ ID NO: 1892880 - DNA, 12 bp, Homo sapiens
aatgctttcgat

SEQ ID NO: 1892881 - DNA, 10 bp, Homo sapiens
aatggtgcct

SEQ ID NO: 1892882 - DNA, 22 bp, Homo sapiens
aatggttgtgaaatgtaacatg

SEQ ID NO: 1892883 - DNA, 19 bp, Homo sapiens
aatgtattgattacaaata

SEQ ID NO: 1892884 - DNA, 12 bp, Homo sapiens
aatgtcagtgtt

SEQ ID NO: 1892885 - DNA, 16 bp, Homo sapiens
aatgtgatattataca

SEQ ID NO: 1892886 - DNA, 22 bp, Homo sapiens
aatgtgtattacaaatattttg

SEQ ID NO: 1892887 - DNA, 23 bp, Homo sapiens
aatgttattattactctacactg

SEQ ID NO: 1892888 - DNA, 12 bp, Homo sapiens
aatgttcatcat

SEQ ID NO: 1892889 - DNA, 14 bp, Homo sapiens
aatgttgaattttg

SEQ ID NO: 1892890 - DNA, 18 bp, Homo sapiens
aattacacaataaagcag

SEQ ID NO: 1892891 - DNA, 17 bp, Homo sapiens
aattagtaattgtcaat

SEQ ID NO: 1892892 - DNA, 14 bp, Homo sapiens
aattagttttatat

SEQ ID NO: 1892893 - DNA, 14 bp, Homo sapiens
aattcagagtcctt

SEQ ID NO: 1892894 - DNA, 14 bp, Homo sapiens
aattcatgtaacag

SEQ ID NO: 1892895 - DNA, 15 bp, Homo sapiens
aattgaatcactgct

SEQ ID NO: 1892896 - DNA, 14 bp, Homo sapiens
aattgactgcagtt

SEQ ID NO: 1892897 - DNA, 15 bp, Homo sapiens
aattgactgcagttg

SEQ ID NO: 1892898 - DNA, 22 bp, Homo sapiens
aattgaggagagggactgaata

SEQ ID NO: 1892899 - DNA, 17 bp, Homo sapiens
aattgggtgtgccctgg

SEQ ID NO: 1892900 - DNA, 21 bp, Homo sapiens
aattgggtgtgccctggctcc

SEQ ID NO: 1892901 - DNA, 21 bp, Homo sapiens
aattgtaaaattgtatagaga

SEQ ID NO: 1892902 - DNA, 21 bp, Homo sapiens
aattgtggggatgatgaaata

SEQ ID NO: 1892903 - DNA, 12 bp, Homo sapiens
aatttattttgt

SEQ ID NO: 1892904 - DNA, 17 bp, Homo sapiens
aatttattttgtcgaat

SEQ ID NO: 1892905 - DNA, 21 bp, Homo sapiens
aatttattttgtcgaattttt

SEQ ID NO: 1892906 - DNA, 12 bp, Homo sapiens
aatttgtatctg

SEQ ID NO: 1892907 - DNA, 15 bp, Homo sapiens
aatttgtatctgaag

SEQ ID NO: 1892908 - DNA, 18 bp, Homo sapiens
aatttgtatctgaaggag

SEQ ID NO: 1892909 - DNA, 14 bp, Homo sapiens
aattttgatgaaca

SEQ ID NO: 1892910 - DNA, 16 bp, Homo sapiens
aattttgatgaacaaa

SEQ ID NO: 1892911 - DNA, 13 bp, Homo sapiens
aattttgtgaagc

SEQ ID NO: 1892912 - DNA, 18 bp, Homo sapiens
aattttgtgaagcaaaat

SEQ ID NO: 1892913 - DNA, 19 bp, Homo sapiens
aatttttatatttgaaata

SEQ ID NO: 1892914 - DNA, 12 bp, Homo sapiens
acaaataaacag

SEQ ID NO: 1892915 - DNA, 13 bp, Homo sapiens
acaaataaacagt

SEQ ID NO: 1892916 - DNA, 14 bp, Homo sapiens
acaacagctgcctg

SEQ ID NO: 1892917 - DNA, 16 bp, Homo sapiens
acaacttgtgttctat

SEQ ID NO: 1892918 - DNA, 13 bp, Homo sapiens
acaagactgcaca

SEQ ID NO: 1892919 - DNA, 21 bp, Homo sapiens
acaaggatgaattaagttttt

SEQ ID NO: 1892920 - DNA, 20 bp, Homo sapiens
acaaggtcaggagttcgaga

SEQ ID NO: 1892921 - DNA, 17 bp, Homo sapiens
acaataaagcagtcctg

SEQ ID NO: 1892922 - DNA, 17 bp, Homo sapiens
acaatgctgtattttaa

SEQ ID NO: 1892923 - DNA, 18 bp, Homo sapiens
acaatgctgtattttaaa

SEQ ID NO: 1892924 - DNA, 14 bp, Homo sapiens
acaatgtgtctgag

SEQ ID NO: 1892925 - DNA, 17 bp, Homo sapiens
acacaactatattgttt

SEQ ID NO: 1892926 - DNA, 15 bp, Homo sapiens
acacaataaagcagt

SEQ ID NO: 1892927 - DNA, 23 bp, Homo sapiens
acacacactcgggttaagaaata

SEQ ID NO: 1892928 - DNA, 21 bp, Homo sapiens
acacactcgggttaagaaata

SEQ ID NO: 1892929 - DNA, 16 bp, Homo sapiens
acaccaagctgtgcca

SEQ ID NO: 1892930 - DNA, 18 bp, Homo sapiens
acaccaagctgtgccacc

SEQ ID NO: 1892931 - DNA, 21 bp, Homo sapiens
acaccatttttccagagctgc

SEQ ID NO: 1892932 - DNA, 12 bp, Homo sapiens
acacctctgggc

SEQ ID NO: 1892933 - DNA, 15 bp, Homo sapiens
acactaaacagacta

SEQ ID NO: 1892934 - DNA, 19 bp, Homo sapiens
acactcgggttaagaaata

SEQ ID NO: 1892935 - DNA, 18 bp, Homo sapiens
acacttcagcctgtgcag

SEQ ID NO: 1892936 - DNA, 17 bp, Homo sapiens
acagaatagaatacatt

SEQ ID NO: 1892937 - DNA, 19 bp, Homo sapiens
acagaatagaatacattga

SEQ ID NO: 1892938 - DNA, 16 bp, Homo sapiens
acagaatgctgtttta

SEQ ID NO: 1892939 - DNA, 18 bp, Homo sapiens
acagaatgctgttttaaa

SEQ ID NO: 1892940 - DNA, 21 bp, Homo sapiens
acagaattgactgcagttgaa

SEQ ID NO: 1892941 - DNA, 20 bp, Homo sapiens
acagagtgtggtccctccac

SEQ ID NO: 1892942 - DNA, 23 bp, Homo sapiens
acagcaaggaggctggctggggc

SEQ ID NO: 1892943 - DNA, 16 bp, Homo sapiens
acagcccacgtcctgt

SEQ ID NO: 1892944 - DNA, 21 bp, Homo sapiens
acagccctcccgccccttccc

SEQ ID NO: 1892945 - DNA, 22 bp, Homo sapiens
acagccctcccgccccttcccc

SEQ ID NO: 1892946 - DNA, 19 bp, Homo sapiens
acagcccttctttccacag

SEQ ID NO: 1892947 - DNA, 20 bp, Homo sapiens
acagcccttctttccacaga

SEQ ID NO: 1892948 - DNA, 20 bp, Homo sapiens
acagctgtatgattcccagc

SEQ ID NO: 1892949 - DNA, 24 bp, Homo sapiens
acaggatggttcccttgatgaaga

SEQ ID NO: 1892950 - DNA, 21 bp, Homo sapiens
acaggcaaaccaatacagaat

SEQ ID NO: 1892951 - DNA, 13 bp, Homo sapiens
acaggggctcagg

SEQ ID NO: 1892952 - DNA, 17 bp, Homo sapiens
acagtaaataaattgtt

SEQ ID NO: 1892953 - DNA, 16 bp, Homo sapiens
acagtcacctcatgga

SEQ ID NO: 1892954 - DNA, 17 bp, Homo sapiens
acagtcacctcatggaa

SEQ ID NO: 1892955 - DNA, 18 bp, Homo sapiens
acagtcacctcatggaat

SEQ ID NO: 1892956 - DNA, 23 bp, Homo sapiens
acagtcctctccacctagtggct

SEQ ID NO: 1892957 - DNA, 17 bp, Homo sapiens
aggccttggcccacctg

SEQ ID NO: 1892958 - DNA, 14 bp, Homo sapiens
aggcgactggaggc

SEQ ID NO: 1892959 - DNA, 18 bp, Homo sapiens
aggcgggggagcctggag

SEQ ID NO: 1892960 - DNA, 23 bp, Homo sapiens
aggcgggggagcctggagcccct

SEQ ID NO: 1892961 - DNA, 14 bp, Homo sapiens
aggctgagactgca

SEQ ID NO: 1892962 - DNA, 19 bp, Homo sapiens
aggctgagactgcagagga

SEQ ID NO: 1892963 - DNA, 18 bp, Homo sapiens
aggctgcagcaggcagag

SEQ ID NO: 1892964 - DNA, 22 bp, Homo sapiens
aggctgcagcaggcagaggaga

SEQ ID NO: 1892965 - DNA, 15 bp, Homo sapiens
aggctggccagcccc

SEQ ID NO: 1892966 - DNA, 22 bp, Homo sapiens
aggctggccagccccacagccc

SEQ ID NO: 1892967 - DNA, 13 bp, Homo sapiens
aggctggctgggg

SEQ ID NO: 1892968 - DNA, 15 bp, Homo sapiens
aggctggctggggcc

SEQ ID NO: 1892969 - DNA, 23 bp, Homo sapiens
agggaccacagcaaggcacctgc

SEQ ID NO: 1892970 - DNA, 16 bp, Homo sapiens
agggaggggaggtggc

SEQ ID NO: 1892971 - DNA, 23 bp, Homo sapiens
agggatcctctctccaggcccca

SEQ ID NO: 1892972 - DNA, 14 bp, Homo sapiens
agggccccggggcc

SEQ ID NO: 1892973 - DNA, 22 bp, Homo sapiens
agggcgaggcgggggagcctgg

SEQ ID NO: 1892974 - DNA, 22 bp, Homo sapiens
agggcgaggcgggggatcctgg

SEQ ID NO: 1892975 - DNA, 22 bp, Homo sapiens
agggctgggcaggtcctgggga

SEQ ID NO: 1892976 - DNA, 13 bp, Homo sapiens
aggggagtctgct

SEQ ID NO: 1892977 - DNA, 16 bp, Homo sapiens
aggggagtctgcttgt

SEQ ID NO: 1892978 - DNA, 19 bp, Homo sapiens
aggggcaggccctgcactg

SEQ ID NO: 1892979 - DNA, 21 bp, Homo sapiens
aggggcccgttgtctccctgg

SEQ ID NO: 1892980 - DNA, 13 bp, Homo sapiens
aggggtctccctg

SEQ ID NO: 1892981 - DNA, 14 bp, Homo sapiens
aggggtctccctga

SEQ ID NO: 1892982 - DNA, 15 bp, Homo sapiens
aggggtctccctgag

SEQ ID NO: 1892983 - DNA, 18 bp, Homo sapiens
aggggtctccctgagcct

SEQ ID NO: 1892984 - DNA, 14 bp, Homo sapiens
agggtcaaagtaca

SEQ ID NO: 1892985 - DNA, 20 bp, Homo sapiens
agggtcctacggagggacca

SEQ ID NO: 1892986 - DNA, 11 bp, Homo sapiens
aggtaaataaa

SEQ ID NO: 1892987 - DNA, 23 bp, Homo sapiens
aggtacttcaaatccttgaagat

SEQ ID NO: 1892988 - DNA, 23 bp, Homo sapiens
aggtctcctccaccgccatggct

SEQ ID NO: 1892989 - DNA, 22 bp, Homo sapiens
aggtgaccccatctctgctgct

SEQ ID NO: 1892990 - DNA, 21 bp, Homo sapiens
aggtgatggccagtcatgtgc

SEQ ID NO: 1892991 - DNA, 21 bp, Homo sapiens
aggtgcagtcccagtccttga

SEQ ID NO: 1892992 - DNA, 22 bp, Homo sapiens
aggtgctagggtgcctgctctc

SEQ ID NO: 1892993 - DNA, 20 bp, Homo sapiens
aggtgctgctaccctccctg

SEQ ID NO: 1892994 - DNA, 22 bp, Homo sapiens
aggtgctgctaccctccctgct

SEQ ID NO: 1892995 - DNA, 18 bp, Homo sapiens
aggtggcgccccctggtg

SEQ ID NO: 1892996 - DNA, 17 bp, Homo sapiens
aggtggcttaccaagat

SEQ ID NO: 1892997 - DNA, 19 bp, Homo sapiens
aggtgggaacatggtcacc

SEQ ID NO: 1892998 - DNA, 14 bp, Homo sapiens
aggtgggggagcct

SEQ ID NO: 1892999 - DNA, 18 bp, Homo sapiens
aggtgggggagcctggag

SEQ ID NO: 1893000 - DNA, 21 bp, Homo sapiens
aggtgggggagcctggagccc

SEQ ID NO: 1893001 - DNA, 16 bp, Homo sapiens
aggtggtagctctgag

SEQ ID NO: 1893002 - DNA, 20 bp, Homo sapiens
aggtggtagctctgagccct

SEQ ID NO: 1893003 - DNA, 12 bp, Homo sapiens
aggttgcagtga

SEQ ID NO: 1893004 - DNA, 19 bp, Homo sapiens
aggtttctccttgaagcaa

SEQ ID NO: 1893005 - DNA, 13 bp, Homo sapiens
agtaattggaaag

SEQ ID NO: 1893006 - DNA, 21 bp, Homo sapiens
agtactcctcacttttcaatt

SEQ ID NO: 1893007 - DNA, 14 bp, Homo sapiens
agtactgaggtggt

SEQ ID NO: 1893008 - DNA, 14 bp, Homo sapiens
agtatctggctggg

SEQ ID NO: 1893009 - DNA, 15 bp, Homo sapiens
agtatcttttaaaat

SEQ ID NO: 1893010 - DNA, 18 bp, Homo sapiens
agtattagaataccacag

SEQ ID NO: 1893011 - DNA, 17 bp, Homo sapiens
agtatttctatgaaata

SEQ ID NO: 1893012 - DNA, 22 bp, Homo sapiens
agtatttctatgaaatattatg

SEQ ID NO: 1893013 - DNA, 23 bp, Homo sapiens
agtcaaatggagaaacaggccca

SEQ ID NO: 1893014 - DNA, 17 bp, Homo sapiens
agtcaaattgtgtgaaa

SEQ ID NO: 1893015 - DNA, 15 bp, Homo sapiens
agtcacctcatggaa

SEQ ID NO: 1893016 - DNA, 17 bp, Homo sapiens
agtcacctcatggaatt

SEQ ID NO: 1893017 - DNA, 14 bp, Homo sapiens
agtcaggaaagaga

SEQ ID NO: 1893018 - DNA, 15 bp, Homo sapiens
agtcaggaaagagaa

SEQ ID NO: 1893019 - DNA, 15 bp, Homo sapiens
agtcatattcttatg

SEQ ID NO: 1893020 - DNA, 13 bp, Homo sapiens
agtcatcgtttgt

SEQ ID NO: 1893021 - DNA, 17 bp, Homo sapiens
agtcatggtggccacgg

SEQ ID NO: 1893022 - DNA, 17 bp, Homo sapiens
agtcctcacatgcccgc

SEQ ID NO: 1893023 - DNA, 21 bp, Homo sapiens
agtcctctccacctagtggct

SEQ ID NO: 1893024 - DNA, 13 bp, Homo sapiens
agtcctgttcaaa

SEQ ID NO: 1893025 - DNA, 13 bp, Homo sapiens
agtcgcgctgcct

SEQ ID NO: 1893026 - DNA, 18 bp, Homo sapiens
agtcgcgctgcctgtgtg

SEQ ID NO: 1893027 - DNA, 12 bp, Homo sapiens
agtctaaagttt

SEQ ID NO: 1893028 - DNA, 20 bp, Homo sapiens
agtctaaagtttacagtaaa

SEQ ID NO: 1893029 - DNA, 23 bp, Homo sapiens
agtctaaagtttacagtaaataa

SEQ ID NO: 1893030 - DNA, 20 bp, Homo sapiens
agtctgcttgtcttagatgt

SEQ ID NO: 1893031 - DNA, 18 bp, Homo sapiens
agtctgtgagattcattc

SEQ ID NO: 1893032 - DNA, 14 bp, Homo sapiens
agtgaaaaatgaga

SEQ ID NO: 1893033 - DNA, 21 bp, Homo sapiens
agtgactcgggctcctgtgcc

SEQ ID NO: 1893034 - DNA, 19 bp, Homo sapiens
agtgatcttaggtttgttt

SEQ ID NO: 1893035 - DNA, 23 bp, Homo sapiens
agtgatcttaggtttgttttttc

SEQ ID NO: 1893036 - DNA, 14 bp, Homo sapiens
agtgcaaattgtca

SEQ ID NO: 1893037 - DNA, 15 bp, Homo sapiens
agtgcagcttgcagt

SEQ ID NO: 1893038 - DNA, 16 bp, Homo sapiens
agtgcagcttgcagtc

SEQ ID NO: 1893039 - DNA, 13 bp, Homo sapiens
agtgcccattcct

SEQ ID NO: 1893040 - DNA, 19 bp, Homo sapiens
agtgccgccgcctcgccca

SEQ ID NO: 1893041 - DNA, 14 bp, Homo sapiens
agtgccttttggaa

SEQ ID NO: 1893042 - DNA, 15 bp, Homo sapiens
agtgccttttggaac

SEQ ID NO: 1893043 - DNA, 13 bp, Homo sapiens
agtgctggctcca

SEQ ID NO: 1893044 - DNA, 16 bp, Homo sapiens
agtggcattggcagca

SEQ ID NO: 1893045 - DNA, 18 bp, Homo sapiens
agtggcattggcagcagg

SEQ ID NO: 1893046 - DNA, 22 bp, Homo sapiens
agtggccaagatcacagtggcc

SEQ ID NO: 1893047 - DNA, 18 bp, Homo sapiens
agtggctgtccagtgccc

SEQ ID NO: 1893048 - DNA, 17 bp, Homo sapiens
agtgggtcccacttccc

SEQ ID NO: 1893049 - DNA, 21 bp, Homo sapiens
agtggtctggaatggactggg

SEQ ID NO: 1893050 - DNA, 20 bp, Homo sapiens
agtgtacccccgcccaggct

SEQ ID NO: 1893051 - DNA, 23 bp, Homo sapiens
agtgtacccccgcccaggctggc

SEQ ID NO: 1893052 - DNA, 14 bp, Homo sapiens
agtgtctgggctga

SEQ ID NO: 1893053 - DNA, 15 bp, Homo sapiens
agtgtctgtaaggac

SEQ ID NO: 1893054 - DNA, 14 bp, Homo sapiens
agtgtcttcctgtg

SEQ ID NO: 1893055 - DNA, 13 bp, Homo sapiens
agtgtggtccctc

SEQ ID NO: 1893056 - DNA, 17 bp, Homo sapiens
agtgtgtgtgttctgta

SEQ ID NO: 1893057 - DNA, 17 bp, Homo sapiens
agtgttggagaagaact

SEQ ID NO: 1893058 - DNA, 22 bp, Homo sapiens
agttatttatgcctctgtattt

SEQ ID NO: 1893059 - DNA, 16 bp, Homo sapiens
agttcagttcctcttt

SEQ ID NO: 1893060 - DNA, 18 bp, Homo sapiens
agttcctcctaaggaaat

SEQ ID NO: 1893061 - DNA, 16 bp, Homo sapiens
agttcctctttgcatg

SEQ ID NO: 1893062 - DNA, 10 bp, Homo sapiens
agttgcagtt

SEQ ID NO: 1893063 - DNA, 14 bp, Homo sapiens
agtttacagtaaat

SEQ ID NO: 1893064 - DNA, 16 bp, Homo sapiens
agtttacagtaaataa

SEQ ID NO: 1893065 - DNA, 18 bp, Homo sapiens
agtttacagtaaataaat

SEQ ID NO: 1893066 - DNA, 20 bp, Homo sapiens
agtttacagtaaataaattg

SEQ ID NO: 1893067 - DNA, 15 bp, Homo sapiens
agtttagctggaaaa

SEQ ID NO: 1893068 - DNA, 22 bp, Homo sapiens
agtttgttcacttaaattcttt

SEQ ID NO: 1893069 - DNA, 22 bp, Homo sapiens
agttttcctaagtgattgtatg

SEQ ID NO: 1893070 - DNA, 12 bp, Homo sapiens
ataaaaaatggt

SEQ ID NO: 1893071 - DNA, 15 bp, Homo sapiens
ataaaactgctttgt

SEQ ID NO: 1893072 - DNA, 15 bp, Homo sapiens
ataaaataattttta

SEQ ID NO: 1893073 - DNA, 16 bp, Homo sapiens
ataaaataatttttat

SEQ ID NO: 1893074 - DNA, 22 bp, Homo sapiens
ataaaataatttttatatttga

SEQ ID NO: 1893075 - DNA, 20 bp, Homo sapiens
attttagcttcagttgttct

SEQ ID NO: 1893076 - DNA, 13 bp, Homo sapiens
attttcatgactt

SEQ ID NO: 1893077 - DNA, 20 bp, Homo sapiens
attttcatgacttttccatg

SEQ ID NO: 1893078 - DNA, 15 bp, Homo sapiens
attttcattattcct

SEQ ID NO: 1893079 - DNA, 14 bp, Homo sapiens
attttcttcacagt

SEQ ID NO: 1893080 - DNA, 20 bp, Homo sapiens
attttgaaatcatgaagata

SEQ ID NO: 1893081 - DNA, 22 bp, Homo sapiens
attttgagaaagtcttatttat

SEQ ID NO: 1893082 - DNA, 17 bp, Homo sapiens
attttgtaactttctct

SEQ ID NO: 1893083 - DNA, 14 bp, Homo sapiens
attttgtcgaattt

SEQ ID NO: 1893084 - DNA, 19 bp, Homo sapiens
atttttaatatatactatg

SEQ ID NO: 1893085 - DNA, 23 bp, Homo sapiens
attttttctctaggaaatattta

SEQ ID NO: 1893086 - DNA, 19 bp, Homo sapiens
caaaaacgccttttcttgg

SEQ ID NO: 1893087 - DNA, 18 bp, Homo sapiens
caaaagtttcatcctttt

SEQ ID NO: 1893088 - DNA, 20 bp, Homo sapiens
caaaattgtctaaaatgtca

SEQ ID NO: 1893089 - DNA, 11 bp, Homo sapiens
caaacataata

SEQ ID NO: 1893090 - DNA, 17 bp, Homo sapiens
caaacatatataacaat

SEQ ID NO: 1893091 - DNA, 16 bp, Homo sapiens
caaagcaataatagta

SEQ ID NO: 1893092 - DNA, 13 bp, Homo sapiens
caaagtctaaagt

SEQ ID NO: 1893093 - DNA, 15 bp, Homo sapiens
caaataaacagttgt

SEQ ID NO: 1893094 - DNA, 19 bp, Homo sapiens
caaataaacagttgttact

SEQ ID NO: 1893095 - DNA, 19 bp, Homo sapiens
caaatggagaaacaggccc

SEQ ID NO: 1893096 - DNA, 14 bp, Homo sapiens
caaattatcttaaa

SEQ ID NO: 1893097 - DNA, 17 bp, Homo sapiens
caacaaagaggacacca

SEQ ID NO: 1893098 - DNA, 20 bp, Homo sapiens
caacagtgttaggcctggca

SEQ ID NO: 1893099 - DNA, 18 bp, Homo sapiens
caacagtgttctgagccc

SEQ ID NO: 1893100 - DNA, 19 bp, Homo sapiens
caaccagattgtcagctcc

SEQ ID NO: 1893101 - DNA, 20 bp, Homo sapiens
caaccagattgtcagctcct

SEQ ID NO: 1893102 - DNA, 23 bp, Homo sapiens
caaccagggccccggggcctgtt

SEQ ID NO: 1893103 - DNA, 18 bp, Homo sapiens
caacccagccgctgcccg

SEQ ID NO: 1893104 - DNA, 15 bp, Homo sapiens
caacccatgccctgc

SEQ ID NO: 1893105 - DNA, 19 bp, Homo sapiens
caactatattgtttgctaa

SEQ ID NO: 1893106 - DNA, 18 bp, Homo sapiens
caactccaggacttgctt

SEQ ID NO: 1893107 - DNA, 20 bp, Homo sapiens
caactcgggagcattctgcc

SEQ ID NO: 1893108 - DNA, 21 bp, Homo sapiens
caagagatgaacatctgggga

SEQ ID NO: 1893109 - DNA, 13 bp, Homo sapiens
caagagccacagt

SEQ ID NO: 1893110 - DNA, 19 bp, Homo sapiens
caagcatttagatgtatag

SEQ ID NO: 1893111 - DNA, 18 bp, Homo sapiens
caagcccttccctctgtt

SEQ ID NO: 1893112 - DNA, 12 bp, Homo sapiens
caagcctggagc

SEQ ID NO: 1893113 - DNA, 21 bp, Homo sapiens
caagcctggagcccctgtgtt

SEQ ID NO: 1893114 - DNA, 17 bp, Homo sapiens
caagctgtgccaccctg

SEQ ID NO: 1893115 - DNA, 18 bp, Homo sapiens
caagctgtgccaccctgg

SEQ ID NO: 1893116 - DNA, 19 bp, Homo sapiens
caagctgtgccaccctggg

SEQ ID NO: 1893117 - DNA, 19 bp, Homo sapiens
caagcttaaggagaggaga

SEQ ID NO: 1893118 - DNA, 21 bp, Homo sapiens
caaggaggctggctggggcct

SEQ ID NO: 1893119 - DNA, 19 bp, Homo sapiens
caaggcacctgcaggttgg

SEQ ID NO: 1893120 - DNA, 14 bp, Homo sapiens
caaggcctcccaca

SEQ ID NO: 1893121 - DNA, 18 bp, Homo sapiens
caaggcctcccacagtga

SEQ ID NO: 1893122 - DNA, 22 bp, Homo sapiens
caagggtcctacggagggacca

SEQ ID NO: 1893123 - DNA, 17 bp, Homo sapiens
caaggtgggggagcctg

SEQ ID NO: 1893124 - DNA, 23 bp, Homo sapiens
caaggtggtctgctcgggcccag

SEQ ID NO: 1893125 - DNA, 20 bp, Homo sapiens
caagtattagaataccacag

SEQ ID NO: 1893126 - DNA, 18 bp, Homo sapiens
caagtcctgcctcttaaa

SEQ ID NO: 1893127 - DNA, 23 bp, Homo sapiens
caagtgcaggcgactggaggcag

SEQ ID NO: 1893128 - DNA, 23 bp, Homo sapiens
caatacccctagtatctggctgg

SEQ ID NO: 1893129 - DNA, 17 bp, Homo sapiens
caatcagcctagttgat

SEQ ID NO: 1893130 - DNA, 23 bp, Homo sapiens
caatccgttcccttctgccacct

SEQ ID NO: 1893131 - DNA, 17 bp, Homo sapiens
caatgctgtattttaaa

SEQ ID NO: 1893132 - DNA, 20 bp, Homo sapiens
caattcatgtaacagttgtg

SEQ ID NO: 1893133 - DNA, 17 bp, Homo sapiens
cacacatgaagtccaag

SEQ ID NO: 1893134 - DNA, 22 bp, Homo sapiens
cacacatgaagtccaagcattt

SEQ ID NO: 1893135 - DNA, 22 bp, Homo sapiens
cacacctctgtccctcaaaatt

SEQ ID NO: 1893136 - DNA, 14 bp, Homo sapiens
cacactgaagaagc

SEQ ID NO: 1893137 - DNA, 17 bp, Homo sapiens
cacagcaaggcacctgc

SEQ ID NO: 1893138 - DNA, 18 bp, Homo sapiens
cacagcccacgtcctgtc

SEQ ID NO: 1893139 - DNA, 20 bp, Homo sapiens
cacagcccacgtcctgtcag

SEQ ID NO: 1893140 - DNA, 14 bp, Homo sapiens
cacagccctcccgc

SEQ ID NO: 1893141 - DNA, 19 bp, Homo sapiens
cacagcgctggccgggacc

SEQ ID NO: 1893142 - DNA, 22 bp, Homo sapiens
cacagcgctggccgggaccccg

SEQ ID NO: 1893143 - DNA, 22 bp, Homo sapiens
cacaggacccagaaaaaaagcc

SEQ ID NO: 1893144 - DNA, 19 bp, Homo sapiens
cacagtcatggtggccacg

SEQ ID NO: 1893145 - DNA, 19 bp, Homo sapiens
cacagtgactcgggctcct

SEQ ID NO: 1893146 - DNA, 22 bp, Homo sapiens
cacagtgactcgggctcctgtg

SEQ ID NO: 1893147 - DNA, 23 bp, Homo sapiens
cacagtgactcgggctcctgtgc

SEQ ID NO: 1893148 - DNA, 19 bp, Homo sapiens
cacagtgcagcttgcagtc

SEQ ID NO: 1893149 - DNA, 22 bp, Homo sapiens
cacagtggccaagatcacagtg

SEQ ID NO: 1893150 - DNA, 20 bp, Homo sapiens
cacagtgtctgggctgactg

SEQ ID NO: 1893151 - DNA, 17 bp, Homo sapiens
cacagtgttggcgagag

SEQ ID NO: 1893152 - DNA, 16 bp, Homo sapiens
cacatgaagtccaagc

SEQ ID NO: 1893153 - DNA, 20 bp, Homo sapiens
cacatgaagtccaagcattt

SEQ ID NO: 1893154 - DNA, 13 bp, Homo sapiens
caccaacccagcc

SEQ ID NO: 1893155 - DNA, 14 bp, Homo sapiens
caccaagctgtgcc

SEQ ID NO: 1893156 - DNA, 16 bp, Homo sapiens
caccaagctgtgccac

SEQ ID NO: 1893157 - DNA, 18 bp, Homo sapiens
caccaagctgtgccaccc

SEQ ID NO: 1893158 - DNA, 20 bp, Homo sapiens
caccaagctgtgccaccctg

SEQ ID NO: 1893159 - DNA, 20 bp, Homo sapiens
caccagctccactggcctgc

SEQ ID NO: 1893160 - DNA, 12 bp, Homo sapiens
caccaggggcag

SEQ ID NO: 1893161 - DNA, 16 bp, Homo sapiens
caccaggggcaggcac

SEQ ID NO: 1893162 - DNA, 20 bp, Homo sapiens
caccaggggcaggcacagca

SEQ ID NO: 1893163 - DNA, 19 bp, Homo sapiens
caccagttgaactgcagga

SEQ ID NO: 1893164 - DNA, 14 bp, Homo sapiens
caccccctcctgct

SEQ ID NO: 1893165 - DNA, 13 bp, Homo sapiens
caccctcccctcc

SEQ ID NO: 1893166 - DNA, 18 bp, Homo sapiens
caccctgcctctacccaa

SEQ ID NO: 1893167 - DNA, 21 bp, Homo sapiens
caccctgcctctacccaacca

SEQ ID NO: 1893168 - DNA, 21 bp, Homo sapiens
caccctggattgatcggagcc

SEQ ID NO: 1893169 - DNA, 15 bp, Homo sapiens
caccctgggctctgt

SEQ ID NO: 1893170 - DNA, 14 bp, Homo sapiens
cacccttggacttg

SEQ ID NO: 1893171 - DNA, 18 bp, Homo sapiens
caccgcatgccccctcgt

SEQ ID NO: 1893172 - DNA, 23 bp, Homo sapiens
caccgccatggcttccaaggtgg

SEQ ID NO: 1893173 - DNA, 14 bp, Homo sapiens
cacctagtggctgt

SEQ ID NO: 1893174 - DNA, 23 bp, Homo sapiens
cacctagtggctgtccagtgccc

SEQ ID NO: 1893175 - DNA, 17 bp, Homo sapiens
cacctcaagtgcaagga

SEQ ID NO: 1893176 - DNA, 18 bp, Homo sapiens
cacctcaagtgcaaggac

SEQ ID NO: 1893177 - DNA, 21 bp, Homo sapiens
cacctcaagtgcaaggaccaa

SEQ ID NO: 1893178 - DNA, 12 bp, Homo sapiens
cacctcatggaa

SEQ ID NO: 1893179 - DNA, 14 bp, Homo sapiens
cacctctgggccct

SEQ ID NO: 1893180 - DNA, 19 bp, Homo sapiens
cacctctgggccctgcagg

SEQ ID NO: 1893181 - DNA, 22 bp, Homo sapiens
cacctctgggccctgcaggagg

SEQ ID NO: 1893182 - DNA, 23 bp, Homo sapiens
cacctgcaggttgggccatactg

SEQ ID NO: 1893183 - DNA, 12 bp, Homo sapiens
cacctgcctgac

SEQ ID NO: 1893184 - DNA, 22 bp, Homo sapiens
cacctgggctgggagaaggtgc

SEQ ID NO: 1893185 - DNA, 14 bp, Homo sapiens
cacctttaaagtgt

SEQ ID NO: 1893186 - DNA, 17 bp, Homo sapiens
cacgaggaggaaccagg

SEQ ID NO: 1893187 - DNA, 20 bp, Homo sapiens
cacgaggaggaaccaggcta

SEQ ID NO: 1893188 - DNA, 20 bp, Homo sapiens
cacgaggtggtagctctgag

SEQ ID NO: 1893189 - DNA, 19 bp, Homo sapiens
cacgtcctgtcagtgccgc

SEQ ID NO: 1893190 - DNA, 23 bp, Homo sapiens
cacgtcctgtcagtgccgccgcc

SEQ ID NO: 1893191 - DNA, 18 bp, Homo sapiens
cacgtggtaaaacacttg

SEQ ID NO: 1893192 - DNA, 19 bp, Homo sapiens
cccacgtcctgtcagtgcc

SEQ ID NO: 1893193 - DNA, 14 bp, Homo sapiens
cccactgcaccccc

SEQ ID NO: 1893194 - DNA, 18 bp, Homo sapiens
cccactgcaccccctcct

SEQ ID NO: 1893195 - DNA, 19 bp, Homo sapiens
cccactgcaccccctcctg

SEQ ID NO: 1893196 - DNA, 20 bp, Homo sapiens
cccactgcaccccctcctgc

SEQ ID NO: 1893197 - DNA, 23 bp, Homo sapiens
cccactgcaccccctcctgctgc

SEQ ID NO: 1893198 - DNA, 19 bp, Homo sapiens
cccacttcccctcctaccc

SEQ ID NO: 1893199 - DNA, 23 bp, Homo sapiens
cccacttcccctcctacccctcc

SEQ ID NO: 1893200 - DNA, 22 bp, Homo sapiens
cccagaaaaaaagcccaacaca

SEQ ID NO: 1893201 - DNA, 22 bp, Homo sapiens
cccagcacccgggctcagggac

SEQ ID NO: 1893202 - DNA, 17 bp, Homo sapiens
cccagcccaagagatga

SEQ ID NO: 1893203 - DNA, 17 bp, Homo sapiens
cccagccgctgcccggc

SEQ ID NO: 1893204 - DNA, 12 bp, Homo sapiens
cccagcctggcc

SEQ ID NO: 1893205 - DNA, 16 bp, Homo sapiens
cccagcctggcccagc

SEQ ID NO: 1893206 - DNA, 18 bp, Homo sapiens
cccagcctggcccagctc

SEQ ID NO: 1893207 - DNA, 20 bp, Homo sapiens
cccagcctggcccagctccc

SEQ ID NO: 1893208 - DNA, 22 bp, Homo sapiens
cccagcctggcccagctccccc

SEQ ID NO: 1893209 - DNA, 23 bp, Homo sapiens
cccagctgggctgttggctgggg

SEQ ID NO: 1893210 - DNA, 12 bp, Homo sapiens
cccaggaccaag

SEQ ID NO: 1893211 - DNA, 20 bp, Homo sapiens
cccaggaggcggaggttgca

SEQ ID NO: 1893212 - DNA, 20 bp, Homo sapiens
cccaggccatcttccaggtg

SEQ ID NO: 1893213 - DNA, 13 bp, Homo sapiens
cccaggctggcca

SEQ ID NO: 1893214 - DNA, 15 bp, Homo sapiens
cccaggctggccagc

SEQ ID NO: 1893215 - DNA, 20 bp, Homo sapiens
cccaggctggccagccccac

SEQ ID NO: 1893216 - DNA, 17 bp, Homo sapiens
cccaggggtctccctga

SEQ ID NO: 1893217 - DNA, 21 bp, Homo sapiens
cccaggggtctccctgagcct

SEQ ID NO: 1893218 - DNA, 22 bp, Homo sapiens
cccaggggtctccctgagcctg

SEQ ID NO: 1893219 - DNA, 17 bp, Homo sapiens
cccaggtaagcaggagg

SEQ ID NO: 1893220 - DNA, 19 bp, Homo sapiens
cccaggtaagcaggaggag

SEQ ID NO: 1893221 - DNA, 20 bp, Homo sapiens
cccagtgtcttcctgtgggg

SEQ ID NO: 1893222 - DNA, 15 bp, Homo sapiens
cccatacctttccag

SEQ ID NO: 1893223 - DNA, 13 bp, Homo sapiens
cccatcagtgtac

SEQ ID NO: 1893224 - DNA, 14 bp, Homo sapiens
cccatcccccctca

SEQ ID NO: 1893225 - DNA, 17 bp, Homo sapiens
cccatcctggcccatca

SEQ ID NO: 1893226 - DNA, 12 bp, Homo sapiens
cccatctgccca

SEQ ID NO: 1893227 - DNA, 20 bp, Homo sapiens
cccatctggaggctcccatg

SEQ ID NO: 1893228 - DNA, 21 bp, Homo sapiens
cccatctggaggctcccatgg

SEQ ID NO: 1893229 - DNA, 16 bp, Homo sapiens
cccatgagcagtccag

SEQ ID NO: 1893230 - DNA, 12 bp, Homo sapiens
cccatgccctgc

SEQ ID NO: 1893231 - DNA, 22 bp, Homo sapiens
cccatgccctgccaagcctgga

SEQ ID NO: 1893232 - DNA, 15 bp, Homo sapiens
cccatgggcactgct

SEQ ID NO: 1893233 - DNA, 16 bp, Homo sapiens
cccatgggcactgctg

SEQ ID NO: 1893234 - DNA, 17 bp, Homo sapiens
cccatgggcactgctgg

SEQ ID NO: 1893235 - DNA, 16 bp, Homo sapiens
cccatgtcaccggtca

SEQ ID NO: 1893236 - DNA, 14 bp, Homo sapiens
cccattcctcacct

SEQ ID NO: 1893237 - DNA, 12 bp, Homo sapiens
ccccacagccca

SEQ ID NO: 1893238 - DNA, 13 bp, Homo sapiens
ccccacagcccac

SEQ ID NO: 1893239 - DNA, 16 bp, Homo sapiens
ccccacagcccacgtc

SEQ ID NO: 1893240 - DNA, 21 bp, Homo sapiens
ccccacagcccacgtcctgtc

SEQ ID NO: 1893241 - DNA, 13 bp, Homo sapiens
ccccacctgcctg

SEQ ID NO: 1893242 - DNA, 22 bp, Homo sapiens
ccccagcctggcccagctcccc

SEQ ID NO: 1893243 - DNA, 17 bp, Homo sapiens
ccccaggaccaagctta

SEQ ID NO: 1893244 - DNA, 15 bp, Homo sapiens
ccccatcctggccca

SEQ ID NO: 1893245 - DNA, 17 bp, Homo sapiens
ccccatcctggcccatc

SEQ ID NO: 1893246 - DNA, 17 bp, Homo sapiens
ccccatctctgctgctt

SEQ ID NO: 1893247 - DNA, 14 bp, Homo sapiens
ccccatctgcccag

SEQ ID NO: 1893248 - DNA, 17 bp, Homo sapiens
ccccatctgcccaggac

SEQ ID NO: 1893249 - DNA, 15 bp, Homo sapiens
cccccatcctggccc

SEQ ID NO: 1893250 - DNA, 13 bp, Homo sapiens
cccccgcccaggc

SEQ ID NO: 1893251 - DNA, 15 bp, Homo sapiens
cccccggggctgggt

SEQ ID NO: 1893252 - DNA, 13 bp, Homo sapiens
ccccctccctgga

SEQ ID NO: 1893253 - DNA, 13 bp, Homo sapiens
ccccctcctgctg

SEQ ID NO: 1893254 - DNA, 11 bp, Homo sapiens
ccccctggtgg

SEQ ID NO: 1893255 - DNA, 12 bp, Homo sapiens
ccccctggtggg

SEQ ID NO: 1893256 - DNA, 18 bp, Homo sapiens
ccccgagggatgatgcca

SEQ ID NO: 1893257 - DNA, 15 bp, Homo sapiens
ccccgcccaggctgg

SEQ ID NO: 1893258 - DNA, 17 bp, Homo sapiens
cccctagtatctggctg

SEQ ID NO: 1893259 - DNA, 18 bp, Homo sapiens
cccctagtatctggctgg

SEQ ID NO: 1893260 - DNA, 16 bp, Homo sapiens
cccctcaccaggggca

SEQ ID NO: 1893261 - DNA, 19 bp, Homo sapiens
cccctcctacccctcccag

SEQ ID NO: 1893262 - DNA, 22 bp, Homo sapiens
cccctcctgctgcagaggggca

SEQ ID NO: 1893263 - DNA, 15 bp, Homo sapiens
cccctcgtgccagtc

SEQ ID NO: 1893264 - DNA, 17 bp, Homo sapiens
cccctcgtgccagtcgc

SEQ ID NO: 1893265 - DNA, 19 bp, Homo sapiens
cccctggcctgactcccat

SEQ ID NO: 1893266 - DNA, 15 bp, Homo sapiens
cccgagcctggctcc

SEQ ID NO: 1893267 - DNA, 12 bp, Homo sapiens
cccgcccaggct

SEQ ID NO: 1893268 - DNA, 14 bp, Homo sapiens
cccgcccaggctgg

SEQ ID NO: 1893269 - DNA, 20 bp, Homo sapiens
cccgccccttccccgaggga

SEQ ID NO: 1893270 - DNA, 15 bp, Homo sapiens
cccgctcccagtgtc

SEQ ID NO: 1893271 - DNA, 17 bp, Homo sapiens
cccgcttgcctcggctc

SEQ ID NO: 1893272 - DNA, 22 bp, Homo sapiens
cccgcttgcctcggctcctgct

SEQ ID NO: 1893273 - DNA, 23 bp, Homo sapiens
cccgcttgcctcggctcctgctg

SEQ ID NO: 1893274 - DNA, 18 bp, Homo sapiens
cccggcgccctctgtcct

SEQ ID NO: 1893275 - DNA, 19 bp, Homo sapiens
cccggcgccctctgtcctg

SEQ ID NO: 1893276 - DNA, 18 bp, Homo sapiens
cccgggaggggcccgctt

SEQ ID NO: 1893277 - DNA, 12 bp, Homo sapiens
cccgtggcccca

SEQ ID NO: 1893278 - DNA, 20 bp, Homo sapiens
cccgtggccccagcctggcc

SEQ ID NO: 1893279 - DNA, 19 bp, Homo sapiens
cccgttgccgggcctggac

SEQ ID NO: 1893280 - DNA, 16 bp, Homo sapiens
cccgttgtctccctgg

SEQ ID NO: 1893281 - DNA, 19 bp, Homo sapiens
cccgttgtctccctggccc

SEQ ID NO: 1893282 - DNA, 16 bp, Homo sapiens
ccctcaaggcctccca

SEQ ID NO: 1893283 - DNA, 17 bp, Homo sapiens
ccctcaaggcctcccac

SEQ ID NO: 1893284 - DNA, 22 bp, Homo sapiens
ccctcaaggcctcccacagtga

SEQ ID NO: 1893285 - DNA, 14 bp, Homo sapiens
ccctccactaggag

SEQ ID NO: 1893286 - DNA, 13 bp, Homo sapiens
ccctccatccctg

SEQ ID NO: 1893287 - DNA, 14 bp, Homo sapiens
ccctccatccctgg

SEQ ID NO: 1893288 - DNA, 14 bp, Homo sapiens
ccctcccacagcgc

SEQ ID NO: 1893289 - DNA, 12 bp, Homo sapiens
ccctcccagctg

SEQ ID NO: 1893290 - DNA, 20 bp, Homo sapiens
ccctcccagctgacagtcct

SEQ ID NO: 1893291 - DNA, 12 bp, Homo sapiens
ccctccctgctg

SEQ ID NO: 1893292 - DNA, 19 bp, Homo sapiens
ccctccctgctgtcccctc

SEQ ID NO: 1893293 - DNA, 14 bp, Homo sapiens
ccctccgttgacag

SEQ ID NO: 1893294 - DNA, 20 bp, Homo sapiens
ccctcctacccctcccagct

SEQ ID NO: 1893295 - DNA, 21 bp, Homo sapiens
ccctcctacccctcccagctg

SEQ ID NO: 1893296 - DNA, 16 bp, Homo sapiens
ccctccttcttgccct

SEQ ID NO: 1893297 - DNA, 22 bp, Homo sapiens
ccctccttcttgccctgagctt

SEQ ID NO: 1893298 - DNA, 22 bp, Homo sapiens
ccctcgaggcggatctttggac

SEQ ID NO: 1893299 - DNA, 13 bp, Homo sapiens
ccctcgtgccagt

SEQ ID NO: 1893300 - DNA, 14 bp, Homo sapiens
ccctcgtgccagtc

SEQ ID NO: 1893301 - DNA, 15 bp, Homo sapiens
ccctctgtcctgact

SEQ ID NO: 1893302 - DNA, 18 bp, Homo sapiens
ccctcttgccccaacccc

SEQ ID NO: 1893303 - DNA, 22 bp, Homo sapiens
ccctcttgccccaacccccagc

SEQ ID NO: 1893304 - DNA, 15 bp, Homo sapiens
ccctgagagcatgtg

SEQ ID NO: 1893305 - DNA, 13 bp, Homo sapiens
ccctgcactgtcc

SEQ ID NO: 1893306 - DNA, 16 bp, Homo sapiens
ccctgcactgtcctgc

SEQ ID NO: 1893307 - DNA, 17 bp, Homo sapiens
ccctgcactgtcctgct

SEQ ID NO: 1893308 - DNA, 20 bp, Homo sapiens
ccctgcactgtcctgctcca

SEQ ID NO: 1893309 - DNA, 17 bp, Homo sapiens
ccctgcaggaggcctgg

SEQ ID NO: 1893310 - DNA, 19 bp, Homo sapiens
ccctgcaggaggcctggga

SEQ ID NO: 1893311 - DNA, 19 bp, Homo sapiens
ctctgctatgcattttctt

SEQ ID NO: 1893312 - DNA, 14 bp, Homo sapiens
ctctggaccccagg

SEQ ID NO: 1893313 - DNA, 15 bp, Homo sapiens
ctctggaccccaggc

SEQ ID NO: 1893314 - DNA, 13 bp, Homo sapiens
ctctgtcctgact

SEQ ID NO: 1893315 - DNA, 18 bp, Homo sapiens
ctctgtcctgacttcagg

SEQ ID NO: 1893316 - DNA, 12 bp, Homo sapiens
ctctgtgcccat

SEQ ID NO: 1893317 - DNA, 14 bp, Homo sapiens
ctctgtgctgagca

SEQ ID NO: 1893318 - DNA, 17 bp, Homo sapiens
ctctgtgggctgcactc

SEQ ID NO: 1893319 - DNA, 23 bp, Homo sapiens
ctctgtgggctgcactctgtgcc

SEQ ID NO: 1893320 - DNA, 17 bp, Homo sapiens
ctctgtgtcactggctg

SEQ ID NO: 1893321 - DNA, 20 bp, Homo sapiens
ctctgtgtcactggctgcct

SEQ ID NO: 1893322 - DNA, 20 bp, Homo sapiens
ctcttagatgcagttctgaa

SEQ ID NO: 1893323 - DNA, 12 bp, Homo sapiens
ctcttatttgct

SEQ ID NO: 1893324 - DNA, 22 bp, Homo sapiens
ctcttgccccaacccccagcac

SEQ ID NO: 1893325 - DNA, 14 bp, Homo sapiens
ctgaagaagatggt

SEQ ID NO: 1893326 - DNA, 23 bp, Homo sapiens
ctgaagaagcaccaatcatgaat

SEQ ID NO: 1893327 - DNA, 20 bp, Homo sapiens
ctgaaggagattttccttcc

SEQ ID NO: 1893328 - DNA, 21 bp, Homo sapiens
ctgaaggagattttccttcct

SEQ ID NO: 1893329 - DNA, 18 bp, Homo sapiens
ctgaatatataaacactc

SEQ ID NO: 1893330 - DNA, 21 bp, Homo sapiens
ctgacactgcggggcttggct

SEQ ID NO: 1893331 - DNA, 23 bp, Homo sapiens
ctgacactgcggggcttggctga

SEQ ID NO: 1893332 - DNA, 17 bp, Homo sapiens
ctgacagtcctctccac

SEQ ID NO: 1893333 - DNA, 19 bp, Homo sapiens
ctgacagtcctctccacct

SEQ ID NO: 1893334 - DNA, 14 bp, Homo sapiens
ctgacttcaggggc

SEQ ID NO: 1893335 - DNA, 22 bp, Homo sapiens
ctgacttcaggggctgcccgct

SEQ ID NO: 1893336 - DNA, 17 bp, Homo sapiens
ctgagagcatgtggggg

SEQ ID NO: 1893337 - DNA, 22 bp, Homo sapiens
ctgagagcatgtgggggaaggc

SEQ ID NO: 1893338 - DNA, 23 bp, Homo sapiens
ctgagagcatgtgggggaaggcc

SEQ ID NO: 1893339 - DNA, 15 bp, Homo sapiens
ctgagcccccacctg

SEQ ID NO: 1893340 - DNA, 13 bp, Homo sapiens
ctgagccctcctt

SEQ ID NO: 1893341 - DNA, 17 bp, Homo sapiens
ctgagctttccggggag

SEQ ID NO: 1893342 - DNA, 20 bp, Homo sapiens
ctgagctttccggggaggag

SEQ ID NO: 1893343 - DNA, 21 bp, Homo sapiens
ctgagctttccggggaggagc

SEQ ID NO: 1893344 - DNA, 20 bp, Homo sapiens
ctgaggactctggaccccag

SEQ ID NO: 1893345 - DNA, 18 bp, Homo sapiens
ctgaggagtacccccagc

SEQ ID NO: 1893346 - DNA, 19 bp, Homo sapiens
ctgaggtctcgctgatgct

SEQ ID NO: 1893347 - DNA, 14 bp, Homo sapiens
ctgaggtggtggac

SEQ ID NO: 1893348 - DNA, 17 bp, Homo sapiens
ctgatatttgctggagt

SEQ ID NO: 1893349 - DNA, 18 bp, Homo sapiens
ctgatatttgctggagtg

SEQ ID NO: 1893350 - DNA, 21 bp, Homo sapiens
ctgatatttgctggagtgctg

SEQ ID NO: 1893351 - DNA, 18 bp, Homo sapiens
ctgatgctgggctgggtg

SEQ ID NO: 1893352 - DNA, 14 bp, Homo sapiens
ctgatggagaggag

SEQ ID NO: 1893353 - DNA, 15 bp, Homo sapiens
ctgatggagaggaga

SEQ ID NO: 1893354 - DNA, 16 bp, Homo sapiens
ctgatggagaggagaa

SEQ ID NO: 1893355 - DNA, 17 bp, Homo sapiens
ctgatggagaggagaac

SEQ ID NO: 1893356 - DNA, 16 bp, Homo sapiens
ctgatggctgctggag

SEQ ID NO: 1893357 - DNA, 12 bp, Homo sapiens
ctgatgtttgtt

SEQ ID NO: 1893358 - DNA, 17 bp, Homo sapiens
ctgattcggctgtctca

SEQ ID NO: 1893359 - DNA, 23 bp, Homo sapiens
ctgattcggctgtctcagactct

SEQ ID NO: 1893360 - DNA, 14 bp, Homo sapiens
ctgattttttttgt

SEQ ID NO: 1893361 - DNA, 23 bp, Homo sapiens
ctgcaccaacccagccgctgccc

SEQ ID NO: 1893362 - DNA, 13 bp, Homo sapiens
ctgcactgtcctg

SEQ ID NO: 1893363 - DNA, 17 bp, Homo sapiens
ctgcactgtcctgctcc

SEQ ID NO: 1893364 - DNA, 21 bp, Homo sapiens
ctgcactgtcctgctccacag

SEQ ID NO: 1893365 - DNA, 20 bp, Homo sapiens
ctgcagagagcacctggtgg

SEQ ID NO: 1893366 - DNA, 14 bp, Homo sapiens
ctgcagaggagcca

SEQ ID NO: 1893367 - DNA, 21 bp, Homo sapiens
ctgcagaggagccacctgggc

SEQ ID NO: 1893368 - DNA, 14 bp, Homo sapiens
ctgcagaggggcag

SEQ ID NO: 1893369 - DNA, 19 bp, Homo sapiens
ctgcagaggggcaggccct

SEQ ID NO: 1893370 - DNA, 22 bp, Homo sapiens
ctgcagaggggcaggccctgca

SEQ ID NO: 1893371 - DNA, 15 bp, Homo sapiens
ctgcagcaggcagag

SEQ ID NO: 1893372 - DNA, 18 bp, Homo sapiens
ctgcagcaggcagaggag

SEQ ID NO: 1893373 - DNA, 11 bp, Homo sapiens
ctgcagcctcc

SEQ ID NO: 1893374 - DNA, 15 bp, Homo sapiens
ctgcaggtttctcct

SEQ ID NO: 1893375 - DNA, 14 bp, Homo sapiens
ctgccaagcctgga

SEQ ID NO: 1893376 - DNA, 15 bp, Homo sapiens
ctgccaagcctggag

SEQ ID NO: 1893377 - DNA, 13 bp, Homo sapiens
ctgccacttccca

SEQ ID NO: 1893378 - DNA, 20 bp, Homo sapiens
ctgcccaggacggggccggc

SEQ ID NO: 1893379 - DNA, 16 bp, Homo sapiens
ctgccccagctgggct

SEQ ID NO: 1893380 - DNA, 17 bp, Homo sapiens
ctgccccagctgggctg

SEQ ID NO: 1893381 - DNA, 14 bp, Homo sapiens
ctgcccgctcccag

SEQ ID NO: 1893382 - DNA, 15 bp, Homo sapiens
ctgcccgctcccagt

SEQ ID NO: 1893383 - DNA, 16 bp, Homo sapiens
ctgcccggcgccctct

SEQ ID NO: 1893384 - DNA, 22 bp, Homo sapiens
ctgcccggcgccctctgtcctg

SEQ ID NO: 1893385 - DNA, 17 bp, Homo sapiens
ctgcccgttgccgggcc

SEQ ID NO: 1893386 - DNA, 20 bp, Homo sapiens
ctgcccgttgccgggcctgg

SEQ ID NO: 1893387 - DNA, 22 bp, Homo sapiens
ctgcccgttgccgggcctggac

SEQ ID NO: 1893388 - DNA, 13 bp, Homo sapiens
ctgcctccactcc

SEQ ID NO: 1893389 - DNA, 14 bp, Homo sapiens
ctgcctccactccc

SEQ ID NO: 1893390 - DNA, 17 bp, Homo sapiens
ctgcctccactcccact

SEQ ID NO: 1893391 - DNA, 19 bp, Homo sapiens
ctgcctccactcccacttc

SEQ ID NO: 1893392 - DNA, 19 bp, Homo sapiens
ctgcctggaagagcagccc

SEQ ID NO: 1893393 - DNA, 15 bp, Homo sapiens
ctgcggggcttggct

SEQ ID NO: 1893394 - DNA, 15 bp, Homo sapiens
ctgcggtgaggcagg

SEQ ID NO: 1893395 - DNA, 18 bp, Homo sapiens
ctgcggtgaggcagggga

SEQ ID NO: 1893396 - DNA, 19 bp, Homo sapiens
ctgctatattttcatgact

SEQ ID NO: 1893397 - DNA, 23 bp, Homo sapiens
ctgctatattttcatgacttttc

SEQ ID NO: 1893398 - DNA, 19 bp, Homo sapiens
ctgctatgcattttcttca

SEQ ID NO: 1893399 - DNA, 18 bp, Homo sapiens
ctgctatggacgacctcc

SEQ ID NO: 1893400 - DNA, 14 bp, Homo sapiens
ctgctccacagtgt

SEQ ID NO: 1893401 - DNA, 21 bp, Homo sapiens
ctgctccacagtgttggcgag

SEQ ID NO: 1893402 - DNA, 13 bp, Homo sapiens
ctgctcgggccca

SEQ ID NO: 1893403 - DNA, 15 bp, Homo sapiens
ctgctcgggcccagg

SEQ ID NO: 1893404 - DNA, 16 bp, Homo sapiens
ctgctctccttgccct

SEQ ID NO: 1893405 - DNA, 17 bp, Homo sapiens
ctgctctccttgccctg

SEQ ID NO: 1893406 - DNA, 18 bp, Homo sapiens
ctgctgcaccaacccagc

SEQ ID NO: 1893407 - DNA, 17 bp, Homo sapiens
ctgctgcttctgggcct

SEQ ID NO: 1893408 - DNA, 21 bp, Homo sapiens
ctgctgggctggggcctgatg

SEQ ID NO: 1893409 - DNA, 11 bp, Homo sapiens
ctgctgggtgg

SEQ ID NO: 1893410 - DNA, 16 bp, Homo sapiens
ctgctgggtggcccat

SEQ ID NO: 1893411 - DNA, 18 bp, Homo sapiens
ctgctgtcccctcttgcc

SEQ ID NO: 1893412 - DNA, 23 bp, Homo sapiens
ctggaaaagtatgttagtgcaaa

SEQ ID NO: 1893413 - DNA, 21 bp, Homo sapiens
ctggaaatcagggttagtatt

SEQ ID NO: 1893414 - DNA, 21 bp, Homo sapiens
ctggacccacgaggaggaacc

SEQ ID NO: 1893415 - DNA, 15 bp, Homo sapiens
ctggaccccaggcca

SEQ ID NO: 1893416 - DNA, 16 bp, Homo sapiens
ctggagcccctgtgtg

SEQ ID NO: 1893417 - DNA, 18 bp, Homo sapiens
ctggaggcaggactcctg

SEQ ID NO: 1893418 - DNA, 16 bp, Homo sapiens
ctggaggctcccatgg

SEQ ID NO: 1893419 - DNA, 13 bp, Homo sapiens
ctggaggtggcgc

SEQ ID NO: 1893420 - DNA, 13 bp, Homo sapiens
ctggatgacccca

SEQ ID NO: 1893421 - DNA, 12 bp, Homo sapiens
ctggcacagtgt

SEQ ID NO: 1893422 - DNA, 15 bp, Homo sapiens
ctggcacagtgtctg

SEQ ID NO: 1893423 - DNA, 19 bp, Homo sapiens
ctggcacagtgtctgggct

SEQ ID NO: 1893424 - DNA, 20 bp, Homo sapiens
ctggcacagtgtctgggctg

SEQ ID NO: 1893425 - DNA, 12 bp, Homo sapiens
ctggccagaggc

SEQ ID NO: 1893426 - DNA, 13 bp, Homo sapiens
ctggccagcccca

SEQ ID NO: 1893427 - DNA, 20 bp, Homo sapiens
ctggccagccccacagccca

SEQ ID NO: 1893428 - DNA, 12 bp, Homo sapiens
ctggcccagctc

SEQ ID NO: 1893429 - DNA, 15 bp, Homo sapiens
gcacagtgtctgggc

SEQ ID NO: 1893430 - DNA, 14 bp, Homo sapiens
gcaccaacccagcc

SEQ ID NO: 1893431 - DNA, 22 bp, Homo sapiens
gcaccaacccagccgctgcccg

SEQ ID NO: 1893432 - DNA, 12 bp, Homo sapiens
gcaccccctcct

SEQ ID NO: 1893433 - DNA, 21 bp, Homo sapiens
gcacccgggctcagggaccac

SEQ ID NO: 1893434 - DNA, 22 bp, Homo sapiens
gcacccgggctcagggaccaca

SEQ ID NO: 1893435 - DNA, 14 bp, Homo sapiens
gcaccctcccctcc

SEQ ID NO: 1893436 - DNA, 15 bp, Homo sapiens
gcaccctcccctccc

SEQ ID NO: 1893437 - DNA, 17 bp, Homo sapiens
gcaccctcccctcccgt

SEQ ID NO: 1893438 - DNA, 21 bp, Homo sapiens
gcacctcaagtgcaaggacca

SEQ ID NO: 1893439 - DNA, 15 bp, Homo sapiens
gcacctgcaggttgg

SEQ ID NO: 1893440 - DNA, 20 bp, Homo sapiens
gcacctgcaggttgggccat

SEQ ID NO: 1893441 - DNA, 13 bp, Homo sapiens
gcactctgtgccc

SEQ ID NO: 1893442 - DNA, 14 bp, Homo sapiens
gcactctgtgccca

SEQ ID NO: 1893443 - DNA, 21 bp, Homo sapiens
gcactgaatatataaacactc

SEQ ID NO: 1893444 - DNA, 13 bp, Homo sapiens
gcactgctgggtg

SEQ ID NO: 1893445 - DNA, 22 bp, Homo sapiens
gcagaaggaagggcatccttct

SEQ ID NO: 1893446 - DNA, 19 bp, Homo sapiens
gcagagagcacctggtggg

SEQ ID NO: 1893447 - DNA, 13 bp, Homo sapiens
gcagaggggcagg

SEQ ID NO: 1893448 - DNA, 14 bp, Homo sapiens
gcagatgggtgcta

SEQ ID NO: 1893449 - DNA, 17 bp, Homo sapiens
gcagcaggcagaggaga

SEQ ID NO: 1893450 - DNA, 15 bp, Homo sapiens
gcagcaggtgctgct

SEQ ID NO: 1893451 - DNA, 16 bp, Homo sapiens
gcagcaggtgctgcta

SEQ ID NO: 1893452 - DNA, 19 bp, Homo sapiens
gcagcaggtgctgctaccc

SEQ ID NO: 1893453 - DNA, 13 bp, Homo sapiens
gcagccccaggac

SEQ ID NO: 1893454 - DNA, 14 bp, Homo sapiens
gcagccccaggacc

SEQ ID NO: 1893455 - DNA, 15 bp, Homo sapiens
gcagctaaggggcag

SEQ ID NO: 1893456 - DNA, 17 bp, Homo sapiens
gcagcttctgccacttc

SEQ ID NO: 1893457 - DNA, 18 bp, Homo sapiens
gcagcttctgccacttcc

SEQ ID NO: 1893458 - DNA, 13 bp, Homo sapiens
gcagcttgcagtc

SEQ ID NO: 1893459 - DNA, 20 bp, Homo sapiens
gcaggaatcaaggagcctcc

SEQ ID NO: 1893460 - DNA, 14 bp, Homo sapiens
gcaggaggaggtgc

SEQ ID NO: 1893461 - DNA, 20 bp, Homo sapiens
gcaggaggaggtgccaacag

SEQ ID NO: 1893462 - DNA, 15 bp, Homo sapiens
gcaggaggcctggga

SEQ ID NO: 1893463 - DNA, 12 bp, Homo sapiens
gcaggccctgca

SEQ ID NO: 1893464 - DNA, 23 bp, Homo sapiens
gcaggccctgcactgtcctgctc

SEQ ID NO: 1893465 - DNA, 16 bp, Homo sapiens
gcaggcgactggaggc

SEQ ID NO: 1893466 - DNA, 19 bp, Homo sapiens
gcaggtcctggggaggctg

SEQ ID NO: 1893467 - DNA, 21 bp, Homo sapiens
gcaggtcctggggaggctgag

SEQ ID NO: 1893468 - DNA, 20 bp, Homo sapiens
gcaggtgctgctaccctccc

SEQ ID NO: 1893469 - DNA, 22 bp, Homo sapiens
gcaggttgggccatactggcct

SEQ ID NO: 1893470 - DNA, 21 bp, Homo sapiens
gcaggtttatattgggaagct

SEQ ID NO: 1893471 - DNA, 19 bp, Homo sapiens
gcagtaaatacttgcagtt

SEQ ID NO: 1893472 - DNA, 13 bp, Homo sapiens
gcagtcctgttca

SEQ ID NO: 1893473 - DNA, 14 bp, Homo sapiens
gcagtcctgttcaa

SEQ ID NO: 1893474 - DNA, 15 bp, Homo sapiens
gcagtcctgttcaaa

SEQ ID NO: 1893475 - DNA, 13 bp, Homo sapiens
gcagttctgaaga

SEQ ID NO: 1893476 - DNA, 15 bp, Homo sapiens
gcagttctgaagaag

SEQ ID NO: 1893477 - DNA, 17 bp, Homo sapiens
gcagttctgaagaagat

SEQ ID NO: 1893478 - DNA, 15 bp, Homo sapiens
gcagttgaacagact

SEQ ID NO: 1893479 - DNA, 21 bp, Homo sapiens
gcatgagttatctgatttttt

SEQ ID NO: 1893480 - DNA, 12 bp, Homo sapiens
gcatgccccctc

SEQ ID NO: 1893481 - DNA, 17 bp, Homo sapiens
gcatgggggaggctctg

SEQ ID NO: 1893482 - DNA, 14 bp, Homo sapiens
gcatgtgggggaag

SEQ ID NO: 1893483 - DNA, 16 bp, Homo sapiens
gcattctgcctgcctg

SEQ ID NO: 1893484 - DNA, 20 bp, Homo sapiens
gcattctgcctgcctgggaa

SEQ ID NO: 1893485 - DNA, 12 bp, Homo sapiens
gcatttagatgt

SEQ ID NO: 1893486 - DNA, 19 bp, Homo sapiens
gcatttccagaaatctgcc

SEQ ID NO: 1893487 - DNA, 20 bp, Homo sapiens
gccaacagtgttaggcctgg

SEQ ID NO: 1893488 - DNA, 15 bp, Homo sapiens
gccaactcgggagca

SEQ ID NO: 1893489 - DNA, 19 bp, Homo sapiens
gccaagcctggagcccctg

SEQ ID NO: 1893490 - DNA, 16 bp, Homo sapiens
gccaaggtacctaggt

SEQ ID NO: 1893491 - DNA, 15 bp, Homo sapiens
gccacaccaagctgt

SEQ ID NO: 1893492 - DNA, 18 bp, Homo sapiens
gccacaccaagctgtgcc

SEQ ID NO: 1893493 - DNA, 20 bp, Homo sapiens
gccacaccaagctgtgccac

SEQ ID NO: 1893494 - DNA, 17 bp, Homo sapiens
gccacagtcatggtggc

SEQ ID NO: 1893495 - DNA, 16 bp, Homo sapiens
gccaccagctccactg

SEQ ID NO: 1893496 - DNA, 13 bp, Homo sapiens
gccaccctgggct

SEQ ID NO: 1893497 - DNA, 17 bp, Homo sapiens
gccaccctgggctctgt

SEQ ID NO: 1893498 - DNA, 18 bp, Homo sapiens
gccaccctgggctctgtg

SEQ ID NO: 1893499 - DNA, 13 bp, Homo sapiens
gccacctgccttc

SEQ ID NO: 1893500 - DNA, 13 bp, Homo sapiens
gccacctgggctg

SEQ ID NO: 1893501 - DNA, 14 bp, Homo sapiens
gccacctgggctgg

SEQ ID NO: 1893502 - DNA, 19 bp, Homo sapiens
gccagattttcctgaaaac

SEQ ID NO: 1893503 - DNA, 15 bp, Homo sapiens
gccagcccaggattg

SEQ ID NO: 1893504 - DNA, 14 bp, Homo sapiens
gccagccccacagc

SEQ ID NO: 1893505 - DNA, 17 bp, Homo sapiens
gccagccccacagccca

SEQ ID NO: 1893506 - DNA, 18 bp, Homo sapiens
gccagccccacagcccac

SEQ ID NO: 1893507 - DNA, 17 bp, Homo sapiens
gccagtcgcgctgcctg

SEQ ID NO: 1893508 - DNA, 17 bp, Homo sapiens
gccatactggcctcgcc

SEQ ID NO: 1893509 - DNA, 18 bp, Homo sapiens
gccatactggcctcgcct

SEQ ID NO: 1893510 - DNA, 19 bp, Homo sapiens
gccatactggcctcgcctg

SEQ ID NO: 1893511 - DNA, 22 bp, Homo sapiens
gccatgtgctagtaattggaaa

SEQ ID NO: 1893512 - DNA, 18 bp, Homo sapiens
gcccaccgcatgccccct

SEQ ID NO: 1893513 - DNA, 20 bp, Homo sapiens
gcccaccgcatgccccctcg

SEQ ID NO: 1893514 - DNA, 12 bp, Homo sapiens
gcccagctcccc

SEQ ID NO: 1893515 - DNA, 23 bp, Homo sapiens
gcccaggattgtacgtgggagag

SEQ ID NO: 1893516 - DNA, 18 bp, Homo sapiens
gcccaggccatcttccag

SEQ ID NO: 1893517 - DNA, 22 bp, Homo sapiens
gcccaggccatcttccaggtgg

SEQ ID NO: 1893518 - DNA, 23 bp, Homo sapiens
gcccaggccatcttccaggtggg

SEQ ID NO: 1893519 - DNA, 16 bp, Homo sapiens
gcccaggctggccagc

SEQ ID NO: 1893520 - DNA, 23 bp, Homo sapiens
gcccaggctggccagccccacag

SEQ ID NO: 1893521 - DNA, 14 bp, Homo sapiens
gcccatcccccctc

SEQ ID NO: 1893522 - DNA, 16 bp, Homo sapiens
gcccatcccccctcac

SEQ ID NO: 1893523 - DNA, 20 bp, Homo sapiens
gcccatgggcactgctgggt

SEQ ID NO: 1893524 - DNA, 14 bp, Homo sapiens
gccccaacccccag

SEQ ID NO: 1893525 - DNA, 17 bp, Homo sapiens
gccccaacccccagcac

SEQ ID NO: 1893526 - DNA, 10 bp, Homo sapiens
gccccagcct

SEQ ID NO: 1893527 - DNA, 13 bp, Homo sapiens
gccccagcctggc

SEQ ID NO: 1893528 - DNA, 18 bp, Homo sapiens
gccccagcctggcccagc

SEQ ID NO: 1893529 - DNA, 20 bp, Homo sapiens
gccccagcctggcccagctc

SEQ ID NO: 1893530 - DNA, 22 bp, Homo sapiens
gccccagcctggcccagctccc

SEQ ID NO: 1893531 - DNA, 15 bp, Homo sapiens
gccccccatcctggc

SEQ ID NO: 1893532 - DNA, 17 bp, Homo sapiens
gccccccatcctggccc

SEQ ID NO: 1893533 - DNA, 19 bp, Homo sapiens
gccccccatcctggcccat

SEQ ID NO: 1893534 - DNA, 16 bp, Homo sapiens
gccccctccctggatg

SEQ ID NO: 1893535 - DNA, 14 bp, Homo sapiens
gccccctcgtgcca

SEQ ID NO: 1893536 - DNA, 17 bp, Homo sapiens
gccccctcgtgccagtc

SEQ ID NO: 1893537 - DNA, 18 bp, Homo sapiens
gcccctcccacagcgctg

SEQ ID NO: 1893538 - DNA, 16 bp, Homo sapiens
gccccttccccgaggg

SEQ ID NO: 1893539 - DNA, 12 bp, Homo sapiens
gcccgctcccag

SEQ ID NO: 1893540 - DNA, 13 bp, Homo sapiens
gcccgctcccagt

SEQ ID NO: 1893541 - DNA, 17 bp, Homo sapiens
gcccgctgtcccagggg

SEQ ID NO: 1893542 - DNA, 12 bp, Homo sapiens
gcccgcttgcct

SEQ ID NO: 1893543 - DNA, 21 bp, Homo sapiens
gcccgcttgcctcggctcctg

SEQ ID NO: 1893544 - DNA, 22 bp, Homo sapiens
gcccgcttgcctcggctcctgc

SEQ ID NO: 1893545 - DNA, 18 bp, Homo sapiens
gcccggcgccctctgtcc

SEQ ID NO: 1893546 - DNA, 19 bp, Homo sapiens
gcccgttgccgggcctgga

SEQ ID NO: 1893547 - DNA, 17 bp, Homo sapiens
gcccgttgtctccctgg

SEQ ID NO: 1893548 - DNA, 12 bp, Homo sapiens
gtgtcttcctgt

SEQ ID NO: 1893549 - DNA, 14 bp, Homo sapiens
gtgtcttcctgtgg

SEQ ID NO: 1893550 - DNA, 17 bp, Homo sapiens
gtgtgccccccatcctg

SEQ ID NO: 1893551 - DNA, 19 bp, Homo sapiens
gtgtggctttcagagcctc

SEQ ID NO: 1893552 - DNA, 12 bp, Homo sapiens
gtgtgggagggc

SEQ ID NO: 1893553 - DNA, 20 bp, Homo sapiens
gtgtgggagggcgaggcggg

SEQ ID NO: 1893554 - DNA, 12 bp, Homo sapiens
gtgtgttctgta

SEQ ID NO: 1893555 - DNA, 14 bp, Homo sapiens
gtgttaggcctggc

SEQ ID NO: 1893556 - DNA, 18 bp, Homo sapiens
gtgttcctccattttctt

SEQ ID NO: 1893557 - DNA, 14 bp, Homo sapiens
gttacattaaagcc

SEQ ID NO: 1893558 - DNA, 15 bp, Homo sapiens
gttaggcctggcaca

SEQ ID NO: 1893559 - DNA, 20 bp, Homo sapiens
gttatttagtaaagtttgtt

SEQ ID NO: 1893560 - DNA, 14 bp, Homo sapiens
gttatttgtacagt

SEQ ID NO: 1893561 - DNA, 19 bp, Homo sapiens
gttatttttacattctgaa

SEQ ID NO: 1893562 - DNA, 20 bp, Homo sapiens
gttatttttacattctgaat

SEQ ID NO: 1893563 - DNA, 13 bp, Homo sapiens
gttcagtgctttt

SEQ ID NO: 1893564 - DNA, 20 bp, Homo sapiens
gttcagttcctctttgcatg

SEQ ID NO: 1893565 - DNA, 18 bp, Homo sapiens
gttcattgcctttccagg

SEQ ID NO: 1893566 - DNA, 16 bp, Homo sapiens
gttcccacctctgagg

SEQ ID NO: 1893567 - DNA, 18 bp, Homo sapiens
gttcccttgatgaagaag

SEQ ID NO: 1893568 - DNA, 13 bp, Homo sapiens
gttctgaagaaga

SEQ ID NO: 1893569 - DNA, 22 bp, Homo sapiens
gttctgagcccccacctgcctg

SEQ ID NO: 1893570 - DNA, 16 bp, Homo sapiens
gttctgtggtcacagt

SEQ ID NO: 1893571 - DNA, 21 bp, Homo sapiens
gttgaacactagtctgtgtaa

SEQ ID NO: 1893572 - DNA, 14 bp, Homo sapiens
gttgacatgggaca

SEQ ID NO: 1893573 - DNA, 18 bp, Homo sapiens
gttgacatgggacatttg

SEQ ID NO: 1893574 - DNA, 19 bp, Homo sapiens
gttgaggatgcactggcct

SEQ ID NO: 1893575 - DNA, 18 bp, Homo sapiens
gttgccgggcctggactg

SEQ ID NO: 1893576 - DNA, 18 bp, Homo sapiens
gttgggccatactggcct

SEQ ID NO: 1893577 - DNA, 19 bp, Homo sapiens
gttgggccatactggcctc

SEQ ID NO: 1893578 - DNA, 15 bp, Homo sapiens
gttgtctccctggcc

SEQ ID NO: 1893579 - DNA, 18 bp, Homo sapiens
gttgtgaaatgtaacatg

SEQ ID NO: 1893580 - DNA, 20 bp, Homo sapiens
gttgttctgtggtcacagtg

SEQ ID NO: 1893581 - DNA, 19 bp, Homo sapiens
gtttacagtaaataaattg

SEQ ID NO: 1893582 - DNA, 16 bp, Homo sapiens
gtttacttgtttcaga

SEQ ID NO: 1893583 - DNA, 18 bp, Homo sapiens
gtttaggtgatggccagt

SEQ ID NO: 1893584 - DNA, 21 bp, Homo sapiens
gtttatattgggaagctgtag

SEQ ID NO: 1893585 - DNA, 13 bp, Homo sapiens
gtttatgtctaaa

SEQ ID NO: 1893586 - DNA, 14 bp, Homo sapiens
gtttatttcttaaa

SEQ ID NO: 1893587 - DNA, 21 bp, Homo sapiens
gtttcaaacatatataacaat

SEQ ID NO: 1893588 - DNA, 17 bp, Homo sapiens
gtttctccttgaagcaa

SEQ ID NO: 1893589 - DNA, 13 bp, Homo sapiens
gtttctgtagaaa

SEQ ID NO: 1893590 - DNA, 24 bp, Homo sapiens
gtttcttgcactgaatatataaac

SEQ ID NO: 1893591 - DNA, 13 bp, Homo sapiens
gtttgcttccatt

SEQ ID NO: 1893592 - DNA, 16 bp, Homo sapiens
gtttgtgcaaacataa

SEQ ID NO: 1893593 - DNA, 17 bp, Homo sapiens
gtttgttttttcatgcg

SEQ ID NO: 1893594 - DNA, 15 bp, Homo sapiens
gttttataattttgt

SEQ ID NO: 1893595 - DNA, 17 bp, Homo sapiens
gttttgacatttttagt

SEQ ID NO: 1893596 - DNA, 14 bp, Homo sapiens
gtttttgctataga

SEQ ID NO: 1893597 - DNA, 18 bp, Homo sapiens
taaaaacaaagaaataaa

SEQ ID NO: 1893598 - DNA, 19 bp, Homo sapiens
taaaaacattttgaagtgt

SEQ ID NO: 1893599 - DNA, 16 bp, Homo sapiens
taaaaagtcaatgttt

SEQ ID NO: 1893600 - DNA, 15 bp, Homo sapiens
taaaaatagatatat

SEQ ID NO: 1893601 - DNA, 13 bp, Homo sapiens
taaaacattcaca

SEQ ID NO: 1893602 - DNA, 12 bp, Homo sapiens
taaaagaatgat

SEQ ID NO: 1893603 - DNA, 22 bp, Homo sapiens
taaaataatttttatatttgaa

SEQ ID NO: 1893604 - DNA, 23 bp, Homo sapiens
taaaatagaatgatagaactttg

SEQ ID NO: 1893605 - DNA, 19 bp, Homo sapiens
taaacactccacagtgttt

SEQ ID NO: 1893606 - DNA, 23 bp, Homo sapiens
taaacagactatttaacttgagg

SEQ ID NO: 1893607 - DNA, 17 bp, Homo sapiens
taaacagttgttactta

SEQ ID NO: 1893608 - DNA, 22 bp, Homo sapiens
taaacatctagcagtaaatact

SEQ ID NO: 1893609 - DNA, 15 bp, Homo sapiens
taaacatgatgtcaa

SEQ ID NO: 1893610 - DNA, 18 bp, Homo sapiens
taaacctctaatttattt

SEQ ID NO: 1893611 - DNA, 15 bp, Homo sapiens
taaagaacataaata

SEQ ID NO: 1893612 - DNA, 18 bp, Homo sapiens
taaagccagttggcttct

SEQ ID NO: 1893613 - DNA, 16 bp, Homo sapiens
taaagtgatatttccc

SEQ ID NO: 1893614 - DNA, 23 bp, Homo sapiens
taaagtttacagtaaataaattg

SEQ ID NO: 1893615 - DNA, 18 bp, Homo sapiens
taaagtttggtattgtaa

SEQ ID NO: 1893616 - DNA, 22 bp, Homo sapiens
taaagtttggtattgtaaaaca

SEQ ID NO: 1893617 - DNA, 11 bp, Homo sapiens
taaataaagct

SEQ ID NO: 1893618 - DNA, 13 bp, Homo sapiens
taaataaattgtt

SEQ ID NO: 1893619 - DNA, 16 bp, Homo sapiens
taaatacttgcagttg

SEQ ID NO: 1893620 - DNA, 19 bp, Homo sapiens
taaatacttgcagttgtga

SEQ ID NO: 1893621 - DNA, 21 bp, Homo sapiens
taaatcattagagcttaaatt

SEQ ID NO: 1893622 - DNA, 14 bp, Homo sapiens
taaatccaataaaa

SEQ ID NO: 1893623 - DNA, 17 bp, Homo sapiens
taaatgttaaagccaga

SEQ ID NO: 1893624 - DNA, 12 bp, Homo sapiens
taaattcttttg

SEQ ID NO: 1893625 - DNA, 20 bp, Homo sapiens
taaattgtcagatcgttcat

SEQ ID NO: 1893626 - DNA, 12 bp, Homo sapiens
taaattgtttga

SEQ ID NO: 1893627 - DNA, 18 bp, Homo sapiens
taaatttaggtaaataaa

SEQ ID NO: 1893628 - DNA, 22 bp, Homo sapiens
taaatttaggtaaataaagctc

SEQ ID NO: 1893629 - DNA, 15 bp, Homo sapiens
taacaaccaaagact

SEQ ID NO: 1893630 - DNA, 21 bp, Homo sapiens
taacataatggttgtgaaatg

SEQ ID NO: 1893631 - DNA, 21 bp, Homo sapiens
taacgtggcttgtagaatttt

SEQ ID NO: 1893632 - DNA, 17 bp, Homo sapiens
taactaccctacacctc

SEQ ID NO: 1893633 - DNA, 22 bp, Homo sapiens
taacttgagggtaataaactta

SEQ ID NO: 1893634 - DNA, 23 bp, Homo sapiens
taacttttttttttttaacatct

SEQ ID NO: 1893635 - DNA, 22 bp, Homo sapiens
taagaaaaaattctttcacttg

SEQ ID NO: 1893636 - DNA, 21 bp, Homo sapiens
taagaaaatatcacttgtcaa

SEQ ID NO: 1893637 - DNA, 22 bp, Homo sapiens
taagaggctatttaaaagtata

SEQ ID NO: 1893638 - DNA, 21 bp, Homo sapiens
taagatatgggacatttttga

SEQ ID NO: 1893639 - DNA, 17 bp, Homo sapiens
taagatatttttcatga

SEQ ID NO: 1893640 - DNA, 15 bp, Homo sapiens
taagcaggaggaggt

SEQ ID NO: 1893641 - DNA, 18 bp, Homo sapiens
taagccctgcataatgtt

SEQ ID NO: 1893642 - DNA, 14 bp, Homo sapiens
taagccttcatttg

SEQ ID NO: 1893643 - DNA, 20 bp, Homo sapiens
taagccttcatttgcaattc

SEQ ID NO: 1893644 - DNA, 13 bp, Homo sapiens
taagctgtaaaaa

SEQ ID NO: 1893645 - DNA, 16 bp, Homo sapiens
taaggagaggagagca

SEQ ID NO: 1893646 - DNA, 13 bp, Homo sapiens
taaggggcaggaa

SEQ ID NO: 1893647 - DNA, 14 bp, Homo sapiens
taagttgtattaaa

SEQ ID NO: 1893648 - DNA, 15 bp, Homo sapiens
taagttgtattaaaa

SEQ ID NO: 1893649 - DNA, 17 bp, Homo sapiens
taagttgtattaaaaat

SEQ ID NO: 1893650 - DNA, 17 bp, Homo sapiens
taagtttatttcttaaa

SEQ ID NO: 1893651 - DNA, 18 bp, Homo sapiens
taagtttttttttaaaaa

SEQ ID NO: 1893652 - DNA, 22 bp, Homo sapiens
taatcattcttatttcatgaaa

SEQ ID NO: 1893653 - DNA, 22 bp, Homo sapiens
taatctgtttgtgcaaacataa

SEQ ID NO: 1893654 - DNA, 15 bp, Homo sapiens
taatgagggctgagt

SEQ ID NO: 1893655 - DNA, 16 bp, Homo sapiens
taatgataactggaaa

SEQ ID NO: 1893656 - DNA, 17 bp, Homo sapiens
taatgataactggaaac

SEQ ID NO: 1893657 - DNA, 22 bp, Homo sapiens
taatgataactggaaacttcag

SEQ ID NO: 1893658 - DNA, 14 bp, Homo sapiens
taatggttgtgaaa

SEQ ID NO: 1893659 - DNA, 21 bp, Homo sapiens
taatggttgtgaaatgtaaca

SEQ ID NO: 1893660 - DNA, 22 bp, Homo sapiens
taatggttgtgaaatgtaacat

SEQ ID NO: 1893661 - DNA, 13 bp, Homo sapiens
taatgtgatatta

SEQ ID NO: 1893662 - DNA, 17 bp, Homo sapiens
taatgttaagctttatt

SEQ ID NO: 1893663 - DNA, 14 bp, Homo sapiens
taatgtttcaaaca

SEQ ID NO: 1893664 - DNA, 22 bp, Homo sapiens
taatgtttcaaacatatataac

SEQ ID NO: 1893665 - DNA, 13 bp, Homo sapiens
tacaaaaattcct

SEQ ID NO: 1893666 - DNA, 20 bp, Homo sapiens
tcttgctgttcagtgctttt

SEQ ID NO: 1893667 - DNA, 20 bp, Homo sapiens
tcttggttcttttttcagtt

SEQ ID NO: 1893668 - DNA, 21 bp, Homo sapiens
tcttgtccccaacaccccaca

SEQ ID NO: 1893669 - DNA, 22 bp, Homo sapiens
tctttagaggctttcaaatgta

SEQ ID NO: 1893670 - DNA, 11 bp, Homo sapiens
tctttctttta

SEQ ID NO: 1893671 - DNA, 15 bp, Homo sapiens
tctttgcatggaatt

SEQ ID NO: 1893672 - DNA, 16 bp, Homo sapiens
tcttttactctgtgta

SEQ ID NO: 1893673 - DNA, 16 bp, Homo sapiens
tgaaaagataaattat

SEQ ID NO: 1893674 - DNA, 18 bp, Homo sapiens
tgaaatattatgttaaaa

SEQ ID NO: 1893675 - DNA, 16 bp, Homo sapiens
tgaaatattgactttt

SEQ ID NO: 1893676 - DNA, 14 bp, Homo sapiens
tgaaatgtaacatg

SEQ ID NO: 1893677 - DNA, 15 bp, Homo sapiens
tgaaatgtaacatga

SEQ ID NO: 1893678 - DNA, 19 bp, Homo sapiens
tgaaatgtaacatgaagca

SEQ ID NO: 1893679 - DNA, 22 bp, Homo sapiens
tgaacactagtctgtgtaactt

SEQ ID NO: 1893680 - DNA, 14 bp, Homo sapiens
tgaacatggactct

SEQ ID NO: 1893681 - DNA, 21 bp, Homo sapiens
tgaaccttggtaaattgtaaa

SEQ ID NO: 1893682 - DNA, 23 bp, Homo sapiens
tgaactagggtggtgcatttttg

SEQ ID NO: 1893683 - DNA, 15 bp, Homo sapiens
tgaagagatttttca

SEQ ID NO: 1893684 - DNA, 16 bp, Homo sapiens
tgaagagatttttcat

SEQ ID NO: 1893685 - DNA, 20 bp, Homo sapiens
tgaagatttaccacttgtgt

SEQ ID NO: 1893686 - DNA, 13 bp, Homo sapiens
tgaagcaaatgtg

SEQ ID NO: 1893687 - DNA, 23 bp, Homo sapiens
tgaagcatgagttatctgatttt

SEQ ID NO: 1893688 - DNA, 20 bp, Homo sapiens
tgaaggagattttccttcct

SEQ ID NO: 1893689 - DNA, 17 bp, Homo sapiens
tgaatagaagcccaaat

SEQ ID NO: 1893690 - DNA, 13 bp, Homo sapiens
tgaatatataaac

SEQ ID NO: 1893691 - DNA, 14 bp, Homo sapiens
tgaatatataaaca

SEQ ID NO: 1893692 - DNA, 16 bp, Homo sapiens
tgaatatataaacact

SEQ ID NO: 1893693 - DNA, 17 bp, Homo sapiens
tgaatatataaacactc

SEQ ID NO: 1893694 - DNA, 14 bp, Homo sapiens
tgaattaagttttt

SEQ ID NO: 1893695 - DNA, 13 bp, Homo sapiens
tgaattacatttg

SEQ ID NO: 1893696 - DNA, 14 bp, Homo sapiens
tgaattacatttgt

SEQ ID NO: 1893697 - DNA, 15 bp, Homo sapiens
tgacacccctggcct

SEQ ID NO: 1893698 - DNA, 13 bp, Homo sapiens
tgacactgttttc

SEQ ID NO: 1893699 - DNA, 15 bp, Homo sapiens
tgacactgttttcct

SEQ ID NO: 1893700 - DNA, 16 bp, Homo sapiens
tgacagaatgctgttt

SEQ ID NO: 1893701 - DNA, 16 bp, Homo sapiens
tgacatgggacatttg

SEQ ID NO: 1893702 - DNA, 22 bp, Homo sapiens
tgaccaaccttttcccaaccat

SEQ ID NO: 1893703 - DNA, 14 bp, Homo sapiens
tgacccagccctga

SEQ ID NO: 1893704 - DNA, 18 bp, Homo sapiens
tgaccccatctctgctgc

SEQ ID NO: 1893705 - DNA, 22 bp, Homo sapiens
tgacctccatgactgcacagta

SEQ ID NO: 1893706 - DNA, 21 bp, Homo sapiens
tgaccttctgaacatgagtgt

SEQ ID NO: 1893707 - DNA, 23 bp, Homo sapiens
tgactaataaaaaactgtgaacc

SEQ ID NO: 1893708 - DNA, 13 bp, Homo sapiens
tgactcccatgca

SEQ ID NO: 1893709 - DNA, 14 bp, Homo sapiens
tgactctgtgctga

SEQ ID NO: 1893710 - DNA, 13 bp, Homo sapiens
tgactcttaagaa

SEQ ID NO: 1893711 - DNA, 16 bp, Homo sapiens
tgactcttaagaagac

SEQ ID NO: 1893712 - DNA, 20 bp, Homo sapiens
tgactgtaggcgcccctggg

SEQ ID NO: 1893713 - DNA, 22 bp, Homo sapiens
tgactgtaggcgcccctggggt

SEQ ID NO: 1893714 - DNA, 13 bp, Homo sapiens
tgacttcaggggc

SEQ ID NO: 1893715 - DNA, 18 bp, Homo sapiens
tgacttttccatgtatct

SEQ ID NO: 1893716 - DNA, 18 bp, Homo sapiens
tgagacggatggaaggag

SEQ ID NO: 1893717 - DNA, 19 bp, Homo sapiens
tgagacggatggaaggaga

SEQ ID NO: 1893718 - DNA, 21 bp, Homo sapiens
tgagacggatggaaggagaga

SEQ ID NO: 1893719 - DNA, 16 bp, Homo sapiens
tgagactgcagaggag

SEQ ID NO: 1893720 - DNA, 17 bp, Homo sapiens
tgagactgcagaggagc

SEQ ID NO: 1893721 - DNA, 17 bp, Homo sapiens
tgagagacacactgaag

SEQ ID NO: 1893722 - DNA, 19 bp, Homo sapiens
tgagagacacactgaagaa

SEQ ID NO: 1893723 - DNA, 17 bp, Homo sapiens
tgagagcatgtggggga

SEQ ID NO: 1893724 - DNA, 15 bp, Homo sapiens
tgagcagtcaggaaa

SEQ ID NO: 1893725 - DNA, 21 bp, Homo sapiens
tgagccctccttcttgccctg

SEQ ID NO: 1893726 - DNA, 14 bp, Homo sapiens
tgagcctgccccag

SEQ ID NO: 1893727 - DNA, 22 bp, Homo sapiens
tgagcctgccccagctgggctg

SEQ ID NO: 1893728 - DNA, 15 bp, Homo sapiens
tgaggacactgatat

SEQ ID NO: 1893729 - DNA, 15 bp, Homo sapiens
tgaggagagggactg

SEQ ID NO: 1893730 - DNA, 21 bp, Homo sapiens
tgaggagtacccccagcccaa

SEQ ID NO: 1893731 - DNA, 20 bp, Homo sapiens
tgaggatatggcagggaagc

SEQ ID NO: 1893732 - DNA, 21 bp, Homo sapiens
tgaggatatggcagggaagct

SEQ ID NO: 1893733 - DNA, 17 bp, Homo sapiens
tgaggatgggatgtatt

SEQ ID NO: 1893734 - DNA, 18 bp, Homo sapiens
tgaggatgggatgtattt

SEQ ID NO: 1893735 - DNA, 21 bp, Homo sapiens
tgagggtttcattgtgtgtta

SEQ ID NO: 1893736 - DNA, 14 bp, Homo sapiens
tgaggtctcgctga

SEQ ID NO: 1893737 - DNA, 23 bp, Homo sapiens
tgaggtctcgctgatgctgggct

SEQ ID NO: 1893738 - DNA, 19 bp, Homo sapiens
tgatatttccccatggttt

SEQ ID NO: 1893739 - DNA, 17 bp, Homo sapiens
tgatctagagccagtta

SEQ ID NO: 1893740 - DNA, 23 bp, Homo sapiens
tgatcttaggtttgttttttcat

SEQ ID NO: 1893741 - DNA, 18 bp, Homo sapiens
tgatgccacaccaagctg

SEQ ID NO: 1893742 - DNA, 23 bp, Homo sapiens
tgatgccacaccaagctgtgcca

SEQ ID NO: 1893743 - DNA, 20 bp, Homo sapiens
tgatgctgggctgggtgcga

SEQ ID NO: 1893744 - DNA, 12 bp, Homo sapiens
tgatggagagga

SEQ ID NO: 1893745 - DNA, 15 bp, Homo sapiens
tgatggagaggagaa

SEQ ID NO: 1893746 - DNA, 22 bp, Homo sapiens
tgattaaatgtctgacacatta

SEQ ID NO: 1893747 - DNA, 15 bp, Homo sapiens
tgattaagtaatgat

SEQ ID NO: 1893748 - DNA, 18 bp, Homo sapiens
tgattaagtaatgataac

SEQ ID NO: 1893749 - DNA, 22 bp, Homo sapiens
tgattacaaataaacagttgtt

SEQ ID NO: 1893750 - DNA, 21 bp, Homo sapiens
tgattacgtgtatgtttcttc

SEQ ID NO: 1893751 - DNA, 17 bp, Homo sapiens
tgattatgaattacatt

SEQ ID NO: 1893752 - DNA, 20 bp, Homo sapiens
tgatttcccgtggccccagc

SEQ ID NO: 1893753 - DNA, 22 bp, Homo sapiens
tgatttcccgtggccccagcct

SEQ ID NO: 1893754 - DNA, 16 bp, Homo sapiens
tgatttcttctccctc

SEQ ID NO: 1893755 - DNA, 19 bp, Homo sapiens
tgattttaagaatccaaac

SEQ ID NO: 1893756 - DNA, 19 bp, Homo sapiens
tgatttttatccatttctt

SEQ ID NO: 1893757 - DNA, 22 bp, Homo sapiens
tgcaaaattgtctaaaatgtca

SEQ ID NO: 1893758 - DNA, 21 bp, Homo sapiens
tgcaagccagattttcctgaa

SEQ ID NO: 1893759 - DNA, 13 bp, Homo sapiens
tgcaattcatgta

SEQ ID NO: 1893760 - DNA, 14 bp, Homo sapiens
tgcaattcatgtaa

SEQ ID NO: 1893761 - DNA, 16 bp, Homo sapiens
tgcaattcatgtaaca

SEQ ID NO: 1893762 - DNA, 17 bp, Homo sapiens
tgcaattcatgtaacag

SEQ ID NO: 1893763 - DNA, 16 bp, Homo sapiens
tgcaccaacccagccg

SEQ ID NO: 1893764 - DNA, 19 bp, Homo sapiens
tgcaccaacccagccgctg

SEQ ID NO: 1893765 - DNA, 16 bp, Homo sapiens
tgcaccccctcctgct

SEQ ID NO: 1893766 - DNA, 13 bp, Homo sapiens
tgcactctgtgcc

SEQ ID NO: 1893767 - DNA, 22 bp, Homo sapiens
tgcactgaatatataaacactc

SEQ ID NO: 1893768 - DNA, 12 bp, Homo sapiens
tgcactggcctg

SEQ ID NO: 1893769 - DNA, 17 bp, Homo sapiens
tgcactgtcctgctcca

SEQ ID NO: 1893770 - DNA, 18 bp, Homo sapiens
tgcactgtcctgctccac

SEQ ID NO: 1893771 - DNA, 21 bp, Homo sapiens
tgcactgtcctgctccacagt

SEQ ID NO: 1893772 - DNA, 22 bp, Homo sapiens
tgcactgtcctgctccacagtg

SEQ ID NO: 1893773 - DNA, 18 bp, Homo sapiens
tgcagagagcacctggtg

SEQ ID NO: 1893774 - DNA, 20 bp, Homo sapiens
tgcagagagcacctggtggg

SEQ ID NO: 1893775 - DNA, 17 bp, Homo sapiens
tgcagaggagccacctg

SEQ ID NO: 1893776 - DNA, 19 bp, Homo sapiens
tgcagaggagccacctggg

SEQ ID NO: 1893777 - DNA, 17 bp, Homo sapiens
tgcagaggggcaggccc

SEQ ID NO: 1893778 - DNA, 21 bp, Homo sapiens
tgcagatgggtgctatcagag

SEQ ID NO: 1893779 - DNA, 14 bp, Homo sapiens
tgcagcaggcagag

SEQ ID NO: 1893780 - DNA, 16 bp, Homo sapiens
tgcagcaggcagagga

SEQ ID NO: 1893781 - DNA, 18 bp, Homo sapiens
tgcagcaggcagaggaga

SEQ ID NO: 1893782 - DNA, 14 bp, Homo sapiens
tgcagccccaggac

SEQ ID NO: 1893783 - DNA, 18 bp, Homo sapiens
tgcagccccaggaccaag

SEQ ID NO: 1893784 - DNA, 21 bp, Homo sapiens
ttctcccccccggggctgggt

SEQ ID NO: 1893785 - DNA, 21 bp, Homo sapiens
ttctccttgaagcaaatgtgt

SEQ ID NO: 1893786 - DNA, 20 bp, Homo sapiens
ttctgaaatgacagaatgct

SEQ ID NO: 1893787 - DNA, 22 bp, Homo sapiens
ttctgaaatgacagaatgctgt

SEQ ID NO: 1893788 - DNA, 21 bp, Homo sapiens
ttctgaacatgagtgtcaact

SEQ ID NO: 1893789 - DNA, 14 bp, Homo sapiens
ttctgaagaagatg

SEQ ID NO: 1893790 - DNA, 22 bp, Homo sapiens
ttctgagcccccacctgcctga

SEQ ID NO: 1893791 - DNA, 14 bp, Homo sapiens
ttctgccacttccc

SEQ ID NO: 1893792 - DNA, 17 bp, Homo sapiens
ttctgccacttcccagg

SEQ ID NO: 1893793 - DNA, 13 bp, Homo sapiens
ttctgctgggctg

SEQ ID NO: 1893794 - DNA, 20 bp, Homo sapiens
ttctgctgggctggggcctg

SEQ ID NO: 1893795 - DNA, 23 bp, Homo sapiens
ttctgggcctgatggagaggaga

SEQ ID NO: 1893796 - DNA, 22 bp, Homo sapiens
ttctgtgcctgactctgtgctg

SEQ ID NO: 1893797 - DNA, 17 bp, Homo sapiens
ttcttaaagtcaagatt

SEQ ID NO: 1893798 - DNA, 14 bp, Homo sapiens
ttcttatttcatga

SEQ ID NO: 1893799 - DNA, 14 bp, Homo sapiens
ttcttgcactgaat

SEQ ID NO: 1893800 - DNA, 19 bp, Homo sapiens
ttcttgcactgaatatata

SEQ ID NO: 1893801 - DNA, 17 bp, Homo sapiens
ttctttcacttgatgtt

SEQ ID NO: 1893802 - DNA, 18 bp, Homo sapiens
ttctttcacttgatgttt

SEQ ID NO: 1893803 - DNA, 21 bp, Homo sapiens
ttctttttaaagtttgttcac

SEQ ID NO: 1893804 - DNA, 17 bp, Homo sapiens
ttcttttttcagttatt

SEQ ID NO: 1893805 - DNA, 14 bp, Homo sapiens
ttgaaccttggtaa

SEQ ID NO: 1893806 - DNA, 17 bp, Homo sapiens
ttgaattttcccactgc

SEQ ID NO: 1893807 - DNA, 18 bp, Homo sapiens
ttgaattttcccactgca

SEQ ID NO: 1893808 - DNA, 18 bp, Homo sapiens
ttgaattttgatgaacaa

SEQ ID NO: 1893809 - DNA, 12 bp, Homo sapiens
ttgacactgttt

SEQ ID NO: 1893810 - DNA, 16 bp, Homo sapiens
ttgacactgttttcct

SEQ ID NO: 1893811 - DNA, 19 bp, Homo sapiens
ttgacactgttttccttac

SEQ ID NO: 1893812 - DNA, 14 bp, Homo sapiens
ttgacagtatatgt

SEQ ID NO: 1893813 - DNA, 16 bp, Homo sapiens
ttgaggatgcactggc

SEQ ID NO: 1893814 - DNA, 19 bp, Homo sapiens
ttgaggatgggatgtattt

SEQ ID NO: 1893815 - DNA, 15 bp, Homo sapiens
ttgaggattttgagt

SEQ ID NO: 1893816 - DNA, 13 bp, Homo sapiens
ttgagttcctcct

SEQ ID NO: 1893817 - DNA, 12 bp, Homo sapiens
ttgatctgtgat

SEQ ID NO: 1893818 - DNA, 13 bp, Homo sapiens
ttgatgaagaagt

SEQ ID NO: 1893819 - DNA, 14 bp, Homo sapiens
ttgatggagatatt

SEQ ID NO: 1893820 - DNA, 18 bp, Homo sapiens
ttgatggtggtatgtttt

SEQ ID NO: 1893821 - DNA, 13 bp, Homo sapiens
ttgcaattcatgt

SEQ ID NO: 1893822 - DNA, 18 bp, Homo sapiens
ttgcaattcatgtaacag

SEQ ID NO: 1893823 - DNA, 17 bp, Homo sapiens
ttgcacagtggtctgga

SEQ ID NO: 1893824 - DNA, 16 bp, Homo sapiens
ttgcagttgtgatata

SEQ ID NO: 1893825 - DNA, 21 bp, Homo sapiens
ttgcagtttttataatagatt

SEQ ID NO: 1893826 - DNA, 12 bp, Homo sapiens
ttgccctgagct

SEQ ID NO: 1893827 - DNA, 21 bp, Homo sapiens
ttgccctgggccagcccagga

SEQ ID NO: 1893828 - DNA, 23 bp, Homo sapiens
ttgccgggcctggactgtcctag

SEQ ID NO: 1893829 - DNA, 17 bp, Homo sapiens
ttgcctcggctcctgct

SEQ ID NO: 1893830 - DNA, 19 bp, Homo sapiens
ttgcctcggctcctgctgc

SEQ ID NO: 1893831 - DNA, 20 bp, Homo sapiens
ttgcctcggctcctgctgca

SEQ ID NO: 1893832 - DNA, 20 bp, Homo sapiens
ttgcctgctgagctgtgccc

SEQ ID NO: 1893833 - DNA, 16 bp, Homo sapiens
ttgctaagcattccaa

SEQ ID NO: 1893834 - DNA, 17 bp, Homo sapiens
ttgctgtcatgtgaatc

SEQ ID NO: 1893835 - DNA, 22 bp, Homo sapiens
ttgctgtcatgtgaatccctca

SEQ ID NO: 1893836 - DNA, 22 bp, Homo sapiens
ttgcttccaagcccttccctct

SEQ ID NO: 1893837 - DNA, 23 bp, Homo sapiens
ttggaaattgggtgtgccctggc

SEQ ID NO: 1893838 - DNA, 14 bp, Homo sapiens
ttggaagctctgtt

SEQ ID NO: 1893839 - DNA, 19 bp, Homo sapiens
ttggacagaagcagctctt

SEQ ID NO: 1893840 - DNA, 18 bp, Homo sapiens
ttggcagcaggtgctgct

SEQ ID NO: 1893841 - DNA, 17 bp, Homo sapiens
ttggcgcaccctcccct

SEQ ID NO: 1893842 - DNA, 14 bp, Homo sapiens
ttggcttctgtgcc

SEQ ID NO: 1893843 - DNA, 16 bp, Homo sapiens
ttgggccatactggcc

SEQ ID NO: 1893844 - DNA, 18 bp, Homo sapiens
ttgggtgtgccctggctc

SEQ ID NO: 1893845 - DNA, 19 bp, Homo sapiens
ttgtaaacagctaataatg

SEQ ID NO: 1893846 - DNA, 15 bp, Homo sapiens
ttgtacagttcagtt

SEQ ID NO: 1893847 - DNA, 16 bp, Homo sapiens
ttgtacagttcagttc

SEQ ID NO: 1893848 - DNA, 15 bp, Homo sapiens
ttgtacgtgggagag

SEQ ID NO: 1893849 - DNA, 22 bp, Homo sapiens
ttgtacgtgggagaggcagaaa

SEQ ID NO: 1893850 - DNA, 13 bp, Homo sapiens
ttgtagaactgcc

SEQ ID NO: 1893851 - DNA, 19 bp, Homo sapiens
ttgtataaaataattttta

SEQ ID NO: 1893852 - DNA, 20 bp, Homo sapiens
ttgtataccttgtaatttga

SEQ ID NO: 1893853 - DNA, 15 bp, Homo sapiens
ttgtctagtgaaact

SEQ ID NO: 1893854 - DNA, 15 bp, Homo sapiens
ttgtctccctggccc

SEQ ID NO: 1893855 - DNA, 17 bp, Homo sapiens
ttgtctccctggccctc

SEQ ID NO: 1893856 - DNA, 20 bp, Homo sapiens
ttgtctttgttcttctacca

SEQ ID NO: 1893857 - DNA, 23 bp, Homo sapiens
ttgtgatttcccgtggccccagc

SEQ ID NO: 1893858 - DNA, 19 bp, Homo sapiens
ttgtgtcataaattacaca

SEQ ID NO: 1893859 - DNA, 23 bp, Homo sapiens
ttgtgtgaaaggtacttcaaatc

SEQ ID NO: 1893860 - DNA, 14 bp, Homo sapiens
ttgttcacttaaat

SEQ ID NO: 1893861 - DNA, 13 bp, Homo sapiens
ttgttctttagag

SEQ ID NO: 1893862 - DNA, 18 bp, Homo sapiens
ttgtttgcttccattatt

SEQ ID NO: 1893863 - DNA, 17 bp, Homo sapiens
tttaaaagaatgattat

SEQ ID NO: 1893864 - DNA, 22 bp, Homo sapiens
tttaaaagtataaaactgcttt

SEQ ID NO: 1893865 - DNA, 23 bp, Homo sapiens
tttaaagtgcagtcatttgtggt

SEQ ID NO: 1893866 - DNA, 18 bp, Homo sapiens
tttaaagtttggtattgt

SEQ ID NO: 1893867 - DNA, 13 bp, Homo sapiens
tttaaagtttgtt

SEQ ID NO: 1893868 - DNA, 21 bp, Homo sapiens
tttaaagtttgttcacttaaa

SEQ ID NO: 1893869 - DNA, 14 bp, Homo sapiens
tttaacgtggcttg

SEQ ID NO: 1893870 - DNA, 19 bp, Homo sapiens
tttaacttgagggtaataa

SEQ ID NO: 1893871 - DNA, 13 bp, Homo sapiens
tttaataatgttt

SEQ ID NO: 1893872 - DNA, 19 bp, Homo sapiens
tttaataatgtttcaaaca

SEQ ID NO: 1893873 - DNA, 14 bp, Homo sapiens
tttactctgtgtaa

SEQ ID NO: 1893874 - DNA, 19 bp, Homo sapiens
tttaggcagggatttgagg

SEQ ID NO: 1893875 - DNA, 21 bp, Homo sapiens
tttagggatctggggaaggac

SEQ ID NO: 1893876 - DNA, 17 bp, Homo sapiens
tttaggtaaataaagct

SEQ ID NO: 1893877 - DNA, 18 bp, Homo sapiens
tttaggtaaataaagctc

SEQ ID NO: 1893878 - DNA, 21 bp, Homo sapiens
tttagtagatattaccagttt

SEQ ID NO: 1893879 - DNA, 19 bp, Homo sapiens
tttatatgcttctgtttta

SEQ ID NO: 1893880 - DNA, 14 bp, Homo sapiens
tttatccatttctt

SEQ ID NO: 1893881 - DNA, 17 bp, Homo sapiens
tttatggcactagtatt

SEQ ID NO: 1893882 - DNA, 19 bp, Homo sapiens
tttatgtctaaagagcttt

SEQ ID NO: 1893883 - DNA, 16 bp, Homo sapiens
tttattactgtaagaa

SEQ ID NO: 1893884 - DNA, 16 bp, Homo sapiens
tttattttaataatgt

SEQ ID NO: 1893885 - DNA, 18 bp, Homo sapiens
tttattttgtaattattg

SEQ ID NO: 1893886 - DNA, 19 bp, Homo sapiens
tttcacttgatgtttgtta

SEQ ID NO: 1893887 - DNA, 13 bp, Homo sapiens
tttcagagcctcc

SEQ ID NO: 1893888 - DNA, 23 bp, Homo sapiens
tttcagctcttaaaaagacactt

SEQ ID NO: 1893889 - DNA, 20 bp, Homo sapiens
tttcagcttctgctgggctg

SEQ ID NO: 1893890 - DNA, 20 bp, Homo sapiens
tttcaggggctttggaagct

SEQ ID NO: 1893891 - DNA, 12 bp, Homo sapiens
tttcatctgttg

SEQ ID NO: 1893892 - DNA, 18 bp, Homo sapiens
tttcatctgttgttctgt

SEQ ID NO: 1893893 - DNA, 15 bp, Homo sapiens
tttcccgtggcccca

SEQ ID NO: 1893894 - DNA, 20 bp, Homo sapiens
tttcccgtggccccagcctg

SEQ ID NO: 1893895 - DNA, 19 bp, Homo sapiens
tttcctaagtgattgtatg

SEQ ID NO: 1893896 - DNA, 17 bp, Homo sapiens
tttccttttcatctgtt

SEQ ID NO: 1893897 - DNA, 14 bp, Homo sapiens
tttctaatgagata

SEQ ID NO: 1893898 - DNA, 20 bp, Homo sapiens
tttctatgaaatattatgtt

SEQ ID NO: 1893899 - DNA, 21 bp, Homo sapiens
tttctgggctgtctattctag

SEQ ID NO: 1893900 - DNA, 13 bp, Homo sapiens
tttctgtagaaaa

SEQ ID NO: 1893901 - DNA, 14 bp, Homo sapiens
tttctgtagaaaag

SEQ ID NO: 1893902 - DNA, 20 bp, Homo sapiens
tcctgcaggccaggccagct

SEQ ID NO: 1893903 - DNA, 22 bp, Homo sapiens
tcctgtgtgtccaaaactgcct

SEQ ID NO: 1893904 - DNA, 14 bp, Homo sapiens
tctggcctcccaca

SEQ ID NO: 1893905 - DNA, 17 bp, Homo sapiens
tcttggcttggtgagga

SEQ ID NO: 1893906 - DNA, 14 bp, Homo sapiens
tgaggagaatgaaa

SEQ ID NO: 1893907 - DNA, 18 bp, Homo sapiens
tgatcaaagccacactct

SEQ ID NO: 1893908 - DNA, 23 bp, Homo sapiens
tgcaagcccctgctccagaagat

SEQ ID NO: 1893909 - DNA, 14 bp, Homo sapiens
tgcactcagctctt

SEQ ID NO: 1893910 - DNA, 21 bp, Homo sapiens
tgcccggggaaaggcaaggtc

SEQ ID NO: 1893911 - DNA, 16 bp, Homo sapiens
tgccgcgtcgccctcc

SEQ ID NO: 1893912 - DNA, 18 bp, Homo sapiens
tgcctcccctctccttcc

SEQ ID NO: 1893913 - DNA, 22 bp, Homo sapiens
tgcctccgcgtgatcaaagcca

SEQ ID NO: 1893914 - DNA, 14 bp, Homo sapiens
tgctcagaccagct

SEQ ID NO: 1893915 - DNA, 16 bp, Homo sapiens
tggcagctgccacgcc

SEQ ID NO: 1893916 - DNA, 21 bp, Homo sapiens
tggtcaaacaaactctctgaa

SEQ ID NO: 1893917 - DNA, 16 bp, Homo sapiens
tgtgtccaaaactgcc

SEQ ID NO: 1893918 - DNA, 22 bp, Homo sapiens
ttcactgtcctccaagccagcg

SEQ ID NO: 1893919 - DNA, 21 bp, Homo sapiens
ttcctgcaggccaggccagct

SEQ ID NO: 1893920 - DNA, 22 bp, Homo sapiens
ttcttcactgtcctccaagcca

SEQ ID NO: 1893921 - DNA, 21 bp, Homo sapiens
ttgccgcgtcgccctcccagg

SEQ ID NO: 1893922 - DNA, 13 bp, Homo sapiens
tctcccctcagag

SEQ ID NO: 1893923 - DNA, 13 bp, Homo sapiens
tctccttcctgtg

SEQ ID NO: 1893924 - DNA, 13 bp, Homo sapiens
tctggcctcccac

SEQ ID NO: 1893925 - DNA, 13 bp, Homo sapiens
tctgggctccaga

SEQ ID NO: 1893926 - DNA, 16 bp, Homo sapiens
tgaaagtccagaaact

SEQ ID NO: 1893927 - DNA, 18 bp, Homo sapiens
tgaaagtccagaaactgt

SEQ ID NO: 1893928 - DNA, 15 bp, Homo sapiens
tgaatgaaccttctg

SEQ ID NO: 1893929 - DNA, 16 bp, Homo sapiens
tgaatgaaccttctgg

SEQ ID NO: 1893930 - DNA, 18 bp, Homo sapiens
tgacatgcactcagctct

SEQ ID NO: 1893931 - DNA, 15 bp, Homo sapiens
tgcaggccaggccag

SEQ ID NO: 1893932 - DNA, 20 bp, Homo sapiens
tgccactggcaaatgtaact

SEQ ID NO: 1893933 - DNA, 17 bp, Homo sapiens
tgcgccaccgcccagag

SEQ ID NO: 1893934 - DNA, 21 bp, Homo sapiens
tggactagagggacctctccc

SEQ ID NO: 1893935 - DNA, 18 bp, Homo sapiens
tggcctcccacagactca

SEQ ID NO: 1893936 - DNA, 16 bp, Homo sapiens
tggtgaatttcacaag

SEQ ID NO: 1893937 - DNA, 17 bp, Homo sapiens
tgtcctccaagccagcg

SEQ ID NO: 1893938 - DNA, 17 bp, Homo sapiens
tgttcccacctgctgga

SEQ ID NO: 1893939 - DNA, 14 bp, Homo sapiens
ttcgggctgtgccc

SEQ ID NO: 1893940 - DNA, 17 bp, Homo sapiens
ttggtgaatttcacaag

SEQ ID NO: 1893941 - DNA, 19 bp, Homo sapiens
tttacccacacacagataa

SEQ ID NO: 1893942 - DNA, 15 bp, Homo sapiens
tttcccttgaggaaa

SEQ ID NO: 1893943 - DNA, 12 bp, Homo sapiens
ggcagctgccac

SEQ ID NO: 1893944 - DNA, 21 bp, Homo sapiens
ggcaggaccttcgggctgtgc

SEQ ID NO: 1893945 - DNA, 23 bp, Homo sapiens
ggcaggaccttcgggctgtgccc

SEQ ID NO: 1893946 - DNA, 15 bp, Homo sapiens
ggccaggccagctgc

SEQ ID NO: 1893947 - DNA, 13 bp, Homo sapiens
ggcctgaagagtc

SEQ ID NO: 1893948 - DNA, 19 bp, Homo sapiens
ggcctgaagagtcctctga

SEQ ID NO: 1893949 - DNA, 14 bp, Homo sapiens
ggggagggtgacag

SEQ ID NO: 1893950 - DNA, 20 bp, Homo sapiens
ggggagggtgacagtggccg

SEQ ID NO: 1893951 - DNA, 15 bp, Homo sapiens
gtcgccctcccaggc

SEQ ID NO: 1893952 - DNA, 22 bp, Homo sapiens
gtgaggagaatgaaatgtatgt

SEQ ID NO: 1893953 - DNA, 20 bp, Homo sapiens
gtggtgtttcctgcaggcca

SEQ ID NO: 1893954 - DNA, 14 bp, Homo sapiens
gtttcctgcaggcc

SEQ ID NO: 1893955 - DNA, 11 bp, Homo sapiens
taaaagcacac

SEQ ID NO: 1893956 - DNA, 16 bp, Homo sapiens
taaaccaaaaactgaa

SEQ ID NO: 1893957 - DNA, 23 bp, Homo sapiens
tataaagaaggttggtgaatttc

SEQ ID NO: 1893958 - DNA, 20 bp, Homo sapiens
tatgaactttatagttgttt

SEQ ID NO: 1893959 - DNA, 19 bp, Homo sapiens
tcaaacaaactctctgaac

SEQ ID NO: 1893960 - DNA, 21 bp, Homo sapiens
tcccaggctctcaacagggga

SEQ ID NO: 1893961 - DNA, 17 bp, Homo sapiens
tcctcatgttctgcttt

SEQ ID NO: 1893962 - DNA, 12 bp, Homo sapiens
tcctccaagcca

SEQ ID NO: 1893963 - DNA, 14 bp, Homo sapiens
tcctgcaggccagg

SEQ ID NO: 1893964 - DNA, 17 bp, Homo sapiens
tcgccctcccaggctct

SEQ ID NO: 1893965 - DNA, 16 bp, Homo sapiens
tctcctcatgttctgc

SEQ ID NO: 1893966 - DNA, 16 bp, Homo sapiens
tctccttcctgtgtgt

SEQ ID NO: 1893967 - DNA, 11 bp, Homo sapiens
tctctgaaccc

SEQ ID NO: 1893968 - DNA, 16 bp, Homo sapiens
tgcaatgactcaggac

SEQ ID NO: 1893969 - DNA, 14 bp, Homo sapiens
tgcagcctgcgcca

SEQ ID NO: 1893970 - DNA, 18 bp, Homo sapiens
tgcccggggaaaggcaag

SEQ ID NO: 1893971 - DNA, 20 bp, Homo sapiens
tgccgcgtcgccctcccagg

SEQ ID NO: 1893972 - DNA, 17 bp, Homo sapiens
tgcctcccctctccttc

SEQ ID NO: 1893973 - DNA, 16 bp, Homo sapiens
tgctcagaccagctct

SEQ ID NO: 1893974 - DNA, 22 bp, Homo sapiens
tgctcagggaaaagcagctctc

SEQ ID NO: 1893975 - DNA, 23 bp, Homo sapiens
tggcaaatgtaactgtgccagtt

SEQ ID NO: 1893976 - DNA, 21 bp, Homo sapiens
tggcctgaagagtcctctgaa

SEQ ID NO: 1893977 - DNA, 16 bp, Homo sapiens
tggtcaaacaaactct

SEQ ID NO: 1893978 - DNA, 22 bp, Homo sapiens
tggtcaaacaaactctctgaac

SEQ ID NO: 1893979 - DNA, 22 bp, Homo sapiens
tgtcaggggcggggagggtgac

SEQ ID NO: 1893980 - DNA, 15 bp, Homo sapiens
tgtccaaaactgcct

SEQ ID NO: 1893981 - DNA, 16 bp, Homo sapiens
tgtccaaaactgcctc

SEQ ID NO: 1893982 - DNA, 19 bp, Homo sapiens
tgtgtgtccaaaactgcct

SEQ ID NO: 1893983 - DNA, 16 bp, Homo sapiens
tgttgctataataaag

SEQ ID NO: 1893984 - DNA, 16 bp, Homo sapiens
ttaagaatttcacaag

SEQ ID NO: 1893985 - DNA, 16 bp, Homo sapiens
ttacccacacacagat

SEQ ID NO: 1893986 - DNA, 18 bp, Homo sapiens
ttattaatttttaaggat

SEQ ID NO: 1893987 - DNA, 22 bp, Homo sapiens
ttcctgtgtgtccaaaactgcc

SEQ ID NO: 1893988 - DNA, 12 bp, Homo sapiens
ttcgggctgtgc

SEQ ID NO: 1893989 - DNA, 13 bp, Homo sapiens
ttcgggctgtgcc

SEQ ID NO: 1893990 - DNA, 14 bp, Homo sapiens
ttctggcctcccac

SEQ ID NO: 1893991 - DNA, 18 bp, Homo sapiens
ttgaggaaacaacagctt

SEQ ID NO: 1893992 - DNA, 18 bp, Homo sapiens
ttgccgcgtcgccctccc

SEQ ID NO: 1893993 - DNA, 15 bp, Homo sapiens
ttgttctttgttctt

SEQ ID NO: 1893994 - DNA, 22 bp, Homo sapiens
tttcgattcgttaagagagcaa

SEQ ID NO: 1893995 - DNA, 16 bp, Homo sapiens
ttttatatgttgctat

SEQ ID NO: 1893996 - DNA, 18 bp, Homo sapiens
cgtgatcaaagccacact

SEQ ID NO: 1893997 - DNA, 22 bp, Homo sapiens
cgtgatcaaagccacactctgg

SEQ ID NO: 1893998 - DNA, 14 bp, Homo sapiens
ctagagggacctct

SEQ ID NO: 1893999 - DNA, 16 bp, Homo sapiens
ctagagggacctctcc

SEQ ID NO: 1894000 - DNA, 17 bp, Homo sapiens
ctagagggacctctccc

SEQ ID NO: 1894001 - DNA, 20 bp, Homo sapiens
ctagagggacctctcccagg

SEQ ID NO: 1894002 - DNA, 21 bp, Homo sapiens
ctagagggacctctcccaggg

SEQ ID NO: 1894003 - DNA, 19 bp, Homo sapiens
ctcaaatgctcagaccagc

SEQ ID NO: 1894004 - DNA, 13 bp, Homo sapiens
ctcagagtgcaag

SEQ ID NO: 1894005 - DNA, 17 bp, Homo sapiens
ctcagctcttggctcca

SEQ ID NO: 1894006 - DNA, 17 bp, Homo sapiens
ctcaggaggcaggacct

SEQ ID NO: 1894007 - DNA, 16 bp, Homo sapiens
ctcatgttctgctttc

SEQ ID NO: 1894008 - DNA, 16 bp, Homo sapiens
ctcccctcagagtgca

SEQ ID NO: 1894009 - DNA, 16 bp, Homo sapiens
ctcccctctccttcct

SEQ ID NO: 1894010 - DNA, 13 bp, Homo sapiens
ctccttcctgtgt

SEQ ID NO: 1894011 - DNA, 15 bp, Homo sapiens
ctccttcctgtgtgt

SEQ ID NO: 1894012 - DNA, 11 bp, Homo sapiens
ctctcccaggg

SEQ ID NO: 1894013 - DNA, 20 bp, Homo sapiens
ctctcctcatgttctgcttt

SEQ ID NO: 1894014 - DNA, 14 bp, Homo sapiens
ctctccttcctgtg

SEQ ID NO: 1894015 - DNA, 18 bp, Homo sapiens
ctcttagcaaaaacatgt

SEQ ID NO: 1894016 - DNA, 15 bp, Homo sapiens
ctgaaaacctctcct

SEQ ID NO: 1894017 - DNA, 17 bp, Homo sapiens
ctgaaaacctctcctca

SEQ ID NO: 1894018 - DNA, 14 bp, Homo sapiens
ctgaagagtcctct

SEQ ID NO: 1894019 - DNA, 16 bp, Homo sapiens
ctgaagagtcctctga

SEQ ID NO: 1894020 - DNA, 22 bp, Homo sapiens
ctgcctcaggaggcaggacctt

SEQ ID NO: 1894021 - DNA, 20 bp, Homo sapiens
ctggactagagggacctctc

SEQ ID NO: 1894022 - DNA, 23 bp, Homo sapiens
ctggactagagggacctctccca

SEQ ID NO: 1894023 - DNA, 14 bp, Homo sapiens
ctggcctcccacag

SEQ ID NO: 1894024 - DNA, 17 bp, Homo sapiens
ctggcctcccacagact

SEQ ID NO: 1894025 - DNA, 16 bp, Homo sapiens
ctgggaaacagaggct

SEQ ID NO: 1894026 - DNA, 20 bp, Homo sapiens
ctggggtggggatagggagc

SEQ ID NO: 1894027 - DNA, 23 bp, Homo sapiens
ctggtcaaacaaactctctgaac

SEQ ID NO: 1894028 - DNA, 12 bp, Homo sapiens
ctgtcctccaag

SEQ ID NO: 1894029 - DNA, 15 bp, Homo sapiens
ctgtgtgtccaaaac

SEQ ID NO: 1894030 - DNA, 14 bp, Homo sapiens
cttatctccaagac

SEQ ID NO: 1894031 - DNA, 21 bp, Homo sapiens
cttcactgtcctccaagccag

SEQ ID NO: 1894032 - DNA, 15 bp, Homo sapiens
cttcgggctgtgccc

SEQ ID NO: 1894033 - DNA, 16 bp, Homo sapiens
cttctggcctcccaca

SEQ ID NO: 1894034 - DNA, 18 bp, Homo sapiens
cttgaggaaacaacagct

SEQ ID NO: 1894035 - DNA, 18 bp, Homo sapiens
gaaaagcggacatcagct

SEQ ID NO: 1894036 - DNA, 20 bp, Homo sapiens
gaaaagcggacatcagctgg

SEQ ID NO: 1894037 - DNA, 14 bp, Homo sapiens
gacctctcccaggg

SEQ ID NO: 1894038 - DNA, 18 bp, Homo sapiens
gaccttcgggctgtgccc

SEQ ID NO: 1894039 - DNA, 20 bp, Homo sapiens
gactagagggacctctccca

SEQ ID NO: 1894040 - DNA, 17 bp, Homo sapiens
gactgaaaacctctcct

SEQ ID NO: 1894041 - DNA, 13 bp, Homo sapiens
gagcaacatttta

SEQ ID NO: 1894042 - DNA, 14 bp, Homo sapiens
gagggacctctccc

SEQ ID NO: 1894043 - DNA, 15 bp, Homo sapiens
gagggtgagtgcaag

SEQ ID NO: 1894044 - DNA, 13 bp, Homo sapiens
gaggtttcagtga

SEQ ID NO: 1894045 - DNA, 21 bp, Homo sapiens
gagtgcaagcccctgctccag

SEQ ID NO: 1894046 - DNA, 20 bp, Homo sapiens
gcacactcatcccctcactt

SEQ ID NO: 1894047 - DNA, 19 bp, Homo sapiens
gcagatgcaatgactcagg

SEQ ID NO: 1894048 - DNA, 23 bp, Homo sapiens
gcagcctgcgccaccgcccagag

SEQ ID NO: 1894049 - DNA, 21 bp, Homo sapiens
gccaaggagggtgagtgcaag

SEQ ID NO: 1894050 - DNA, 19 bp, Homo sapiens
gccagcgggaatggcagct

SEQ ID NO: 1894051 - DNA, 13 bp, Homo sapiens
gccagctgcctcc

SEQ ID NO: 1894052 - DNA, 12 bp, Homo sapiens
gccaggccagct

SEQ ID NO: 1894053 - DNA, 19 bp, Homo sapiens
gcccagagacccaagctgc

SEQ ID NO: 1894054 - DNA, 22 bp, Homo sapiens
gccccaggaaaggcccagccac

SEQ ID NO: 1894055 - DNA, 15 bp, Homo sapiens
gccctaaaagcacac

SEQ ID NO: 1894056 - DNA, 21 bp, Homo sapiens
gcctcccctctccttcctgtg

SEQ ID NO: 1894057 - DNA, 21 bp, Homo sapiens
gcctgcgccaccgcccagaga

SEQ ID NO: 1894058 - DNA, 16 bp, Homo sapiens
gcgtcgccctcccagg

SEQ ID NO: 1894059 - DNA, 17 bp, Homo sapiens
gcgtcgccctcccaggc

SEQ ID NO: 1894060 - DNA, 15 bp, Homo sapiens
gcgtgatcaaagcca

SEQ ID NO: 1894061 - DNA, 20 bp, Homo sapiens
gcgtgatcaaagccacactc

SEQ ID NO: 1894062 - DNA, 15 bp, Homo sapiens
gctcagggaaaagca

SEQ ID NO: 1894063 - DNA, 23 bp, Homo sapiens
gctcttagcaaaaacatgtatgt

SEQ ID NO: 1894064 - DNA, 21 bp, Homo sapiens
gctgcagcctgcgccaccgcc

SEQ ID NO: 1894065 - DNA, 21 bp, Homo sapiens
gctgcctcccctctccttcct

SEQ ID NO: 1894066 - DNA, 14 bp, Homo sapiens
ggacatcagctggt

SEQ ID NO: 1894067 - DNA, 20 bp, Homo sapiens
ggacatccccccgccaaaag

SEQ ID NO: 1894068 - DNA, 12 bp, Homo sapiens
ggacctctccca

SEQ ID NO: 1894069 - DNA, 18 bp, Homo sapiens
ggaccttcgggctgtgcc

SEQ ID NO: 1894070 - DNA, 18 bp, Homo sapiens
ggactagagggacctctc

SEQ ID NO: 1894071 - DNA, 19 bp, Homo sapiens
ggactagagggacctctcc

SEQ ID NO: 1894072 - DNA, 11 bp, Homo sapiens
acatgtatgtg

SEQ ID NO: 1894073 - DNA, 13 bp, Homo sapiens
acctctcccaggg

SEQ ID NO: 1894074 - DNA, 14 bp, Homo sapiens
accttcgggctgtg

SEQ ID NO: 1894075 - DNA, 18 bp, Homo sapiens
accttcgggctgtgcccg

SEQ ID NO: 1894076 - DNA, 19 bp, Homo sapiens
actagagggacctctccca

SEQ ID NO: 1894077 - DNA, 21 bp, Homo sapiens
actagagggacctctcccagg

SEQ ID NO: 1894078 - DNA, 18 bp, Homo sapiens
actaggtcaaaaatctgt

SEQ ID NO: 1894079 - DNA, 18 bp, Homo sapiens
actctctgaacccctccc

SEQ ID NO: 1894080 - DNA, 14 bp, Homo sapiens
actctgggctccag

SEQ ID NO: 1894081 - DNA, 15 bp, Homo sapiens
actgaaaacctctcc

SEQ ID NO: 1894082 - DNA, 18 bp, Homo sapiens
acttataaagaaggttgg

SEQ ID NO: 1894083 - DNA, 23 bp, Homo sapiens
acttgccgcgtcgccctcccagg

SEQ ID NO: 1894084 - DNA, 22 bp, Homo sapiens
agaaactgttcccacctgctgg

SEQ ID NO: 1894085 - DNA, 16 bp, Homo sapiens
cttatctccaagacca

SEQ ID NO: 1894086 - DNA, 15 bp, Homo sapiens
cttcctgtgtgtcca

SEQ ID NO: 1894087 - DNA, 14 bp, Homo sapiens
cttctggcctccca

SEQ ID NO: 1894088 - DNA, 13 bp, Homo sapiens
cttgaggaaacaa

SEQ ID NO: 1894089 - DNA, 21 bp, Homo sapiens
cttgaggaaacaacagcttta

SEQ ID NO: 1894090 - DNA, 21 bp, Homo sapiens
cttgccgcgtcgccctcccag

SEQ ID NO: 1894091 - DNA, 17 bp, Homo sapiens
gaaaagcagctctcccc

SEQ ID NO: 1894092 - DNA, 15 bp, Homo sapiens
gaaacaacagcttta

SEQ ID NO: 1894093 - DNA, 12 bp, Homo sapiens
gaaacagaggct

SEQ ID NO: 1894094 - DNA, 22 bp, Homo sapiens
gaaactgttcccacctgctgga

SEQ ID NO: 1894095 - DNA, 18 bp, Homo sapiens
gaaccttctggcctccca

SEQ ID NO: 1894096 - DNA, 21 bp, Homo sapiens
gaaccttctggcctcccacag

SEQ ID NO: 1894097 - DNA, 16 bp, Homo sapiens
gaagagtcctctgaat

SEQ ID NO: 1894098 - DNA, 16 bp, Homo sapiens
gaatggcagctgccac

SEQ ID NO: 1894099 - DNA, 19 bp, Homo sapiens
gacaacactgggaaacaga

SEQ ID NO: 1894100 - DNA, 13 bp, Homo sapiens
gacatcagctggt

SEQ ID NO: 1894101 - DNA, 19 bp, Homo sapiens
gaccttcgggctgtgcccg

SEQ ID NO: 1894102 - DNA, 22 bp, Homo sapiens
gactcaaatgctcagaccagct

SEQ ID NO: 1894103 - DNA, 16 bp, Homo sapiens
gactgaaaacctctcc

SEQ ID NO: 1894104 - DNA, 15 bp, Homo sapiens
gagagcaacatttta

SEQ ID NO: 1894105 - DNA, 18 bp, Homo sapiens
gaggaaacaacagcttta

SEQ ID NO: 1894106 - DNA, 15 bp, Homo sapiens
gagggacctctccca

SEQ ID NO: 1894107 - DNA, 23 bp, Homo sapiens
gatagtggggagacttcttggct

SEQ ID NO: 1894108 - DNA, 20 bp, Homo sapiens
gatgacatgcactcagctct

SEQ ID NO: 1894109 - DNA, 15 bp, Homo sapiens
gcaagcccctgctcc

SEQ ID NO: 1894110 - DNA, 18 bp, Homo sapiens
gcaaggtccggcccatcc

SEQ ID NO: 1894111 - DNA, 20 bp, Homo sapiens
gcaggaccttcgggctgtgc

SEQ ID NO: 1894112 - DNA, 16 bp, Homo sapiens
gcaggccaggccagct

SEQ ID NO: 1894113 - DNA, 20 bp, Homo sapiens
gccaaggagggtgagtgcaa

SEQ ID NO: 1894114 - DNA, 21 bp, Homo sapiens
gccagttctttccataataaa

SEQ ID NO: 1894115 - DNA, 14 bp, Homo sapiens
gccgcccaaggccc

SEQ ID NO: 1894116 - DNA, 17 bp, Homo sapiens
gccgcgtcgccctccca

SEQ ID NO: 1894117 - DNA, 13 bp, Homo sapiens
gcctcccacagac

SEQ ID NO: 1894118 - DNA, 18 bp, Homo sapiens
gcctcccctctccttcct

SEQ ID NO: 1894119 - DNA, 19 bp, Homo sapiens
gcctcccctctccttcctg

SEQ ID NO: 1894120 - DNA, 20 bp, Homo sapiens
gcctgaagagtcctctgaat

SEQ ID NO: 1894121 - DNA, 13 bp, Homo sapiens
gcctgagtcacct

SEQ ID NO: 1894122 - DNA, 16 bp, Homo sapiens
gctaacaccagacaga

SEQ ID NO: 1894123 - DNA, 16 bp, Homo sapiens
gctcagaccagctctt

SEQ ID NO: 1894124 - DNA, 17 bp, Homo sapiens
gctcagggaaaagcagc

SEQ ID NO: 1894125 - DNA, 20 bp, Homo sapiens
ggaccttcgggctgtgcccg

SEQ ID NO: 1894126 - DNA, 19 bp, Homo sapiens
ggcacctcacaggccccag

SEQ ID NO: 1894127 - DNA, 16 bp, Homo sapiens
ggccaaggagggtgag

SEQ ID NO: 1894128 - DNA, 17 bp, Homo sapiens
ggccaggccagctgcct

SEQ ID NO: 1894129 - DNA, 18 bp, Homo sapiens
ggccccaggaaaggccca

SEQ ID NO: 1894130 - DNA, 14 bp, Homo sapiens
ggcctcccacagac

SEQ ID NO: 1894131 - DNA, 16 bp, Homo sapiens
ggcctcccacagactc

SEQ ID NO: 1894132 - DNA, 12 bp, Homo sapiens
gggacctctccc

SEQ ID NO: 1894133 - DNA, 23 bp, Homo sapiens
gggacctctcccagggtccctgg

SEQ ID NO: 1894134 - DNA, 12 bp, Homo sapiens
ggtgacagtggc

SEQ ID NO: 1894135 - DNA, 20 bp, Homo sapiens
gtcaaacaaactctctgaac

SEQ ID NO: 1894136 - DNA, 12 bp, Homo sapiens
gtcagtctttag

SEQ ID NO: 1894137 - DNA, 19 bp, Homo sapiens
gtgtgtccaaaactgcctc

SEQ ID NO: 1894138 - DNA, 20 bp, Homo sapiens
gttctttccataataaaagg

SEQ ID NO: 1894139 - DNA, 20 bp, Homo sapiens
gttttcccttgaggaaacaa

SEQ ID NO: 1894140 - DNA, 20 bp, Homo sapiens
tagagggacctctcccaggg

SEQ ID NO: 1894141 - DNA, 18 bp, Homo sapiens
tagcaaaaacatgtatgt

SEQ ID NO: 1894142 - DNA, 15 bp, Homo sapiens
tatctccaagaccag

SEQ ID NO: 1894143 - DNA, 21 bp, Homo sapiens
tatgttgctataataaagaag

SEQ ID NO: 1894144 - DNA, 15 bp, Homo sapiens
tcaaagccacactct

SEQ ID NO: 1894145 - DNA, 19 bp, Homo sapiens
tcaaatgctcagaccagct

SEQ ID NO: 1894146 - DNA, 14 bp, Homo sapiens
tcagaccagctctt

SEQ ID NO: 1894147 - DNA, 23 bp, Homo sapiens
tcagagtgcaagcccctgctcca

SEQ ID NO: 1894148 - DNA, 17 bp, Homo sapiens
tcaggaggcaggacctt

SEQ ID NO: 1894149 - DNA, 15 bp, Homo sapiens
tccaagccagcggga

SEQ ID NO: 1894150 - DNA, 16 bp, Homo sapiens
tcccagctacctcaac

SEQ ID NO: 1894151 - DNA, 14 bp, Homo sapiens
tccctggggtgggg

SEQ ID NO: 1894152 - DNA, 15 bp, Homo sapiens
agaatgaaatgtatg

SEQ ID NO: 1894153 - DNA, 13 bp, Homo sapiens
agaccagctcttc

SEQ ID NO: 1894154 - DNA, 19 bp, Homo sapiens
agagggacctctcccaggg

SEQ ID NO: 1894155 - DNA, 14 bp, Homo sapiens
agcaaaaacatgta

SEQ ID NO: 1894156 - DNA, 20 bp, Homo sapiens
agcacactcatcccctcact

SEQ ID NO: 1894157 - DNA, 14 bp, Homo sapiens
agcagctctcccct

SEQ ID NO: 1894158 - DNA, 21 bp, Homo sapiens
agccacactctgggctccaga

SEQ ID NO: 1894159 - DNA, 21 bp, Homo sapiens
agccaccgaagccgcctgtgg

SEQ ID NO: 1894160 - DNA, 16 bp, Homo sapiens
agcctgagtcacctgc

SEQ ID NO: 1894161 - DNA, 19 bp, Homo sapiens
agcctgagtcacctgcaga

SEQ ID NO: 1894162 - DNA, 21 bp, Homo sapiens
agcctgcgccaccgcccagag

SEQ ID NO: 1894163 - DNA, 20 bp, Homo sapiens
agcgggaatggcagctgcca

SEQ ID NO: 1894164 - DNA, 13 bp, Homo sapiens
agctttaaaagaa

SEQ ID NO: 1894165 - DNA, 20 bp, Homo sapiens
aggaaaagcggacatcagct

SEQ ID NO: 1894166 - DNA, 20 bp, Homo sapiens
aggacatccccccgccaaaa

SEQ ID NO: 1894167 - DNA, 19 bp, Homo sapiens
aggaccttcgggctgtgcc

SEQ ID NO: 1894168 - DNA, 16 bp, Homo sapiens
aggagaatgaaatgta

SEQ ID NO: 1894169 - DNA, 14 bp, Homo sapiens
aggaggcaggacct

SEQ ID NO: 1894170 - DNA, 17 bp, Homo sapiens
aggccttatctccaaga

SEQ ID NO: 1894171 - DNA, 16 bp, Homo sapiens
agggacctctcccagg

SEQ ID NO: 1894172 - DNA, 20 bp, Homo sapiens
aggggcgtgggagtggcctg

SEQ ID NO: 1894173 - DNA, 14 bp, Homo sapiens
agtgaggagaatga

SEQ ID NO: 1894174 - DNA, 18 bp, Homo sapiens
atatgttgctataataaa

SEQ ID NO: 1894175 - DNA, 21 bp, Homo sapiens
atgaaccttctggcctcccac

SEQ ID NO: 1894176 - DNA, 12 bp, Homo sapiens
atgctcagacca

SEQ ID NO: 1894177 - DNA, 17 bp, Homo sapiens
atgctcagaccagctct

SEQ ID NO: 1894178 - DNA, 23 bp, Homo sapiens
atgtcaggggcggggagggtgac

SEQ ID NO: 1894179 - DNA, 17 bp, Homo sapiens
atgttgctataataaag

SEQ ID NO: 1894180 - DNA, 15 bp, Homo sapiens
caaaaacatgtatgt

SEQ ID NO: 1894181 - DNA, 22 bp, Homo sapiens
caaaaacatgtatgtgcatttc

SEQ ID NO: 1894182 - DNA, 22 bp, Homo sapiens
caaaactgcctcaggaggcagg

SEQ ID NO: 1894183 - DNA, 12 bp, Homo sapiens
caaaagctgctc

SEQ ID NO: 1894184 - DNA, 21 bp, Homo sapiens
caagcccctgctccagaagat

SEQ ID NO: 1894185 - DNA, 12 bp, Homo sapiens
caatcccagcta

SEQ ID NO: 1894186 - DNA, 22 bp, Homo sapiens
cactcagctcttggctccactg

SEQ ID NO: 1894187 - DNA, 14 bp, Homo sapiens
cactctgggctcca

SEQ ID NO: 1894188 - DNA, 16 bp, Homo sapiens
cactctgggctccaga

SEQ ID NO: 1894189 - DNA, 17 bp, Homo sapiens
cactctgggctccagag

SEQ ID NO: 1894190 - DNA, 22 bp, Homo sapiens
cagagatagtggggagacttct

SEQ ID NO: 1894191 - DNA, 18 bp, Homo sapiens
cagagtgcaagcccctgc

SEQ ID NO: 1894192 - DNA, 20 bp, Homo sapiens
cagagtgcaagcccctgctc

SEQ ID NO: 1894193 - DNA, 21 bp, Homo sapiens
cagctacctcaaccaatgcca

SEQ ID NO: 1894194 - DNA, 16 bp, Homo sapiens
cagctcttggctccac

SEQ ID NO: 1894195 - DNA, 18 bp, Homo sapiens
caggaaaggcccagccac

SEQ ID NO: 1894196 - DNA, 21 bp, Homo sapiens
caggaccttcgggctgtgccc

SEQ ID NO: 1894197 - DNA, 17 bp, Homo sapiens
caggccttatctccaag

SEQ ID NO: 1894198 - DNA, 22 bp, Homo sapiens
caggccttatctccaagaccag

SEQ ID NO: 1894199 - DNA, 17 bp, Homo sapiens
cagggaaaagcagctct

SEQ ID NO: 1894200 - DNA, 21 bp, Homo sapiens
cagggactgaaaacctctcct

SEQ ID NO: 1894201 - DNA, 18 bp, Homo sapiens
cataataaaaggctttga

SEQ ID NO: 1894202 - DNA, 15 bp, Homo sapiens
catgcactcagctct

SEQ ID NO: 1894203 - DNA, 16 bp, Homo sapiens
catgcactcagctctt

SEQ ID NO: 1894204 - DNA, 18 bp, Homo sapiens
ccaatcccagctacctca

SEQ ID NO: 1894205 - DNA, 13 bp, Homo sapiens
ccaccgcccagag

SEQ ID NO: 1894206 - DNA, 21 bp, Homo sapiens
ccagagtggggatgacatgca

SEQ ID NO: 1894207 - DNA, 12 bp, Homo sapiens
ccagctgcctcc

SEQ ID NO: 1894208 - DNA, 23 bp, Homo sapiens
cccaatcccagctacctcaacca

SEQ ID NO: 1894209 - DNA, 13 bp, Homo sapiens
cccacacacagat

SEQ ID NO: 1894210 - DNA, 22 bp, Homo sapiens
cccagctacctcaaccaatgcc

SEQ ID NO: 1894211 - DNA, 14 bp, Homo sapiens
cccctctccttcct

SEQ ID NO: 1894212 - DNA, 15 bp, Homo sapiens
cccgccaaaagctgc

SEQ ID NO: 1894213 - DNA, 15 bp, Homo sapiens
ccctcagagtgcaag

SEQ ID NO: 1894214 - DNA, 19 bp, Homo sapiens
ccctgctccagaagatagc

SEQ ID NO: 1894215 - DNA, 18 bp, Homo sapiens
ccgaagccgcctgtggac

SEQ ID NO: 1894216 - DNA, 21 bp, Homo sapiens
ccgccaaaagctgctcaggga

SEQ ID NO: 1894217 - DNA, 19 bp, Homo sapiens
ccgcgtcgccctcccaggc

SEQ ID NO: 1894218 - DNA, 16 bp, Homo sapiens
cctaaaccaaaaactg

SEQ ID NO: 1894219 - DNA, 15 bp, Homo sapiens
cctcacaggccccag

SEQ ID NO: 1894220 - DNA, 11 bp, Homo sapiens
cctctcccagg

SEQ ID NO: 1894221 - DNA, 12 bp, Homo sapiens
cctctcccaggg

SEQ ID NO: 1894222 - DNA, 18 bp, Homo sapiens
cctctcctcatgttctgc

SEQ ID NO: 1894223 - DNA, 13 bp, Homo sapiens
cctctccttcctg

SEQ ID NO: 1894224 - DNA, 15 bp, Homo sapiens
cctctccttcctgtg

SEQ ID NO: 1894225 - DNA, 12 bp, Homo sapiens
cctgcaggccag

SEQ ID NO: 1894226 - DNA, 16 bp, Homo sapiens
cctgcaggccaggcca

SEQ ID NO: 1894227 - DNA, 21 bp, Homo sapiens
cctggggtggggatagggagc

SEQ ID NO: 1894228 - DNA, 21 bp, Homo sapiens
cctgtgtgtccaaaactgcct

SEQ ID NO: 1894229 - DNA, 16 bp, Homo sapiens
ccttatctccaagacc

SEQ ID NO: 1894230 - DNA, 14 bp, Homo sapiens
ccttcgggctgtgc

SEQ ID NO: 1894231 - DNA, 15 bp, Homo sapiens
ccttcgggctgtgcc

SEQ ID NO: 1894232 - DNA, 17 bp, Homo sapiens
ccttctggcctcccaca

SEQ ID NO: 1894233 - DNA, 18 bp, Homo sapiens
ccttgaggaaacaacagc

SEQ ID NO: 1894234 - DNA, 13 bp, Homo sapiens
cgccctcccaggc

SEQ ID NO: 1894235 - DNA, 20 bp, Homo sapiens
cggcccatccccaggcacct

SEQ ID NO: 1894236 - DNA, 15 bp, Homo sapiens
cggggagggtgacag

SEQ ID NO: 1894237 - DNA, 16 bp, Homo sapiens
cgtcgccctcccaggc

SEQ ID NO: 1894238 - DNA, 12 bp, Homo sapiens
ctaaaagcacac

SEQ ID NO: 1894239 - DNA, 15 bp, Homo sapiens
ctaacaccagacaga

SEQ ID NO: 1894240 - DNA, 22 bp, Homo sapiens
ctcaaatgctcagaccagctct

SEQ ID NO: 1894241 - DNA, 16 bp, Homo sapiens
ctcagaccagctcttc

SEQ ID NO: 1894242 - DNA, 20 bp, Homo sapiens
ctcagctcttggctccactg

SEQ ID NO: 1894243 - DNA, 16 bp, Homo sapiens
ctcaggaggcaggacc

SEQ ID NO: 1894244 - DNA, 18 bp, Homo sapiens
ctcaggaggcaggacctt

SEQ ID NO: 1894245 - DNA, 15 bp, Homo sapiens
ctccagaagatagct

SEQ ID NO: 1894246 - DNA, 23 bp, Homo sapiens
ctccagaagatagcttcacccca

SEQ ID NO: 1894247 - DNA, 20 bp, Homo sapiens
ctccagagtggggatgacat

SEQ ID NO: 1894248 - DNA, 13 bp, Homo sapiens
ctcccctcagagt

SEQ ID NO: 1894249 - DNA, 16 bp, Homo sapiens
ctctctgaacccctcc

SEQ ID NO: 1894250 - DNA, 17 bp, Homo sapiens
ctgcaggccaggccagc

SEQ ID NO: 1894251 - DNA, 19 bp, Homo sapiens
ctggcctcccacagactca

SEQ ID NO: 1894252 - DNA, 11 bp, Homo sapiens
ctgggaaacag

SEQ ID NO: 1894253 - DNA, 15 bp, Homo sapiens
ctgggaaacagaggc

SEQ ID NO: 1894254 - DNA, 20 bp, Homo sapiens
ctgggatgggaggagaggac

SEQ ID NO: 1894255 - DNA, 17 bp, Homo sapiens
ctgttcccacctgctgg

SEQ ID NO: 1894256 - DNA, 18 bp, Homo sapiens
cttcaccccaatcccagc

SEQ ID NO: 1894257 - DNA, 15 bp, Homo sapiens
cttctggcctcccac

SEQ ID NO: 1894258 - DNA, 19 bp, Homo sapiens
cttctggcctcccacagac

SEQ ID NO: 1894259 - DNA, 23 bp, Homo sapiens
cttgccgcgtcgccctcccaggc

SEQ ID NO: 1894260 - DNA, 20 bp, Homo sapiens
aaaaacatgtatgtgcattt

SEQ ID NO: 1894261 - DNA, 14 bp, Homo sapiens
aaaaagacagggct

SEQ ID NO: 1894262 - DNA, 19 bp, Homo sapiens
aaaaagtaggaaatgaatg

SEQ ID NO: 1894263 - DNA, 11 bp, Homo sapiens
aaaaccaggcc

SEQ ID NO: 1894264 - DNA, 17 bp, Homo sapiens
aaaagcagctctcccct

SEQ ID NO: 1894265 - DNA, 22 bp, Homo sapiens
aaagacagggctgataagctaa

SEQ ID NO: 1894266 - DNA, 20 bp, Homo sapiens
aaagcacactcatcccctca

SEQ ID NO: 1894267 - DNA, 18 bp, Homo sapiens
aactgttcccacctgctg

SEQ ID NO: 1894268 - DNA, 21 bp, Homo sapiens
aagacagggctgataagctaa

SEQ ID NO: 1894269 - DNA, 13 bp, Homo sapiens
aagcagctctccc

SEQ ID NO: 1894270 - DNA, 14 bp, Homo sapiens
aagcagctctcccc

SEQ ID NO: 1894271 - DNA, 17 bp, Homo sapiens
aagcagctctcccctca

SEQ ID NO: 1894272 - DNA, 23 bp, Homo sapiens
aaggaactaggtcaaaaatctgt

SEQ ID NO: 1894273 - DNA, 15 bp, Homo sapiens
aatgaaatgtatgtg

SEQ ID NO: 1894274 - DNA, 23 bp, Homo sapiens
acaagctattccctcaaatctga

SEQ ID NO: 1894275 - DNA, 20 bp, Homo sapiens
acagactcaaatgctcagac

SEQ ID NO: 1894276 - DNA, 22 bp, Homo sapiens
acagggactgaaaacctctcct

SEQ ID NO: 1894277 - DNA, 22 bp, Homo sapiens
acatcagctggtcaaacaaact

SEQ ID NO: 1894278 - DNA, 17 bp, Homo sapiens
acatgcactcagctctt

SEQ ID NO: 1894279 - DNA, 11 bp, Homo sapiens
aaaaaaagaca

SEQ ID NO: 1894280 - DNA, 21 bp, Homo sapiens
aaaagcacactcatcccctca

SEQ ID NO: 1894281 - DNA, 16 bp, Homo sapiens
aaaagcagctctcccc

SEQ ID NO: 1894282 - DNA, 11 bp, Homo sapiens
aaacctctcct

SEQ ID NO: 1894283 - DNA, 20 bp, Homo sapiens
aaactgttcccacctgctgg

SEQ ID NO: 1894284 - DNA, 18 bp, Homo sapiens
aaagcagctctcccctca

SEQ ID NO: 1894285 - DNA, 20 bp, Homo sapiens
aaagtgaaagtccagaaact

SEQ ID NO: 1894286 - DNA, 18 bp, Homo sapiens
aaatgtaactgtgccagt

SEQ ID NO: 1894287 - DNA, 15 bp, Homo sapiens
aacattttacccaca

SEQ ID NO: 1894288 - DNA, 17 bp, Homo sapiens
aacattttacccacaca

SEQ ID NO: 1894289 - DNA, 15 bp, Homo sapiens
aactgttcccacctg

SEQ ID NO: 1894290 - DNA, 23 bp, Homo sapiens
aagaccagagatagtggggagac

SEQ ID NO: 1894291 - DNA, 19 bp, Homo sapiens
aagcacactcatcccctca

SEQ ID NO: 1894292 - DNA, 23 bp, Homo sapiens
aagctgcctcccctctccttcct

SEQ ID NO: 1894293 - DNA, 21 bp, Homo sapiens
aaggcccacgagcttgttctt

SEQ ID NO: 1894294 - DNA, 17 bp, Homo sapiens
aatgaaatgtatgtgct

SEQ ID NO: 1894295 - DNA, 15 bp, Homo sapiens
acaaactctctgaac

SEQ ID NO: 1894296 - DNA, 22 bp, Homo sapiens
acaaactctctgaacccctccc

SEQ ID NO: 1894297 - DNA, 18 bp, Homo sapiens
acaagccacgaatgaatg

SEQ ID NO: 1894298 - DNA, 20 bp, Homo sapiens
acaccatcgatcatgatgta

SEQ ID NO: 1894299 - DNA, 14 bp, Homo sapiens
acctctcctcatgt

SEQ ID NO: 1894300 - DNA, 15 bp, Homo sapiens
accttcgggctgtgc

SEQ ID NO: 1894301 - DNA, 20 bp, Homo sapiens
acgccgccctaaaagcacac

SEQ ID NO: 1894302 - DNA, 16 bp, Homo sapiens
actgaaaacctctcct

SEQ ID NO: 1894303 - DNA, 22 bp, Homo sapiens
actgggatgggaggagaggaca

SEQ ID NO: 1894304 - DNA, 18 bp, Homo sapiens
actgtcctccaagccagc

SEQ ID NO: 1894305 - DNA, 19 bp, Homo sapiens
actttatagttgttttata

SEQ ID NO: 1894306 - DNA, 17 bp, Homo sapiens
agaatgaaatgtatgtg

SEQ ID NO: 1894307 - DNA, 12 bp, Homo sapiens
agaccagctctt

SEQ ID NO: 1894308 - DNA, 15 bp, Homo sapiens
agagggacctctccc

SEQ ID NO: 1894309 - DNA, 16 bp, Homo sapiens
agagggacctctccca

SEQ ID NO: 1894310 - DNA, 13 bp, Homo sapiens
agaggtttcagtg

SEQ ID NO: 1894311 - DNA, 14 bp, Homo sapiens
agagtcctctgaat

SEQ ID NO: 1894312 - DNA, 22 bp, Homo sapiens
agcaacattttacccacacaca

SEQ ID NO: 1894313 - DNA, 14 bp, Homo sapiens
agcacactcatccc

SEQ ID NO: 1894314 - DNA, 19 bp, Homo sapiens
agcagatgcaatgactcag

SEQ ID NO: 1894315 - DNA, 15 bp, Homo sapiens
agccaccgaagccgc

SEQ ID NO: 1894316 - DNA, 20 bp, Homo sapiens
agccaccgaagccgcctgtg

SEQ ID NO: 1894317 - DNA, 14 bp, Homo sapiens
agctacctcaacca

SEQ ID NO: 1894318 - DNA, 16 bp, Homo sapiens
agctcttggctccact

SEQ ID NO: 1894319 - DNA, 20 bp, Homo sapiens
agcttcaccccaatcccagc

SEQ ID NO: 1894320 - DNA, 15 bp, Homo sapiens
agctttaaaagaaaa

SEQ ID NO: 1894321 - DNA, 18 bp, Homo sapiens
aggaccttcgggctgtgc

SEQ ID NO: 1894322 - DNA, 21 bp, Homo sapiens
aggcaggaccttcgggctgtg

SEQ ID NO: 1894323 - DNA, 22 bp, Homo sapiens
aggcaggaccttcgggctgtgc

SEQ ID NO: 1894324 - DNA, 13 bp, Homo sapiens
aggccagctgcct

SEQ ID NO: 1894325 - DNA, 13 bp, Homo sapiens
agggacctctccc

SEQ ID NO: 1894326 - DNA, 12 bp, Homo sapiens
agggtccctggg

SEQ ID NO: 1894327 - DNA, 14 bp, Homo sapiens
aggttggtgaattt

SEQ ID NO: 1894328 - DNA, 20 bp, Homo sapiens
agtccagaaactgttcccac

SEQ ID NO: 1894329 - DNA, 12 bp, Homo sapiens
agtcctctgaat

SEQ ID NO: 1894330 - DNA, 23 bp, Homo sapiens
agtgtggtgtttcctgcaggcca

SEQ ID NO: 1894331 - DNA, 14 bp, Homo sapiens
atcaaagccacact

SEQ ID NO: 1894332 - DNA, 16 bp, Homo sapiens
atcaaagccacactct

SEQ ID NO: 1894333 - DNA, 14 bp, Homo sapiens
atgaaccttctggc

SEQ ID NO: 1894334 - DNA, 24 bp, Homo sapiens
atgaaccttctggcctcccacaga

SEQ ID NO: 1894335 - DNA, 14 bp, Homo sapiens
atgctcagaccagc

SEQ ID NO: 1894336 - DNA, 13 bp, Homo sapiens
atgttctgctttc

SEQ ID NO: 1894337 - DNA, 22 bp, Homo sapiens
atttcaatcccacgtacttata

SEQ ID NO: 1894338 - DNA, 14 bp, Homo sapiens
caaaagctgctcag

SEQ ID NO: 1894339 - DNA, 17 bp, Homo sapiens
caaaggagctcgaagga

SEQ ID NO: 1894340 - DNA, 20 bp, Homo sapiens
caacactgggaaacagaggc

SEQ ID NO: 1894341 - DNA, 17 bp, Homo sapiens
caatcccagctacctca

SEQ ID NO: 1894342 - DNA, 18 bp, Homo sapiens
cacagactcaaatgctca

SEQ ID NO: 1894343 - DNA, 15 bp, Homo sapiens
cacctgctggagtga

SEQ ID NO: 1894344 - DNA, 19 bp, Homo sapiens
cagaaactgttcccacctg

SEQ ID NO: 1894345 - DNA, 13 bp, Homo sapiens
cagaccagctctt

SEQ ID NO: 1894346 - DNA, 23 bp, Homo sapiens
cagagtgcaagcccctgctccag

SEQ ID NO: 1894347 - DNA, 14 bp, Homo sapiens
cagatgcaatgact

SEQ ID NO: 1894348 - DNA, 13 bp, Homo sapiens
gaaaacctctcct

SEQ ID NO: 1894349 - DNA, 21 bp, Homo sapiens
gaaacaacagctttaaaagaa

SEQ ID NO: 1894350 - DNA, 16 bp, Homo sapiens
gaaagtgaaagtccag

SEQ ID NO: 1894351 - DNA, 12 bp, Homo sapiens
gaatttcacaag

SEQ ID NO: 1894352 - DNA, 23 bp, Homo sapiens
gacagacaacactgggaaacaga

SEQ ID NO: 1894353 - DNA, 23 bp, Homo sapiens
gacatccccccgccaaaagctgc

SEQ ID NO: 1894354 - DNA, 14 bp, Homo sapiens
gacatgcactcagc

SEQ ID NO: 1894355 - DNA, 23 bp, Homo sapiens
gactagagggacctctcccaggg

SEQ ID NO: 1894356 - DNA, 18 bp, Homo sapiens
gactgaaaacctctcctc

SEQ ID NO: 1894357 - DNA, 13 bp, Homo sapiens
gagggacctctcc

SEQ ID NO: 1894358 - DNA, 18 bp, Homo sapiens
gagggacctctcccaggg

SEQ ID NO: 1894359 - DNA, 23 bp, Homo sapiens
gatagcttcaccccaatcccagc

SEQ ID NO: 1894360 - DNA, 18 bp, Homo sapiens
gatgccgaggtaaaagtt

SEQ ID NO: 1894361 - DNA, 12 bp, Homo sapiens
gcagctctcccc

SEQ ID NO: 1894362 - DNA, 21 bp, Homo sapiens
gcaggaccttcgggctgtgcc

SEQ ID NO: 1894363 - DNA, 15 bp, Homo sapiens
gcaggccaggccagc

SEQ ID NO: 1894364 - DNA, 17 bp, Homo sapiens
gcaggccaggccagctg

SEQ ID NO: 1894365 - DNA, 16 bp, Homo sapiens
gccaaaaaaagacagg

SEQ ID NO: 1894366 - DNA, 14 bp, Homo sapiens
gccaaaagctgctc

SEQ ID NO: 1894367 - DNA, 15 bp, Homo sapiens
gccaaaagctgctca

SEQ ID NO: 1894368 - DNA, 22 bp, Homo sapiens
gccacactctgggctccagagt

SEQ ID NO: 1894369 - DNA, 18 bp, Homo sapiens
gcccatccccaggcacct

SEQ ID NO: 1894370 - DNA, 12 bp, Homo sapiens
gccctcccaggc

SEQ ID NO: 1894371 - DNA, 19 bp, Homo sapiens
gcgggaatggcagctgcca

SEQ ID NO: 1894372 - DNA, 20 bp, Homo sapiens
gctcttccgaaaaccaggcc

SEQ ID NO: 1894373 - DNA, 20 bp, Homo sapiens
gctgctcagggaaaagcagc

SEQ ID NO: 1894374 - DNA, 22 bp, Homo sapiens
gctggtcaaacaaactctctga

SEQ ID NO: 1894375 - DNA, 14 bp, Homo sapiens
ggaaaagcagctct

SEQ ID NO: 1894376 - DNA, 19 bp, Homo sapiens
ggaaaagcggacatcagct

SEQ ID NO: 1894377 - DNA, 13 bp, Homo sapiens
ggaaacaacagct

SEQ ID NO: 1894378 - DNA, 16 bp, Homo sapiens
ggaaacaacagcttta

SEQ ID NO: 1894379 - DNA, 13 bp, Homo sapiens
ggaaacagaggct

SEQ ID NO: 1894380 - DNA, 14 bp, Homo sapiens
ggacctctcccagg

SEQ ID NO: 1894381 - DNA, 15 bp, Homo sapiens
ggacctctcccaggg

SEQ ID NO: 1894382 - DNA, 19 bp, Homo sapiens
ggaccttcgggctgtgccc

SEQ ID NO: 1894383 - DNA, 21 bp, Homo sapiens
ggatgacatgcactcagctct

SEQ ID NO: 1894384 - DNA, 16 bp, Homo sapiens
ggcacctcacaggccc

SEQ ID NO: 1894385 - DNA, 23 bp, Homo sapiens
ggcctgaagagtcctctgaatga

SEQ ID NO: 1894386 - DNA, 20 bp, Homo sapiens
gggatgacatgcactcagct

SEQ ID NO: 1894387 - DNA, 17 bp, Homo sapiens
ggggaaaggcaaggtcc

SEQ ID NO: 1894388 - DNA, 13 bp, Homo sapiens
gtcctctgaatga

SEQ ID NO: 1894389 - DNA, 17 bp, Homo sapiens
gtcctctgaatgaacct

SEQ ID NO: 1894390 - DNA, 20 bp, Homo sapiens
gtgacctatcagttattaat

SEQ ID NO: 1894391 - DNA, 15 bp, Homo sapiens
gtgcaagcccctgct

SEQ ID NO: 1894392 - DNA, 17 bp, Homo sapiens
gtggccgcccaaggccc

SEQ ID NO: 1894393 - DNA, 15 bp, Homo sapiens
gtgtggttatgaact

SEQ ID NO: 1894394 - DNA, 18 bp, Homo sapiens
gtgtgtccaaaactgcct

SEQ ID NO: 1894395 - DNA, 16 bp, Homo sapiens
gtttcctgcaggccag

SEQ ID NO: 1894396 - DNA, 12 bp, Homo sapiens
taaaagttcttt

SEQ ID NO: 1894397 - DNA, 18 bp, Homo sapiens
taactgtgccagttcttt

SEQ ID NO: 1894398 - DNA, 15 bp, Homo sapiens
tagagggacctctcc

SEQ ID NO: 1894399 - DNA, 19 bp, Homo sapiens
tagagggacctctcccagg

SEQ ID NO: 1894400 - DNA, 18 bp, Homo sapiens
tatagttgttttatatgt

SEQ ID NO: 1894401 - DNA, 17 bp, Homo sapiens
tcaaccaatgccaaaaa

SEQ ID NO: 1894402 - DNA, 19 bp, Homo sapiens
tcacaggccccaggaaagg

SEQ ID NO: 1894403 - DNA, 16 bp, Homo sapiens
tcactgtcctccaagc

SEQ ID NO: 1894404 - DNA, 19 bp, Homo sapiens
tcactgtcctccaagccag

SEQ ID NO: 1894405 - DNA, 16 bp, Homo sapiens
tcagggaaaagcagct

SEQ ID NO: 1894406 - DNA, 18 bp, Homo sapiens
tcagggaaaagcagctct

SEQ ID NO: 1894407 - DNA, 19 bp, Homo sapiens
tcagggaaaagcagctctc

SEQ ID NO: 1894408 - DNA, 17 bp, Homo sapiens
tcatcccctcacttgcc

SEQ ID NO: 1894409 - DNA, 13 bp, Homo sapiens
tccaaaactgcct

SEQ ID NO: 1894410 - DNA, 23 bp, Homo sapiens
tcccttgaggaaacaacagcttt

SEQ ID NO: 1894411 - DNA, 14 bp, Homo sapiens
tcctccaagccagc

SEQ ID NO: 1894412 - DNA, 13 bp, Homo sapiens
tcgccctcccagg

SEQ ID NO: 1894413 - DNA, 14 bp, Homo sapiens
tcgccctcccaggc

SEQ ID NO: 1894414 - DNA, 18 bp, Homo sapiens
tctcccctcagagtgcaa

SEQ ID NO: 1894415 - DNA, 16 bp, Homo sapiens
tctttccataataaaa

SEQ ID NO: 1894416 - DNA, 17 bp, Homo sapiens
tgaagagtcctctgaat

SEQ ID NO: 1894417 - DNA, 23 bp, Homo sapiens
tgaagagtcctctgaatgaacct

SEQ ID NO: 1894418 - DNA, 22 bp, Homo sapiens
tgaaggggccaaggagggtgag

SEQ ID NO: 1894419 - DNA, 21 bp, Homo sapiens
tgacagtggccgcccaaggcc

SEQ ID NO: 1894420 - DNA, 16 bp, Homo sapiens
tgaggaaacaacagct

SEQ ID NO: 1894421 - DNA, 20 bp, Homo sapiens
tgccaaaaaaagacagggct

SEQ ID NO: 1894422 - DNA, 21 bp, Homo sapiens
tgccgcgtcgccctcccaggc

SEQ ID NO: 1894423 - DNA, 18 bp, Homo sapiens
tgcctcaggaggcaggac

SEQ ID NO: 1894424 - DNA, 21 bp, Homo sapiens
tgcctcaggaggcaggacctt

SEQ ID NO: 1894425 - DNA, 17 bp, Homo sapiens
tgctcagaccagctctt

SEQ ID NO: 1894426 - DNA, 19 bp, Homo sapiens
tgctcagggaaaagcagct

SEQ ID NO: 1894427 - DNA, 21 bp, Homo sapiens
tgctcagggaaaagcagctct

SEQ ID NO: 1894428 - DNA, 15 bp, Homo sapiens
tgggaaacagaggct

SEQ ID NO: 1894429 - DNA, 12 bp, Homo sapiens
tggttatgaact

SEQ ID NO: 1894430 - DNA, 17 bp, Homo sapiens
tgtcacagggactgaaa

SEQ ID NO: 1894431 - DNA, 21 bp, Homo sapiens
tgtggtgtttcctgcaggcca

SEQ ID NO: 1894432 - DNA, 16 bp, Homo sapiens
tgtgtgtccaaaactg

SEQ ID NO: 1894433 - DNA, 16 bp, Homo sapiens
tgtttcctgcaggcca

SEQ ID NO: 1894434 - DNA, 17 bp, Homo sapiens
ttcaccccaatcccagc

SEQ ID NO: 1894435 - DNA, 21 bp, Homo sapiens
ttcctgtgtgtccaaaactgc

SEQ ID NO: 1894436 - DNA, 15 bp, Homo sapiens
ttctggcctcccaca

SEQ ID NO: 1894437 - DNA, 22 bp, Homo sapiens
ttgccgcgtcgccctcccaggc

SEQ ID NO: 1894438 - DNA, 15 bp, Homo sapiens
ttttcttcactgtcc

SEQ ID NO: 1894439 - DNA, 23 bp, Homo sapiens
aaaactgaaagtgaaagtccaga

SEQ ID NO: 1894440 - DNA, 13 bp, Homo sapiens
aaaagacagggct

SEQ ID NO: 1894441 - DNA, 11 bp, Homo sapiens
aaaagttcttt

SEQ ID NO: 1894442 - DNA, 15 bp, Homo sapiens
aaaccaaaaactgaa

SEQ ID NO: 1894443 - DNA, 15 bp, Homo sapiens
aaagcagctctcccc

SEQ ID NO: 1894444 - DNA, 19 bp, Homo sapiens
aaagcggacatcagctggt

SEQ ID NO: 1894445 - DNA, 21 bp, Homo sapiens
aaagctgctcagggaaaagca

SEQ ID NO: 1894446 - DNA, 23 bp, Homo sapiens
aaatgtaactgtgccagttcttt

SEQ ID NO: 1894447 - DNA, 16 bp, Homo sapiens
aacaaactctctgaac

SEQ ID NO: 1894448 - DNA, 13 bp, Homo sapiens
aactgaaagtgaa

SEQ ID NO: 1894449 - DNA, 13 bp, Homo sapiens
aactgttcccacc

SEQ ID NO: 1894450 - DNA, 14 bp, Homo sapiens
aagaatttcacaag

SEQ ID NO: 1894451 - DNA, 15 bp, Homo sapiens
aagagtcctctgaat

SEQ ID NO: 1894452 - DNA, 17 bp, Homo sapiens
aagatagcttcacccca

SEQ ID NO: 1894453 - DNA, 12 bp, Homo sapiens
aaggagggtgag

SEQ ID NO: 1894454 - DNA, 21 bp, Homo sapiens
aagttttcccttgaggaaaca

SEQ ID NO: 1894455 - DNA, 16 bp, Homo sapiens
aatctgagggagctga

SEQ ID NO: 1894456 - DNA, 16 bp, Homo sapiens
aatgaaatgtatgtgc

SEQ ID NO: 1894457 - DNA, 20 bp, Homo sapiens
aatgactcaggacatccccc

SEQ ID NO: 1894458 - DNA, 15 bp, Homo sapiens
aatgctcagaccagc

SEQ ID NO: 1894459 - DNA, 14 bp, Homo sapiens
acaccagacagaca

SEQ ID NO: 1894460 - DNA, 14 bp, Homo sapiens
acactgggaaacag

SEQ ID NO: 1894461 - DNA, 21 bp, Homo sapiens
acagggctgataagctaacac

SEQ ID NO: 1894462 - DNA, 18 bp, Homo sapiens
acatgcactcagctcttg

SEQ ID NO: 1894463 - DNA, 19 bp, Homo sapiens
accaaaaactgaaagtgaa

SEQ ID NO: 1894464 - DNA, 21 bp, Homo sapiens
accaatgccaaaaaaagacag

SEQ ID NO: 1894465 - DNA, 14 bp, Homo sapiens
accccaatcccagc

SEQ ID NO: 1894466 - DNA, 17 bp, Homo sapiens
accttcgggctgtgccc

SEQ ID NO: 1894467 - DNA, 18 bp, Homo sapiens
accttctggcctcccaca

SEQ ID NO: 1894468 - DNA, 18 bp, Homo sapiens
actagagggacctctccc

SEQ ID NO: 1894469 - DNA, 23 bp, Homo sapiens
actcaaatgctcagaccagctct

SEQ ID NO: 1894470 - DNA, 17 bp, Homo sapiens
actgaaaacctctcctc

SEQ ID NO: 1894471 - DNA, 22 bp, Homo sapiens
acttcttggcttggtgaggaaa

SEQ ID NO: 1894472 - DNA, 22 bp, Homo sapiens
acttgccgcgtcgccctcccag

SEQ ID NO: 1894473 - DNA, 15 bp, Homo sapiens
agaaactgttcccac

SEQ ID NO: 1894474 - DNA, 13 bp, Homo sapiens
agactcaaatgct

SEQ ID NO: 1894475 - DNA, 12 bp, Homo sapiens
agagtcctctga

SEQ ID NO: 1894476 - DNA, 20 bp, Homo sapiens
agcaacattttacccacaca

SEQ ID NO: 1894477 - DNA, 22 bp, Homo sapiens
agccagcgggaatggcagctgc

SEQ ID NO: 1894478 - DNA, 23 bp, Homo sapiens
agctacctcaaccaatgccaaaa

SEQ ID NO: 1894479 - DNA, 15 bp, Homo sapiens
agctctcccctcaga

SEQ ID NO: 1894480 - DNA, 23 bp, Homo sapiens
agctgcctcccctctccttcctg

SEQ ID NO: 1894481 - DNA, 16 bp, Homo sapiens
agctgctcagggaaaa

SEQ ID NO: 1894482 - DNA, 18 bp, Homo sapiens
agcttcaccccaatccca

SEQ ID NO: 1894483 - DNA, 21 bp, Homo sapiens
agcttcaccccaatcccagct

SEQ ID NO: 1894484 - DNA, 15 bp, Homo sapiens
aggaaacaacagctt

SEQ ID NO: 1894485 - DNA, 20 bp, Homo sapiens
aggaccttcgggctgtgccc

SEQ ID NO: 1894486 - DNA, 20 bp, Homo sapiens
aggcacctcacaggccccag

SEQ ID NO: 1894487 - DNA, 13 bp, Homo sapiens
aggccaggccagc

SEQ ID NO: 1894488 - DNA, 21 bp, Homo sapiens
aggctattgtcccctaaacca

SEQ ID NO: 1894489 - DNA, 17 bp, Homo sapiens
agtgcaagcccctgctc

SEQ ID NO: 1894490 - DNA, 22 bp, Homo sapiens
agtgtggttatgaactttatag

SEQ ID NO: 1894491 - DNA, 19 bp, Homo sapiens
agttctttccataataaaa

SEQ ID NO: 1894492 - DNA, 18 bp, Homo sapiens
agttttcccttgaggaaa

SEQ ID NO: 1894493 - DNA, 22 bp, Homo sapiens
atagcttcaccccaatcccagc

SEQ ID NO: 1894494 - DNA, 14 bp, Homo sapiens
atgcactcagctct

SEQ ID NO: 1894495 - DNA, 14 bp, Homo sapiens
atggcagctgccac

SEQ ID NO: 1894496 - DNA, 10 bp, Homo sapiens
atttcacaag

SEQ ID NO: 1894497 - DNA, 23 bp, Homo sapiens
caaaaacatgtatgtgcatttca

SEQ ID NO: 1894498 - DNA, 14 bp, Homo sapiens
caaactctctgaac

SEQ ID NO: 1894499 - DNA, 22 bp, Homo sapiens
caagccagcgggaatggcagct

SEQ ID NO: 1894500 - DNA, 22 bp, Homo sapiens
caatgccaaaaaaagacagggc

SEQ ID NO: 1894501 - DNA, 14 bp, Homo sapiens
cacactcatcccct

SEQ ID NO: 1894502 - DNA, 22 bp, Homo sapiens
cacagggactgaaaacctctcc

SEQ ID NO: 1894503 - DNA, 16 bp, Homo sapiens
cactcatcccctcact

SEQ ID NO: 1894504 - DNA, 14 bp, Homo sapiens
cactgtcctccaag

SEQ ID NO: 1894505 - DNA, 17 bp, Homo sapiens
cactgtcctccaagcca

SEQ ID NO: 1894506 - DNA, 18 bp, Homo sapiens
cactgtcctccaagccag

SEQ ID NO: 1894507 - DNA, 23 bp, Homo sapiens
cagactcaaatgctcagaccagc

SEQ ID NO: 1894508 - DNA, 22 bp, Homo sapiens
cagcgggaatggcagctgccac

SEQ ID NO: 1894509 - DNA, 23 bp, Homo sapiens
cagcgggaatggcagctgccacg

SEQ ID NO: 1894510 - DNA, 12 bp, Homo sapiens
cagctctcccct

SEQ ID NO: 1894511 - DNA, 20 bp, Homo sapiens
caggaccttcgggctgtgcc

SEQ ID NO: 1894512 - DNA, 15 bp, Homo sapiens
caggaggcaggacct

SEQ ID NO: 1894513 - DNA, 14 bp, Homo sapiens
caggccaggccagc

SEQ ID NO: 1894514 - DNA, 13 bp, Homo sapiens
caggctctcaaca

SEQ ID NO: 1894515 - DNA, 21 bp, Homo sapiens
cagggaaaagcagctctcccc

SEQ ID NO: 1894516 - DNA, 12 bp, Homo sapiens
cagggtccctgg

SEQ ID NO: 1894517 - DNA, 14 bp, Homo sapiens
catgttctgctttc

SEQ ID NO: 1894518 - DNA, 23 bp, Homo sapiens
ccaagctgcctcccctctccttc

SEQ ID NO: 1894519 - DNA, 20 bp, Homo sapiens
ccaaggagggtgagtgcaag

SEQ ID NO: 1894520 - DNA, 17 bp, Homo sapiens
ccaccgcccagagaccc

SEQ ID NO: 1894521 - DNA, 24 bp, Homo sapiens
ccagaaactgttcccacctgctgg

SEQ ID NO: 1894522 - DNA, 22 bp, Homo sapiens
ccagaagatagcttcaccccaa

SEQ ID NO: 1894523 - DNA, 17 bp, Homo sapiens
ccagcgggaatggcagc

SEQ ID NO: 1894524 - DNA, 23 bp, Homo sapiens
ccagcgggaatggcagctgccac

SEQ ID NO: 1894525 - DNA, 18 bp, Homo sapiens
ccaggccttatctccaag

SEQ ID NO: 1894526 - DNA, 13 bp, Homo sapiens
ccagggtccctgg

SEQ ID NO: 1894527 - DNA, 23 bp, Homo sapiens
cccacagactcaaatgctcagac

SEQ ID NO: 1894528 - DNA, 22 bp, Homo sapiens
cccggggaaaggcaaggtccgg

SEQ ID NO: 1894529 - DNA, 14 bp, Homo sapiens
ccctaaaagcacac

SEQ ID NO: 1894530 - DNA, 22 bp, Homo sapiens
cccttgaggaaacaacagcttt

SEQ ID NO: 1894531 - DNA, 22 bp, Homo sapiens
ccgcccagagacccaagctgcc

SEQ ID NO: 1894532 - DNA, 17 bp, Homo sapiens
ccgcgtcgccctcccag

SEQ ID NO: 1894533 - DNA, 18 bp, Homo sapiens
cctaaaagcacactcatc

SEQ ID NO: 1894534 - DNA, 14 bp, Homo sapiens
cctcagagtgcaag

SEQ ID NO: 1894535 - DNA, 19 bp, Homo sapiens
cctcaggaggcaggacctt

SEQ ID NO: 1894536 - DNA, 15 bp, Homo sapiens
cctcccaggctctca

SEQ ID NO: 1894537 - DNA, 17 bp, Homo sapiens
cctcccctctccttcct

SEQ ID NO: 1894538 - DNA, 21 bp, Homo sapiens
cctgaagagtcctctgaatga

SEQ ID NO: 1894539 - DNA, 22 bp, Homo sapiens
cctggactagagggacctctcc

SEQ ID NO: 1894540 - DNA, 18 bp, Homo sapiens
ccttctggcctcccacag

SEQ ID NO: 1894541 - DNA, 20 bp, Homo sapiens
ccttctggcctcccacagac

SEQ ID NO: 1894542 - DNA, 22 bp, Homo sapiens
cgaaaaccaggccttatctcca

SEQ ID NO: 1894543 - DNA, 12 bp, Homo sapiens
cgcccaaggccc

SEQ ID NO: 1894544 - DNA, 22 bp, Homo sapiens
cgcccagagacccaagctgcct

SEQ ID NO: 1894545 - DNA, 12 bp, Homo sapiens
cgccctcccagg

SEQ ID NO: 1894546 - DNA, 21 bp, Homo sapiens
cgcgtcgccctcccaggctct

SEQ ID NO: 1894547 - DNA, 22 bp, Homo sapiens
cggggagggtgacagtggccgc

SEQ ID NO: 1894548 - DNA, 14 bp, Homo sapiens
cgtacttataaaga

SEQ ID NO: 1894549 - DNA, 21 bp, Homo sapiens
cgtgatcaaagccacactctg

SEQ ID NO: 1894550 - DNA, 15 bp, Homo sapiens
ctagagggacctctc

SEQ ID NO: 1894551 - DNA, 15 bp, Homo sapiens
ctcaaatctgaggga

SEQ ID NO: 1894552 - DNA, 15 bp, Homo sapiens
ctcagaccagctctt

SEQ ID NO: 1894553 - DNA, 18 bp, Homo sapiens
ctcagctcttggctccac

SEQ ID NO: 1894554 - DNA, 20 bp, Homo sapiens
ctcagggaaaagcagctctc

SEQ ID NO: 1894555 - DNA, 22 bp, Homo sapiens
ctcagggaaaagcagctctccc

SEQ ID NO: 1894556 - DNA, 23 bp, Homo sapiens
ctcagggaaaagcagctctcccc

SEQ ID NO: 1894557 - DNA, 15 bp, Homo sapiens
ctcatgttctgcttt

SEQ ID NO: 1894558 - DNA, 14 bp, Homo sapiens
ctccagaagatagc

SEQ ID NO: 1894559 - DNA, 12 bp, Homo sapiens
ctcccaggctct

SEQ ID NO: 1894560 - DNA, 14 bp, Homo sapiens
ctcttggctccact

SEQ ID NO: 1894561 - DNA, 14 bp, Homo sapiens
ctgaaaacctctcc

SEQ ID NO: 1894562 - DNA, 20 bp, Homo sapiens
ctgaaaacctctcctcatgt

SEQ ID NO: 1894563 - DNA, 19 bp, Homo sapiens
ctgaaagtgaaagtccaga

SEQ ID NO: 1894564 - DNA, 18 bp, Homo sapiens
ctgcaggccaggccagct

SEQ ID NO: 1894565 - DNA, 23 bp, Homo sapiens
ctgcctcaggaggcaggaccttc

SEQ ID NO: 1894566 - DNA, 20 bp, Homo sapiens
ctgcctcccctctccttcct

SEQ ID NO: 1894567 - DNA, 23 bp, Homo sapiens
ctgcctccgcgtgatcaaagcca

SEQ ID NO: 1894568 - DNA, 18 bp, Homo sapiens
ctgcctggactagaggga

SEQ ID NO: 1894569 - DNA, 22 bp, Homo sapiens
ctgctcagggaaaagcagctct

SEQ ID NO: 1894570 - DNA, 23 bp, Homo sapiens
ctgctcagggaaaagcagctctc

SEQ ID NO: 1894571 - DNA, 21 bp, Homo sapiens
ctggactagagggacctctcc

SEQ ID NO: 1894572 - DNA, 13 bp, Homo sapiens
ctggcctcccaca

SEQ ID NO: 1894573 - DNA, 18 bp, Homo sapiens
ctggtcaaacaaactctc

SEQ ID NO: 1894574 - DNA, 15 bp, Homo sapiens
ctgtcctccaagcca

SEQ ID NO: 1894575 - DNA, 19 bp, Homo sapiens
ctgtgtgtccaaaactgcc

SEQ ID NO: 1894576 - DNA, 13 bp, Homo sapiens
aaaaacatgtatg

SEQ ID NO: 1894577 - DNA, 16 bp, Homo sapiens
aaaaacatgtatgtgc

SEQ ID NO: 1894578 - DNA, 13 bp, Homo sapiens
aaaacatgtatgt

SEQ ID NO: 1894579 - DNA, 13 bp, Homo sapiens
aaaagctgctcag

SEQ ID NO: 1894580 - DNA, 12 bp, Homo sapiens
aaacatgtatgt

SEQ ID NO: 1894581 - DNA, 13 bp, Homo sapiens
aaacatgtatgtg

SEQ ID NO: 1894582 - DNA, 22 bp, Homo sapiens
aaacctctcctcatgttctgct

SEQ ID NO: 1894583 - DNA, 13 bp, Homo sapiens
aaactctctgaac

SEQ ID NO: 1894584 - DNA, 22 bp, Homo sapiens
aaaggagctcgaaggatattgt

SEQ ID NO: 1894585 - DNA, 13 bp, Homo sapiens
aaaggcaaggtcc

SEQ ID NO: 1894586 - DNA, 15 bp, Homo sapiens
aaagttttcccttga

SEQ ID NO: 1894587 - DNA, 11 bp, Homo sapiens
aacatgtatgt

SEQ ID NO: 1894588 - DNA, 16 bp, Homo sapiens
aacatgtatgtgcatt

SEQ ID NO: 1894589 - DNA, 21 bp, Homo sapiens
aacctctcctcatgttctgct

SEQ ID NO: 1894590 - DNA, 12 bp, Homo sapiens
aaccttctggcc

SEQ ID NO: 1894591 - DNA, 12 bp, Homo sapiens
aactctctgaac

SEQ ID NO: 1894592 - DNA, 21 bp, Homo sapiens
aagctattccctcaaatctga

SEQ ID NO: 1894593 - DNA, 22 bp, Homo sapiens
aagttttcccttgaggaaacaa

SEQ ID NO: 1894594 - DNA, 14 bp, Homo sapiens
aatgaaatgtatgt

SEQ ID NO: 1894595 - DNA, 15 bp, Homo sapiens
aatgctgaggttatg

SEQ ID NO: 1894596 - DNA, 20 bp, Homo sapiens
acactctgggctccagagtg

SEQ ID NO: 1894597 - DNA, 17 bp, Homo sapiens
acagaggctattgtccc

SEQ ID NO: 1894598 - DNA, 18 bp, Homo sapiens
acatccccccgccaaaag

SEQ ID NO: 1894599 - DNA, 16 bp, Homo sapiens
acctcaaccaatgcca

SEQ ID NO: 1894600 - DNA, 16 bp, Homo sapiens
accttcgggctgtgcc

SEQ ID NO: 1894601 - DNA, 22 bp, Homo sapiens
accttctggcctcccacagact

SEQ ID NO: 1894602 - DNA, 20 bp, Homo sapiens
actagagggacctctcccag

SEQ ID NO: 1894603 - DNA, 22 bp, Homo sapiens
actagagggacctctcccaggg

SEQ ID NO: 1894604 - DNA, 18 bp, Homo sapiens
actcaaatgctcagacca

SEQ ID NO: 1894605 - DNA, 21 bp, Homo sapiens
actcaaatgctcagaccagct

SEQ ID NO: 1894606 - DNA, 22 bp, Homo sapiens
actcagctcttggctccactgg

SEQ ID NO: 1894607 - DNA, 19 bp, Homo sapiens
actctctgaacccctccct

SEQ ID NO: 1894608 - DNA, 21 bp, Homo sapiens
actctctgaacccctccctcc

SEQ ID NO: 1894609 - DNA, 16 bp, Homo sapiens
actctgggctccagag

SEQ ID NO: 1894610 - DNA, 16 bp, Homo sapiens
actgtcctccaagcca

SEQ ID NO: 1894611 - DNA, 21 bp, Homo sapiens
agaaactgttcccacctgctg

SEQ ID NO: 1894612 - DNA, 16 bp, Homo sapiens
agaatgaaatgtatgt

SEQ ID NO: 1894613 - DNA, 16 bp, Homo sapiens
agaggacaagggaaat

SEQ ID NO: 1894614 - DNA, 20 bp, Homo sapiens
agatgcaatgactcaggaca

SEQ ID NO: 1894615 - DNA, 12 bp, Homo sapiens
agcagctctccc

SEQ ID NO: 1894616 - DNA, 19 bp, Homo sapiens
agcggacatcagctggtca

SEQ ID NO: 1894617 - DNA, 20 bp, Homo sapiens
agctgcctcccctctccttc

SEQ ID NO: 1894618 - DNA, 21 bp, Homo sapiens
agctgctcagggaaaagcagc

SEQ ID NO: 1894619 - DNA, 14 bp, Homo sapiens
aggaaacaacagct

SEQ ID NO: 1894620 - DNA, 23 bp, Homo sapiens
aggcaggaccttcgggctgtgcc

SEQ ID NO: 1894621 - DNA, 15 bp, Homo sapiens
aggccaggccagctg

SEQ ID NO: 1894622 - DNA, 19 bp, Homo sapiens
aggccttatctccaagacc

SEQ ID NO: 1894623 - DNA, 20 bp, Homo sapiens
aggctctcaacaggggagag

SEQ ID NO: 1894624 - DNA, 16 bp, Homo sapiens
agggaaaagcagctct

SEQ ID NO: 1894625 - DNA, 15 bp, Homo sapiens
agggacctctcccag

SEQ ID NO: 1894626 - DNA, 15 bp, Homo sapiens
aggtgtgttgcagtg

SEQ ID NO: 1894627 - DNA, 14 bp, Homo sapiens
agtcctctgaatga

SEQ ID NO: 1894628 - DNA, 15 bp, Homo sapiens
agtgcaagcccctgc

SEQ ID NO: 1894629 - DNA, 18 bp, Homo sapiens
agtgcaagcccctgctcc

SEQ ID NO: 1894630 - DNA, 22 bp, Homo sapiens
agttattaatttttaaggatgt

SEQ ID NO: 1894631 - DNA, 20 bp, Homo sapiens
agttttcccttgaggaaaca

SEQ ID NO: 1894632 - DNA, 21 bp, Homo sapiens
ataagctaacaccagacagac

SEQ ID NO: 1894633 - DNA, 21 bp, Homo sapiens
atagcttcaccccaatcccag

SEQ ID NO: 1894634 - DNA, 16 bp, Homo sapiens
atagtggggagacttc

SEQ ID NO: 1894635 - DNA, 20 bp, Homo sapiens
atatgttgctataataaaga

SEQ ID NO: 1894636 - DNA, 22 bp, Homo sapiens
atcagctggtcaaacaaactct

SEQ ID NO: 1894637 - DNA, 18 bp, Homo sapiens
atctccaagaccagagat

SEQ ID NO: 1894638 - DNA, 13 bp, Homo sapiens
atgaaatgtatgt

SEQ ID NO: 1894639 - DNA, 17 bp, Homo sapiens
atgaaccttctggcctc

SEQ ID NO: 1894640 - DNA, 19 bp, Homo sapiens
atgactcaggacatccccc

SEQ ID NO: 1894641 - DNA, 13 bp, Homo sapiens
atgagttgcagtt

SEQ ID NO: 1894642 - DNA, 18 bp, Homo sapiens
atgccaaaaaaagacagg

SEQ ID NO: 1894643 - DNA, 14 bp, Homo sapiens
atgtatgtgcattt

SEQ ID NO: 1894644 - DNA, 15 bp, Homo sapiens
atttcacaagctatt

SEQ ID NO: 1894645 - DNA, 19 bp, Homo sapiens
caaaggagctcgaaggata

SEQ ID NO: 1894646 - DNA, 19 bp, Homo sapiens
caaggagggtgagtgcaag

SEQ ID NO: 1894647 - DNA, 20 bp, Homo sapiens
caaggagggtgagtgcaagg

SEQ ID NO: 1894648 - DNA, 15 bp, Homo sapiens
cactctgggctccag

SEQ ID NO: 1894649 - DNA, 13 bp, Homo sapiens
cactgggaaacag

SEQ ID NO: 1894650 - DNA, 18 bp, Homo sapiens
cactgggaaacagaggct

SEQ ID NO: 1894651 - DNA, 22 bp, Homo sapiens
cacttgccgcgtcgccctccca

SEQ ID NO: 1894652 - DNA, 20 bp, Homo sapiens
cagaagatagcttcacccca

SEQ ID NO: 1894653 - DNA, 22 bp, Homo sapiens
cagactcaaatgctcagaccag

SEQ ID NO: 1894654 - DNA, 17 bp, Homo sapiens
cagctcttggctccact

SEQ ID NO: 1894655 - DNA, 18 bp, Homo sapiens
cagctcttggctccactg

SEQ ID NO: 1894656 - DNA, 22 bp, Homo sapiens
caggaccttcgggctgtgcccg

SEQ ID NO: 1894657 - DNA, 18 bp, Homo sapiens
caggaggcaggaccttcg

SEQ ID NO: 1894658 - DNA, 16 bp, Homo sapiens
caggccttatctccaa

SEQ ID NO: 1894659 - DNA, 14 bp, Homo sapiens
caggctctcaacag

SEQ ID NO: 1894660 - DNA, 20 bp, Homo sapiens
cagggaaaagcagctctccc

SEQ ID NO: 1894661 - DNA, 20 bp, Homo sapiens
cagggactgaaaacctctcc

SEQ ID NO: 1894662 - DNA, 20 bp, Homo sapiens
cattttacccacacacagat

SEQ ID NO: 1894663 - DNA, 18 bp, Homo sapiens
ccaccgaagccgcctgtg

SEQ ID NO: 1894664 - DNA, 17 bp, Homo sapiens
ccagacagacaacactg

SEQ ID NO: 1894665 - DNA, 19 bp, Homo sapiens
ccataataaaaggctttga

SEQ ID NO: 1894666 - DNA, 14 bp, Homo sapiens
cccagctacctcaa

SEQ ID NO: 1894667 - DNA, 19 bp, Homo sapiens
cccctctccttcctgtgtg

SEQ ID NO: 1894668 - DNA, 17 bp, Homo sapiens
ccctctccttcctgtgt

SEQ ID NO: 1894669 - DNA, 21 bp, Homo sapiens
cctcagagtgcaagcccctgc

SEQ ID NO: 1894670 - DNA, 20 bp, Homo sapiens
cctgcgccaccgcccagaga

SEQ ID NO: 1894671 - DNA, 15 bp, Homo sapiens
cctggactagaggga

SEQ ID NO: 1894672 - DNA, 22 bp, Homo sapiens
ccttatctccaagaccagagat

SEQ ID NO: 1894673 - DNA, 13 bp, Homo sapiens
cgaaaaccaggcc

SEQ ID NO: 1894674 - DNA, 14 bp, Homo sapiens
cgtgatcaaagcca

SEQ ID NO: 1894675 - DNA, 21 bp, Homo sapiens
cagccaccgaagccgcctgtg

SEQ ID NO: 1894676 - DNA, 16 bp, Homo sapiens
cagcgggaatggcagc

SEQ ID NO: 1894677 - DNA, 15 bp, Homo sapiens
caggccagctgcctc

SEQ ID NO: 1894678 - DNA, 15 bp, Homo sapiens
caggccccaggaaag

SEQ ID NO: 1894679 - DNA, 15 bp, Homo sapiens
cagggaaaagcagct

SEQ ID NO: 1894680 - DNA, 19 bp, Homo sapiens
cagggaaaagcagctctcc

SEQ ID NO: 1894681 - DNA, 23 bp, Homo sapiens
cagggactgaaaacctctcctca

SEQ ID NO: 1894682 - DNA, 22 bp, Homo sapiens
catcgttttcttcactgtcctc

SEQ ID NO: 1894683 - DNA, 14 bp, Homo sapiens
ccaaaagctgctca

SEQ ID NO: 1894684 - DNA, 13 bp, Homo sapiens
ccaatgccaaaaa

SEQ ID NO: 1894685 - DNA, 15 bp, Homo sapiens
ccaggccagctgcct

SEQ ID NO: 1894686 - DNA, 19 bp, Homo sapiens
cccaatcccagctacctca

SEQ ID NO: 1894687 - DNA, 16 bp, Homo sapiens
cccaggaaaggcccag

SEQ ID NO: 1894688 - DNA, 13 bp, Homo sapiens
ccccaatcccagc

SEQ ID NO: 1894689 - DNA, 14 bp, Homo sapiens
ccctctccttcctg

SEQ ID NO: 1894690 - DNA, 22 bp, Homo sapiens
ccgcgtgatcaaagccacactc

SEQ ID NO: 1894691 - DNA, 15 bp, Homo sapiens
ccggggaaaggcaag

SEQ ID NO: 1894692 - DNA, 21 bp, Homo sapiens
cctaaaccaaaaactgaaagt

SEQ ID NO: 1894693 - DNA, 20 bp, Homo sapiens
cctccgcgtgatcaaagcca

SEQ ID NO: 1894694 - DNA, 20 bp, Homo sapiens
cctctgaatgaaccttctgg

SEQ ID NO: 1894695 - DNA, 18 bp, Homo sapiens
cctgcaggccaggccagc

SEQ ID NO: 1894696 - DNA, 20 bp, Homo sapiens
cctgtgtgtccaaaactgcc

SEQ ID NO: 1894697 - DNA, 16 bp, Homo sapiens
ccttcgggctgtgccc

SEQ ID NO: 1894698 - DNA, 21 bp, Homo sapiens
ccttgaggaaacaacagcttt

SEQ ID NO: 1894699 - DNA, 19 bp, Homo sapiens
cgcctggctgcagcctgcg

SEQ ID NO: 1894700 - DNA, 12 bp, Homo sapiens
cgggctgtgccc

SEQ ID NO: 1894701 - DNA, 15 bp, Homo sapiens
cgtcgccctcccagg

SEQ ID NO: 1894702 - DNA, 18 bp, Homo sapiens
ctagagggacctctccca

SEQ ID NO: 1894703 - DNA, 19 bp, Homo sapiens
ctagagggacctctcccag

SEQ ID NO: 1894704 - DNA, 15 bp, Homo sapiens
ctataataaagaagt

SEQ ID NO: 1894705 - DNA, 16 bp, Homo sapiens
ctcaaatgctcagacc

SEQ ID NO: 1894706 - DNA, 14 bp, Homo sapiens
ctcagaccagctct

SEQ ID NO: 1894707 - DNA, 17 bp, Homo sapiens
ctcagggaaaagcagct

SEQ ID NO: 1894708 - DNA, 13 bp, Homo sapiens
ctccaagccagcg

SEQ ID NO: 1894709 - DNA, 13 bp, Homo sapiens
ctcccaggctctc

SEQ ID NO: 1894710 - DNA, 21 bp, Homo sapiens
ctctcccctcagagtgcaagc

SEQ ID NO: 1894711 - DNA, 23 bp, Homo sapiens
ctgaaagtgaaagtccagaaact

SEQ ID NO: 1894712 - DNA, 16 bp, Homo sapiens
ctgaacccctccctcc

SEQ ID NO: 1894713 - DNA, 15 bp, Homo sapiens
ctgaagagtcctctg

SEQ ID NO: 1894714 - DNA, 18 bp, Homo sapiens
ctgaagagtcctctgaat

SEQ ID NO: 1894715 - DNA, 22 bp, Homo sapiens
ctgaatgaaccttctggcctcc

SEQ ID NO: 1894716 - DNA, 23 bp, Homo sapiens
ctgcaggccaggccagctgcctc

SEQ ID NO: 1894717 - DNA, 17 bp, Homo sapiens
ctggtcaaacaaactct

SEQ ID NO: 1894718 - DNA, 17 bp, Homo sapiens
ctgtcctccaagccagc

SEQ ID NO: 1894719 - DNA, 21 bp, Homo sapiens
ctgtgtgtccaaaactgcctc

SEQ ID NO: 1894720 - DNA, 22 bp, Homo sapiens
ctgtgtgtccaaaactgcctca

SEQ ID NO: 1894721 - DNA, 13 bp, Homo sapiens
cttatctccaaga

SEQ ID NO: 1894722 - DNA, 17 bp, Homo sapiens
cttcactgtcctccaag

SEQ ID NO: 1894723 - DNA, 18 bp, Homo sapiens
cttcactgtcctccaagc

SEQ ID NO: 1894724 - DNA, 23 bp, Homo sapiens
cttcctgtgtgtccaaaactgcc

SEQ ID NO: 1894725 - DNA, 14 bp, Homo sapiens
cttcgggctgtgcc

SEQ ID NO: 1894726 - DNA, 16 bp, Homo sapiens
cttcgggctgtgcccg

SEQ ID NO: 1894727 - DNA, 20 bp, Homo sapiens
cttgaggaaacaacagcttt

SEQ ID NO: 1894728 - DNA, 18 bp, Homo sapiens
cttgccgcgtcgccctcc

SEQ ID NO: 1894729 - DNA, 14 bp, Homo sapiens
gaaaagcagctctc

SEQ ID NO: 1894730 - DNA, 20 bp, Homo sapiens
gaaactgttcccacctgctg

SEQ ID NO: 1894731 - DNA, 21 bp, Homo sapiens
gaaactgttcccacctgctgg

SEQ ID NO: 1894732 - DNA, 14 bp, Homo sapiens
gaagagtcctctga

SEQ ID NO: 1894733 - DNA, 22 bp, Homo sapiens
gaaggttggtgaatttcacaag

SEQ ID NO: 1894734 - DNA, 14 bp, Homo sapiens
gaatgaaatgtatg

SEQ ID NO: 1894735 - DNA, 15 bp, Homo sapiens
gaatgaaccttctgg

SEQ ID NO: 1894736 - DNA, 17 bp, Homo sapiens
gaatgaaccttctggcc

SEQ ID NO: 1894737 - DNA, 13 bp, Homo sapiens
gaatggcagctgc

SEQ ID NO: 1894738 - DNA, 12 bp, Homo sapiens
gacctctcccag

SEQ ID NO: 1894739 - DNA, 16 bp, Homo sapiens
gaccttcgggctgtgc

SEQ ID NO: 1894740 - DNA, 17 bp, Homo sapiens
gactagagggacctctc

SEQ ID NO: 1894741 - DNA, 19 bp, Homo sapiens
gactagagggacctctccc

SEQ ID NO: 1894742 - DNA, 20 bp, Homo sapiens
gactgaaaacctctcctcat

SEQ ID NO: 1894743 - DNA, 17 bp, Homo sapiens
gagggacctctcccagg

SEQ ID NO: 1894744 - DNA, 13 bp, Homo sapiens
gagtcctctgaat

SEQ ID NO: 1894745 - DNA, 15 bp, Homo sapiens
gcaaaaacatgtatg

SEQ ID NO: 1894746 - DNA, 22 bp, Homo sapiens
gcaaaaacatgtatgtgcattt

SEQ ID NO: 1894747 - DNA, 13 bp, Homo sapiens
gcagatgcaatga

SEQ ID NO: 1894748 - DNA, 14 bp, Homo sapiens
gccaaaaaaagaca

SEQ ID NO: 1894749 - DNA, 13 bp, Homo sapiens
gccaggccagctg

SEQ ID NO: 1894750 - DNA, 15 bp, Homo sapiens
gccccaggaaaggcc

SEQ ID NO: 1894751 - DNA, 21 bp, Homo sapiens
gccctcccaggctctcaacag

SEQ ID NO: 1894752 - DNA, 23 bp, Homo sapiens
gccttatctccaagaccagagat

SEQ ID NO: 1894753 - DNA, 16 bp, Homo sapiens
gcggacatcagctggt

SEQ ID NO: 1894754 - DNA, 19 bp, Homo sapiens
gcgtgatcaaagccacact

SEQ ID NO: 1894755 - DNA, 16 bp, Homo sapiens
gctgcagcctgcgcca

SEQ ID NO: 1894756 - DNA, 21 bp, Homo sapiens
gctgctcagggaaaagcagct

SEQ ID NO: 1894757 - DNA, 19 bp, Homo sapiens
gcttcaccccaatcccagc

SEQ ID NO: 1894758 - DNA, 20 bp, Homo sapiens
gcttcaccccaatcccagct

SEQ ID NO: 1894759 - DNA, 23 bp, Homo sapiens
gctttcaaaggagctcgaaggat

SEQ ID NO: 1894760 - DNA, 18 bp, Homo sapiens
ggaaaagcagctctcccc

SEQ ID NO: 1894761 - DNA, 17 bp, Homo sapiens
ggaccttcgggctgtgc

SEQ ID NO: 1894762 - DNA, 21 bp, Homo sapiens
ggactagagggacctctccca

SEQ ID NO: 1894763 - DNA, 16 bp, Homo sapiens
ggactgaaaacctctc

SEQ ID NO: 1894764 - DNA, 17 bp, Homo sapiens
ggactgaaaacctctcc

SEQ ID NO: 1894765 - DNA, 18 bp, Homo sapiens
ggactgaaaacctctcct

SEQ ID NO: 1894766 - DNA, 16 bp, Homo sapiens
ggatgtggtggcagtg

SEQ ID NO: 1894767 - DNA, 17 bp, Homo sapiens
ggcctcccacagactca

SEQ ID NO: 1894768 - DNA, 13 bp, Homo sapiens
gggaaaagcagct

SEQ ID NO: 1894769 - DNA, 15 bp, Homo sapiens
gggaatggcagctgc

SEQ ID NO: 1894770 - DNA, 16 bp, Homo sapiens
gggacctctcccaggg

SEQ ID NO: 1894771 - DNA, 18 bp, Homo sapiens
gggactgaaaacctctcc

SEQ ID NO: 1894772 - DNA, 19 bp, Homo sapiens
gggactgaaaacctctcct

SEQ ID NO: 1894773 - DNA, 22 bp, Homo sapiens
ggggaaaggcaaggtccggccc

SEQ ID NO: 1894774 - DNA, 22 bp, Homo sapiens
ggggtcactcaattctgcagta

SEQ ID NO: 1894775 - DNA, 14 bp, Homo sapiens
gtcctccaagccag

SEQ ID NO: 1894776 - DNA, 13 bp, Homo sapiens
gtgatcaaagcca

SEQ ID NO: 1894777 - DNA, 14 bp, Homo sapiens
tacttataaagaag

SEQ ID NO: 1894778 - DNA, 14 bp, Homo sapiens
tagcaaaaacatgt

SEQ ID NO: 1894779 - DNA, 21 bp, Homo sapiens
tagcttcaccccaatcccagc

SEQ ID NO: 1894780 - DNA, 14 bp, Homo sapiens
tcaaatgctcagac

SEQ ID NO: 1894781 - DNA, 21 bp, Homo sapiens
tcaaatgctcagaccagctct

SEQ ID NO: 1894782 - DNA, 23 bp, Homo sapiens
tcacagggactgaaaacctctcc

SEQ ID NO: 1894783 - DNA, 15 bp, Homo sapiens
tcactgtcctccaag

SEQ ID NO: 1894784 - DNA, 19 bp, Homo sapiens
tcagctcttggctccactg

SEQ ID NO: 1894785 - DNA, 23 bp, Homo sapiens
tcagggaaaagcagctctcccct

SEQ ID NO: 1894786 - DNA, 12 bp, Homo sapiens
tccaaaactgcc

SEQ ID NO: 1894787 - DNA, 16 bp, Homo sapiens
tccccaggcacctcac

SEQ ID NO: 1894788 - DNA, 15 bp, Homo sapiens
tcccctctccttcct

SEQ ID NO: 1894789 - DNA, 16 bp, Homo sapiens
tcccctctccttcctg

SEQ ID NO: 1894790 - DNA, 19 bp, Homo sapiens
tcctgcaggccaggccagc

SEQ ID NO: 1894791 - DNA, 12 bp, Homo sapiens
tcgggctgtgcc

SEQ ID NO: 1894792 - DNA, 13 bp, Homo sapiens
tcgggctgtgccc

SEQ ID NO: 1894793 - DNA, 23 bp, Homo sapiens
agaactgctttctttcgtttgtt

SEQ ID NO: 1894794 - DNA, 16 bp, Homo sapiens
agaacttgttgctgat

SEQ ID NO: 1894795 - DNA, 17 bp, Homo sapiens
agaacttgttgctgatt

SEQ ID NO: 1894796 - DNA, 19 bp, Homo sapiens
agaacttgttgctgatttt

SEQ ID NO: 1894797 - DNA, 21 bp, Homo sapiens
agaacttgttgctgattttga

SEQ ID NO: 1894798 - DNA, 14 bp, Homo sapiens
agaagacaaaggcc

SEQ ID NO: 1894799 - DNA, 11 bp, Homo sapiens
agaagagaaag

SEQ ID NO: 1894800 - DNA, 16 bp, Homo sapiens
agaagatcacagcagg

SEQ ID NO: 1894801 - DNA, 19 bp, Homo sapiens
agaagatcacagcagggcc

SEQ ID NO: 1894802 - DNA, 20 bp, Homo sapiens
agaagatcacagcagggcct

SEQ ID NO: 1894803 - DNA, 18 bp, Homo sapiens
agaagctaaggtttagat

SEQ ID NO: 1894804 - DNA, 14 bp, Homo sapiens
agaaggacttgttt

SEQ ID NO: 1894805 - DNA, 16 bp, Homo sapiens
agaaggagcaggccct

SEQ ID NO: 1894806 - DNA, 16 bp, Homo sapiens
agaaggggactgccac

SEQ ID NO: 1894807 - DNA, 16 bp, Homo sapiens
agaagtatatttttgc

SEQ ID NO: 1894808 - DNA, 16 bp, Homo sapiens
agaagtgacggttcct

SEQ ID NO: 1894809 - DNA, 17 bp, Homo sapiens
agaagtgacggttccta

SEQ ID NO: 1894810 - DNA, 15 bp, Homo sapiens
agaagtgcatcctga

SEQ ID NO: 1894811 - DNA, 21 bp, Homo sapiens
agaatactgatggaatttttt

SEQ ID NO: 1894812 - DNA, 13 bp, Homo sapiens
agaatagaaattt

SEQ ID NO: 1894813 - DNA, 17 bp, Homo sapiens
agaatagaaatttgccc

SEQ ID NO: 1894814 - DNA, 13 bp, Homo sapiens
agaataggattaa

SEQ ID NO: 1894815 - DNA, 20 bp, Homo sapiens
agaatatgcatcttaaaatg

SEQ ID NO: 1894816 - DNA, 15 bp, Homo sapiens
agaatcacaggctgg

SEQ ID NO: 1894817 - DNA, 20 bp, Homo sapiens
agaatcagatacaaaactat

SEQ ID NO: 1894818 - DNA, 21 bp, Homo sapiens
agaatccctgtgttaatttaa

SEQ ID NO: 1894819 - DNA, 12 bp, Homo sapiens
agaatgtaaagc

SEQ ID NO: 1894820 - DNA, 15 bp, Homo sapiens
agaatgtaaagcaac

SEQ ID NO: 1894821 - DNA, 21 bp, Homo sapiens
agaatgtcaataaatttgctt

SEQ ID NO: 1894822 - DNA, 17 bp, Homo sapiens
agaattaaaactttgta

SEQ ID NO: 1894823 - DNA, 23 bp, Homo sapiens
agaattaaaactttgtagacatt

SEQ ID NO: 1894824 - DNA, 14 bp, Homo sapiens
agaattctttttac

SEQ ID NO: 1894825 - DNA, 16 bp, Homo sapiens
agaattgaaggttttt

SEQ ID NO: 1894826 - DNA, 20 bp, Homo sapiens
agaattgaaggtttttgata

SEQ ID NO: 1894827 - DNA, 12 bp, Homo sapiens
agaatttaaaga

SEQ ID NO: 1894828 - DNA, 15 bp, Homo sapiens
agaatttcgaagatg

SEQ ID NO: 1894829 - DNA, 14 bp, Homo sapiens
agaattttgtgaaa

SEQ ID NO: 1894830 - DNA, 14 bp, Homo sapiens
agacaaatgaaata

SEQ ID NO: 1894831 - DNA, 15 bp, Homo sapiens
agacaaccaagtatg

SEQ ID NO: 1894832 - DNA, 15 bp, Homo sapiens
agacaagtctgtggc

SEQ ID NO: 1894833 - DNA, 16 bp, Homo sapiens
agacaccacagcctcc

SEQ ID NO: 1894834 - DNA, 18 bp, Homo sapiens
agacacccttggagctct

SEQ ID NO: 1894835 - DNA, 15 bp, Homo sapiens
agacagcatttgtgt

SEQ ID NO: 1894836 - DNA, 20 bp, Homo sapiens
agacagcatttgtgtgttac

SEQ ID NO: 1894837 - DNA, 22 bp, Homo sapiens
agacagcccgatcctcccctgg

SEQ ID NO: 1894838 - DNA, 15 bp, Homo sapiens
agacaggacccctgc

SEQ ID NO: 1894839 - DNA, 22 bp, Homo sapiens
agacagggcccgggcccaggca

SEQ ID NO: 1894840 - DNA, 22 bp, Homo sapiens
agacatcctgggcagcttgggc

SEQ ID NO: 1894841 - DNA, 21 bp, Homo sapiens
agacatgtaatttgtgtaaat

SEQ ID NO: 1894842 - DNA, 15 bp, Homo sapiens
agacatttcaaataa

SEQ ID NO: 1894843 - DNA, 22 bp, Homo sapiens
agaccaattttttgtgtgtgaa

SEQ ID NO: 1894844 - DNA, 22 bp, Homo sapiens
agaccagccccaccatgcaact

SEQ ID NO: 1894845 - DNA, 14 bp, Homo sapiens
agacccttatttaa

SEQ ID NO: 1894846 - DNA, 19 bp, Homo sapiens
agacgctcattcagcatct

SEQ ID NO: 1894847 - DNA, 20 bp, Homo sapiens
agactataaaatctggatat

SEQ ID NO: 1894848 - DNA, 17 bp, Homo sapiens
agactgctcctgagccc

SEQ ID NO: 1894849 - DNA, 14 bp, Homo sapiens
agactgcttgacaa

SEQ ID NO: 1894850 - DNA, 15 bp, Homo sapiens
agactgtcctgccct

SEQ ID NO: 1894851 - DNA, 20 bp, Homo sapiens
agacttccccaagcctggca

SEQ ID NO: 1894852 - DNA, 16 bp, Homo sapiens
agacttgtatattcta

SEQ ID NO: 1894853 - DNA, 21 bp, Homo sapiens
agacttgtatattctatttta

SEQ ID NO: 1894854 - DNA, 16 bp, Homo sapiens
agagaaaaaagcccgg

SEQ ID NO: 1894855 - DNA, 10 bp, Homo sapiens
agagaaaaga

SEQ ID NO: 1894856 - DNA, 17 bp, Homo sapiens
agagaaccatgtgctac

SEQ ID NO: 1894857 - DNA, 13 bp, Homo sapiens
agagaagagcccc

SEQ ID NO: 1894858 - DNA, 16 bp, Homo sapiens
agagaagagccccact

SEQ ID NO: 1894859 - DNA, 22 bp, Homo sapiens
agagacaggcaggtgatctgct

SEQ ID NO: 1894860 - DNA, 18 bp, Homo sapiens
agagacagggcccgggcc

SEQ ID NO: 1894861 - DNA, 11 bp, Homo sapiens
agagacctgaa

SEQ ID NO: 1894862 - DNA, 15 bp, Homo sapiens
agagactgcttgaca

SEQ ID NO: 1894863 - DNA, 16 bp, Homo sapiens
agagactgcttgacaa

SEQ ID NO: 1894864 - DNA, 14 bp, Homo sapiens
agagagaagagccc

SEQ ID NO: 1894865 - DNA, 16 bp, Homo sapiens
agagagcgaccagcag

SEQ ID NO: 1894866 - DNA, 17 bp, Homo sapiens
agagagctggagtctgg

SEQ ID NO: 1894867 - DNA, 19 bp, Homo sapiens
agagagggaagctgaggcc

SEQ ID NO: 1894868 - DNA, 22 bp, Homo sapiens
agagagggaagctgaggcccat

SEQ ID NO: 1894869 - DNA, 18 bp, Homo sapiens
agagagtagctcgtcctc

SEQ ID NO: 1894870 - DNA, 14 bp, Homo sapiens
agagatactctggg

SEQ ID NO: 1894871 - DNA, 18 bp, Homo sapiens
agagatgacaacaaattt

SEQ ID NO: 1894872 - DNA, 18 bp, Homo sapiens
agagcaacccctggaccc

SEQ ID NO: 1894873 - DNA, 21 bp, Homo sapiens
agagcaacccctggaccccag

SEQ ID NO: 1894874 - DNA, 13 bp, Homo sapiens
agagccccactct

SEQ ID NO: 1894875 - DNA, 15 bp, Homo sapiens
agagccccactctca

SEQ ID NO: 1894876 - DNA, 21 bp, Homo sapiens
agagccccactctcagaggcc

SEQ ID NO: 1894877 - DNA, 15 bp, Homo sapiens
agagcgaccagcagg

SEQ ID NO: 1894878 - DNA, 21 bp, Homo sapiens
agagcgaccagcaggctcctc

SEQ ID NO: 1894879 - DNA, 12 bp, Homo sapiens
agagctaaggcc

SEQ ID NO: 1894880 - DNA, 18 bp, Homo sapiens
agagctggagtctgggct

SEQ ID NO: 1894881 - DNA, 14 bp, Homo sapiens
agaggaaaagaaat

SEQ ID NO: 1894882 - DNA, 12 bp, Homo sapiens
agaggagccctg

SEQ ID NO: 1894883 - DNA, 14 bp, Homo sapiens
agaggagccctgcc

SEQ ID NO: 1894884 - DNA, 15 bp, Homo sapiens
agaggagccctgcct

SEQ ID NO: 1894885 - DNA, 16 bp, Homo sapiens
agaggccaaacaggcc

SEQ ID NO: 1894886 - DNA, 10 bp, Homo sapiens
agaggctcag

SEQ ID NO: 1894887 - DNA, 15 bp, Homo sapiens
agagggaagctgagg

SEQ ID NO: 1894888 - DNA, 18 bp, Homo sapiens
agagggaagctgaggccc

SEQ ID NO: 1894889 - DNA, 20 bp, Homo sapiens
agagggaagctgaggcccat

SEQ ID NO: 1894890 - DNA, 13 bp, Homo sapiens
agaggggaggcca

SEQ ID NO: 1894891 - DNA, 15 bp, Homo sapiens
agaggggaggccaag

SEQ ID NO: 1894892 - DNA, 23 bp, Homo sapiens
agagggtgccggaaagagagctg

SEQ ID NO: 1894893 - DNA, 16 bp, Homo sapiens
agaggttctaacttct

SEQ ID NO: 1894894 - DNA, 20 bp, Homo sapiens
agagtattctaaaaaaataa

SEQ ID NO: 1894895 - DNA, 12 bp, Homo sapiens
agagtctgaggg

SEQ ID NO: 1894896 - DNA, 19 bp, Homo sapiens
agagttaagaactatgacg

SEQ ID NO: 1894897 - DNA, 14 bp, Homo sapiens
agataagttttgtt

SEQ ID NO: 1894898 - DNA, 14 bp, Homo sapiens
agataattgtactt

SEQ ID NO: 1894899 - DNA, 15 bp, Homo sapiens
agataattgtacttt

SEQ ID NO: 1894900 - DNA, 13 bp, Homo sapiens
agatactttgtat

SEQ ID NO: 1894901 - DNA, 16 bp, Homo sapiens
agatactttgtattgt

SEQ ID NO: 1894902 - DNA, 23 bp, Homo sapiens
agatatatttggcttatattcta

SEQ ID NO: 1894903 - DNA, 13 bp, Homo sapiens
agatatgtatatt

SEQ ID NO: 1894904 - DNA, 18 bp, Homo sapiens
agatatgtatatttttga

SEQ ID NO: 1894905 - DNA, 22 bp, Homo sapiens
agatatgtatatttttgatctt

SEQ ID NO: 1894906 - DNA, 14 bp, Homo sapiens
agatcaaaaaggct

SEQ ID NO: 1894907 - DNA, 13 bp, Homo sapiens
agatcatagtttt

SEQ ID NO: 1894908 - DNA, 14 bp, Homo sapiens
agatcatagtttta

SEQ ID NO: 1894909 - DNA, 22 bp, Homo sapiens
agatcatagttttatttatatt

SEQ ID NO: 1894910 - DNA, 21 bp, Homo sapiens
aaaatcagcagatgttgaaga

SEQ ID NO: 1894911 - DNA, 11 bp, Homo sapiens
aaaatgaagaa

SEQ ID NO: 1894912 - DNA, 15 bp, Homo sapiens
aaaatgaagaattta

SEQ ID NO: 1894913 - DNA, 20 bp, Homo sapiens
aaaatgctgaacattgcata

SEQ ID NO: 1894914 - DNA, 12 bp, Homo sapiens
aaaatgtagctg

SEQ ID NO: 1894915 - DNA, 23 bp, Homo sapiens
aaaatgtcaaaagtagaactttg

SEQ ID NO: 1894916 - DNA, 14 bp, Homo sapiens
aaaatgttaagcat

SEQ ID NO: 1894917 - DNA, 17 bp, Homo sapiens
aaaattaaggtgtttga

SEQ ID NO: 1894918 - DNA, 20 bp, Homo sapiens
aaaattcaaaatacttttta

SEQ ID NO: 1894919 - DNA, 21 bp, Homo sapiens
aaacaagagactgcttgacaa

SEQ ID NO: 1894920 - DNA, 20 bp, Homo sapiens
aaacaagcctgagggaggag

SEQ ID NO: 1894921 - DNA, 18 bp, Homo sapiens
aaacaccagctgtatata

SEQ ID NO: 1894922 - DNA, 15 bp, Homo sapiens
aaacacctctgtatt

SEQ ID NO: 1894923 - DNA, 18 bp, Homo sapiens
aaacagagtaatcttgtt

SEQ ID NO: 1894924 - DNA, 17 bp, Homo sapiens
aaacagatttggaaaga

SEQ ID NO: 1894925 - DNA, 17 bp, Homo sapiens
aaacatcaattgatatt

SEQ ID NO: 1894926 - DNA, 16 bp, Homo sapiens
aaacatcattcctttt

SEQ ID NO: 1894927 - DNA, 18 bp, Homo sapiens
aaacatcattccttttta

SEQ ID NO: 1894928 - DNA, 19 bp, Homo sapiens
aaacatcattcctttttat

SEQ ID NO: 1894929 - DNA, 19 bp, Homo sapiens
aaacatcccaattctttag

SEQ ID NO: 1894930 - DNA, 20 bp, Homo sapiens
aaacatgttgccaaaatggt

SEQ ID NO: 1894931 - DNA, 14 bp, Homo sapiens
aaacattaaaatat

SEQ ID NO: 1894932 - DNA, 13 bp, Homo sapiens
aaacatttaaaga

SEQ ID NO: 1894933 - DNA, 21 bp, Homo sapiens
aaaccaggctttctagaaaga

SEQ ID NO: 1894934 - DNA, 18 bp, Homo sapiens
aaacccctgtaggcctca

SEQ ID NO: 1894935 - DNA, 18 bp, Homo sapiens
aaactatttaaagaaata

SEQ ID NO: 1894936 - DNA, 13 bp, Homo sapiens
aaactcatctgga

SEQ ID NO: 1894937 - DNA, 17 bp, Homo sapiens
aaactctatggtcttat

SEQ ID NO: 1894938 - DNA, 22 bp, Homo sapiens
aaactctgttacactttttgga

SEQ ID NO: 1894939 - DNA, 17 bp, Homo sapiens
aaactggaataagcctt

SEQ ID NO: 1894940 - DNA, 13 bp, Homo sapiens
aaacttaaatgaa

SEQ ID NO: 1894941 - DNA, 23 bp, Homo sapiens
aaactttgtagacattttgaaat

SEQ ID NO: 1894942 - DNA, 19 bp, Homo sapiens
aaagaaaaaaatgtcaaaa

SEQ ID NO: 1894943 - DNA, 14 bp, Homo sapiens
aaagaaattagcct

SEQ ID NO: 1894944 - DNA, 18 bp, Homo sapiens
aaagaaattgtccttgaa

SEQ ID NO: 1894945 - DNA, 20 bp, Homo sapiens
aaagaacgctgatttaaaga

SEQ ID NO: 1894946 - DNA, 13 bp, Homo sapiens
aaagaatttgtca

SEQ ID NO: 1894947 - DNA, 16 bp, Homo sapiens
aaagaatttttggtgt

SEQ ID NO: 1894948 - DNA, 21 bp, Homo sapiens
aaagacctagattattgaatt

SEQ ID NO: 1894949 - DNA, 22 bp, Homo sapiens
aaagacctggggctgctgtgaa

SEQ ID NO: 1894950 - DNA, 11 bp, Homo sapiens
aaagactggca

SEQ ID NO: 1894951 - DNA, 13 bp, Homo sapiens
aaagagaaaagaa

SEQ ID NO: 1894952 - DNA, 21 bp, Homo sapiens
aaagaggccaaacaggccctc

SEQ ID NO: 1894953 - DNA, 15 bp, Homo sapiens
aaagatatgtatatt

SEQ ID NO: 1894954 - DNA, 19 bp, Homo sapiens
aaagcaccaaaataagaaa

SEQ ID NO: 1894955 - DNA, 20 bp, Homo sapiens
aaagcaccaaaataagaaaa

SEQ ID NO: 1894956 - DNA, 21 bp, Homo sapiens
aaagcaccaaaataagaaaag

SEQ ID NO: 1894957 - DNA, 16 bp, Homo sapiens
aaagccccattaactg

SEQ ID NO: 1894958 - DNA, 17 bp, Homo sapiens
aaagcctttgaaaatac

SEQ ID NO: 1894959 - DNA, 13 bp, Homo sapiens
aaagctacagaac

SEQ ID NO: 1894960 - DNA, 22 bp, Homo sapiens
aaagctctgaattcaggtccca

SEQ ID NO: 1894961 - DNA, 13 bp, Homo sapiens
aaagctgcatatg

SEQ ID NO: 1894962 - DNA, 23 bp, Homo sapiens
aaaggaaggtagttcaagaaatg

SEQ ID NO: 1894963 - DNA, 18 bp, Homo sapiens
aaaggacatggcgtattt

SEQ ID NO: 1894964 - DNA, 16 bp, Homo sapiens
aaaggacccaagtact

SEQ ID NO: 1894965 - DNA, 20 bp, Homo sapiens
aaaggccagcagccttccag

SEQ ID NO: 1894966 - DNA, 21 bp, Homo sapiens
aaaggccagcagccttccagt

SEQ ID NO: 1894967 - DNA, 12 bp, Homo sapiens
aaaggcccagag

SEQ ID NO: 1894968 - DNA, 13 bp, Homo sapiens
aaaggtgtgctgt

SEQ ID NO: 1894969 - DNA, 18 bp, Homo sapiens
aaagtagaactttgtata

SEQ ID NO: 1894970 - DNA, 23 bp, Homo sapiens
aaagtagaactttgtatagttat

SEQ ID NO: 1894971 - DNA, 16 bp, Homo sapiens
aaagtatgttttactt

SEQ ID NO: 1894972 - DNA, 18 bp, Homo sapiens
aaagtatttttataatga

SEQ ID NO: 1894973 - DNA, 22 bp, Homo sapiens
aaagtccaagccgtaggaccca

SEQ ID NO: 1894974 - DNA, 21 bp, Homo sapiens
aaagtgcaaacagaagtgcat

SEQ ID NO: 1894975 - DNA, 14 bp, Homo sapiens
aaagtgcctttgca

SEQ ID NO: 1894976 - DNA, 21 bp, Homo sapiens
aaagtgggccctcatacacaa

SEQ ID NO: 1894977 - DNA, 18 bp, Homo sapiens
aaagtgggtactttctga

SEQ ID NO: 1894978 - DNA, 21 bp, Homo sapiens
aaagtgggtactttctgaaaa

SEQ ID NO: 1894979 - DNA, 14 bp, Homo sapiens
aaagtgtggaaagc

SEQ ID NO: 1894980 - DNA, 22 bp, Homo sapiens
aatgctggagaaaaatatctgt

SEQ ID NO: 1894981 - DNA, 18 bp, Homo sapiens
aatgctttagcatactag

SEQ ID NO: 1894982 - DNA, 10 bp, Homo sapiens
aatggaagag

SEQ ID NO: 1894983 - DNA, 19 bp, Homo sapiens
aatggaagagaagagaaag

SEQ ID NO: 1894984 - DNA, 22 bp, Homo sapiens
aatggaagagaagagaaaggac

SEQ ID NO: 1894985 - DNA, 22 bp, Homo sapiens
aatggagaattaaaactttgta

SEQ ID NO: 1894986 - DNA, 14 bp, Homo sapiens
aatggcaagttttc

SEQ ID NO: 1894987 - DNA, 18 bp, Homo sapiens
aatggctgacctgacctg

SEQ ID NO: 1894988 - DNA, 14 bp, Homo sapiens
aatggcttctctgt

SEQ ID NO: 1894989 - DNA, 22 bp, Homo sapiens
aatgggacattagcattgagtt

SEQ ID NO: 1894990 - DNA, 18 bp, Homo sapiens
aatggtagtttctgtggt

SEQ ID NO: 1894991 - DNA, 20 bp, Homo sapiens
aatggtagtttctgtggttg

SEQ ID NO: 1894992 - DNA, 22 bp, Homo sapiens
aatggttaagggacttgtccca

SEQ ID NO: 1894993 - DNA, 13 bp, Homo sapiens
aatgtatacttga

SEQ ID NO: 1894994 - DNA, 19 bp, Homo sapiens
aatgtcaaaagtagaactt

SEQ ID NO: 1894995 - DNA, 23 bp, Homo sapiens
aatgtcaaaagtagaactttgta

SEQ ID NO: 1894996 - DNA, 13 bp, Homo sapiens
aatgtcaataaat

SEQ ID NO: 1894997 - DNA, 22 bp, Homo sapiens
aatgtccagtaagatcactgtt

SEQ ID NO: 1894998 - DNA, 16 bp, Homo sapiens
aatgtctagattttga

SEQ ID NO: 1894999 - DNA, 17 bp, Homo sapiens
aatgtctagattttgaa

SEQ ID NO: 1895000 - DNA, 21 bp, Homo sapiens
aatgtctcaagtgcaatgccc

SEQ ID NO: 1895001 - DNA, 16 bp, Homo sapiens
aatgtgtgcccagctt

SEQ ID NO: 1895002 - DNA, 22 bp, Homo sapiens
aatgttaagcatctaaggacaa

SEQ ID NO: 1895003 - DNA, 13 bp, Homo sapiens
aatgttataaagt

SEQ ID NO: 1895004 - DNA, 21 bp, Homo sapiens
aatgttataacttatgaagta

SEQ ID NO: 1895005 - DNA, 15 bp, Homo sapiens
aattaaaaaatcaaa

SEQ ID NO: 1895006 - DNA, 17 bp, Homo sapiens
aattaaggtgtttgaaa

SEQ ID NO: 1895007 - DNA, 20 bp, Homo sapiens
aattaaggtgtttgaaaata

SEQ ID NO: 1895008 - DNA, 22 bp, Homo sapiens
aattaattgtgtgaacttggaa

SEQ ID NO: 1895009 - DNA, 18 bp, Homo sapiens
aattacaccacaagtatc

SEQ ID NO: 1895010 - DNA, 17 bp, Homo sapiens
aattatggtaaaatttt

SEQ ID NO: 1895011 - DNA, 18 bp, Homo sapiens
aattcaccacagacttta

SEQ ID NO: 1895012 - DNA, 14 bp, Homo sapiens
aattccagaatgaa

SEQ ID NO: 1895013 - DNA, 18 bp, Homo sapiens
aattccatagctcaataa

SEQ ID NO: 1895014 - DNA, 18 bp, Homo sapiens
aattctaaggagttttgt

SEQ ID NO: 1895015 - DNA, 13 bp, Homo sapiens
aattctatgcctg

SEQ ID NO: 1895016 - DNA, 15 bp, Homo sapiens
aattctatgcctgtc

SEQ ID NO: 1895017 - DNA, 14 bp, Homo sapiens
aattctgatttctt

SEQ ID NO: 1895018 - DNA, 22 bp, Homo sapiens
aattctgatttcttttcaccat

SEQ ID NO: 1895019 - DNA, 20 bp, Homo sapiens
aattctgggttcatttgtga

SEQ ID NO: 1895020 - DNA, 22 bp, Homo sapiens
aattcttagcatacattcagac

SEQ ID NO: 1895021 - DNA, 13 bp, Homo sapiens
aattcttttttat

SEQ ID NO: 1895022 - DNA, 18 bp, Homo sapiens
aattgagaatagaaattt

SEQ ID NO: 1895023 - DNA, 23 bp, Homo sapiens
aattgatgatgttgtaaaatgaa

SEQ ID NO: 1895024 - DNA, 18 bp, Homo sapiens
aattggaatgcactcaga

SEQ ID NO: 1895025 - DNA, 20 bp, Homo sapiens
acatttcaaataactgcaga

SEQ ID NO: 1895026 - DNA, 19 bp, Homo sapiens
acatttccgccacatccct

SEQ ID NO: 1895027 - DNA, 13 bp, Homo sapiens
acattttcagaca

SEQ ID NO: 1895028 - DNA, 14 bp, Homo sapiens
accaaaaagaaaaa

SEQ ID NO: 1895029 - DNA, 14 bp, Homo sapiens
accaaaagcaacat

SEQ ID NO: 1895030 - DNA, 15 bp, Homo sapiens
accaaaataagaaaa

SEQ ID NO: 1895031 - DNA, 20 bp, Homo sapiens
accaaacccaccctttctac

SEQ ID NO: 1895032 - DNA, 13 bp, Homo sapiens
accaactgggcct

SEQ ID NO: 1895033 - DNA, 22 bp, Homo sapiens
accaactgggcctctgatgttc

SEQ ID NO: 1895034 - DNA, 15 bp, Homo sapiens
accaatcaataatag

SEQ ID NO: 1895035 - DNA, 18 bp, Homo sapiens
accaatcttactttgtaa

SEQ ID NO: 1895036 - DNA, 20 bp, Homo sapiens
accaatcttactttgtaaat

SEQ ID NO: 1895037 - DNA, 13 bp, Homo sapiens
accacagaggctg

SEQ ID NO: 1895038 - DNA, 12 bp, Homo sapiens
accacagcctcc

SEQ ID NO: 1895039 - DNA, 16 bp, Homo sapiens
accacagcctcccctt

SEQ ID NO: 1895040 - DNA, 23 bp, Homo sapiens
accacagcctccccttcccagac

SEQ ID NO: 1895041 - DNA, 18 bp, Homo sapiens
accacatacgtaaaaatc

SEQ ID NO: 1895042 - DNA, 23 bp, Homo sapiens
accacgtctatttcatcagaaca

SEQ ID NO: 1895043 - DNA, 22 bp, Homo sapiens
accacttaaaaaaaaatctaaa

SEQ ID NO: 1895044 - DNA, 15 bp, Homo sapiens
accacttttctatat

SEQ ID NO: 1895045 - DNA, 17 bp, Homo sapiens
accagcaggctcctcag

SEQ ID NO: 1895046 - DNA, 20 bp, Homo sapiens
accagcaggctcctcagccc

SEQ ID NO: 1895047 - DNA, 17 bp, Homo sapiens
accagcccacgctgact

SEQ ID NO: 1895048 - DNA, 21 bp, Homo sapiens
accagcccacgctgactacag

SEQ ID NO: 1895049 - DNA, 22 bp, Homo sapiens
accagcccacgctgactacagg

SEQ ID NO: 1895050 - DNA, 20 bp, Homo sapiens
accagcgcccccactcctcc

SEQ ID NO: 1895051 - DNA, 21 bp, Homo sapiens
accagcgcccccactcctcct

SEQ ID NO: 1895052 - DNA, 19 bp, Homo sapiens
accagcttggctcaggctg

SEQ ID NO: 1895053 - DNA, 20 bp, Homo sapiens
accagcttggctcaggctga

SEQ ID NO: 1895054 - DNA, 12 bp, Homo sapiens
accagtgcctta

SEQ ID NO: 1895055 - DNA, 18 bp, Homo sapiens
accagttgttttgtcttg

SEQ ID NO: 1895056 - DNA, 16 bp, Homo sapiens
accagttttgatattt

SEQ ID NO: 1895057 - DNA, 17 bp, Homo sapiens
accataacagtgccagc

SEQ ID NO: 1895058 - DNA, 19 bp, Homo sapiens
accatagtgttcattgata

SEQ ID NO: 1895059 - DNA, 12 bp, Homo sapiens
accatcccctcc

SEQ ID NO: 1895060 - DNA, 22 bp, Homo sapiens
accattgagaccgtgaagatac

SEQ ID NO: 1895061 - DNA, 17 bp, Homo sapiens
acccaagtactttccaa

SEQ ID NO: 1895062 - DNA, 23 bp, Homo sapiens
acccactgtgaaagttggaatat

SEQ ID NO: 1895063 - DNA, 19 bp, Homo sapiens
acccagaaacaacacaatc

SEQ ID NO: 1895064 - DNA, 23 bp, Homo sapiens
acccagacctgcctgtctcccac

SEQ ID NO: 1895065 - DNA, 23 bp, Homo sapiens
acccaggtccccaattgagaatg

SEQ ID NO: 1895066 - DNA, 15 bp, Homo sapiens
acccagtggcagggc

SEQ ID NO: 1895067 - DNA, 19 bp, Homo sapiens
acccagtggcagggcacag

SEQ ID NO: 1895068 - DNA, 22 bp, Homo sapiens
acccagtggcagggcacagggc

SEQ ID NO: 1895069 - DNA, 14 bp, Homo sapiens
acccatgggcagga

SEQ ID NO: 1895070 - DNA, 23 bp, Homo sapiens
accccaaacaaatggaagagaag

SEQ ID NO: 1895071 - DNA, 16 bp, Homo sapiens
accccaagcgccctgg

SEQ ID NO: 1895072 - DNA, 16 bp, Homo sapiens
accccatctgtgaata

SEQ ID NO: 1895073 - DNA, 18 bp, Homo sapiens
acccctcactttccctga

SEQ ID NO: 1895074 - DNA, 21 bp, Homo sapiens
acccctgtaaggggccagagc

SEQ ID NO: 1895075 - DNA, 15 bp, Homo sapiens
acccctgtaggcctc

SEQ ID NO: 1895076 - DNA, 11 bp, Homo sapiens
accctaataag

SEQ ID NO: 1895077 - DNA, 11 bp, Homo sapiens
accctccaagg

SEQ ID NO: 1895078 - DNA, 14 bp, Homo sapiens
accctccaaggcca

SEQ ID NO: 1895079 - DNA, 20 bp, Homo sapiens
accctgatcacctcagggca

SEQ ID NO: 1895080 - DNA, 22 bp, Homo sapiens
accctgccaggcacaggcaggg

SEQ ID NO: 1895081 - DNA, 15 bp, Homo sapiens
accctgtcccaggca

SEQ ID NO: 1895082 - DNA, 21 bp, Homo sapiens
accctgtcccaggcagcgcca

SEQ ID NO: 1895083 - DNA, 18 bp, Homo sapiens
acccttggagctctgagt

SEQ ID NO: 1895084 - DNA, 18 bp, Homo sapiens
accctttctacttccaag

SEQ ID NO: 1895085 - DNA, 19 bp, Homo sapiens
accctttctacttccaaga

SEQ ID NO: 1895086 - DNA, 15 bp, Homo sapiens
accctttctggcacg

SEQ ID NO: 1895087 - DNA, 15 bp, Homo sapiens
acccttttccatttt

SEQ ID NO: 1895088 - DNA, 20 bp, Homo sapiens
accgaggacagcctgcctct

SEQ ID NO: 1895089 - DNA, 15 bp, Homo sapiens
accgtcccctcccag

SEQ ID NO: 1895090 - DNA, 18 bp, Homo sapiens
accgtgaagatactttgt

SEQ ID NO: 1895091 - DNA, 16 bp, Homo sapiens
acctaagtacttaaaa

SEQ ID NO: 1895092 - DNA, 19 bp, Homo sapiens
acctatagtagtctgtgtt

SEQ ID NO: 1895093 - DNA, 15 bp, Homo sapiens
acctcacacacctct

SEQ ID NO: 1895094 - DNA, 17 bp, Homo sapiens
acctccccttgccagct

SEQ ID NO: 1895095 - DNA, 22 bp, Homo sapiens
acctcctaaaaggcccagagag

SEQ ID NO: 1895096 - DNA, 16 bp, Homo sapiens
acctctgtgcagggca

SEQ ID NO: 1895097 - DNA, 20 bp, Homo sapiens
acctgaaagttccttctgta

SEQ ID NO: 1895098 - DNA, 23 bp, Homo sapiens
acctgaaggggttttcttgataa

SEQ ID NO: 1895099 - DNA, 13 bp, Homo sapiens
acctgcaaaaaat

SEQ ID NO: 1895100 - DNA, 14 bp, Homo sapiens
acctggaaaaacat

SEQ ID NO: 1895101 - DNA, 18 bp, Homo sapiens
acctggccctctctgaag

SEQ ID NO: 1895102 - DNA, 21 bp, Homo sapiens
acctgtttcataagctttgta

SEQ ID NO: 1895103 - DNA, 23 bp, Homo sapiens
accttaagagttctaaccatgcc

SEQ ID NO: 1895104 - DNA, 14 bp, Homo sapiens
accttactctgagc

SEQ ID NO: 1895105 - DNA, 14 bp, Homo sapiens
accttcaagctgct

SEQ ID NO: 1895106 - DNA, 14 bp, Homo sapiens
accttcttgggact

SEQ ID NO: 1895107 - DNA, 20 bp, Homo sapiens
accttggcttggccctggca

SEQ ID NO: 1895108 - DNA, 21 bp, Homo sapiens
accttggcttggccctggcag

SEQ ID NO: 1895109 - DNA, 10 bp, Homo sapiens
accttgtatt

SEQ ID NO: 1895110 - DNA, 21 bp, Homo sapiens
accttgtattgaagttaactg

SEQ ID NO: 1895111 - DNA, 14 bp, Homo sapiens
acgaaatggctgaa

SEQ ID NO: 1895112 - DNA, 22 bp, Homo sapiens
acgacagtactttcaatgaaca

SEQ ID NO: 1895113 - DNA, 15 bp, Homo sapiens
acgatcacaaatgac

SEQ ID NO: 1895114 - DNA, 16 bp, Homo sapiens
acgatcacaaatgact

SEQ ID NO: 1895115 - DNA, 15 bp, Homo sapiens
acgcctctccccacc

SEQ ID NO: 1895116 - DNA, 17 bp, Homo sapiens
acgcctctccccacctt

SEQ ID NO: 1895117 - DNA, 18 bp, Homo sapiens
acgcctctccccaccttc

SEQ ID NO: 1895118 - DNA, 13 bp, Homo sapiens
acgcctgtaaatg

SEQ ID NO: 1895119 - DNA, 17 bp, Homo sapiens
acgctgactacagggcc

SEQ ID NO: 1895120 - DNA, 16 bp, Homo sapiens
acgtacaagtagttct

SEQ ID NO: 1895121 - DNA, 18 bp, Homo sapiens
acgtacaagtagttctgt

SEQ ID NO: 1895122 - DNA, 15 bp, Homo sapiens
acgtcagatgtttaa

SEQ ID NO: 1895123 - DNA, 18 bp, Homo sapiens
acgtcagatgtttaaaac

SEQ ID NO: 1895124 - DNA, 14 bp, Homo sapiens
acgtcattgtgtaa

SEQ ID NO: 1895125 - DNA, 19 bp, Homo sapiens
acgtgcacaaattcatgtg

SEQ ID NO: 1895126 - DNA, 19 bp, Homo sapiens
acgtggagaatcacaggct

SEQ ID NO: 1895127 - DNA, 20 bp, Homo sapiens
acgtgtggcttggtcacttc

SEQ ID NO: 1895128 - DNA, 21 bp, Homo sapiens
acgttgtgatgaagctgaggc

SEQ ID NO: 1895129 - DNA, 21 bp, Homo sapiens
acgtttattaggaaaagatat

SEQ ID NO: 1895130 - DNA, 17 bp, Homo sapiens
acgttttctactttgaa

SEQ ID NO: 1895131 - DNA, 16 bp, Homo sapiens
actaaaataattttgt

SEQ ID NO: 1895132 - DNA, 17 bp, Homo sapiens
actaaaccacttaaaat

SEQ ID NO: 1895133 - DNA, 17 bp, Homo sapiens
actaaatgtacagatat

SEQ ID NO: 1895134 - DNA, 13 bp, Homo sapiens
actagattacatt

SEQ ID NO: 1895135 - DNA, 16 bp, Homo sapiens
actatttttattttta

SEQ ID NO: 1895136 - DNA, 21 bp, Homo sapiens
actatttttatttttaaatta

SEQ ID NO: 1895137 - DNA, 13 bp, Homo sapiens
actcacagccagc

SEQ ID NO: 1895138 - DNA, 18 bp, Homo sapiens
actcacagccagcgaact

SEQ ID NO: 1895139 - DNA, 17 bp, Homo sapiens
actcatgcatgcaaatt

SEQ ID NO: 1895140 - DNA, 16 bp, Homo sapiens
actcccatggctctgg

SEQ ID NO: 1895141 - DNA, 14 bp, Homo sapiens
actctaaagtctgt

SEQ ID NO: 1895142 - DNA, 17 bp, Homo sapiens
actctaggactctgcac

SEQ ID NO: 1895143 - DNA, 11 bp, Homo sapiens
actctcttcct

SEQ ID NO: 1895144 - DNA, 15 bp, Homo sapiens
actctcttcctttca

SEQ ID NO: 1895145 - DNA, 16 bp, Homo sapiens
actctcttcctttcat

SEQ ID NO: 1895146 - DNA, 13 bp, Homo sapiens
actctgcagactg

SEQ ID NO: 1895147 - DNA, 12 bp, Homo sapiens
actcttgacagc

SEQ ID NO: 1895148 - DNA, 15 bp, Homo sapiens
actcttgagttgttt

SEQ ID NO: 1895149 - DNA, 21 bp, Homo sapiens
actcttttccaaacacaggca

SEQ ID NO: 1895150 - DNA, 16 bp, Homo sapiens
actgaaagaaaaagta

SEQ ID NO: 1895151 - DNA, 20 bp, Homo sapiens
actgaaatgtggatgtgatt

SEQ ID NO: 1895152 - DNA, 16 bp, Homo sapiens
actgaaccacttgtag

SEQ ID NO: 1895153 - DNA, 19 bp, Homo sapiens
actgaaccacttgtagatt

SEQ ID NO: 1895154 - DNA, 15 bp, Homo sapiens
actgaatttttatgt

SEQ ID NO: 1895155 - DNA, 16 bp, Homo sapiens
actgaatttttatgtg

SEQ ID NO: 1895156 - DNA, 17 bp, Homo sapiens
actgactgcttataaac

SEQ ID NO: 1895157 - DNA, 19 bp, Homo sapiens
tggcccagggggcttcctg

SEQ ID NO: 1895158 - DNA, 21 bp, Homo sapiens
tggcccagggggcttcctgag

SEQ ID NO: 1895159 - DNA, 12 bp, Homo sapiens
tggccccacctg

SEQ ID NO: 1895160 - DNA, 17 bp, Homo sapiens
tggcccccacatggtga

SEQ ID NO: 1895161 - DNA, 20 bp, Homo sapiens
tggccccttctatgcccagc

SEQ ID NO: 1895162 - DNA, 24 bp, Homo sapiens
tggccctctctgaaggaggccacc

SEQ ID NO: 1895163 - DNA, 17 bp, Homo sapiens
tggccggggtccaggca

SEQ ID NO: 1895164 - DNA, 16 bp, Homo sapiens
tggccttaactgttca

SEQ ID NO: 1895165 - DNA, 18 bp, Homo sapiens
tggctccctcactctcag

SEQ ID NO: 1895166 - DNA, 12 bp, Homo sapiens
tggctctacaca

SEQ ID NO: 1895167 - DNA, 14 bp, Homo sapiens
tggctctacacata

SEQ ID NO: 1895168 - DNA, 15 bp, Homo sapiens
tggctcttagaaact

SEQ ID NO: 1895169 - DNA, 17 bp, Homo sapiens
tggctcttagaaactca

SEQ ID NO: 1895170 - DNA, 20 bp, Homo sapiens
tggctgaagtgcatgggtca

SEQ ID NO: 1895171 - DNA, 15 bp, Homo sapiens
tggcttacatttgaa

SEQ ID NO: 1895172 - DNA, 17 bp, Homo sapiens
tggcttacatttgaata

SEQ ID NO: 1895173 - DNA, 15 bp, Homo sapiens
tggcttcctctgctg

SEQ ID NO: 1895174 - DNA, 13 bp, Homo sapiens
tggcttctcccaa

SEQ ID NO: 1895175 - DNA, 13 bp, Homo sapiens
tggcttctctgtt

SEQ ID NO: 1895176 - DNA, 20 bp, Homo sapiens
tgggaatataatattgtctc

SEQ ID NO: 1895177 - DNA, 22 bp, Homo sapiens
tgggacaactgtagaggcagtt

SEQ ID NO: 1895178 - DNA, 19 bp, Homo sapiens
tgggacatcctgtcatctg

SEQ ID NO: 1895179 - DNA, 17 bp, Homo sapiens
tgggacccagtggcagg

SEQ ID NO: 1895180 - DNA, 20 bp, Homo sapiens
tgggacccagtggcagggca

SEQ ID NO: 1895181 - DNA, 20 bp, Homo sapiens
tgggactatgcttttctcaa

SEQ ID NO: 1895182 - DNA, 23 bp, Homo sapiens
tgggactgctgtgaacatgcctc

SEQ ID NO: 1895183 - DNA, 23 bp, Homo sapiens
tgggagcagcgcggatttctctt

SEQ ID NO: 1895184 - DNA, 21 bp, Homo sapiens
tgggatgagggagacagacca

SEQ ID NO: 1895185 - DNA, 22 bp, Homo sapiens
tgggatgagggagacagaccac

SEQ ID NO: 1895186 - DNA, 14 bp, Homo sapiens
tgggatgattgaag

SEQ ID NO: 1895187 - DNA, 16 bp, Homo sapiens
tgggatgattgaagaa

SEQ ID NO: 1895188 - DNA, 17 bp, Homo sapiens
tgggcagcttgggctgg

SEQ ID NO: 1895189 - DNA, 18 bp, Homo sapiens
tgggcagcttgggctggc

SEQ ID NO: 1895190 - DNA, 13 bp, Homo sapiens
tgggcctccacct

SEQ ID NO: 1895191 - DNA, 14 bp, Homo sapiens
tgggcctccacctc

SEQ ID NO: 1895192 - DNA, 19 bp, Homo sapiens
tgggcctccacctctgtgc

SEQ ID NO: 1895193 - DNA, 20 bp, Homo sapiens
tgggcctccacctctgtgca

SEQ ID NO: 1895194 - DNA, 10 bp, Homo sapiens
tgggcctccc

SEQ ID NO: 1895195 - DNA, 12 bp, Homo sapiens
tgggcctcccac

SEQ ID NO: 1895196 - DNA, 13 bp, Homo sapiens
tgggcctcccact

SEQ ID NO: 1895197 - DNA, 21 bp, Homo sapiens
tgggcctcccactcccatggc

SEQ ID NO: 1895198 - DNA, 23 bp, Homo sapiens
tgggcggtccagaaggagcaggc

SEQ ID NO: 1895199 - DNA, 14 bp, Homo sapiens
tgggctagagggtg

SEQ ID NO: 1895200 - DNA, 23 bp, Homo sapiens
tggggaagacttatgccatcccg

SEQ ID NO: 1895201 - DNA, 15 bp, Homo sapiens
tggggaccacagagg

SEQ ID NO: 1895202 - DNA, 16 bp, Homo sapiens
tggggaccacagaggc

SEQ ID NO: 1895203 - DNA, 18 bp, Homo sapiens
tggggaccacagaggctg

SEQ ID NO: 1895204 - DNA, 23 bp, Homo sapiens
tggggctcccgcctccaacccct

SEQ ID NO: 1895205 - DNA, 20 bp, Homo sapiens
tgggggaggggagactttga

SEQ ID NO: 1895206 - DNA, 17 bp, Homo sapiens
tgggggatgggcctgag

SEQ ID NO: 1895207 - DNA, 22 bp, Homo sapiens
tgggggccccgtctcaggtctg

SEQ ID NO: 1895208 - DNA, 23 bp, Homo sapiens
tgggggccccgtctcaggtctga

SEQ ID NO: 1895209 - DNA, 22 bp, Homo sapiens
tgggtactgtctcggcagaggt

SEQ ID NO: 1895210 - DNA, 20 bp, Homo sapiens
tgggtactttctgaaaattt

SEQ ID NO: 1895211 - DNA, 18 bp, Homo sapiens
tgggtcagggtgtgaggc

SEQ ID NO: 1895212 - DNA, 15 bp, Homo sapiens
tgggttagactgcca

SEQ ID NO: 1895213 - DNA, 18 bp, Homo sapiens
tgggtttccaacaattca

SEQ ID NO: 1895214 - DNA, 15 bp, Homo sapiens
tggtaaaatgaagaa

SEQ ID NO: 1895215 - DNA, 18 bp, Homo sapiens
tggtaaaatgaagaattt

SEQ ID NO: 1895216 - DNA, 17 bp, Homo sapiens
tggtagtcggagccccc

SEQ ID NO: 1895217 - DNA, 17 bp, Homo sapiens
tggtagtttctgtggtt

SEQ ID NO: 1895218 - DNA, 14 bp, Homo sapiens
tggtatttgtttaa

SEQ ID NO: 1895219 - DNA, 22 bp, Homo sapiens
tggtctaatcctagtttgctgt

SEQ ID NO: 1895220 - DNA, 16 bp, Homo sapiens
tggtctccctggcctc

SEQ ID NO: 1895221 - DNA, 20 bp, Homo sapiens
tggtcttccttacctggaaa

SEQ ID NO: 1895222 - DNA, 18 bp, Homo sapiens
tggtgacctcacacacct

SEQ ID NO: 1895223 - DNA, 22 bp, Homo sapiens
tggtgacctcacacacctctgc

SEQ ID NO: 1895224 - DNA, 17 bp, Homo sapiens
tggtgagtctgtgtggc

SEQ ID NO: 1895225 - DNA, 23 bp, Homo sapiens
tggtgcacgctggggaagaattt

SEQ ID NO: 1895226 - DNA, 20 bp, Homo sapiens
tggttaagggacttgtccca

SEQ ID NO: 1895227 - DNA, 21 bp, Homo sapiens
tggttaagggacttgtcccaa

SEQ ID NO: 1895228 - DNA, 17 bp, Homo sapiens
tggttcaggtacacata

SEQ ID NO: 1895229 - DNA, 14 bp, Homo sapiens
tggttcctggggca

SEQ ID NO: 1895230 - DNA, 20 bp, Homo sapiens
tggttgtgtgtccccttgca

SEQ ID NO: 1895231 - DNA, 15 bp, Homo sapiens
tggttttatgatgac

SEQ ID NO: 1895232 - DNA, 17 bp, Homo sapiens
tgtaaaagcattttgta

SEQ ID NO: 1895233 - DNA, 22 bp, Homo sapiens
tgtaaaggacctcctaaataaa

SEQ ID NO: 1895234 - DNA, 23 bp, Homo sapiens
tgtaaataattcttttttattaa

SEQ ID NO: 1895235 - DNA, 16 bp, Homo sapiens
tgtaaatgactttcat

SEQ ID NO: 1895236 - DNA, 20 bp, Homo sapiens
tgtaaatgactttcataata

SEQ ID NO: 1895237 - DNA, 21 bp, Homo sapiens
tgtaaatgtattcattcttaa

SEQ ID NO: 1895238 - DNA, 17 bp, Homo sapiens
tgtaaattgtattctca

SEQ ID NO: 1895239 - DNA, 19 bp, Homo sapiens
tgtaaattgtattctcata

SEQ ID NO: 1895240 - DNA, 20 bp, Homo sapiens
tgtaaattgtattctcataa

SEQ ID NO: 1895241 - DNA, 12 bp, Homo sapiens
tgtaacaaagtt

SEQ ID NO: 1895242 - DNA, 13 bp, Homo sapiens
tgtaacaagaaaa

SEQ ID NO: 1895243 - DNA, 15 bp, Homo sapiens
tgtaagaaatacaga

SEQ ID NO: 1895244 - DNA, 17 bp, Homo sapiens
tgtaagaaatacagact

SEQ ID NO: 1895245 - DNA, 15 bp, Homo sapiens
tgtaagagtgtttat

SEQ ID NO: 1895246 - DNA, 17 bp, Homo sapiens
tgtaagcgtatggcttt

SEQ ID NO: 1895247 - DNA, 21 bp, Homo sapiens
tgtaaggaaaaataaaagtgc

SEQ ID NO: 1895248 - DNA, 22 bp, Homo sapiens
tgtaatctagttgtcaataaat

SEQ ID NO: 1895249 - DNA, 23 bp, Homo sapiens
tgtaatgtatacttgaaaaatgt

SEQ ID NO: 1895250 - DNA, 23 bp, Homo sapiens
tgtaatgtatcaaatacatttaa

SEQ ID NO: 1895251 - DNA, 19 bp, Homo sapiens
tgtaattgttgtttgtatg

SEQ ID NO: 1895252 - DNA, 20 bp, Homo sapiens
tgtaattgttgtttgtatgt

SEQ ID NO: 1895253 - DNA, 14 bp, Homo sapiens
tgtacatgggacta

SEQ ID NO: 1895254 - DNA, 23 bp, Homo sapiens
tgtacatgggactatgcttttct

SEQ ID NO: 1895255 - DNA, 22 bp, Homo sapiens
tgtacgacgtcagatgtttaaa

SEQ ID NO: 1895256 - DNA, 12 bp, Homo sapiens
tgtagaacttgt

SEQ ID NO: 1895257 - DNA, 17 bp, Homo sapiens
tgtagacattttgaaat

SEQ ID NO: 1895258 - DNA, 20 bp, Homo sapiens
tgtagacattttgaaataaa

SEQ ID NO: 1895259 - DNA, 13 bp, Homo sapiens
tgtagatttgatt

SEQ ID NO: 1895260 - DNA, 23 bp, Homo sapiens
tgtagcctcaatcgagtgagaca

SEQ ID NO: 1895261 - DNA, 18 bp, Homo sapiens
tgtagcctgaagagtttg

SEQ ID NO: 1895262 - DNA, 14 bp, Homo sapiens
tgtagctgcgtcat

SEQ ID NO: 1895263 - DNA, 17 bp, Homo sapiens
tgtagttctttaaactg

SEQ ID NO: 1895264 - DNA, 19 bp, Homo sapiens
tgtataaaggtgtgctgtg

SEQ ID NO: 1895265 - DNA, 14 bp, Homo sapiens
tgtatacttgaaaa

SEQ ID NO: 1895266 - DNA, 15 bp, Homo sapiens
tgtatatatttttct

SEQ ID NO: 1895267 - DNA, 17 bp, Homo sapiens
tgtatatatttttctta

SEQ ID NO: 1895268 - DNA, 13 bp, Homo sapiens
tgtatattggttt

SEQ ID NO: 1895269 - DNA, 20 bp, Homo sapiens
tgtatattggttttatgatg

SEQ ID NO: 1895270 - DNA, 21 bp, Homo sapiens
tgtatattggttttatgatga

SEQ ID NO: 1895271 - DNA, 16 bp, Homo sapiens
tgtatcaaactgcttt

SEQ ID NO: 1895272 - DNA, 21 bp, Homo sapiens
tgtatcaaatacatttaaaac

SEQ ID NO: 1895273 - DNA, 15 bp, Homo sapiens
tgtatcagaatcttg

SEQ ID NO: 1895274 - DNA, 19 bp, Homo sapiens
tgtatgaaaacatggaaca

SEQ ID NO: 1895275 - DNA, 11 bp, Homo sapiens
tgtatgtgttt

SEQ ID NO: 1895276 - DNA, 12 bp, Homo sapiens
tgtatgtgttta

SEQ ID NO: 1895277 - DNA, 11 bp, Homo sapiens
tgtatgttatt

SEQ ID NO: 1895278 - DNA, 12 bp, Homo sapiens
tgtattaattat

SEQ ID NO: 1895279 - DNA, 21 bp, Homo sapiens
tgtattctgggtattctatta

SEQ ID NO: 1895280 - DNA, 23 bp, Homo sapiens
tgtattgagatttacccagactg

SEQ ID NO: 1895281 - DNA, 11 bp, Homo sapiens
tgtattgtaat

SEQ ID NO: 1895282 - DNA, 13 bp, Homo sapiens
tgtatttgaaagt

SEQ ID NO: 1895283 - DNA, 19 bp, Homo sapiens
tgtcaaatatttagatgta

SEQ ID NO: 1895284 - DNA, 15 bp, Homo sapiens
tgacaacaaattttg

SEQ ID NO: 1895285 - DNA, 14 bp, Homo sapiens
tgacaagctggctt

SEQ ID NO: 1895286 - DNA, 23 bp, Homo sapiens
tgacaagctggcttacactggca

SEQ ID NO: 1895287 - DNA, 19 bp, Homo sapiens
tgacagcgcacagctgctc

SEQ ID NO: 1895288 - DNA, 15 bp, Homo sapiens
tgacataattctaag

SEQ ID NO: 1895289 - DNA, 21 bp, Homo sapiens
tgacatcacagggcctcagtt

SEQ ID NO: 1895290 - DNA, 14 bp, Homo sapiens
tgacatcactggca

SEQ ID NO: 1895291 - DNA, 18 bp, Homo sapiens
tgacatcactggcatggt

SEQ ID NO: 1895292 - DNA, 20 bp, Homo sapiens
tgacattttagaatgtcaat

SEQ ID NO: 1895293 - DNA, 19 bp, Homo sapiens
tgacattttgcatgatgaa

SEQ ID NO: 1895294 - DNA, 22 bp, Homo sapiens
tgaccagaagacaaaggcccaa

SEQ ID NO: 1895295 - DNA, 19 bp, Homo sapiens
tgaccataacagtgccagc

SEQ ID NO: 1895296 - DNA, 20 bp, Homo sapiens
tgaccataacagtgccagct

SEQ ID NO: 1895297 - DNA, 18 bp, Homo sapiens
tgacccatgggcaggaga

SEQ ID NO: 1895298 - DNA, 17 bp, Homo sapiens
tgacctcacacacctct

SEQ ID NO: 1895299 - DNA, 14 bp, Homo sapiens
tgacctcacgtgca

SEQ ID NO: 1895300 - DNA, 16 bp, Homo sapiens
tgaccttaaatgcaac

SEQ ID NO: 1895301 - DNA, 20 bp, Homo sapiens
tgacggttcctacacaggac

SEQ ID NO: 1895302 - DNA, 13 bp, Homo sapiens
tgacgtctgccac

SEQ ID NO: 1895303 - DNA, 14 bp, Homo sapiens
tgacgtctgccacc

SEQ ID NO: 1895304 - DNA, 17 bp, Homo sapiens
tgactaaaaatatcaca

SEQ ID NO: 1895305 - DNA, 21 bp, Homo sapiens
tgactaaaaatatcacactga

SEQ ID NO: 1895306 - DNA, 17 bp, Homo sapiens
tgactataccaactggg

SEQ ID NO: 1895307 - DNA, 23 bp, Homo sapiens
tgactctagtactgtgaatccag

SEQ ID NO: 1895308 - DNA, 17 bp, Homo sapiens
tgactctgccagggtgg

SEQ ID NO: 1895309 - DNA, 23 bp, Homo sapiens
tgactcttgagttgtttttgtat

SEQ ID NO: 1895310 - DNA, 16 bp, Homo sapiens
tgactgaaaatgaact

SEQ ID NO: 1895311 - DNA, 19 bp, Homo sapiens
tgacttaacatagccaaaa

SEQ ID NO: 1895312 - DNA, 13 bp, Homo sapiens
tgacttagaatcc

SEQ ID NO: 1895313 - DNA, 13 bp, Homo sapiens
tgactttgaattt

SEQ ID NO: 1895314 - DNA, 14 bp, Homo sapiens
tgactttgaattta

SEQ ID NO: 1895315 - DNA, 15 bp, Homo sapiens
tgactttgaatttat

SEQ ID NO: 1895316 - DNA, 18 bp, Homo sapiens
tgagaacattaggcccca

SEQ ID NO: 1895317 - DNA, 22 bp, Homo sapiens
tgagaacattaggccccagcaa

SEQ ID NO: 1895318 - DNA, 14 bp, Homo sapiens
tgagaatagaaatt

SEQ ID NO: 1895319 - DNA, 15 bp, Homo sapiens
tgagaatagaaattt

SEQ ID NO: 1895320 - DNA, 22 bp, Homo sapiens
tgccacaaggaagaaattaact

SEQ ID NO: 1895321 - DNA, 21 bp, Homo sapiens
tgccaccagcgcccccactcc

SEQ ID NO: 1895322 - DNA, 22 bp, Homo sapiens
tgccaccagcgcccccactcct

SEQ ID NO: 1895323 - DNA, 15 bp, Homo sapiens
tgccaccctgctgag

SEQ ID NO: 1895324 - DNA, 10 bp, Homo sapiens
tgccacctcc

SEQ ID NO: 1895325 - DNA, 16 bp, Homo sapiens
tgccacctcccaagag

SEQ ID NO: 1895326 - DNA, 17 bp, Homo sapiens
tgccacctccccttgcc

SEQ ID NO: 1895327 - DNA, 22 bp, Homo sapiens
tgccacctccccttgccagctg

SEQ ID NO: 1895328 - DNA, 22 bp, Homo sapiens
tgccagacgctcattcagcatc

SEQ ID NO: 1895329 - DNA, 22 bp, Homo sapiens
tgccagctcttcctagctggag

SEQ ID NO: 1895330 - DNA, 23 bp, Homo sapiens
tgccagctcttcctagctggaga

SEQ ID NO: 1895331 - DNA, 15 bp, Homo sapiens
tgccagctgctgagc

SEQ ID NO: 1895332 - DNA, 22 bp, Homo sapiens
tgccaggcacaggcagggcagg

SEQ ID NO: 1895333 - DNA, 11 bp, Homo sapiens
tgccagggatg

SEQ ID NO: 1895334 - DNA, 16 bp, Homo sapiens
tgccagggatggcagt

SEQ ID NO: 1895335 - DNA, 14 bp, Homo sapiens
tgccatagagtaca

SEQ ID NO: 1895336 - DNA, 15 bp, Homo sapiens
tgccatagagtacac

SEQ ID NO: 1895337 - DNA, 16 bp, Homo sapiens
tgccatcccggcagcg

SEQ ID NO: 1895338 - DNA, 18 bp, Homo sapiens
tgcccagaatactgatgg

SEQ ID NO: 1895339 - DNA, 17 bp, Homo sapiens
tgcccaggtggctgtgg

SEQ ID NO: 1895340 - DNA, 14 bp, Homo sapiens
tgcccctggcaaat

SEQ ID NO: 1895341 - DNA, 12 bp, Homo sapiens
tgccccttgggc

SEQ ID NO: 1895342 - DNA, 16 bp, Homo sapiens
tgccctccgccccgtc

SEQ ID NO: 1895343 - DNA, 12 bp, Homo sapiens
tgccctctgctc

SEQ ID NO: 1895344 - DNA, 14 bp, Homo sapiens
tgccctctgctcta

SEQ ID NO: 1895345 - DNA, 20 bp, Homo sapiens
tgcctaaataagttataaag

SEQ ID NO: 1895346 - DNA, 17 bp, Homo sapiens
tgcctataagccaaaat

SEQ ID NO: 1895347 - DNA, 20 bp, Homo sapiens
tgcctataagccaaaattaa

SEQ ID NO: 1895348 - DNA, 14 bp, Homo sapiens
tgcctcaataaagc

SEQ ID NO: 1895349 - DNA, 15 bp, Homo sapiens
tgcctcagcttcccc

SEQ ID NO: 1895350 - DNA, 20 bp, Homo sapiens
aggactttggcttacatttg

SEQ ID NO: 1895351 - DNA, 22 bp, Homo sapiens
aggagacctgtatcaaactgct

SEQ ID NO: 1895352 - DNA, 20 bp, Homo sapiens
aggagactgtggagactgct

SEQ ID NO: 1895353 - DNA, 21 bp, Homo sapiens
aggagactgtggagactgctc

SEQ ID NO: 1895354 - DNA, 15 bp, Homo sapiens
aggagcactgaaagt

SEQ ID NO: 1895355 - DNA, 12 bp, Homo sapiens
aggagcaggccc

SEQ ID NO: 1895356 - DNA, 14 bp, Homo sapiens
aggagcaggccctg

SEQ ID NO: 1895357 - DNA, 17 bp, Homo sapiens
aggagcaggccctgggc

SEQ ID NO: 1895358 - DNA, 19 bp, Homo sapiens
aggagcaggccctgggcct

SEQ ID NO: 1895359 - DNA, 22 bp, Homo sapiens
aggagcaggccctgggcctcca

SEQ ID NO: 1895360 - DNA, 19 bp, Homo sapiens
aggagcagtatcatgaagc

SEQ ID NO: 1895361 - DNA, 23 bp, Homo sapiens
aggagcattgcagtcactttgac

SEQ ID NO: 1895362 - DNA, 22 bp, Homo sapiens
aggagcccatttggagggcctg

SEQ ID NO: 1895363 - DNA, 18 bp, Homo sapiens
aggagccccagtggtgag

SEQ ID NO: 1895364 - DNA, 13 bp, Homo sapiens
aggagccctgcct

SEQ ID NO: 1895365 - DNA, 23 bp, Homo sapiens
aggagctcactgtggtgtctgtg

SEQ ID NO: 1895366 - DNA, 12 bp, Homo sapiens
aggaggcagaga

SEQ ID NO: 1895367 - DNA, 14 bp, Homo sapiens
aggaggcaggagga

SEQ ID NO: 1895368 - DNA, 15 bp, Homo sapiens
aggaggcaggaggag

SEQ ID NO: 1895369 - DNA, 17 bp, Homo sapiens
aggaggcaggaggagca

SEQ ID NO: 1895370 - DNA, 14 bp, Homo sapiens
aggagtggattcct

SEQ ID NO: 1895371 - DNA, 23 bp, Homo sapiens
aggagttcgagttacagcctggg

SEQ ID NO: 1895372 - DNA, 13 bp, Homo sapiens
aggatatatttta

SEQ ID NO: 1895373 - DNA, 14 bp, Homo sapiens
aggatatattttat

SEQ ID NO: 1895374 - DNA, 17 bp, Homo sapiens
aggatatcggcatttgt

SEQ ID NO: 1895375 - DNA, 16 bp, Homo sapiens
aggatgggcttctgtg

SEQ ID NO: 1895376 - DNA, 16 bp, Homo sapiens
aggattagtttagaac

SEQ ID NO: 1895377 - DNA, 18 bp, Homo sapiens
aggattagtttagaacag

SEQ ID NO: 1895378 - DNA, 19 bp, Homo sapiens
aggcaataccaacctgaaa

SEQ ID NO: 1895379 - DNA, 21 bp, Homo sapiens
aggcaataccaacctgaaagt

SEQ ID NO: 1895380 - DNA, 15 bp, Homo sapiens
aggcacaggcagggc

SEQ ID NO: 1895381 - DNA, 17 bp, Homo sapiens
aggcacaggcagggcag

SEQ ID NO: 1895382 - DNA, 23 bp, Homo sapiens
aggcactctggggctggcaccag

SEQ ID NO: 1895383 - DNA, 16 bp, Homo sapiens
aggcagaaagcaaaat

SEQ ID NO: 1895384 - DNA, 14 bp, Homo sapiens
aggcagagagggtc

SEQ ID NO: 1895385 - DNA, 17 bp, Homo sapiens
aggcagcctgagagtct

SEQ ID NO: 1895386 - DNA, 14 bp, Homo sapiens
aggcagcgccactg

SEQ ID NO: 1895387 - DNA, 20 bp, Homo sapiens
aggcaggtgatctgctgcag

SEQ ID NO: 1895388 - DNA, 19 bp, Homo sapiens
aggcatggatgaataaatg

SEQ ID NO: 1895389 - DNA, 15 bp, Homo sapiens
aggccaagagtggcc

SEQ ID NO: 1895390 - DNA, 19 bp, Homo sapiens
aggccaagagtggccccac

SEQ ID NO: 1895391 - DNA, 22 bp, Homo sapiens
aggccaatatattttgaaatat

SEQ ID NO: 1895392 - DNA, 20 bp, Homo sapiens
aggccaatcagaagctaaca

SEQ ID NO: 1895393 - DNA, 16 bp, Homo sapiens
aggccaatgggctaga

SEQ ID NO: 1895394 - DNA, 22 bp, Homo sapiens
aggccacctcctaaaaggccca

SEQ ID NO: 1895395 - DNA, 21 bp, Homo sapiens
aggccacctcttcctggccgg

SEQ ID NO: 1895396 - DNA, 16 bp, Homo sapiens
aggccagcagccttcc

SEQ ID NO: 1895397 - DNA, 19 bp, Homo sapiens
aggccagcagccttccagt

SEQ ID NO: 1895398 - DNA, 14 bp, Homo sapiens
aggccaggggaggg

SEQ ID NO: 1895399 - DNA, 12 bp, Homo sapiens
aggcccaccctg

SEQ ID NO: 1895400 - DNA, 15 bp, Homo sapiens
aggcccaccctgctt

SEQ ID NO: 1895401 - DNA, 22 bp, Homo sapiens
aggcccaccctgcttggcccag

SEQ ID NO: 1895402 - DNA, 15 bp, Homo sapiens
aggcccatggccaca

SEQ ID NO: 1895403 - DNA, 20 bp, Homo sapiens
aggccccagcaacacgtcat

SEQ ID NO: 1895404 - DNA, 22 bp, Homo sapiens
aggccccgaggctcgagctcgg

SEQ ID NO: 1895405 - DNA, 20 bp, Homo sapiens
aggccctgggcctccacctc

SEQ ID NO: 1895406 - DNA, 19 bp, Homo sapiens
aggcctaattctatgcctg

SEQ ID NO: 1895407 - DNA, 22 bp, Homo sapiens
aggcctaattctatgcctgtct

SEQ ID NO: 1895408 - DNA, 14 bp, Homo sapiens
aggcgagcagggca

SEQ ID NO: 1895409 - DNA, 15 bp, Homo sapiens
aggcgagcagggcag

SEQ ID NO: 1895410 - DNA, 20 bp, Homo sapiens
aggcgcaagggaggcccagc

SEQ ID NO: 1895411 - DNA, 14 bp, Homo sapiens
aggctcaaattttg

SEQ ID NO: 1895412 - DNA, 19 bp, Homo sapiens
aggctcctcagccctctct

SEQ ID NO: 1895413 - DNA, 24 bp, Homo sapiens
aggctcctcagccctctcttgcca

SEQ ID NO: 1895414 - DNA, 14 bp, Homo sapiens
aggctcgagctcgg

SEQ ID NO: 1895415 - DNA, 15 bp, Homo sapiens
aggctgagtgcaggc

SEQ ID NO: 1895416 - DNA, 20 bp, Homo sapiens
aggctgagtgcaggcccacc

SEQ ID NO: 1895417 - DNA, 23 bp, Homo sapiens
aggctgagtgcaggcccaccctg

SEQ ID NO: 1895418 - DNA, 24 bp, Homo sapiens
aggctgagtgcaggcccaccctgc

SEQ ID NO: 1895419 - DNA, 13 bp, Homo sapiens
aggctgctgccag

SEQ ID NO: 1895420 - DNA, 15 bp, Homo sapiens
aggctgctgccaggc

SEQ ID NO: 1895421 - DNA, 17 bp, Homo sapiens
aggctggcaagaaccag

SEQ ID NO: 1895422 - DNA, 15 bp, Homo sapiens
aggctgggctgggca

SEQ ID NO: 1895423 - DNA, 18 bp, Homo sapiens
aggctgggctgggcactg

SEQ ID NO: 1895424 - DNA, 22 bp, Homo sapiens
aggctgggctgggcactgctct

SEQ ID NO: 1895425 - DNA, 20 bp, Homo sapiens
aggctgtcagtgtttggtgc

SEQ ID NO: 1895426 - DNA, 13 bp, Homo sapiens
aggctgtggtcag

SEQ ID NO: 1895427 - DNA, 15 bp, Homo sapiens
aggctgtggtcagag

SEQ ID NO: 1895428 - DNA, 19 bp, Homo sapiens
aggctgttgaatggaattt

SEQ ID NO: 1895429 - DNA, 16 bp, Homo sapiens
aggcttataaaacaga

SEQ ID NO: 1895430 - DNA, 17 bp, Homo sapiens
aggcttatacaaattta

SEQ ID NO: 1895431 - DNA, 18 bp, Homo sapiens
aggcttatacaaatttaa

SEQ ID NO: 1895432 - DNA, 20 bp, Homo sapiens
aggctttatttataaaataa

SEQ ID NO: 1895433 - DNA, 21 bp, Homo sapiens
aggctttatttataaaataaa

SEQ ID NO: 1895434 - DNA, 16 bp, Homo sapiens
agggaagctgaggccc

SEQ ID NO: 1895435 - DNA, 17 bp, Homo sapiens
agggactctgtctggcc

SEQ ID NO: 1895436 - DNA, 14 bp, Homo sapiens
agggactggatctg

SEQ ID NO: 1895437 - DNA, 23 bp, Homo sapiens
agggagcagacttttaaagactt

SEQ ID NO: 1895438 - DNA, 16 bp, Homo sapiens
agggagccctgggcca

SEQ ID NO: 1895439 - DNA, 21 bp, Homo sapiens
agggagccctgggccagggcg

SEQ ID NO: 1895440 - DNA, 23 bp, Homo sapiens
agggagccctgggccagggcgtg

SEQ ID NO: 1895441 - DNA, 16 bp, Homo sapiens
agggagtaagtagagg

SEQ ID NO: 1895442 - DNA, 19 bp, Homo sapiens
agggagtaagtagaggtgg

SEQ ID NO: 1895443 - DNA, 11 bp, Homo sapiens
agggatggcag

SEQ ID NO: 1895444 - DNA, 17 bp, Homo sapiens
agggatggcagtggctg

SEQ ID NO: 1895445 - DNA, 14 bp, Homo sapiens
agggcacagaaggc

SEQ ID NO: 1895446 - DNA, 14 bp, Homo sapiens
agggcaggaccagc

SEQ ID NO: 1895447 - DNA, 16 bp, Homo sapiens
agggcaggaccagccc

SEQ ID NO: 1895448 - DNA, 17 bp, Homo sapiens
agggcaggaccagccca

SEQ ID NO: 1895449 - DNA, 18 bp, Homo sapiens
agggcaggcccccgggga

SEQ ID NO: 1895450 - DNA, 16 bp, Homo sapiens
agggcatttggcttcc

SEQ ID NO: 1895451 - DNA, 17 bp, Homo sapiens
agggcatttggcttcct

SEQ ID NO: 1895452 - DNA, 20 bp, Homo sapiens
agggcatttggcttcctctg

SEQ ID NO: 1895453 - DNA, 23 bp, Homo sapiens
agggcatttggcttcctctgctg

SEQ ID NO: 1895454 - DNA, 15 bp, Homo sapiens
agggcccgggcccag

SEQ ID NO: 1895455 - DNA, 13 bp, Homo sapiens
agggcctggccca

SEQ ID NO: 1895456 - DNA, 14 bp, Homo sapiens
agggcctggcccat

SEQ ID NO: 1895457 - DNA, 16 bp, Homo sapiens
agggcctggcccatgt

SEQ ID NO: 1895458 - DNA, 16 bp, Homo sapiens
agggcctgggcctggc

SEQ ID NO: 1895459 - DNA, 20 bp, Homo sapiens
agggcctgggcctggctccc

SEQ ID NO: 1895460 - DNA, 19 bp, Homo sapiens
agggccttctgcctgctga

SEQ ID NO: 1895461 - DNA, 21 bp, Homo sapiens
agggccttctgcctgctgacc

SEQ ID NO: 1895462 - DNA, 15 bp, Homo sapiens
agggctgggtcaggg

SEQ ID NO: 1895463 - DNA, 14 bp, Homo sapiens
agggcttgtagttc

SEQ ID NO: 1895464 - DNA, 15 bp, Homo sapiens
aggggactgccacct

SEQ ID NO: 1895465 - DNA, 14 bp, Homo sapiens
aggggagacagagc

SEQ ID NO: 1895466 - DNA, 12 bp, Homo sapiens
aggggaggccaa

SEQ ID NO: 1895467 - DNA, 22 bp, Homo sapiens
aggggatccagctcaagggagt

SEQ ID NO: 1895468 - DNA, 14 bp, Homo sapiens
aggggccaagcagg

SEQ ID NO: 1895469 - DNA, 21 bp, Homo sapiens
aggggccagcggccctcccag

SEQ ID NO: 1895470 - DNA, 17 bp, Homo sapiens
agggggacctcgggctg

SEQ ID NO: 1895471 - DNA, 23 bp, Homo sapiens
aggggtacacagagctaaggcca

SEQ ID NO: 1895472 - DNA, 12 bp, Homo sapiens
agggtaagtatt

SEQ ID NO: 1895473 - DNA, 21 bp, Homo sapiens
agggtacaaaaaattcagtga

SEQ ID NO: 1895474 - DNA, 18 bp, Homo sapiens
agggtaggcagcctgaga

SEQ ID NO: 1895475 - DNA, 16 bp, Homo sapiens
agggtctatcttgtaa

SEQ ID NO: 1895476 - DNA, 17 bp, Homo sapiens
agggtctatcttgtaaa

SEQ ID NO: 1895477 - DNA, 16 bp, Homo sapiens
agggtctctagtgctg

SEQ ID NO: 1895478 - DNA, 20 bp, Homo sapiens
agggtggtttacctgcaccg

SEQ ID NO: 1895479 - DNA, 16 bp, Homo sapiens
agggtgtgaggccaca

SEQ ID NO: 1895480 - DNA, 22 bp, Homo sapiens
aggtagttcaagaaatgaagag

SEQ ID NO: 1895481 - DNA, 20 bp, Homo sapiens
aggtcgcttgggaattttat

SEQ ID NO: 1895482 - DNA, 19 bp, Homo sapiens
aggtgaaactccagatgcc

SEQ ID NO: 1895483 - DNA, 14 bp, Homo sapiens
aggtgaacattggt

SEQ ID NO: 1895484 - DNA, 16 bp, Homo sapiens
tccctctctgctggac

SEQ ID NO: 1895485 - DNA, 15 bp, Homo sapiens
tcccttccatctctt

SEQ ID NO: 1895486 - DNA, 12 bp, Homo sapiens
tcccttcttttt

SEQ ID NO: 1895487 - DNA, 22 bp, Homo sapiens
tcccttctttttccctttcctt

SEQ ID NO: 1895488 - DNA, 20 bp, Homo sapiens
tccctttcctttcctttcat

SEQ ID NO: 1895489 - DNA, 16 bp, Homo sapiens
tcccttttctttcctt

SEQ ID NO: 1895490 - DNA, 21 bp, Homo sapiens
tccgccccgtccccccatccc

SEQ ID NO: 1895491 - DNA, 16 bp, Homo sapiens
tccgcccctgagccca

SEQ ID NO: 1895492 - DNA, 19 bp, Homo sapiens
tccgcccctgagcccactg

SEQ ID NO: 1895493 - DNA, 13 bp, Homo sapiens
tccgcttccctgg

SEQ ID NO: 1895494 - DNA, 18 bp, Homo sapiens
tccggcaccagtagcagg

SEQ ID NO: 1895495 - DNA, 15 bp, Homo sapiens
tccggctaagcaggc

SEQ ID NO: 1895496 - DNA, 15 bp, Homo sapiens
tcctaaaaggcccag

SEQ ID NO: 1895497 - DNA, 18 bp, Homo sapiens
tcctaaaaggcccagaga

SEQ ID NO: 1895498 - DNA, 21 bp, Homo sapiens
tcctaaaaggcccagagagaa

SEQ ID NO: 1895499 - DNA, 21 bp, Homo sapiens
tcctaacgttttctactttga

SEQ ID NO: 1895500 - DNA, 14 bp, Homo sapiens
tcctaatggtgatg

SEQ ID NO: 1895501 - DNA, 24 bp, Homo sapiens
tcctaatggtgatgcagtcttaga

SEQ ID NO: 1895502 - DNA, 12 bp, Homo sapiens
tcctacacaatg

SEQ ID NO: 1895503 - DNA, 15 bp, Homo sapiens
tcctacacaggacag

SEQ ID NO: 1895504 - DNA, 16 bp, Homo sapiens
tcctacacaggacagg

SEQ ID NO: 1895505 - DNA, 22 bp, Homo sapiens
tcctagctggagaggagccctg

SEQ ID NO: 1895506 - DNA, 23 bp, Homo sapiens
tcctagctggagaggagccctgc

SEQ ID NO: 1895507 - DNA, 24 bp, Homo sapiens
tcctagctggagaggagccctgcc

SEQ ID NO: 1895508 - DNA, 17 bp, Homo sapiens
tcctagtttgctgtggc

SEQ ID NO: 1895509 - DNA, 17 bp, Homo sapiens
tcctattagtgttatat

SEQ ID NO: 1895510 - DNA, 15 bp, Homo sapiens
tcctatttagacatg

SEQ ID NO: 1895511 - DNA, 19 bp, Homo sapiens
tcctcagccctctcttgcc

SEQ ID NO: 1895512 - DNA, 14 bp, Homo sapiens
tcctccccaccctg

SEQ ID NO: 1895513 - DNA, 23 bp, Homo sapiens
tcctccccaccctgtcccaggca

SEQ ID NO: 1895514 - DNA, 13 bp, Homo sapiens
tcctccctcccag

SEQ ID NO: 1895515 - DNA, 15 bp, Homo sapiens
tcctccctcccagct

SEQ ID NO: 1895516 - DNA, 14 bp, Homo sapiens
tcctcctcctttct

SEQ ID NO: 1895517 - DNA, 15 bp, Homo sapiens
tcctcctgccctccg

SEQ ID NO: 1895518 - DNA, 19 bp, Homo sapiens
tcctgagcccccagcttcc

SEQ ID NO: 1895519 - DNA, 20 bp, Homo sapiens
tcctgaggggagacagagca

SEQ ID NO: 1895520 - DNA, 23 bp, Homo sapiens
tcctgaggggagacagagcaacc

SEQ ID NO: 1895521 - DNA, 20 bp, Homo sapiens
tcctgattattttcagaagc

SEQ ID NO: 1895522 - DNA, 22 bp, Homo sapiens
tcctgattattttcagaagctg

SEQ ID NO: 1895523 - DNA, 22 bp, Homo sapiens
tcctgattctaaaatgtctcaa

SEQ ID NO: 1895524 - DNA, 16 bp, Homo sapiens
tcctgcactgactctg

SEQ ID NO: 1895525 - DNA, 17 bp, Homo sapiens
tcctgcactgactctgg

SEQ ID NO: 1895526 - DNA, 19 bp, Homo sapiens
tcctggccggtgtgggggc

SEQ ID NO: 1895527 - DNA, 15 bp, Homo sapiens
tcctgtcatctgaga

SEQ ID NO: 1895528 - DNA, 13 bp, Homo sapiens
tccttacctggaa

SEQ ID NO: 1895529 - DNA, 18 bp, Homo sapiens
tccttacctggaaaaaca

SEQ ID NO: 1895530 - DNA, 14 bp, Homo sapiens
tccttcagatattt

SEQ ID NO: 1895531 - DNA, 15 bp, Homo sapiens
tccttcagatatttt

SEQ ID NO: 1895532 - DNA, 22 bp, Homo sapiens
tccttctatacatgtttgcagt

SEQ ID NO: 1895533 - DNA, 22 bp, Homo sapiens
tccttctgtagcctgaagagtt

SEQ ID NO: 1895534 - DNA, 20 bp, Homo sapiens
tccttgaaccctaataagac

SEQ ID NO: 1895535 - DNA, 17 bp, Homo sapiens
tctgactttgaatttat

SEQ ID NO: 1895536 - DNA, 22 bp, Homo sapiens
tctgactttgaatttatataaa

SEQ ID NO: 1895537 - DNA, 12 bp, Homo sapiens
tctgagaatgaa

SEQ ID NO: 1895538 - DNA, 16 bp, Homo sapiens
tctgagaatgaacaaa

SEQ ID NO: 1895539 - DNA, 17 bp, Homo sapiens
tctgagcttacgtagtt

SEQ ID NO: 1895540 - DNA, 18 bp, Homo sapiens
tctgaggacaagagaaaa

SEQ ID NO: 1895541 - DNA, 21 bp, Homo sapiens
tctgaggccgttgctgactta

SEQ ID NO: 1895542 - DNA, 19 bp, Homo sapiens
tctgagttgttaccccaag

SEQ ID NO: 1895543 - DNA, 15 bp, Homo sapiens
tctgataccaaagag

SEQ ID NO: 1895544 - DNA, 16 bp, Homo sapiens
tctgatcactgaaata

SEQ ID NO: 1895545 - DNA, 18 bp, Homo sapiens
tctgatcactgaaataaa

SEQ ID NO: 1895546 - DNA, 14 bp, Homo sapiens
tctgatctgtgcag

SEQ ID NO: 1895547 - DNA, 13 bp, Homo sapiens
tctgatttcaggg

SEQ ID NO: 1895548 - DNA, 17 bp, Homo sapiens
tctgccaccctgctgag

SEQ ID NO: 1895549 - DNA, 19 bp, Homo sapiens
tctgccccttgggcctccc

SEQ ID NO: 1895550 - DNA, 20 bp, Homo sapiens
tctgccccttgggcctccca

SEQ ID NO: 1895551 - DNA, 22 bp, Homo sapiens
tctgctcccctaaagcctcaaa

SEQ ID NO: 1895552 - DNA, 22 bp, Homo sapiens
tctgctgcagagcagtaaggga

SEQ ID NO: 1895553 - DNA, 13 bp, Homo sapiens
tctgctgcatccc

SEQ ID NO: 1895554 - DNA, 20 bp, Homo sapiens
tctgctgcatccccttccag

SEQ ID NO: 1895555 - DNA, 23 bp, Homo sapiens
tctgctgcatccccttccagctc

SEQ ID NO: 1895556 - DNA, 14 bp, Homo sapiens
tctggaactgctgc

SEQ ID NO: 1895557 - DNA, 15 bp, Homo sapiens
tctggaactgctgct

SEQ ID NO: 1895558 - DNA, 19 bp, Homo sapiens
tctggaactgctgctgacc

SEQ ID NO: 1895559 - DNA, 17 bp, Homo sapiens
tctggaccccatctgtg

SEQ ID NO: 1895560 - DNA, 19 bp, Homo sapiens
tctggaccccatctgtgaa

SEQ ID NO: 1895561 - DNA, 13 bp, Homo sapiens
tctggcacagcct

SEQ ID NO: 1895562 - DNA, 22 bp, Homo sapiens
tctggccagggaggagccccag

SEQ ID NO: 1895563 - DNA, 16 bp, Homo sapiens
tctggctctacacata

SEQ ID NO: 1895564 - DNA, 17 bp, Homo sapiens
tctggggctcttggccc

SEQ ID NO: 1895565 - DNA, 21 bp, Homo sapiens
tctggtaatcggggtataata

SEQ ID NO: 1895566 - DNA, 19 bp, Homo sapiens
tctgtagcctgaagagttt

SEQ ID NO: 1895567 - DNA, 14 bp, Homo sapiens
tctgtatttgaaag

SEQ ID NO: 1895568 - DNA, 15 bp, Homo sapiens
tctgtctggccaggg

SEQ ID NO: 1895569 - DNA, 16 bp, Homo sapiens
tctgtgcagggtatta

SEQ ID NO: 1895570 - DNA, 14 bp, Homo sapiens
tctgtggttggctg

SEQ ID NO: 1895571 - DNA, 20 bp, Homo sapiens
tctgtggttggctgggaaat

SEQ ID NO: 1895572 - DNA, 13 bp, Homo sapiens
tctgttgcccagg

SEQ ID NO: 1895573 - DNA, 16 bp, Homo sapiens
tctgttgtattcattg

SEQ ID NO: 1895574 - DNA, 23 bp, Homo sapiens
tcttaaaatggcaagttttccat

SEQ ID NO: 1895575 - DNA, 14 bp, Homo sapiens
tcttaagtcataat

SEQ ID NO: 1895576 - DNA, 17 bp, Homo sapiens
tcttaagtcataatgaa

SEQ ID NO: 1895577 - DNA, 13 bp, Homo sapiens
tcttactttgtaa

SEQ ID NO: 1895578 - DNA, 13 bp, Homo sapiens
ttctgccagggat

SEQ ID NO: 1895579 - DNA, 20 bp, Homo sapiens
ttctgccagggatggcagtg

SEQ ID NO: 1895580 - DNA, 11 bp, Homo sapiens
ttctggtaatc

SEQ ID NO: 1895581 - DNA, 19 bp, Homo sapiens
ttctggttgtttttaaaca

SEQ ID NO: 1895582 - DNA, 14 bp, Homo sapiens
ttctgtagcctgaa

SEQ ID NO: 1895583 - DNA, 13 bp, Homo sapiens
ttctgtatttgaa

SEQ ID NO: 1895584 - DNA, 13 bp, Homo sapiens
ttctgtggaaaaa

SEQ ID NO: 1895585 - DNA, 20 bp, Homo sapiens
ttctgtggttggctgggaaa

SEQ ID NO: 1895586 - DNA, 13 bp, Homo sapiens
ttcttatttatgt

SEQ ID NO: 1895587 - DNA, 24 bp, Homo sapiens
ttcttccagtgaggcatctctctg

SEQ ID NO: 1895588 - DNA, 19 bp, Homo sapiens
ttcttctgatcactgaaat

SEQ ID NO: 1895589 - DNA, 17 bp, Homo sapiens
ttcttgggactgctgtg

SEQ ID NO: 1895590 - DNA, 19 bp, Homo sapiens
ttcttgggactgctgtgaa

SEQ ID NO: 1895591 - DNA, 17 bp, Homo sapiens
ttcttgtaataaatgat

SEQ ID NO: 1895592 - DNA, 14 bp, Homo sapiens
ttctttccttttca

SEQ ID NO: 1895593 - DNA, 22 bp, Homo sapiens
ttctttgtacacccatgaaaga

SEQ ID NO: 1895594 - DNA, 23 bp, Homo sapiens
ttgaaaatagtttattttaaaac

SEQ ID NO: 1895595 - DNA, 15 bp, Homo sapiens
ttgaaagaatgtaaa

SEQ ID NO: 1895596 - DNA, 17 bp, Homo sapiens
ttgaaagtgcctttgca

SEQ ID NO: 1895597 - DNA, 16 bp, Homo sapiens
ttgaaataaaaagagt

SEQ ID NO: 1895598 - DNA, 21 bp, Homo sapiens
ttgaaccataaaatgtccagt

SEQ ID NO: 1895599 - DNA, 16 bp, Homo sapiens
ttgaactcttctcatt

SEQ ID NO: 1895600 - DNA, 23 bp, Homo sapiens
ttgaataaacaccactggattaa

SEQ ID NO: 1895601 - DNA, 12 bp, Homo sapiens
ttgaataaacta

SEQ ID NO: 1895602 - DNA, 23 bp, Homo sapiens
ttgaataatgtctagattttgaa

SEQ ID NO: 1895603 - DNA, 12 bp, Homo sapiens
ttgaatacttga

SEQ ID NO: 1895604 - DNA, 14 bp, Homo sapiens
ttgaatacttgaac

SEQ ID NO: 1895605 - DNA, 17 bp, Homo sapiens
ttgaatacttgaaccat

SEQ ID NO: 1895606 - DNA, 15 bp, Homo sapiens
ttgaatatgattaaa

SEQ ID NO: 1895607 - DNA, 13 bp, Homo sapiens
ttgaatatttaag

SEQ ID NO: 1895608 - DNA, 21 bp, Homo sapiens
ttgacaactgaaagaaaaagt

SEQ ID NO: 1895609 - DNA, 23 bp, Homo sapiens
ttgacagagagagatactctggg

SEQ ID NO: 1895610 - DNA, 13 bp, Homo sapiens
ttgactatttctt

SEQ ID NO: 1895611 - DNA, 21 bp, Homo sapiens
ttgactctagtactgtgaatc

SEQ ID NO: 1895612 - DNA, 17 bp, Homo sapiens
ttgagaatagaaatttg

SEQ ID NO: 1895613 - DNA, 23 bp, Homo sapiens
ttgagaatagaaatttgcccctg

SEQ ID NO: 1895614 - DNA, 16 bp, Homo sapiens
ttgagaccgtgaagat

SEQ ID NO: 1895615 - DNA, 22 bp, Homo sapiens
ttgagaccgtgaagatactttg

SEQ ID NO: 1895616 - DNA, 12 bp, Homo sapiens
ttgagataagtt

SEQ ID NO: 1895617 - DNA, 20 bp, Homo sapiens
ttgagataagttttgtttca

SEQ ID NO: 1895618 - DNA, 16 bp, Homo sapiens
ttgagatttacccaga

SEQ ID NO: 1895619 - DNA, 11 bp, Homo sapiens
ttgagctatga

SEQ ID NO: 1895620 - DNA, 16 bp, Homo sapiens
ttgagctatgacttaa

SEQ ID NO: 1895621 - DNA, 22 bp, Homo sapiens
ttgagctcccacttctgccaga

SEQ ID NO: 1895622 - DNA, 18 bp, Homo sapiens
ttgaggattagtttagaa

SEQ ID NO: 1895623 - DNA, 19 bp, Homo sapiens
ttgagggcatttggcttcc

SEQ ID NO: 1895624 - DNA, 20 bp, Homo sapiens
ttgagggcatttggcttcct

SEQ ID NO: 1895625 - DNA, 13 bp, Homo sapiens
ttgagttaacttt

SEQ ID NO: 1895626 - DNA, 19 bp, Homo sapiens
ttgagttaactttttgtag

SEQ ID NO: 1895627 - DNA, 18 bp, Homo sapiens
ttgataacaatgttttaa

SEQ ID NO: 1895628 - DNA, 16 bp, Homo sapiens
ttgataaggaacattt

SEQ ID NO: 1895629 - DNA, 17 bp, Homo sapiens
ttgataattttccttta

SEQ ID NO: 1895630 - DNA, 18 bp, Homo sapiens
ttgattatataagcaaaa

SEQ ID NO: 1895631 - DNA, 13 bp, Homo sapiens
ttgatttattaac

SEQ ID NO: 1895632 - DNA, 19 bp, Homo sapiens
ttgcaaacaactgaaatgt

SEQ ID NO: 1895633 - DNA, 21 bp, Homo sapiens
ttgcaagggcggcctttccca

SEQ ID NO: 1895634 - DNA, 17 bp, Homo sapiens
ttgcacaccagccttac

SEQ ID NO: 1895635 - DNA, 14 bp, Homo sapiens
ttgcagctgtcacc

SEQ ID NO: 1895636 - DNA, 13 bp, Homo sapiens
ttgcagtgtctta

SEQ ID NO: 1895637 - DNA, 14 bp, Homo sapiens
ttgcatataactta

SEQ ID NO: 1895638 - DNA, 22 bp, Homo sapiens
ttgcatataacttatattgtaa

SEQ ID NO: 1895639 - DNA, 20 bp, Homo sapiens
ttgcatctgggtagctgtaa

SEQ ID NO: 1895640 - DNA, 13 bp, Homo sapiens
ttgcattgtctgt

SEQ ID NO: 1895641 - DNA, 18 bp, Homo sapiens
ttgccaggtatttttcta

SEQ ID NO: 1895642 - DNA, 17 bp, Homo sapiens
ttgccatagagtacact

SEQ ID NO: 1895643 - DNA, 23 bp, Homo sapiens
ttgccatagagtacactgcctgc

SEQ ID NO: 1895644 - DNA, 22 bp, Homo sapiens
ttgccatgcttcagtgaacata

SEQ ID NO: 1895645 - DNA, 13 bp, Homo sapiens
ttgccatgtgctt

SEQ ID NO: 1895646 - DNA, 17 bp, Homo sapiens
ttgcccaggctggagtg

SEQ ID NO: 1895647 - DNA, 19 bp, Homo sapiens
ttgcctcagcttccccagt

SEQ ID NO: 1895648 - DNA, 21 bp, Homo sapiens
ttgcgaatattttgtaaatta

SEQ ID NO: 1895649 - DNA, 12 bp, Homo sapiens
ttgctaataatg

SEQ ID NO: 1895650 - DNA, 18 bp, Homo sapiens
ttgctgaaagatatgtat

SEQ ID NO: 1895651 - DNA, 20 bp, Homo sapiens
ttgctgattttgaccttgta

SEQ ID NO: 1895652 - DNA, 17 bp, Homo sapiens
ttgctgtagtgtttctt

SEQ ID NO: 1895653 - DNA, 12 bp, Homo sapiens
ttgctgtggcct

SEQ ID NO: 1895654 - DNA, 20 bp, Homo sapiens
ttgcttagtatctaataatg

SEQ ID NO: 1895655 - DNA, 13 bp, Homo sapiens
ttgctttcctttc

SEQ ID NO: 1895656 - DNA, 19 bp, Homo sapiens
ttggaaagtccaagccgta

SEQ ID NO: 1895657 - DNA, 15 bp, Homo sapiens
ttggaacttacaaag

SEQ ID NO: 1895658 - DNA, 22 bp, Homo sapiens
ttggaagcacaccaatcttact

SEQ ID NO: 1895659 - DNA, 23 bp, Homo sapiens
ttggaatgcactcagactgtata

SEQ ID NO: 1895660 - DNA, 14 bp, Homo sapiens
ttggagggcctggg

SEQ ID NO: 1895661 - DNA, 16 bp, Homo sapiens
ttggcaaatttgtgaa

SEQ ID NO: 1895662 - DNA, 18 bp, Homo sapiens
ttggcaataaattttgaa

SEQ ID NO: 1895663 - DNA, 21 bp, Homo sapiens
ttggcccagggggcttcctga

SEQ ID NO: 1895664 - DNA, 12 bp, Homo sapiens
ttggcttacatt

SEQ ID NO: 1895665 - DNA, 19 bp, Homo sapiens
ttggcttcctctgctgcat

SEQ ID NO: 1895666 - DNA, 13 bp, Homo sapiens
ttggcttggccct

SEQ ID NO: 1895667 - DNA, 20 bp, Homo sapiens
ttgggacccagtggcagggc

SEQ ID NO: 1895668 - DNA, 15 bp, Homo sapiens
ttgggactgctgtga

SEQ ID NO: 1895669 - DNA, 13 bp, Homo sapiens
ttgggcctcccac

SEQ ID NO: 1895670 - DNA, 14 bp, Homo sapiens
ttgggctggcgggc

SEQ ID NO: 1895671 - DNA, 23 bp, Homo sapiens
ttgggctggcgggccctggagct

SEQ ID NO: 1895672 - DNA, 13 bp, Homo sapiens
ttggtactgtaat

SEQ ID NO: 1895673 - DNA, 15 bp, Homo sapiens
ttggtatttgtttaa

SEQ ID NO: 1895674 - DNA, 13 bp, Homo sapiens
ttggttgaataaa

SEQ ID NO: 1895675 - DNA, 12 bp, Homo sapiens
ttggttttatga

SEQ ID NO: 1895676 - DNA, 15 bp, Homo sapiens
ttggttttctactgt

SEQ ID NO: 1895677 - DNA, 19 bp, Homo sapiens
ttgtaaaagcattttgtaa

SEQ ID NO: 1895678 - DNA, 14 bp, Homo sapiens
ttgtaaatgacttt

SEQ ID NO: 1895679 - DNA, 13 bp, Homo sapiens
ttgtaaattctga

SEQ ID NO: 1895680 - DNA, 13 bp, Homo sapiens
ttgtaagaaatac

SEQ ID NO: 1895681 - DNA, 14 bp, Homo sapiens
ttgtaagaaatact

SEQ ID NO: 1895682 - DNA, 17 bp, Homo sapiens
ttgtaagcgtatggctt

SEQ ID NO: 1895683 - DNA, 15 bp, Homo sapiens
ttgtaataataaaga

SEQ ID NO: 1895684 - DNA, 14 bp, Homo sapiens
ttgtaatatgtaaa

SEQ ID NO: 1895685 - DNA, 19 bp, Homo sapiens
ttgtaatgtatacttgaaa

SEQ ID NO: 1895686 - DNA, 20 bp, Homo sapiens
ttgtaattcagaaatccttg

SEQ ID NO: 1895687 - DNA, 12 bp, Homo sapiens
ttgtagaacttg

SEQ ID NO: 1895688 - DNA, 13 bp, Homo sapiens
ttgtaggatactt

SEQ ID NO: 1895689 - DNA, 16 bp, Homo sapiens
ttgtatagttatgtaa

SEQ ID NO: 1895690 - DNA, 20 bp, Homo sapiens
ttgtatagttatgtaaataa

SEQ ID NO: 1895691 - DNA, 22 bp, Homo sapiens
ttgtatagttatgtaaataatt

SEQ ID NO: 1895692 - DNA, 15 bp, Homo sapiens
ttgtatatgctgcat

SEQ ID NO: 1895693 - DNA, 19 bp, Homo sapiens
ttgtatattggttttatga

SEQ ID NO: 1895694 - DNA, 12 bp, Homo sapiens
ttgtatgaaaac

SEQ ID NO: 1895695 - DNA, 15 bp, Homo sapiens
ttgtattatcaatga

SEQ ID NO: 1895696 - DNA, 22 bp, Homo sapiens
ttgtcaagaatagcattgtaaa

SEQ ID NO: 1895697 - DNA, 20 bp, Homo sapiens
tttgtgaaacagacttgtat

SEQ ID NO: 1895698 - DNA, 22 bp, Homo sapiens
tttgtgaacaagtccctgtaat

SEQ ID NO: 1895699 - DNA, 13 bp, Homo sapiens
tttgtgaactgtc

SEQ ID NO: 1895700 - DNA, 17 bp, Homo sapiens
tttgtgaactgtcatga

SEQ ID NO: 1895701 - DNA, 16 bp, Homo sapiens
tttgtgatgtactgta

SEQ ID NO: 1895702 - DNA, 12 bp, Homo sapiens
tttgtgtaaatt

SEQ ID NO: 1895703 - DNA, 21 bp, Homo sapiens
tttgtgtaaattattgatgaa

SEQ ID NO: 1895704 - DNA, 15 bp, Homo sapiens
tttgtttaaggttaa

SEQ ID NO: 1895705 - DNA, 18 bp, Homo sapiens
tttgttttttgtttttct

SEQ ID NO: 1895706 - DNA, 16 bp, Homo sapiens
ttttaacaagaagcaa

SEQ ID NO: 1895707 - DNA, 18 bp, Homo sapiens
ttttaagaaagaaatact

SEQ ID NO: 1895708 - DNA, 15 bp, Homo sapiens
ttttaaggactgact

SEQ ID NO: 1895709 - DNA, 16 bp, Homo sapiens
ttttaaggactgactg

SEQ ID NO: 1895710 - DNA, 19 bp, Homo sapiens
ttttaaggactgactgagg

SEQ ID NO: 1895711 - DNA, 19 bp, Homo sapiens
ttttaaggatggcacagta

SEQ ID NO: 1895712 - DNA, 21 bp, Homo sapiens
ttttaagtggactctctgaca

SEQ ID NO: 1895713 - DNA, 21 bp, Homo sapiens
ttttaatgctaatcttgtgaa

SEQ ID NO: 1895714 - DNA, 13 bp, Homo sapiens
ttttaattgtatt

SEQ ID NO: 1895715 - DNA, 19 bp, Homo sapiens
ttttagaatgtcaataaat

SEQ ID NO: 1895716 - DNA, 22 bp, Homo sapiens
ttttagaattacaccacaagta

SEQ ID NO: 1895717 - DNA, 18 bp, Homo sapiens
ttttagaattttgtgaaa

SEQ ID NO: 1895718 - DNA, 23 bp, Homo sapiens
ttttagcacagcgttatgtgtct

SEQ ID NO: 1895719 - DNA, 16 bp, Homo sapiens
ttttagttctgacttt

SEQ ID NO: 1895720 - DNA, 18 bp, Homo sapiens
ttttagttctgactttga

SEQ ID NO: 1895721 - DNA, 13 bp, Homo sapiens
ttttataatgact

SEQ ID NO: 1895722 - DNA, 13 bp, Homo sapiens
ttttatatgtgga

SEQ ID NO: 1895723 - DNA, 21 bp, Homo sapiens
tgtcaagaatagcattgtaaa

SEQ ID NO: 1895724 - DNA, 15 bp, Homo sapiens
tgtcagggttggaaa

SEQ ID NO: 1895725 - DNA, 14 bp, Homo sapiens
tgtcagtgtttggt

SEQ ID NO: 1895726 - DNA, 17 bp, Homo sapiens
tgtcatggatagatttt

SEQ ID NO: 1895727 - DNA, 23 bp, Homo sapiens
tgtcattcgctactatgatttaa

SEQ ID NO: 1895728 - DNA, 10 bp, Homo sapiens
tgtcccaggc

SEQ ID NO: 1895729 - DNA, 14 bp, Homo sapiens
tgtcccaggcagcg

SEQ ID NO: 1895730 - DNA, 21 bp, Homo sapiens
tgtcccaggcagcgccactgt

SEQ ID NO: 1895731 - DNA, 15 bp, Homo sapiens
tgtcctaatggtgat

SEQ ID NO: 1895732 - DNA, 16 bp, Homo sapiens
tgtcctattagtgtta

SEQ ID NO: 1895733 - DNA, 18 bp, Homo sapiens
tgtcggggtcaagctgga

SEQ ID NO: 1895734 - DNA, 22 bp, Homo sapiens
tgtctactctaggactgggccc

SEQ ID NO: 1895735 - DNA, 15 bp, Homo sapiens
tgtctagattttgaa

SEQ ID NO: 1895736 - DNA, 19 bp, Homo sapiens
tgtctattcaaaatatcaa

SEQ ID NO: 1895737 - DNA, 13 bp, Homo sapiens
tgtctcaagtgca

SEQ ID NO: 1895738 - DNA, 23 bp, Homo sapiens
tgtctcaagtgcaatgccccctc

SEQ ID NO: 1895739 - DNA, 14 bp, Homo sapiens
tgtctccctcctga

SEQ ID NO: 1895740 - DNA, 13 bp, Homo sapiens
tgtctcggcagag

SEQ ID NO: 1895741 - DNA, 16 bp, Homo sapiens
tgtctgccacattaac

SEQ ID NO: 1895742 - DNA, 18 bp, Homo sapiens
tgtctggcacagcctgca

SEQ ID NO: 1895743 - DNA, 14 bp, Homo sapiens
tgtctggccaggga

SEQ ID NO: 1895744 - DNA, 16 bp, Homo sapiens
tgtctggccagggagg

SEQ ID NO: 1895745 - DNA, 18 bp, Homo sapiens
tgtcttgcgggtctgtca

SEQ ID NO: 1895746 - DNA, 22 bp, Homo sapiens
tgtgaacatgcctcctcctgcc

SEQ ID NO: 1895747 - DNA, 17 bp, Homo sapiens
tgtgaactgtcatgata

SEQ ID NO: 1895748 - DNA, 18 bp, Homo sapiens
tgtgaacttggaagcaca

SEQ ID NO: 1895749 - DNA, 13 bp, Homo sapiens
tgtgacctcacgt

SEQ ID NO: 1895750 - DNA, 12 bp, Homo sapiens
tgtgagaacatt

SEQ ID NO: 1895751 - DNA, 14 bp, Homo sapiens
tgtgagtggttgaa

SEQ ID NO: 1895752 - DNA, 17 bp, Homo sapiens
tgtgatataaacagctt

SEQ ID NO: 1895753 - DNA, 18 bp, Homo sapiens
tgtgcaagcttttcctaa

SEQ ID NO: 1895754 - DNA, 15 bp, Homo sapiens
tgtgcagggtattaa

SEQ ID NO: 1895755 - DNA, 15 bp, Homo sapiens
tgtgctccgtagctt

SEQ ID NO: 1895756 - DNA, 15 bp, Homo sapiens
tgtggagactgctcc

SEQ ID NO: 1895757 - DNA, 18 bp, Homo sapiens
tgtggagactgctcctga

SEQ ID NO: 1895758 - DNA, 16 bp, Homo sapiens
tgtggcagcaggaggg

SEQ ID NO: 1895759 - DNA, 18 bp, Homo sapiens
tgtggcctcttctgagct

SEQ ID NO: 1895760 - DNA, 21 bp, Homo sapiens
tgtgggggccccgtctcaggt

SEQ ID NO: 1895761 - DNA, 17 bp, Homo sapiens
tgtggtccatctctgaa

SEQ ID NO: 1895762 - DNA, 16 bp, Homo sapiens
tgtgtctgccacatta

SEQ ID NO: 1895763 - DNA, 13 bp, Homo sapiens
tgtgttaatttaa

SEQ ID NO: 1895764 - DNA, 15 bp, Homo sapiens
tgtgttccaaccact

SEQ ID NO: 1895765 - DNA, 17 bp, Homo sapiens
tgtgttgcagctgtcac

SEQ ID NO: 1895766 - DNA, 17 bp, Homo sapiens
tgtgtttagaattgaag

SEQ ID NO: 1895767 - DNA, 20 bp, Homo sapiens
tgttaacataggcttataca

SEQ ID NO: 1895768 - DNA, 15 bp, Homo sapiens
tgttaagataattgt

SEQ ID NO: 1895769 - DNA, 22 bp, Homo sapiens
tgttaagataattgtactttga

SEQ ID NO: 1895770 - DNA, 15 bp, Homo sapiens
tgttacaatgtaact

SEQ ID NO: 1895771 - DNA, 21 bp, Homo sapiens
tgttacatagaaagagtctga

SEQ ID NO: 1895772 - DNA, 18 bp, Homo sapiens
tgttactcttgggacatc

SEQ ID NO: 1895773 - DNA, 19 bp, Homo sapiens
tgttacttgctttgagttg

SEQ ID NO: 1895774 - DNA, 17 bp, Homo sapiens
tgttagtattgattcaa

SEQ ID NO: 1895775 - DNA, 12 bp, Homo sapiens
tgttatatgaac

SEQ ID NO: 1895776 - DNA, 20 bp, Homo sapiens
tgttatttttataagaaaac

SEQ ID NO: 1895777 - DNA, 16 bp, Homo sapiens
tgttcagtattgcaat

SEQ ID NO: 1895778 - DNA, 15 bp, Homo sapiens
tgttcattgcacaat

SEQ ID NO: 1895779 - DNA, 18 bp, Homo sapiens
tgttcattgcacaatata

SEQ ID NO: 1895780 - DNA, 18 bp, Homo sapiens
tgttctgggatttctcta

SEQ ID NO: 1895781 - DNA, 14 bp, Homo sapiens
tgttctggtggccc

SEQ ID NO: 1895782 - DNA, 16 bp, Homo sapiens
tgttcttccagtgagg

SEQ ID NO: 1895783 - DNA, 16 bp, Homo sapiens
tgttcttggcaataaa

SEQ ID NO: 1895784 - DNA, 22 bp, Homo sapiens
tgttcttggcaataaattttga

SEQ ID NO: 1895785 - DNA, 23 bp, Homo sapiens
tgttgatgggatgattgaagaaa

SEQ ID NO: 1895786 - DNA, 15 bp, Homo sapiens
tgttgattaaagatg

SEQ ID NO: 1895787 - DNA, 16 bp, Homo sapiens
tgttgattaaagatga

SEQ ID NO: 1895788 - DNA, 15 bp, Homo sapiens
tgttgcagctgtcac

SEQ ID NO: 1895789 - DNA, 16 bp, Homo sapiens
tgttgcagctgtcacc

SEQ ID NO: 1895790 - DNA, 17 bp, Homo sapiens
tgttgcagctgtcacca

SEQ ID NO: 1895791 - DNA, 19 bp, Homo sapiens
tgttgcccaggctggagtg

SEQ ID NO: 1895792 - DNA, 22 bp, Homo sapiens
tgttgcctataagccaaaatta

SEQ ID NO: 1895793 - DNA, 15 bp, Homo sapiens
tgttgctgattttga

SEQ ID NO: 1895794 - DNA, 20 bp, Homo sapiens
tgttgctgattttgaccttg

SEQ ID NO: 1895795 - DNA, 17 bp, Homo sapiens
tgttggcaaatttgtga

SEQ ID NO: 1895796 - DNA, 16 bp, Homo sapiens
tgttggggctcttcct

SEQ ID NO: 1895797 - DNA, 11 bp, Homo sapiens
tgttgtataaa

SEQ ID NO: 1895798 - DNA, 13 bp, Homo sapiens
tgttgtataaatt

SEQ ID NO: 1895799 - DNA, 20 bp, Homo sapiens
tgttgtcaagaatagcattg

SEQ ID NO: 1895800 - DNA, 15 bp, Homo sapiens
tgtttaataccctgt

SEQ ID NO: 1895801 - DNA, 23 bp, Homo sapiens
tgtttagaattgaaggtttttga

SEQ ID NO: 1895802 - DNA, 12 bp, Homo sapiens
tgtttagatttg

SEQ ID NO: 1895803 - DNA, 21 bp, Homo sapiens
tgtttctttctctgaggacaa

SEQ ID NO: 1895804 - DNA, 13 bp, Homo sapiens
tgtttgatgcatt

SEQ ID NO: 1895805 - DNA, 14 bp, Homo sapiens
tgttttattcagct

SEQ ID NO: 1895806 - DNA, 15 bp, Homo sapiens
tgttttgcattgtct

SEQ ID NO: 1895807 - DNA, 20 bp, Homo sapiens
tgttttggtctgaaaagctg

SEQ ID NO: 1895808 - DNA, 19 bp, Homo sapiens
tgttttgtatatgctgcat

SEQ ID NO: 1895809 - DNA, 21 bp, Homo sapiens
tgtttttgtatattggtttta

SEQ ID NO: 1895810 - DNA, 14 bp, Homo sapiens
tgtttttgtattta

SEQ ID NO: 1895811 - DNA, 23 bp, Homo sapiens
ttaaaaagataaaaaaacagctt

SEQ ID NO: 1895812 - DNA, 15 bp, Homo sapiens
ttaaaaataaagcaa

SEQ ID NO: 1895813 - DNA, 13 bp, Homo sapiens
ttaaaaatatcaa

SEQ ID NO: 1895814 - DNA, 23 bp, Homo sapiens
ttaaaacacgttttaaggactga

SEQ ID NO: 1895815 - DNA, 23 bp, Homo sapiens
ttaaaacatcattcctttttatt

SEQ ID NO: 1895816 - DNA, 21 bp, Homo sapiens
ttaaaactgctcatttcatga

SEQ ID NO: 1895817 - DNA, 15 bp, Homo sapiens
ttaaaactttgtaga

SEQ ID NO: 1895818 - DNA, 22 bp, Homo sapiens
ttaaaagaaaataaaaaaaaga

SEQ ID NO: 1895819 - DNA, 23 bp, Homo sapiens
ttaaaagaaaataaaaaaaagaa

SEQ ID NO: 1895820 - DNA, 15 bp, Homo sapiens
ttaaaattttttgag

SEQ ID NO: 1895821 - DNA, 19 bp, Homo sapiens
ttaaatgtcaaatgtgaat

SEQ ID NO: 1895822 - DNA, 22 bp, Homo sapiens
ttaaatttttttgtatgaaaac

SEQ ID NO: 1895823 - DNA, 12 bp, Homo sapiens
ttaacaagaagc

SEQ ID NO: 1895824 - DNA, 19 bp, Homo sapiens
ttaactgttccccttggta

SEQ ID NO: 1895825 - DNA, 14 bp, Homo sapiens
ttaacttaataatc

SEQ ID NO: 1895826 - DNA, 21 bp, Homo sapiens
ttaactttttgtaggatactt

SEQ ID NO: 1895827 - DNA, 23 bp, Homo sapiens
ttaactttttgtaggatacttgc

SEQ ID NO: 1895828 - DNA, 22 bp, Homo sapiens
ttaagaaatagacagcatgaga

SEQ ID NO: 1895829 - DNA, 22 bp, Homo sapiens
ttaagataattgtactttgaaa

SEQ ID NO: 1895830 - DNA, 16 bp, Homo sapiens
ttaagcaataaaactg

SEQ ID NO: 1895831 - DNA, 20 bp, Homo sapiens
ttaagcaataaaactgctag

SEQ ID NO: 1895832 - DNA, 17 bp, Homo sapiens
ttaaggtgtttgaaaat

SEQ ID NO: 1895833 - DNA, 16 bp, Homo sapiens
ttaagtgaggaaatca

SEQ ID NO: 1895834 - DNA, 23 bp, Homo sapiens
ttaagtgaggaaatcaaagtgct

SEQ ID NO: 1895835 - DNA, 20 bp, Homo sapiens
ttaagttagttccactgaga

SEQ ID NO: 1895836 - DNA, 20 bp, Homo sapiens
ttaagttttgacaagctggc

SEQ ID NO: 1895837 - DNA, 23 bp, Homo sapiens
ttaatatgaaattttttttcatg

SEQ ID NO: 1895838 - DNA, 14 bp, Homo sapiens
ttaatcactgtgta

SEQ ID NO: 1895839 - DNA, 20 bp, Homo sapiens
ttaatcactgtgtatatttg

SEQ ID NO: 1895840 - DNA, 15 bp, Homo sapiens
ttaatctactgcatt

SEQ ID NO: 1895841 - DNA, 16 bp, Homo sapiens
ttaatctactgcattt

SEQ ID NO: 1895842 - DNA, 21 bp, Homo sapiens
ttaatctactgcatttaggga

SEQ ID NO: 1895843 - DNA, 23 bp, Homo sapiens
ttaatgctaatcttgtgaaaata

SEQ ID NO: 1895844 - DNA, 22 bp, Homo sapiens
ttaatgtcctctcaaagtaaaa

SEQ ID NO: 1895845 - DNA, 20 bp, Homo sapiens
ttaattgagaatagaaattt

SEQ ID NO: 1895846 - DNA, 15 bp, Homo sapiens
ttaatttaagttttg

SEQ ID NO: 1895847 - DNA, 15 bp, Homo sapiens
ttaattttatatgta

SEQ ID NO: 1895848 - DNA, 21 bp, Homo sapiens
ttacactggcaatggtagttt

SEQ ID NO: 1895849 - DNA, 16 bp, Homo sapiens
ttacactttttggaag

SEQ ID NO: 1895850 - DNA, 19 bp, Homo sapiens
ttacagatgttttccactg

SEQ ID NO: 1895851 - DNA, 22 bp, Homo sapiens
ttacagatgttttccactgagc

SEQ ID NO: 1895852 - DNA, 22 bp, Homo sapiens
ttacattgtgaatgctgtggga

SEQ ID NO: 1895853 - DNA, 20 bp, Homo sapiens
ttacctaaaagctacagaac

SEQ ID NO: 1895854 - DNA, 13 bp, Homo sapiens
ttacctctttgga

SEQ ID NO: 1895855 - DNA, 15 bp, Homo sapiens
ttacctctttggaaa

SEQ ID NO: 1895856 - DNA, 23 bp, Homo sapiens
ttttattaatcactgtgtatatt

SEQ ID NO: 1895857 - DNA, 16 bp, Homo sapiens
ttttatttatatgtat

SEQ ID NO: 1895858 - DNA, 23 bp, Homo sapiens
ttttcaaaattcaaaatactttt

SEQ ID NO: 1895859 - DNA, 22 bp, Homo sapiens
ttttcagacatttttggaaatt

SEQ ID NO: 1895860 - DNA, 14 bp, Homo sapiens
ttttcagattcagg

SEQ ID NO: 1895861 - DNA, 17 bp, Homo sapiens
ttttcatgctttatcaa

SEQ ID NO: 1895862 - DNA, 17 bp, Homo sapiens
ttttccctttcctttcc

SEQ ID NO: 1895863 - DNA, 18 bp, Homo sapiens
ttttccgcattctttgta

SEQ ID NO: 1895864 - DNA, 17 bp, Homo sapiens
ttttccttcagatattt

SEQ ID NO: 1895865 - DNA, 18 bp, Homo sapiens
ttttctatattgcagtgt

SEQ ID NO: 1895866 - DNA, 12 bp, Homo sapiens
ttttctgcttta

SEQ ID NO: 1895867 - DNA, 15 bp, Homo sapiens
ttttctgctttagac

SEQ ID NO: 1895868 - DNA, 19 bp, Homo sapiens
ttttcttatttatgtaaca

SEQ ID NO: 1895869 - DNA, 12 bp, Homo sapiens
ttttcttgataa

SEQ ID NO: 1895870 - DNA, 19 bp, Homo sapiens
ttttcttgataattttcct

SEQ ID NO: 1895871 - DNA, 12 bp, Homo sapiens
ttttctttcctt

SEQ ID NO: 1895872 - DNA, 15 bp, Homo sapiens
ttttctttcctttcc

SEQ ID NO: 1895873 - DNA, 22 bp, Homo sapiens
ttttgaaaaatgcactgggaaa

SEQ ID NO: 1895874 - DNA, 11 bp, Homo sapiens
ttttgaaaagt

SEQ ID NO: 1895875 - DNA, 13 bp, Homo sapiens
ttttgatgtgctt

SEQ ID NO: 1895876 - DNA, 15 bp, Homo sapiens
ttttggttgaataaa

SEQ ID NO: 1895877 - DNA, 14 bp, Homo sapiens
ttttggttttctac

SEQ ID NO: 1895878 - DNA, 22 bp, Homo sapiens
tttttaacaagtcatttcaaaa

SEQ ID NO: 1895879 - DNA, 20 bp, Homo sapiens
tttttaagtgaaaatatagc

SEQ ID NO: 1895880 - DNA, 14 bp, Homo sapiens
tttttataatgact

SEQ ID NO: 1895881 - DNA, 21 bp, Homo sapiens
tttttatatttcaagtacact

SEQ ID NO: 1895882 - DNA, 14 bp, Homo sapiens
tttttatttatatg

SEQ ID NO: 1895883 - DNA, 17 bp, Homo sapiens
tttttatttatatgtat

SEQ ID NO: 1895884 - DNA, 13 bp, Homo sapiens
tttttctgcttta

SEQ ID NO: 1895885 - DNA, 20 bp, Homo sapiens
tttttctgctttagacttga

SEQ ID NO: 1895886 - DNA, 12 bp, Homo sapiens
tttttgaaagca

SEQ ID NO: 1895887 - DNA, 23 bp, Homo sapiens
tttttgaaggcagaaagcaaaat

SEQ ID NO: 1895888 - DNA, 18 bp, Homo sapiens
tttttgcaggagcagtat

SEQ ID NO: 1895889 - DNA, 15 bp, Homo sapiens
tttttggaagtgaaa

SEQ ID NO: 1895890 - DNA, 19 bp, Homo sapiens
tttttggaagtgaaaactt

SEQ ID NO: 1895891 - DNA, 15 bp, Homo sapiens
tttttggacacattt

SEQ ID NO: 1895892 - DNA, 9 bp, Homo sapiens
tttttgtat

SEQ ID NO: 1895893 - DNA, 16 bp, Homo sapiens
tttttgtatcagaatc

SEQ ID NO: 1895894 - DNA, 14 bp, Homo sapiens
ttttttgtatgaaa

SEQ ID NO: 1895895 - DNA, 11 bp, Homo sapiens
aaaaaaaagaa

SEQ ID NO: 1895896 - DNA, 10 bp, Homo sapiens
aaaaaaagag

SEQ ID NO: 1895897 - DNA, 13 bp, Homo sapiens
aaaaaaatctaaa

SEQ ID NO: 1895898 - DNA, 13 bp, Homo sapiens
aaaaaaatgctga

SEQ ID NO: 1895899 - DNA, 21 bp, Homo sapiens
aaaaaatatatgacagattat

SEQ ID NO: 1895900 - DNA, 13 bp, Homo sapiens
aaaaagaaaaaag

SEQ ID NO: 1895901 - DNA, 12 bp, Homo sapiens
aaaaagaaatta

SEQ ID NO: 1895902 - DNA, 20 bp, Homo sapiens
aaaaaggcttataaaacaga

SEQ ID NO: 1895903 - DNA, 14 bp, Homo sapiens
aaaaatatcaaatt

SEQ ID NO: 1895904 - DNA, 15 bp, Homo sapiens
aaaaatatctgtaag

SEQ ID NO: 1895905 - DNA, 18 bp, Homo sapiens
aaaaatgtcaaaagtaga

SEQ ID NO: 1895906 - DNA, 23 bp, Homo sapiens
aaaaatgtcaaaagtagaacttt

SEQ ID NO: 1895907 - DNA, 18 bp, Homo sapiens
aaaaatgttaagcatcta

SEQ ID NO: 1895908 - DNA, 22 bp, Homo sapiens
aaaaatgttaagcatctaagga

SEQ ID NO: 1895909 - DNA, 16 bp, Homo sapiens
aaaacaaataatatct

SEQ ID NO: 1895910 - DNA, 22 bp, Homo sapiens
aaaacaagagactgcttgacaa

SEQ ID NO: 1895911 - DNA, 17 bp, Homo sapiens
aaaacaccagctgtata

SEQ ID NO: 1895912 - DNA, 22 bp, Homo sapiens
aaaacaccagctgtatatattt

SEQ ID NO: 1895913 - DNA, 18 bp, Homo sapiens
aaaacagagtaatcttgt

SEQ ID NO: 1895914 - DNA, 19 bp, Homo sapiens
aaaacagagtaatcttgtt

SEQ ID NO: 1895915 - DNA, 18 bp, Homo sapiens
aaaacagtagtgtattaa

SEQ ID NO: 1895916 - DNA, 19 bp, Homo sapiens
aaaacatcattccttttta

SEQ ID NO: 1895917 - DNA, 14 bp, Homo sapiens
aaaaccaatcaata

SEQ ID NO: 1895918 - DNA, 17 bp, Homo sapiens
aaaactattaagtatgt

SEQ ID NO: 1895919 - DNA, 22 bp, Homo sapiens
aaaactgctagtgagttattgt

SEQ ID NO: 1895920 - DNA, 22 bp, Homo sapiens
aaaactgctcatttcatgaagc

SEQ ID NO: 1895921 - DNA, 12 bp, Homo sapiens
aaaagaaaaaaa

SEQ ID NO: 1895922 - DNA, 10 bp, Homo sapiens
aaaagaaaga

SEQ ID NO: 1895923 - DNA, 11 bp, Homo sapiens
aaaagaaagaa

SEQ ID NO: 1895924 - DNA, 16 bp, Homo sapiens
aaaagaacagtaaaca

SEQ ID NO: 1895925 - DNA, 19 bp, Homo sapiens
aaaagacgcaccagcccag

SEQ ID NO: 1895926 - DNA, 22 bp, Homo sapiens
aaaagagaacttttttcaaaat

SEQ ID NO: 1895927 - DNA, 13 bp, Homo sapiens
aaaagatgtagat

SEQ ID NO: 1895928 - DNA, 22 bp, Homo sapiens
aaaagatgtagatttatttcat

SEQ ID NO: 1895929 - DNA, 16 bp, Homo sapiens
aacaaagaccaatttt

SEQ ID NO: 1895930 - DNA, 21 bp, Homo sapiens
aacaaagaccaattttttgtg

SEQ ID NO: 1895931 - DNA, 22 bp, Homo sapiens
aacaaaggcctaattctatgcc

SEQ ID NO: 1895932 - DNA, 17 bp, Homo sapiens
aacaaagtttgctgaaa

SEQ ID NO: 1895933 - DNA, 21 bp, Homo sapiens
aacaaattttggttttctact

SEQ ID NO: 1895934 - DNA, 19 bp, Homo sapiens
aacaacttatgactaaaaa

SEQ ID NO: 1895935 - DNA, 22 bp, Homo sapiens
aacaagcctgagggaggaggca

SEQ ID NO: 1895936 - DNA, 16 bp, Homo sapiens
aacaagtccctgtaat

SEQ ID NO: 1895937 - DNA, 22 bp, Homo sapiens
aacaagttgagctatgacttaa

SEQ ID NO: 1895938 - DNA, 22 bp, Homo sapiens
aacaatgtgtctatttctgaaa

SEQ ID NO: 1895939 - DNA, 22 bp, Homo sapiens
aacaattctcccgggactctgc

SEQ ID NO: 1895940 - DNA, 15 bp, Homo sapiens
aacaattttctagat

SEQ ID NO: 1895941 - DNA, 16 bp, Homo sapiens
aacaccagctgtatat

SEQ ID NO: 1895942 - DNA, 19 bp, Homo sapiens
aacaccttctatagcatca

SEQ ID NO: 1895943 - DNA, 20 bp, Homo sapiens
aacactcattcttttttcta

SEQ ID NO: 1895944 - DNA, 14 bp, Homo sapiens
aacactttaatggg

SEQ ID NO: 1895945 - DNA, 13 bp, Homo sapiens
aacagaagtgcat

SEQ ID NO: 1895946 - DNA, 14 bp, Homo sapiens
aacagaagtgcatc

SEQ ID NO: 1895947 - DNA, 17 bp, Homo sapiens
aacagattcttttatgt

SEQ ID NO: 1895948 - DNA, 14 bp, Homo sapiens
aacagatttggaaa

SEQ ID NO: 1895949 - DNA, 15 bp, Homo sapiens
aacagcaagtgtgaa

SEQ ID NO: 1895950 - DNA, 16 bp, Homo sapiens
aacagcaagtgtgaat

SEQ ID NO: 1895951 - DNA, 22 bp, Homo sapiens
aacagggtctctagtgctgtga

SEQ ID NO: 1895952 - DNA, 12 bp, Homo sapiens
aacagtgccagc

SEQ ID NO: 1895953 - DNA, 14 bp, Homo sapiens
aacatcattccttt

SEQ ID NO: 1895954 - DNA, 21 bp, Homo sapiens
aacatcattcctttttattta

SEQ ID NO: 1895955 - DNA, 18 bp, Homo sapiens
aacatgcctcctcctgcc

SEQ ID NO: 1895956 - DNA, 23 bp, Homo sapiens
aacatggttcaggtacacatatt

SEQ ID NO: 1895957 - DNA, 22 bp, Homo sapiens
aacattgcatataacttatatt

SEQ ID NO: 1895958 - DNA, 14 bp, Homo sapiens
aacattgtagcctc

SEQ ID NO: 1895959 - DNA, 17 bp, Homo sapiens
aaccaacaacaatgtgt

SEQ ID NO: 1895960 - DNA, 16 bp, Homo sapiens
aaccaatcaataatag

SEQ ID NO: 1895961 - DNA, 13 bp, Homo sapiens
aaccactgaatct

SEQ ID NO: 1895962 - DNA, 22 bp, Homo sapiens
aaccacttaaaatgatcaaggc

SEQ ID NO: 1895963 - DNA, 17 bp, Homo sapiens
aaccacttgtagatttg

SEQ ID NO: 1895964 - DNA, 18 bp, Homo sapiens
aaccacttgtagatttga

SEQ ID NO: 1895965 - DNA, 21 bp, Homo sapiens
aaccacttgtagatttgattt

SEQ ID NO: 1895966 - DNA, 14 bp, Homo sapiens
aaccaggctttcta

SEQ ID NO: 1895967 - DNA, 16 bp, Homo sapiens
aaccagttgttttgtc

SEQ ID NO: 1895968 - DNA, 14 bp, Homo sapiens
aacccaaaggaccc

SEQ ID NO: 1895969 - DNA, 20 bp, Homo sapiens
aacccctggaccccagcctc

SEQ ID NO: 1895970 - DNA, 17 bp, Homo sapiens
aacccctgtaggcctca

SEQ ID NO: 1895971 - DNA, 23 bp, Homo sapiens
aaccgaagggactggatctgcag

SEQ ID NO: 1895972 - DNA, 19 bp, Homo sapiens
aaccttggcttggccctgg

SEQ ID NO: 1895973 - DNA, 15 bp, Homo sapiens
aacgtaatcaaatat

SEQ ID NO: 1895974 - DNA, 21 bp, Homo sapiens
aacgtaatcaaatatgtggtc

SEQ ID NO: 1895975 - DNA, 22 bp, Homo sapiens
aactaggattataatgctgcct

SEQ ID NO: 1895976 - DNA, 22 bp, Homo sapiens
aactaggtctgatattcaaatg

SEQ ID NO: 1895977 - DNA, 20 bp, Homo sapiens
aactatgacgtagcgagtta

SEQ ID NO: 1895978 - DNA, 15 bp, Homo sapiens
aactatttaaagaaa

SEQ ID NO: 1895979 - DNA, 13 bp, Homo sapiens
aactcaaatcccc

SEQ ID NO: 1895980 - DNA, 16 bp, Homo sapiens
aactctgttacacttt

SEQ ID NO: 1895981 - DNA, 16 bp, Homo sapiens
aactgcagaaaaaata

SEQ ID NO: 1895982 - DNA, 11 bp, Homo sapiens
aactgctgctg

SEQ ID NO: 1895983 - DNA, 22 bp, Homo sapiens
aactgctgctgacccctgtgtg

SEQ ID NO: 1895984 - DNA, 19 bp, Homo sapiens
aactgcttcctttcttgat

SEQ ID NO: 1895985 - DNA, 15 bp, Homo sapiens
aactgctttctttcg

SEQ ID NO: 1895986 - DNA, 15 bp, Homo sapiens
aactggaataagcct

SEQ ID NO: 1895987 - DNA, 19 bp, Homo sapiens
aactgggcatatttctaat

SEQ ID NO: 1895988 - DNA, 22 bp, Homo sapiens
aactgtcatgatacgcttaagg

SEQ ID NO: 1895989 - DNA, 14 bp, Homo sapiens
aactgttgtataaa

SEQ ID NO: 1895990 - DNA, 19 bp, Homo sapiens
aactgttgtataaatttat

SEQ ID NO: 1895991 - DNA, 18 bp, Homo sapiens
aacttaaatgaacacagc

SEQ ID NO: 1895992 - DNA, 13 bp, Homo sapiens
aacttaataatca

SEQ ID NO: 1895993 - DNA, 23 bp, Homo sapiens
aacttaccctgtatatcagggta

SEQ ID NO: 1895994 - DNA, 15 bp, Homo sapiens
aacttatattgtaag

SEQ ID NO: 1895995 - DNA, 15 bp, Homo sapiens
aacttatgactaaaa

SEQ ID NO: 1895996 - DNA, 20 bp, Homo sapiens
aacttcctttgactttctgt

SEQ ID NO: 1895997 - DNA, 22 bp, Homo sapiens
aactttgtagacattttgaaat

SEQ ID NO: 1895998 - DNA, 15 bp, Homo sapiens
aactttgtatagtta

SEQ ID NO: 1895999 - DNA, 20 bp, Homo sapiens
aactttgtatagttatgtaa

SEQ ID NO: 1896000 - DNA, 21 bp, Homo sapiens
aactttgtatagttatgtaaa

SEQ ID NO: 1896001 - DNA, 20 bp, Homo sapiens
aagaaaaaaatgtcaaaagt

SEQ ID NO: 1896002 - DNA, 20 bp, Homo sapiens
aagaaaaaagagaaaagaaa

SEQ ID NO: 1896003 - DNA, 13 bp, Homo sapiens
aagaaaaccaaac

SEQ ID NO: 1896004 - DNA, 18 bp, Homo sapiens
aagaaaataaaaaaaaga

SEQ ID NO: 1896005 - DNA, 21 bp, Homo sapiens
aagaaaataaaaaaaagaaaa

SEQ ID NO: 1896006 - DNA, 23 bp, Homo sapiens
aagaaaataaaaaaaagaaaaaa

SEQ ID NO: 1896007 - DNA, 19 bp, Homo sapiens
aagaaactctatggtctta

SEQ ID NO: 1896008 - DNA, 21 bp, Homo sapiens
aagaaactctatggtcttata

SEQ ID NO: 1896009 - DNA, 15 bp, Homo sapiens
aagaaattgtccttg

SEQ ID NO: 1896010 - DNA, 11 bp, Homo sapiens
aagaataattt

SEQ ID NO: 1896011 - DNA, 18 bp, Homo sapiens
aagaatagcattgtaaaa

SEQ ID NO: 1896012 - DNA, 13 bp, Homo sapiens
aagaatgtaaagc

SEQ ID NO: 1896013 - DNA, 14 bp, Homo sapiens
aagaattcagattg

SEQ ID NO: 1896014 - DNA, 13 bp, Homo sapiens
aagaatttaaaga

SEQ ID NO: 1896015 - DNA, 23 bp, Homo sapiens
aagacctggggctgctgtgaagc

SEQ ID NO: 1896016 - DNA, 16 bp, Homo sapiens
aagacgcaccagccca

SEQ ID NO: 1896017 - DNA, 13 bp, Homo sapiens
aagacttaatatg

SEQ ID NO: 1896018 - DNA, 14 bp, Homo sapiens
aagacttaatatgt

SEQ ID NO: 1896019 - DNA, 13 bp, Homo sapiens
aagagaaaagaaa

SEQ ID NO: 1896020 - DNA, 16 bp, Homo sapiens
aagagaaaagaaaaaa

SEQ ID NO: 1896021 - DNA, 11 bp, Homo sapiens
aagagaaactt

SEQ ID NO: 1896022 - DNA, 19 bp, Homo sapiens
aagagaaacttaaatgaac

SEQ ID NO: 1896023 - DNA, 17 bp, Homo sapiens
aagagacaatttctgca

SEQ ID NO: 1896024 - DNA, 13 bp, Homo sapiens
aagagacagggcc

SEQ ID NO: 1896025 - DNA, 23 bp, Homo sapiens
aagagagtagctcgtcctcactg

SEQ ID NO: 1896026 - DNA, 17 bp, Homo sapiens
aagagccccactctcag

SEQ ID NO: 1896027 - DNA, 13 bp, Homo sapiens
aagaggaaaagaa

SEQ ID NO: 1896028 - DNA, 17 bp, Homo sapiens
aagaggaggcaggagga

SEQ ID NO: 1896029 - DNA, 19 bp, Homo sapiens
aagagtttgtaaatgactt

SEQ ID NO: 1896030 - DNA, 18 bp, Homo sapiens
aagataattgtactttga

SEQ ID NO: 1896031 - DNA, 12 bp, Homo sapiens
aagatactttgt

SEQ ID NO: 1896032 - DNA, 14 bp, Homo sapiens
aagatactttgtat

SEQ ID NO: 1896033 - DNA, 16 bp, Homo sapiens
aagatactttgtattg

SEQ ID NO: 1896034 - DNA, 12 bp, Homo sapiens
aagatatgtata

SEQ ID NO: 1896035 - DNA, 16 bp, Homo sapiens
aagatatttttatagg

SEQ ID NO: 1896036 - DNA, 21 bp, Homo sapiens
aagatcaaaaaggcttataaa

SEQ ID NO: 1896037 - DNA, 14 bp, Homo sapiens
aagatcactgttta

SEQ ID NO: 1896038 - DNA, 13 bp, Homo sapiens
aagatgacacaag

SEQ ID NO: 1896039 - DNA, 22 bp, Homo sapiens
aagatgtagatttatttcatca

SEQ ID NO: 1896040 - DNA, 15 bp, Homo sapiens
aagatgttctggata

SEQ ID NO: 1896041 - DNA, 17 bp, Homo sapiens
aagcaaaatgaaaagag

SEQ ID NO: 1896042 - DNA, 11 bp, Homo sapiens
aagcaataaaa

SEQ ID NO: 1896043 - DNA, 16 bp, Homo sapiens
aagcaataaaactgct

SEQ ID NO: 1896044 - DNA, 19 bp, Homo sapiens
aagcacaccaatcttactt

SEQ ID NO: 1896045 - DNA, 17 bp, Homo sapiens
aagcagcataaagaatt

SEQ ID NO: 1896046 - DNA, 18 bp, Homo sapiens
aagcagtgcccaggtggc

SEQ ID NO: 1896047 - DNA, 17 bp, Homo sapiens
aagcatctaaggacaag

SEQ ID NO: 1896048 - DNA, 16 bp, Homo sapiens
aagcatctctgaccag

SEQ ID NO: 1896049 - DNA, 20 bp, Homo sapiens
aagccaaaattaaggtgttt

SEQ ID NO: 1896050 - DNA, 14 bp, Homo sapiens
aagccatgagaatg

SEQ ID NO: 1896051 - DNA, 15 bp, Homo sapiens
aagcctcaaaacaaa

SEQ ID NO: 1896052 - DNA, 16 bp, Homo sapiens
aagcctcaaaacaaag

SEQ ID NO: 1896053 - DNA, 18 bp, Homo sapiens
aagcctcaaaacaaaggc

SEQ ID NO: 1896054 - DNA, 15 bp, Homo sapiens
aagcctgagggagga

SEQ ID NO: 1896055 - DNA, 19 bp, Homo sapiens
aagcctgagggaggaggca

SEQ ID NO: 1896056 - DNA, 12 bp, Homo sapiens
aagcctggcagg

SEQ ID NO: 1896057 - DNA, 13 bp, Homo sapiens
aagcgccctggcc

SEQ ID NO: 1896058 - DNA, 13 bp, Homo sapiens
aagcgtatggctt

SEQ ID NO: 1896059 - DNA, 21 bp, Homo sapiens
aagctaacagcagtttcaggt

SEQ ID NO: 1896060 - DNA, 13 bp, Homo sapiens
aagctagttgaat

SEQ ID NO: 1896061 - DNA, 20 bp, Homo sapiens
aagctagttgaatacttgaa

SEQ ID NO: 1896062 - DNA, 21 bp, Homo sapiens
aagctagttgaatacttgaac

SEQ ID NO: 1896063 - DNA, 23 bp, Homo sapiens
aagctctgaattcaggtcccagt

SEQ ID NO: 1896064 - DNA, 19 bp, Homo sapiens
aagctgaggctgctgccag

SEQ ID NO: 1896065 - DNA, 16 bp, Homo sapiens
aagctgcatatgccta

SEQ ID NO: 1896066 - DNA, 14 bp, Homo sapiens
aaaagcccaggagc

SEQ ID NO: 1896067 - DNA, 20 bp, Homo sapiens
aaaagctgtgtactttatag

SEQ ID NO: 1896068 - DNA, 11 bp, Homo sapiens
aaaaggcccag

SEQ ID NO: 1896069 - DNA, 19 bp, Homo sapiens
aaaaggcttataaaacaga

SEQ ID NO: 1896070 - DNA, 20 bp, Homo sapiens
aaaaggcttataaaacagag

SEQ ID NO: 1896071 - DNA, 18 bp, Homo sapiens
aaaagtagaactttgtat

SEQ ID NO: 1896072 - DNA, 20 bp, Homo sapiens
aaaagtagaactttgtatag

SEQ ID NO: 1896073 - DNA, 22 bp, Homo sapiens
aaaataagaaaagatgtagatt

SEQ ID NO: 1896074 - DNA, 13 bp, Homo sapiens
aaaataattttgt

SEQ ID NO: 1896075 - DNA, 13 bp, Homo sapiens
aaaatatagctaa

SEQ ID NO: 1896076 - DNA, 17 bp, Homo sapiens
aaaatctgccacctgca

SEQ ID NO: 1896077 - DNA, 18 bp, Homo sapiens
aaaatgaaaagagaaact

SEQ ID NO: 1896078 - DNA, 16 bp, Homo sapiens
aaaatgctgaacattg

SEQ ID NO: 1896079 - DNA, 18 bp, Homo sapiens
aaaatgctgaacattgca

SEQ ID NO: 1896080 - DNA, 23 bp, Homo sapiens
aaaatgtagctgcgtcataagga

SEQ ID NO: 1896081 - DNA, 22 bp, Homo sapiens
aaaatgtcaaaagtagaacttt

SEQ ID NO: 1896082 - DNA, 23 bp, Homo sapiens
aaaatgtccagtaagatcactgt

SEQ ID NO: 1896083 - DNA, 18 bp, Homo sapiens
aaaattaaggtgtttgaa

SEQ ID NO: 1896084 - DNA, 17 bp, Homo sapiens
aaaattccagaatgaag

SEQ ID NO: 1896085 - DNA, 14 bp, Homo sapiens
aaacaaatggaaga

SEQ ID NO: 1896086 - DNA, 15 bp, Homo sapiens
aaacaataaagcaat

SEQ ID NO: 1896087 - DNA, 23 bp, Homo sapiens
aaacaccagctgtatatattttt

SEQ ID NO: 1896088 - DNA, 14 bp, Homo sapiens
aaacaccttctata

SEQ ID NO: 1896089 - DNA, 18 bp, Homo sapiens
aaacacgttttaaggact

SEQ ID NO: 1896090 - DNA, 22 bp, Homo sapiens
aaacacgttttaaggactgact

SEQ ID NO: 1896091 - DNA, 16 bp, Homo sapiens
aaacagaagtgcatcc

SEQ ID NO: 1896092 - DNA, 17 bp, Homo sapiens
aaacagagtaatcttgt

SEQ ID NO: 1896093 - DNA, 20 bp, Homo sapiens
aaacatcattcctttttatt

SEQ ID NO: 1896094 - DNA, 21 bp, Homo sapiens
aaacatcattcctttttattt

SEQ ID NO: 1896095 - DNA, 22 bp, Homo sapiens
aaacatgttgccaaaatggtgg

SEQ ID NO: 1896096 - DNA, 19 bp, Homo sapiens
aaacattggcataattttt

SEQ ID NO: 1896097 - DNA, 17 bp, Homo sapiens
aaaccaatcaataatag

SEQ ID NO: 1896098 - DNA, 17 bp, Homo sapiens
aaaccaggctttctaga

SEQ ID NO: 1896099 - DNA, 14 bp, Homo sapiens
aaaccttactctga

SEQ ID NO: 1896100 - DNA, 18 bp, Homo sapiens
aaacgtataatatgtaca

SEQ ID NO: 1896101 - DNA, 15 bp, Homo sapiens
aaactccagatgcca

SEQ ID NO: 1896102 - DNA, 22 bp, Homo sapiens
aaactccagatgccacaatgga

SEQ ID NO: 1896103 - DNA, 18 bp, Homo sapiens
aaactctatttagatgca

SEQ ID NO: 1896104 - DNA, 23 bp, Homo sapiens
aaacttggatcagatagcaggag

SEQ ID NO: 1896105 - DNA, 9 bp, Homo sapiens
aaagaaaaa

SEQ ID NO: 1896106 - DNA, 18 bp, Homo sapiens
aaagaaaaaaaagaaagc

SEQ ID NO: 1896107 - DNA, 15 bp, Homo sapiens
aaagaaagaggaaaa

SEQ ID NO: 1896108 - DNA, 15 bp, Homo sapiens
aaagaaattagccta

SEQ ID NO: 1896109 - DNA, 15 bp, Homo sapiens
aaagaacagtaaaca

SEQ ID NO: 1896110 - DNA, 18 bp, Homo sapiens
aaagaacgctgatttaaa

SEQ ID NO: 1896111 - DNA, 16 bp, Homo sapiens
aaagaatagaagctaa

SEQ ID NO: 1896112 - DNA, 17 bp, Homo sapiens
aaagaatctgatactta

SEQ ID NO: 1896113 - DNA, 13 bp, Homo sapiens
aaagaatgtaaag

SEQ ID NO: 1896114 - DNA, 12 bp, Homo sapiens
aaagagaaactt

SEQ ID NO: 1896115 - DNA, 18 bp, Homo sapiens
aaagaggtcgcttgggaa

SEQ ID NO: 1896116 - DNA, 13 bp, Homo sapiens
aaagatatgtata

SEQ ID NO: 1896117 - DNA, 16 bp, Homo sapiens
aaagatgttctggata

SEQ ID NO: 1896118 - DNA, 22 bp, Homo sapiens
aaagattctgaccttaaatgca

SEQ ID NO: 1896119 - DNA, 13 bp, Homo sapiens
aaagcattttgta

SEQ ID NO: 1896120 - DNA, 14 bp, Homo sapiens
aaagcattttgtaa

SEQ ID NO: 1896121 - DNA, 12 bp, Homo sapiens
aaagcccaggag

SEQ ID NO: 1896122 - DNA, 15 bp, Homo sapiens
aaagcccaggagccc

SEQ ID NO: 1896123 - DNA, 19 bp, Homo sapiens
aaagctagtcaacagtacc

SEQ ID NO: 1896124 - DNA, 22 bp, Homo sapiens
aaagctcgtccccattgcttaa

SEQ ID NO: 1896125 - DNA, 20 bp, Homo sapiens
aaaggaaacaaactctcaaa

SEQ ID NO: 1896126 - DNA, 19 bp, Homo sapiens
aaaggaaattcagattgtt

SEQ ID NO: 1896127 - DNA, 22 bp, Homo sapiens
aaaggacccaagtactttccaa

SEQ ID NO: 1896128 - DNA, 21 bp, Homo sapiens
aaaggcacatggaatatattt

SEQ ID NO: 1896129 - DNA, 21 bp, Homo sapiens
aaaggcctaattctatgcctg

SEQ ID NO: 1896130 - DNA, 15 bp, Homo sapiens
aaagtaatatttatt

SEQ ID NO: 1896131 - DNA, 16 bp, Homo sapiens
aaagtagaactttgta

SEQ ID NO: 1896132 - DNA, 21 bp, Homo sapiens
aaagtatttactgactgctta

SEQ ID NO: 1896133 - DNA, 23 bp, Homo sapiens
aaagtccaagccgtaggacccag

SEQ ID NO: 1896134 - DNA, 16 bp, Homo sapiens
aaagtgaacagatttt

SEQ ID NO: 1896135 - DNA, 18 bp, Homo sapiens
aaagtgaatttttaaaga

SEQ ID NO: 1896136 - DNA, 10 bp, Homo sapiens
aaagtgcagt

SEQ ID NO: 1896137 - DNA, 17 bp, Homo sapiens
aaagtgccttagcatgt

SEQ ID NO: 1896138 - DNA, 21 bp, Homo sapiens
aaagtgttcattgcacaatat

SEQ ID NO: 1896139 - DNA, 16 bp, Homo sapiens
aaagttaccagtgcct

SEQ ID NO: 1896140 - DNA, 17 bp, Homo sapiens
aaagttgaccaatgaaa

SEQ ID NO: 1896141 - DNA, 23 bp, Homo sapiens
aaagtttgctgaaagatatgtat

SEQ ID NO: 1896142 - DNA, 22 bp, Homo sapiens
aaataaaaaaaagaaaaaagag

SEQ ID NO: 1896143 - DNA, 18 bp, Homo sapiens
aaataacaaaaaagagaa

SEQ ID NO: 1896144 - DNA, 19 bp, Homo sapiens
aaataacaaaaaagagaaa

SEQ ID NO: 1896145 - DNA, 13 bp, Homo sapiens
aaataagaaaaga

SEQ ID NO: 1896146 - DNA, 22 bp, Homo sapiens
aaataagaaaagatgtagattt

SEQ ID NO: 1896147 - DNA, 18 bp, Homo sapiens
aaataatatctctaatat

SEQ ID NO: 1896148 - DNA, 18 bp, Homo sapiens
aaataattcttttttatt

SEQ ID NO: 1896149 - DNA, 12 bp, Homo sapiens
aaataattttgt

SEQ ID NO: 1896150 - DNA, 15 bp, Homo sapiens
aaatacagactggat

SEQ ID NO: 1896151 - DNA, 15 bp, Homo sapiens
aaatacatcaaggag

SEQ ID NO: 1896152 - DNA, 22 bp, Homo sapiens
aaatacattccttttagagtta

SEQ ID NO: 1896153 - DNA, 13 bp, Homo sapiens
aaatactttttaa

SEQ ID NO: 1896154 - DNA, 21 bp, Homo sapiens
aaatagtttattttaaaacaa

SEQ ID NO: 1896155 - DNA, 21 bp, Homo sapiens
aaatatcacactgaataagag

SEQ ID NO: 1896156 - DNA, 13 bp, Homo sapiens
aaatatgcactgc

SEQ ID NO: 1896157 - DNA, 11 bp, Homo sapiens
aaatattgttt

SEQ ID NO: 1896158 - DNA, 23 bp, Homo sapiens
aaatatttgtcatatgaatgaaa

SEQ ID NO: 1896159 - DNA, 15 bp, Homo sapiens
aaatcaaagtgctat

SEQ ID NO: 1896160 - DNA, 19 bp, Homo sapiens
aaatccaggaccctgccag

SEQ ID NO: 1896161 - DNA, 18 bp, Homo sapiens
aaatctgacataaaaaca

SEQ ID NO: 1896162 - DNA, 18 bp, Homo sapiens
aaatgaaaagagaaactt

SEQ ID NO: 1896163 - DNA, 14 bp, Homo sapiens
aaatgaacatctat

SEQ ID NO: 1896164 - DNA, 16 bp, Homo sapiens
aaatgaactgtaaatg

SEQ ID NO: 1896165 - DNA, 15 bp, Homo sapiens
aaatgaagaatttaa

SEQ ID NO: 1896166 - DNA, 19 bp, Homo sapiens
aaatgaagagctgttgatg

SEQ ID NO: 1896167 - DNA, 15 bp, Homo sapiens
aaatgactttattat

SEQ ID NO: 1896168 - DNA, 18 bp, Homo sapiens
aaatgactttattattta

SEQ ID NO: 1896169 - DNA, 20 bp, Homo sapiens
aaatgactttattatttatt

SEQ ID NO: 1896170 - DNA, 14 bp, Homo sapiens
aaatgatcaaggca

SEQ ID NO: 1896171 - DNA, 14 bp, Homo sapiens
aaatgcatctttga

SEQ ID NO: 1896172 - DNA, 20 bp, Homo sapiens
aaatgcatctttgatgtgtt

SEQ ID NO: 1896173 - DNA, 19 bp, Homo sapiens
aaatgcctaaaagttttga

SEQ ID NO: 1896174 - DNA, 18 bp, Homo sapiens
aaatgctgaaataaaatg

SEQ ID NO: 1896175 - DNA, 12 bp, Homo sapiens
aaatgctgaccc

SEQ ID NO: 1896176 - DNA, 16 bp, Homo sapiens
aaatgctgacccatgg

SEQ ID NO: 1896177 - DNA, 20 bp, Homo sapiens
aaatggaagagaagagaaag

SEQ ID NO: 1896178 - DNA, 16 bp, Homo sapiens
aaatggatcaagtgcg

SEQ ID NO: 1896179 - DNA, 17 bp, Homo sapiens
aaatggcaagttttcca

SEQ ID NO: 1896180 - DNA, 17 bp, Homo sapiens
aaatggcccggacatgt

SEQ ID NO: 1896181 - DNA, 16 bp, Homo sapiens
aaatgtaaagttgtct

SEQ ID NO: 1896182 - DNA, 15 bp, Homo sapiens
aaatgtattcattct

SEQ ID NO: 1896183 - DNA, 18 bp, Homo sapiens
aaatgtattcattcttaa

SEQ ID NO: 1896184 - DNA, 15 bp, Homo sapiens
aaatgtcaaatgtga

SEQ ID NO: 1896185 - DNA, 16 bp, Homo sapiens
aaattaagaagaaact

SEQ ID NO: 1896186 - DNA, 18 bp, Homo sapiens
aaattaattgtgtgaact

SEQ ID NO: 1896187 - DNA, 16 bp, Homo sapiens
aaattctgatttcttt

SEQ ID NO: 1896188 - DNA, 22 bp, Homo sapiens
aaattctgatttcttttcacca

SEQ ID NO: 1896189 - DNA, 19 bp, Homo sapiens
aaattgaaataaagataaa

SEQ ID NO: 1896190 - DNA, 20 bp, Homo sapiens
aaattggtatcaagaaagtc

SEQ ID NO: 1896191 - DNA, 18 bp, Homo sapiens
aaattgtccttgaagctt

SEQ ID NO: 1896192 - DNA, 15 bp, Homo sapiens
aaatttatataactg

SEQ ID NO: 1896193 - DNA, 19 bp, Homo sapiens
aaatttatataactgttgt

SEQ ID NO: 1896194 - DNA, 15 bp, Homo sapiens
aaatttcacttgaaa

SEQ ID NO: 1896195 - DNA, 13 bp, Homo sapiens
aaatttgcccctg

SEQ ID NO: 1896196 - DNA, 19 bp, Homo sapiens
aaatttggaacttacaaag

SEQ ID NO: 1896197 - DNA, 14 bp, Homo sapiens
aaattttgaaaagt

SEQ ID NO: 1896198 - DNA, 18 bp, Homo sapiens
aaattttgaaaagtaata

SEQ ID NO: 1896199 - DNA, 18 bp, Homo sapiens
aaattttggttttctact

SEQ ID NO: 1896200 - DNA, 19 bp, Homo sapiens
aaattttggttttctactg

SEQ ID NO: 1896201 - DNA, 14 bp, Homo sapiens
aaatttttttgtat

SEQ ID NO: 1896202 - DNA, 14 bp, Homo sapiens
aacaaaaaagagaa

SEQ ID NO: 1896203 - DNA, 14 bp, Homo sapiens
agcgaggctgggct

SEQ ID NO: 1896204 - DNA, 13 bp, Homo sapiens
agcgccactgtcc

SEQ ID NO: 1896205 - DNA, 22 bp, Homo sapiens
agcgccactgtccgctgtctcc

SEQ ID NO: 1896206 - DNA, 15 bp, Homo sapiens
agcgcccccactcct

SEQ ID NO: 1896207 - DNA, 13 bp, Homo sapiens
agcgccctggccc

SEQ ID NO: 1896208 - DNA, 14 bp, Homo sapiens
agcgccctggcccc

SEQ ID NO: 1896209 - DNA, 16 bp, Homo sapiens
agcgccctggccccca

SEQ ID NO: 1896210 - DNA, 17 bp, Homo sapiens
agcgcggacatcccctg

SEQ ID NO: 1896211 - DNA, 22 bp, Homo sapiens
agcgcggatttctctttctctc

SEQ ID NO: 1896212 - DNA, 18 bp, Homo sapiens
agctaaggccaatgggct

SEQ ID NO: 1896213 - DNA, 19 bp, Homo sapiens
agctaaggccaatgggcta

SEQ ID NO: 1896214 - DNA, 19 bp, Homo sapiens
agctaaggtttagataaat

SEQ ID NO: 1896215 - DNA, 18 bp, Homo sapiens
agctaataacatgtgaaa

SEQ ID NO: 1896216 - DNA, 14 bp, Homo sapiens
agctagtcaacagt

SEQ ID NO: 1896217 - DNA, 16 bp, Homo sapiens
agctagttgaatactt

SEQ ID NO: 1896218 - DNA, 17 bp, Homo sapiens
agctagttgaatacttg

SEQ ID NO: 1896219 - DNA, 20 bp, Homo sapiens
agctagttgaatacttgaac

SEQ ID NO: 1896220 - DNA, 18 bp, Homo sapiens
agctataattattattca

SEQ ID NO: 1896221 - DNA, 12 bp, Homo sapiens
agctatgactta

SEQ ID NO: 1896222 - DNA, 21 bp, Homo sapiens
agctccaccccgcaagcacca

SEQ ID NO: 1896223 - DNA, 17 bp, Homo sapiens
agctcccacttctgcca

SEQ ID NO: 1896224 - DNA, 12 bp, Homo sapiens
agctccctcccc

SEQ ID NO: 1896225 - DNA, 15 bp, Homo sapiens
agctccctcccctgc

SEQ ID NO: 1896226 - DNA, 16 bp, Homo sapiens
agctccctcccctgct

SEQ ID NO: 1896227 - DNA, 14 bp, Homo sapiens
agctcggggctggg

SEQ ID NO: 1896228 - DNA, 22 bp, Homo sapiens
agctcgtccccattgcttaagc

SEQ ID NO: 1896229 - DNA, 17 bp, Homo sapiens
agctcgtcctcactggt

SEQ ID NO: 1896230 - DNA, 19 bp, Homo sapiens
agctctgggggactccttc

SEQ ID NO: 1896231 - DNA, 19 bp, Homo sapiens
agctgactttcaaagtgga

SEQ ID NO: 1896232 - DNA, 22 bp, Homo sapiens
agctgagacccttatttaaaac

SEQ ID NO: 1896233 - DNA, 15 bp, Homo sapiens
agctgaggctgctgc

SEQ ID NO: 1896234 - DNA, 19 bp, Homo sapiens
agctgaggctgctgccagg

SEQ ID NO: 1896235 - DNA, 21 bp, Homo sapiens
agctgattttgagggttttta

SEQ ID NO: 1896236 - DNA, 16 bp, Homo sapiens
agctgctgagccgcag

SEQ ID NO: 1896237 - DNA, 15 bp, Homo sapiens
agctggaaaggccag

SEQ ID NO: 1896238 - DNA, 17 bp, Homo sapiens
agctggagaggagccct

SEQ ID NO: 1896239 - DNA, 21 bp, Homo sapiens
agctggagaggagccctgcct

SEQ ID NO: 1896240 - DNA, 18 bp, Homo sapiens
agctgggaccacaggtgc

SEQ ID NO: 1896241 - DNA, 13 bp, Homo sapiens
agctgtaaggcat

SEQ ID NO: 1896242 - DNA, 20 bp, Homo sapiens
agctgtcaccactacagtaa

SEQ ID NO: 1896243 - DNA, 14 bp, Homo sapiens
agctgtgctgggag

SEQ ID NO: 1896244 - DNA, 13 bp, Homo sapiens
agctgttgactct

SEQ ID NO: 1896245 - DNA, 21 bp, Homo sapiens
agctgttgactctagtactgt

SEQ ID NO: 1896246 - DNA, 20 bp, Homo sapiens
agcttaagggtcatatgttt

SEQ ID NO: 1896247 - DNA, 12 bp, Homo sapiens
agcttccagcag

SEQ ID NO: 1896248 - DNA, 19 bp, Homo sapiens
agcttccagcaggagggac

SEQ ID NO: 1896249 - DNA, 18 bp, Homo sapiens
agcttccccagtagctgg

SEQ ID NO: 1896250 - DNA, 21 bp, Homo sapiens
agcttctagtctggaactgct

SEQ ID NO: 1896251 - DNA, 16 bp, Homo sapiens
agcttggctcaggctg

SEQ ID NO: 1896252 - DNA, 13 bp, Homo sapiens
agcttgggctggc

SEQ ID NO: 1896253 - DNA, 18 bp, Homo sapiens
agcttgtatctgatatca

SEQ ID NO: 1896254 - DNA, 21 bp, Homo sapiens
agctttaatgatatgcttgta

SEQ ID NO: 1896255 - DNA, 14 bp, Homo sapiens
agctttctgagcaa

SEQ ID NO: 1896256 - DNA, 22 bp, Homo sapiens
agctttctgagcaagaggattt

SEQ ID NO: 1896257 - DNA, 12 bp, Homo sapiens
agctttgtaatt

SEQ ID NO: 1896258 - DNA, 20 bp, Homo sapiens
agctttgtttagtctttata

SEQ ID NO: 1896259 - DNA, 13 bp, Homo sapiens
aggaaaaataaaa

SEQ ID NO: 1896260 - DNA, 13 bp, Homo sapiens
aggaaaagatatt

SEQ ID NO: 1896261 - DNA, 13 bp, Homo sapiens
aggaaatcaaagt

SEQ ID NO: 1896262 - DNA, 14 bp, Homo sapiens
aggaaatgccaaag

SEQ ID NO: 1896263 - DNA, 16 bp, Homo sapiens
aggaactgtgtgtgtc

SEQ ID NO: 1896264 - DNA, 19 bp, Homo sapiens
aggaagaactgaaaggctt

SEQ ID NO: 1896265 - DNA, 15 bp, Homo sapiens
aggaaggctgtctca

SEQ ID NO: 1896266 - DNA, 16 bp, Homo sapiens
aggaagtagcacaggc

SEQ ID NO: 1896267 - DNA, 18 bp, Homo sapiens
aggaagtagcacaggctg

SEQ ID NO: 1896268 - DNA, 19 bp, Homo sapiens
aggacactaagaggaggca

SEQ ID NO: 1896269 - DNA, 13 bp, Homo sapiens
aggacagcctgcc

SEQ ID NO: 1896270 - DNA, 17 bp, Homo sapiens
aggacagcctgcctctg

SEQ ID NO: 1896271 - DNA, 22 bp, Homo sapiens
aggacagcctgcctctgccaca

SEQ ID NO: 1896272 - DNA, 15 bp, Homo sapiens
aggacaggggttcct

SEQ ID NO: 1896273 - DNA, 23 bp, Homo sapiens
aggaccatgaggcctcctgccat

SEQ ID NO: 1896274 - DNA, 13 bp, Homo sapiens
aggaccctgccag

SEQ ID NO: 1896275 - DNA, 15 bp, Homo sapiens
aggaccctgccaggc

SEQ ID NO: 1896276 - DNA, 18 bp, Homo sapiens
aggaccctgccaggcaca

SEQ ID NO: 1896277 - DNA, 19 bp, Homo sapiens
aggaccctgccaggcacag

SEQ ID NO: 1896278 - DNA, 21 bp, Homo sapiens
aggaccctgccaggcacaggc

SEQ ID NO: 1896279 - DNA, 16 bp, Homo sapiens
aggactgactgaggca

SEQ ID NO: 1896280 - DNA, 22 bp, Homo sapiens
aggactttggcttacatttgaa

SEQ ID NO: 1896281 - DNA, 13 bp, Homo sapiens
aggagaaaaacaa

SEQ ID NO: 1896282 - DNA, 13 bp, Homo sapiens
aggagacttctgt

SEQ ID NO: 1896283 - DNA, 15 bp, Homo sapiens
aggagcaggccctgg

SEQ ID NO: 1896284 - DNA, 14 bp, Homo sapiens
aggagcctgcccag

SEQ ID NO: 1896285 - DNA, 23 bp, Homo sapiens
aggagggactctgtctggccagg

SEQ ID NO: 1896286 - DNA, 21 bp, Homo sapiens
aggagtgagtgaaactcccac

SEQ ID NO: 1896287 - DNA, 23 bp, Homo sapiens
aggagtgagtgaaactcccaccc

SEQ ID NO: 1896288 - DNA, 12 bp, Homo sapiens
aggagtggattc

SEQ ID NO: 1896289 - DNA, 21 bp, Homo sapiens
aggagtggattcctccccacc

SEQ ID NO: 1896290 - DNA, 23 bp, Homo sapiens
aggatgacaaaattctttctggt

SEQ ID NO: 1896291 - DNA, 20 bp, Homo sapiens
aggatgctcccccagggaag

SEQ ID NO: 1896292 - DNA, 22 bp, Homo sapiens
aggatgctcccccagggaagaa

SEQ ID NO: 1896293 - DNA, 17 bp, Homo sapiens
aggatgggcttctgtgc

SEQ ID NO: 1896294 - DNA, 22 bp, Homo sapiens
aggattgccaggtatttttcta

SEQ ID NO: 1896295 - DNA, 15 bp, Homo sapiens
aggcaaaaaaggatg

SEQ ID NO: 1896296 - DNA, 15 bp, Homo sapiens
aggcaagccctgcct

SEQ ID NO: 1896297 - DNA, 17 bp, Homo sapiens
aggcaatttctctgcac

SEQ ID NO: 1896298 - DNA, 18 bp, Homo sapiens
aggcacaggcagggcagg

SEQ ID NO: 1896299 - DNA, 18 bp, Homo sapiens
aggcacatggaatatatt

SEQ ID NO: 1896300 - DNA, 14 bp, Homo sapiens
aggcagaaagcaaa

SEQ ID NO: 1896301 - DNA, 21 bp, Homo sapiens
aggcagcagtgggttcaggcc

SEQ ID NO: 1896302 - DNA, 12 bp, Homo sapiens
aggcagggcagg

SEQ ID NO: 1896303 - DNA, 15 bp, Homo sapiens
aggcagtttgaggat

SEQ ID NO: 1896304 - DNA, 20 bp, Homo sapiens
aggcagtttgaggattagtt

SEQ ID NO: 1896305 - DNA, 11 bp, Homo sapiens
aggcatgaagg

SEQ ID NO: 1896306 - DNA, 17 bp, Homo sapiens
aggcatgggccaccacg

SEQ ID NO: 1896307 - DNA, 21 bp, Homo sapiens
aggcattttcccccttggctc

SEQ ID NO: 1896308 - DNA, 23 bp, Homo sapiens
aggccaagagtggccccacctgg

SEQ ID NO: 1896309 - DNA, 22 bp, Homo sapiens
aggccaagtgtgataaataaac

SEQ ID NO: 1896310 - DNA, 22 bp, Homo sapiens
aggccaatgggctagagggtgc

SEQ ID NO: 1896311 - DNA, 16 bp, Homo sapiens
aggccacacccagagt

SEQ ID NO: 1896312 - DNA, 14 bp, Homo sapiens
aggccacctcttcc

SEQ ID NO: 1896313 - DNA, 15 bp, Homo sapiens
aggccacctcttcct

SEQ ID NO: 1896314 - DNA, 17 bp, Homo sapiens
aggccagcagccttcca

SEQ ID NO: 1896315 - DNA, 20 bp, Homo sapiens
aggcccagagagaagagccc

SEQ ID NO: 1896316 - DNA, 19 bp, Homo sapiens
aggcccggcatgaggcccc

SEQ ID NO: 1896317 - DNA, 14 bp, Homo sapiens
aggccctgggcctc

SEQ ID NO: 1896318 - DNA, 16 bp, Homo sapiens
aggccctgggcctcca

SEQ ID NO: 1896319 - DNA, 17 bp, Homo sapiens
aggccctgggcctccac

SEQ ID NO: 1896320 - DNA, 16 bp, Homo sapiens
aggcctaaaagtaaac

SEQ ID NO: 1896321 - DNA, 22 bp, Homo sapiens
aggcctacatgctttgtgaaca

SEQ ID NO: 1896322 - DNA, 18 bp, Homo sapiens
aggcctctgcctcacaac

SEQ ID NO: 1896323 - DNA, 21 bp, Homo sapiens
aggcgaaagaaaactctattt

SEQ ID NO: 1896324 - DNA, 16 bp, Homo sapiens
aggctcctcagccctc

SEQ ID NO: 1896325 - DNA, 21 bp, Homo sapiens
aggctcctcagccctctcttg

SEQ ID NO: 1896326 - DNA, 22 bp, Homo sapiens
aggctcctcagccctctcttgc

SEQ ID NO: 1896327 - DNA, 21 bp, Homo sapiens
aggctcgagctcggggctggg

SEQ ID NO: 1896328 - DNA, 19 bp, Homo sapiens
aggctgagtgcaggcccac

SEQ ID NO: 1896329 - DNA, 17 bp, Homo sapiens
aggctgctgccaggccc

SEQ ID NO: 1896330 - DNA, 20 bp, Homo sapiens
aggctggagtgcagtggcat

SEQ ID NO: 1896331 - DNA, 15 bp, Homo sapiens
aggctgggctggcca

SEQ ID NO: 1896332 - DNA, 16 bp, Homo sapiens
aggctgggctgggcac

SEQ ID NO: 1896333 - DNA, 16 bp, Homo sapiens
aggctgtctgttgtat

SEQ ID NO: 1896334 - DNA, 19 bp, Homo sapiens
aggctgtggtcagagaggg

SEQ ID NO: 1896335 - DNA, 20 bp, Homo sapiens
aggctgtggtcagagaggga

SEQ ID NO: 1896336 - DNA, 14 bp, Homo sapiens
aggcttataaaaca

SEQ ID NO: 1896337 - DNA, 18 bp, Homo sapiens
agggaagctgaggcccat

SEQ ID NO: 1896338 - DNA, 13 bp, Homo sapiens
agggacagtctca

SEQ ID NO: 1896339 - DNA, 19 bp, Homo sapiens
aatcttgtgaaaataattg

SEQ ID NO: 1896340 - DNA, 18 bp, Homo sapiens
aatcttgttggttcacca

SEQ ID NO: 1896341 - DNA, 13 bp, Homo sapiens
aatgaaaaaataa

SEQ ID NO: 1896342 - DNA, 20 bp, Homo sapiens
aatgaacacagctctttaac

SEQ ID NO: 1896343 - DNA, 22 bp, Homo sapiens
aatgaacacagctctttaacat

SEQ ID NO: 1896344 - DNA, 14 bp, Homo sapiens
aatgaagaatttaa

SEQ ID NO: 1896345 - DNA, 16 bp, Homo sapiens
aatgaagaatttaaag

SEQ ID NO: 1896346 - DNA, 16 bp, Homo sapiens
aatgactttcataata

SEQ ID NO: 1896347 - DNA, 17 bp, Homo sapiens
aatgatatgcttgtaac

SEQ ID NO: 1896348 - DNA, 16 bp, Homo sapiens
aatgattaatcataaa

SEQ ID NO: 1896349 - DNA, 18 bp, Homo sapiens
aatgcaaccatttgaaac

SEQ ID NO: 1896350 - DNA, 15 bp, Homo sapiens
aatgcaatatgtgaa

SEQ ID NO: 1896351 - DNA, 16 bp, Homo sapiens
aatgcacacacctcat

SEQ ID NO: 1896352 - DNA, 18 bp, Homo sapiens
aatgcactgggaaaaagt

SEQ ID NO: 1896353 - DNA, 16 bp, Homo sapiens
aatgccccctcccctc

SEQ ID NO: 1896354 - DNA, 17 bp, Homo sapiens
aatgccccctcccctcc

SEQ ID NO: 1896355 - DNA, 23 bp, Homo sapiens
aatgcctctggctctacacatat

SEQ ID NO: 1896356 - DNA, 18 bp, Homo sapiens
aatgctgaacattgcata

SEQ ID NO: 1896357 - DNA, 15 bp, Homo sapiens
aatgctgacccatgg

SEQ ID NO: 1896358 - DNA, 22 bp, Homo sapiens
aatgctgacccatgggcaggag

SEQ ID NO: 1896359 - DNA, 13 bp, Homo sapiens
aatggtagtttct

SEQ ID NO: 1896360 - DNA, 17 bp, Homo sapiens
aatggtagtttctgtgg

SEQ ID NO: 1896361 - DNA, 22 bp, Homo sapiens
aatgtaaagcaaccaaaaagaa

SEQ ID NO: 1896362 - DNA, 21 bp, Homo sapiens
aatgtaaagttgtcttttaaa

SEQ ID NO: 1896363 - DNA, 19 bp, Homo sapiens
aatgtacagatatgcaaat

SEQ ID NO: 1896364 - DNA, 20 bp, Homo sapiens
aatgtaggggaaagtttcat

SEQ ID NO: 1896365 - DNA, 15 bp, Homo sapiens
aatgtattcattctt

SEQ ID NO: 1896366 - DNA, 17 bp, Homo sapiens
aatgtccagtaagatca

SEQ ID NO: 1896367 - DNA, 14 bp, Homo sapiens
aatgtctagatttt

SEQ ID NO: 1896368 - DNA, 20 bp, Homo sapiens
aatgtctcaagtgcaatgcc

SEQ ID NO: 1896369 - DNA, 14 bp, Homo sapiens
aatgtctttcatgt

SEQ ID NO: 1896370 - DNA, 17 bp, Homo sapiens
aatgttagttagtgtag

SEQ ID NO: 1896371 - DNA, 16 bp, Homo sapiens
aatgttttaacaagaa

SEQ ID NO: 1896372 - DNA, 22 bp, Homo sapiens
aattaaaactttgtagacattt

SEQ ID NO: 1896373 - DNA, 13 bp, Homo sapiens
aattaaagctgcc

SEQ ID NO: 1896374 - DNA, 12 bp, Homo sapiens
aattaagaagaa

SEQ ID NO: 1896375 - DNA, 16 bp, Homo sapiens
aattaagaagaaacta

SEQ ID NO: 1896376 - DNA, 16 bp, Homo sapiens
aattaaggtgtttgaa

SEQ ID NO: 1896377 - DNA, 16 bp, Homo sapiens
aattacaccacaagta

SEQ ID NO: 1896378 - DNA, 19 bp, Homo sapiens
aattacaccacaagtatct

SEQ ID NO: 1896379 - DNA, 16 bp, Homo sapiens
aattagaaaaggaaat

SEQ ID NO: 1896380 - DNA, 23 bp, Homo sapiens
aattatcttagtctatagaaatg

SEQ ID NO: 1896381 - DNA, 22 bp, Homo sapiens
aattatggtagcaaattttgga

SEQ ID NO: 1896382 - DNA, 22 bp, Homo sapiens
aattatgtttgccactttgcaa

SEQ ID NO: 1896383 - DNA, 13 bp, Homo sapiens
aattcagattgtt

SEQ ID NO: 1896384 - DNA, 16 bp, Homo sapiens
aattctcgattctttg

SEQ ID NO: 1896385 - DNA, 21 bp, Homo sapiens
aattctgggttcatttgtgat

SEQ ID NO: 1896386 - DNA, 16 bp, Homo sapiens
aattcttttttattaa

SEQ ID NO: 1896387 - DNA, 22 bp, Homo sapiens
aattcttttttattaatcactg

SEQ ID NO: 1896388 - DNA, 23 bp, Homo sapiens
aattcttttttattaatcactgt

SEQ ID NO: 1896389 - DNA, 13 bp, Homo sapiens
aattgatgatgtt

SEQ ID NO: 1896390 - DNA, 15 bp, Homo sapiens
aattgtactttgaaa

SEQ ID NO: 1896391 - DNA, 14 bp, Homo sapiens
aattgtatttttgt

SEQ ID NO: 1896392 - DNA, 17 bp, Homo sapiens
aattgtccttgaagctt

SEQ ID NO: 1896393 - DNA, 20 bp, Homo sapiens
aatttaaagaaaaaaatgtc

SEQ ID NO: 1896394 - DNA, 15 bp, Homo sapiens
aatttaagttttgac

SEQ ID NO: 1896395 - DNA, 23 bp, Homo sapiens
aatttaagttttgacaagctggc

SEQ ID NO: 1896396 - DNA, 15 bp, Homo sapiens
aatttatataactgt

SEQ ID NO: 1896397 - DNA, 19 bp, Homo sapiens
aatttatgtaaggtttttt

SEQ ID NO: 1896398 - DNA, 20 bp, Homo sapiens
aatttatttttaagaaagaa

SEQ ID NO: 1896399 - DNA, 14 bp, Homo sapiens
aatttcacttgaaa

SEQ ID NO: 1896400 - DNA, 16 bp, Homo sapiens
aatttccattaaaggt

SEQ ID NO: 1896401 - DNA, 13 bp, Homo sapiens
aatttgcccctgg

SEQ ID NO: 1896402 - DNA, 14 bp, Homo sapiens
aatttgcccctggc

SEQ ID NO: 1896403 - DNA, 16 bp, Homo sapiens
aatttgtggtgatttg

SEQ ID NO: 1896404 - DNA, 12 bp, Homo sapiens
aattttatatgt

SEQ ID NO: 1896405 - DNA, 20 bp, Homo sapiens
aattttcctttaatatgaaa

SEQ ID NO: 1896406 - DNA, 18 bp, Homo sapiens
aattttgtaatgtatcaa

SEQ ID NO: 1896407 - DNA, 23 bp, Homo sapiens
aattttgtgaaacagacttgtat

SEQ ID NO: 1896408 - DNA, 14 bp, Homo sapiens
aatttttggttgaa

SEQ ID NO: 1896409 - DNA, 19 bp, Homo sapiens
aatttttttgtatgaaaac

SEQ ID NO: 1896410 - DNA, 12 bp, Homo sapiens
acaaaaaagaga

SEQ ID NO: 1896411 - DNA, 12 bp, Homo sapiens
acaaaaataaca

SEQ ID NO: 1896412 - DNA, 15 bp, Homo sapiens
acaaactgcttcctt

SEQ ID NO: 1896413 - DNA, 21 bp, Homo sapiens
acaaactgcttcctttcttga

SEQ ID NO: 1896414 - DNA, 23 bp, Homo sapiens
acaaagctctgaattcaggtccc

SEQ ID NO: 1896415 - DNA, 20 bp, Homo sapiens
acaaagtgggtactttctga

SEQ ID NO: 1896416 - DNA, 21 bp, Homo sapiens
acaaagtgggtactttctgaa

SEQ ID NO: 1896417 - DNA, 23 bp, Homo sapiens
acaaagtgggtactttctgaaaa

SEQ ID NO: 1896418 - DNA, 18 bp, Homo sapiens
acaaagtttatcttggcc

SEQ ID NO: 1896419 - DNA, 12 bp, Homo sapiens
acaaatgacttt

SEQ ID NO: 1896420 - DNA, 23 bp, Homo sapiens
acaaatgactttattatttattt

SEQ ID NO: 1896421 - DNA, 20 bp, Homo sapiens
acaaatgcatctttgatgtg

SEQ ID NO: 1896422 - DNA, 20 bp, Homo sapiens
acaaattttggttttctact

SEQ ID NO: 1896423 - DNA, 18 bp, Homo sapiens
acaacgtaatcaaatatg

SEQ ID NO: 1896424 - DNA, 14 bp, Homo sapiens
acaactgaaatgtg

SEQ ID NO: 1896425 - DNA, 16 bp, Homo sapiens
acaagtagttctgtat

SEQ ID NO: 1896426 - DNA, 17 bp, Homo sapiens
acaagtagttctgtatt

SEQ ID NO: 1896427 - DNA, 15 bp, Homo sapiens
acaagtcatttcaaa

SEQ ID NO: 1896428 - DNA, 19 bp, Homo sapiens
acaataaagagaaccatgt

SEQ ID NO: 1896429 - DNA, 22 bp, Homo sapiens
acaataactaaaccacttaaaa

SEQ ID NO: 1896430 - DNA, 13 bp, Homo sapiens
acaatgactttat

SEQ ID NO: 1896431 - DNA, 14 bp, Homo sapiens
acaatgactttatt

SEQ ID NO: 1896432 - DNA, 22 bp, Homo sapiens
acaatgtgtctatttctgaaag

SEQ ID NO: 1896433 - DNA, 13 bp, Homo sapiens
acaatgtttacaa

SEQ ID NO: 1896434 - DNA, 14 bp, Homo sapiens
acaattcagcatta

SEQ ID NO: 1896435 - DNA, 21 bp, Homo sapiens
acaattctcccgggactctgc

SEQ ID NO: 1896436 - DNA, 13 bp, Homo sapiens
acaatttcttttg

SEQ ID NO: 1896437 - DNA, 14 bp, Homo sapiens
acacaagtaaacat

SEQ ID NO: 1896438 - DNA, 23 bp, Homo sapiens
acacagaaggggactgccacctc

SEQ ID NO: 1896439 - DNA, 15 bp, Homo sapiens
acacatttaaaaata

SEQ ID NO: 1896440 - DNA, 22 bp, Homo sapiens
acacatttgttgccagatttca

SEQ ID NO: 1896441 - DNA, 14 bp, Homo sapiens
acaccaatcttact

SEQ ID NO: 1896442 - DNA, 18 bp, Homo sapiens
acaccaatcttactttgt

SEQ ID NO: 1896443 - DNA, 16 bp, Homo sapiens
acaccacaagtatcta

SEQ ID NO: 1896444 - DNA, 13 bp, Homo sapiens
acacctctgcccc

SEQ ID NO: 1896445 - DNA, 14 bp, Homo sapiens
acacctctgcccct

SEQ ID NO: 1896446 - DNA, 16 bp, Homo sapiens
acacgtcattgtgtaa

SEQ ID NO: 1896447 - DNA, 16 bp, Homo sapiens
acacgttttaaggact

SEQ ID NO: 1896448 - DNA, 22 bp, Homo sapiens
acacgttttaaggactgactga

SEQ ID NO: 1896449 - DNA, 17 bp, Homo sapiens
acactaagaggaggcag

SEQ ID NO: 1896450 - DNA, 16 bp, Homo sapiens
acactgaatttttatg

SEQ ID NO: 1896451 - DNA, 22 bp, Homo sapiens
acactgaatttttatgtgtgat

SEQ ID NO: 1896452 - DNA, 20 bp, Homo sapiens
acactgcctgccttaagtga

SEQ ID NO: 1896453 - DNA, 13 bp, Homo sapiens
acactgtggcagc

SEQ ID NO: 1896454 - DNA, 16 bp, Homo sapiens
acactgtggcagcagg

SEQ ID NO: 1896455 - DNA, 17 bp, Homo sapiens
acactgtggcagcagga

SEQ ID NO: 1896456 - DNA, 18 bp, Homo sapiens
accctgtatatcagggta

SEQ ID NO: 1896457 - DNA, 16 bp, Homo sapiens
accctgtcccaggcag

SEQ ID NO: 1896458 - DNA, 22 bp, Homo sapiens
accctgtcccaggcagcgccac

SEQ ID NO: 1896459 - DNA, 15 bp, Homo sapiens
accctttctgccagg

SEQ ID NO: 1896460 - DNA, 16 bp, Homo sapiens
accctttctgccaggg

SEQ ID NO: 1896461 - DNA, 14 bp, Homo sapiens
accgtccctctgca

SEQ ID NO: 1896462 - DNA, 20 bp, Homo sapiens
acctaacaacattgtagcct

SEQ ID NO: 1896463 - DNA, 13 bp, Homo sapiens
acctaacccagaa

SEQ ID NO: 1896464 - DNA, 14 bp, Homo sapiens
acctcacacacctc

SEQ ID NO: 1896465 - DNA, 16 bp, Homo sapiens
acctcacacacctctg

SEQ ID NO: 1896466 - DNA, 17 bp, Homo sapiens
acctcacacacctctgc

SEQ ID NO: 1896467 - DNA, 21 bp, Homo sapiens
acctcacacacctctgcccct

SEQ ID NO: 1896468 - DNA, 21 bp, Homo sapiens
acctcacgtgcaaagccacca

SEQ ID NO: 1896469 - DNA, 17 bp, Homo sapiens
acctcatgctagcctca

SEQ ID NO: 1896470 - DNA, 15 bp, Homo sapiens
acctccccttgccag

SEQ ID NO: 1896471 - DNA, 16 bp, Homo sapiens
acctccccttgccagc

SEQ ID NO: 1896472 - DNA, 17 bp, Homo sapiens
acctcctaaaaggccca

SEQ ID NO: 1896473 - DNA, 19 bp, Homo sapiens
acctcctaaaaggcccaga

SEQ ID NO: 1896474 - DNA, 14 bp, Homo sapiens
acctcgggctgttc

SEQ ID NO: 1896475 - DNA, 18 bp, Homo sapiens
acctctgccccttgggcc

SEQ ID NO: 1896476 - DNA, 19 bp, Homo sapiens
acctctgcctttgtggtga

SEQ ID NO: 1896477 - DNA, 14 bp, Homo sapiens
acctgagttcctga

SEQ ID NO: 1896478 - DNA, 22 bp, Homo sapiens
acctgcaaacgcttcagttgtt

SEQ ID NO: 1896479 - DNA, 19 bp, Homo sapiens
acctggccctctctgaagg

SEQ ID NO: 1896480 - DNA, 19 bp, Homo sapiens
acctggggctgctgtgaag

SEQ ID NO: 1896481 - DNA, 20 bp, Homo sapiens
acctgtaatgacaggcctgt

SEQ ID NO: 1896482 - DNA, 17 bp, Homo sapiens
acctgtatcaaactgct

SEQ ID NO: 1896483 - DNA, 14 bp, Homo sapiens
aagctggaaaggcc

SEQ ID NO: 1896484 - DNA, 18 bp, Homo sapiens
aagctggcttacactggc

SEQ ID NO: 1896485 - DNA, 19 bp, Homo sapiens
aagctgttggcctctgcaa

SEQ ID NO: 1896486 - DNA, 20 bp, Homo sapiens
aagctttgttgaaagaaagt

SEQ ID NO: 1896487 - DNA, 14 bp, Homo sapiens
aagcttttcctaat

SEQ ID NO: 1896488 - DNA, 19 bp, Homo sapiens
aaggaaataggttttaggt

SEQ ID NO: 1896489 - DNA, 20 bp, Homo sapiens
aaggaaattcagattgttta

SEQ ID NO: 1896490 - DNA, 17 bp, Homo sapiens
aaggaagaaattaactt

SEQ ID NO: 1896491 - DNA, 12 bp, Homo sapiens
aaggactgactg

SEQ ID NO: 1896492 - DNA, 18 bp, Homo sapiens
aaggagacttctgtcttc

SEQ ID NO: 1896493 - DNA, 18 bp, Homo sapiens
aaggagattgtggggaga

SEQ ID NO: 1896494 - DNA, 22 bp, Homo sapiens
aaggagctcactgtggtgtctg

SEQ ID NO: 1896495 - DNA, 12 bp, Homo sapiens
aaggaggccacc

SEQ ID NO: 1896496 - DNA, 15 bp, Homo sapiens
aaggaggccacctcc

SEQ ID NO: 1896497 - DNA, 20 bp, Homo sapiens
aaggatgccaagaagtttaa

SEQ ID NO: 1896498 - DNA, 18 bp, Homo sapiens
aaggcaatttctctgcac

SEQ ID NO: 1896499 - DNA, 12 bp, Homo sapiens
aaggcaggacca

SEQ ID NO: 1896500 - DNA, 20 bp, Homo sapiens
aaggccaatgggctagaggg

SEQ ID NO: 1896501 - DNA, 21 bp, Homo sapiens
aaggccacctcttcctggccg

SEQ ID NO: 1896502 - DNA, 18 bp, Homo sapiens
aaggccagcagccttcca

SEQ ID NO: 1896503 - DNA, 21 bp, Homo sapiens
aaggcccagagagaagagccc

SEQ ID NO: 1896504 - DNA, 15 bp, Homo sapiens
aaggcttataaaaca

SEQ ID NO: 1896505 - DNA, 18 bp, Homo sapiens
aagggactggatctgcag

SEQ ID NO: 1896506 - DNA, 18 bp, Homo sapiens
aagggcagaagtagggga

SEQ ID NO: 1896507 - DNA, 22 bp, Homo sapiens
aaggggcccctccttgtgctgc

SEQ ID NO: 1896508 - DNA, 15 bp, Homo sapiens
aagggggtagggaaa

SEQ ID NO: 1896509 - DNA, 22 bp, Homo sapiens
aaggggttttcttgataatttt

SEQ ID NO: 1896510 - DNA, 18 bp, Homo sapiens
aaggtactttcatatttt

SEQ ID NO: 1896511 - DNA, 22 bp, Homo sapiens
aaggtactttcatattttaaac

SEQ ID NO: 1896512 - DNA, 22 bp, Homo sapiens
aaggtagttcaagaaatgaaga

SEQ ID NO: 1896513 - DNA, 14 bp, Homo sapiens
aaggtcatatgcac

SEQ ID NO: 1896514 - DNA, 22 bp, Homo sapiens
aaggtcttgcatttaaaagaca

SEQ ID NO: 1896515 - DNA, 12 bp, Homo sapiens
aaggtgtttgaa

SEQ ID NO: 1896516 - DNA, 19 bp, Homo sapiens
aaggtttttgatagcattg

SEQ ID NO: 1896517 - DNA, 14 bp, Homo sapiens
aagtaagtctcaag

SEQ ID NO: 1896518 - DNA, 14 bp, Homo sapiens
aagtaatatttatt

SEQ ID NO: 1896519 - DNA, 18 bp, Homo sapiens
aagtagaactttgtatag

SEQ ID NO: 1896520 - DNA, 21 bp, Homo sapiens
aagtagaactttgtatagtta

SEQ ID NO: 1896521 - DNA, 23 bp, Homo sapiens
aagtagaactttgtatagttatg

SEQ ID NO: 1896522 - DNA, 22 bp, Homo sapiens
aagtagccacctgagttcctga

SEQ ID NO: 1896523 - DNA, 16 bp, Homo sapiens
aagtagttctgtattt

SEQ ID NO: 1896524 - DNA, 19 bp, Homo sapiens
aagtagttctgtatttgaa

SEQ ID NO: 1896525 - DNA, 21 bp, Homo sapiens
aagtatcctgagagcccagaa

SEQ ID NO: 1896526 - DNA, 17 bp, Homo sapiens
aagtatctaaatttgga

SEQ ID NO: 1896527 - DNA, 19 bp, Homo sapiens
aagtatttactgactgctt

SEQ ID NO: 1896528 - DNA, 17 bp, Homo sapiens
aagtatttttataatga

SEQ ID NO: 1896529 - DNA, 20 bp, Homo sapiens
aagtatttttataatgactg

SEQ ID NO: 1896530 - DNA, 16 bp, Homo sapiens
aagtcataatgaataa

SEQ ID NO: 1896531 - DNA, 13 bp, Homo sapiens
aagtcatttcaaa

SEQ ID NO: 1896532 - DNA, 20 bp, Homo sapiens
aagtccaagccgtaggaccc

SEQ ID NO: 1896533 - DNA, 15 bp, Homo sapiens
aagtccatctgtcac

SEQ ID NO: 1896534 - DNA, 14 bp, Homo sapiens
aagtgaaaatatag

SEQ ID NO: 1896535 - DNA, 15 bp, Homo sapiens
aagtgaacagatttt

SEQ ID NO: 1896536 - DNA, 15 bp, Homo sapiens
aagtgaatttttaaa

SEQ ID NO: 1896537 - DNA, 17 bp, Homo sapiens
aagtgacggttcctaca

SEQ ID NO: 1896538 - DNA, 18 bp, Homo sapiens
aagtgaggaaatcaaagt

SEQ ID NO: 1896539 - DNA, 22 bp, Homo sapiens
aagtgatgtatgttatttgatg

SEQ ID NO: 1896540 - DNA, 16 bp, Homo sapiens
aagtgccttagcatgt

SEQ ID NO: 1896541 - DNA, 23 bp, Homo sapiens
aagtgccttagcatgtgttgcag

SEQ ID NO: 1896542 - DNA, 15 bp, Homo sapiens
aagtggactctctga

SEQ ID NO: 1896543 - DNA, 22 bp, Homo sapiens
aagtggactctctgacaaagtg

SEQ ID NO: 1896544 - DNA, 17 bp, Homo sapiens
aagtggatattttctta

SEQ ID NO: 1896545 - DNA, 17 bp, Homo sapiens
aagtgggtactttctga

SEQ ID NO: 1896546 - DNA, 18 bp, Homo sapiens
aagtgtgaatactgcttg

SEQ ID NO: 1896547 - DNA, 14 bp, Homo sapiens
aagttagtttcagt

SEQ ID NO: 1896548 - DNA, 18 bp, Homo sapiens
aagttggtaaagtattta

SEQ ID NO: 1896549 - DNA, 23 bp, Homo sapiens
aagtttaaggaatatgggagaaa

SEQ ID NO: 1896550 - DNA, 15 bp, Homo sapiens
aagttttgacaagct

SEQ ID NO: 1896551 - DNA, 20 bp, Homo sapiens
aagttttgacaagctggctt

SEQ ID NO: 1896552 - DNA, 19 bp, Homo sapiens
aagtttttatatcttttct

SEQ ID NO: 1896553 - DNA, 13 bp, Homo sapiens
aataaaaaaaaga

SEQ ID NO: 1896554 - DNA, 15 bp, Homo sapiens
aataaaaaaaagaaa

SEQ ID NO: 1896555 - DNA, 17 bp, Homo sapiens
aataaaaaaaagaaaaa

SEQ ID NO: 1896556 - DNA, 17 bp, Homo sapiens
aataaaagcctttgaaa

SEQ ID NO: 1896557 - DNA, 14 bp, Homo sapiens
aataaaagtgctgc

SEQ ID NO: 1896558 - DNA, 16 bp, Homo sapiens
aataaagcaataagaa

SEQ ID NO: 1896559 - DNA, 12 bp, Homo sapiens
aataaaggaaat

SEQ ID NO: 1896560 - DNA, 13 bp, Homo sapiens
aataaaggaaata

SEQ ID NO: 1896561 - DNA, 19 bp, Homo sapiens
aataaagtgcaaacagaag

SEQ ID NO: 1896562 - DNA, 22 bp, Homo sapiens
aataaatggcccggacatgtct

SEQ ID NO: 1896563 - DNA, 14 bp, Homo sapiens
aataaattatttgt

SEQ ID NO: 1896564 - DNA, 19 bp, Homo sapiens
aataaattggagttttaaa

SEQ ID NO: 1896565 - DNA, 13 bp, Homo sapiens
aataaatttgctt

SEQ ID NO: 1896566 - DNA, 16 bp, Homo sapiens
aataaattttgaaaag

SEQ ID NO: 1896567 - DNA, 21 bp, Homo sapiens
aataactaaaccacttaaaat

SEQ ID NO: 1896568 - DNA, 14 bp, Homo sapiens
aataagccttcgaa

SEQ ID NO: 1896569 - DNA, 21 bp, Homo sapiens
aataagccttcgaaaagaaat

SEQ ID NO: 1896570 - DNA, 18 bp, Homo sapiens
aataagctagttgaatac

SEQ ID NO: 1896571 - DNA, 20 bp, Homo sapiens
aataagctagttgaatactt

SEQ ID NO: 1896572 - DNA, 22 bp, Homo sapiens
aataagctagttgaatacttga

SEQ ID NO: 1896573 - DNA, 13 bp, Homo sapiens
aataataaagaga

SEQ ID NO: 1896574 - DNA, 11 bp, Homo sapiens
aataatcaaga

SEQ ID NO: 1896575 - DNA, 15 bp, Homo sapiens
aataatcaagagcct

SEQ ID NO: 1896576 - DNA, 20 bp, Homo sapiens
aataatgtctagattttgaa

SEQ ID NO: 1896577 - DNA, 21 bp, Homo sapiens
aataatgtctagattttgaaa

SEQ ID NO: 1896578 - DNA, 13 bp, Homo sapiens
aataattttgtaa

SEQ ID NO: 1896579 - DNA, 14 bp, Homo sapiens
aataattttgtaat

SEQ ID NO: 1896580 - DNA, 17 bp, Homo sapiens
aatacaggtttttttga

SEQ ID NO: 1896581 - DNA, 14 bp, Homo sapiens
aatacatttaaaac

SEQ ID NO: 1896582 - DNA, 20 bp, Homo sapiens
aatactgaaccacttgtaga

SEQ ID NO: 1896583 - DNA, 22 bp, Homo sapiens
aatagaacagtttacttggaaa

SEQ ID NO: 1896584 - DNA, 20 bp, Homo sapiens
aataggatgggcttctgtgc

SEQ ID NO: 1896585 - DNA, 22 bp, Homo sapiens
aatagtatccagcacagatttg

SEQ ID NO: 1896586 - DNA, 15 bp, Homo sapiens
aatagtgatttttgt

SEQ ID NO: 1896587 - DNA, 20 bp, Homo sapiens
aatagtttattttaaaacaa

SEQ ID NO: 1896588 - DNA, 14 bp, Homo sapiens
aatataatattgtc

SEQ ID NO: 1896589 - DNA, 21 bp, Homo sapiens
aatatatttaatggttaaggg

SEQ ID NO: 1896590 - DNA, 17 bp, Homo sapiens
aatatcaaattaattgt

SEQ ID NO: 1896591 - DNA, 20 bp, Homo sapiens
aatatcacactgaataagag

SEQ ID NO: 1896592 - DNA, 21 bp, Homo sapiens
aatatgtattctgtaaaagaa

SEQ ID NO: 1896593 - DNA, 16 bp, Homo sapiens
aatattgttttgcatt

SEQ ID NO: 1896594 - DNA, 20 bp, Homo sapiens
aatatttaagcaataaaact

SEQ ID NO: 1896595 - DNA, 23 bp, Homo sapiens
aatatttaagcaataaaactgct

SEQ ID NO: 1896596 - DNA, 16 bp, Homo sapiens
aatatttatgactttc

SEQ ID NO: 1896597 - DNA, 12 bp, Homo sapiens
aatatttattaa

SEQ ID NO: 1896598 - DNA, 16 bp, Homo sapiens
aatatttattaaattt

SEQ ID NO: 1896599 - DNA, 22 bp, Homo sapiens
aatcaaatcatgtacatttgaa

SEQ ID NO: 1896600 - DNA, 21 bp, Homo sapiens
aatcaagagccttaaaacatc

SEQ ID NO: 1896601 - DNA, 22 bp, Homo sapiens
aatcaagagccttaaaacatca

SEQ ID NO: 1896602 - DNA, 12 bp, Homo sapiens
aatcacaggctg

SEQ ID NO: 1896603 - DNA, 21 bp, Homo sapiens
aatcactgtgtatatttgatt

SEQ ID NO: 1896604 - DNA, 22 bp, Homo sapiens
aatcatggctcttagaaactca

SEQ ID NO: 1896605 - DNA, 14 bp, Homo sapiens
attgaaagaatgta

SEQ ID NO: 1896606 - DNA, 17 bp, Homo sapiens
attgaaagaatgtaaag

SEQ ID NO: 1896607 - DNA, 17 bp, Homo sapiens
attgaaggtttttgata

SEQ ID NO: 1896608 - DNA, 24 bp, Homo sapiens
attgaattcttcacatgtaacttt

SEQ ID NO: 1896609 - DNA, 17 bp, Homo sapiens
attgacaggcgaaagaa

SEQ ID NO: 1896610 - DNA, 21 bp, Homo sapiens
attgagaatagaaatttgccc

SEQ ID NO: 1896611 - DNA, 17 bp, Homo sapiens
attgagaccgtgaagat

SEQ ID NO: 1896612 - DNA, 9 bp, Homo sapiens
attgagatt

SEQ ID NO: 1896613 - DNA, 17 bp, Homo sapiens
attgataaccatagcat

SEQ ID NO: 1896614 - DNA, 13 bp, Homo sapiens
attgatacgttta

SEQ ID NO: 1896615 - DNA, 20 bp, Homo sapiens
attgcaaacaactgaaatgt

SEQ ID NO: 1896616 - DNA, 18 bp, Homo sapiens
attgcagtcactttgaca

SEQ ID NO: 1896617 - DNA, 16 bp, Homo sapiens
attgcatataacttat

SEQ ID NO: 1896618 - DNA, 22 bp, Homo sapiens
attgcatctgggtagctgtaag

SEQ ID NO: 1896619 - DNA, 21 bp, Homo sapiens
attgccaggtatttttctatt

SEQ ID NO: 1896620 - DNA, 17 bp, Homo sapiens
attggaatgcactcaga

SEQ ID NO: 1896621 - DNA, 23 bp, Homo sapiens
attggtactgccttaaagataca

SEQ ID NO: 1896622 - DNA, 17 bp, Homo sapiens
attggtatcaagaaagt

SEQ ID NO: 1896623 - DNA, 17 bp, Homo sapiens
attggttttatgatgac

SEQ ID NO: 1896624 - DNA, 18 bp, Homo sapiens
attggttttatgatgacg

SEQ ID NO: 1896625 - DNA, 20 bp, Homo sapiens
attgtaaaagcattttgtaa

SEQ ID NO: 1896626 - DNA, 21 bp, Homo sapiens
attgtaaaagcattttgtaat

SEQ ID NO: 1896627 - DNA, 16 bp, Homo sapiens
attgtactttgaaaac

SEQ ID NO: 1896628 - DNA, 18 bp, Homo sapiens
attgtagtttgaatattt

SEQ ID NO: 1896629 - DNA, 19 bp, Homo sapiens
attgtcaatgctggagaaa

SEQ ID NO: 1896630 - DNA, 14 bp, Homo sapiens
attgtcctattagt

SEQ ID NO: 1896631 - DNA, 18 bp, Homo sapiens
attgtcctattagtgtta

SEQ ID NO: 1896632 - DNA, 23 bp, Homo sapiens
attgtcctattagtgttatatga

SEQ ID NO: 1896633 - DNA, 15 bp, Homo sapiens
attgtccttgaagct

SEQ ID NO: 1896634 - DNA, 21 bp, Homo sapiens
attgtccttgaagcttgtatc

SEQ ID NO: 1896635 - DNA, 21 bp, Homo sapiens
attgtcttaatggatgaaatc

SEQ ID NO: 1896636 - DNA, 18 bp, Homo sapiens
attgtggggagagaaatc

SEQ ID NO: 1896637 - DNA, 22 bp, Homo sapiens
attgttaacataggcttataca

SEQ ID NO: 1896638 - DNA, 15 bp, Homo sapiens
attgttactccatat

SEQ ID NO: 1896639 - DNA, 21 bp, Homo sapiens
attgttgtttgtatgtataat

SEQ ID NO: 1896640 - DNA, 15 bp, Homo sapiens
attgttttgcattgt

SEQ ID NO: 1896641 - DNA, 21 bp, Homo sapiens
atttaaaacattaaaatataa

SEQ ID NO: 1896642 - DNA, 14 bp, Homo sapiens
atttaaaagacagc

SEQ ID NO: 1896643 - DNA, 17 bp, Homo sapiens
atttaaaagacagcttt

SEQ ID NO: 1896644 - DNA, 18 bp, Homo sapiens
atttaaagacaaagacat

SEQ ID NO: 1896645 - DNA, 15 bp, Homo sapiens
atttaagcaataaaa

SEQ ID NO: 1896646 - DNA, 20 bp, Homo sapiens
atttacaacactttaatggg

SEQ ID NO: 1896647 - DNA, 17 bp, Homo sapiens
atttacgcctgtaaatg

SEQ ID NO: 1896648 - DNA, 20 bp, Homo sapiens
atttactgactgcttataaa

SEQ ID NO: 1896649 - DNA, 17 bp, Homo sapiens
atttactgcattcttct

SEQ ID NO: 1896650 - DNA, 18 bp, Homo sapiens
atttagggagtattctaa

SEQ ID NO: 1896651 - DNA, 14 bp, Homo sapiens
atttatataaagta

SEQ ID NO: 1896652 - DNA, 15 bp, Homo sapiens
atttatataaagtat

SEQ ID NO: 1896653 - DNA, 16 bp, Homo sapiens
atttatataaagtatt

SEQ ID NO: 1896654 - DNA, 20 bp, Homo sapiens
atttatataaagtattttta

SEQ ID NO: 1896655 - DNA, 16 bp, Homo sapiens
atttatatttattgac

SEQ ID NO: 1896656 - DNA, 20 bp, Homo sapiens
atttatatttattgactctt

SEQ ID NO: 1896657 - DNA, 17 bp, Homo sapiens
atttatccaggaattga

SEQ ID NO: 1896658 - DNA, 14 bp, Homo sapiens
atttattaaatttt

SEQ ID NO: 1896659 - DNA, 14 bp, Homo sapiens
atttattaacttaa

SEQ ID NO: 1896660 - DNA, 13 bp, Homo sapiens
atttattgactct

SEQ ID NO: 1896661 - DNA, 20 bp, Homo sapiens
atttattgactcttgagttg

SEQ ID NO: 1896662 - DNA, 21 bp, Homo sapiens
atttattttttttaattgtat

SEQ ID NO: 1896663 - DNA, 22 bp, Homo sapiens
atttattttttttaattgtatt

SEQ ID NO: 1896664 - DNA, 17 bp, Homo sapiens
atttcaaaatatgtgta

SEQ ID NO: 1896665 - DNA, 17 bp, Homo sapiens
atttcatcagaacagct

SEQ ID NO: 1896666 - DNA, 20 bp, Homo sapiens
atttcatcatattatacaga

SEQ ID NO: 1896667 - DNA, 16 bp, Homo sapiens
atttccattaaaggtg

SEQ ID NO: 1896668 - DNA, 19 bp, Homo sapiens
atttcccaacacaaagatt

SEQ ID NO: 1896669 - DNA, 14 bp, Homo sapiens
atttccccagggca

SEQ ID NO: 1896670 - DNA, 16 bp, Homo sapiens
atttcgtgactttttt

SEQ ID NO: 1896671 - DNA, 17 bp, Homo sapiens
atttctctagaggctgg

SEQ ID NO: 1896672 - DNA, 20 bp, Homo sapiens
atttctctagaggctggcaa

SEQ ID NO: 1896673 - DNA, 14 bp, Homo sapiens
atttctctccttaa

SEQ ID NO: 1896674 - DNA, 13 bp, Homo sapiens
atttctctgcaca

SEQ ID NO: 1896675 - DNA, 16 bp, Homo sapiens
atttctctttctctct

SEQ ID NO: 1896676 - DNA, 17 bp, Homo sapiens
atttctctttctctctc

SEQ ID NO: 1896677 - DNA, 20 bp, Homo sapiens
atttcttttcaccattcgta

SEQ ID NO: 1896678 - DNA, 22 bp, Homo sapiens
atttgaaagtgcctttgcagct

SEQ ID NO: 1896679 - DNA, 22 bp, Homo sapiens
atttgatttattaacttaataa

SEQ ID NO: 1896680 - DNA, 15 bp, Homo sapiens
atttgccatagagta

SEQ ID NO: 1896681 - DNA, 15 bp, Homo sapiens
atttgcccctggcaa

SEQ ID NO: 1896682 - DNA, 20 bp, Homo sapiens
atttgcccctggcaaatgca

SEQ ID NO: 1896683 - DNA, 15 bp, Homo sapiens
atttgctttggaagt

SEQ ID NO: 1896684 - DNA, 20 bp, Homo sapiens
atttggaacttacaaagggt

SEQ ID NO: 1896685 - DNA, 21 bp, Homo sapiens
atttggaacttacaaagggtc

SEQ ID NO: 1896686 - DNA, 22 bp, Homo sapiens
atttggaataaaaattccagaa

SEQ ID NO: 1896687 - DNA, 17 bp, Homo sapiens
atttggagggcctgggc

SEQ ID NO: 1896688 - DNA, 22 bp, Homo sapiens
atttggagggcctgggcctggc

SEQ ID NO: 1896689 - DNA, 16 bp, Homo sapiens
atttggcttcctctgc

SEQ ID NO: 1896690 - DNA, 17 bp, Homo sapiens
atttggcttcctctgct

SEQ ID NO: 1896691 - DNA, 18 bp, Homo sapiens
atttggcttcctctgctg

SEQ ID NO: 1896692 - DNA, 15 bp, Homo sapiens
atttggtatccttat

SEQ ID NO: 1896693 - DNA, 20 bp, Homo sapiens
atttgtattaatttgtaaga

SEQ ID NO: 1896694 - DNA, 20 bp, Homo sapiens
atttgtgtggagtcatttct

SEQ ID NO: 1896695 - DNA, 13 bp, Homo sapiens
atttgtgtgttac

SEQ ID NO: 1896696 - DNA, 14 bp, Homo sapiens
atttgtttaaagta

SEQ ID NO: 1896697 - DNA, 18 bp, Homo sapiens
attttaaaacaataggat

SEQ ID NO: 1896698 - DNA, 22 bp, Homo sapiens
attttattttgaaatggaaatt

SEQ ID NO: 1896699 - DNA, 23 bp, Homo sapiens
attttattttgaaatggaaatta

SEQ ID NO: 1896700 - DNA, 14 bp, Homo sapiens
attttcaatgtgat

SEQ ID NO: 1896701 - DNA, 23 bp, Homo sapiens
attttcttaaaaccaatcaataa

SEQ ID NO: 1896702 - DNA, 22 bp, Homo sapiens
attttgaaaaattacctgtata

SEQ ID NO: 1896703 - DNA, 18 bp, Homo sapiens
attttgacaactgaaaga

SEQ ID NO: 1896704 - DNA, 14 bp, Homo sapiens
attttgaccttgta

SEQ ID NO: 1896705 - DNA, 20 bp, Homo sapiens
attttgcatatccttttagt

SEQ ID NO: 1896706 - DNA, 18 bp, Homo sapiens
attttggacctaaacatt

SEQ ID NO: 1896707 - DNA, 13 bp, Homo sapiens
attttggttttct

SEQ ID NO: 1896708 - DNA, 17 bp, Homo sapiens
attttgtgtaagaaata

SEQ ID NO: 1896709 - DNA, 18 bp, Homo sapiens
attttgtgtaagaaatac

SEQ ID NO: 1896710 - DNA, 14 bp, Homo sapiens
atttttaacaagtc

SEQ ID NO: 1896711 - DNA, 14 bp, Homo sapiens
atttttactgcttt

SEQ ID NO: 1896712 - DNA, 18 bp, Homo sapiens
atttttactgctttctga

SEQ ID NO: 1896713 - DNA, 21 bp, Homo sapiens
atttttactgctttctgaatg

SEQ ID NO: 1896714 - DNA, 15 bp, Homo sapiens
atttttatgtgtgat

SEQ ID NO: 1896715 - DNA, 12 bp, Homo sapiens
atttttctctct

SEQ ID NO: 1896716 - DNA, 19 bp, Homo sapiens
atttttcttatttatgtaa

SEQ ID NO: 1896717 - DNA, 20 bp, Homo sapiens
atttttcttatttatgtaac

SEQ ID NO: 1896718 - DNA, 15 bp, Homo sapiens
atttttcttcagact

SEQ ID NO: 1896719 - DNA, 18 bp, Homo sapiens
atttttctttattgctta

SEQ ID NO: 1896720 - DNA, 19 bp, Homo sapiens
atttttgatctttgagtgt

SEQ ID NO: 1896721 - DNA, 15 bp, Homo sapiens
atttttggttgaata

SEQ ID NO: 1896722 - DNA, 12 bp, Homo sapiens
atttttgttgtt

SEQ ID NO: 1896723 - DNA, 21 bp, Homo sapiens
attttttaagtgaaaatatag

SEQ ID NO: 1896724 - DNA, 12 bp, Homo sapiens
attttttgtgtg

SEQ ID NO: 1896725 - DNA, 21 bp, Homo sapiens
atttttttgaactcttctcat

SEQ ID NO: 1896726 - DNA, 13 bp, Homo sapiens
atttttttgtatg

SEQ ID NO: 1896727 - DNA, 21 bp, Homo sapiens
atttttttttttaatctactg

SEQ ID NO: 1896728 - DNA, 12 bp, Homo sapiens
caaaaaagagaa

SEQ ID NO: 1896729 - DNA, 14 bp, Homo sapiens
caaaagtagaactt

SEQ ID NO: 1896730 - DNA, 21 bp, Homo sapiens
caaaagtagaactttgtatag

SEQ ID NO: 1896731 - DNA, 15 bp, Homo sapiens
caaaataagaaaaga

SEQ ID NO: 1896732 - DNA, 12 bp, Homo sapiens
caaaatgtgagt

SEQ ID NO: 1896733 - DNA, 19 bp, Homo sapiens
caaaatgtgagtggttgaa

SEQ ID NO: 1896734 - DNA, 15 bp, Homo sapiens
caaaattaaacttca

SEQ ID NO: 1896735 - DNA, 16 bp, Homo sapiens
caaaattaaggtgttt

SEQ ID NO: 1896736 - DNA, 19 bp, Homo sapiens
caaaattcaaaatactttt

SEQ ID NO: 1896737 - DNA, 12 bp, Homo sapiens
caaacacaggca

SEQ ID NO: 1896738 - DNA, 14 bp, Homo sapiens
caaacagaagtgca

SEQ ID NO: 1896739 - DNA, 15 bp, Homo sapiens
caaacagaagtgcat

SEQ ID NO: 1896740 - DNA, 16 bp, Homo sapiens
caaacagaagtgcatc

SEQ ID NO: 1896741 - DNA, 19 bp, Homo sapiens
atgcatctttgatgtgttg

SEQ ID NO: 1896742 - DNA, 20 bp, Homo sapiens
atgcattaaaagaaaataaa

SEQ ID NO: 1896743 - DNA, 17 bp, Homo sapiens
atgcattgactatttct

SEQ ID NO: 1896744 - DNA, 19 bp, Homo sapiens
atgcatttatcaataaaag

SEQ ID NO: 1896745 - DNA, 16 bp, Homo sapiens
atgccccctcccctcc

SEQ ID NO: 1896746 - DNA, 17 bp, Homo sapiens
atgccccctcccctcct

SEQ ID NO: 1896747 - DNA, 13 bp, Homo sapiens
atgcctcctcctg

SEQ ID NO: 1896748 - DNA, 14 bp, Homo sapiens
atgcctcctcctgc

SEQ ID NO: 1896749 - DNA, 17 bp, Homo sapiens
atgcctcctcctgccct

SEQ ID NO: 1896750 - DNA, 19 bp, Homo sapiens
atgcctgtcttaattttct

SEQ ID NO: 1896751 - DNA, 20 bp, Homo sapiens
atgcgtagcatttgctgcat

SEQ ID NO: 1896752 - DNA, 17 bp, Homo sapiens
atgctaatcttgtgaaa

SEQ ID NO: 1896753 - DNA, 19 bp, Homo sapiens
atgctgacccatgggcagg

SEQ ID NO: 1896754 - DNA, 23 bp, Homo sapiens
atgctggagaaaaatatctgtaa

SEQ ID NO: 1896755 - DNA, 22 bp, Homo sapiens
atgctgtctggcacagcctgca

SEQ ID NO: 1896756 - DNA, 20 bp, Homo sapiens
atgctgtgggaaggcaattt

SEQ ID NO: 1896757 - DNA, 14 bp, Homo sapiens
atgcttttctcaaa

SEQ ID NO: 1896758 - DNA, 18 bp, Homo sapiens
atggaagagaagagaaag

SEQ ID NO: 1896759 - DNA, 15 bp, Homo sapiens
atggaatttttttgt

SEQ ID NO: 1896760 - DNA, 16 bp, Homo sapiens
atggaatttttttgta

SEQ ID NO: 1896761 - DNA, 15 bp, Homo sapiens
atggcagcatgcaaa

SEQ ID NO: 1896762 - DNA, 17 bp, Homo sapiens
atggcagtggctgtgaa

SEQ ID NO: 1896763 - DNA, 22 bp, Homo sapiens
atggccacatcctcatggccca

SEQ ID NO: 1896764 - DNA, 16 bp, Homo sapiens
atggcccatcaggggc

SEQ ID NO: 1896765 - DNA, 13 bp, Homo sapiens
atggctcttagaa

SEQ ID NO: 1896766 - DNA, 17 bp, Homo sapiens
atggctcttagaaactc

SEQ ID NO: 1896767 - DNA, 23 bp, Homo sapiens
atggctgaagtgcatgggtcagg

SEQ ID NO: 1896768 - DNA, 15 bp, Homo sapiens
atggcttctctgttt

SEQ ID NO: 1896769 - DNA, 18 bp, Homo sapiens
atggctttatttttttga

SEQ ID NO: 1896770 - DNA, 13 bp, Homo sapiens
atggggaggacaa

SEQ ID NO: 1896771 - DNA, 22 bp, Homo sapiens
atgggtactgtctcggcagagg

SEQ ID NO: 1896772 - DNA, 23 bp, Homo sapiens
atgggtactgtctcggcagaggt

SEQ ID NO: 1896773 - DNA, 12 bp, Homo sapiens
atggtagtttct

SEQ ID NO: 1896774 - DNA, 22 bp, Homo sapiens
atggtagtttctgtggttggct

SEQ ID NO: 1896775 - DNA, 23 bp, Homo sapiens
atggtagtttctgtggttggctg

SEQ ID NO: 1896776 - DNA, 19 bp, Homo sapiens
atggtgatgcagtcttaga

SEQ ID NO: 1896777 - DNA, 20 bp, Homo sapiens
atggtgatgcagtcttagat

SEQ ID NO: 1896778 - DNA, 24 bp, Homo sapiens
atggtggttgggacccagtggcag

SEQ ID NO: 1896779 - DNA, 14 bp, Homo sapiens
atgtaaataattct

SEQ ID NO: 1896780 - DNA, 23 bp, Homo sapiens
atgtaaggttttttttgtacgca

SEQ ID NO: 1896781 - DNA, 13 bp, Homo sapiens
atgtaatttgtgt

SEQ ID NO: 1896782 - DNA, 12 bp, Homo sapiens
atgtaattttgt

SEQ ID NO: 1896783 - DNA, 15 bp, Homo sapiens
atgtaattttgtgta

SEQ ID NO: 1896784 - DNA, 22 bp, Homo sapiens
atgtaattttgtgtaagaaata

SEQ ID NO: 1896785 - DNA, 16 bp, Homo sapiens
atgtagatttatttca

SEQ ID NO: 1896786 - DNA, 17 bp, Homo sapiens
atgtagatttatttcat

SEQ ID NO: 1896787 - DNA, 18 bp, Homo sapiens
atgtatatagatatattt

SEQ ID NO: 1896788 - DNA, 22 bp, Homo sapiens
atgtatatttttgatctttgag

SEQ ID NO: 1896789 - DNA, 12 bp, Homo sapiens
atgtatgtgttt

SEQ ID NO: 1896790 - DNA, 17 bp, Homo sapiens
atgtatgtgtttagaat

SEQ ID NO: 1896791 - DNA, 20 bp, Homo sapiens
atgtatgtgtttagaattga

SEQ ID NO: 1896792 - DNA, 22 bp, Homo sapiens
atgtattctgggtattctatta

SEQ ID NO: 1896793 - DNA, 18 bp, Homo sapiens
atgtattctgtaaaagaa

SEQ ID NO: 1896794 - DNA, 16 bp, Homo sapiens
atgtattttgtgaata

SEQ ID NO: 1896795 - DNA, 13 bp, Homo sapiens
atgtcagcagttg

SEQ ID NO: 1896796 - DNA, 16 bp, Homo sapiens
atgtcagcagttgctg

SEQ ID NO: 1896797 - DNA, 20 bp, Homo sapiens
atgtcagcagttgctggtaa

SEQ ID NO: 1896798 - DNA, 21 bp, Homo sapiens
atgtcagcagttgctggtaaa

SEQ ID NO: 1896799 - DNA, 21 bp, Homo sapiens
atgtccagtaagatcactgtt

SEQ ID NO: 1896800 - DNA, 15 bp, Homo sapiens
atgtcctaatggtga

SEQ ID NO: 1896801 - DNA, 22 bp, Homo sapiens
atgtctcaagtgcaatgccccc

SEQ ID NO: 1896802 - DNA, 15 bp, Homo sapiens
atgtgagtggttgaa

SEQ ID NO: 1896803 - DNA, 21 bp, Homo sapiens
atgtgattgcctcaataaagc

SEQ ID NO: 1896804 - DNA, 18 bp, Homo sapiens
atgtgcctaaataagtta

SEQ ID NO: 1896805 - DNA, 23 bp, Homo sapiens
atgtgcctgcttcagcctcccac

SEQ ID NO: 1896806 - DNA, 13 bp, Homo sapiens
atgtgtctcctgt

SEQ ID NO: 1896807 - DNA, 21 bp, Homo sapiens
atgtgtgattcaatgcctctg

SEQ ID NO: 1896808 - DNA, 13 bp, Homo sapiens
atgtgtgcccagc

SEQ ID NO: 1896809 - DNA, 15 bp, Homo sapiens
atgtgtgcccagctt

SEQ ID NO: 1896810 - DNA, 21 bp, Homo sapiens
atgtgttgtaaaaatgtcttt

SEQ ID NO: 1896811 - DNA, 16 bp, Homo sapiens
atgttataacttatga

SEQ ID NO: 1896812 - DNA, 14 bp, Homo sapiens
atgttatagctgca

SEQ ID NO: 1896813 - DNA, 16 bp, Homo sapiens
atgttgccaaaatggt

SEQ ID NO: 1896814 - DNA, 20 bp, Homo sapiens
atgttggactctgagctcat

SEQ ID NO: 1896815 - DNA, 20 bp, Homo sapiens
atgttgtaaaatgaatttgt

SEQ ID NO: 1896816 - DNA, 21 bp, Homo sapiens
atgtttaaaacaccttctata

SEQ ID NO: 1896817 - DNA, 15 bp, Homo sapiens
atgtttccttccctc

SEQ ID NO: 1896818 - DNA, 13 bp, Homo sapiens
atgtttgcagtgt

SEQ ID NO: 1896819 - DNA, 22 bp, Homo sapiens
atgttttggtctgaaaagctgt

SEQ ID NO: 1896820 - DNA, 18 bp, Homo sapiens
atgtttttagttctgact

SEQ ID NO: 1896821 - DNA, 23 bp, Homo sapiens
atgtttttagttctgactttgaa

SEQ ID NO: 1896822 - DNA, 12 bp, Homo sapiens
attaaaaaacaa

SEQ ID NO: 1896823 - DNA, 16 bp, Homo sapiens
attaaaaccttaagag

SEQ ID NO: 1896824 - DNA, 18 bp, Homo sapiens
attaaaactttgtagaca

SEQ ID NO: 1896825 - DNA, 21 bp, Homo sapiens
attaaaactttgtagacattt

SEQ ID NO: 1896826 - DNA, 23 bp, Homo sapiens
attaaaactttgtagacattttg

SEQ ID NO: 1896827 - DNA, 13 bp, Homo sapiens
attaaaatataat

SEQ ID NO: 1896828 - DNA, 18 bp, Homo sapiens
attaaaatataatctcta

SEQ ID NO: 1896829 - DNA, 14 bp, Homo sapiens
attaaatatatttt

SEQ ID NO: 1896830 - DNA, 18 bp, Homo sapiens
attaaatgaacatctata

SEQ ID NO: 1896831 - DNA, 23 bp, Homo sapiens
attaaatttttttgtatgaaaac

SEQ ID NO: 1896832 - DNA, 14 bp, Homo sapiens
attaacttaataat

SEQ ID NO: 1896833 - DNA, 19 bp, Homo sapiens
attaacttaataatcaaga

SEQ ID NO: 1896834 - DNA, 15 bp, Homo sapiens
attaaggtgtttgaa

SEQ ID NO: 1896835 - DNA, 18 bp, Homo sapiens
attaaggtgtttgaaaat

SEQ ID NO: 1896836 - DNA, 20 bp, Homo sapiens
attaatcactgtgtatattt

SEQ ID NO: 1896837 - DNA, 22 bp, Homo sapiens
attaatcactgtgtatatttga

SEQ ID NO: 1896838 - DNA, 21 bp, Homo sapiens
attaatgtatccaatgaaata

SEQ ID NO: 1896839 - DNA, 11 bp, Homo sapiens
attaattgtgt

SEQ ID NO: 1896840 - DNA, 21 bp, Homo sapiens
attaattgtgtgaacttggaa

SEQ ID NO: 1896841 - DNA, 23 bp, Homo sapiens
attacagtctcactcagaactgt

SEQ ID NO: 1896842 - DNA, 20 bp, Homo sapiens
attacctctttggaaaagga

SEQ ID NO: 1896843 - DNA, 17 bp, Homo sapiens
attacctgtataatgga

SEQ ID NO: 1896844 - DNA, 21 bp, Homo sapiens
attactagactgccacaagga

SEQ ID NO: 1896845 - DNA, 15 bp, Homo sapiens
attagaaaaggaaat

SEQ ID NO: 1896846 - DNA, 17 bp, Homo sapiens
attagtgttatatgaac

SEQ ID NO: 1896847 - DNA, 21 bp, Homo sapiens
attagtgttatatgaacatac

SEQ ID NO: 1896848 - DNA, 13 bp, Homo sapiens
attatataagcaa

SEQ ID NO: 1896849 - DNA, 14 bp, Homo sapiens
attattattcagaa

SEQ ID NO: 1896850 - DNA, 11 bp, Homo sapiens
attatttaaag

SEQ ID NO: 1896851 - DNA, 15 bp, Homo sapiens
attattttgtttaaa

SEQ ID NO: 1896852 - DNA, 15 bp, Homo sapiens
attatttttctctct

SEQ ID NO: 1896853 - DNA, 18 bp, Homo sapiens
attcaaaatactttttaa

SEQ ID NO: 1896854 - DNA, 19 bp, Homo sapiens
attcagcattagtgggaaa

SEQ ID NO: 1896855 - DNA, 23 bp, Homo sapiens
attcagcttctataagtgtgacc

SEQ ID NO: 1896856 - DNA, 16 bp, Homo sapiens
attcagtgatgtgcct

SEQ ID NO: 1896857 - DNA, 16 bp, Homo sapiens
attcatacacaacgta

SEQ ID NO: 1896858 - DNA, 23 bp, Homo sapiens
attcatagtgatagagtgcagtg

SEQ ID NO: 1896859 - DNA, 20 bp, Homo sapiens
attccagcacttcaggaggc

SEQ ID NO: 1896860 - DNA, 20 bp, Homo sapiens
attcccgggtgcagaattgt

SEQ ID NO: 1896861 - DNA, 19 bp, Homo sapiens
attcccttgttattcaaca

SEQ ID NO: 1896862 - DNA, 22 bp, Homo sapiens
attcctgacgagataagcagtt

SEQ ID NO: 1896863 - DNA, 18 bp, Homo sapiens
attcctttttatttatat

SEQ ID NO: 1896864 - DNA, 21 bp, Homo sapiens
attcctttttatttatatgta

SEQ ID NO: 1896865 - DNA, 18 bp, Homo sapiens
attcgtacataatactga

SEQ ID NO: 1896866 - DNA, 22 bp, Homo sapiens
attctaaaatgtctcaagtgca

SEQ ID NO: 1896867 - DNA, 20 bp, Homo sapiens
attctaataagctagttgaa

SEQ ID NO: 1896868 - DNA, 23 bp, Homo sapiens
attctcccgggactctgcatatt

SEQ ID NO: 1896869 - DNA, 21 bp, Homo sapiens
attctctccatttcactggct

SEQ ID NO: 1896870 - DNA, 14 bp, Homo sapiens
attctggttgtaaa

SEQ ID NO: 1896871 - DNA, 13 bp, Homo sapiens
attcttattacta

SEQ ID NO: 1896872 - DNA, 15 bp, Homo sapiens
attcttcacatgtaa

SEQ ID NO: 1896873 - DNA, 17 bp, Homo sapiens
attcttcacatgtaact

SEQ ID NO: 1896874 - DNA, 14 bp, Homo sapiens
attcttttttatta

SEQ ID NO: 1896875 - DNA, 16 bp, Homo sapiens
attcttttttattaat

SEQ ID NO: 1896876 - DNA, 13 bp, Homo sapiens
atataagcaaaat

SEQ ID NO: 1896877 - DNA, 18 bp, Homo sapiens
atatatccacacatttgt

SEQ ID NO: 1896878 - DNA, 22 bp, Homo sapiens
atatattcccctaagatttgat

SEQ ID NO: 1896879 - DNA, 18 bp, Homo sapiens
atatattttatttttaga

SEQ ID NO: 1896880 - DNA, 15 bp, Homo sapiens
atatattttgaaata

SEQ ID NO: 1896881 - DNA, 19 bp, Homo sapiens
atatatttttatatgtgga

SEQ ID NO: 1896882 - DNA, 17 bp, Homo sapiens
atatatttttcttattt

SEQ ID NO: 1896883 - DNA, 14 bp, Homo sapiens
atatcagcactgga

SEQ ID NO: 1896884 - DNA, 18 bp, Homo sapiens
atatcccctatttaacag

SEQ ID NO: 1896885 - DNA, 18 bp, Homo sapiens
atatgaacatacaaatgc

SEQ ID NO: 1896886 - DNA, 20 bp, Homo sapiens
atatgtatctttataattga

SEQ ID NO: 1896887 - DNA, 13 bp, Homo sapiens
atatgtatgtgtt

SEQ ID NO: 1896888 - DNA, 18 bp, Homo sapiens
atatgtatgtgtttagaa

SEQ ID NO: 1896889 - DNA, 20 bp, Homo sapiens
atatgtatgtgtttagaatt

SEQ ID NO: 1896890 - DNA, 21 bp, Homo sapiens
atatgtatgtgtttagaattg

SEQ ID NO: 1896891 - DNA, 21 bp, Homo sapiens
atatgtattctgtaaaagaaa

SEQ ID NO: 1896892 - DNA, 18 bp, Homo sapiens
atatgtgtatctcaaatt

SEQ ID NO: 1896893 - DNA, 21 bp, Homo sapiens
atattactgtacatgggacta

SEQ ID NO: 1896894 - DNA, 19 bp, Homo sapiens
atattctagtaataaagac

SEQ ID NO: 1896895 - DNA, 21 bp, Homo sapiens
atattctagtaataaagactc

SEQ ID NO: 1896896 - DNA, 13 bp, Homo sapiens
atattctatttta

SEQ ID NO: 1896897 - DNA, 16 bp, Homo sapiens
atattctattttacaa

SEQ ID NO: 1896898 - DNA, 18 bp, Homo sapiens
atattctgatgtttctca

SEQ ID NO: 1896899 - DNA, 13 bp, Homo sapiens
atattgtaagaaa

SEQ ID NO: 1896900 - DNA, 16 bp, Homo sapiens
atattgtaagaaatac

SEQ ID NO: 1896901 - DNA, 18 bp, Homo sapiens
atatttattgactcttga

SEQ ID NO: 1896902 - DNA, 19 bp, Homo sapiens
atatttcaagtacactgaa

SEQ ID NO: 1896903 - DNA, 15 bp, Homo sapiens
atatttgatttatta

SEQ ID NO: 1896904 - DNA, 14 bp, Homo sapiens
atattttaaacaga

SEQ ID NO: 1896905 - DNA, 23 bp, Homo sapiens
atattttacattcttggaaagtc

SEQ ID NO: 1896906 - DNA, 14 bp, Homo sapiens
atattttattttta

SEQ ID NO: 1896907 - DNA, 20 bp, Homo sapiens
atatttttactgctttctga

SEQ ID NO: 1896908 - DNA, 21 bp, Homo sapiens
atatttttactgctttctgaa

SEQ ID NO: 1896909 - DNA, 13 bp, Homo sapiens
atatttttatagg

SEQ ID NO: 1896910 - DNA, 20 bp, Homo sapiens
atatttttcttatttatgta

SEQ ID NO: 1896911 - DNA, 11 bp, Homo sapiens
atcaaactgct

SEQ ID NO: 1896912 - DNA, 14 bp, Homo sapiens
atcaaatacattta

SEQ ID NO: 1896913 - DNA, 16 bp, Homo sapiens
atcaaattaattgtgt

SEQ ID NO: 1896914 - DNA, 16 bp, Homo sapiens
atcaacacacatttta

SEQ ID NO: 1896915 - DNA, 19 bp, Homo sapiens
atcacaaatgactttatta

SEQ ID NO: 1896916 - DNA, 17 bp, Homo sapiens
atcacactgaataagag

SEQ ID NO: 1896917 - DNA, 22 bp, Homo sapiens
atcacagatttgctaataatgt

SEQ ID NO: 1896918 - DNA, 14 bp, Homo sapiens
atcacagcagggcc

SEQ ID NO: 1896919 - DNA, 14 bp, Homo sapiens
atcacctcagggca

SEQ ID NO: 1896920 - DNA, 19 bp, Homo sapiens
atcactgaacctctcagga

SEQ ID NO: 1896921 - DNA, 20 bp, Homo sapiens
atcactgtgtatatttgatt

SEQ ID NO: 1896922 - DNA, 14 bp, Homo sapiens
atcactgtttagat

SEQ ID NO: 1896923 - DNA, 16 bp, Homo sapiens
atcactgtttagattt

SEQ ID NO: 1896924 - DNA, 12 bp, Homo sapiens
atcacttaaaac

SEQ ID NO: 1896925 - DNA, 16 bp, Homo sapiens
atcagcactggattgt

SEQ ID NO: 1896926 - DNA, 20 bp, Homo sapiens
atcagctacccctgcagctg

SEQ ID NO: 1896927 - DNA, 16 bp, Homo sapiens
atcatagttttattta

SEQ ID NO: 1896928 - DNA, 17 bp, Homo sapiens
atcatagttttatttat

SEQ ID NO: 1896929 - DNA, 20 bp, Homo sapiens
atcatggctcttagaaactc

SEQ ID NO: 1896930 - DNA, 21 bp, Homo sapiens
atcattcctttttatttatat

SEQ ID NO: 1896931 - DNA, 11 bp, Homo sapiens
atcatttgagt

SEQ ID NO: 1896932 - DNA, 12 bp, Homo sapiens
atcatttgttca

SEQ ID NO: 1896933 - DNA, 21 bp, Homo sapiens
atccacccctctggcacctgg

SEQ ID NO: 1896934 - DNA, 14 bp, Homo sapiens
atccagctcaaggg

SEQ ID NO: 1896935 - DNA, 11 bp, Homo sapiens
atccaggaccc

SEQ ID NO: 1896936 - DNA, 18 bp, Homo sapiens
atccaggaccctgccagg

SEQ ID NO: 1896937 - DNA, 19 bp, Homo sapiens
atccaggaccctgccaggc

SEQ ID NO: 1896938 - DNA, 20 bp, Homo sapiens
atccaggaccctgccaggca

SEQ ID NO: 1896939 - DNA, 15 bp, Homo sapiens
agactgccacaagga

SEQ ID NO: 1896940 - DNA, 11 bp, Homo sapiens
agactgccagc

SEQ ID NO: 1896941 - DNA, 12 bp, Homo sapiens
agactgccagct

SEQ ID NO: 1896942 - DNA, 18 bp, Homo sapiens
agactgccagctcttcct

SEQ ID NO: 1896943 - DNA, 16 bp, Homo sapiens
agactgctcctgagcc

SEQ ID NO: 1896944 - DNA, 19 bp, Homo sapiens
agactgctcctgagccccc

SEQ ID NO: 1896945 - DNA, 23 bp, Homo sapiens
agactgctcctgagcccccagct

SEQ ID NO: 1896946 - DNA, 15 bp, Homo sapiens
agactgcttgacaaa

SEQ ID NO: 1896947 - DNA, 20 bp, Homo sapiens
agactgtggagactgctcct

SEQ ID NO: 1896948 - DNA, 15 bp, Homo sapiens
agacttacggcaaga

SEQ ID NO: 1896949 - DNA, 20 bp, Homo sapiens
agacttacggcaagaaggca

SEQ ID NO: 1896950 - DNA, 13 bp, Homo sapiens
agacttatgccat

SEQ ID NO: 1896951 - DNA, 23 bp, Homo sapiens
agacttccccaagcctggcaggg

SEQ ID NO: 1896952 - DNA, 12 bp, Homo sapiens
agacttgaaaag

SEQ ID NO: 1896953 - DNA, 19 bp, Homo sapiens
agacttgaaaagagacagg

SEQ ID NO: 1896954 - DNA, 22 bp, Homo sapiens
agacttgaaaagagacaggcag

SEQ ID NO: 1896955 - DNA, 18 bp, Homo sapiens
agacttgtatattctatt

SEQ ID NO: 1896956 - DNA, 17 bp, Homo sapiens
agactttagctttctga

SEQ ID NO: 1896957 - DNA, 17 bp, Homo sapiens
agactttgatgtcagca

SEQ ID NO: 1896958 - DNA, 18 bp, Homo sapiens
agactttgatgtcagcag

SEQ ID NO: 1896959 - DNA, 13 bp, Homo sapiens
agagaaaagaaaa

SEQ ID NO: 1896960 - DNA, 14 bp, Homo sapiens
agagaaaagaaaaa

SEQ ID NO: 1896961 - DNA, 15 bp, Homo sapiens
agagaaaagaaaaaa

SEQ ID NO: 1896962 - DNA, 15 bp, Homo sapiens
agagaaccatgtgct

SEQ ID NO: 1896963 - DNA, 16 bp, Homo sapiens
agagaacttttttcaa

SEQ ID NO: 1896964 - DNA, 17 bp, Homo sapiens
agagaagagaaaggaca

SEQ ID NO: 1896965 - DNA, 15 bp, Homo sapiens
agagaagagccccac

SEQ ID NO: 1896966 - DNA, 18 bp, Homo sapiens
agagaagagccccactct

SEQ ID NO: 1896967 - DNA, 18 bp, Homo sapiens
agagaagtgacggttcct

SEQ ID NO: 1896968 - DNA, 19 bp, Homo sapiens
agagaagtgacggttccta

SEQ ID NO: 1896969 - DNA, 12 bp, Homo sapiens
agagacagggcc

SEQ ID NO: 1896970 - DNA, 16 bp, Homo sapiens
agagagaagagcccca

SEQ ID NO: 1896971 - DNA, 21 bp, Homo sapiens
agagagctgagacccttattt

SEQ ID NO: 1896972 - DNA, 20 bp, Homo sapiens
agagagggaagctgaggccc

SEQ ID NO: 1896973 - DNA, 16 bp, Homo sapiens
agagccccactctcag

SEQ ID NO: 1896974 - DNA, 20 bp, Homo sapiens
agagccccactctcagaggc

SEQ ID NO: 1896975 - DNA, 14 bp, Homo sapiens
agagccttaaaaca

SEQ ID NO: 1896976 - DNA, 13 bp, Homo sapiens
agaggagccctgc

SEQ ID NO: 1896977 - DNA, 14 bp, Homo sapiens
agaggattttgcgt

SEQ ID NO: 1896978 - DNA, 21 bp, Homo sapiens
agaggccccaataccccatgg

SEQ ID NO: 1896979 - DNA, 21 bp, Homo sapiens
agaggcctttagttataaagg

SEQ ID NO: 1896980 - DNA, 15 bp, Homo sapiens
actgtccgctgtctc

SEQ ID NO: 1896981 - DNA, 12 bp, Homo sapiens
actgtctcggca

SEQ ID NO: 1896982 - DNA, 15 bp, Homo sapiens
actgtctcggcagag

SEQ ID NO: 1896983 - DNA, 19 bp, Homo sapiens
actgtgcagtggagcagaa

SEQ ID NO: 1896984 - DNA, 11 bp, Homo sapiens
actgtggagac

SEQ ID NO: 1896985 - DNA, 14 bp, Homo sapiens
actgtggcagcagg

SEQ ID NO: 1896986 - DNA, 15 bp, Homo sapiens
actgtgtatatttga

SEQ ID NO: 1896987 - DNA, 11 bp, Homo sapiens
actgtgttaaa

SEQ ID NO: 1896988 - DNA, 20 bp, Homo sapiens
actgttatgtgagaacatta

SEQ ID NO: 1896989 - DNA, 13 bp, Homo sapiens
actgttcagtatt

SEQ ID NO: 1896990 - DNA, 13 bp, Homo sapiens
actgtttagattt

SEQ ID NO: 1896991 - DNA, 20 bp, Homo sapiens
actgttttgtatatgctgca

SEQ ID NO: 1896992 - DNA, 14 bp, Homo sapiens
acttaaaacacgtt

SEQ ID NO: 1896993 - DNA, 21 bp, Homo sapiens
acttaaaatgatcaaggcact

SEQ ID NO: 1896994 - DNA, 19 bp, Homo sapiens
acttaataatcaagagcct

SEQ ID NO: 1896995 - DNA, 22 bp, Homo sapiens
acttaataatcaagagccttaa

SEQ ID NO: 1896996 - DNA, 13 bp, Homo sapiens
acttacaaagggt

SEQ ID NO: 1896997 - DNA, 23 bp, Homo sapiens
acttacctgaaggggttttcttg

SEQ ID NO: 1896998 - DNA, 22 bp, Homo sapiens
acttagaatccctgtgttaatt

SEQ ID NO: 1896999 - DNA, 15 bp, Homo sapiens
acttatattgtaaga

SEQ ID NO: 1897000 - DNA, 20 bp, Homo sapiens
acttatattgtaagaaatac

SEQ ID NO: 1897001 - DNA, 21 bp, Homo sapiens
acttatattgtaagaaatact

SEQ ID NO: 1897002 - DNA, 21 bp, Homo sapiens
acttccctgggttagactgcc

SEQ ID NO: 1897003 - DNA, 22 bp, Homo sapiens
acttccctgggttagactgcca

SEQ ID NO: 1897004 - DNA, 20 bp, Homo sapiens
acttcctcaatgcattgact

SEQ ID NO: 1897005 - DNA, 12 bp, Homo sapiens
acttctgccaga

SEQ ID NO: 1897006 - DNA, 19 bp, Homo sapiens
acttctgccagatgtccta

SEQ ID NO: 1897007 - DNA, 14 bp, Homo sapiens
acttgaaccataaa

SEQ ID NO: 1897008 - DNA, 22 bp, Homo sapiens
acttgaaccataaaatgtccag

SEQ ID NO: 1897009 - DNA, 15 bp, Homo sapiens
acttgagggccagga

SEQ ID NO: 1897010 - DNA, 16 bp, Homo sapiens
acttgagttaactttt

SEQ ID NO: 1897011 - DNA, 22 bp, Homo sapiens
acttgagttaactttttgtagg

SEQ ID NO: 1897012 - DNA, 21 bp, Homo sapiens
acttgctccattcatacacaa

SEQ ID NO: 1897013 - DNA, 19 bp, Homo sapiens
acttggaaattgttaacat

SEQ ID NO: 1897014 - DNA, 18 bp, Homo sapiens
cacccatgaaagaaaact

SEQ ID NO: 1897015 - DNA, 16 bp, Homo sapiens
cacccctctggcacct

SEQ ID NO: 1897016 - DNA, 18 bp, Homo sapiens
caccctgcttggcccagg

SEQ ID NO: 1897017 - DNA, 15 bp, Homo sapiens
cacccttggagctct

SEQ ID NO: 1897018 - DNA, 22 bp, Homo sapiens
caccctttctacttccaagact

SEQ ID NO: 1897019 - DNA, 19 bp, Homo sapiens
caccctttctgccagggat

SEQ ID NO: 1897020 - DNA, 16 bp, Homo sapiens
cacctcatgctagcct

SEQ ID NO: 1897021 - DNA, 18 bp, Homo sapiens
cacctccccttgccagct

SEQ ID NO: 1897022 - DNA, 22 bp, Homo sapiens
cacctccccttgccagctgctg

SEQ ID NO: 1897023 - DNA, 17 bp, Homo sapiens
cacctctgccccttggg

SEQ ID NO: 1897024 - DNA, 23 bp, Homo sapiens
cacctctgccccttgggcctccc

SEQ ID NO: 1897025 - DNA, 17 bp, Homo sapiens
cacctctgtgcagggca

SEQ ID NO: 1897026 - DNA, 17 bp, Homo sapiens
cacctcttcctggccgg

SEQ ID NO: 1897027 - DNA, 15 bp, Homo sapiens
cacctgagttcctga

SEQ ID NO: 1897028 - DNA, 22 bp, Homo sapiens
cacctgcacaggtatttttgaa

SEQ ID NO: 1897029 - DNA, 17 bp, Homo sapiens
cacctggccctctctga

SEQ ID NO: 1897030 - DNA, 19 bp, Homo sapiens
cacctggccctctctgaag

SEQ ID NO: 1897031 - DNA, 21 bp, Homo sapiens
caccttctatagcatcactta

SEQ ID NO: 1897032 - DNA, 20 bp, Homo sapiens
caccttcttgggactgctgt

SEQ ID NO: 1897033 - DNA, 22 bp, Homo sapiens
caccttcttgggactgctgtga

SEQ ID NO: 1897034 - DNA, 22 bp, Homo sapiens
caccttggttcctggggcatcc

SEQ ID NO: 1897035 - DNA, 17 bp, Homo sapiens
cacgcctctccccacct

SEQ ID NO: 1897036 - DNA, 12 bp, Homo sapiens
cacgctcctttc

SEQ ID NO: 1897037 - DNA, 14 bp, Homo sapiens
cacgctggggaaga

SEQ ID NO: 1897038 - DNA, 19 bp, Homo sapiens
cacgctggggaagaattta

SEQ ID NO: 1897039 - DNA, 23 bp, Homo sapiens
cacgtctatttcatcagaacagc

SEQ ID NO: 1897040 - DNA, 15 bp, Homo sapiens
cacgttttaaggact

SEQ ID NO: 1897041 - DNA, 21 bp, Homo sapiens
cactcagaaaagacgcaccag

SEQ ID NO: 1897042 - DNA, 13 bp, Homo sapiens
cactcccatggct

SEQ ID NO: 1897043 - DNA, 16 bp, Homo sapiens
cactcccatggctctg

SEQ ID NO: 1897044 - DNA, 13 bp, Homo sapiens
cactctcagaggc

SEQ ID NO: 1897045 - DNA, 17 bp, Homo sapiens
cactctcagaggcccca

SEQ ID NO: 1897046 - DNA, 13 bp, Homo sapiens
cactctcttcctt

SEQ ID NO: 1897047 - DNA, 15 bp, Homo sapiens
cactctcttcctttc

SEQ ID NO: 1897048 - DNA, 16 bp, Homo sapiens
cactctcttcctttca

SEQ ID NO: 1897049 - DNA, 13 bp, Homo sapiens
cactgactctgga

SEQ ID NO: 1897050 - DNA, 14 bp, Homo sapiens
cactgactctggaa

SEQ ID NO: 1897051 - DNA, 22 bp, Homo sapiens
cactgagcatcacaataaagag

SEQ ID NO: 1897052 - DNA, 20 bp, Homo sapiens
cactgatcaccatgtaaggt

SEQ ID NO: 1897053 - DNA, 21 bp, Homo sapiens
cactgcagaacagcttcatgt

SEQ ID NO: 1897054 - DNA, 19 bp, Homo sapiens
cactgcagcctccgcttcc

SEQ ID NO: 1897055 - DNA, 21 bp, Homo sapiens
cactgcagcctccgcttccct

SEQ ID NO: 1897056 - DNA, 22 bp, Homo sapiens
cactgcagcctccgcttccctg

SEQ ID NO: 1897057 - DNA, 22 bp, Homo sapiens
cactggaaattgaaataaagat

SEQ ID NO: 1897058 - DNA, 15 bp, Homo sapiens
cactggagtctctct

SEQ ID NO: 1897059 - DNA, 23 bp, Homo sapiens
cactgggggacactgtggcagca

SEQ ID NO: 1897060 - DNA, 16 bp, Homo sapiens
cactggtctacactgg

SEQ ID NO: 1897061 - DNA, 14 bp, Homo sapiens
cactgtccgctgtc

SEQ ID NO: 1897062 - DNA, 15 bp, Homo sapiens
cactgtccgctgtct

SEQ ID NO: 1897063 - DNA, 22 bp, Homo sapiens
cactgtccgctgtctccctcct

SEQ ID NO: 1897064 - DNA, 18 bp, Homo sapiens
cactgtggcagcaggagg

SEQ ID NO: 1897065 - DNA, 19 bp, Homo sapiens
cactgtggcagcaggaggg

SEQ ID NO: 1897066 - DNA, 23 bp, Homo sapiens
cactgtggcagcaggagggactc

SEQ ID NO: 1897067 - DNA, 14 bp, Homo sapiens
cactgtgtatattt

SEQ ID NO: 1897068 - DNA, 15 bp, Homo sapiens
cactgtgtatatttg

SEQ ID NO: 1897069 - DNA, 21 bp, Homo sapiens
cactgtgtatatttgatttat

SEQ ID NO: 1897070 - DNA, 22 bp, Homo sapiens
cacttaaaacacgttttaagga

SEQ ID NO: 1897071 - DNA, 13 bp, Homo sapiens
cacttctgccaga

SEQ ID NO: 1897072 - DNA, 18 bp, Homo sapiens
cacttgggggctcagcaa

SEQ ID NO: 1897073 - DNA, 20 bp, Homo sapiens
cacttgggggctcagcaagg

SEQ ID NO: 1897074 - DNA, 21 bp, Homo sapiens
cacttgggggctcagcaaggc

SEQ ID NO: 1897075 - DNA, 15 bp, Homo sapiens
cacttgtagatttga

SEQ ID NO: 1897076 - DNA, 12 bp, Homo sapiens
cacttttgccag

SEQ ID NO: 1897077 - DNA, 19 bp, Homo sapiens
cagaactgcagtcactgca

SEQ ID NO: 1897078 - DNA, 18 bp, Homo sapiens
cagaagacaaaggcccaa

SEQ ID NO: 1897079 - DNA, 12 bp, Homo sapiens
cagaaggctggg

SEQ ID NO: 1897080 - DNA, 23 bp, Homo sapiens
cagaagtaggggaagaataattt

SEQ ID NO: 1897081 - DNA, 15 bp, Homo sapiens
cagaatactgatgga

SEQ ID NO: 1897082 - DNA, 18 bp, Homo sapiens
cagaatgaggaataataa

SEQ ID NO: 1897083 - DNA, 13 bp, Homo sapiens
cagacaaatgaaa

SEQ ID NO: 1897084 - DNA, 14 bp, Homo sapiens
cagacaccacagcc

SEQ ID NO: 1897085 - DNA, 22 bp, Homo sapiens
cagacaccacagcctccccttc

SEQ ID NO: 1897086 - DNA, 15 bp, Homo sapiens
cagacaggacccctg

SEQ ID NO: 1897087 - DNA, 21 bp, Homo sapiens
cagaccgaactgttgtataaa

SEQ ID NO: 1897088 - DNA, 13 bp, Homo sapiens
cagacctgcctgt

SEQ ID NO: 1897089 - DNA, 20 bp, Homo sapiens
cagacgctcattcagcatct

SEQ ID NO: 1897090 - DNA, 20 bp, Homo sapiens
cagacgttttttctgcacaa

SEQ ID NO: 1897091 - DNA, 19 bp, Homo sapiens
cagactggtttgggcaagc

SEQ ID NO: 1897092 - DNA, 16 bp, Homo sapiens
cagacttgtatattct

SEQ ID NO: 1897093 - DNA, 23 bp, Homo sapiens
cagacttgtatattctattttac

SEQ ID NO: 1897094 - DNA, 19 bp, Homo sapiens
cagacttttaaagacttgc

SEQ ID NO: 1897095 - DNA, 16 bp, Homo sapiens
cagagaaatgtctgtc

SEQ ID NO: 1897096 - DNA, 16 bp, Homo sapiens
cagagagaagagcccc

SEQ ID NO: 1897097 - DNA, 15 bp, Homo sapiens
cagagagggaagctg

SEQ ID NO: 1897098 - DNA, 19 bp, Homo sapiens
cagagagggaagctgaggc

SEQ ID NO: 1897099 - DNA, 22 bp, Homo sapiens
cagagagggaagctgaggccca

SEQ ID NO: 1897100 - DNA, 23 bp, Homo sapiens
cagagagggaagctgaggcccat

SEQ ID NO: 1897101 - DNA, 18 bp, Homo sapiens
cagagcaacccctggacc

SEQ ID NO: 1897102 - DNA, 20 bp, Homo sapiens
cagagcaagactccgtctca

SEQ ID NO: 1897103 - DNA, 19 bp, Homo sapiens
cagagccttggaggacact

SEQ ID NO: 1897104 - DNA, 23 bp, Homo sapiens
cagaggccccaataccccatgga

SEQ ID NO: 1897105 - DNA, 12 bp, Homo sapiens
cagaggctgtgg

SEQ ID NO: 1897106 - DNA, 22 bp, Homo sapiens
cagaggctgtggtcagagaggg

SEQ ID NO: 1897107 - DNA, 20 bp, Homo sapiens
cagagtatatttaagaagcc

SEQ ID NO: 1897108 - DNA, 13 bp, Homo sapiens
cagatacactgct

SEQ ID NO: 1897109 - DNA, 15 bp, Homo sapiens
cagatagcaggagga

SEQ ID NO: 1897110 - DNA, 16 bp, Homo sapiens
cagatagcaggaggaa

SEQ ID NO: 1897111 - DNA, 20 bp, Homo sapiens
cagatcccacttttgccaga

SEQ ID NO: 1897112 - DNA, 22 bp, Homo sapiens
cagatgtcctaatggtgatgca

SEQ ID NO: 1897113 - DNA, 18 bp, Homo sapiens
cagatgttgaagacaggg

SEQ ID NO: 1897114 - DNA, 14 bp, Homo sapiens
cagatgtttaaaac

SEQ ID NO: 1897115 - DNA, 17 bp, Homo sapiens
cagatgtttaaaacacc

SEQ ID NO: 1897116 - DNA, 13 bp, Homo sapiens
cagattcaggcat

SEQ ID NO: 1897117 - DNA, 15 bp, Homo sapiens
cagattcaggcattt

SEQ ID NO: 1897118 - DNA, 12 bp, Homo sapiens
cagattctttta

SEQ ID NO: 1897119 - DNA, 21 bp, Homo sapiens
cagcaaacctaattgcacaac

SEQ ID NO: 1897120 - DNA, 14 bp, Homo sapiens
cagcaacacgtcat

SEQ ID NO: 1897121 - DNA, 19 bp, Homo sapiens
cagcaacacgtcattgtgt

SEQ ID NO: 1897122 - DNA, 21 bp, Homo sapiens
cagcaacacgtcattgtgtaa

SEQ ID NO: 1897123 - DNA, 18 bp, Homo sapiens
cagcaacgatcacaaatg

SEQ ID NO: 1897124 - DNA, 21 bp, Homo sapiens
cagcaacgatcacaaatgact

SEQ ID NO: 1897125 - DNA, 22 bp, Homo sapiens
cagcaacgatcacaaatgactt

SEQ ID NO: 1897126 - DNA, 13 bp, Homo sapiens
cagcaaggccacc

SEQ ID NO: 1897127 - DNA, 17 bp, Homo sapiens
cagcaaggccacctctt

SEQ ID NO: 1897128 - DNA, 23 bp, Homo sapiens
cagcaaggccacctcttcctggc

SEQ ID NO: 1897129 - DNA, 18 bp, Homo sapiens
cagcacaaccttcaagct

SEQ ID NO: 1897130 - DNA, 21 bp, Homo sapiens
cagcacagatttgcttttctt

SEQ ID NO: 1897131 - DNA, 12 bp, Homo sapiens
cagcacgcctct

SEQ ID NO: 1897132 - DNA, 15 bp, Homo sapiens
cagcacgcctctccc

SEQ ID NO: 1897133 - DNA, 23 bp, Homo sapiens
cagcagccagccaaacacacaga

SEQ ID NO: 1897134 - DNA, 11 bp, Homo sapiens
cagcaggaggg

SEQ ID NO: 1897135 - DNA, 12 bp, Homo sapiens
cagcaggaggga

SEQ ID NO: 1897136 - DNA, 15 bp, Homo sapiens
cagcaggagggacag

SEQ ID NO: 1897137 - DNA, 23 bp, Homo sapiens
cagcaggagggacagtctcacca

SEQ ID NO: 1897138 - DNA, 21 bp, Homo sapiens
cagcaggctcctcagccctct

SEQ ID NO: 1897139 - DNA, 19 bp, Homo sapiens
cagcagggccttctgcctg

SEQ ID NO: 1897140 - DNA, 21 bp, Homo sapiens
cagcagttgctggtaaaatga

SEQ ID NO: 1897141 - DNA, 18 bp, Homo sapiens
cagcattacctctttgga

SEQ ID NO: 1897142 - DNA, 16 bp, Homo sapiens
cagccaaacacacaga

SEQ ID NO: 1897143 - DNA, 18 bp, Homo sapiens
cagccaccctttctggca

SEQ ID NO: 1897144 - DNA, 19 bp, Homo sapiens
cagccaccctttctggcac

SEQ ID NO: 1897145 - DNA, 20 bp, Homo sapiens
cagcccagaagtgcagaact

SEQ ID NO: 1897146 - DNA, 13 bp, Homo sapiens
cagccccctggtc

SEQ ID NO: 1897147 - DNA, 21 bp, Homo sapiens
cagcccgcatcagctgctcag

SEQ ID NO: 1897148 - DNA, 19 bp, Homo sapiens
cagcctaggcttggctcct

SEQ ID NO: 1897149 - DNA, 19 bp, Homo sapiens
caaacagaagtgcatcctg

SEQ ID NO: 1897150 - DNA, 18 bp, Homo sapiens
caaacagattcttttatg

SEQ ID NO: 1897151 - DNA, 19 bp, Homo sapiens
caaaccttactctgagctc

SEQ ID NO: 1897152 - DNA, 20 bp, Homo sapiens
caaacctttctataatttta

SEQ ID NO: 1897153 - DNA, 22 bp, Homo sapiens
caaacctttctataattttaca

SEQ ID NO: 1897154 - DNA, 22 bp, Homo sapiens
caaagacatttcaaataactgc

SEQ ID NO: 1897155 - DNA, 19 bp, Homo sapiens
caaagcaccaaaataagaa

SEQ ID NO: 1897156 - DNA, 21 bp, Homo sapiens
caaagcaccaaaataagaaaa

SEQ ID NO: 1897157 - DNA, 22 bp, Homo sapiens
caaagcaccaaaataagaaaag

SEQ ID NO: 1897158 - DNA, 24 bp, Homo sapiens
caaagcaccaaaataagaaaagat

SEQ ID NO: 1897159 - DNA, 17 bp, Homo sapiens
caaagccccattaactg

SEQ ID NO: 1897160 - DNA, 13 bp, Homo sapiens
caaagctctgaat

SEQ ID NO: 1897161 - DNA, 19 bp, Homo sapiens
caaagctctgaattcaggt

SEQ ID NO: 1897162 - DNA, 23 bp, Homo sapiens
caaaggcctaattctatgcctgt

SEQ ID NO: 1897163 - DNA, 21 bp, Homo sapiens
caaagggtctatcttgtaaat

SEQ ID NO: 1897164 - DNA, 22 bp, Homo sapiens
caaagtgctattacgaagttca

SEQ ID NO: 1897165 - DNA, 20 bp, Homo sapiens
caaagttttcatgtgctcag

SEQ ID NO: 1897166 - DNA, 19 bp, Homo sapiens
caaataactgcagaaaaaa

SEQ ID NO: 1897167 - DNA, 22 bp, Homo sapiens
caaatatttagatgtaattttg

SEQ ID NO: 1897168 - DNA, 14 bp, Homo sapiens
caaatccaggaccc

SEQ ID NO: 1897169 - DNA, 22 bp, Homo sapiens
caaatccaggaccctgccaggc

SEQ ID NO: 1897170 - DNA, 18 bp, Homo sapiens
caaatccccaagaacaca

SEQ ID NO: 1897171 - DNA, 15 bp, Homo sapiens
caaatgactttatta

SEQ ID NO: 1897172 - DNA, 18 bp, Homo sapiens
caaatgcacacacctcat

SEQ ID NO: 1897173 - DNA, 17 bp, Homo sapiens
caaatgcatctttgatg

SEQ ID NO: 1897174 - DNA, 22 bp, Homo sapiens
caaatgcatctttgatgtgttg

SEQ ID NO: 1897175 - DNA, 16 bp, Homo sapiens
caaatggaagagaaga

SEQ ID NO: 1897176 - DNA, 14 bp, Homo sapiens
caacacgtcattgt

SEQ ID NO: 1897177 - DNA, 13 bp, Homo sapiens
caacactcttggg

SEQ ID NO: 1897178 - DNA, 17 bp, Homo sapiens
caacagccactcagaaa

SEQ ID NO: 1897179 - DNA, 14 bp, Homo sapiens
caaccatttgaaac

SEQ ID NO: 1897180 - DNA, 13 bp, Homo sapiens
caaccccagaccc

SEQ ID NO: 1897181 - DNA, 22 bp, Homo sapiens
caacccctcgcccagtcccagc

SEQ ID NO: 1897182 - DNA, 17 bp, Homo sapiens
caacccctggaccccag

SEQ ID NO: 1897183 - DNA, 18 bp, Homo sapiens
caacccctggaccccagc

SEQ ID NO: 1897184 - DNA, 18 bp, Homo sapiens
caacgatcacaaatgact

SEQ ID NO: 1897185 - DNA, 20 bp, Homo sapiens
caacgatcacaaatgacttt

SEQ ID NO: 1897186 - DNA, 19 bp, Homo sapiens
caactactacctgtaatga

SEQ ID NO: 1897187 - DNA, 14 bp, Homo sapiens
caacttgcaagggc

SEQ ID NO: 1897188 - DNA, 12 bp, Homo sapiens
caagaaaagagt

SEQ ID NO: 1897189 - DNA, 13 bp, Homo sapiens
caagaaatgaaga

SEQ ID NO: 1897190 - DNA, 16 bp, Homo sapiens
caagagccttaaaaca

SEQ ID NO: 1897191 - DNA, 16 bp, Homo sapiens
caagagtctggggacc

SEQ ID NO: 1897192 - DNA, 14 bp, Homo sapiens
caagagtggcccca

SEQ ID NO: 1897193 - DNA, 23 bp, Homo sapiens
caagagtggccccacctggccct

SEQ ID NO: 1897194 - DNA, 23 bp, Homo sapiens
caagccgtggccggggtccaggc

SEQ ID NO: 1897195 - DNA, 22 bp, Homo sapiens
caagcctgagggaggaggcagg

SEQ ID NO: 1897196 - DNA, 13 bp, Homo sapiens
caagcctggcagg

SEQ ID NO: 1897197 - DNA, 15 bp, Homo sapiens
caagcctggcagggg

SEQ ID NO: 1897198 - DNA, 16 bp, Homo sapiens
caagcgccctggcccc

SEQ ID NO: 1897199 - DNA, 20 bp, Homo sapiens
caagctggaaaggccagcag

SEQ ID NO: 1897200 - DNA, 22 bp, Homo sapiens
caaggcactaatgttttggtct

SEQ ID NO: 1897201 - DNA, 14 bp, Homo sapiens
caaggccacctctt

SEQ ID NO: 1897202 - DNA, 16 bp, Homo sapiens
caagggaggcccagcg

SEQ ID NO: 1897203 - DNA, 19 bp, Homo sapiens
caagggcggcctttcccac

SEQ ID NO: 1897204 - DNA, 19 bp, Homo sapiens
caagggggacctcgggctg

SEQ ID NO: 1897205 - DNA, 13 bp, Homo sapiens
caagtagttctgt

SEQ ID NO: 1897206 - DNA, 18 bp, Homo sapiens
caagtagttctgtatttg

SEQ ID NO: 1897207 - DNA, 22 bp, Homo sapiens
caagtatctaaatttggaactt

SEQ ID NO: 1897208 - DNA, 14 bp, Homo sapiens
caagtcatttcaaa

SEQ ID NO: 1897209 - DNA, 18 bp, Homo sapiens
caagtcatttcaaaatat

SEQ ID NO: 1897210 - DNA, 11 bp, Homo sapiens
caagtccctgt

SEQ ID NO: 1897211 - DNA, 22 bp, Homo sapiens
caagtgcaatgccccctcccct

SEQ ID NO: 1897212 - DNA, 20 bp, Homo sapiens
caagtggatattttcttaaa

SEQ ID NO: 1897213 - DNA, 21 bp, Homo sapiens
caagtggatattttcttaaaa

SEQ ID NO: 1897214 - DNA, 17 bp, Homo sapiens
caagtggcataaagcat

SEQ ID NO: 1897215 - DNA, 13 bp, Homo sapiens
caataaaactgct

SEQ ID NO: 1897216 - DNA, 14 bp, Homo sapiens
caataaaactgcta

SEQ ID NO: 1897217 - DNA, 14 bp, Homo sapiens
caataaaagcccag

SEQ ID NO: 1897218 - DNA, 15 bp, Homo sapiens
caataaaagcccagg

SEQ ID NO: 1897219 - DNA, 18 bp, Homo sapiens
caataaaagcccaggagc

SEQ ID NO: 1897220 - DNA, 19 bp, Homo sapiens
caataaaagcccaggagcc

SEQ ID NO: 1897221 - DNA, 15 bp, Homo sapiens
caataaaggaaatat

SEQ ID NO: 1897222 - DNA, 11 bp, Homo sapiens
caataaatttt

SEQ ID NO: 1897223 - DNA, 16 bp, Homo sapiens
caataaattttgaaaa

SEQ ID NO: 1897224 - DNA, 16 bp, Homo sapiens
caataccaacctgaaa

SEQ ID NO: 1897225 - DNA, 14 bp, Homo sapiens
caatcattgcaaac

SEQ ID NO: 1897226 - DNA, 15 bp, Homo sapiens
caatctagctctcca

SEQ ID NO: 1897227 - DNA, 22 bp, Homo sapiens
caatgaaatacacaagtaaaca

SEQ ID NO: 1897228 - DNA, 16 bp, Homo sapiens
caatgaaatgaattta

SEQ ID NO: 1897229 - DNA, 16 bp, Homo sapiens
caatgccccctcccct

SEQ ID NO: 1897230 - DNA, 21 bp, Homo sapiens
caatgccccctcccctccttt

SEQ ID NO: 1897231 - DNA, 15 bp, Homo sapiens
caatgggctagaggg

SEQ ID NO: 1897232 - DNA, 16 bp, Homo sapiens
caatggtagtttctgt

SEQ ID NO: 1897233 - DNA, 18 bp, Homo sapiens
caatgtgatataaacagc

SEQ ID NO: 1897234 - DNA, 20 bp, Homo sapiens
caatgtgatataaacagctt

SEQ ID NO: 1897235 - DNA, 22 bp, Homo sapiens
caatgtgatataaacagcttct

SEQ ID NO: 1897236 - DNA, 19 bp, Homo sapiens
caatgtgtctatttctgaa

SEQ ID NO: 1897237 - DNA, 16 bp, Homo sapiens
caattagaaaaggaaa

SEQ ID NO: 1897238 - DNA, 20 bp, Homo sapiens
caattctcccgggactctgc

SEQ ID NO: 1897239 - DNA, 11 bp, Homo sapiens
caattttcctt

SEQ ID NO: 1897240 - DNA, 20 bp, Homo sapiens
caattttttaagtgaaaata

SEQ ID NO: 1897241 - DNA, 21 bp, Homo sapiens
caattttttaagtgaaaatat

SEQ ID NO: 1897242 - DNA, 16 bp, Homo sapiens
cacaaaggagtgagtg

SEQ ID NO: 1897243 - DNA, 14 bp, Homo sapiens
cacaaatgacttta

SEQ ID NO: 1897244 - DNA, 15 bp, Homo sapiens
cacaaatgactttat

SEQ ID NO: 1897245 - DNA, 20 bp, Homo sapiens
cacaaatgactttattattt

SEQ ID NO: 1897246 - DNA, 12 bp, Homo sapiens
cacaagaagacc

SEQ ID NO: 1897247 - DNA, 23 bp, Homo sapiens
cacaccaatcttactttgtaaat

SEQ ID NO: 1897248 - DNA, 13 bp, Homo sapiens
cacacctctgccc

SEQ ID NO: 1897249 - DNA, 16 bp, Homo sapiens
cacacctctgcccctt

SEQ ID NO: 1897250 - DNA, 22 bp, Homo sapiens
cacacctctgccccttgggcct

SEQ ID NO: 1897251 - DNA, 21 bp, Homo sapiens
cacactgaataagagagcagg

SEQ ID NO: 1897252 - DNA, 22 bp, Homo sapiens
cacagaaggggactgccacctc

SEQ ID NO: 1897253 - DNA, 15 bp, Homo sapiens
cacagacaggacccc

SEQ ID NO: 1897254 - DNA, 22 bp, Homo sapiens
cacagacaggacccctgcagtt

SEQ ID NO: 1897255 - DNA, 19 bp, Homo sapiens
cacagaggacacagagaag

SEQ ID NO: 1897256 - DNA, 21 bp, Homo sapiens
cacagcagggccttctgcctg

SEQ ID NO: 1897257 - DNA, 22 bp, Homo sapiens
cacagcagggccttctgcctgc

SEQ ID NO: 1897258 - DNA, 13 bp, Homo sapiens
cacagcctcccct

SEQ ID NO: 1897259 - DNA, 13 bp, Homo sapiens
cacagcctgcact

SEQ ID NO: 1897260 - DNA, 23 bp, Homo sapiens
cacagcctgcacttgggggctca

SEQ ID NO: 1897261 - DNA, 14 bp, Homo sapiens
cacagctctttaac

SEQ ID NO: 1897262 - DNA, 13 bp, Homo sapiens
cacaggcagggca

SEQ ID NO: 1897263 - DNA, 19 bp, Homo sapiens
cacaggcagggcaggacca

SEQ ID NO: 1897264 - DNA, 18 bp, Homo sapiens
cacaggctgggctgggca

SEQ ID NO: 1897265 - DNA, 15 bp, Homo sapiens
cacagggcctggccc

SEQ ID NO: 1897266 - DNA, 16 bp, Homo sapiens
cacagggcctggccca

SEQ ID NO: 1897267 - DNA, 17 bp, Homo sapiens
cacagggcctggcccat

SEQ ID NO: 1897268 - DNA, 17 bp, Homo sapiens
cacatatttcagtgagg

SEQ ID NO: 1897269 - DNA, 17 bp, Homo sapiens
cacatgttgatttccta

SEQ ID NO: 1897270 - DNA, 14 bp, Homo sapiens
cacatttatttggt

SEQ ID NO: 1897271 - DNA, 12 bp, Homo sapiens
caccaaaataag

SEQ ID NO: 1897272 - DNA, 18 bp, Homo sapiens
caccaatcttactttgta

SEQ ID NO: 1897273 - DNA, 18 bp, Homo sapiens
caccacaagtatctaaat

SEQ ID NO: 1897274 - DNA, 10 bp, Homo sapiens
caccacagcc

SEQ ID NO: 1897275 - DNA, 15 bp, Homo sapiens
caccactacagtaag

SEQ ID NO: 1897276 - DNA, 20 bp, Homo sapiens
caccactacagtaagctggt

SEQ ID NO: 1897277 - DNA, 14 bp, Homo sapiens
caccagcgccccca

SEQ ID NO: 1897278 - DNA, 17 bp, Homo sapiens
caccagcgcccccactc

SEQ ID NO: 1897279 - DNA, 18 bp, Homo sapiens
caccatgttggccaggct

SEQ ID NO: 1897280 - DNA, 20 bp, Homo sapiens
caccattcgtacataatact

SEQ ID NO: 1897281 - DNA, 22 bp, Homo sapiens
caccattcgtacataatactga

SEQ ID NO: 1897282 - DNA, 19 bp, Homo sapiens
caccatttccccagggcac

SEQ ID NO: 1897283 - DNA, 16 bp, Homo sapiens
cacccagacctgcctg

SEQ ID NO: 1897284 - DNA, 16 bp, Homo sapiens
cacccagagtagccat

SEQ ID NO: 1897285 - DNA, 17 bp, Homo sapiens
cagcctcaaatccagga

SEQ ID NO: 1897286 - DNA, 19 bp, Homo sapiens
cagcctcaaatccaggacc

SEQ ID NO: 1897287 - DNA, 15 bp, Homo sapiens
cagcctcccacagtg

SEQ ID NO: 1897288 - DNA, 13 bp, Homo sapiens
cagcctccctgac

SEQ ID NO: 1897289 - DNA, 16 bp, Homo sapiens
cagcctccgcttccct

SEQ ID NO: 1897290 - DNA, 21 bp, Homo sapiens
cagcctccgcttccctggttc

SEQ ID NO: 1897291 - DNA, 11 bp, Homo sapiens
cagcctctgat

SEQ ID NO: 1897292 - DNA, 17 bp, Homo sapiens
cagcctctgatctgtgc

SEQ ID NO: 1897293 - DNA, 13 bp, Homo sapiens
cagcctgagagtc

SEQ ID NO: 1897294 - DNA, 16 bp, Homo sapiens
cagcctgcctctgcca

SEQ ID NO: 1897295 - DNA, 17 bp, Homo sapiens
cagcctgcctctgccac

SEQ ID NO: 1897296 - DNA, 17 bp, Homo sapiens
cagccttccagtggctt

SEQ ID NO: 1897297 - DNA, 22 bp, Homo sapiens
cagccttccagtggcttctccc

SEQ ID NO: 1897298 - DNA, 15 bp, Homo sapiens
cagcgcacagctgct

SEQ ID NO: 1897299 - DNA, 17 bp, Homo sapiens
cagcgcccccactcctc

SEQ ID NO: 1897300 - DNA, 20 bp, Homo sapiens
cagcgcccccactcctcctc

SEQ ID NO: 1897301 - DNA, 15 bp, Homo sapiens
cagcggccctcccag

SEQ ID NO: 1897302 - DNA, 18 bp, Homo sapiens
cagctacccctgcagctg

SEQ ID NO: 1897303 - DNA, 14 bp, Homo sapiens
cagctccctcccct

SEQ ID NO: 1897304 - DNA, 23 bp, Homo sapiens
cagctctgggggactccttcctt

SEQ ID NO: 1897305 - DNA, 14 bp, Homo sapiens
cagctgagaggctg

SEQ ID NO: 1897306 - DNA, 16 bp, Homo sapiens
cagctgctgagccgca

SEQ ID NO: 1897307 - DNA, 22 bp, Homo sapiens
cagctgtatatatttttcttat

SEQ ID NO: 1897308 - DNA, 11 bp, Homo sapiens
cagctgtcacc

SEQ ID NO: 1897309 - DNA, 21 bp, Homo sapiens
cagctgtgctgggaggtccca

SEQ ID NO: 1897310 - DNA, 11 bp, Homo sapiens
cagcttccagc

SEQ ID NO: 1897311 - DNA, 13 bp, Homo sapiens
cagcttggctcag

SEQ ID NO: 1897312 - DNA, 20 bp, Homo sapiens
cagcttgggctggcgggccc

SEQ ID NO: 1897313 - DNA, 21 bp, Homo sapiens
caggaaatgctgacccatggg

SEQ ID NO: 1897314 - DNA, 23 bp, Homo sapiens
caggaaatgctgacccatgggca

SEQ ID NO: 1897315 - DNA, 16 bp, Homo sapiens
tggccggacacccgac

SEQ ID NO: 1897316 - DNA, 18 bp, Homo sapiens
tggcctctgcaaaggaaa

SEQ ID NO: 1897317 - DNA, 16 bp, Homo sapiens
tggctcttagaaactc

SEQ ID NO: 1897318 - DNA, 18 bp, Homo sapiens
tggctcttagaaactcag

SEQ ID NO: 1897319 - DNA, 20 bp, Homo sapiens
tggctcttagaaactcagga

SEQ ID NO: 1897320 - DNA, 13 bp, Homo sapiens
tggcttcctctgc

SEQ ID NO: 1897321 - DNA, 17 bp, Homo sapiens
tggcttcctctgctgca

SEQ ID NO: 1897322 - DNA, 18 bp, Homo sapiens
tggcttcctctgctgcat

SEQ ID NO: 1897323 - DNA, 21 bp, Homo sapiens
tgggacccagtggcagggcac

SEQ ID NO: 1897324 - DNA, 17 bp, Homo sapiens
tgggaggtcccagggcc

SEQ ID NO: 1897325 - DNA, 18 bp, Homo sapiens
tgggatgattgaagaaac

SEQ ID NO: 1897326 - DNA, 17 bp, Homo sapiens
tgggcctccacctctgt

SEQ ID NO: 1897327 - DNA, 14 bp, Homo sapiens
tgggcctctgatgt

SEQ ID NO: 1897328 - DNA, 13 bp, Homo sapiens
tgggcctgagtga

SEQ ID NO: 1897329 - DNA, 21 bp, Homo sapiens
tgggcctggctccctcactct

SEQ ID NO: 1897330 - DNA, 21 bp, Homo sapiens
tgggcggtccagaaggagcag

SEQ ID NO: 1897331 - DNA, 14 bp, Homo sapiens
tgggctgttacttg

SEQ ID NO: 1897332 - DNA, 16 bp, Homo sapiens
tgggctgttacttgct

SEQ ID NO: 1897333 - DNA, 12 bp, Homo sapiens
tgggcttctgtg

SEQ ID NO: 1897334 - DNA, 21 bp, Homo sapiens
tggggaccacagaggctgtgg

SEQ ID NO: 1897335 - DNA, 12 bp, Homo sapiens
tggggaggacaa

SEQ ID NO: 1897336 - DNA, 14 bp, Homo sapiens
tggggctgctgtga

SEQ ID NO: 1897337 - DNA, 17 bp, Homo sapiens
tggggctggcaccagca

SEQ ID NO: 1897338 - DNA, 19 bp, Homo sapiens
tggggctggcaccagcagg

SEQ ID NO: 1897339 - DNA, 20 bp, Homo sapiens
tggggctggcaccagcaggc

SEQ ID NO: 1897340 - DNA, 13 bp, Homo sapiens
tggggctggggga

SEQ ID NO: 1897341 - DNA, 21 bp, Homo sapiens
tggggctgggggatgggcctg

SEQ ID NO: 1897342 - DNA, 20 bp, Homo sapiens
tgggggacactgtggcagca

SEQ ID NO: 1897343 - DNA, 21 bp, Homo sapiens
tgggggacactgtggcagcag

SEQ ID NO: 1897344 - DNA, 23 bp, Homo sapiens
tgggggctcagcaaggccacctc

SEQ ID NO: 1897345 - DNA, 13 bp, Homo sapiens
tggggggaacgcc

SEQ ID NO: 1897346 - DNA, 19 bp, Homo sapiens
tggggggaacgcccacttc

SEQ ID NO: 1897347 - DNA, 20 bp, Homo sapiens
tggggggaacgcccacttcc

SEQ ID NO: 1897348 - DNA, 17 bp, Homo sapiens
tggggtctctcacagac

SEQ ID NO: 1897349 - DNA, 14 bp, Homo sapiens
tgggtactgtctcg

SEQ ID NO: 1897350 - DNA, 21 bp, Homo sapiens
tgggtactgtctcggcagagg

SEQ ID NO: 1897351 - DNA, 15 bp, Homo sapiens
tgggtactttctgaa

SEQ ID NO: 1897352 - DNA, 22 bp, Homo sapiens
tgggtagctgtaaggcatgaag

SEQ ID NO: 1897353 - DNA, 20 bp, Homo sapiens
tgggtcaggggtacacagag

SEQ ID NO: 1897354 - DNA, 21 bp, Homo sapiens
tgggtcaggggtacacagagc

SEQ ID NO: 1897355 - DNA, 20 bp, Homo sapiens
tgggttagactgccagctct

SEQ ID NO: 1897356 - DNA, 15 bp, Homo sapiens
tgggtttggcaggca

SEQ ID NO: 1897357 - DNA, 23 bp, Homo sapiens
tggtaaagaaatacacagggagg

SEQ ID NO: 1897358 - DNA, 14 bp, Homo sapiens
tggtagtttctgtg

SEQ ID NO: 1897359 - DNA, 15 bp, Homo sapiens
tggtatttgtttaat

SEQ ID NO: 1897360 - DNA, 14 bp, Homo sapiens
tggtccatctctga

SEQ ID NO: 1897361 - DNA, 20 bp, Homo sapiens
tggtccatctggttttctct

SEQ ID NO: 1897362 - DNA, 20 bp, Homo sapiens
tggtcctggaggctcaaatt

SEQ ID NO: 1897363 - DNA, 21 bp, Homo sapiens
tggtctaatcctagtttgctg

SEQ ID NO: 1897364 - DNA, 13 bp, Homo sapiens
tggtctacactgg

SEQ ID NO: 1897365 - DNA, 19 bp, Homo sapiens
tggtctctcccagctctgg

SEQ ID NO: 1897366 - DNA, 14 bp, Homo sapiens
tggtctggtgccac

SEQ ID NO: 1897367 - DNA, 14 bp, Homo sapiens
tggtgacctcacac

SEQ ID NO: 1897368 - DNA, 23 bp, Homo sapiens
tggtgacctcacacacctctgcc

SEQ ID NO: 1897369 - DNA, 14 bp, Homo sapiens
tggtgatgcagtct

SEQ ID NO: 1897370 - DNA, 20 bp, Homo sapiens
tggtgattaaaatgagttta

SEQ ID NO: 1897371 - DNA, 13 bp, Homo sapiens
tggttacatatca

SEQ ID NO: 1897372 - DNA, 21 bp, Homo sapiens
tggttcaaatgtgttttggtc

SEQ ID NO: 1897373 - DNA, 17 bp, Homo sapiens
tggttcattttcagatt

SEQ ID NO: 1897374 - DNA, 12 bp, Homo sapiens
tggttgaatatg

SEQ ID NO: 1897375 - DNA, 18 bp, Homo sapiens
tggttggctgggaaatcg

SEQ ID NO: 1897376 - DNA, 14 bp, Homo sapiens
tggttgggacccag

SEQ ID NO: 1897377 - DNA, 21 bp, Homo sapiens
tggttgggacccagtggcagg

SEQ ID NO: 1897378 - DNA, 23 bp, Homo sapiens
tggttgggacccagtggcagggc

SEQ ID NO: 1897379 - DNA, 22 bp, Homo sapiens
tggtttactcagggtctgatgt

SEQ ID NO: 1897380 - DNA, 22 bp, Homo sapiens
tggtttcaggacccctgcattt

SEQ ID NO: 1897381 - DNA, 14 bp, Homo sapiens
tgtaaataattctt

SEQ ID NO: 1897382 - DNA, 21 bp, Homo sapiens
tgtaaatgactttcataataa

SEQ ID NO: 1897383 - DNA, 22 bp, Homo sapiens
tgtaaatgactttcataataaa

SEQ ID NO: 1897384 - DNA, 14 bp, Homo sapiens
tgtaaatgtattca

SEQ ID NO: 1897385 - DNA, 15 bp, Homo sapiens
tgtaaattctgattt

SEQ ID NO: 1897386 - DNA, 18 bp, Homo sapiens
tgtaaattctgatttctt

SEQ ID NO: 1897387 - DNA, 21 bp, Homo sapiens
tgtaactttggttaaaatctc

SEQ ID NO: 1897388 - DNA, 12 bp, Homo sapiens
tgtaagaaatac

SEQ ID NO: 1897389 - DNA, 15 bp, Homo sapiens
tgtaaggcatgaagg

SEQ ID NO: 1897390 - DNA, 13 bp, Homo sapiens
tgtaaggtttttt

SEQ ID NO: 1897391 - DNA, 16 bp, Homo sapiens
tgtaatcccagcactt

SEQ ID NO: 1897392 - DNA, 12 bp, Homo sapiens
tgtaatgacagg

SEQ ID NO: 1897393 - DNA, 20 bp, Homo sapiens
tgtaatgtaggggaaagttt

SEQ ID NO: 1897394 - DNA, 16 bp, Homo sapiens
tgtaattgttgtttgt

SEQ ID NO: 1897395 - DNA, 17 bp, Homo sapiens
tgtaattgttgtttgta

SEQ ID NO: 1897396 - DNA, 23 bp, Homo sapiens
tgtaattgttgtttgtatgtata

SEQ ID NO: 1897397 - DNA, 14 bp, Homo sapiens
tgtacatatctttg

SEQ ID NO: 1897398 - DNA, 15 bp, Homo sapiens
tgtacatatctttga

SEQ ID NO: 1897399 - DNA, 20 bp, Homo sapiens
tgtacatatctttgagttca

SEQ ID NO: 1897400 - DNA, 14 bp, Homo sapiens
tgtacatttgaaaa

SEQ ID NO: 1897401 - DNA, 18 bp, Homo sapiens
tgtacccattgcagaccc

SEQ ID NO: 1897402 - DNA, 22 bp, Homo sapiens
tgtttcaattagaaaaggaaat

SEQ ID NO: 1897403 - DNA, 20 bp, Homo sapiens
tgtttctttctctgaggaca

SEQ ID NO: 1897404 - DNA, 16 bp, Homo sapiens
tgtttgaaaatagttt

SEQ ID NO: 1897405 - DNA, 19 bp, Homo sapiens
tgtttgaaaatagtttatt

SEQ ID NO: 1897406 - DNA, 16 bp, Homo sapiens
tgtttgatgcattaaa

SEQ ID NO: 1897407 - DNA, 19 bp, Homo sapiens
tgtttgatgcattaaaaga

SEQ ID NO: 1897408 - DNA, 16 bp, Homo sapiens
tgtttgtaacaagaaa

SEQ ID NO: 1897409 - DNA, 19 bp, Homo sapiens
tgttttaacaagaagcaat

SEQ ID NO: 1897410 - DNA, 16 bp, Homo sapiens
tgttttagcacagcgt

SEQ ID NO: 1897411 - DNA, 20 bp, Homo sapiens
tgtttttagttctgactttg

SEQ ID NO: 1897412 - DNA, 18 bp, Homo sapiens
ttaaaaatatcaaattaa

SEQ ID NO: 1897413 - DNA, 15 bp, Homo sapiens
ttaaaaatctgccac

SEQ ID NO: 1897414 - DNA, 21 bp, Homo sapiens
ttaaaacacgttttaaggact

SEQ ID NO: 1897415 - DNA, 15 bp, Homo sapiens
ttaaaacattaaaat

SEQ ID NO: 1897416 - DNA, 13 bp, Homo sapiens
ttaaaactttgta

SEQ ID NO: 1897417 - DNA, 12 bp, Homo sapiens
ttaaaataatat

SEQ ID NO: 1897418 - DNA, 23 bp, Homo sapiens
ttaaaattttttgagtgaagttt

SEQ ID NO: 1897419 - DNA, 23 bp, Homo sapiens
ttaaagaaaaaaatgtcaaaagt

SEQ ID NO: 1897420 - DNA, 15 bp, Homo sapiens
ttaaaggtggaaaat

SEQ ID NO: 1897421 - DNA, 20 bp, Homo sapiens
ttaaatgcaaccatttgaaa

SEQ ID NO: 1897422 - DNA, 20 bp, Homo sapiens
ttaaatttttttgtatgaaa

SEQ ID NO: 1897423 - DNA, 21 bp, Homo sapiens
ttaaatttttttgtatgaaaa

SEQ ID NO: 1897424 - DNA, 15 bp, Homo sapiens
ttaactgcttcctat

SEQ ID NO: 1897425 - DNA, 11 bp, Homo sapiens
ttaactgttca

SEQ ID NO: 1897426 - DNA, 14 bp, Homo sapiens
ttaactgttcagta

SEQ ID NO: 1897427 - DNA, 17 bp, Homo sapiens
ttaactgttcagtattg

SEQ ID NO: 1897428 - DNA, 16 bp, Homo sapiens
ttaacttaataatcaa

SEQ ID NO: 1897429 - DNA, 13 bp, Homo sapiens
ttaagaagaaact

SEQ ID NO: 1897430 - DNA, 13 bp, Homo sapiens
ttaagcaataaaa

SEQ ID NO: 1897431 - DNA, 14 bp, Homo sapiens
ttaaggtgtttgaa

SEQ ID NO: 1897432 - DNA, 22 bp, Homo sapiens
ttaaggtgtttgaaaatagttt

SEQ ID NO: 1897433 - DNA, 12 bp, Homo sapiens
ttaagtcataat

SEQ ID NO: 1897434 - DNA, 17 bp, Homo sapiens
ttaagtggactctctga

SEQ ID NO: 1897435 - DNA, 18 bp, Homo sapiens
ttaagtggactctctgac

SEQ ID NO: 1897436 - DNA, 20 bp, Homo sapiens
ttaataatcaagagccttaa

SEQ ID NO: 1897437 - DNA, 16 bp, Homo sapiens
ttaataccctgtacat

SEQ ID NO: 1897438 - DNA, 15 bp, Homo sapiens
ttaatcactgtgtat

SEQ ID NO: 1897439 - DNA, 14 bp, Homo sapiens
ttaatctactgcat

SEQ ID NO: 1897440 - DNA, 18 bp, Homo sapiens
ttaatgctaatcttgtga

SEQ ID NO: 1897441 - DNA, 23 bp, Homo sapiens
ttaattatcttagtctatagaaa

SEQ ID NO: 1897442 - DNA, 13 bp, Homo sapiens
ttaattatttaaa

SEQ ID NO: 1897443 - DNA, 16 bp, Homo sapiens
ttaattgtgtgaactt

SEQ ID NO: 1897444 - DNA, 15 bp, Homo sapiens
ttaatttgaaatatg

SEQ ID NO: 1897445 - DNA, 20 bp, Homo sapiens
ttacactggcaatggtagtt

SEQ ID NO: 1897446 - DNA, 22 bp, Homo sapiens
ttacactggcaatggtagtttc

SEQ ID NO: 1897447 - DNA, 23 bp, Homo sapiens
ttacactggcaatggtagtttct

SEQ ID NO: 1897448 - DNA, 20 bp, Homo sapiens
ttacagatgttttccactga

SEQ ID NO: 1897449 - DNA, 13 bp, Homo sapiens
ttacattcagttg

SEQ ID NO: 1897450 - DNA, 12 bp, Homo sapiens
ttacatttgaat

SEQ ID NO: 1897451 - DNA, 15 bp, Homo sapiens
ttacatttgaataat

SEQ ID NO: 1897452 - DNA, 14 bp, Homo sapiens
ttacccagactggt

SEQ ID NO: 1897453 - DNA, 23 bp, Homo sapiens
ttactgttcatttgatttgtaca

SEQ ID NO: 1897454 - DNA, 23 bp, Homo sapiens
ttacttgttgcctataagccaaa

SEQ ID NO: 1897455 - DNA, 11 bp, Homo sapiens
ttactttgtaa

SEQ ID NO: 1897456 - DNA, 14 bp, Homo sapiens
ttactttgtaaatt

SEQ ID NO: 1897457 - DNA, 17 bp, Homo sapiens
ttactttgtaaattctg

SEQ ID NO: 1897458 - DNA, 23 bp, Homo sapiens
tctcacagacaggacccctgcag

SEQ ID NO: 1897459 - DNA, 14 bp, Homo sapiens
tctcacagctatgc

SEQ ID NO: 1897460 - DNA, 11 bp, Homo sapiens
tctcaccagcc

SEQ ID NO: 1897461 - DNA, 19 bp, Homo sapiens
tctcactctcttcctttca

SEQ ID NO: 1897462 - DNA, 22 bp, Homo sapiens
tctccatccctctcctctgccc

SEQ ID NO: 1897463 - DNA, 13 bp, Homo sapiens
tctccatggagtt

SEQ ID NO: 1897464 - DNA, 16 bp, Homo sapiens
tctcccaccctttctg

SEQ ID NO: 1897465 - DNA, 13 bp, Homo sapiens
tctcccagctctg

SEQ ID NO: 1897466 - DNA, 16 bp, Homo sapiens
tctcccgggactctgc

SEQ ID NO: 1897467 - DNA, 19 bp, Homo sapiens
tctccctggcctcagggct

SEQ ID NO: 1897468 - DNA, 15 bp, Homo sapiens
tctccgcccctgagc

SEQ ID NO: 1897469 - DNA, 12 bp, Homo sapiens
tctcctctgccc

SEQ ID NO: 1897470 - DNA, 17 bp, Homo sapiens
tctcctgtttcagacca

SEQ ID NO: 1897471 - DNA, 19 bp, Homo sapiens
tctccttaagagacaattt

SEQ ID NO: 1897472 - DNA, 18 bp, Homo sapiens
tctcgctctgttgcccag

SEQ ID NO: 1897473 - DNA, 20 bp, Homo sapiens
tctcggatcaggctcccagg

SEQ ID NO: 1897474 - DNA, 16 bp, Homo sapiens
tctcggcagaggtggt

SEQ ID NO: 1897475 - DNA, 14 bp, Homo sapiens
tctcgtactctctc

SEQ ID NO: 1897476 - DNA, 18 bp, Homo sapiens
tctctaacccacaggtgt

SEQ ID NO: 1897477 - DNA, 21 bp, Homo sapiens
tctctcactctcttcctttca

SEQ ID NO: 1897478 - DNA, 15 bp, Homo sapiens
tctctccatccctct

SEQ ID NO: 1897479 - DNA, 18 bp, Homo sapiens
tctctcgttcgctcgctc

SEQ ID NO: 1897480 - DNA, 14 bp, Homo sapiens
tctctctctctcca

SEQ ID NO: 1897481 - DNA, 18 bp, Homo sapiens
tctctgaaggaggccacc

SEQ ID NO: 1897482 - DNA, 13 bp, Homo sapiens
tcccaccctaccc

SEQ ID NO: 1897483 - DNA, 19 bp, Homo sapiens
tcccaccctttctgccagg

SEQ ID NO: 1897484 - DNA, 20 bp, Homo sapiens
tcccaccctttctgccaggg

SEQ ID NO: 1897485 - DNA, 21 bp, Homo sapiens
tcccaccctttctgccaggga

SEQ ID NO: 1897486 - DNA, 18 bp, Homo sapiens
tcccactacgggcaccta

SEQ ID NO: 1897487 - DNA, 11 bp, Homo sapiens
tcccactccca

SEQ ID NO: 1897488 - DNA, 15 bp, Homo sapiens
tcccactcccatggc

SEQ ID NO: 1897489 - DNA, 14 bp, Homo sapiens
tcccagcagccagc

SEQ ID NO: 1897490 - DNA, 15 bp, Homo sapiens
tcccagcagccagcc

SEQ ID NO: 1897491 - DNA, 16 bp, Homo sapiens
tcccagcagccagcca

SEQ ID NO: 1897492 - DNA, 13 bp, Homo sapiens
tcccaggagcctg

SEQ ID NO: 1897493 - DNA, 19 bp, Homo sapiens
tcccaggcagcgccactgt

SEQ ID NO: 1897494 - DNA, 21 bp, Homo sapiens
tcccagggagcaagggcaggg

SEQ ID NO: 1897495 - DNA, 17 bp, Homo sapiens
tcccagttgctgtcaca

SEQ ID NO: 1897496 - DNA, 14 bp, Homo sapiens
tccccaaccccaga

SEQ ID NO: 1897497 - DNA, 17 bp, Homo sapiens
tccccaaccccagaccc

SEQ ID NO: 1897498 - DNA, 22 bp, Homo sapiens
tcaagcctagatgttttataca

SEQ ID NO: 1897499 - DNA, 22 bp, Homo sapiens
tcaagctggaaaggccagcagc

SEQ ID NO: 1897500 - DNA, 23 bp, Homo sapiens
tcaagctggaaaggccagcagcc

SEQ ID NO: 1897501 - DNA, 21 bp, Homo sapiens
tcaagggagtaagtagaggtg

SEQ ID NO: 1897502 - DNA, 22 bp, Homo sapiens
tcaagtgcaatgccccctcccc

SEQ ID NO: 1897503 - DNA, 18 bp, Homo sapiens
tcaataaaagcctttgaa

SEQ ID NO: 1897504 - DNA, 13 bp, Homo sapiens
tcaataaagctcg

SEQ ID NO: 1897505 - DNA, 23 bp, Homo sapiens
tcaataatttgtggtgatttgga

SEQ ID NO: 1897506 - DNA, 14 bp, Homo sapiens
tcaatataaaaaca

SEQ ID NO: 1897507 - DNA, 18 bp, Homo sapiens
tacagatgttttccactg

SEQ ID NO: 1897508 - DNA, 14 bp, Homo sapiens
tacagtaagctggt

SEQ ID NO: 1897509 - DNA, 23 bp, Homo sapiens
tacagtagaaggagattgtgggg

SEQ ID NO: 1897510 - DNA, 13 bp, Homo sapiens
tacataactgata

SEQ ID NO: 1897511 - DNA, 18 bp, Homo sapiens
tacatcacagatttgcta

SEQ ID NO: 1897512 - DNA, 19 bp, Homo sapiens
tacatgtatcaagcctaga

SEQ ID NO: 1897513 - DNA, 17 bp, Homo sapiens
tacatgtttgcagtgtt

SEQ ID NO: 1897514 - DNA, 23 bp, Homo sapiens
tacatgtttgcagtgttaagata

SEQ ID NO: 1897515 - DNA, 14 bp, Homo sapiens
tacatttgaaaata

SEQ ID NO: 1897516 - DNA, 12 bp, Homo sapiens
tacatttgaata

SEQ ID NO: 1897517 - DNA, 16 bp, Homo sapiens
taccaacctgaaagtt

SEQ ID NO: 1897518 - DNA, 23 bp, Homo sapiens
taccacctcactttttcatttcc

SEQ ID NO: 1897519 - DNA, 20 bp, Homo sapiens
taccgaggacagcctgcctc

SEQ ID NO: 1897520 - DNA, 15 bp, Homo sapiens
tacctgtataatgga

SEQ ID NO: 1897521 - DNA, 18 bp, Homo sapiens
tacgaagttcaagatcaa

SEQ ID NO: 1897522 - DNA, 14 bp, Homo sapiens
tacgcaattctcga

SEQ ID NO: 1897523 - DNA, 14 bp, Homo sapiens
tacgcctgtaaatg

SEQ ID NO: 1897524 - DNA, 14 bp, Homo sapiens
tacggcaagaaggc

SEQ ID NO: 1897525 - DNA, 16 bp, Homo sapiens
tactaaatgtacagat

SEQ ID NO: 1897526 - DNA, 21 bp, Homo sapiens
tactctctctcttttccctcc

SEQ ID NO: 1897527 - DNA, 12 bp, Homo sapiens
tactctgggaac

SEQ ID NO: 1897528 - DNA, 22 bp, Homo sapiens
tactgaggcctaaaagtaaaca

SEQ ID NO: 1897529 - DNA, 14 bp, Homo sapiens
tactgctttctgaa

SEQ ID NO: 1897530 - DNA, 19 bp, Homo sapiens
tactgtacaatgactttat

SEQ ID NO: 1897531 - DNA, 21 bp, Homo sapiens
tactgtctcggcagaggtggt

SEQ ID NO: 1897532 - DNA, 17 bp, Homo sapiens
tactgtgttaaaatttt

SEQ ID NO: 1897533 - DNA, 14 bp, Homo sapiens
tactgttacttgat

SEQ ID NO: 1897534 - DNA, 15 bp, Homo sapiens
tactgttacttgata

SEQ ID NO: 1897535 - DNA, 17 bp, Homo sapiens
tactgttacttgataac

SEQ ID NO: 1897536 - DNA, 21 bp, Homo sapiens
tactgttatgtgagaacatta

SEQ ID NO: 1897537 - DNA, 23 bp, Homo sapiens
tacttcagccaccctttctggca

SEQ ID NO: 1897538 - DNA, 20 bp, Homo sapiens
tacttgaaccataaaatgtc

SEQ ID NO: 1897539 - DNA, 15 bp, Homo sapiens
tacttggaaattgtt

SEQ ID NO: 1897540 - DNA, 12 bp, Homo sapiens
tactttctgaaa

SEQ ID NO: 1897541 - DNA, 15 bp, Homo sapiens
tactttctgaaaatt

SEQ ID NO: 1897542 - DNA, 20 bp, Homo sapiens
tactttctgaaaatttatat

SEQ ID NO: 1897543 - DNA, 21 bp, Homo sapiens
tactttctgaaaatttatata

SEQ ID NO: 1897544 - DNA, 22 bp, Homo sapiens
tactttctgaaaatttatataa

SEQ ID NO: 1897545 - DNA, 22 bp, Homo sapiens
tactttgaaaacaccagctgta

SEQ ID NO: 1897546 - DNA, 13 bp, Homo sapiens
tactttgaaatat

SEQ ID NO: 1897547 - DNA, 19 bp, Homo sapiens
tactttgtaaattctgatt

SEQ ID NO: 1897548 - DNA, 19 bp, Homo sapiens
tactttgttaaaaacactg

SEQ ID NO: 1897549 - DNA, 20 bp, Homo sapiens
tactttttaaggatggcaca

SEQ ID NO: 1897550 - DNA, 21 bp, Homo sapiens
tagaaaagaaaaaaaaaatat

SEQ ID NO: 1897551 - DNA, 22 bp, Homo sapiens
tagaaagctttgttgaaagaaa

SEQ ID NO: 1897552 - DNA, 22 bp, Homo sapiens
tagaaatttgcccctggcaaat

SEQ ID NO: 1897553 - DNA, 14 bp, Homo sapiens
tagaacaggttttt

SEQ ID NO: 1897554 - DNA, 19 bp, Homo sapiens
tagaacattccatttgctt

SEQ ID NO: 1897555 - DNA, 12 bp, Homo sapiens
tagaactttgta

SEQ ID NO: 1897556 - DNA, 16 bp, Homo sapiens
tagaactttgtatagt

SEQ ID NO: 1897557 - DNA, 19 bp, Homo sapiens
tagaagatcacagcagggc

SEQ ID NO: 1897558 - DNA, 15 bp, Homo sapiens
tagaagtacgtgtta

SEQ ID NO: 1897559 - DNA, 14 bp, Homo sapiens
tagaatcagataca

SEQ ID NO: 1897560 - DNA, 21 bp, Homo sapiens
tagaatgtcaataaatttgct

SEQ ID NO: 1897561 - DNA, 23 bp, Homo sapiens
tagaatgtcaataaatttgcttt

SEQ ID NO: 1897562 - DNA, 20 bp, Homo sapiens
tagaattgaaggtttttgat

SEQ ID NO: 1897563 - DNA, 21 bp, Homo sapiens
tagaattgaaggtttttgata

SEQ ID NO: 1897564 - DNA, 23 bp, Homo sapiens
tagaattgaaggtttttgatagc

SEQ ID NO: 1897565 - DNA, 14 bp, Homo sapiens
tagacagcatgaga

SEQ ID NO: 1897566 - DNA, 12 bp, Homo sapiens
tagacattttga

SEQ ID NO: 1897567 - DNA, 14 bp, Homo sapiens
tagacggaacagtg

SEQ ID NO: 1897568 - DNA, 13 bp, Homo sapiens
tagactgccagct

SEQ ID NO: 1897569 - DNA, 14 bp, Homo sapiens
tagactgccagctc

SEQ ID NO: 1897570 - DNA, 13 bp, Homo sapiens
tagacttgaaaag

SEQ ID NO: 1897571 - DNA, 19 bp, Homo sapiens
tagacttgaaaagagacag

SEQ ID NO: 1897572 - DNA, 23 bp, Homo sapiens
tagacttgaaaagagacaggcag

SEQ ID NO: 1897573 - DNA, 23 bp, Homo sapiens
tagaggcagttcgaccagccagg

SEQ ID NO: 1897574 - DNA, 14 bp, Homo sapiens
tagaggctggcaag

SEQ ID NO: 1897575 - DNA, 12 bp, Homo sapiens
tagaggtggctt

SEQ ID NO: 1897576 - DNA, 19 bp, Homo sapiens
tagagtatattcctctgct

SEQ ID NO: 1897577 - DNA, 21 bp, Homo sapiens
tagagtctgagggcttgtagt

SEQ ID NO: 1897578 - DNA, 13 bp, Homo sapiens
tagatcatagttt

SEQ ID NO: 1897579 - DNA, 21 bp, Homo sapiens
tagattccatttactgcattc

SEQ ID NO: 1897580 - DNA, 14 bp, Homo sapiens
tagatttatttcat

SEQ ID NO: 1897581 - DNA, 15 bp, Homo sapiens
tagattttgaaaaat

SEQ ID NO: 1897582 - DNA, 20 bp, Homo sapiens
tagcacagcgttatgtgtct

SEQ ID NO: 1897583 - DNA, 15 bp, Homo sapiens
tagcacaggctgagt

SEQ ID NO: 1897584 - DNA, 21 bp, Homo sapiens
tagcacaggctgagtgcaggc

SEQ ID NO: 1897585 - DNA, 18 bp, Homo sapiens
tagcagtgtgtaaagtaa

SEQ ID NO: 1897586 - DNA, 12 bp, Homo sapiens
tagcatatcaat

SEQ ID NO: 1897587 - DNA, 18 bp, Homo sapiens
tagcatcacttaaaacac

SEQ ID NO: 1897588 - DNA, 20 bp, Homo sapiens
tagcatgtgttgcagctgtc

SEQ ID NO: 1897589 - DNA, 22 bp, Homo sapiens
tagcatgtgttgcagctgtcac

SEQ ID NO: 1897590 - DNA, 18 bp, Homo sapiens
tagcattgtaaaagcatt

SEQ ID NO: 1897591 - DNA, 19 bp, Homo sapiens
tagcattgtaaaagcattt

SEQ ID NO: 1897592 - DNA, 22 bp, Homo sapiens
tagcattgtctatttttctctt

SEQ ID NO: 1897593 - DNA, 16 bp, Homo sapiens
tagccaaaatgtgagt

SEQ ID NO: 1897594 - DNA, 19 bp, Homo sapiens
tagccatgaggaggcagag

SEQ ID NO: 1897595 - DNA, 22 bp, Homo sapiens
tagccatgaggaggcagagagg

SEQ ID NO: 1897596 - DNA, 21 bp, Homo sapiens
tagcctcacgaaactggaata

SEQ ID NO: 1897597 - DNA, 11 bp, Homo sapiens
tagcctcacgc

SEQ ID NO: 1897598 - DNA, 16 bp, Homo sapiens
tagctcgtcctcactg

SEQ ID NO: 1897599 - DNA, 17 bp, Homo sapiens
tagctggagaggagccc

SEQ ID NO: 1897600 - DNA, 19 bp, Homo sapiens
tagctggagaggagccctg

SEQ ID NO: 1897601 - DNA, 23 bp, Homo sapiens
tagctggagaggagccctgcctc

SEQ ID NO: 1897602 - DNA, 12 bp, Homo sapiens
tagctgtaaggc

SEQ ID NO: 1897603 - DNA, 19 bp, Homo sapiens
tagctgtaaggcatgaagg

SEQ ID NO: 1897604 - DNA, 19 bp, Homo sapiens
taggaagttaaaagcacaa

SEQ ID NO: 1897605 - DNA, 21 bp, Homo sapiens
taggaggatgcctaacagaga

SEQ ID NO: 1897606 - DNA, 14 bp, Homo sapiens
taggattataatgc

SEQ ID NO: 1897607 - DNA, 18 bp, Homo sapiens
taggccaatcagaagcta

SEQ ID NO: 1897608 - DNA, 17 bp, Homo sapiens
taggctctgcctgacag

SEQ ID NO: 1897609 - DNA, 15 bp, Homo sapiens
tagggagtattctaa

SEQ ID NO: 1897610 - DNA, 17 bp, Homo sapiens
taggtctgatattcaaa

SEQ ID NO: 1897611 - DNA, 14 bp, Homo sapiens
tagtaataaagact

SEQ ID NO: 1897612 - DNA, 14 bp, Homo sapiens
tagtactgtgaatc

SEQ ID NO: 1897613 - DNA, 15 bp, Homo sapiens
tagtctggaactgct

SEQ ID NO: 1897614 - DNA, 20 bp, Homo sapiens
tagtctggaactgctgctga

SEQ ID NO: 1897615 - DNA, 17 bp, Homo sapiens
tagtgctgtgaaaaaaa

SEQ ID NO: 1897616 - DNA, 15 bp, Homo sapiens
tagtggcatggagaa

SEQ ID NO: 1897617 - DNA, 22 bp, Homo sapiens
tagtgtggaaattaagaagaaa

SEQ ID NO: 1897618 - DNA, 13 bp, Homo sapiens
tagtgttatatga

SEQ ID NO: 1897619 - DNA, 16 bp, Homo sapiens
tagtgttatatgaaca

SEQ ID NO: 1897620 - DNA, 18 bp, Homo sapiens
tagtgttatatgaacata

SEQ ID NO: 1897621 - DNA, 21 bp, Homo sapiens
tagttatgtaaataattcttt

SEQ ID NO: 1897622 - DNA, 18 bp, Homo sapiens
tagttcaagaaatgaaga

SEQ ID NO: 1897623 - DNA, 21 bp, Homo sapiens
tagttcaagaaatgaagagct

SEQ ID NO: 1897624 - DNA, 15 bp, Homo sapiens
tagttccactgagac

SEQ ID NO: 1897625 - DNA, 12 bp, Homo sapiens
tagttctgactt

SEQ ID NO: 1897626 - DNA, 23 bp, Homo sapiens
tagttctgactttgaatttatat

SEQ ID NO: 1897627 - DNA, 14 bp, Homo sapiens
tagttctgtatttg

SEQ ID NO: 1897628 - DNA, 15 bp, Homo sapiens
tagttctgtatttga

SEQ ID NO: 1897629 - DNA, 16 bp, Homo sapiens
tagttctgtatttgaa

SEQ ID NO: 1897630 - DNA, 15 bp, Homo sapiens
tagttttatttatat

SEQ ID NO: 1897631 - DNA, 21 bp, Homo sapiens
tataaaacagagtaatcttgt

SEQ ID NO: 1897632 - DNA, 14 bp, Homo sapiens
tataaaataaacac

SEQ ID NO: 1897633 - DNA, 18 bp, Homo sapiens
tataaaatgtatcaacac

SEQ ID NO: 1897634 - DNA, 12 bp, Homo sapiens
tataaacagctt

SEQ ID NO: 1897635 - DNA, 15 bp, Homo sapiens
tataaacatttaaag

SEQ ID NO: 1897636 - DNA, 21 bp, Homo sapiens
tataacttatattgtaagaaa

SEQ ID NO: 1897637 - DNA, 22 bp, Homo sapiens
tataacttatattgtaagaaat

SEQ ID NO: 1897638 - DNA, 16 bp, Homo sapiens
tataacttatgaagta

SEQ ID NO: 1897639 - DNA, 22 bp, Homo sapiens
tataagagcttccaattttcct

SEQ ID NO: 1897640 - DNA, 22 bp, Homo sapiens
tataagccaaaattaaggtgtt

SEQ ID NO: 1897641 - DNA, 17 bp, Homo sapiens
tataaggtttaaaaaga

SEQ ID NO: 1897642 - DNA, 14 bp, Homo sapiens
tataataaaagtgc

SEQ ID NO: 1897643 - DNA, 21 bp, Homo sapiens
gtgcttctgccaccctgctga

SEQ ID NO: 1897644 - DNA, 19 bp, Homo sapiens
gtggaaagtgttcattgca

SEQ ID NO: 1897645 - DNA, 20 bp, Homo sapiens
gtggaaattaagaagaaact

SEQ ID NO: 1897646 - DNA, 14 bp, Homo sapiens
gtggactctctgac

SEQ ID NO: 1897647 - DNA, 14 bp, Homo sapiens
gtggagactgctcc

SEQ ID NO: 1897648 - DNA, 14 bp, Homo sapiens
gtggagtcatttct

SEQ ID NO: 1897649 - DNA, 12 bp, Homo sapiens
gtggcagcagga

SEQ ID NO: 1897650 - DNA, 13 bp, Homo sapiens
gtggcagcaggag

SEQ ID NO: 1897651 - DNA, 14 bp, Homo sapiens
gtggcagcaggagg

SEQ ID NO: 1897652 - DNA, 17 bp, Homo sapiens
gtggcaggacactgcag

SEQ ID NO: 1897653 - DNA, 14 bp, Homo sapiens
gtggcagggcacag

SEQ ID NO: 1897654 - DNA, 20 bp, Homo sapiens
gtggcgaaatccctgctcac

SEQ ID NO: 1897655 - DNA, 22 bp, Homo sapiens
gtggcgaaatccctgctcactg

SEQ ID NO: 1897656 - DNA, 14 bp, Homo sapiens
gtggctgtgaagga

SEQ ID NO: 1897657 - DNA, 15 bp, Homo sapiens
gtggggctcccgcct

SEQ ID NO: 1897658 - DNA, 15 bp, Homo sapiens
gtgggtgatttgata

SEQ ID NO: 1897659 - DNA, 16 bp, Homo sapiens
gtggtccatctctgaa

SEQ ID NO: 1897660 - DNA, 13 bp, Homo sapiens
gtgtaaggaaaaa

SEQ ID NO: 1897661 - DNA, 23 bp, Homo sapiens
gtgtacagaatttttcttcatta

SEQ ID NO: 1897662 - DNA, 17 bp, Homo sapiens
gtgtatatttgatttat

SEQ ID NO: 1897663 - DNA, 20 bp, Homo sapiens
gtgtcctcctggggttcttt

SEQ ID NO: 1897664 - DNA, 21 bp, Homo sapiens
gtgtctcctgtttcagaccag

SEQ ID NO: 1897665 - DNA, 19 bp, Homo sapiens
gtgtgacatcacagggcct

SEQ ID NO: 1897666 - DNA, 22 bp, Homo sapiens
gtgtgacatcacagggcctcag

SEQ ID NO: 1897667 - DNA, 13 bp, Homo sapiens
gtgtgcagggctg

SEQ ID NO: 1897668 - DNA, 18 bp, Homo sapiens
gtgtgctgttagtattga

SEQ ID NO: 1897669 - DNA, 20 bp, Homo sapiens
gtgtggaaattaagaagaaa

SEQ ID NO: 1897670 - DNA, 21 bp, Homo sapiens
gtgtggagtcatttctgattt

SEQ ID NO: 1897671 - DNA, 15 bp, Homo sapiens
gtgtgttacaatgta

SEQ ID NO: 1897672 - DNA, 13 bp, Homo sapiens
gtgttaaaatttt

SEQ ID NO: 1897673 - DNA, 19 bp, Homo sapiens
gtgttaaaattttttgagt

SEQ ID NO: 1897674 - DNA, 22 bp, Homo sapiens
gtgttataatacgctgctgatc

SEQ ID NO: 1897675 - DNA, 16 bp, Homo sapiens
gtgttggctgcctggc

SEQ ID NO: 1897676 - DNA, 22 bp, Homo sapiens
gtgttgtaaaaatgtctttcat

SEQ ID NO: 1897677 - DNA, 15 bp, Homo sapiens
gtgtttagaattgaa

SEQ ID NO: 1897678 - DNA, 18 bp, Homo sapiens
gtgtttagaattgaaggt

SEQ ID NO: 1897679 - DNA, 17 bp, Homo sapiens
gtgtttatcagaaaggg

SEQ ID NO: 1897680 - DNA, 15 bp, Homo sapiens
gttaaaaacactgct

SEQ ID NO: 1897681 - DNA, 18 bp, Homo sapiens
gttaaaggtgaacattgg

SEQ ID NO: 1897682 - DNA, 14 bp, Homo sapiens
gttaactttttgta

SEQ ID NO: 1897683 - DNA, 12 bp, Homo sapiens
gttaatttaagt

SEQ ID NO: 1897684 - DNA, 13 bp, Homo sapiens
gttaatttaagtt

SEQ ID NO: 1897685 - DNA, 19 bp, Homo sapiens
gttaatttaagttttgaca

SEQ ID NO: 1897686 - DNA, 23 bp, Homo sapiens
gttaatttaagttttgacaagct

SEQ ID NO: 1897687 - DNA, 18 bp, Homo sapiens
gttacactttttggaagt

SEQ ID NO: 1897688 - DNA, 22 bp, Homo sapiens
gttacactttttggaagtgaaa

SEQ ID NO: 1897689 - DNA, 15 bp, Homo sapiens
gttacatatcaaaac

SEQ ID NO: 1897690 - DNA, 15 bp, Homo sapiens
gttactcttgggaca

SEQ ID NO: 1897691 - DNA, 14 bp, Homo sapiens
gttacttgctttga

SEQ ID NO: 1897692 - DNA, 12 bp, Homo sapiens
gttagactgcca

SEQ ID NO: 1897693 - DNA, 13 bp, Homo sapiens
gttataaaggaat

SEQ ID NO: 1897694 - DNA, 15 bp, Homo sapiens
gttatgtaaataatt

SEQ ID NO: 1897695 - DNA, 21 bp, Homo sapiens
gttatgtaaataattcttttt

SEQ ID NO: 1897696 - DNA, 22 bp, Homo sapiens
gttattcaacagcaagtgtgaa

SEQ ID NO: 1897697 - DNA, 22 bp, Homo sapiens
gttattggtgtaaggtactttc

SEQ ID NO: 1897698 - DNA, 16 bp, Homo sapiens
gttcaaacctgtgaag

SEQ ID NO: 1897699 - DNA, 13 bp, Homo sapiens
gttcaagaaatga

SEQ ID NO: 1897700 - DNA, 19 bp, Homo sapiens
gttcaggtacacatatttt

SEQ ID NO: 1897701 - DNA, 13 bp, Homo sapiens
gttccactgagac

SEQ ID NO: 1897702 - DNA, 19 bp, Homo sapiens
gttccatgcctgctctcga

SEQ ID NO: 1897703 - DNA, 15 bp, Homo sapiens
gttccttctgggcat

SEQ ID NO: 1897704 - DNA, 14 bp, Homo sapiens
gttctgactttgaa

SEQ ID NO: 1897705 - DNA, 17 bp, Homo sapiens
gttctgactttgaattt

SEQ ID NO: 1897706 - DNA, 19 bp, Homo sapiens
gttctgactttgaatttat

SEQ ID NO: 1897707 - DNA, 15 bp, Homo sapiens
gttctggtggcccct

SEQ ID NO: 1897708 - DNA, 20 bp, Homo sapiens
gttctgtatttgaaagtgcc

SEQ ID NO: 1897709 - DNA, 23 bp, Homo sapiens
gttctttaaactgtcgtgtcata

SEQ ID NO: 1897710 - DNA, 22 bp, Homo sapiens
gttgactctagtactgtgaatc

SEQ ID NO: 1897711 - DNA, 16 bp, Homo sapiens
gttgagctatgactta

SEQ ID NO: 1897712 - DNA, 18 bp, Homo sapiens
gttgaggcgagcagggca

SEQ ID NO: 1897713 - DNA, 17 bp, Homo sapiens
gttgatgggatgattga

SEQ ID NO: 1897714 - DNA, 21 bp, Homo sapiens
gttgatgggatgattgaagaa

SEQ ID NO: 1897715 - DNA, 20 bp, Homo sapiens
gttgcccaggctggagtgca

SEQ ID NO: 1897716 - DNA, 23 bp, Homo sapiens
gttgcctataagccaaaattaag

SEQ ID NO: 1897717 - DNA, 15 bp, Homo sapiens
gttgctgacttagaa

SEQ ID NO: 1897718 - DNA, 22 bp, Homo sapiens
gttgctgattttgaccttgtat

SEQ ID NO: 1897719 - DNA, 16 bp, Homo sapiens
gttgctggtaaaatga

SEQ ID NO: 1897720 - DNA, 20 bp, Homo sapiens
gttgggacccagtggcaggg

SEQ ID NO: 1897721 - DNA, 21 bp, Homo sapiens
gttgggacccagtggcagggc

SEQ ID NO: 1897722 - DNA, 21 bp, Homo sapiens
gttgggggaggggagactttg

SEQ ID NO: 1897723 - DNA, 20 bp, Homo sapiens
gttgtacttcatttctagag

SEQ ID NO: 1897724 - DNA, 14 bp, Homo sapiens
gttgtcaagaatag

SEQ ID NO: 1897725 - DNA, 18 bp, Homo sapiens
gttgtcaagaatagcatt

SEQ ID NO: 1897726 - DNA, 19 bp, Homo sapiens
gttgttcttggcaataaat

SEQ ID NO: 1897727 - DNA, 23 bp, Homo sapiens
gttgttgagggcatttggcttcc

SEQ ID NO: 1897728 - DNA, 21 bp, Homo sapiens
gttgttgataaggaacattta

SEQ ID NO: 1897729 - DNA, 14 bp, Homo sapiens
gttgtttttgtata

SEQ ID NO: 1897730 - DNA, 19 bp, Homo sapiens
gtttaaaaatctgccacct

SEQ ID NO: 1897731 - DNA, 20 bp, Homo sapiens
gtttaaaaatctgccacctg

SEQ ID NO: 1897732 - DNA, 23 bp, Homo sapiens
gtttaaagtgaatttttaaagac

SEQ ID NO: 1897733 - DNA, 17 bp, Homo sapiens
gtttaaggttaattatg

SEQ ID NO: 1897734 - DNA, 19 bp, Homo sapiens
gtttaataccctgtacata

SEQ ID NO: 1897735 - DNA, 16 bp, Homo sapiens
gtttacagatgttttc

SEQ ID NO: 1897736 - DNA, 13 bp, Homo sapiens
gtttacctgcacc

SEQ ID NO: 1897737 - DNA, 15 bp, Homo sapiens
gtttactcacagcca

SEQ ID NO: 1897738 - DNA, 12 bp, Homo sapiens
gtttagaacagg

SEQ ID NO: 1897739 - DNA, 12 bp, Homo sapiens
gtttagatttgc

SEQ ID NO: 1897740 - DNA, 15 bp, Homo sapiens
gtttattttaaaaca

SEQ ID NO: 1897741 - DNA, 16 bp, Homo sapiens
gtttattttaaaacaa

SEQ ID NO: 1897742 - DNA, 12 bp, Homo sapiens
gtttcagaccag

SEQ ID NO: 1897743 - DNA, 13 bp, Homo sapiens
gtttcagggctga

SEQ ID NO: 1897744 - DNA, 23 bp, Homo sapiens
gtttcaggtagaggtgcatgcct

SEQ ID NO: 1897745 - DNA, 12 bp, Homo sapiens
gtttccctccag

SEQ ID NO: 1897746 - DNA, 22 bp, Homo sapiens
gtttctgtcgttaaaaacagat

SEQ ID NO: 1897747 - DNA, 22 bp, Homo sapiens
gtttctgtggttggctgggaaa

SEQ ID NO: 1897748 - DNA, 17 bp, Homo sapiens
gtttctttaagaaagta

SEQ ID NO: 1897749 - DNA, 13 bp, Homo sapiens
gtttgaaaatagt

SEQ ID NO: 1897750 - DNA, 22 bp, Homo sapiens
gtttgaggattagtttagaaca

SEQ ID NO: 1897751 - DNA, 21 bp, Homo sapiens
gtttgccaatcattgcaaaca

SEQ ID NO: 1897752 - DNA, 12 bp, Homo sapiens
gtttggcaggca

SEQ ID NO: 1897753 - DNA, 16 bp, Homo sapiens
gtttgtatgtataatt

SEQ ID NO: 1897754 - DNA, 12 bp, Homo sapiens
gttttatttata

SEQ ID NO: 1897755 - DNA, 17 bp, Homo sapiens
gttttatttatatttat

SEQ ID NO: 1897756 - DNA, 20 bp, Homo sapiens
gttttcacagtcaccaagtg

SEQ ID NO: 1897757 - DNA, 23 bp, Homo sapiens
gttttcttgataattttccttta

SEQ ID NO: 1897758 - DNA, 18 bp, Homo sapiens
gttttgcattgtctgttg

SEQ ID NO: 1897759 - DNA, 17 bp, Homo sapiens
gtttttagttctgactt

SEQ ID NO: 1897760 - DNA, 14 bp, Homo sapiens
gtttttctgcttta

SEQ ID NO: 1897761 - DNA, 16 bp, Homo sapiens
gtttttctgctttaga

SEQ ID NO: 1897762 - DNA, 22 bp, Homo sapiens
gtttttctgctttagacttgaa

SEQ ID NO: 1897763 - DNA, 18 bp, Homo sapiens
gttttttaaaaatctgtg

SEQ ID NO: 1897764 - DNA, 14 bp, Homo sapiens
taaaaaaacagctt

SEQ ID NO: 1897765 - DNA, 20 bp, Homo sapiens
taaaaacagatttggaaaga

SEQ ID NO: 1897766 - DNA, 13 bp, Homo sapiens
taaaaagtgcagt

SEQ ID NO: 1897767 - DNA, 14 bp, Homo sapiens
taaaaagtgtttaa

SEQ ID NO: 1897768 - DNA, 21 bp, Homo sapiens
taaaaatatcacactgaataa

SEQ ID NO: 1897769 - DNA, 12 bp, Homo sapiens
taaaaatgtctt

SEQ ID NO: 1897770 - DNA, 16 bp, Homo sapiens
taaaaatgtctttcat

SEQ ID NO: 1897771 - DNA, 14 bp, Homo sapiens
taaaaattccagaa

SEQ ID NO: 1897772 - DNA, 17 bp, Homo sapiens
taaaacagagtaatctt

SEQ ID NO: 1897773 - DNA, 15 bp, Homo sapiens
taaaacatcattcct

SEQ ID NO: 1897774 - DNA, 19 bp, Homo sapiens
taaaacattaaaatataat

SEQ ID NO: 1897775 - DNA, 17 bp, Homo sapiens
taaaaccaggctttcta

SEQ ID NO: 1897776 - DNA, 23 bp, Homo sapiens
taaaagaagcatctctgaccaga

SEQ ID NO: 1897777 - DNA, 18 bp, Homo sapiens
taaaagcagcataaagaa

SEQ ID NO: 1897778 - DNA, 21 bp, Homo sapiens
taaaagcagcataaagaattt

SEQ ID NO: 1897779 - DNA, 14 bp, Homo sapiens
taaaagcattttgt

SEQ ID NO: 1897780 - DNA, 15 bp, Homo sapiens
taaaagcattttgta

SEQ ID NO: 1897781 - DNA, 18 bp, Homo sapiens
taaaagcattttgtaata

SEQ ID NO: 1897782 - DNA, 19 bp, Homo sapiens
taaaagcccaggagcccat

SEQ ID NO: 1897783 - DNA, 13 bp, Homo sapiens
taaaagtaaacat

SEQ ID NO: 1897784 - DNA, 19 bp, Homo sapiens
taaaagttgaccaatgaaa

SEQ ID NO: 1897785 - DNA, 17 bp, Homo sapiens
taaaatgaagaatttaa

SEQ ID NO: 1897786 - DNA, 17 bp, Homo sapiens
taaagaaaaaaatgtca

SEQ ID NO: 1897787 - DNA, 20 bp, Homo sapiens
taaagaaaaaaatgtcaaaa

SEQ ID NO: 1897788 - DNA, 22 bp, Homo sapiens
taaagaaaaaaatgtcaaaagt

SEQ ID NO: 1897789 - DNA, 18 bp, Homo sapiens
taaagaaatacacaggga

SEQ ID NO: 1897790 - DNA, 15 bp, Homo sapiens
taaagccgctgcctt

SEQ ID NO: 1897791 - DNA, 10 bp, Homo sapiens
taaaggaaat

SEQ ID NO: 1897792 - DNA, 15 bp, Homo sapiens
taaaggcctctgcct

SEQ ID NO: 1897793 - DNA, 20 bp, Homo sapiens
taaaggcctctgcctcacaa

SEQ ID NO: 1897794 - DNA, 13 bp, Homo sapiens
taaaggtggaaaa

SEQ ID NO: 1897795 - DNA, 20 bp, Homo sapiens
taaaggttaccgatttcaaa

SEQ ID NO: 1897796 - DNA, 14 bp, Homo sapiens
taaagtataacatg

SEQ ID NO: 1897797 - DNA, 21 bp, Homo sapiens
taaagtctgttgattaaagat

SEQ ID NO: 1897798 - DNA, 11 bp, Homo sapiens
taaagtgaatt

SEQ ID NO: 1897799 - DNA, 22 bp, Homo sapiens
taaagtgcaaacagaagtgcat

SEQ ID NO: 1897800 - DNA, 14 bp, Homo sapiens
taaagtgtggaaag

SEQ ID NO: 1897801 - DNA, 23 bp, Homo sapiens
taaataattcttttttattaatc

SEQ ID NO: 1897802 - DNA, 12 bp, Homo sapiens
taaatgactttc

SEQ ID NO: 1897803 - DNA, 13 bp, Homo sapiens
taaatgctgaaat

SEQ ID NO: 1897804 - DNA, 14 bp, Homo sapiens
taaatgctgaaata

SEQ ID NO: 1897805 - DNA, 19 bp, Homo sapiens
taaatgctgaaataaaatg

SEQ ID NO: 1897806 - DNA, 18 bp, Homo sapiens
taaatgttatagctgcat

SEQ ID NO: 1897807 - DNA, 16 bp, Homo sapiens
taaattggagttttaa

SEQ ID NO: 1897808 - DNA, 21 bp, Homo sapiens
taaattggagttttaaaaatg

SEQ ID NO: 1897809 - DNA, 21 bp, Homo sapiens
taaattgtattctcataatac

SEQ ID NO: 1897810 - DNA, 14 bp, Homo sapiens
taaatttggaactt

SEQ ID NO: 1897811 - DNA, 16 bp, Homo sapiens
taaatttttttgtatg

SEQ ID NO: 1897812 - DNA, 16 bp, Homo sapiens
taacaaaaaagagaaa

SEQ ID NO: 1897813 - DNA, 13 bp, Homo sapiens
taacaagaagcaa

SEQ ID NO: 1897814 - DNA, 15 bp, Homo sapiens
taacacacccctgct

SEQ ID NO: 1897815 - DNA, 19 bp, Homo sapiens
taaccattccataatcatg

SEQ ID NO: 1897816 - DNA, 13 bp, Homo sapiens
taacccagaaaat

SEQ ID NO: 1897817 - DNA, 16 bp, Homo sapiens
taacctttgctgtagt

SEQ ID NO: 1897818 - DNA, 18 bp, Homo sapiens
taacctttgctgtagtgt

SEQ ID NO: 1897819 - DNA, 19 bp, Homo sapiens
taacgttttctactttgaa

SEQ ID NO: 1897820 - DNA, 18 bp, Homo sapiens
taactaaaataattttgt

SEQ ID NO: 1897821 - DNA, 14 bp, Homo sapiens
taactcctgcctat

SEQ ID NO: 1897822 - DNA, 17 bp, Homo sapiens
taactgttgttgataag

SEQ ID NO: 1897823 - DNA, 23 bp, Homo sapiens
taactgttttgtatatgctgcat

SEQ ID NO: 1897824 - DNA, 13 bp, Homo sapiens
taacttaataatc

SEQ ID NO: 1897825 - DNA, 14 bp, Homo sapiens
taacttaataatca

SEQ ID NO: 1897826 - DNA, 17 bp, Homo sapiens
taacttatattgtaaga

SEQ ID NO: 1897827 - DNA, 16 bp, Homo sapiens
taacttatgaagtaaa

SEQ ID NO: 1897828 - DNA, 14 bp, Homo sapiens
taactttttgtagg

SEQ ID NO: 1897829 - DNA, 16 bp, Homo sapiens
taagaaatactgtaca

SEQ ID NO: 1897830 - DNA, 18 bp, Homo sapiens
taagaaatactgtacaat

SEQ ID NO: 1897831 - DNA, 14 bp, Homo sapiens
taagaagccaaggg

SEQ ID NO: 1897832 - DNA, 18 bp, Homo sapiens
taagaccccactggagtc

SEQ ID NO: 1897833 - DNA, 18 bp, Homo sapiens
taagaggttctaacttct

SEQ ID NO: 1897834 - DNA, 17 bp, Homo sapiens
taagatcactgtttaga

SEQ ID NO: 1897835 - DNA, 18 bp, Homo sapiens
taagatcactgtttagat

SEQ ID NO: 1897836 - DNA, 18 bp, Homo sapiens
taagcaggcgcaagggag

SEQ ID NO: 1897837 - DNA, 21 bp, Homo sapiens
taagccaaaattaaggtgttt

SEQ ID NO: 1897838 - DNA, 14 bp, Homo sapiens
taagccatgagaat

SEQ ID NO: 1897839 - DNA, 15 bp, Homo sapiens
taagcgtatggcttt

SEQ ID NO: 1897840 - DNA, 20 bp, Homo sapiens
taagctagttgaatacttga

SEQ ID NO: 1897841 - DNA, 20 bp, Homo sapiens
taagctggtttacagatgtt

SEQ ID NO: 1897842 - DNA, 20 bp, Homo sapiens
taaggaaaaataaaagtgct

SEQ ID NO: 1897843 - DNA, 21 bp, Homo sapiens
taaggatacaggctggaaagt

SEQ ID NO: 1897844 - DNA, 13 bp, Homo sapiens
taaggcatgaagg

SEQ ID NO: 1897845 - DNA, 15 bp, Homo sapiens
taaggcatgaaggat

SEQ ID NO: 1897846 - DNA, 19 bp, Homo sapiens
taaggtggaaagtgttcat

SEQ ID NO: 1897847 - DNA, 21 bp, Homo sapiens
taaggtgtttgaaaatagttt

SEQ ID NO: 1897848 - DNA, 14 bp, Homo sapiens
taaggttaattatg

SEQ ID NO: 1897849 - DNA, 23 bp, Homo sapiens
taaggttttcttttttccccttt

SEQ ID NO: 1897850 - DNA, 16 bp, Homo sapiens
taaggttttttttgta

SEQ ID NO: 1897851 - DNA, 18 bp, Homo sapiens
taagtccatctgtcactt

SEQ ID NO: 1897852 - DNA, 19 bp, Homo sapiens
taagtggactctctgacaa

SEQ ID NO: 1897853 - DNA, 21 bp, Homo sapiens
taagtggactctctgacaaag

SEQ ID NO: 1897854 - DNA, 17 bp, Homo sapiens
taagttagttccactga

SEQ ID NO: 1897855 - DNA, 21 bp, Homo sapiens
taagtttggcaaacagaatgt

SEQ ID NO: 1897856 - DNA, 23 bp, Homo sapiens
taataaaagtgccttagcatgtg

SEQ ID NO: 1897857 - DNA, 15 bp, Homo sapiens
taataaagactctac

SEQ ID NO: 1897858 - DNA, 16 bp, Homo sapiens
taataaattggagttt

SEQ ID NO: 1897859 - DNA, 16 bp, Homo sapiens
taataagctagttgaa

SEQ ID NO: 1897860 - DNA, 20 bp, Homo sapiens
taataagctagttgaatact

SEQ ID NO: 1897861 - DNA, 20 bp, Homo sapiens
taataatcaagagccttaaa

SEQ ID NO: 1897862 - DNA, 14 bp, Homo sapiens
taatactgaaccac

SEQ ID NO: 1897863 - DNA, 22 bp, Homo sapiens
taatactgaaccacttgtagat

SEQ ID NO: 1897864 - DNA, 13 bp, Homo sapiens
taatatttattaa

SEQ ID NO: 1897865 - DNA, 16 bp, Homo sapiens
taatatttattaaatt

SEQ ID NO: 1897866 - DNA, 20 bp, Homo sapiens
taatcaagagccttaaaaca

SEQ ID NO: 1897867 - DNA, 13 bp, Homo sapiens
taatcactgtgta

SEQ ID NO: 1897868 - DNA, 16 bp, Homo sapiens
taatcactgtgtatat

SEQ ID NO: 1897869 - DNA, 22 bp, Homo sapiens
taatgaataaagtgcaaacaga

SEQ ID NO: 1897870 - DNA, 14 bp, Homo sapiens
taatgactggtctt

SEQ ID NO: 1897871 - DNA, 19 bp, Homo sapiens
taatgactggtcttcctta

SEQ ID NO: 1897872 - DNA, 17 bp, Homo sapiens
taatgctaatcttgtga

SEQ ID NO: 1897873 - DNA, 16 bp, Homo sapiens
taatggatgaaatcat

SEQ ID NO: 1897874 - DNA, 22 bp, Homo sapiens
taatggtgatgcagtcttagat

SEQ ID NO: 1897875 - DNA, 13 bp, Homo sapiens
taattatttaaag

SEQ ID NO: 1897876 - DNA, 15 bp, Homo sapiens
taattctatgcctgt

SEQ ID NO: 1897877 - DNA, 15 bp, Homo sapiens
taattcttttttatt

SEQ ID NO: 1897878 - DNA, 15 bp, Homo sapiens
taattgtatttttgt

SEQ ID NO: 1897879 - DNA, 15 bp, Homo sapiens
taattgttgtttgta

SEQ ID NO: 1897880 - DNA, 22 bp, Homo sapiens
taattgttgtttgtatgtataa

SEQ ID NO: 1897881 - DNA, 20 bp, Homo sapiens
taatttaagttttgacaagc

SEQ ID NO: 1897882 - DNA, 12 bp, Homo sapiens
taatttatgtaa

SEQ ID NO: 1897883 - DNA, 20 bp, Homo sapiens
taattttgatagtgggacca

SEQ ID NO: 1897884 - DNA, 22 bp, Homo sapiens
tacaaaactattaagtatgtca

SEQ ID NO: 1897885 - DNA, 16 bp, Homo sapiens
tacaaatgcatctttg

SEQ ID NO: 1897886 - DNA, 19 bp, Homo sapiens
tacaaatgcatctttgatg

SEQ ID NO: 1897887 - DNA, 18 bp, Homo sapiens
tacaacactttaatgggt

SEQ ID NO: 1897888 - DNA, 22 bp, Homo sapiens
tacaaccagaaacaatgtgtct

SEQ ID NO: 1897889 - DNA, 16 bp, Homo sapiens
tacaagtagttctgta

SEQ ID NO: 1897890 - DNA, 23 bp, Homo sapiens
tacaagtagttctgtatttgaaa

SEQ ID NO: 1897891 - DNA, 23 bp, Homo sapiens
tacaatgatatccaatattaaaa

SEQ ID NO: 1897892 - DNA, 22 bp, Homo sapiens
tacacaggacaggggttccttc

SEQ ID NO: 1897893 - DNA, 14 bp, Homo sapiens
tacacatattttga

SEQ ID NO: 1897894 - DNA, 13 bp, Homo sapiens
tacaccacaagta

SEQ ID NO: 1897895 - DNA, 19 bp, Homo sapiens
tacacccatgaaagaaaac

SEQ ID NO: 1897896 - DNA, 22 bp, Homo sapiens
tacacggttcaaacctgtgaag

SEQ ID NO: 1897897 - DNA, 20 bp, Homo sapiens
tacactgaatttttatgtgt

SEQ ID NO: 1897898 - DNA, 23 bp, Homo sapiens
tacactgaatttttatgtgtgat

SEQ ID NO: 1897899 - DNA, 21 bp, Homo sapiens
tacagaacagtttaagaagtg

SEQ ID NO: 1897900 - DNA, 13 bp, Homo sapiens
ttggttcaaatgt

SEQ ID NO: 1897901 - DNA, 15 bp, Homo sapiens
ttggttcaaatgtgt

SEQ ID NO: 1897902 - DNA, 16 bp, Homo sapiens
ttggttgaataaacta

SEQ ID NO: 1897903 - DNA, 20 bp, Homo sapiens
ttgtaaaagaacagtaaaca

SEQ ID NO: 1897904 - DNA, 23 bp, Homo sapiens
ttgtaaaagaacagtaaacattg

SEQ ID NO: 1897905 - DNA, 18 bp, Homo sapiens
ttgtaaaagcattttgta

SEQ ID NO: 1897906 - DNA, 20 bp, Homo sapiens
ttgtaaaagcattttgtaat

SEQ ID NO: 1897907 - DNA, 15 bp, Homo sapiens
ttgtaaatattgttt

SEQ ID NO: 1897908 - DNA, 22 bp, Homo sapiens
ttgtaactaaaataattttgta

SEQ ID NO: 1897909 - DNA, 17 bp, Homo sapiens
ttgtaagaaatactgta

SEQ ID NO: 1897910 - DNA, 22 bp, Homo sapiens
ttgtaagcgtatggctttattt

SEQ ID NO: 1897911 - DNA, 15 bp, Homo sapiens
ttgtaatatgtaaat

SEQ ID NO: 1897912 - DNA, 23 bp, Homo sapiens
ttgtaatctagttgtcaataaat

SEQ ID NO: 1897913 - DNA, 23 bp, Homo sapiens
ttgtacacccatgaaagaaaact

SEQ ID NO: 1897914 - DNA, 18 bp, Homo sapiens
ttgtacgacgtcagatgt

SEQ ID NO: 1897915 - DNA, 21 bp, Homo sapiens
ttgtacgacgtcagatgttta

SEQ ID NO: 1897916 - DNA, 17 bp, Homo sapiens
ttgtagacattttgaaa

SEQ ID NO: 1897917 - DNA, 15 bp, Homo sapiens
ttgtagatttgattt

SEQ ID NO: 1897918 - DNA, 12 bp, Homo sapiens
ttgtataaattt

SEQ ID NO: 1897919 - DNA, 14 bp, Homo sapiens
ttgtatagttatgt

SEQ ID NO: 1897920 - DNA, 18 bp, Homo sapiens
ttgtatagttatgtaaat

SEQ ID NO: 1897921 - DNA, 19 bp, Homo sapiens
ttgtatagttatgtaaata

SEQ ID NO: 1897922 - DNA, 14 bp, Homo sapiens
ttgtatatgctgca

SEQ ID NO: 1897923 - DNA, 13 bp, Homo sapiens
ttgtatattggtt

SEQ ID NO: 1897924 - DNA, 21 bp, Homo sapiens
ttgtatcagaatcttgtccaa

SEQ ID NO: 1897925 - DNA, 16 bp, Homo sapiens
ttgtattcctaactgt

SEQ ID NO: 1897926 - DNA, 18 bp, Homo sapiens
ttgtattgaagttaactg

SEQ ID NO: 1897927 - DNA, 16 bp, Homo sapiens
ttgtattgtcctatta

SEQ ID NO: 1897928 - DNA, 16 bp, Homo sapiens
ttgtatttttgttgtt

SEQ ID NO: 1897929 - DNA, 19 bp, Homo sapiens
ttgtatttttgttgttggg

SEQ ID NO: 1897930 - DNA, 18 bp, Homo sapiens
ttgtcaatgctggagaaa

SEQ ID NO: 1897931 - DNA, 19 bp, Homo sapiens
ttgtcactccaaaccttac

SEQ ID NO: 1897932 - DNA, 16 bp, Homo sapiens
ttgtcagaccataaga

SEQ ID NO: 1897933 - DNA, 19 bp, Homo sapiens
ttgtcctattagtgttata

SEQ ID NO: 1897934 - DNA, 17 bp, Homo sapiens
ttgtccttgaagcttgt

SEQ ID NO: 1897935 - DNA, 21 bp, Homo sapiens
ttgtccttgaagcttgtatct

SEQ ID NO: 1897936 - DNA, 15 bp, Homo sapiens
ttgtcctttgattcc

SEQ ID NO: 1897937 - DNA, 18 bp, Homo sapiens
ttgtctgttggcaaattt

SEQ ID NO: 1897938 - DNA, 19 bp, Homo sapiens
ttgtgaacaagtccctgta

SEQ ID NO: 1897939 - DNA, 21 bp, Homo sapiens
ttgtgtaaggactttggctta

SEQ ID NO: 1897940 - DNA, 16 bp, Homo sapiens
ttgtgtgtccccttgc

SEQ ID NO: 1897941 - DNA, 17 bp, Homo sapiens
ttgttaaaaacactgct

SEQ ID NO: 1897942 - DNA, 15 bp, Homo sapiens
ttgttactgtatcct

SEQ ID NO: 1897943 - DNA, 19 bp, Homo sapiens
ttgttcctttaacctttgc

SEQ ID NO: 1897944 - DNA, 21 bp, Homo sapiens
ttgttgctgattttgaccttg

SEQ ID NO: 1897945 - DNA, 23 bp, Homo sapiens
ttgtttcaattagaaaaggaaat

SEQ ID NO: 1897946 - DNA, 16 bp, Homo sapiens
ttgtttctttctctga

SEQ ID NO: 1897947 - DNA, 23 bp, Homo sapiens
ttgtttgatgcattaaaagaaaa

SEQ ID NO: 1897948 - DNA, 13 bp, Homo sapiens
ttgtttgtatgta

SEQ ID NO: 1897949 - DNA, 19 bp, Homo sapiens
ttgtttgtatgtataattc

SEQ ID NO: 1897950 - DNA, 13 bp, Homo sapiens
ttgtttgtttcaa

SEQ ID NO: 1897951 - DNA, 16 bp, Homo sapiens
ttgttttgcattgtct

SEQ ID NO: 1897952 - DNA, 13 bp, Homo sapiens
ttgttttgtcttg

SEQ ID NO: 1897953 - DNA, 20 bp, Homo sapiens
tttaaaagtaattgtattaa

SEQ ID NO: 1897954 - DNA, 13 bp, Homo sapiens
tttaaatgtcaaa

SEQ ID NO: 1897955 - DNA, 23 bp, Homo sapiens
tttaacagggtctctagtgctgt

SEQ ID NO: 1897956 - DNA, 21 bp, Homo sapiens
tttaacatggttcaggtacac

SEQ ID NO: 1897957 - DNA, 14 bp, Homo sapiens
tttaagcaataaaa

SEQ ID NO: 1897958 - DNA, 12 bp, Homo sapiens
tttaaggaatat

SEQ ID NO: 1897959 - DNA, 19 bp, Homo sapiens
tttaaggactgactgaggc

SEQ ID NO: 1897960 - DNA, 14 bp, Homo sapiens
tttaaggttaatta

SEQ ID NO: 1897961 - DNA, 17 bp, Homo sapiens
tttaagtggactctctg

SEQ ID NO: 1897962 - DNA, 18 bp, Homo sapiens
tttaagtggactctctga

SEQ ID NO: 1897963 - DNA, 15 bp, Homo sapiens
tttaatatgaaattt

SEQ ID NO: 1897964 - DNA, 16 bp, Homo sapiens
tttaatatgaaatttt

SEQ ID NO: 1897965 - DNA, 12 bp, Homo sapiens
tttacagatgtt

SEQ ID NO: 1897966 - DNA, 17 bp, Homo sapiens
tttaccttgtcattttg

SEQ ID NO: 1897967 - DNA, 14 bp, Homo sapiens
tttactgcattctt

SEQ ID NO: 1897968 - DNA, 21 bp, Homo sapiens
tttactttttttttattttat

SEQ ID NO: 1897969 - DNA, 21 bp, Homo sapiens
tttagaattacaccacaagta

SEQ ID NO: 1897970 - DNA, 22 bp, Homo sapiens
tttagaattacaccacaagtat

SEQ ID NO: 1897971 - DNA, 13 bp, Homo sapiens
tttagaattgaag

SEQ ID NO: 1897972 - DNA, 18 bp, Homo sapiens
tttagaattgaaggtttt

SEQ ID NO: 1897973 - DNA, 12 bp, Homo sapiens
tttagacttgaa

SEQ ID NO: 1897974 - DNA, 20 bp, Homo sapiens
tttagacttgaaaagagaca

SEQ ID NO: 1897975 - DNA, 21 bp, Homo sapiens
tttagacttgaaaagagacag

SEQ ID NO: 1897976 - DNA, 22 bp, Homo sapiens
tttagacttgaaaagagacagg

SEQ ID NO: 1897977 - DNA, 17 bp, Homo sapiens
tttagatgtaattttgt

SEQ ID NO: 1897978 - DNA, 15 bp, Homo sapiens
tttagggagtattct

SEQ ID NO: 1897979 - DNA, 18 bp, Homo sapiens
tttagggagtattctaat

SEQ ID NO: 1897980 - DNA, 18 bp, Homo sapiens
tttagttctgactttgaa

SEQ ID NO: 1897981 - DNA, 12 bp, Homo sapiens
tttataatgact

SEQ ID NO: 1897982 - DNA, 23 bp, Homo sapiens
tttataatgactggtcttcctta

SEQ ID NO: 1897983 - DNA, 16 bp, Homo sapiens
tttatataaagtattt

SEQ ID NO: 1897984 - DNA, 15 bp, Homo sapiens
tttatatgtatgtgt

SEQ ID NO: 1897985 - DNA, 20 bp, Homo sapiens
tttatatgtatgtgtttaga

SEQ ID NO: 1897986 - DNA, 20 bp, Homo sapiens
tttatatttcaagtacactg

SEQ ID NO: 1897987 - DNA, 16 bp, Homo sapiens
tttatccaggaattga

SEQ ID NO: 1897988 - DNA, 15 bp, Homo sapiens
tttatgttttcacag

SEQ ID NO: 1897989 - DNA, 12 bp, Homo sapiens
tttattaaattt

SEQ ID NO: 1897990 - DNA, 19 bp, Homo sapiens
tttattaggaaaagatatt

SEQ ID NO: 1897991 - DNA, 23 bp, Homo sapiens
tttattgcatctgggtagctgta

SEQ ID NO: 1897992 - DNA, 24 bp, Homo sapiens
tttattgcatctgggtagctgtaa

SEQ ID NO: 1897993 - DNA, 16 bp, Homo sapiens
tttatttactgctagt

SEQ ID NO: 1897994 - DNA, 17 bp, Homo sapiens
tttatttatatttattg

SEQ ID NO: 1897995 - DNA, 19 bp, Homo sapiens
tttatttcagcaaacttgt

SEQ ID NO: 1897996 - DNA, 16 bp, Homo sapiens
tttatttttagaattt

SEQ ID NO: 1897997 - DNA, 17 bp, Homo sapiens
tttcaaaatatgtgtat

SEQ ID NO: 1897998 - DNA, 23 bp, Homo sapiens
tttcaatgtgatataaacagctt

SEQ ID NO: 1897999 - DNA, 19 bp, Homo sapiens
tttcaattagaaaaggaaa

SEQ ID NO: 1898000 - DNA, 22 bp, Homo sapiens
tttcaggtagaggtgcatgcct

SEQ ID NO: 1898001 - DNA, 23 bp, Homo sapiens
tttcataagaggttctaacttct

SEQ ID NO: 1898002 - DNA, 14 bp, Homo sapiens
tttccctccaggtg

SEQ ID NO: 1898003 - DNA, 16 bp, Homo sapiens
tttccctcctttcctt

SEQ ID NO: 1898004 - DNA, 17 bp, Homo sapiens
tttccctcctttccttt

SEQ ID NO: 1898005 - DNA, 16 bp, Homo sapiens
tttcctatatgatgat

SEQ ID NO: 1898006 - DNA, 16 bp, Homo sapiens
tttcctttcctttctt

SEQ ID NO: 1898007 - DNA, 19 bp, Homo sapiens
tttcctttcttagctgatg

SEQ ID NO: 1898008 - DNA, 16 bp, Homo sapiens
tttcctttttctttcc

SEQ ID NO: 1898009 - DNA, 15 bp, Homo sapiens
tttcgacttgcattt

SEQ ID NO: 1898010 - DNA, 19 bp, Homo sapiens
tttcgacttgcatttttgc

SEQ ID NO: 1898011 - DNA, 17 bp, Homo sapiens
tttctagaaagaataaa

SEQ ID NO: 1898012 - DNA, 20 bp, Homo sapiens
tttctaggcctacatgcttt

SEQ ID NO: 1898013 - DNA, 12 bp, Homo sapiens
tttctatgaaag

SEQ ID NO: 1898014 - DNA, 16 bp, Homo sapiens
tttctccatggagttg

SEQ ID NO: 1898015 - DNA, 17 bp, Homo sapiens
tttctctttctctctca

SEQ ID NO: 1898016 - DNA, 16 bp, Homo sapiens
tttctgatagtagtct

SEQ ID NO: 1898017 - DNA, 21 bp, Homo sapiens
tttctgatagtagtctttaaa

SEQ ID NO: 1898018 - DNA, 18 bp, Homo sapiens
tttctgcacaataataag

SEQ ID NO: 1898019 - DNA, 13 bp, Homo sapiens
tttctgccaggga

SEQ ID NO: 1898020 - DNA, 19 bp, Homo sapiens
tttctgctttagacttgaa

SEQ ID NO: 1898021 - DNA, 19 bp, Homo sapiens
tttcttatttatgtaacaa

SEQ ID NO: 1898022 - DNA, 19 bp, Homo sapiens
tttcttcagactgaggcct

SEQ ID NO: 1898023 - DNA, 15 bp, Homo sapiens
tttctttcccttctt

SEQ ID NO: 1898024 - DNA, 12 bp, Homo sapiens
tttctttccttt

SEQ ID NO: 1898025 - DNA, 12 bp, Homo sapiens
tttgaaaagtaa

SEQ ID NO: 1898026 - DNA, 11 bp, Homo sapiens
tttgaaaatag

SEQ ID NO: 1898027 - DNA, 16 bp, Homo sapiens
tttgaaataaaaatgg

SEQ ID NO: 1898028 - DNA, 14 bp, Homo sapiens
tttgaataatgtct

SEQ ID NO: 1898029 - DNA, 19 bp, Homo sapiens
tttgaggattagtttagaa

SEQ ID NO: 1898030 - DNA, 23 bp, Homo sapiens
tttgaggattagtttagaacagg

SEQ ID NO: 1898031 - DNA, 17 bp, Homo sapiens
tttgatatatgtatctt

SEQ ID NO: 1898032 - DNA, 13 bp, Homo sapiens
ttccaattttcct

SEQ ID NO: 1898033 - DNA, 19 bp, Homo sapiens
ttccactttttgttacata

SEQ ID NO: 1898034 - DNA, 23 bp, Homo sapiens
ttccagcaggagggacagtctca

SEQ ID NO: 1898035 - DNA, 21 bp, Homo sapiens
ttccagcatgtaaagagctgg

SEQ ID NO: 1898036 - DNA, 16 bp, Homo sapiens
ttccagctccctcccc

SEQ ID NO: 1898037 - DNA, 17 bp, Homo sapiens
ttccagctccctcccct

SEQ ID NO: 1898038 - DNA, 17 bp, Homo sapiens
ttccagtggcttctccc

SEQ ID NO: 1898039 - DNA, 15 bp, Homo sapiens
ttccatctcttcctt

SEQ ID NO: 1898040 - DNA, 17 bp, Homo sapiens
ttccatctcttcctttc

SEQ ID NO: 1898041 - DNA, 18 bp, Homo sapiens
ttccatgcctgctctcga

SEQ ID NO: 1898042 - DNA, 17 bp, Homo sapiens
ttccatttactgcattc

SEQ ID NO: 1898043 - DNA, 20 bp, Homo sapiens
ttccccaagcctggcagggg

SEQ ID NO: 1898044 - DNA, 22 bp, Homo sapiens
ttccccctgtttcagaggctca

SEQ ID NO: 1898045 - DNA, 23 bp, Homo sapiens
ttccctgggttagactgccagct

SEQ ID NO: 1898046 - DNA, 19 bp, Homo sapiens
ttcccttccatctcttcct

SEQ ID NO: 1898047 - DNA, 12 bp, Homo sapiens
ttcctaaaacag

SEQ ID NO: 1898048 - DNA, 14 bp, Homo sapiens
ttcctagtgtcttt

SEQ ID NO: 1898049 - DNA, 18 bp, Homo sapiens
ttcctatcaaaaagatat

SEQ ID NO: 1898050 - DNA, 20 bp, Homo sapiens
ttcctccccaccctgtccca

SEQ ID NO: 1898051 - DNA, 22 bp, Homo sapiens
ttcctccccaccctgtcccagg

SEQ ID NO: 1898052 - DNA, 11 bp, Homo sapiens
ttcctctgctg

SEQ ID NO: 1898053 - DNA, 13 bp, Homo sapiens
ttcctctgctgca

SEQ ID NO: 1898054 - DNA, 15 bp, Homo sapiens
ttcctttcctttcat

SEQ ID NO: 1898055 - DNA, 14 bp, Homo sapiens
ttcctttcctttct

SEQ ID NO: 1898056 - DNA, 21 bp, Homo sapiens
ttccttttagagttaagaact

SEQ ID NO: 1898057 - DNA, 15 bp, Homo sapiens
ttcgaagttctagaa

SEQ ID NO: 1898058 - DNA, 14 bp, Homo sapiens
ttcgaccagccagg

SEQ ID NO: 1898059 - DNA, 17 bp, Homo sapiens
ttcgtttgtttgtttca

SEQ ID NO: 1898060 - DNA, 17 bp, Homo sapiens
ttctaataagctagttg

SEQ ID NO: 1898061 - DNA, 20 bp, Homo sapiens
ttctaataagctagttgaat

SEQ ID NO: 1898062 - DNA, 20 bp, Homo sapiens
ttctaattggctttactatt

SEQ ID NO: 1898063 - DNA, 18 bp, Homo sapiens
ttctacaactttaaaact

SEQ ID NO: 1898064 - DNA, 23 bp, Homo sapiens
ttctactgttatgtgagaacatt

SEQ ID NO: 1898065 - DNA, 24 bp, Homo sapiens
ttctactgttatgtgagaacatta

SEQ ID NO: 1898066 - DNA, 14 bp, Homo sapiens
ttctactttgaaat

SEQ ID NO: 1898067 - DNA, 20 bp, Homo sapiens
ttctagtaataaagactcta

SEQ ID NO: 1898068 - DNA, 14 bp, Homo sapiens
ttctagtctggaac

SEQ ID NO: 1898069 - DNA, 23 bp, Homo sapiens
ttctataagtgtgaccagttttg

SEQ ID NO: 1898070 - DNA, 16 bp, Homo sapiens
ttctataattttacaa

SEQ ID NO: 1898071 - DNA, 22 bp, Homo sapiens
ttctatagcatcacttaaaaca

SEQ ID NO: 1898072 - DNA, 16 bp, Homo sapiens
ttctatgaatctattt

SEQ ID NO: 1898073 - DNA, 21 bp, Homo sapiens
ttctatgtctagcacatgttg

SEQ ID NO: 1898074 - DNA, 13 bp, Homo sapiens
ttctattttacaa

SEQ ID NO: 1898075 - DNA, 24 bp, Homo sapiens
ttctctctcactctcttcctttca

SEQ ID NO: 1898076 - DNA, 20 bp, Homo sapiens
ttctctgaggacaagagaaa

SEQ ID NO: 1898077 - DNA, 22 bp, Homo sapiens
ttctctggtacaatttcttttg

SEQ ID NO: 1898078 - DNA, 12 bp, Homo sapiens
ttctcttgcctc

SEQ ID NO: 1898079 - DNA, 17 bp, Homo sapiens
ttctgaaaatttatata

SEQ ID NO: 1898080 - DNA, 18 bp, Homo sapiens
ttctgaaaatttatataa

SEQ ID NO: 1898081 - DNA, 19 bp, Homo sapiens
ttctgaaaatttatataac

SEQ ID NO: 1898082 - DNA, 14 bp, Homo sapiens
ttctgactttgaat

SEQ ID NO: 1898083 - DNA, 18 bp, Homo sapiens
ttctgactttgaatttat

SEQ ID NO: 1898084 - DNA, 23 bp, Homo sapiens
ttctgactttgaatttatataaa

SEQ ID NO: 1898085 - DNA, 13 bp, Homo sapiens
ttctgatttcttt

SEQ ID NO: 1898086 - DNA, 21 bp, Homo sapiens
ttctgccaccctgctgagtct

SEQ ID NO: 1898087 - DNA, 22 bp, Homo sapiens
ttctgccagatgtcctaatggt

SEQ ID NO: 1898088 - DNA, 19 bp, Homo sapiens
ttctgctttagacttgaaa

SEQ ID NO: 1898089 - DNA, 17 bp, Homo sapiens
ttctggcacgaaatggc

SEQ ID NO: 1898090 - DNA, 19 bp, Homo sapiens
ttctgtatttgaaagtgcc

SEQ ID NO: 1898091 - DNA, 14 bp, Homo sapiens
ttcttaatttatgt

SEQ ID NO: 1898092 - DNA, 17 bp, Homo sapiens
ttcttattactagactg

SEQ ID NO: 1898093 - DNA, 20 bp, Homo sapiens
tgatgttgacatcactggca

SEQ ID NO: 1898094 - DNA, 16 bp, Homo sapiens
tgattaaaatgagttt

SEQ ID NO: 1898095 - DNA, 15 bp, Homo sapiens
tgattaaagatgagc

SEQ ID NO: 1898096 - DNA, 14 bp, Homo sapiens
tgattaatgcattt

SEQ ID NO: 1898097 - DNA, 18 bp, Homo sapiens
tgattatataagcaaaat

SEQ ID NO: 1898098 - DNA, 22 bp, Homo sapiens
tgattatataagcaaaatgaaa

SEQ ID NO: 1898099 - DNA, 21 bp, Homo sapiens
tgattattttcagaagctgat

SEQ ID NO: 1898100 - DNA, 20 bp, Homo sapiens
tgattcccttgttattcaac

SEQ ID NO: 1898101 - DNA, 19 bp, Homo sapiens
tgattgcctcaataaagct

SEQ ID NO: 1898102 - DNA, 19 bp, Homo sapiens
tgatttattaacttaataa

SEQ ID NO: 1898103 - DNA, 18 bp, Homo sapiens
tgcaaacagaagtgcatc

SEQ ID NO: 1898104 - DNA, 21 bp, Homo sapiens
tgcaacattttaaggcaatgg

SEQ ID NO: 1898105 - DNA, 13 bp, Homo sapiens
tgcaagcttttcc

SEQ ID NO: 1898106 - DNA, 17 bp, Homo sapiens
tgcaagcttttcctaat

SEQ ID NO: 1898107 - DNA, 15 bp, Homo sapiens
tgcaatgccccctcc

SEQ ID NO: 1898108 - DNA, 16 bp, Homo sapiens
tgcacgttttcatctc

SEQ ID NO: 1898109 - DNA, 16 bp, Homo sapiens
tgcactgactctggaa

SEQ ID NO: 1898110 - DNA, 17 bp, Homo sapiens
tgcagagcagtaaggga

SEQ ID NO: 1898111 - DNA, 19 bp, Homo sapiens
tgcagcctccgcttccctg

SEQ ID NO: 1898112 - DNA, 13 bp, Homo sapiens
tgcaggcccaccc

SEQ ID NO: 1898113 - DNA, 17 bp, Homo sapiens
tgcaggcccaccctgct

SEQ ID NO: 1898114 - DNA, 15 bp, Homo sapiens
tgcaggtgggatgag

SEQ ID NO: 1898115 - DNA, 22 bp, Homo sapiens
tgcagtggcgaaatccctgctc

SEQ ID NO: 1898116 - DNA, 19 bp, Homo sapiens
tgcagtgtgaatgctgggc

SEQ ID NO: 1898117 - DNA, 13 bp, Homo sapiens
tgcagttcccatc

SEQ ID NO: 1898118 - DNA, 14 bp, Homo sapiens
tgcatataacttat

SEQ ID NO: 1898119 - DNA, 20 bp, Homo sapiens
tgcatataacttatattgta

SEQ ID NO: 1898120 - DNA, 22 bp, Homo sapiens
tgcatattctagtaataaagac

SEQ ID NO: 1898121 - DNA, 13 bp, Homo sapiens
tgcatccccttcc

SEQ ID NO: 1898122 - DNA, 14 bp, Homo sapiens
tgcatccccttcca

SEQ ID NO: 1898123 - DNA, 18 bp, Homo sapiens
tgcatccccttccagctc

SEQ ID NO: 1898124 - DNA, 16 bp, Homo sapiens
tgcatctttgatgtgt

SEQ ID NO: 1898125 - DNA, 17 bp, Homo sapiens
tgcatctttgatgtgtt

SEQ ID NO: 1898126 - DNA, 23 bp, Homo sapiens
tgcatgggttaattgagaataga

SEQ ID NO: 1898127 - DNA, 19 bp, Homo sapiens
tgcattaaaagaaaataaa

SEQ ID NO: 1898128 - DNA, 15 bp, Homo sapiens
tgcattcttctgatc

SEQ ID NO: 1898129 - DNA, 20 bp, Homo sapiens
tgaaatgctttagcatacta

SEQ ID NO: 1898130 - DNA, 15 bp, Homo sapiens
tgaacaagcattctc

SEQ ID NO: 1898131 - DNA, 23 bp, Homo sapiens
tgaacagattttattaatcacgg

SEQ ID NO: 1898132 - DNA, 15 bp, Homo sapiens
tgaacatgcctcctc

SEQ ID NO: 1898133 - DNA, 19 bp, Homo sapiens
tgaacatgcctcctcctgc

SEQ ID NO: 1898134 - DNA, 23 bp, Homo sapiens
tgaacatgcctcctcctgccctc

SEQ ID NO: 1898135 - DNA, 12 bp, Homo sapiens
tgaacattgcat

SEQ ID NO: 1898136 - DNA, 22 bp, Homo sapiens
tgaacattgcatataacttata

SEQ ID NO: 1898137 - DNA, 14 bp, Homo sapiens
tgaaccacttgtag

SEQ ID NO: 1898138 - DNA, 15 bp, Homo sapiens
tgaaccataaaatgt

SEQ ID NO: 1898139 - DNA, 20 bp, Homo sapiens
tgaacgtttggttcaaatgt

SEQ ID NO: 1898140 - DNA, 16 bp, Homo sapiens
tgaagaatttaaagaa

SEQ ID NO: 1898141 - DNA, 15 bp, Homo sapiens
tgaagacagcccgat

SEQ ID NO: 1898142 - DNA, 23 bp, Homo sapiens
tgaagagatgacaacaaattttg

SEQ ID NO: 1898143 - DNA, 15 bp, Homo sapiens
tgaagatactttgta

SEQ ID NO: 1898144 - DNA, 16 bp, Homo sapiens
tgaagatactttgtat

SEQ ID NO: 1898145 - DNA, 15 bp, Homo sapiens
tgaagcaaacagttg

SEQ ID NO: 1898146 - DNA, 22 bp, Homo sapiens
tgaagctgaggctgctgccagg

SEQ ID NO: 1898147 - DNA, 15 bp, Homo sapiens
tgaagcttgtatctg

SEQ ID NO: 1898148 - DNA, 19 bp, Homo sapiens
tgaagcttgtatctgatat

SEQ ID NO: 1898149 - DNA, 16 bp, Homo sapiens
tgaaggagtaatggga

SEQ ID NO: 1898150 - DNA, 15 bp, Homo sapiens
tgaaggatgccaaga

SEQ ID NO: 1898151 - DNA, 15 bp, Homo sapiens
tgaaggcagaaagca

SEQ ID NO: 1898152 - DNA, 19 bp, Homo sapiens
tgaagtaaaagttaagatc

SEQ ID NO: 1898153 - DNA, 21 bp, Homo sapiens
tgaagtgcatgggtcagggtg

SEQ ID NO: 1898154 - DNA, 20 bp, Homo sapiens
tgaataaactagattacatt

SEQ ID NO: 1898155 - DNA, 13 bp, Homo sapiens
tgaataaagtgca

SEQ ID NO: 1898156 - DNA, 17 bp, Homo sapiens
tgaataaagtgcaaaca

SEQ ID NO: 1898157 - DNA, 14 bp, Homo sapiens
tgaataatgtctag

SEQ ID NO: 1898158 - DNA, 23 bp, Homo sapiens
tgaataatgtctagattttgaaa

SEQ ID NO: 1898159 - DNA, 20 bp, Homo sapiens
tggactctctgacaaagtgg

SEQ ID NO: 1898160 - DNA, 14 bp, Homo sapiens
tggactctgagctc

SEQ ID NO: 1898161 - DNA, 15 bp, Homo sapiens
tggagaatcacaggc

SEQ ID NO: 1898162 - DNA, 21 bp, Homo sapiens
tggagaatgcaccatactcat

SEQ ID NO: 1898163 - DNA, 18 bp, Homo sapiens
tggagaattaaaactttg

SEQ ID NO: 1898164 - DNA, 18 bp, Homo sapiens
tggagaggagccctgcct

SEQ ID NO: 1898165 - DNA, 21 bp, Homo sapiens
tggagcctgcggggcagcagg

SEQ ID NO: 1898166 - DNA, 19 bp, Homo sapiens
tggagctcaagccgtggcc

SEQ ID NO: 1898167 - DNA, 22 bp, Homo sapiens
tggagggcctgggcctggctcc

SEQ ID NO: 1898168 - DNA, 13 bp, Homo sapiens
tggataccattat

SEQ ID NO: 1898169 - DNA, 15 bp, Homo sapiens
tggatattttcttaa

SEQ ID NO: 1898170 - DNA, 21 bp, Homo sapiens
tggatcagatagcaggaggaa

SEQ ID NO: 1898171 - DNA, 11 bp, Homo sapiens
tggatctgcag

SEQ ID NO: 1898172 - DNA, 14 bp, Homo sapiens
tggatctgcaggtg

SEQ ID NO: 1898173 - DNA, 16 bp, Homo sapiens
tggatggacagacaga

SEQ ID NO: 1898174 - DNA, 19 bp, Homo sapiens
tggatgtttttagttctga

SEQ ID NO: 1898175 - DNA, 12 bp, Homo sapiens
tggattcctccc

SEQ ID NO: 1898176 - DNA, 14 bp, Homo sapiens
tggattcctcccca

SEQ ID NO: 1898177 - DNA, 24 bp, Homo sapiens
tggattcctccccaccctgtccca

SEQ ID NO: 1898178 - DNA, 14 bp, Homo sapiens
tggatttctggtct

SEQ ID NO: 1898179 - DNA, 23 bp, Homo sapiens
tggcaaagcagcaacacacatgc

SEQ ID NO: 1898180 - DNA, 14 bp, Homo sapiens
tggcaaatttgtga

SEQ ID NO: 1898181 - DNA, 20 bp, Homo sapiens
tggcaaatttgtgaactgtc

SEQ ID NO: 1898182 - DNA, 15 bp, Homo sapiens
tggcaagaaccagtt

SEQ ID NO: 1898183 - DNA, 16 bp, Homo sapiens
tggcaatggtagtttc

SEQ ID NO: 1898184 - DNA, 14 bp, Homo sapiens
tggcaccagcaggc

SEQ ID NO: 1898185 - DNA, 18 bp, Homo sapiens
tggcacgaaatggctgaa

SEQ ID NO: 1898186 - DNA, 16 bp, Homo sapiens
tggcagcaggagggac

SEQ ID NO: 1898187 - DNA, 20 bp, Homo sapiens
tggcagcccgcatcagctgc

SEQ ID NO: 1898188 - DNA, 15 bp, Homo sapiens
tggcagggcacaggg

SEQ ID NO: 1898189 - DNA, 18 bp, Homo sapiens
tggcagggcacagggcct

SEQ ID NO: 1898190 - DNA, 22 bp, Homo sapiens
tggcaggggatccagctcaagg

SEQ ID NO: 1898191 - DNA, 15 bp, Homo sapiens
tggcatatctctgtt

SEQ ID NO: 1898192 - DNA, 19 bp, Homo sapiens
tggccacatcctcatggcc

SEQ ID NO: 1898193 - DNA, 20 bp, Homo sapiens
tggccagccaccactgacta

SEQ ID NO: 1898194 - DNA, 19 bp, Homo sapiens
tggccaggaagtagcacag

SEQ ID NO: 1898195 - DNA, 21 bp, Homo sapiens
tggccaggaagtagcacaggc

SEQ ID NO: 1898196 - DNA, 13 bp, Homo sapiens
tggccaggctgct

SEQ ID NO: 1898197 - DNA, 19 bp, Homo sapiens
tggccaggctgctctcaaa

SEQ ID NO: 1898198 - DNA, 15 bp, Homo sapiens
tggccagggaggagc

SEQ ID NO: 1898199 - DNA, 17 bp, Homo sapiens
tggccagggaggagccc

SEQ ID NO: 1898200 - DNA, 20 bp, Homo sapiens
tggccagggaggagccccag

SEQ ID NO: 1898201 - DNA, 17 bp, Homo sapiens
tggcccatgtatggcca

SEQ ID NO: 1898202 - DNA, 13 bp, Homo sapiens
ttttatgatgacg

SEQ ID NO: 1898203 - DNA, 12 bp, Homo sapiens
ttttattaatca

SEQ ID NO: 1898204 - DNA, 14 bp, Homo sapiens
ttttatttatatgt

SEQ ID NO: 1898205 - DNA, 17 bp, Homo sapiens
ttttatttttagaattt

SEQ ID NO: 1898206 - DNA, 13 bp, Homo sapiens
ttttcaatgtgat

SEQ ID NO: 1898207 - DNA, 18 bp, Homo sapiens
ttttcagattcaggcatt

SEQ ID NO: 1898208 - DNA, 16 bp, Homo sapiens
ttttcatgctttatca

SEQ ID NO: 1898209 - DNA, 15 bp, Homo sapiens
ttttccactgagcat

SEQ ID NO: 1898210 - DNA, 18 bp, Homo sapiens
ttttccatatttttacaa

SEQ ID NO: 1898211 - DNA, 14 bp, Homo sapiens
ttttccattttata

SEQ ID NO: 1898212 - DNA, 13 bp, Homo sapiens
ttttccctttcct

SEQ ID NO: 1898213 - DNA, 16 bp, Homo sapiens
ttttcccttttctttc

SEQ ID NO: 1898214 - DNA, 17 bp, Homo sapiens
ttttcccttttctttcc

SEQ ID NO: 1898215 - DNA, 23 bp, Homo sapiens
ttttcctcctttgcagtgtctta

SEQ ID NO: 1898216 - DNA, 13 bp, Homo sapiens
ttttctactttga

SEQ ID NO: 1898217 - DNA, 12 bp, Homo sapiens
ttttctctctct

SEQ ID NO: 1898218 - DNA, 14 bp, Homo sapiens
ttttctgaagttgt

SEQ ID NO: 1898219 - DNA, 22 bp, Homo sapiens
ttttcttttgctttcctttcct

SEQ ID NO: 1898220 - DNA, 22 bp, Homo sapiens
ttttgaaaaattacctgtataa

SEQ ID NO: 1898221 - DNA, 23 bp, Homo sapiens
ttttgaaaaattacctgtataat

SEQ ID NO: 1898222 - DNA, 19 bp, Homo sapiens
ttttgatagcattgtaagc

SEQ ID NO: 1898223 - DNA, 16 bp, Homo sapiens
ttttgatgtaaagatg

SEQ ID NO: 1898224 - DNA, 18 bp, Homo sapiens
ttttgatgtaaagatgtt

SEQ ID NO: 1898225 - DNA, 22 bp, Homo sapiens
ttttgcttgaagcaaacagttg

SEQ ID NO: 1898226 - DNA, 21 bp, Homo sapiens
ttttggacctaaacattattt

SEQ ID NO: 1898227 - DNA, 15 bp, Homo sapiens
ttttggtaattgtag

SEQ ID NO: 1898228 - DNA, 22 bp, Homo sapiens
ttttggttcattttcagattca

SEQ ID NO: 1898229 - DNA, 19 bp, Homo sapiens
ttttgtaataataaagaat

SEQ ID NO: 1898230 - DNA, 13 bp, Homo sapiens
ttttgttacatag

SEQ ID NO: 1898231 - DNA, 16 bp, Homo sapiens
ttttgttactcttggg

SEQ ID NO: 1898232 - DNA, 16 bp, Homo sapiens
tttttaaacaataaag

SEQ ID NO: 1898233 - DNA, 21 bp, Homo sapiens
tttttaatgctaatcttgtga

SEQ ID NO: 1898234 - DNA, 13 bp, Homo sapiens
tttttaattgtat

SEQ ID NO: 1898235 - DNA, 14 bp, Homo sapiens
tttttatatgtgga

SEQ ID NO: 1898236 - DNA, 14 bp, Homo sapiens
tttttatatttcaa

SEQ ID NO: 1898237 - DNA, 15 bp, Homo sapiens
tttttattaatcact

SEQ ID NO: 1898238 - DNA, 19 bp, Homo sapiens
tttttattaatcactgtgt

SEQ ID NO: 1898239 - DNA, 21 bp, Homo sapiens
tttttattaatcactgtgtat

SEQ ID NO: 1898240 - DNA, 22 bp, Homo sapiens
tttttgaaggcagaaagcaaaa

SEQ ID NO: 1898241 - DNA, 19 bp, Homo sapiens
tttttgatagcattgtaag

SEQ ID NO: 1898242 - DNA, 12 bp, Homo sapiens
ttttttaatcta

SEQ ID NO: 1898243 - DNA, 19 bp, Homo sapiens
ttttaagtggactctctga

SEQ ID NO: 1898244 - DNA, 20 bp, Homo sapiens
ttttaagtggactctctgac

SEQ ID NO: 1898245 - DNA, 16 bp, Homo sapiens
ttttactgctttctga

SEQ ID NO: 1898246 - DNA, 19 bp, Homo sapiens
ttttactgctttctgaatg

SEQ ID NO: 1898247 - DNA, 17 bp, Homo sapiens
ttttagaatgtcaataa

SEQ ID NO: 1898248 - DNA, 19 bp, Homo sapiens
ttttagttccttctataca

SEQ ID NO: 1898249 - DNA, 22 bp, Homo sapiens
ttttatataataaaagtgcctt

SEQ ID NO: 1898250 - DNA, 21 bp, Homo sapiens
aataccctgtacatatctttg

SEQ ID NO: 1898251 - DNA, 22 bp, Homo sapiens
aataccctgtacatatctttga

SEQ ID NO: 1898252 - DNA, 13 bp, Homo sapiens
aatactgaaccac

SEQ ID NO: 1898253 - DNA, 18 bp, Homo sapiens
aatactgatggaattttt

SEQ ID NO: 1898254 - DNA, 13 bp, Homo sapiens
aatactgcttgaa

SEQ ID NO: 1898255 - DNA, 22 bp, Homo sapiens
aatactgtacaatgactttatt

SEQ ID NO: 1898256 - DNA, 14 bp, Homo sapiens
aatacttgaaccat

SEQ ID NO: 1898257 - DNA, 22 bp, Homo sapiens
aatacttgaaccataaaatgtc

SEQ ID NO: 1898258 - DNA, 23 bp, Homo sapiens
aatactttgcagcacagctgaga

SEQ ID NO: 1898259 - DNA, 23 bp, Homo sapiens
aatagaaatttgcccctggcaaa

SEQ ID NO: 1898260 - DNA, 22 bp, Homo sapiens
aatagtgtggaaattaagaaga

SEQ ID NO: 1898261 - DNA, 17 bp, Homo sapiens
aatagtttattttaaaa

SEQ ID NO: 1898262 - DNA, 16 bp, Homo sapiens
aatatattttgaaata

SEQ ID NO: 1898263 - DNA, 23 bp, Homo sapiens
aatatatttttactgctttctga

SEQ ID NO: 1898264 - DNA, 13 bp, Homo sapiens
aatatcaaattaa

SEQ ID NO: 1898265 - DNA, 19 bp, Homo sapiens
aatatcaaattaattgtgt

SEQ ID NO: 1898266 - DNA, 20 bp, Homo sapiens
aatatgaaattttttttcat

SEQ ID NO: 1898267 - DNA, 18 bp, Homo sapiens
aatatgattaaaaatatc

SEQ ID NO: 1898268 - DNA, 22 bp, Homo sapiens
aatatgtggtccatctctgaaa

SEQ ID NO: 1898269 - DNA, 20 bp, Homo sapiens
aatatttgcacacatttaaa

SEQ ID NO: 1898270 - DNA, 13 bp, Homo sapiens
aatcaaatgtaaa

SEQ ID NO: 1898271 - DNA, 19 bp, Homo sapiens
aatcaagagccttaaaaca

SEQ ID NO: 1898272 - DNA, 18 bp, Homo sapiens
aatcacggcttttggtga

SEQ ID NO: 1898273 - DNA, 13 bp, Homo sapiens
aatcactgtgtat

SEQ ID NO: 1898274 - DNA, 14 bp, Homo sapiens
aatcactgtgtata

SEQ ID NO: 1898275 - DNA, 17 bp, Homo sapiens
aatcactgtgtatattt

SEQ ID NO: 1898276 - DNA, 19 bp, Homo sapiens
aatcactgtgtatatttga

SEQ ID NO: 1898277 - DNA, 22 bp, Homo sapiens
aatcactgtgtatatttgattt

SEQ ID NO: 1898278 - DNA, 23 bp, Homo sapiens
aatcactgtgtatatttgattta

SEQ ID NO: 1898279 - DNA, 23 bp, Homo sapiens
aatcatgaagtgatataaaagct

SEQ ID NO: 1898280 - DNA, 20 bp, Homo sapiens
aatcatggctcttagaaact

SEQ ID NO: 1898281 - DNA, 22 bp, Homo sapiens
aatcattgcaaacaactgaaat

SEQ ID NO: 1898282 - DNA, 13 bp, Homo sapiens
aatccccaagaac

SEQ ID NO: 1898283 - DNA, 19 bp, Homo sapiens
aatccctgtgttaatttaa

SEQ ID NO: 1898284 - DNA, 16 bp, Homo sapiens
aatcctagtttgctgt

SEQ ID NO: 1898285 - DNA, 20 bp, Homo sapiens
aatcctagtttgctgtggcc

SEQ ID NO: 1898286 - DNA, 19 bp, Homo sapiens
aatctaaaaattgaactac

SEQ ID NO: 1898287 - DNA, 14 bp, Homo sapiens
aatctactgcattt

SEQ ID NO: 1898288 - DNA, 21 bp, Homo sapiens
aatctagttgtcaataaatgg

SEQ ID NO: 1898289 - DNA, 12 bp, Homo sapiens
aatctgccacct

SEQ ID NO: 1898290 - DNA, 16 bp, Homo sapiens
aatctgccacctgcac

SEQ ID NO: 1898291 - DNA, 17 bp, Homo sapiens
aatctgccacctgcaca

SEQ ID NO: 1898292 - DNA, 19 bp, Homo sapiens
aatctgccacctgcacagg

SEQ ID NO: 1898293 - DNA, 19 bp, Homo sapiens
aatcttaagtcataatgaa

SEQ ID NO: 1898294 - DNA, 15 bp, Homo sapiens
aatcttactttgtaa

SEQ ID NO: 1898295 - DNA, 19 bp, Homo sapiens
aatcttactttgtaaattc

SEQ ID NO: 1898296 - DNA, 18 bp, Homo sapiens
aatcttgtccaagttgtt

SEQ ID NO: 1898297 - DNA, 19 bp, Homo sapiens
aatcttgttggttcaccat

SEQ ID NO: 1898298 - DNA, 17 bp, Homo sapiens
aatgaaaagagaaactt

SEQ ID NO: 1898299 - DNA, 20 bp, Homo sapiens
aatgaaaatttcacttgaaa

SEQ ID NO: 1898300 - DNA, 15 bp, Homo sapiens
aatgaacaagcattc

SEQ ID NO: 1898301 - DNA, 15 bp, Homo sapiens
aatgaagaattcaga

SEQ ID NO: 1898302 - DNA, 13 bp, Homo sapiens
aatgaagaattta

SEQ ID NO: 1898303 - DNA, 15 bp, Homo sapiens
aatgaagaatttaaa

SEQ ID NO: 1898304 - DNA, 20 bp, Homo sapiens
aatgaagagctgttgatggg

SEQ ID NO: 1898305 - DNA, 21 bp, Homo sapiens
aatgagtttcacagtgtgatt

SEQ ID NO: 1898306 - DNA, 19 bp, Homo sapiens
aatgatatgcttgtaacta

SEQ ID NO: 1898307 - DNA, 19 bp, Homo sapiens
aatgatgtgcctgcttcag

SEQ ID NO: 1898308 - DNA, 13 bp, Homo sapiens
aatgcaaccattt

SEQ ID NO: 1898309 - DNA, 20 bp, Homo sapiens
aatgcatctttgatgtgttg

SEQ ID NO: 1898310 - DNA, 14 bp, Homo sapiens
aatgccccctcccc

SEQ ID NO: 1898311 - DNA, 14 bp, Homo sapiens
aatgctgaaataaa

SEQ ID NO: 1898312 - DNA, 17 bp, Homo sapiens
aatgctgacccatgggc

SEQ ID NO: 1898313 - DNA, 11 bp, Homo sapiens
aatgctgggcc

SEQ ID NO: 1898314 - DNA, 12 bp, Homo sapiens
aatgctttagca

SEQ ID NO: 1898315 - DNA, 21 bp, Homo sapiens
aatgggaggggaaatgggaat

SEQ ID NO: 1898316 - DNA, 12 bp, Homo sapiens
aatggtagtttc

SEQ ID NO: 1898317 - DNA, 14 bp, Homo sapiens
aatggtagtttctg

SEQ ID NO: 1898318 - DNA, 14 bp, Homo sapiens
aatgtatacttgaa

SEQ ID NO: 1898319 - DNA, 14 bp, Homo sapiens
aatgtcaaaagtag

SEQ ID NO: 1898320 - DNA, 15 bp, Homo sapiens
aatgtcaaaagtaga

SEQ ID NO: 1898321 - DNA, 19 bp, Homo sapiens
aatgtccagtaagatcact

SEQ ID NO: 1898322 - DNA, 13 bp, Homo sapiens
aatgtctagattt

SEQ ID NO: 1898323 - DNA, 18 bp, Homo sapiens
aatgtctcaagtgcaatg

SEQ ID NO: 1898324 - DNA, 23 bp, Homo sapiens
aatgtgagtggttgaatatgatt

SEQ ID NO: 1898325 - DNA, 17 bp, Homo sapiens
aatgtgtctatttctga

SEQ ID NO: 1898326 - DNA, 19 bp, Homo sapiens
aatgtgtctatttctgaaa

SEQ ID NO: 1898327 - DNA, 19 bp, Homo sapiens
aatgttcatactgatgtgt

SEQ ID NO: 1898328 - DNA, 12 bp, Homo sapiens
aatgtttacaaa

SEQ ID NO: 1898329 - DNA, 19 bp, Homo sapiens
aattaaaactttgtagaca

SEQ ID NO: 1898330 - DNA, 14 bp, Homo sapiens
aattaaacttcaaa

SEQ ID NO: 1898331 - DNA, 15 bp, Homo sapiens
aattaaggtgtttga

SEQ ID NO: 1898332 - DNA, 13 bp, Homo sapiens
aattaattgtgtg

SEQ ID NO: 1898333 - DNA, 15 bp, Homo sapiens
aattaattgtgtgaa

SEQ ID NO: 1898334 - DNA, 22 bp, Homo sapiens
aattacaccacaagtatctaaa

SEQ ID NO: 1898335 - DNA, 18 bp, Homo sapiens
aattatggtaaaattttg

SEQ ID NO: 1898336 - DNA, 16 bp, Homo sapiens
aattattgatgaaaat

SEQ ID NO: 1898337 - DNA, 19 bp, Homo sapiens
aattatttaaagtgtggaa

SEQ ID NO: 1898338 - DNA, 21 bp, Homo sapiens
aattatttgttactgtatcct

SEQ ID NO: 1898339 - DNA, 16 bp, Homo sapiens
aattcagattgtttaa

SEQ ID NO: 1898340 - DNA, 18 bp, Homo sapiens
aattctcgattctttgaa

SEQ ID NO: 1898341 - DNA, 11 bp, Homo sapiens
aattctgattt

SEQ ID NO: 1898342 - DNA, 15 bp, Homo sapiens
aattctgatttcttt

SEQ ID NO: 1898343 - DNA, 16 bp, Homo sapiens
aattctgatttctttt

SEQ ID NO: 1898344 - DNA, 21 bp, Homo sapiens
aattcttagcatacattcaga

SEQ ID NO: 1898345 - DNA, 20 bp, Homo sapiens
aattcttcacatgtaacttt

SEQ ID NO: 1898346 - DNA, 24 bp, Homo sapiens
aattcttcacatgtaactttcgta

SEQ ID NO: 1898347 - DNA, 17 bp, Homo sapiens
aattcttttttattaat

SEQ ID NO: 1898348 - DNA, 19 bp, Homo sapiens
aattgaaggtttttgatag

SEQ ID NO: 1898349 - DNA, 21 bp, Homo sapiens
aattgaaggtttttgatagca

SEQ ID NO: 1898350 - DNA, 21 bp, Homo sapiens
aattgatgatgttgtaaaatg

SEQ ID NO: 1898351 - DNA, 16 bp, Homo sapiens
aattgtattctcataa

SEQ ID NO: 1898352 - DNA, 11 bp, Homo sapiens
aattgtatttt

SEQ ID NO: 1898353 - DNA, 12 bp, Homo sapiens
aattgtattttt

SEQ ID NO: 1898354 - DNA, 16 bp, Homo sapiens
aattgtccttgaagct

SEQ ID NO: 1898355 - DNA, 19 bp, Homo sapiens
aattgtccttgaagcttgt

SEQ ID NO: 1898356 - DNA, 20 bp, Homo sapiens
aattgtccttgaagcttgta

SEQ ID NO: 1898357 - DNA, 18 bp, Homo sapiens
aattgtgtgaacttggaa

SEQ ID NO: 1898358 - DNA, 14 bp, Homo sapiens
aattgttgtttgta

SEQ ID NO: 1898359 - DNA, 22 bp, Homo sapiens
aattgttgtttgtatgtataat

SEQ ID NO: 1898360 - DNA, 19 bp, Homo sapiens
aatttaacttttaaagaat

SEQ ID NO: 1898361 - DNA, 17 bp, Homo sapiens
aatttaagttttgacaa

SEQ ID NO: 1898362 - DNA, 20 bp, Homo sapiens
aatttaagttttgacaagct

SEQ ID NO: 1898363 - DNA, 15 bp, Homo sapiens
aatttactttggaaa

SEQ ID NO: 1898364 - DNA, 17 bp, Homo sapiens
aatttagttcatgcatt

SEQ ID NO: 1898365 - DNA, 11 bp, Homo sapiens
aatttatataa

SEQ ID NO: 1898366 - DNA, 14 bp, Homo sapiens
aatttatataaagt

SEQ ID NO: 1898367 - DNA, 15 bp, Homo sapiens
aatttatataaagta

SEQ ID NO: 1898368 - DNA, 18 bp, Homo sapiens
aatttatataaagtattt

SEQ ID NO: 1898369 - DNA, 16 bp, Homo sapiens
aatttatataactgtt

SEQ ID NO: 1898370 - DNA, 14 bp, Homo sapiens
aatttatgtaaggt

SEQ ID NO: 1898371 - DNA, 19 bp, Homo sapiens
aatttatttttaagaaaga

SEQ ID NO: 1898372 - DNA, 16 bp, Homo sapiens
aatttggaacttacaa

SEQ ID NO: 1898373 - DNA, 19 bp, Homo sapiens
aatttgtgaactgtcatga

SEQ ID NO: 1898374 - DNA, 14 bp, Homo sapiens
aatttgtggtgatt

SEQ ID NO: 1898375 - DNA, 16 bp, Homo sapiens
aatttgtttaaggtta

SEQ ID NO: 1898376 - DNA, 20 bp, Homo sapiens
aattttccttcagatatttt

SEQ ID NO: 1898377 - DNA, 22 bp, Homo sapiens
aattttgtgtaagaaatacaga

SEQ ID NO: 1898378 - DNA, 13 bp, Homo sapiens
aatttttatgtgt

SEQ ID NO: 1898379 - DNA, 14 bp, Homo sapiens
aatttttttgtatg

SEQ ID NO: 1898380 - DNA, 15 bp, Homo sapiens
aatttttttgtatga

SEQ ID NO: 1898381 - DNA, 18 bp, Homo sapiens
aatttttttgtatgaaaa

SEQ ID NO: 1898382 - DNA, 19 bp, Homo sapiens
agcacgcctctccccacct

SEQ ID NO: 1898383 - DNA, 21 bp, Homo sapiens
agcacgcctctccccaccttc

SEQ ID NO: 1898384 - DNA, 14 bp, Homo sapiens
agcactcctttaaa

SEQ ID NO: 1898385 - DNA, 20 bp, Homo sapiens
agcactgaaagtatgtttta

SEQ ID NO: 1898386 - DNA, 20 bp, Homo sapiens
agcactggattgtagaactt

SEQ ID NO: 1898387 - DNA, 21 bp, Homo sapiens
agcactggattgtagaacttg

SEQ ID NO: 1898388 - DNA, 22 bp, Homo sapiens
agcactggattgtagaacttgt

SEQ ID NO: 1898389 - DNA, 15 bp, Homo sapiens
agcacttcaggaggc

SEQ ID NO: 1898390 - DNA, 18 bp, Homo sapiens
agcagacttttaaagact

SEQ ID NO: 1898391 - DNA, 12 bp, Homo sapiens
agcagccttcca

SEQ ID NO: 1898392 - DNA, 14 bp, Homo sapiens
agcagccttccagt

SEQ ID NO: 1898393 - DNA, 18 bp, Homo sapiens
agcagccttccagtggct

SEQ ID NO: 1898394 - DNA, 19 bp, Homo sapiens
agcagctgactttcaaagt

SEQ ID NO: 1898395 - DNA, 18 bp, Homo sapiens
agcaggagggacagtctc

SEQ ID NO: 1898396 - DNA, 20 bp, Homo sapiens
agcaggccctgggcctccac

SEQ ID NO: 1898397 - DNA, 19 bp, Homo sapiens
agcaggctcctcagccctc

SEQ ID NO: 1898398 - DNA, 15 bp, Homo sapiens
agcagggcaggcccc

SEQ ID NO: 1898399 - DNA, 18 bp, Homo sapiens
agcagggccttctgcctg

SEQ ID NO: 1898400 - DNA, 20 bp, Homo sapiens
agcagggccttctgcctgct

SEQ ID NO: 1898401 - DNA, 15 bp, Homo sapiens
agcagtaagggaaca

SEQ ID NO: 1898402 - DNA, 16 bp, Homo sapiens
agcagtatcatgaagc

SEQ ID NO: 1898403 - DNA, 12 bp, Homo sapiens
agcagtgcccag

SEQ ID NO: 1898404 - DNA, 14 bp, Homo sapiens
agcagtgcccaggt

SEQ ID NO: 1898405 - DNA, 14 bp, Homo sapiens
agcagtttcaggta

SEQ ID NO: 1898406 - DNA, 11 bp, Homo sapiens
agcataaagaa

SEQ ID NO: 1898407 - DNA, 14 bp, Homo sapiens
agcataaagaattt

SEQ ID NO: 1898408 - DNA, 16 bp, Homo sapiens
agcatactagaatcag

SEQ ID NO: 1898409 - DNA, 16 bp, Homo sapiens
agcatcacttaaaaca

SEQ ID NO: 1898410 - DNA, 17 bp, Homo sapiens
agcatcacttaaaacac

SEQ ID NO: 1898411 - DNA, 22 bp, Homo sapiens
agcatcacttaaaacacgtttt

SEQ ID NO: 1898412 - DNA, 15 bp, Homo sapiens
agcatctctgaccag

SEQ ID NO: 1898413 - DNA, 20 bp, Homo sapiens
agcatgagagggatgaggca

SEQ ID NO: 1898414 - DNA, 23 bp, Homo sapiens
agcatgaggcagcacgtgcacaa

SEQ ID NO: 1898415 - DNA, 15 bp, Homo sapiens
agcatgtgttgcagc

SEQ ID NO: 1898416 - DNA, 18 bp, Homo sapiens
agcatgtgttgcagctgt

SEQ ID NO: 1898417 - DNA, 21 bp, Homo sapiens
agcatgtgttgcagctgtcac

SEQ ID NO: 1898418 - DNA, 23 bp, Homo sapiens
agcattacctctttggaaaagga

SEQ ID NO: 1898419 - DNA, 17 bp, Homo sapiens
agcattgtaaaagcatt

SEQ ID NO: 1898420 - DNA, 22 bp, Homo sapiens
agcattgtaagcgtatggcttt

SEQ ID NO: 1898421 - DNA, 13 bp, Homo sapiens
agcatttggtgct

SEQ ID NO: 1898422 - DNA, 13 bp, Homo sapiens
agcattttgtaat

SEQ ID NO: 1898423 - DNA, 23 bp, Homo sapiens
agccaaaatgtgagtggttgaat

SEQ ID NO: 1898424 - DNA, 20 bp, Homo sapiens
agccaagggggacctcgggc

SEQ ID NO: 1898425 - DNA, 18 bp, Homo sapiens
agccaccctttctggcac

SEQ ID NO: 1898426 - DNA, 20 bp, Homo sapiens
agccaccctttctggcacga

SEQ ID NO: 1898427 - DNA, 16 bp, Homo sapiens
agccacctgagttcct

SEQ ID NO: 1898428 - DNA, 23 bp, Homo sapiens
agccagagcgttagaggggccag

SEQ ID NO: 1898429 - DNA, 21 bp, Homo sapiens
agccagggaaagactggcaag

SEQ ID NO: 1898430 - DNA, 23 bp, Homo sapiens
agccagtgaacataattcttatt

SEQ ID NO: 1898431 - DNA, 14 bp, Homo sapiens
agccatgagaatgt

SEQ ID NO: 1898432 - DNA, 16 bp, Homo sapiens
agccatgaggaggcag

SEQ ID NO: 1898433 - DNA, 16 bp, Homo sapiens
agcccagaagtgcaga

SEQ ID NO: 1898434 - DNA, 15 bp, Homo sapiens
agcccaggagcccat

SEQ ID NO: 1898435 - DNA, 17 bp, Homo sapiens
agcccatttggagggcc

SEQ ID NO: 1898436 - DNA, 20 bp, Homo sapiens
agcccatttggagggcctgg

SEQ ID NO: 1898437 - DNA, 17 bp, Homo sapiens
agccccactctcagagg

SEQ ID NO: 1898438 - DNA, 21 bp, Homo sapiens
agccccactctcagaggcccc

SEQ ID NO: 1898439 - DNA, 22 bp, Homo sapiens
agccccctggtctttgagctcc

SEQ ID NO: 1898440 - DNA, 15 bp, Homo sapiens
agcccgcatcagctg

SEQ ID NO: 1898441 - DNA, 15 bp, Homo sapiens
agccctctcttgcca

SEQ ID NO: 1898442 - DNA, 16 bp, Homo sapiens
agccgtaggacccagt

SEQ ID NO: 1898443 - DNA, 20 bp, Homo sapiens
agccgtggccggggtccagg

SEQ ID NO: 1898444 - DNA, 16 bp, Homo sapiens
agcctcaaatccagga

SEQ ID NO: 1898445 - DNA, 20 bp, Homo sapiens
agcctcaaatccaggaccct

SEQ ID NO: 1898446 - DNA, 17 bp, Homo sapiens
agcctcacgaaactgga

SEQ ID NO: 1898447 - DNA, 18 bp, Homo sapiens
agcctcccacagtgctgg

SEQ ID NO: 1898448 - DNA, 13 bp, Homo sapiens
agcctccccttcc

SEQ ID NO: 1898449 - DNA, 16 bp, Homo sapiens
agcctccccttcccag

SEQ ID NO: 1898450 - DNA, 17 bp, Homo sapiens
agcctccccttcccaga

SEQ ID NO: 1898451 - DNA, 19 bp, Homo sapiens
agcctccccttcccagacc

SEQ ID NO: 1898452 - DNA, 22 bp, Homo sapiens
agcctccctgacgtctgccacc

SEQ ID NO: 1898453 - DNA, 23 bp, Homo sapiens
agcctccctgacgtctgccacca

SEQ ID NO: 1898454 - DNA, 16 bp, Homo sapiens
agcctccgcttccctg

SEQ ID NO: 1898455 - DNA, 22 bp, Homo sapiens
agcctccgcttccctggttcaa

SEQ ID NO: 1898456 - DNA, 15 bp, Homo sapiens
agcctgagggaggag

SEQ ID NO: 1898457 - DNA, 23 bp, Homo sapiens
agcctgcacttgggggctcagca

SEQ ID NO: 1898458 - DNA, 16 bp, Homo sapiens
agcctgcctctgccac

SEQ ID NO: 1898459 - DNA, 15 bp, Homo sapiens
agcctggcaggggat

SEQ ID NO: 1898460 - DNA, 16 bp, Homo sapiens
agccttaatgtatttg

SEQ ID NO: 1898461 - DNA, 21 bp, Homo sapiens
agccttccagtggcttctccc

SEQ ID NO: 1898462 - DNA, 23 bp, Homo sapiens
agccttccagtggcttctcccaa

SEQ ID NO: 1898463 - DNA, 18 bp, Homo sapiens
agccttcgaaaagaaatt

SEQ ID NO: 1898464 - DNA, 19 bp, Homo sapiens
agccttcgaaaagaaattg

SEQ ID NO: 1898465 - DNA, 21 bp, Homo sapiens
agccttgattcccttgttatt

SEQ ID NO: 1898466 - DNA, 21 bp, Homo sapiens
agccttgtgggtgtgagcagc

SEQ ID NO: 1898467 - DNA, 13 bp, Homo sapiens
agcgaactgacat

SEQ ID NO: 1898468 - DNA, 16 bp, Homo sapiens
agcgaccagcaggctc

SEQ ID NO: 1898469 - DNA, 22 bp, Homo sapiens
agcgaccagcaggctcctcagc

SEQ ID NO: 1898470 - DNA, 19 bp, Homo sapiens
agcgattctcttgcctcag

SEQ ID NO: 1898471 - DNA, 15 bp, Homo sapiens
agcgcacagctgctc

SEQ ID NO: 1898472 - DNA, 23 bp, Homo sapiens
agcgccactgtccgctgtctccc

SEQ ID NO: 1898473 - DNA, 16 bp, Homo sapiens
agcgcccccactcctc

SEQ ID NO: 1898474 - DNA, 12 bp, Homo sapiens
agcggccctccc

SEQ ID NO: 1898475 - DNA, 15 bp, Homo sapiens
agcggccctcccagg

SEQ ID NO: 1898476 - DNA, 16 bp, Homo sapiens
agcggccctcccaggc

SEQ ID NO: 1898477 - DNA, 16 bp, Homo sapiens
agcgtatggctttatt

SEQ ID NO: 1898478 - DNA, 16 bp, Homo sapiens
agcgttagaggggcca

SEQ ID NO: 1898479 - DNA, 15 bp, Homo sapiens
agctacgtttactca

SEQ ID NO: 1898480 - DNA, 21 bp, Homo sapiens
agctagaacattccatttgct

SEQ ID NO: 1898481 - DNA, 15 bp, Homo sapiens
agctagttgaatact

SEQ ID NO: 1898482 - DNA, 22 bp, Homo sapiens
agctagttgaatacttgaacca

SEQ ID NO: 1898483 - DNA, 16 bp, Homo sapiens
agctatgacttaacat

SEQ ID NO: 1898484 - DNA, 17 bp, Homo sapiens
agctcaaggcaatgggc

SEQ ID NO: 1898485 - DNA, 20 bp, Homo sapiens
agctcaaggcaatgggctac

SEQ ID NO: 1898486 - DNA, 12 bp, Homo sapiens
agctcaataaaa

SEQ ID NO: 1898487 - DNA, 15 bp, Homo sapiens
agctcaataaaagaa

SEQ ID NO: 1898488 - DNA, 19 bp, Homo sapiens
agctcaataaaagaatctg

SEQ ID NO: 1898489 - DNA, 21 bp, Homo sapiens
agctcatttggggaccacaga

SEQ ID NO: 1898490 - DNA, 23 bp, Homo sapiens
agctcatttggggaccacagagg

SEQ ID NO: 1898491 - DNA, 13 bp, Homo sapiens
agctccctcccct

SEQ ID NO: 1898492 - DNA, 18 bp, Homo sapiens
agctccctcccctgctca

SEQ ID NO: 1898493 - DNA, 22 bp, Homo sapiens
agctcggggctgggggctgcag

SEQ ID NO: 1898494 - DNA, 16 bp, Homo sapiens
agctcgtcctcactgg

SEQ ID NO: 1898495 - DNA, 22 bp, Homo sapiens
agctctgaattcaggtcccagt

SEQ ID NO: 1898496 - DNA, 15 bp, Homo sapiens
agctcttttcctaga

SEQ ID NO: 1898497 - DNA, 19 bp, Homo sapiens
agctgagacccttatttaa

SEQ ID NO: 1898498 - DNA, 13 bp, Homo sapiens
agctgaggcccat

SEQ ID NO: 1898499 - DNA, 19 bp, Homo sapiens
agctgaggcccatggccac

SEQ ID NO: 1898500 - DNA, 13 bp, Homo sapiens
agctgctgagccg

SEQ ID NO: 1898501 - DNA, 21 bp, Homo sapiens
agctgctgagccgcagagaag

SEQ ID NO: 1898502 - DNA, 18 bp, Homo sapiens
agctggagaggagccctg

SEQ ID NO: 1898503 - DNA, 19 bp, Homo sapiens
agctggagaggagccctgc

SEQ ID NO: 1898504 - DNA, 22 bp, Homo sapiens
agctggagaggagccctgcctc

SEQ ID NO: 1898505 - DNA, 16 bp, Homo sapiens
agctggagtctgggct

SEQ ID NO: 1898506 - DNA, 19 bp, Homo sapiens
agctggagtctgggctcct

SEQ ID NO: 1898507 - DNA, 17 bp, Homo sapiens
agctggtttacagatgt

SEQ ID NO: 1898508 - DNA, 18 bp, Homo sapiens
agctgtaaggcatgaagg

SEQ ID NO: 1898509 - DNA, 15 bp, Homo sapiens
agctgtgctgggagg

SEQ ID NO: 1898510 - DNA, 21 bp, Homo sapiens
agctgtgctgggaggtcccag

SEQ ID NO: 1898511 - DNA, 22 bp, Homo sapiens
agctgtgctgggaggtcccagg

SEQ ID NO: 1898512 - DNA, 18 bp, Homo sapiens
agcttccaattttccttc

SEQ ID NO: 1898513 - DNA, 20 bp, Homo sapiens
atgtaatagtcttgcagaaa

SEQ ID NO: 1898514 - DNA, 23 bp, Homo sapiens
atgtaattttgtgtaagaaatac

SEQ ID NO: 1898515 - DNA, 19 bp, Homo sapiens
atgtacatactgaaaaata

SEQ ID NO: 1898516 - DNA, 14 bp, Homo sapiens
atgtatgattacat

SEQ ID NO: 1898517 - DNA, 14 bp, Homo sapiens
atgtatgtgtttag

SEQ ID NO: 1898518 - DNA, 18 bp, Homo sapiens
atgtatgtgtttagaatt

SEQ ID NO: 1898519 - DNA, 21 bp, Homo sapiens
atgtatgtgtttagaattgaa

SEQ ID NO: 1898520 - DNA, 15 bp, Homo sapiens
atgtcaaaagtagaa

SEQ ID NO: 1898521 - DNA, 14 bp, Homo sapiens
atgtcaaatgtgaa

SEQ ID NO: 1898522 - DNA, 21 bp, Homo sapiens
atgtcaacagccatttaggca

SEQ ID NO: 1898523 - DNA, 16 bp, Homo sapiens
atgtcaataacagtat

SEQ ID NO: 1898524 - DNA, 22 bp, Homo sapiens
atgtcagcagttgctggtaaaa

SEQ ID NO: 1898525 - DNA, 18 bp, Homo sapiens
atgtctagattttgaaaa

SEQ ID NO: 1898526 - DNA, 19 bp, Homo sapiens
atgtctagattttgaaaaa

SEQ ID NO: 1898527 - DNA, 19 bp, Homo sapiens
atgtgatataaacagcttc

SEQ ID NO: 1898528 - DNA, 22 bp, Homo sapiens
atgtgattgcctcaataaagct

SEQ ID NO: 1898529 - DNA, 16 bp, Homo sapiens
atgtgcattgaatact

SEQ ID NO: 1898530 - DNA, 11 bp, Homo sapiens
atgtgtttaga

SEQ ID NO: 1898531 - DNA, 13 bp, Homo sapiens
atgtgtttagaat

SEQ ID NO: 1898532 - DNA, 20 bp, Homo sapiens
atgtgtttagaattgaaggt

SEQ ID NO: 1898533 - DNA, 18 bp, Homo sapiens
atgttagttagtgtagat

SEQ ID NO: 1898534 - DNA, 19 bp, Homo sapiens
atgttgacatcactggcat

SEQ ID NO: 1898535 - DNA, 22 bp, Homo sapiens
atgttgccaaaatggtggcctg

SEQ ID NO: 1898536 - DNA, 18 bp, Homo sapiens
atgttggaatctgctcca

SEQ ID NO: 1898537 - DNA, 21 bp, Homo sapiens
atgttggccaggctgctctca

SEQ ID NO: 1898538 - DNA, 22 bp, Homo sapiens
atgtttaaaacaccttctatag

SEQ ID NO: 1898539 - DNA, 15 bp, Homo sapiens
atgtttttagttctg

SEQ ID NO: 1898540 - DNA, 15 bp, Homo sapiens
atgtttttgaaggca

SEQ ID NO: 1898541 - DNA, 19 bp, Homo sapiens
atgtttttgaaggcagaaa

SEQ ID NO: 1898542 - DNA, 18 bp, Homo sapiens
atgtttttgtactctgca

SEQ ID NO: 1898543 - DNA, 17 bp, Homo sapiens
attaaaaatatcaaatt

SEQ ID NO: 1898544 - DNA, 19 bp, Homo sapiens
attaaaactttgtagacat

SEQ ID NO: 1898545 - DNA, 20 bp, Homo sapiens
attaaaactttgtagacatt

SEQ ID NO: 1898546 - DNA, 23 bp, Homo sapiens
attaaaagaaaataaaaaaaaga

SEQ ID NO: 1898547 - DNA, 16 bp, Homo sapiens
attaaatttttttgta

SEQ ID NO: 1898548 - DNA, 17 bp, Homo sapiens
attaactgcttcctata

SEQ ID NO: 1898549 - DNA, 16 bp, Homo sapiens
attaacttaataatca

SEQ ID NO: 1898550 - DNA, 19 bp, Homo sapiens
attaagtaagtctcaaggt

SEQ ID NO: 1898551 - DNA, 23 bp, Homo sapiens
attaatcacggcttttggtgaat

SEQ ID NO: 1898552 - DNA, 14 bp, Homo sapiens
attaatcactgtgt

SEQ ID NO: 1898553 - DNA, 21 bp, Homo sapiens
attaatcactgtgtatatttg

SEQ ID NO: 1898554 - DNA, 14 bp, Homo sapiens
attaatgcatttat

SEQ ID NO: 1898555 - DNA, 18 bp, Homo sapiens
attaattgtgtgaacttg

SEQ ID NO: 1898556 - DNA, 20 bp, Homo sapiens
attaattgtgtgaacttgga

SEQ ID NO: 1898557 - DNA, 18 bp, Homo sapiens
attacaccacaagtatct

SEQ ID NO: 1898558 - DNA, 19 bp, Homo sapiens
attacaccacaagtatcta

SEQ ID NO: 1898559 - DNA, 22 bp, Homo sapiens
attacgaagttcaagatcaaaa

SEQ ID NO: 1898560 - DNA, 19 bp, Homo sapiens
attactgcagactataaaa

SEQ ID NO: 1898561 - DNA, 17 bp, Homo sapiens
attacttgttgcctata

SEQ ID NO: 1898562 - DNA, 14 bp, Homo sapiens
attagaaaaggaaa

SEQ ID NO: 1898563 - DNA, 22 bp, Homo sapiens
attaggaaaagatatttttata

SEQ ID NO: 1898564 - DNA, 14 bp, Homo sapiens
attaggccccagca

SEQ ID NO: 1898565 - DNA, 19 bp, Homo sapiens
attagtgttatatgaacat

SEQ ID NO: 1898566 - DNA, 12 bp, Homo sapiens
attagtttagaa

SEQ ID NO: 1898567 - DNA, 15 bp, Homo sapiens
attagtttagaacag

SEQ ID NO: 1898568 - DNA, 17 bp, Homo sapiens
attagtttagaacaggt

SEQ ID NO: 1898569 - DNA, 21 bp, Homo sapiens
attagtttagaacaggttttt

SEQ ID NO: 1898570 - DNA, 14 bp, Homo sapiens
attatgttttactg

SEQ ID NO: 1898571 - DNA, 17 bp, Homo sapiens
attcaaaatacttttta

SEQ ID NO: 1898572 - DNA, 20 bp, Homo sapiens
attcagaaatccttgtattt

SEQ ID NO: 1898573 - DNA, 19 bp, Homo sapiens
attcaggtcccagttgctg

SEQ ID NO: 1898574 - DNA, 16 bp, Homo sapiens
attccagagaaaatca

SEQ ID NO: 1898575 - DNA, 15 bp, Homo sapiens
attcctttttattta

SEQ ID NO: 1898576 - DNA, 14 bp, Homo sapiens
attctagtattctt

SEQ ID NO: 1898577 - DNA, 14 bp, Homo sapiens
attctatttgtgta

SEQ ID NO: 1898578 - DNA, 17 bp, Homo sapiens
attctcccgggactctg

SEQ ID NO: 1898579 - DNA, 18 bp, Homo sapiens
attctcgattctttgaag

SEQ ID NO: 1898580 - DNA, 15 bp, Homo sapiens
attctcttgcctcag

SEQ ID NO: 1898581 - DNA, 14 bp, Homo sapiens
attctgatttcttt

SEQ ID NO: 1898582 - DNA, 16 bp, Homo sapiens
attctgggtattctat

SEQ ID NO: 1898583 - DNA, 19 bp, Homo sapiens
attctgggttcatttgtga

SEQ ID NO: 1898584 - DNA, 15 bp, Homo sapiens
attctgtaaaagaaa

SEQ ID NO: 1898585 - DNA, 23 bp, Homo sapiens
attctgtggaaaaataaaggaaa

SEQ ID NO: 1898586 - DNA, 15 bp, Homo sapiens
attcttaatttatgt

SEQ ID NO: 1898587 - DNA, 18 bp, Homo sapiens
attcttttctgaagttgt

SEQ ID NO: 1898588 - DNA, 17 bp, Homo sapiens
attcttttttattaatc

SEQ ID NO: 1898589 - DNA, 19 bp, Homo sapiens
attcttttttattaatcac

SEQ ID NO: 1898590 - DNA, 20 bp, Homo sapiens
attcttttttattaatcact

SEQ ID NO: 1898591 - DNA, 21 bp, Homo sapiens
attcttttttattaatcactg

SEQ ID NO: 1898592 - DNA, 13 bp, Homo sapiens
attgaaagaatgt

SEQ ID NO: 1898593 - DNA, 18 bp, Homo sapiens
attgaaagaatgtaaagc

SEQ ID NO: 1898594 - DNA, 18 bp, Homo sapiens
attgaaggtttttgatag

SEQ ID NO: 1898595 - DNA, 14 bp, Homo sapiens
attgaagttaactg

SEQ ID NO: 1898596 - DNA, 19 bp, Homo sapiens
attgactcttgagttgttt

SEQ ID NO: 1898597 - DNA, 22 bp, Homo sapiens
attgagaatagaaatttgcccc

SEQ ID NO: 1898598 - DNA, 22 bp, Homo sapiens
attgagaccgtgaagatacttt

SEQ ID NO: 1898599 - DNA, 23 bp, Homo sapiens
attgagaccgtgaagatactttg

SEQ ID NO: 1898600 - DNA, 22 bp, Homo sapiens
attgaggatctctttgatcctg

SEQ ID NO: 1898601 - DNA, 16 bp, Homo sapiens
attgattatataagca

SEQ ID NO: 1898602 - DNA, 19 bp, Homo sapiens
attgattatataagcaaaa

SEQ ID NO: 1898603 - DNA, 14 bp, Homo sapiens
attgcaaacaactg

SEQ ID NO: 1898604 - DNA, 19 bp, Homo sapiens
attgcagtgtgaatgctgg

SEQ ID NO: 1898605 - DNA, 21 bp, Homo sapiens
attgcatctgggtagctgtaa

SEQ ID NO: 1898606 - DNA, 19 bp, Homo sapiens
attgccatggccctgagcc

SEQ ID NO: 1898607 - DNA, 17 bp, Homo sapiens
attgcctcaataaagct

SEQ ID NO: 1898608 - DNA, 20 bp, Homo sapiens
attgcctcaataaagctcgt

SEQ ID NO: 1898609 - DNA, 18 bp, Homo sapiens
attgcttactgtgttaaa

SEQ ID NO: 1898610 - DNA, 18 bp, Homo sapiens
attggtatcaagaaagtc

SEQ ID NO: 1898611 - DNA, 15 bp, Homo sapiens
attggttttatgatg

SEQ ID NO: 1898612 - DNA, 23 bp, Homo sapiens
attgtaaaagcattttgtaataa

SEQ ID NO: 1898613 - DNA, 20 bp, Homo sapiens
attgtaagaaatactgtaca

SEQ ID NO: 1898614 - DNA, 17 bp, Homo sapiens
attgtaagcgtatggct

SEQ ID NO: 1898615 - DNA, 14 bp, Homo sapiens
attgtagaacttgt

SEQ ID NO: 1898616 - DNA, 18 bp, Homo sapiens
attgtagaacttgttgct

SEQ ID NO: 1898617 - DNA, 21 bp, Homo sapiens
attgtcaatgctggagaaaaa

SEQ ID NO: 1898618 - DNA, 13 bp, Homo sapiens
attgtccttgaag

SEQ ID NO: 1898619 - DNA, 18 bp, Homo sapiens
attgtccttgaagcttgt

SEQ ID NO: 1898620 - DNA, 14 bp, Homo sapiens
attgtcttaatgga

SEQ ID NO: 1898621 - DNA, 17 bp, Homo sapiens
attgtcttaatggatga

SEQ ID NO: 1898622 - DNA, 19 bp, Homo sapiens
attgtcttaatggatgaaa

SEQ ID NO: 1898623 - DNA, 14 bp, Homo sapiens
attgtgtgaacttg

SEQ ID NO: 1898624 - DNA, 20 bp, Homo sapiens
attgttgtttgtatgtataa

SEQ ID NO: 1898625 - DNA, 15 bp, Homo sapiens
attgtttaaatgcct

SEQ ID NO: 1898626 - DNA, 19 bp, Homo sapiens
attgtttctttaagaaagt

SEQ ID NO: 1898627 - DNA, 19 bp, Homo sapiens
atttaaaacattaaaatat

SEQ ID NO: 1898628 - DNA, 18 bp, Homo sapiens
atttaaagaaatatgtat

SEQ ID NO: 1898629 - DNA, 22 bp, Homo sapiens
atttaacagggtctctagtgct

SEQ ID NO: 1898630 - DNA, 12 bp, Homo sapiens
atttaactttta

SEQ ID NO: 1898631 - DNA, 16 bp, Homo sapiens
atttaacttttaaaga

SEQ ID NO: 1898632 - DNA, 19 bp, Homo sapiens
atttacgcctgtaaatgta

SEQ ID NO: 1898633 - DNA, 21 bp, Homo sapiens
atttactgcattcttctgatc

SEQ ID NO: 1898634 - DNA, 21 bp, Homo sapiens
atttactgctagtcttaagaa

SEQ ID NO: 1898635 - DNA, 19 bp, Homo sapiens
atttagggagtattctaat

SEQ ID NO: 1898636 - DNA, 14 bp, Homo sapiens
atttagtaaatgct

SEQ ID NO: 1898637 - DNA, 12 bp, Homo sapiens
atttatataaag

SEQ ID NO: 1898638 - DNA, 13 bp, Homo sapiens
atttatataaagt

SEQ ID NO: 1898639 - DNA, 18 bp, Homo sapiens
atttatataaagtatttt

SEQ ID NO: 1898640 - DNA, 15 bp, Homo sapiens
atttatataactgtt

SEQ ID NO: 1898641 - DNA, 11 bp, Homo sapiens
atttatatgta

SEQ ID NO: 1898642 - DNA, 18 bp, Homo sapiens
atttatatgtatgtgttt

SEQ ID NO: 1898643 - DNA, 14 bp, Homo sapiens
atttatgctaatat

SEQ ID NO: 1898644 - DNA, 24 bp, Homo sapiens
atttattaaatttttttgtatgaa

SEQ ID NO: 1898645 - DNA, 14 bp, Homo sapiens
cagcctccccttcc

SEQ ID NO: 1898646 - DNA, 18 bp, Homo sapiens
cagcctccccttcccaga

SEQ ID NO: 1898647 - DNA, 23 bp, Homo sapiens
cagcctccctgacgtctgccacc

SEQ ID NO: 1898648 - DNA, 20 bp, Homo sapiens
cagcctccgcttccctggtt

SEQ ID NO: 1898649 - DNA, 15 bp, Homo sapiens
cagcctctgatctgt

SEQ ID NO: 1898650 - DNA, 19 bp, Homo sapiens
cagcctctgatctgtgcag

SEQ ID NO: 1898651 - DNA, 22 bp, Homo sapiens
cagcctgagatggatggacaga

SEQ ID NO: 1898652 - DNA, 23 bp, Homo sapiens
cagcctgcacttgggggctcagc

SEQ ID NO: 1898653 - DNA, 12 bp, Homo sapiens
cagcctgcctct

SEQ ID NO: 1898654 - DNA, 13 bp, Homo sapiens
cagcctgcctctg

SEQ ID NO: 1898655 - DNA, 15 bp, Homo sapiens
cagcctgcctctgcc

SEQ ID NO: 1898656 - DNA, 20 bp, Homo sapiens
cagcctgcctctgccacagc

SEQ ID NO: 1898657 - DNA, 14 bp, Homo sapiens
cagccttccagtgg

SEQ ID NO: 1898658 - DNA, 18 bp, Homo sapiens
cagccttccagtggcttc

SEQ ID NO: 1898659 - DNA, 20 bp, Homo sapiens
cagccttccagtggcttctc

SEQ ID NO: 1898660 - DNA, 13 bp, Homo sapiens
cagcgcacagctg

SEQ ID NO: 1898661 - DNA, 15 bp, Homo sapiens
cagcgcccccactcc

SEQ ID NO: 1898662 - DNA, 22 bp, Homo sapiens
cagcgcggacatcccctgctgg

SEQ ID NO: 1898663 - DNA, 19 bp, Homo sapiens
cagcgcggatttctctttc

SEQ ID NO: 1898664 - DNA, 13 bp, Homo sapiens
cagcggccctccc

SEQ ID NO: 1898665 - DNA, 16 bp, Homo sapiens
cagcggccctcccagg

SEQ ID NO: 1898666 - DNA, 17 bp, Homo sapiens
cagctacccctgcagct

SEQ ID NO: 1898667 - DNA, 14 bp, Homo sapiens
cagctatgagagga

SEQ ID NO: 1898668 - DNA, 15 bp, Homo sapiens
cagctcagaaccaca

SEQ ID NO: 1898669 - DNA, 12 bp, Homo sapiens
cagctccctccc

SEQ ID NO: 1898670 - DNA, 19 bp, Homo sapiens
cagctccctcccctgctca

SEQ ID NO: 1898671 - DNA, 20 bp, Homo sapiens
cagctccctcccctgctcag

SEQ ID NO: 1898672 - DNA, 13 bp, Homo sapiens
cagctctgtgcca

SEQ ID NO: 1898673 - DNA, 13 bp, Homo sapiens
cagctcttcctag

SEQ ID NO: 1898674 - DNA, 20 bp, Homo sapiens
cagctcttcctagctggaga

SEQ ID NO: 1898675 - DNA, 22 bp, Homo sapiens
cagctcttcctagctggagagg

SEQ ID NO: 1898676 - DNA, 16 bp, Homo sapiens
cagctgtatatatttt

SEQ ID NO: 1898677 - DNA, 22 bp, Homo sapiens
cagctgtcaccactacagtaag

SEQ ID NO: 1898678 - DNA, 16 bp, Homo sapiens
cagctgtgctgggagg

SEQ ID NO: 1898679 - DNA, 20 bp, Homo sapiens
cagctgtgctgggaggtccc

SEQ ID NO: 1898680 - DNA, 14 bp, Homo sapiens
cagctgttgactct

SEQ ID NO: 1898681 - DNA, 19 bp, Homo sapiens
cagctgttgactctagtac

SEQ ID NO: 1898682 - DNA, 23 bp, Homo sapiens
cagctgttgactctagtactgtg

SEQ ID NO: 1898683 - DNA, 12 bp, Homo sapiens
cagcttccagca

SEQ ID NO: 1898684 - DNA, 13 bp, Homo sapiens
cagcttccagcag

SEQ ID NO: 1898685 - DNA, 14 bp, Homo sapiens
cagcttccagcagg

SEQ ID NO: 1898686 - DNA, 18 bp, Homo sapiens
cagcttccccagtagctg

SEQ ID NO: 1898687 - DNA, 14 bp, Homo sapiens
cagcttgggctggc

SEQ ID NO: 1898688 - DNA, 16 bp, Homo sapiens
caggaagtagcacagg

SEQ ID NO: 1898689 - DNA, 17 bp, Homo sapiens
caggaattgatacgttt

SEQ ID NO: 1898690 - DNA, 13 bp, Homo sapiens
caggaccagccca

SEQ ID NO: 1898691 - DNA, 14 bp, Homo sapiens
caggaccctgccag

SEQ ID NO: 1898692 - DNA, 15 bp, Homo sapiens
caggaccctgccagg

SEQ ID NO: 1898693 - DNA, 18 bp, Homo sapiens
caggaccctgccaggcac

SEQ ID NO: 1898694 - DNA, 20 bp, Homo sapiens
caggaccctgccaggcacag

SEQ ID NO: 1898695 - DNA, 23 bp, Homo sapiens
caggacgactgttttcccaacac

SEQ ID NO: 1898696 - DNA, 20 bp, Homo sapiens
caggagcagtatcatgaagc

SEQ ID NO: 1898697 - DNA, 19 bp, Homo sapiens
caggagggacagtctcacc

SEQ ID NO: 1898698 - DNA, 21 bp, Homo sapiens
caggagggactctgtctggcc

SEQ ID NO: 1898699 - DNA, 23 bp, Homo sapiens
caggatatgggctaccaggaaga

SEQ ID NO: 1898700 - DNA, 20 bp, Homo sapiens
caggatgctcccccagggaa

SEQ ID NO: 1898701 - DNA, 14 bp, Homo sapiens
caggcacaggcagg

SEQ ID NO: 1898702 - DNA, 15 bp, Homo sapiens
caggcacaggcaggg

SEQ ID NO: 1898703 - DNA, 22 bp, Homo sapiens
caggcagagagcgaccagcagg

SEQ ID NO: 1898704 - DNA, 13 bp, Homo sapiens
caggcagcgccac

SEQ ID NO: 1898705 - DNA, 12 bp, Homo sapiens
caggcagggcag

SEQ ID NO: 1898706 - DNA, 16 bp, Homo sapiens
caggcatgggccacca

SEQ ID NO: 1898707 - DNA, 23 bp, Homo sapiens
caggcatgttggactctgagctc

SEQ ID NO: 1898708 - DNA, 14 bp, Homo sapiens
caggcccaccctgc

SEQ ID NO: 1898709 - DNA, 20 bp, Homo sapiens
caggcccccggggaggggcc

SEQ ID NO: 1898710 - DNA, 21 bp, Homo sapiens
caggcccccggggaggggcca

SEQ ID NO: 1898711 - DNA, 11 bp, Homo sapiens
caggccctcct

SEQ ID NO: 1898712 - DNA, 23 bp, Homo sapiens
caggccctcctccctcccagctc

SEQ ID NO: 1898713 - DNA, 15 bp, Homo sapiens
caggccctgggcctc

SEQ ID NO: 1898714 - DNA, 22 bp, Homo sapiens
caggccctgggcctccacctct

SEQ ID NO: 1898715 - DNA, 15 bp, Homo sapiens
caggcctgtccaaca

SEQ ID NO: 1898716 - DNA, 22 bp, Homo sapiens
caggcgcaagggaggcccagcg

SEQ ID NO: 1898717 - DNA, 22 bp, Homo sapiens
caggctcccaggagcctgccca

SEQ ID NO: 1898718 - DNA, 23 bp, Homo sapiens
caggctcccaggagcctgcccag

SEQ ID NO: 1898719 - DNA, 20 bp, Homo sapiens
caggctcctcagccctctct

SEQ ID NO: 1898720 - DNA, 21 bp, Homo sapiens
caggctcctcagccctctctt

SEQ ID NO: 1898721 - DNA, 22 bp, Homo sapiens
caggctcctcagccctctcttg

SEQ ID NO: 1898722 - DNA, 12 bp, Homo sapiens
caggctgggctg

SEQ ID NO: 1898723 - DNA, 14 bp, Homo sapiens
caggctgggctggg

SEQ ID NO: 1898724 - DNA, 17 bp, Homo sapiens
caggctgggctgggcac

SEQ ID NO: 1898725 - DNA, 12 bp, Homo sapiens
cagggaagaaac

SEQ ID NO: 1898726 - DNA, 12 bp, Homo sapiens
cagggaggagcc

SEQ ID NO: 1898727 - DNA, 16 bp, Homo sapiens
cagggaggagccccag

SEQ ID NO: 1898728 - DNA, 21 bp, Homo sapiens
cagggaggagccccagtggtg

SEQ ID NO: 1898729 - DNA, 16 bp, Homo sapiens
cagggatggcagtggc

SEQ ID NO: 1898730 - DNA, 17 bp, Homo sapiens
cagggatggcagtggct

SEQ ID NO: 1898731 - DNA, 14 bp, Homo sapiens
cagggcacagaagg

SEQ ID NO: 1898732 - DNA, 19 bp, Homo sapiens
cagggcacagaaggctggg

SEQ ID NO: 1898733 - DNA, 16 bp, Homo sapiens
cagggcacagggcctg

SEQ ID NO: 1898734 - DNA, 18 bp, Homo sapiens
cagggcacagggcctggc

SEQ ID NO: 1898735 - DNA, 22 bp, Homo sapiens
cagggcacagggcctggcccat

SEQ ID NO: 1898736 - DNA, 12 bp, Homo sapiens
cagggcacgtgg

SEQ ID NO: 1898737 - DNA, 13 bp, Homo sapiens
cagggcaggacca

SEQ ID NO: 1898738 - DNA, 16 bp, Homo sapiens
cagggcaggaccagcc

SEQ ID NO: 1898739 - DNA, 22 bp, Homo sapiens
cagggcaggaccagcccacgct

SEQ ID NO: 1898740 - DNA, 13 bp, Homo sapiens
cagggcaggcccc

SEQ ID NO: 1898741 - DNA, 17 bp, Homo sapiens
cagggcccgggcccagg

SEQ ID NO: 1898742 - DNA, 21 bp, Homo sapiens
cagggccggtcgggggggacc

SEQ ID NO: 1898743 - DNA, 11 bp, Homo sapiens
cagggcctggc

SEQ ID NO: 1898744 - DNA, 13 bp, Homo sapiens
cagggcctggccc

SEQ ID NO: 1898745 - DNA, 14 bp, Homo sapiens
cagggcctggccca

SEQ ID NO: 1898746 - DNA, 16 bp, Homo sapiens
cagggcctggcccatg

SEQ ID NO: 1898747 - DNA, 17 bp, Homo sapiens
cagggcctggcccatgt

SEQ ID NO: 1898748 - DNA, 16 bp, Homo sapiens
cagggccttctgcctg

SEQ ID NO: 1898749 - DNA, 22 bp, Homo sapiens
caggggatccagctcaagggag

SEQ ID NO: 1898750 - DNA, 17 bp, Homo sapiens
caggggccaagcaggca

SEQ ID NO: 1898751 - DNA, 15 bp, Homo sapiens
cagggggcttcctga

SEQ ID NO: 1898752 - DNA, 16 bp, Homo sapiens
caggggtacacagagc

SEQ ID NO: 1898753 - DNA, 17 bp, Homo sapiens
caggggtacacagagct

SEQ ID NO: 1898754 - DNA, 21 bp, Homo sapiens
caggggttccttctgggcatt

SEQ ID NO: 1898755 - DNA, 22 bp, Homo sapiens
cagggtctctagtgctgtgaaa

SEQ ID NO: 1898756 - DNA, 12 bp, Homo sapiens
cagggtgtgagg

SEQ ID NO: 1898757 - DNA, 16 bp, Homo sapiens
cagggtgtgaggccac

SEQ ID NO: 1898758 - DNA, 13 bp, Homo sapiens
cagggttggaaag

SEQ ID NO: 1898759 - DNA, 20 bp, Homo sapiens
cagggtttcaccatgttggc

SEQ ID NO: 1898760 - DNA, 19 bp, Homo sapiens
caggtactctttaaacagt

SEQ ID NO: 1898761 - DNA, 14 bp, Homo sapiens
caggtgcccgccac

SEQ ID NO: 1898762 - DNA, 20 bp, Homo sapiens
caggtggaggtggcatcccc

SEQ ID NO: 1898763 - DNA, 15 bp, Homo sapiens
caggttccacagagg

SEQ ID NO: 1898764 - DNA, 19 bp, Homo sapiens
caggttccacagaggacac

SEQ ID NO: 1898765 - DNA, 22 bp, Homo sapiens
cagtaagctggtttacagatgt

SEQ ID NO: 1898766 - DNA, 16 bp, Homo sapiens
cagtaccctggttgtg

SEQ ID NO: 1898767 - DNA, 17 bp, Homo sapiens
cagtaccctggttgtgt

SEQ ID NO: 1898768 - DNA, 20 bp, Homo sapiens
cagtagctgggaccacaggt

SEQ ID NO: 1898769 - DNA, 14 bp, Homo sapiens
cagtatcatgaagc

SEQ ID NO: 1898770 - DNA, 21 bp, Homo sapiens
cagtattgcaataaaaaatat

SEQ ID NO: 1898771 - DNA, 16 bp, Homo sapiens
cagtcaccaagtgtat

SEQ ID NO: 1898772 - DNA, 23 bp, Homo sapiens
cagtcaccaagtgtattgtaatg

SEQ ID NO: 1898773 - DNA, 15 bp, Homo sapiens
cagtcccagcagcca

SEQ ID NO: 1898774 - DNA, 19 bp, Homo sapiens
cagtcggggcaggccaggg

SEQ ID NO: 1898775 - DNA, 16 bp, Homo sapiens
cagtcgtcagcctccc

SEQ ID NO: 1898776 - DNA, 17 bp, Homo sapiens
cagtcgtcagcctccct

SEQ ID NO: 1898777 - DNA, 19 bp, Homo sapiens
cagtcgtcagcctccctga

SEQ ID NO: 1898778 - DNA, 13 bp, Homo sapiens
cccttccagctcc

SEQ ID NO: 1898779 - DNA, 22 bp, Homo sapiens
cccttccagctccctcccctgc

SEQ ID NO: 1898780 - DNA, 13 bp, Homo sapiens
cccttcccagacc

SEQ ID NO: 1898781 - DNA, 20 bp, Homo sapiens
cccttgccagctgctgagcc

SEQ ID NO: 1898782 - DNA, 21 bp, Homo sapiens
cccttgccagctgctgagccg

SEQ ID NO: 1898783 - DNA, 12 bp, Homo sapiens
cccttggctctc

SEQ ID NO: 1898784 - DNA, 16 bp, Homo sapiens
cccttgggcctcccac

SEQ ID NO: 1898785 - DNA, 20 bp, Homo sapiens
cccttgggcctcccactccc

SEQ ID NO: 1898786 - DNA, 13 bp, Homo sapiens
ccctttcctttcc

SEQ ID NO: 1898787 - DNA, 14 bp, Homo sapiens
ccctttctgccagg

SEQ ID NO: 1898788 - DNA, 13 bp, Homo sapiens
cccttttctttcc

SEQ ID NO: 1898789 - DNA, 17 bp, Homo sapiens
ccgaactgttgtataaa

SEQ ID NO: 1898790 - DNA, 22 bp, Homo sapiens
ccgaagggactggatctgcagg

SEQ ID NO: 1898791 - DNA, 17 bp, Homo sapiens
ccgaggacagcctgcct

SEQ ID NO: 1898792 - DNA, 18 bp, Homo sapiens
ccgaggacagcctgcctc

SEQ ID NO: 1898793 - DNA, 21 bp, Homo sapiens
ccgaggacagcctgcctctgc

SEQ ID NO: 1898794 - DNA, 18 bp, Homo sapiens
ccgaggctcgagctcggg

SEQ ID NO: 1898795 - DNA, 21 bp, Homo sapiens
ccgaggctcgagctcggggct

SEQ ID NO: 1898796 - DNA, 23 bp, Homo sapiens
ccgagggtggtttacctgcaccg

SEQ ID NO: 1898797 - DNA, 21 bp, Homo sapiens
ccgagtctttctcactgcctt

SEQ ID NO: 1898798 - DNA, 20 bp, Homo sapiens
ccgatcctcccctggactcc

SEQ ID NO: 1898799 - DNA, 20 bp, Homo sapiens
ccgcagcacgcctctcccca

SEQ ID NO: 1898800 - DNA, 20 bp, Homo sapiens
ccgcagtcgtcagcctccct

SEQ ID NO: 1898801 - DNA, 14 bp, Homo sapiens
ccgcatctcacagc

SEQ ID NO: 1898802 - DNA, 13 bp, Homo sapiens
ccgcccctgagcc

SEQ ID NO: 1898803 - DNA, 16 bp, Homo sapiens
ccgcccctgagcccac

SEQ ID NO: 1898804 - DNA, 17 bp, Homo sapiens
ccgcccctgagcccact

SEQ ID NO: 1898805 - DNA, 16 bp, Homo sapiens
ccgcgggcactgccgc

SEQ ID NO: 1898806 - DNA, 12 bp, Homo sapiens
ccgctgtaattc

SEQ ID NO: 1898807 - DNA, 13 bp, Homo sapiens
ccgctgtctccct

SEQ ID NO: 1898808 - DNA, 17 bp, Homo sapiens
ccgctgtctccctcctg

SEQ ID NO: 1898809 - DNA, 17 bp, Homo sapiens
ccggcaataaaagccca

SEQ ID NO: 1898810 - DNA, 15 bp, Homo sapiens
ccggccgcactggga

SEQ ID NO: 1898811 - DNA, 17 bp, Homo sapiens
ccggccgcactgggagc

SEQ ID NO: 1898812 - DNA, 13 bp, Homo sapiens
ccggggaggggcc

SEQ ID NO: 1898813 - DNA, 11 bp, Homo sapiens
ccgtcccctcc

SEQ ID NO: 1898814 - DNA, 11 bp, Homo sapiens
ccgtctcaggt

SEQ ID NO: 1898815 - DNA, 20 bp, Homo sapiens
ccgtgggctgttacttgctt

SEQ ID NO: 1898816 - DNA, 18 bp, Homo sapiens
ccgtgtaggaacctgcac

SEQ ID NO: 1898817 - DNA, 13 bp, Homo sapiens
ccgtttccctcca

SEQ ID NO: 1898818 - DNA, 14 bp, Homo sapiens
cctaaaagtaaaca

SEQ ID NO: 1898819 - DNA, 15 bp, Homo sapiens
cctaaaagtaaacat

SEQ ID NO: 1898820 - DNA, 13 bp, Homo sapiens
cctaaagcctcaa

SEQ ID NO: 1898821 - DNA, 14 bp, Homo sapiens
cctaaataaattat

SEQ ID NO: 1898822 - DNA, 22 bp, Homo sapiens
cctaacaacattgtagcctcaa

SEQ ID NO: 1898823 - DNA, 15 bp, Homo sapiens
cctaatggtgatgca

SEQ ID NO: 1898824 - DNA, 15 bp, Homo sapiens
cctacaaagctctga

SEQ ID NO: 1898825 - DNA, 19 bp, Homo sapiens
cctacctaacccagaaaat

SEQ ID NO: 1898826 - DNA, 23 bp, Homo sapiens
cctagcctcacgctcctttctga

SEQ ID NO: 1898827 - DNA, 20 bp, Homo sapiens
cctagctggagaggagccct

SEQ ID NO: 1898828 - DNA, 22 bp, Homo sapiens
cctagctggagaggagccctgc

SEQ ID NO: 1898829 - DNA, 20 bp, Homo sapiens
cctagtttgctgtggccttc

SEQ ID NO: 1898830 - DNA, 21 bp, Homo sapiens
cctagtttgctgtggccttcc

SEQ ID NO: 1898831 - DNA, 16 bp, Homo sapiens
cctatgacacagaagc

SEQ ID NO: 1898832 - DNA, 17 bp, Homo sapiens
cctcaaatccaggaccc

SEQ ID NO: 1898833 - DNA, 19 bp, Homo sapiens
cctcaaatccaggaccctg

SEQ ID NO: 1898834 - DNA, 17 bp, Homo sapiens
cctcacacacctctgcc

SEQ ID NO: 1898835 - DNA, 19 bp, Homo sapiens
cctcacctgtcgcacccac

SEQ ID NO: 1898836 - DNA, 16 bp, Homo sapiens
cctcacgaaactggaa

SEQ ID NO: 1898837 - DNA, 16 bp, Homo sapiens
cctcacgtgcaaagcc

SEQ ID NO: 1898838 - DNA, 20 bp, Homo sapiens
cctcactggtctacactggt

SEQ ID NO: 1898839 - DNA, 20 bp, Homo sapiens
cctcagagaaatcactgaac

SEQ ID NO: 1898840 - DNA, 15 bp, Homo sapiens
cctcagccctctctt

SEQ ID NO: 1898841 - DNA, 19 bp, Homo sapiens
cctcagccctctcttgcca

SEQ ID NO: 1898842 - DNA, 16 bp, Homo sapiens
cctcagtcggggcagg

SEQ ID NO: 1898843 - DNA, 20 bp, Homo sapiens
cctcagtttccctatctgca

SEQ ID NO: 1898844 - DNA, 14 bp, Homo sapiens
cctccaaggccagg

SEQ ID NO: 1898845 - DNA, 16 bp, Homo sapiens
cctccacctctgtgca

SEQ ID NO: 1898846 - DNA, 18 bp, Homo sapiens
cctccaggtgttgttgag

SEQ ID NO: 1898847 - DNA, 21 bp, Homo sapiens
cctccagtaccttctgccaga

SEQ ID NO: 1898848 - DNA, 20 bp, Homo sapiens
cctccatccacccctctggc

SEQ ID NO: 1898849 - DNA, 15 bp, Homo sapiens
cctcccaatcacccc

SEQ ID NO: 1898850 - DNA, 16 bp, Homo sapiens
cctcccactcccatgg

SEQ ID NO: 1898851 - DNA, 17 bp, Homo sapiens
cctcccactcccatggc

SEQ ID NO: 1898852 - DNA, 12 bp, Homo sapiens
cctcccagctcc

SEQ ID NO: 1898853 - DNA, 11 bp, Homo sapiens
cctcccaggcg

SEQ ID NO: 1898854 - DNA, 18 bp, Homo sapiens
cctcccagggagcaaggg

SEQ ID NO: 1898855 - DNA, 13 bp, Homo sapiens
cctccccaccctg

SEQ ID NO: 1898856 - DNA, 17 bp, Homo sapiens
cctccccaccctgtccc

SEQ ID NO: 1898857 - DNA, 18 bp, Homo sapiens
cctccccaccctgtccca

SEQ ID NO: 1898858 - DNA, 18 bp, Homo sapiens
cctccctgacgtctgcca

SEQ ID NO: 1898859 - DNA, 23 bp, Homo sapiens
cctccgccccgtccccccatccc

SEQ ID NO: 1898860 - DNA, 14 bp, Homo sapiens
cctccgcttccctg

SEQ ID NO: 1898861 - DNA, 19 bp, Homo sapiens
cctcctaaaaggcccagag

SEQ ID NO: 1898862 - DNA, 21 bp, Homo sapiens
cctcctaaaaggcccagagag

SEQ ID NO: 1898863 - DNA, 14 bp, Homo sapiens
cctcctcctgccct

SEQ ID NO: 1898864 - DNA, 15 bp, Homo sapiens
cctcctcctgccctc

SEQ ID NO: 1898865 - DNA, 16 bp, Homo sapiens
cctcctcctgccctcc

SEQ ID NO: 1898866 - DNA, 17 bp, Homo sapiens
cctcctttaccgaggac

SEQ ID NO: 1898867 - DNA, 18 bp, Homo sapiens
cctcctttaccgaggaca

SEQ ID NO: 1898868 - DNA, 23 bp, Homo sapiens
cctcctttaccgaggacagcctg

SEQ ID NO: 1898869 - DNA, 15 bp, Homo sapiens
cctcctttccttttt

SEQ ID NO: 1898870 - DNA, 22 bp, Homo sapiens
cctcctttctttgctgtttgca

SEQ ID NO: 1898871 - DNA, 12 bp, Homo sapiens
cctcgcccagtc

SEQ ID NO: 1898872 - DNA, 18 bp, Homo sapiens
cctcgcccagtcccagca

SEQ ID NO: 1898873 - DNA, 19 bp, Homo sapiens
cctcgcccagtcccagcag

SEQ ID NO: 1898874 - DNA, 13 bp, Homo sapiens
cctcgggctgttc

SEQ ID NO: 1898875 - DNA, 21 bp, Homo sapiens
cctcgggctgttctggtggcc

SEQ ID NO: 1898876 - DNA, 13 bp, Homo sapiens
cctctccccacct

SEQ ID NO: 1898877 - DNA, 15 bp, Homo sapiens
cctctccccaccttc

SEQ ID NO: 1898878 - DNA, 20 bp, Homo sapiens
cctctccgcccctgagccca

SEQ ID NO: 1898879 - DNA, 22 bp, Homo sapiens
cctctccgcccctgagcccact

SEQ ID NO: 1898880 - DNA, 23 bp, Homo sapiens
cctctctttctaagagacctgaa

SEQ ID NO: 1898881 - DNA, 17 bp, Homo sapiens
cctctgatctgtgcagg

SEQ ID NO: 1898882 - DNA, 13 bp, Homo sapiens
cctctgccacagc

SEQ ID NO: 1898883 - DNA, 14 bp, Homo sapiens
cctctgccacagca

SEQ ID NO: 1898884 - DNA, 21 bp, Homo sapiens
cctctgccacagcaaggctgt

SEQ ID NO: 1898885 - DNA, 16 bp, Homo sapiens
cctctgccccttgggc

SEQ ID NO: 1898886 - DNA, 20 bp, Homo sapiens
cctctgctgcatccccttcc

SEQ ID NO: 1898887 - DNA, 14 bp, Homo sapiens
cctctggcacctgg

SEQ ID NO: 1898888 - DNA, 15 bp, Homo sapiens
cctctgtgcagggca

SEQ ID NO: 1898889 - DNA, 14 bp, Homo sapiens
cctcttctgagctt

SEQ ID NO: 1898890 - DNA, 22 bp, Homo sapiens
cctgaagagtttgtaaatgact

SEQ ID NO: 1898891 - DNA, 19 bp, Homo sapiens
cctgacgagataagcagtt

SEQ ID NO: 1898892 - DNA, 13 bp, Homo sapiens
cctgacgtctgcc

SEQ ID NO: 1898893 - DNA, 19 bp, Homo sapiens
cctgagatggatggacaga

SEQ ID NO: 1898894 - DNA, 23 bp, Homo sapiens
cctgagatggatggacagacaga

SEQ ID NO: 1898895 - DNA, 12 bp, Homo sapiens
cctgagcccact

SEQ ID NO: 1898896 - DNA, 13 bp, Homo sapiens
cctgagcccactg

SEQ ID NO: 1898897 - DNA, 15 bp, Homo sapiens
cctgagcccactgtg

SEQ ID NO: 1898898 - DNA, 14 bp, Homo sapiens
cctgagcccccagc

SEQ ID NO: 1898899 - DNA, 18 bp, Homo sapiens
cctgagtgagaggggagg

SEQ ID NO: 1898900 - DNA, 21 bp, Homo sapiens
cctgagtgagaggggaggcca

SEQ ID NO: 1898901 - DNA, 22 bp, Homo sapiens
cctgagtgagaggggaggccaa

SEQ ID NO: 1898902 - DNA, 23 bp, Homo sapiens
cctgagtgagaggggaggccaag

SEQ ID NO: 1898903 - DNA, 14 bp, Homo sapiens
cctgagttcctgag

SEQ ID NO: 1898904 - DNA, 19 bp, Homo sapiens
cctgattctaaaatgtctc

SEQ ID NO: 1898905 - DNA, 15 bp, Homo sapiens
cctgcactgactctg

SEQ ID NO: 1898906 - DNA, 16 bp, Homo sapiens
cctgcacttgggggct

SEQ ID NO: 1898907 - DNA, 24 bp, Homo sapiens
cctgcagcctgagatggatggaca

SEQ ID NO: 1898908 - DNA, 14 bp, Homo sapiens
cctgccaggcacag

SEQ ID NO: 1898909 - DNA, 21 bp, Homo sapiens
cctgccaggcacaggcagggc

SEQ ID NO: 1898910 - DNA, 18 bp, Homo sapiens
cctgcccagccccctggt

SEQ ID NO: 1898911 - DNA, 13 bp, Homo sapiens
ctgatttcttttc

SEQ ID NO: 1898912 - DNA, 16 bp, Homo sapiens
ctgatttgttccttct

SEQ ID NO: 1898913 - DNA, 16 bp, Homo sapiens
ctgattttgaccttgt

SEQ ID NO: 1898914 - DNA, 15 bp, Homo sapiens
ctgcaaaggaaatac

SEQ ID NO: 1898915 - DNA, 20 bp, Homo sapiens
ctgcactgaatggctgacct

SEQ ID NO: 1898916 - DNA, 18 bp, Homo sapiens
ctgcactgactctggaaa

SEQ ID NO: 1898917 - DNA, 15 bp, Homo sapiens
ctgcacttgggggct

SEQ ID NO: 1898918 - DNA, 20 bp, Homo sapiens
ctgcacttgggggctcagca

SEQ ID NO: 1898919 - DNA, 21 bp, Homo sapiens
ctgcacttgggggctcagcaa

SEQ ID NO: 1898920 - DNA, 17 bp, Homo sapiens
ctgcagaacagcttcat

SEQ ID NO: 1898921 - DNA, 21 bp, Homo sapiens
ctgcagcctccgcttccctgg

SEQ ID NO: 1898922 - DNA, 17 bp, Homo sapiens
ctgcagttcccctggaa

SEQ ID NO: 1898923 - DNA, 20 bp, Homo sapiens
ctgcagttcccctggaagca

SEQ ID NO: 1898924 - DNA, 13 bp, Homo sapiens
ctgcatccccttc

SEQ ID NO: 1898925 - DNA, 14 bp, Homo sapiens
ctgcatccccttcc

SEQ ID NO: 1898926 - DNA, 15 bp, Homo sapiens
ctgcatccccttcca

SEQ ID NO: 1898927 - DNA, 17 bp, Homo sapiens
ctgcatccccttccagc

SEQ ID NO: 1898928 - DNA, 18 bp, Homo sapiens
ctgcatccccttccagct

SEQ ID NO: 1898929 - DNA, 21 bp, Homo sapiens
ctgcatgggttaattgagaat

SEQ ID NO: 1898930 - DNA, 22 bp, Homo sapiens
ctgcattcttctgatcactgaa

SEQ ID NO: 1898931 - DNA, 13 bp, Homo sapiens
ctgcatttaggga

SEQ ID NO: 1898932 - DNA, 17 bp, Homo sapiens
ctgcatttgtctggcct

SEQ ID NO: 1898933 - DNA, 18 bp, Homo sapiens
ctgccacaaggaagaaat

SEQ ID NO: 1898934 - DNA, 16 bp, Homo sapiens
ctgccaccagcgcccc

SEQ ID NO: 1898935 - DNA, 10 bp, Homo sapiens
ctgccacctc

SEQ ID NO: 1898936 - DNA, 11 bp, Homo sapiens
ctgccacctcc

SEQ ID NO: 1898937 - DNA, 12 bp, Homo sapiens
ctgccacctccc

SEQ ID NO: 1898938 - DNA, 13 bp, Homo sapiens
ctgccacctcccc

SEQ ID NO: 1898939 - DNA, 17 bp, Homo sapiens
ctgccacctccccttgc

SEQ ID NO: 1898940 - DNA, 13 bp, Homo sapiens
ctgccacctgcac

SEQ ID NO: 1898941 - DNA, 15 bp, Homo sapiens
ctgccacctgcacag

SEQ ID NO: 1898942 - DNA, 17 bp, Homo sapiens
ctgccagctcttcctag

SEQ ID NO: 1898943 - DNA, 16 bp, Homo sapiens
ctgccaggcacaggca

SEQ ID NO: 1898944 - DNA, 22 bp, Homo sapiens
ctgccaggcccggcatgaggcc

SEQ ID NO: 1898945 - DNA, 11 bp, Homo sapiens
ctgccagggat

SEQ ID NO: 1898946 - DNA, 13 bp, Homo sapiens
ctgccagggatgg

SEQ ID NO: 1898947 - DNA, 12 bp, Homo sapiens
ctgccagttttg

SEQ ID NO: 1898948 - DNA, 16 bp, Homo sapiens
ctgcccctaactcctg

SEQ ID NO: 1898949 - DNA, 18 bp, Homo sapiens
ctgccccttgggcctccc

SEQ ID NO: 1898950 - DNA, 19 bp, Homo sapiens
ctgccccttgggcctccca

SEQ ID NO: 1898951 - DNA, 21 bp, Homo sapiens
ctgccccttgggcctcccact

SEQ ID NO: 1898952 - DNA, 22 bp, Homo sapiens
ctgccccttgggcctcccactc

SEQ ID NO: 1898953 - DNA, 13 bp, Homo sapiens
ctgccctctgctc

SEQ ID NO: 1898954 - DNA, 20 bp, Homo sapiens
ctgccgccgctaggtagagt

SEQ ID NO: 1898955 - DNA, 14 bp, Homo sapiens
ctgcctctccgccc

SEQ ID NO: 1898956 - DNA, 19 bp, Homo sapiens
ctgcctctccgcccctgag

SEQ ID NO: 1898957 - DNA, 21 bp, Homo sapiens
ctgcctctccgcccctgagcc

SEQ ID NO: 1898958 - DNA, 23 bp, Homo sapiens
ctgcctctccgcccctgagccca

SEQ ID NO: 1898959 - DNA, 14 bp, Homo sapiens
ctgcctctgccaca

SEQ ID NO: 1898960 - DNA, 23 bp, Homo sapiens
ctgcctgtctcccaccctttctg

SEQ ID NO: 1898961 - DNA, 16 bp, Homo sapiens
ctgcggggcagcaggg

SEQ ID NO: 1898962 - DNA, 19 bp, Homo sapiens
ctgctattttcctgttcta

SEQ ID NO: 1898963 - DNA, 23 bp, Homo sapiens
ctgctcagatcccacttttgcca

SEQ ID NO: 1898964 - DNA, 12 bp, Homo sapiens
ctgctgaacaaa

SEQ ID NO: 1898965 - DNA, 16 bp, Homo sapiens
ctgctgacccctgtgt

SEQ ID NO: 1898966 - DNA, 20 bp, Homo sapiens
ctgctgagactgctgagtga

SEQ ID NO: 1898967 - DNA, 14 bp, Homo sapiens
ctgctgagccgcag

SEQ ID NO: 1898968 - DNA, 18 bp, Homo sapiens
ctgctgagccgcagagaa

SEQ ID NO: 1898969 - DNA, 17 bp, Homo sapiens
ctgctgaggcttcataa

SEQ ID NO: 1898970 - DNA, 17 bp, Homo sapiens
ctgctgagtctgttctg

SEQ ID NO: 1898971 - DNA, 14 bp, Homo sapiens
ctgctgccaggccc

SEQ ID NO: 1898972 - DNA, 13 bp, Homo sapiens
ctgctgctgaccc

SEQ ID NO: 1898973 - DNA, 21 bp, Homo sapiens
ctgctgctgacccctgtgtga

SEQ ID NO: 1898974 - DNA, 20 bp, Homo sapiens
ctgctggccggacacccgac

SEQ ID NO: 1898975 - DNA, 19 bp, Homo sapiens
ctgctgtgaacatgcctcc

SEQ ID NO: 1898976 - DNA, 21 bp, Homo sapiens
ctgctgtgaacatgcctcctc

SEQ ID NO: 1898977 - DNA, 16 bp, Homo sapiens
ctgcttcctataattt

SEQ ID NO: 1898978 - DNA, 22 bp, Homo sapiens
ctgcttgaataaacaccactgg

SEQ ID NO: 1898979 - DNA, 16 bp, Homo sapiens
ctgctttagacttgaa

SEQ ID NO: 1898980 - DNA, 19 bp, Homo sapiens
ctgctttagacttgaaaag

SEQ ID NO: 1898981 - DNA, 13 bp, Homo sapiens
ctgctttctgaat

SEQ ID NO: 1898982 - DNA, 16 bp, Homo sapiens
ctgcttttgtagtgtg

SEQ ID NO: 1898983 - DNA, 18 bp, Homo sapiens
ctggaaaggccagcagcc

SEQ ID NO: 1898984 - DNA, 21 bp, Homo sapiens
ctggaaaggccagcagccttc

SEQ ID NO: 1898985 - DNA, 14 bp, Homo sapiens
ctggaactgctgct

SEQ ID NO: 1898986 - DNA, 17 bp, Homo sapiens
ctggaactgctgctgac

SEQ ID NO: 1898987 - DNA, 19 bp, Homo sapiens
ctggaactgctgctgaccc

SEQ ID NO: 1898988 - DNA, 20 bp, Homo sapiens
ctggaactgctgctgacccc

SEQ ID NO: 1898989 - DNA, 15 bp, Homo sapiens
ctggaagcagtgccc

SEQ ID NO: 1898990 - DNA, 13 bp, Homo sapiens
ctggaccccagcc

SEQ ID NO: 1898991 - DNA, 17 bp, Homo sapiens
ctggaccccatctgtga

SEQ ID NO: 1898992 - DNA, 23 bp, Homo sapiens
ctggactctaaagtctgttgatt

SEQ ID NO: 1898993 - DNA, 14 bp, Homo sapiens
ctggagaaaaatat

SEQ ID NO: 1898994 - DNA, 21 bp, Homo sapiens
ctggagcctgcggggcagcag

SEQ ID NO: 1898995 - DNA, 19 bp, Homo sapiens
ctggagctcaagccgtggc

SEQ ID NO: 1898996 - DNA, 23 bp, Homo sapiens
ctggagctcaagccgtggccggg

SEQ ID NO: 1898997 - DNA, 16 bp, Homo sapiens
ctggatatagaaagga

SEQ ID NO: 1898998 - DNA, 17 bp, Homo sapiens
ctggattgtagaacttg

SEQ ID NO: 1898999 - DNA, 21 bp, Homo sapiens
ctggattgtagaacttgttgc

SEQ ID NO: 1899000 - DNA, 14 bp, Homo sapiens
ctggcaagaaccag

SEQ ID NO: 1899001 - DNA, 16 bp, Homo sapiens
ctggcaatggtagttt

SEQ ID NO: 1899002 - DNA, 21 bp, Homo sapiens
ctggcaatggtagtttctgtg

SEQ ID NO: 1899003 - DNA, 12 bp, Homo sapiens
ctggcaccagca

SEQ ID NO: 1899004 - DNA, 22 bp, Homo sapiens
ctggcaggggatccagctcaag

SEQ ID NO: 1899005 - DNA, 17 bp, Homo sapiens
ctggcatatctctgttc

SEQ ID NO: 1899006 - DNA, 14 bp, Homo sapiens
ctggccagggagga

SEQ ID NO: 1899007 - DNA, 20 bp, Homo sapiens
ctggccggtgtgggggcccc

SEQ ID NO: 1899008 - DNA, 13 bp, Homo sapiens
ctggcgggccctg

SEQ ID NO: 1899009 - DNA, 22 bp, Homo sapiens
ctggcgggccctggagctcaag

SEQ ID NO: 1899010 - DNA, 13 bp, Homo sapiens
ctggctccctcac

SEQ ID NO: 1899011 - DNA, 14 bp, Homo sapiens
ctggctctacacat

SEQ ID NO: 1899012 - DNA, 18 bp, Homo sapiens
ctggcttacactggcaat

SEQ ID NO: 1899013 - DNA, 19 bp, Homo sapiens
ctgggcagcttgggctggc

SEQ ID NO: 1899014 - DNA, 22 bp, Homo sapiens
ctgggcagcttgggctggcggg

SEQ ID NO: 1899015 - DNA, 13 bp, Homo sapiens
ctgggcctccacc

SEQ ID NO: 1899016 - DNA, 18 bp, Homo sapiens
ctgggcctccacctctgt

SEQ ID NO: 1899017 - DNA, 19 bp, Homo sapiens
ctgggcctccacctctgtg

SEQ ID NO: 1899018 - DNA, 17 bp, Homo sapiens
ctgggcctctgatgttc

SEQ ID NO: 1899019 - DNA, 14 bp, Homo sapiens
ctgggcctggctcc

SEQ ID NO: 1899020 - DNA, 22 bp, Homo sapiens
ctgggcctggctccctcactct

SEQ ID NO: 1899021 - DNA, 16 bp, Homo sapiens
ctgggcggtccagaag

SEQ ID NO: 1899022 - DNA, 13 bp, Homo sapiens
ctgggctgggcac

SEQ ID NO: 1899023 - DNA, 17 bp, Homo sapiens
ctggggcatccatgggg

SEQ ID NO: 1899024 - DNA, 15 bp, Homo sapiens
ctggggctgctgtga

SEQ ID NO: 1899025 - DNA, 21 bp, Homo sapiens
ctggggctggcaccagcaggc

SEQ ID NO: 1899026 - DNA, 22 bp, Homo sapiens
ctggggctggcaccagcaggca

SEQ ID NO: 1899027 - DNA, 21 bp, Homo sapiens
ctgggggacactgtggcagca

SEQ ID NO: 1899028 - DNA, 16 bp, Homo sapiens
ctgggggctgcagggc

SEQ ID NO: 1899029 - DNA, 14 bp, Homo sapiens
ctgggtagctgtaa

SEQ ID NO: 1899030 - DNA, 19 bp, Homo sapiens
ctgggttagactgccagct

SEQ ID NO: 1899031 - DNA, 20 bp, Homo sapiens
ctgggttagactgccagctc

SEQ ID NO: 1899032 - DNA, 14 bp, Homo sapiens
ctgggtttggcagg

SEQ ID NO: 1899033 - DNA, 20 bp, Homo sapiens
ctggtacaatttcttttggt

SEQ ID NO: 1899034 - DNA, 18 bp, Homo sapiens
ctggtctttgagctccca

SEQ ID NO: 1899035 - DNA, 19 bp, Homo sapiens
ctggtctttgagctcccac

SEQ ID NO: 1899036 - DNA, 22 bp, Homo sapiens
ctggtgttataatacgctgctg

SEQ ID NO: 1899037 - DNA, 13 bp, Homo sapiens
ctggttacaattt

SEQ ID NO: 1899038 - DNA, 16 bp, Homo sapiens
ctggtttacagatgtt

SEQ ID NO: 1899039 - DNA, 12 bp, Homo sapiens
ctgtaaatgctc

SEQ ID NO: 1899040 - DNA, 15 bp, Homo sapiens
ctgtaaatgtattca

SEQ ID NO: 1899041 - DNA, 20 bp, Homo sapiens
ctgtaaggggccagagcctt

SEQ ID NO: 1899042 - DNA, 17 bp, Homo sapiens
ctgtaatcccagcactt

SEQ ID NO: 1899043 - DNA, 19 bp, Homo sapiens
ctgtataaaggtgtgctgt

SEQ ID NO: 1899044 - DNA, 15 bp, Homo sapiens
gcagggcacagaagg

SEQ ID NO: 1899045 - DNA, 18 bp, Homo sapiens
gcagggcacagaaggctg

SEQ ID NO: 1899046 - DNA, 12 bp, Homo sapiens
gcagggcacagg

SEQ ID NO: 1899047 - DNA, 16 bp, Homo sapiens
gcagggcacagggcct

SEQ ID NO: 1899048 - DNA, 19 bp, Homo sapiens
gcagggcacagggcctggc

SEQ ID NO: 1899049 - DNA, 14 bp, Homo sapiens
gcagggcaggacca

SEQ ID NO: 1899050 - DNA, 15 bp, Homo sapiens
gcagggcaggaccag

SEQ ID NO: 1899051 - DNA, 17 bp, Homo sapiens
gcagggccttctgcctg

SEQ ID NO: 1899052 - DNA, 23 bp, Homo sapiens
gcaggtgatctgctgcagagcag

SEQ ID NO: 1899053 - DNA, 15 bp, Homo sapiens
gcagtatcatgaagc

SEQ ID NO: 1899054 - DNA, 18 bp, Homo sapiens
gcagtcgtcagcctccct

SEQ ID NO: 1899055 - DNA, 19 bp, Homo sapiens
gcagtcgtcagcctccctg

SEQ ID NO: 1899056 - DNA, 15 bp, Homo sapiens
gcagtgcccaggtgg

SEQ ID NO: 1899057 - DNA, 13 bp, Homo sapiens
gcagtggagcaga

SEQ ID NO: 1899058 - DNA, 20 bp, Homo sapiens
gcagtggcgaaatccctgct

SEQ ID NO: 1899059 - DNA, 22 bp, Homo sapiens
gcagtgtgaatgctgggcccct

SEQ ID NO: 1899060 - DNA, 11 bp, Homo sapiens
gcagtgttaag

SEQ ID NO: 1899061 - DNA, 22 bp, Homo sapiens
gcagttatgtgacctcacgtgc

SEQ ID NO: 1899062 - DNA, 23 bp, Homo sapiens
gcagttgctggtaaaatgaagaa

SEQ ID NO: 1899063 - DNA, 16 bp, Homo sapiens
gcatataacttatatt

SEQ ID NO: 1899064 - DNA, 11 bp, Homo sapiens
gcatccatggg

SEQ ID NO: 1899065 - DNA, 21 bp, Homo sapiens
gcatccatggggtctctcaca

SEQ ID NO: 1899066 - DNA, 15 bp, Homo sapiens
gcatccccttccagc

SEQ ID NO: 1899067 - DNA, 22 bp, Homo sapiens
gcatccccttccagctccctcc

SEQ ID NO: 1899068 - DNA, 13 bp, Homo sapiens
gcatctctctggg

SEQ ID NO: 1899069 - DNA, 19 bp, Homo sapiens
gcatctctctgggatgcag

SEQ ID NO: 1899070 - DNA, 17 bp, Homo sapiens
gcatctgggtagctgta

SEQ ID NO: 1899071 - DNA, 11 bp, Homo sapiens
gcatctttgat

SEQ ID NO: 1899072 - DNA, 12 bp, Homo sapiens
gcatgaggcccc

SEQ ID NO: 1899073 - DNA, 14 bp, Homo sapiens
gcatgaggccccga

SEQ ID NO: 1899074 - DNA, 15 bp, Homo sapiens
gcatggagaataaac

SEQ ID NO: 1899075 - DNA, 20 bp, Homo sapiens
gcatggtggttgggacccag

SEQ ID NO: 1899076 - DNA, 16 bp, Homo sapiens
gcatgtgttgcagctg

SEQ ID NO: 1899077 - DNA, 18 bp, Homo sapiens
gcattacctctttggaaa

SEQ ID NO: 1899078 - DNA, 20 bp, Homo sapiens
gcattgtaaaagcattttgt

SEQ ID NO: 1899079 - DNA, 22 bp, Homo sapiens
gcatttagggagtattctaata

SEQ ID NO: 1899080 - DNA, 23 bp, Homo sapiens
gcatttagggagtattctaataa

SEQ ID NO: 1899081 - DNA, 14 bp, Homo sapiens
gcatttgctgcatg

SEQ ID NO: 1899082 - DNA, 13 bp, Homo sapiens
gcatttggcttcc

SEQ ID NO: 1899083 - DNA, 14 bp, Homo sapiens
gcatttggcttcct

SEQ ID NO: 1899084 - DNA, 18 bp, Homo sapiens
gcatttggcttcctctgc

SEQ ID NO: 1899085 - DNA, 13 bp, Homo sapiens
gcatttgtgtgtt

SEQ ID NO: 1899086 - DNA, 22 bp, Homo sapiens
gcatttgtttctttctctgagg

SEQ ID NO: 1899087 - DNA, 16 bp, Homo sapiens
gcattttgagaatggt

SEQ ID NO: 1899088 - DNA, 12 bp, Homo sapiens
gcattttgtaat

SEQ ID NO: 1899089 - DNA, 17 bp, Homo sapiens
gcatttttgcaggagca

SEQ ID NO: 1899090 - DNA, 21 bp, Homo sapiens
gccaaaattaaggtgtttgaa

SEQ ID NO: 1899091 - DNA, 13 bp, Homo sapiens
gccaacagaacac

SEQ ID NO: 1899092 - DNA, 21 bp, Homo sapiens
gccaactttccccacgttaaa

SEQ ID NO: 1899093 - DNA, 18 bp, Homo sapiens
gccaagaagtttaaggaa

SEQ ID NO: 1899094 - DNA, 18 bp, Homo sapiens
gccaagagtggccccacc

SEQ ID NO: 1899095 - DNA, 22 bp, Homo sapiens
gccaagagtggccccacctggc

SEQ ID NO: 1899096 - DNA, 20 bp, Homo sapiens
gccaagggggacctcgggct

SEQ ID NO: 1899097 - DNA, 21 bp, Homo sapiens
gccaagggggacctcgggctg

SEQ ID NO: 1899098 - DNA, 14 bp, Homo sapiens
gccacacccagagt

SEQ ID NO: 1899099 - DNA, 18 bp, Homo sapiens
gccacacccagagtagcc

SEQ ID NO: 1899100 - DNA, 12 bp, Homo sapiens
gccacagttgtt

SEQ ID NO: 1899101 - DNA, 16 bp, Homo sapiens
gccacatcctcatggc

SEQ ID NO: 1899102 - DNA, 17 bp, Homo sapiens
gccaccacgcctagcct

SEQ ID NO: 1899103 - DNA, 16 bp, Homo sapiens
gccaccaggtactctt

SEQ ID NO: 1899104 - DNA, 17 bp, Homo sapiens
gccaccctttctggcac

SEQ ID NO: 1899105 - DNA, 19 bp, Homo sapiens
gccaccctttctggcacga

SEQ ID NO: 1899106 - DNA, 19 bp, Homo sapiens
gccaccgtccctctgcaga

SEQ ID NO: 1899107 - DNA, 20 bp, Homo sapiens
gccacctccccttgccagct

SEQ ID NO: 1899108 - DNA, 17 bp, Homo sapiens
gccacctgagttcctga

SEQ ID NO: 1899109 - DNA, 15 bp, Homo sapiens
gccactgagtatgtt

SEQ ID NO: 1899110 - DNA, 22 bp, Homo sapiens
gccactgtccgctgtctccctc

SEQ ID NO: 1899111 - DNA, 19 bp, Homo sapiens
gccactttgcaaaggagct

SEQ ID NO: 1899112 - DNA, 15 bp, Homo sapiens
gccagagccttggag

SEQ ID NO: 1899113 - DNA, 16 bp, Homo sapiens
gccagcagcctctgat

SEQ ID NO: 1899114 - DNA, 19 bp, Homo sapiens
gccagcagcctctgatctg

SEQ ID NO: 1899115 - DNA, 21 bp, Homo sapiens
gccagccaaacacacagaagg

SEQ ID NO: 1899116 - DNA, 15 bp, Homo sapiens
gccagcggccctccc

SEQ ID NO: 1899117 - DNA, 19 bp, Homo sapiens
gccagctcttcctagctgg

SEQ ID NO: 1899118 - DNA, 15 bp, Homo sapiens
gccagctgctgagcc

SEQ ID NO: 1899119 - DNA, 18 bp, Homo sapiens
gccagctgctgagccgca

SEQ ID NO: 1899120 - DNA, 18 bp, Homo sapiens
gccaggaagtagcacagg

SEQ ID NO: 1899121 - DNA, 21 bp, Homo sapiens
gccaggaagtagcacaggctg

SEQ ID NO: 1899122 - DNA, 15 bp, Homo sapiens
gccagggaggagccc

SEQ ID NO: 1899123 - DNA, 16 bp, Homo sapiens
gccagggaggagcccc

SEQ ID NO: 1899124 - DNA, 24 bp, Homo sapiens
gccagggaggagccccagtggtga

SEQ ID NO: 1899125 - DNA, 16 bp, Homo sapiens
gccatgaggaggcaga

SEQ ID NO: 1899126 - DNA, 18 bp, Homo sapiens
gccatgaggaggcagaga

SEQ ID NO: 1899127 - DNA, 22 bp, Homo sapiens
gcccaccctgcttggcccaggg

SEQ ID NO: 1899128 - DNA, 22 bp, Homo sapiens
gcccacgctgactacagggccg

SEQ ID NO: 1899129 - DNA, 13 bp, Homo sapiens
gcccactgtgcag

SEQ ID NO: 1899130 - DNA, 22 bp, Homo sapiens
gcccactgtgcagtggagcaga

SEQ ID NO: 1899131 - DNA, 19 bp, Homo sapiens
gcccagcgcggacatcccc

SEQ ID NO: 1899132 - DNA, 22 bp, Homo sapiens
gcccagctgtgctgggaggtcc

SEQ ID NO: 1899133 - DNA, 14 bp, Homo sapiens
gcccagtcccagca

SEQ ID NO: 1899134 - DNA, 18 bp, Homo sapiens
gcccagtcccagcagcca

SEQ ID NO: 1899135 - DNA, 18 bp, Homo sapiens
gcccatgtatggccagga

SEQ ID NO: 1899136 - DNA, 14 bp, Homo sapiens
gccccacctggccc

SEQ ID NO: 1899137 - DNA, 18 bp, Homo sapiens
gccccacctggccctctc

SEQ ID NO: 1899138 - DNA, 12 bp, Homo sapiens
gccccactctca

SEQ ID NO: 1899139 - DNA, 13 bp, Homo sapiens
gccccactctcag

SEQ ID NO: 1899140 - DNA, 14 bp, Homo sapiens
gccccactctcaga

SEQ ID NO: 1899141 - DNA, 17 bp, Homo sapiens
gccccactctcagaggc

SEQ ID NO: 1899142 - DNA, 18 bp, Homo sapiens
gccccactctcagaggcc

SEQ ID NO: 1899143 - DNA, 22 bp, Homo sapiens
gccccactctcagaggccccaa

SEQ ID NO: 1899144 - DNA, 15 bp, Homo sapiens
gccccagcaacacgt

SEQ ID NO: 1899145 - DNA, 15 bp, Homo sapiens
gcccccactcctcct

SEQ ID NO: 1899146 - DNA, 17 bp, Homo sapiens
gcccccactcctcctcc

SEQ ID NO: 1899147 - DNA, 21 bp, Homo sapiens
gcccccgcagtcgtcagcctc

SEQ ID NO: 1899148 - DNA, 22 bp, Homo sapiens
gcccccgcagtcgtcagcctcc

SEQ ID NO: 1899149 - DNA, 13 bp, Homo sapiens
gccccgtctcagg

SEQ ID NO: 1899150 - DNA, 12 bp, Homo sapiens
gcccctgagccc

SEQ ID NO: 1899151 - DNA, 14 bp, Homo sapiens
gcccctgagcccac

SEQ ID NO: 1899152 - DNA, 23 bp, Homo sapiens
gcccctggcaaatgcacacacct

SEQ ID NO: 1899153 - DNA, 17 bp, Homo sapiens
gccccttgggcctccca

SEQ ID NO: 1899154 - DNA, 14 bp, Homo sapiens
gcccgatcctcccc

SEQ ID NO: 1899155 - DNA, 19 bp, Homo sapiens
gcccgcatcagctgctcag

SEQ ID NO: 1899156 - DNA, 23 bp, Homo sapiens
gccctagaagatcacagcagggc

SEQ ID NO: 1899157 - DNA, 17 bp, Homo sapiens
gccctatttcttgataa

SEQ ID NO: 1899158 - DNA, 12 bp, Homo sapiens
gccctcccaggc

SEQ ID NO: 1899159 - DNA, 14 bp, Homo sapiens
gccctcccaggcga

SEQ ID NO: 1899160 - DNA, 15 bp, Homo sapiens
gccctccgccccgtc

SEQ ID NO: 1899161 - DNA, 23 bp, Homo sapiens
gccctctctgaaggaggccacct

SEQ ID NO: 1899162 - DNA, 12 bp, Homo sapiens
gccctctgctct

SEQ ID NO: 1899163 - DNA, 15 bp, Homo sapiens
gccctgcctctccgc

SEQ ID NO: 1899164 - DNA, 18 bp, Homo sapiens
gccctgcctctccgcccc

SEQ ID NO: 1899165 - DNA, 14 bp, Homo sapiens
gccctggagctcaa

SEQ ID NO: 1899166 - DNA, 12 bp, Homo sapiens
gccctggcagcc

SEQ ID NO: 1899167 - DNA, 17 bp, Homo sapiens
gccctgggcctccacct

SEQ ID NO: 1899168 - DNA, 18 bp, Homo sapiens
gccctgggcctccacctc

SEQ ID NO: 1899169 - DNA, 20 bp, Homo sapiens
gccctgggcctccacctctg

SEQ ID NO: 1899170 - DNA, 14 bp, Homo sapiens
gccgcactgggagc

SEQ ID NO: 1899171 - DNA, 23 bp, Homo sapiens
gccgcatctcacagctatgcaaa

SEQ ID NO: 1899172 - DNA, 22 bp, Homo sapiens
gccgccggcaataaaagcccag

SEQ ID NO: 1899173 - DNA, 18 bp, Homo sapiens
gccggcaataaaagccca

SEQ ID NO: 1899174 - DNA, 15 bp, Homo sapiens
gccggccgcactggg

SEQ ID NO: 1899175 - DNA, 16 bp, Homo sapiens
gccggtgtgggggccc

SEQ ID NO: 1899176 - DNA, 20 bp, Homo sapiens
gccgtggccggggtccaggc

SEQ ID NO: 1899177 - DNA, 22 bp, Homo sapiens
gtcctattagtgttatatgaac

SEQ ID NO: 1899178 - DNA, 15 bp, Homo sapiens
gtccttgaagcttgt

SEQ ID NO: 1899179 - DNA, 13 bp, Homo sapiens
gtcctttctgaac

SEQ ID NO: 1899180 - DNA, 23 bp, Homo sapiens
gtcgttaaaaacagatttggaaa

SEQ ID NO: 1899181 - DNA, 20 bp, Homo sapiens
gtctaatcctagtttgctgt

SEQ ID NO: 1899182 - DNA, 14 bp, Homo sapiens
gtctagattttgaa

SEQ ID NO: 1899183 - DNA, 20 bp, Homo sapiens
gtctagattttgaaaaatta

SEQ ID NO: 1899184 - DNA, 13 bp, Homo sapiens
gtctatcttgtaa

SEQ ID NO: 1899185 - DNA, 18 bp, Homo sapiens
gtctcaccatttccccag

SEQ ID NO: 1899186 - DNA, 16 bp, Homo sapiens
gtctcccaccctttct

SEQ ID NO: 1899187 - DNA, 15 bp, Homo sapiens
gtctcgggggtgggc

SEQ ID NO: 1899188 - DNA, 19 bp, Homo sapiens
gtctctcacagacaggacc

SEQ ID NO: 1899189 - DNA, 23 bp, Homo sapiens
gtctctcacagacaggacccctg

SEQ ID NO: 1899190 - DNA, 16 bp, Homo sapiens
gtctctcccagctctg

SEQ ID NO: 1899191 - DNA, 14 bp, Homo sapiens
gtctgaaaagctgt

SEQ ID NO: 1899192 - DNA, 23 bp, Homo sapiens
gtctgacaaggtggtcaacaaca

SEQ ID NO: 1899193 - DNA, 18 bp, Homo sapiens
gtctgaggccgttgctga

SEQ ID NO: 1899194 - DNA, 21 bp, Homo sapiens
gtctgagggcttgtagttctt

SEQ ID NO: 1899195 - DNA, 14 bp, Homo sapiens
gtctgatattcaaa

SEQ ID NO: 1899196 - DNA, 16 bp, Homo sapiens
gtctggcacagcctgc

SEQ ID NO: 1899197 - DNA, 16 bp, Homo sapiens
gtctggccagggagga

SEQ ID NO: 1899198 - DNA, 17 bp, Homo sapiens
gtctggccagggaggag

SEQ ID NO: 1899199 - DNA, 18 bp, Homo sapiens
gtctgggtttggcaggca

SEQ ID NO: 1899200 - DNA, 13 bp, Homo sapiens
gtctgttgattaa

SEQ ID NO: 1899201 - DNA, 18 bp, Homo sapiens
gtctgttggcaaatttgt

SEQ ID NO: 1899202 - DNA, 18 bp, Homo sapiens
gtcttagatcatagtttt

SEQ ID NO: 1899203 - DNA, 19 bp, Homo sapiens
gtcttccttacctggaaaa

SEQ ID NO: 1899204 - DNA, 15 bp, Homo sapiens
gtctttctcactgcc

SEQ ID NO: 1899205 - DNA, 23 bp, Homo sapiens
gtcttttttggcctttgaggttt

SEQ ID NO: 1899206 - DNA, 12 bp, Homo sapiens
gtgaaaagaata

SEQ ID NO: 1899207 - DNA, 16 bp, Homo sapiens
gtgaaactcccaccct

SEQ ID NO: 1899208 - DNA, 18 bp, Homo sapiens
gtgaacatactaattcta

SEQ ID NO: 1899209 - DNA, 20 bp, Homo sapiens
gtgaacatgcctcctcctgc

SEQ ID NO: 1899210 - DNA, 23 bp, Homo sapiens
gtgaacatgcctcctcctgccct

SEQ ID NO: 1899211 - DNA, 18 bp, Homo sapiens
gtgaagatactttgtatt

SEQ ID NO: 1899212 - DNA, 22 bp, Homo sapiens
gtgaatgctgggcccctgctca

SEQ ID NO: 1899213 - DNA, 19 bp, Homo sapiens
gtgacatcacagggcctca

SEQ ID NO: 1899214 - DNA, 21 bp, Homo sapiens
gtgaccagttttgatatttat

SEQ ID NO: 1899215 - DNA, 23 bp, Homo sapiens
gtgacctcacacacctctgcccc

SEQ ID NO: 1899216 - DNA, 14 bp, Homo sapiens
gtgacgtttttcca

SEQ ID NO: 1899217 - DNA, 21 bp, Homo sapiens
gtgagaagacttccccaagcc

SEQ ID NO: 1899218 - DNA, 22 bp, Homo sapiens
gtgaggaaatcaaagtgctatt

SEQ ID NO: 1899219 - DNA, 12 bp, Homo sapiens
gtgaggccacac

SEQ ID NO: 1899220 - DNA, 18 bp, Homo sapiens
gtgaggccacacccagag

SEQ ID NO: 1899221 - DNA, 22 bp, Homo sapiens
gtgaggccacacccagagtagc

SEQ ID NO: 1899222 - DNA, 22 bp, Homo sapiens
gtgagtctgtgtggccagcagc

SEQ ID NO: 1899223 - DNA, 18 bp, Homo sapiens
gtgatataaaagctgcat

SEQ ID NO: 1899224 - DNA, 15 bp, Homo sapiens
gtgatgcgcagttgc

SEQ ID NO: 1899225 - DNA, 17 bp, Homo sapiens
gtgatgcgcagttgctg

SEQ ID NO: 1899226 - DNA, 12 bp, Homo sapiens
gtgcaaagccac

SEQ ID NO: 1899227 - DNA, 19 bp, Homo sapiens
gtgcaatgccccctcccct

SEQ ID NO: 1899228 - DNA, 14 bp, Homo sapiens
gtgcagggcacaga

SEQ ID NO: 1899229 - DNA, 11 bp, Homo sapiens
gtgcccagctt

SEQ ID NO: 1899230 - DNA, 17 bp, Homo sapiens
gtgcctttgcagctcag

SEQ ID NO: 1899231 - DNA, 17 bp, Homo sapiens
gtgctgccacctgcccc

SEQ ID NO: 1899232 - DNA, 16 bp, Homo sapiens
gtggaaagtgttcatt

SEQ ID NO: 1899233 - DNA, 21 bp, Homo sapiens
gtggaaattaagaagaaacta

SEQ ID NO: 1899234 - DNA, 18 bp, Homo sapiens
gtggagaatcacaggctg

SEQ ID NO: 1899235 - DNA, 20 bp, Homo sapiens
gtggagaatcacaggctggg

SEQ ID NO: 1899236 - DNA, 21 bp, Homo sapiens
gtggagcagaaggcaggacca

SEQ ID NO: 1899237 - DNA, 20 bp, Homo sapiens
gtggaggttgctggtacaca

SEQ ID NO: 1899238 - DNA, 20 bp, Homo sapiens
gtggccccttctatgcccag

SEQ ID NO: 1899239 - DNA, 23 bp, Homo sapiens
gtggctaaggtaagaacgtgctt

SEQ ID NO: 1899240 - DNA, 22 bp, Homo sapiens
gtgggatgagggagacagacca

SEQ ID NO: 1899241 - DNA, 22 bp, Homo sapiens
gtgggtgatttgataacaagtt

SEQ ID NO: 1899242 - DNA, 18 bp, Homo sapiens
gtggtccatctctgaaaa

SEQ ID NO: 1899243 - DNA, 23 bp, Homo sapiens
gtggtgacctcacacacctctgc

SEQ ID NO: 1899244 - DNA, 16 bp, Homo sapiens
gtggttgaatatgatt

SEQ ID NO: 1899245 - DNA, 18 bp, Homo sapiens
gtggttgaatatgattaa

SEQ ID NO: 1899246 - DNA, 12 bp, Homo sapiens
gtgtatatttga

SEQ ID NO: 1899247 - DNA, 17 bp, Homo sapiens
gtgtattgtaatgtata

SEQ ID NO: 1899248 - DNA, 20 bp, Homo sapiens
gtgtctcctgtttcagacca

SEQ ID NO: 1899249 - DNA, 14 bp, Homo sapiens
gtgtgaatgctggg

SEQ ID NO: 1899250 - DNA, 20 bp, Homo sapiens
gtgtgaatgctgggcccctg

SEQ ID NO: 1899251 - DNA, 13 bp, Homo sapiens
gtgtgaggccaca

SEQ ID NO: 1899252 - DNA, 13 bp, Homo sapiens
gtgtgcccagctt

SEQ ID NO: 1899253 - DNA, 16 bp, Homo sapiens
gtgtgcccccagattt

SEQ ID NO: 1899254 - DNA, 17 bp, Homo sapiens
gtgtggagtcatttctg

SEQ ID NO: 1899255 - DNA, 23 bp, Homo sapiens
gtgtggccagcagcctctgatct

SEQ ID NO: 1899256 - DNA, 14 bp, Homo sapiens
gtgtgggggccccg

SEQ ID NO: 1899257 - DNA, 19 bp, Homo sapiens
gtgtgggggccccgtctca

SEQ ID NO: 1899258 - DNA, 13 bp, Homo sapiens
gtgtgtaaagtaa

SEQ ID NO: 1899259 - DNA, 13 bp, Homo sapiens
gtgtgtagggggg

SEQ ID NO: 1899260 - DNA, 19 bp, Homo sapiens
gtgtgttacaatgtaactt

SEQ ID NO: 1899261 - DNA, 14 bp, Homo sapiens
gtgttaaaattttt

SEQ ID NO: 1899262 - DNA, 20 bp, Homo sapiens
gtgttaaaattttttgagtg

SEQ ID NO: 1899263 - DNA, 16 bp, Homo sapiens
gtgttaatttaagttt

SEQ ID NO: 1899264 - DNA, 17 bp, Homo sapiens
gtgttgcagctgtcacc

SEQ ID NO: 1899265 - DNA, 12 bp, Homo sapiens
gtgttttggtcc

SEQ ID NO: 1899266 - DNA, 16 bp, Homo sapiens
gttaaaaacactgctg

SEQ ID NO: 1899267 - DNA, 20 bp, Homo sapiens
gttaaaaacagatttggaaa

SEQ ID NO: 1899268 - DNA, 19 bp, Homo sapiens
gttaactgttccccttggt

SEQ ID NO: 1899269 - DNA, 16 bp, Homo sapiens
gttaactttttgtagg

SEQ ID NO: 1899270 - DNA, 17 bp, Homo sapiens
gttacactttttggaag

SEQ ID NO: 1899271 - DNA, 14 bp, Homo sapiens
gttagactgccagc

SEQ ID NO: 1899272 - DNA, 15 bp, Homo sapiens
gttagactgccagct

SEQ ID NO: 1899273 - DNA, 13 bp, Homo sapiens
gttagattaagaa

SEQ ID NO: 1899274 - DNA, 14 bp, Homo sapiens
gttatgtgagaaca

SEQ ID NO: 1899275 - DNA, 18 bp, Homo sapiens
gttattttgatgtaaaga

SEQ ID NO: 1899276 - DNA, 12 bp, Homo sapiens
gttcaaatgtgt

SEQ ID NO: 1899277 - DNA, 14 bp, Homo sapiens
gttccacagaggac

SEQ ID NO: 1899278 - DNA, 12 bp, Homo sapiens
gttccactgaga

SEQ ID NO: 1899279 - DNA, 14 bp, Homo sapiens
gttccactgagacc

SEQ ID NO: 1899280 - DNA, 18 bp, Homo sapiens
gttccccctgtttcagag

SEQ ID NO: 1899281 - DNA, 24 bp, Homo sapiens
gttcccctggaagcagtgcccagg

SEQ ID NO: 1899282 - DNA, 23 bp, Homo sapiens
gttcctagtgatggcttatgata

SEQ ID NO: 1899283 - DNA, 14 bp, Homo sapiens
gttctaaaatataa

SEQ ID NO: 1899284 - DNA, 16 bp, Homo sapiens
gttctaaaatataata

SEQ ID NO: 1899285 - DNA, 12 bp, Homo sapiens
gttctaacttct

SEQ ID NO: 1899286 - DNA, 15 bp, Homo sapiens
gttctgactttgaat

SEQ ID NO: 1899287 - DNA, 12 bp, Homo sapiens
gttctgtatttg

SEQ ID NO: 1899288 - DNA, 14 bp, Homo sapiens
gttctgtatttgaa

SEQ ID NO: 1899289 - DNA, 19 bp, Homo sapiens
gttgacatcactggcatgg

SEQ ID NO: 1899290 - DNA, 12 bp, Homo sapiens
gttgagctatga

SEQ ID NO: 1899291 - DNA, 17 bp, Homo sapiens
gttgataaggaacattt

SEQ ID NO: 1899292 - DNA, 22 bp, Homo sapiens
gttgatgggatgattgaagaaa

SEQ ID NO: 1899293 - DNA, 14 bp, Homo sapiens
gttgcagctgtcac

SEQ ID NO: 1899294 - DNA, 17 bp, Homo sapiens
gttgctgtcagtcttga

SEQ ID NO: 1899295 - DNA, 15 bp, Homo sapiens
gttggactctgagct

SEQ ID NO: 1899296 - DNA, 22 bp, Homo sapiens
gttgggacccagtggcagggca

SEQ ID NO: 1899297 - DNA, 21 bp, Homo sapiens
gttgtataaatttatttactg

SEQ ID NO: 1899298 - DNA, 21 bp, Homo sapiens
gttgttcttggcaataaattt

SEQ ID NO: 1899299 - DNA, 22 bp, Homo sapiens
gttgtttgatgcattaaaagaa

SEQ ID NO: 1899300 - DNA, 16 bp, Homo sapiens
gtttaaaaatctgcca

SEQ ID NO: 1899301 - DNA, 14 bp, Homo sapiens
gtttacctgcaccg

SEQ ID NO: 1899302 - DNA, 17 bp, Homo sapiens
gtttactcacagccagc

SEQ ID NO: 1899303 - DNA, 19 bp, Homo sapiens
gtttacttctgggcaattt

SEQ ID NO: 1899304 - DNA, 15 bp, Homo sapiens
gtttagaacaggttt

SEQ ID NO: 1899305 - DNA, 16 bp, Homo sapiens
gtttagaattgaaggt

SEQ ID NO: 1899306 - DNA, 22 bp, Homo sapiens
gtttagatttgccatagagtac

SEQ ID NO: 1899307 - DNA, 14 bp, Homo sapiens
gtttcagaccagcc

SEQ ID NO: 1899308 - DNA, 13 bp, Homo sapiens
gtttccctccagg

SEQ ID NO: 1899309 - DNA, 22 bp, Homo sapiens
tcaaatccaggaccctgccagg

SEQ ID NO: 1899310 - DNA, 15 bp, Homo sapiens
tcaaatgtaaagttt

SEQ ID NO: 1899311 - DNA, 18 bp, Homo sapiens
tcaaatgtgttttggtcc

SEQ ID NO: 1899312 - DNA, 10 bp, Homo sapiens
tcaaattaat

SEQ ID NO: 1899313 - DNA, 17 bp, Homo sapiens
tcaaattaattgtgtga

SEQ ID NO: 1899314 - DNA, 14 bp, Homo sapiens
tcaaccacaaaact

SEQ ID NO: 1899315 - DNA, 18 bp, Homo sapiens
tcaacctttagtacgtgt

SEQ ID NO: 1899316 - DNA, 14 bp, Homo sapiens
tcaagaaatgaaga

SEQ ID NO: 1899317 - DNA, 21 bp, Homo sapiens
tcaagaaatgaagagctgttg

SEQ ID NO: 1899318 - DNA, 19 bp, Homo sapiens
tcaagaatagcattgtaaa

SEQ ID NO: 1899319 - DNA, 15 bp, Homo sapiens
tcaagagccttaaaa

SEQ ID NO: 1899320 - DNA, 19 bp, Homo sapiens
tcaagagccttaaaacatc

SEQ ID NO: 1899321 - DNA, 21 bp, Homo sapiens
tcaagagccttaaaacatcat

SEQ ID NO: 1899322 - DNA, 22 bp, Homo sapiens
tcaagaggacaatctagctctc

SEQ ID NO: 1899323 - DNA, 19 bp, Homo sapiens
tcaagatcaaaaaggctta

SEQ ID NO: 1899324 - DNA, 13 bp, Homo sapiens
tcaagccgtggcc

SEQ ID NO: 1899325 - DNA, 15 bp, Homo sapiens
tcaagccgtggccgg

SEQ ID NO: 1899326 - DNA, 15 bp, Homo sapiens
tcaagcgattctctt

SEQ ID NO: 1899327 - DNA, 21 bp, Homo sapiens
tcaagctggaaaggccagcag

SEQ ID NO: 1899328 - DNA, 17 bp, Homo sapiens
tcaaggtaaaatgtagc

SEQ ID NO: 1899329 - DNA, 21 bp, Homo sapiens
tcaagtctaccctgatcacct

SEQ ID NO: 1899330 - DNA, 15 bp, Homo sapiens
tcaagtgcaatgccc

SEQ ID NO: 1899331 - DNA, 20 bp, Homo sapiens
tcaagtgcaatgccccctcc

SEQ ID NO: 1899332 - DNA, 20 bp, Homo sapiens
tcaataaaagcctttgaaaa

SEQ ID NO: 1899333 - DNA, 15 bp, Homo sapiens
tcaataaaggaaata

SEQ ID NO: 1899334 - DNA, 15 bp, Homo sapiens
tcaataaatttgctt

SEQ ID NO: 1899335 - DNA, 23 bp, Homo sapiens
tcaatagcccaggatatatttta

SEQ ID NO: 1899336 - DNA, 15 bp, Homo sapiens
tcaatataaaaacat

SEQ ID NO: 1899337 - DNA, 15 bp, Homo sapiens
tcaatgctgtttggg

SEQ ID NO: 1899338 - DNA, 20 bp, Homo sapiens
tcaatttttggttgaataaa

SEQ ID NO: 1899339 - DNA, 11 bp, Homo sapiens
tcacaaatgac

SEQ ID NO: 1899340 - DNA, 12 bp, Homo sapiens
tcacaaatgact

SEQ ID NO: 1899341 - DNA, 13 bp, Homo sapiens
tcacaaatgactt

SEQ ID NO: 1899342 - DNA, 14 bp, Homo sapiens
tcacaaatgacttt

SEQ ID NO: 1899343 - DNA, 18 bp, Homo sapiens
tcacaaatgactttatta

SEQ ID NO: 1899344 - DNA, 20 bp, Homo sapiens
tcacaaatgactttattatt

SEQ ID NO: 1899345 - DNA, 13 bp, Homo sapiens
tcacaataaagag

SEQ ID NO: 1899346 - DNA, 14 bp, Homo sapiens
tcacacacctctgc

SEQ ID NO: 1899347 - DNA, 11 bp, Homo sapiens
tcacagacagg

SEQ ID NO: 1899348 - DNA, 21 bp, Homo sapiens
tcacagacaggacccctgcag

SEQ ID NO: 1899349 - DNA, 23 bp, Homo sapiens
tcacagcagggccttctgcctgc

SEQ ID NO: 1899350 - DNA, 17 bp, Homo sapiens
tcacagggcctcagttt

SEQ ID NO: 1899351 - DNA, 16 bp, Homo sapiens
tcacagtgtgattttg

SEQ ID NO: 1899352 - DNA, 14 bp, Homo sapiens
tcacatatctgctt

SEQ ID NO: 1899353 - DNA, 17 bp, Homo sapiens
tcacatggctctcatgt

SEQ ID NO: 1899354 - DNA, 18 bp, Homo sapiens
tcaccaagtgtattgtaa

SEQ ID NO: 1899355 - DNA, 16 bp, Homo sapiens
tcaccatttccccagg

SEQ ID NO: 1899356 - DNA, 16 bp, Homo sapiens
tcacccaccagacttt

SEQ ID NO: 1899357 - DNA, 17 bp, Homo sapiens
tcacgaaactggaataa

SEQ ID NO: 1899358 - DNA, 16 bp, Homo sapiens
tcacgctcctttctga

SEQ ID NO: 1899359 - DNA, 21 bp, Homo sapiens
tcactccaaaccttactctga

SEQ ID NO: 1899360 - DNA, 23 bp, Homo sapiens
tcactccaaaccttactctgagc

SEQ ID NO: 1899361 - DNA, 12 bp, Homo sapiens
tcactctcagga

SEQ ID NO: 1899362 - DNA, 14 bp, Homo sapiens
tcactctcttcctt

SEQ ID NO: 1899363 - DNA, 18 bp, Homo sapiens
tcactctcttcctttcat

SEQ ID NO: 1899364 - DNA, 18 bp, Homo sapiens
tcactgaaataaaagcta

SEQ ID NO: 1899365 - DNA, 16 bp, Homo sapiens
tcactgtggtgtctgt

SEQ ID NO: 1899366 - DNA, 17 bp, Homo sapiens
tcactgtgtatatttga

SEQ ID NO: 1899367 - DNA, 21 bp, Homo sapiens
tcactgtgtatatttgattta

SEQ ID NO: 1899368 - DNA, 15 bp, Homo sapiens
tcactgtttagattt

SEQ ID NO: 1899369 - DNA, 21 bp, Homo sapiens
tcactgtttagatttgccata

SEQ ID NO: 1899370 - DNA, 13 bp, Homo sapiens
tcacttaaaacac

SEQ ID NO: 1899371 - DNA, 16 bp, Homo sapiens
tcactttgacaggttc

SEQ ID NO: 1899372 - DNA, 18 bp, Homo sapiens
tcagaaatccttgtattt

SEQ ID NO: 1899373 - DNA, 16 bp, Homo sapiens
tcagaacagctgttga

SEQ ID NO: 1899374 - DNA, 24 bp, Homo sapiens
tcagaggccctcctgtgctggtga

SEQ ID NO: 1899375 - DNA, 13 bp, Homo sapiens
tcagatagcagga

SEQ ID NO: 1899376 - DNA, 15 bp, Homo sapiens
tcagatgtttaaaac

SEQ ID NO: 1899377 - DNA, 12 bp, Homo sapiens
tcagcactggat

SEQ ID NO: 1899378 - DNA, 17 bp, Homo sapiens
tcagcagttgctggtaa

SEQ ID NO: 1899379 - DNA, 18 bp, Homo sapiens
tcagcagttgctggtaaa

SEQ ID NO: 1899380 - DNA, 22 bp, Homo sapiens
tcagcagttgctggtaaaatga

SEQ ID NO: 1899381 - DNA, 23 bp, Homo sapiens
tcagcagttgctggtaaaatgaa

SEQ ID NO: 1899382 - DNA, 20 bp, Homo sapiens
tcagcattacctctttggaa

SEQ ID NO: 1899383 - DNA, 17 bp, Homo sapiens
tcagcattagtgggaaa

SEQ ID NO: 1899384 - DNA, 19 bp, Homo sapiens
tcagccaccctttctggca

SEQ ID NO: 1899385 - DNA, 17 bp, Homo sapiens
tcagccctctcttgcca

SEQ ID NO: 1899386 - DNA, 12 bp, Homo sapiens
tcagcctccctg

SEQ ID NO: 1899387 - DNA, 13 bp, Homo sapiens
tcagcctccctga

SEQ ID NO: 1899388 - DNA, 23 bp, Homo sapiens
tcagcctccctgacgtctgccac

SEQ ID NO: 1899389 - DNA, 19 bp, Homo sapiens
tcagcttctataagtgtga

SEQ ID NO: 1899390 - DNA, 14 bp, Homo sapiens
tcaggctgagctga

SEQ ID NO: 1899391 - DNA, 15 bp, Homo sapiens
tcagggcataaagca

SEQ ID NO: 1899392 - DNA, 15 bp, Homo sapiens
tcagggtgtgaggcc

SEQ ID NO: 1899393 - DNA, 13 bp, Homo sapiens
tcaggtcccagtt

SEQ ID NO: 1899394 - DNA, 19 bp, Homo sapiens
tcaggtcccagttgctgtc

SEQ ID NO: 1899395 - DNA, 21 bp, Homo sapiens
tcaggtcccagttgctgtcac

SEQ ID NO: 1899396 - DNA, 16 bp, Homo sapiens
tcagtgatgtgcctaa

SEQ ID NO: 1899397 - DNA, 17 bp, Homo sapiens
tcagtttccctatctgc

SEQ ID NO: 1899398 - DNA, 16 bp, Homo sapiens
tcataagatattttat

SEQ ID NO: 1899399 - DNA, 15 bp, Homo sapiens
tcataagctttgtaa

SEQ ID NO: 1899400 - DNA, 20 bp, Homo sapiens
tcataaggagacttctgtct

SEQ ID NO: 1899401 - DNA, 21 bp, Homo sapiens
tcataataaatagacacttga

SEQ ID NO: 1899402 - DNA, 23 bp, Homo sapiens
tcatacacaacgtaatcaaatat

SEQ ID NO: 1899403 - DNA, 14 bp, Homo sapiens
tcatactgatgtgt

SEQ ID NO: 1899404 - DNA, 20 bp, Homo sapiens
tcatagtgatagagtgcagt

SEQ ID NO: 1899405 - DNA, 18 bp, Homo sapiens
tcatatcccctatttaac

SEQ ID NO: 1899406 - DNA, 22 bp, Homo sapiens
tcatcccaccctctcacagttc

SEQ ID NO: 1899407 - DNA, 12 bp, Homo sapiens
tcatctcaagct

SEQ ID NO: 1899408 - DNA, 22 bp, Homo sapiens
tcatctctagggaccagaacca

SEQ ID NO: 1899409 - DNA, 13 bp, Homo sapiens
tcatctgagaatg

SEQ ID NO: 1899410 - DNA, 14 bp, Homo sapiens
tcatctggagttct

SEQ ID NO: 1899411 - DNA, 19 bp, Homo sapiens
tcatggctcttagaaactc

SEQ ID NO: 1899412 - DNA, 19 bp, Homo sapiens
tcatgtaaaaagtgcagta

SEQ ID NO: 1899413 - DNA, 23 bp, Homo sapiens
tcatgtcaaatatttagatgtaa

SEQ ID NO: 1899414 - DNA, 14 bp, Homo sapiens
tcattcagcatctg

SEQ ID NO: 1899415 - DNA, 23 bp, Homo sapiens
tcattcgctactatgatttaatt

SEQ ID NO: 1899416 - DNA, 22 bp, Homo sapiens
tcattgcaaacaactgaaatgt

SEQ ID NO: 1899417 - DNA, 18 bp, Homo sapiens
tcattgcacaatatattt

SEQ ID NO: 1899418 - DNA, 14 bp, Homo sapiens
tcattgtgtaagga

SEQ ID NO: 1899419 - DNA, 19 bp, Homo sapiens
tcatttcaaaatatgtgta

SEQ ID NO: 1899420 - DNA, 16 bp, Homo sapiens
tcatttctagagaaaa

SEQ ID NO: 1899421 - DNA, 14 bp, Homo sapiens
tcatttgctttgga

SEQ ID NO: 1899422 - DNA, 13 bp, Homo sapiens
tcattttctttcc

SEQ ID NO: 1899423 - DNA, 17 bp, Homo sapiens
tcattttctttcctttc

SEQ ID NO: 1899424 - DNA, 17 bp, Homo sapiens
tccaaactggaatgagc

SEQ ID NO: 1899425 - DNA, 20 bp, Homo sapiens
tccaaataatatgtttcctt

SEQ ID NO: 1899426 - DNA, 23 bp, Homo sapiens
tccaaattgtttaaattcacaat

SEQ ID NO: 1899427 - DNA, 21 bp, Homo sapiens
tccaagccgtaggacccagtt

SEQ ID NO: 1899428 - DNA, 18 bp, Homo sapiens
tccaaggccaggccttgg

SEQ ID NO: 1899429 - DNA, 17 bp, Homo sapiens
tccacagaggacacaga

SEQ ID NO: 1899430 - DNA, 24 bp, Homo sapiens
tccacatgggtactgtctcggcag

SEQ ID NO: 1899431 - DNA, 14 bp, Homo sapiens
tccacctctgtgca

SEQ ID NO: 1899432 - DNA, 19 bp, Homo sapiens
tccacctctgtgcagggca

SEQ ID NO: 1899433 - DNA, 23 bp, Homo sapiens
tccagaaggagcaggccctgggc

SEQ ID NO: 1899434 - DNA, 22 bp, Homo sapiens
tccagcaggagggacagtctca

SEQ ID NO: 1899435 - DNA, 13 bp, Homo sapiens
tccagcatgtaaa

SEQ ID NO: 1899436 - DNA, 15 bp, Homo sapiens
tccagctccctcccc

SEQ ID NO: 1899437 - DNA, 20 bp, Homo sapiens
tccagctccctcccctgctc

SEQ ID NO: 1899438 - DNA, 17 bp, Homo sapiens
tccaggaccctgccagg

SEQ ID NO: 1899439 - DNA, 18 bp, Homo sapiens
tccaggaccctgccaggc

SEQ ID NO: 1899440 - DNA, 17 bp, Homo sapiens
tccagtaagatcactgt

SEQ ID NO: 1899441 - DNA, 18 bp, Homo sapiens
tgctggtaaaatgaagaa

SEQ ID NO: 1899442 - DNA, 19 bp, Homo sapiens
tgctggtaaaatgaagaat

SEQ ID NO: 1899443 - DNA, 18 bp, Homo sapiens
tgctgtcagtcttgacct

SEQ ID NO: 1899444 - DNA, 19 bp, Homo sapiens
tgctgtctggcacagcctg

SEQ ID NO: 1899445 - DNA, 19 bp, Homo sapiens
tgctgtgaacatgcctcct

SEQ ID NO: 1899446 - DNA, 20 bp, Homo sapiens
tgctgtgaacatgcctcctc

SEQ ID NO: 1899447 - DNA, 14 bp, Homo sapiens
tgctgtggccttcc

SEQ ID NO: 1899448 - DNA, 16 bp, Homo sapiens
tgcttactgtgttaaa

SEQ ID NO: 1899449 - DNA, 22 bp, Homo sapiens
tgcttataaacatttaaagaca

SEQ ID NO: 1899450 - DNA, 16 bp, Homo sapiens
tgcttatcagtgtgca

SEQ ID NO: 1899451 - DNA, 16 bp, Homo sapiens
tgcttcagtgaacata

SEQ ID NO: 1899452 - DNA, 20 bp, Homo sapiens
tgcttgaataaacaccactg

SEQ ID NO: 1899453 - DNA, 13 bp, Homo sapiens
tgcttgttttaca

SEQ ID NO: 1899454 - DNA, 14 bp, Homo sapiens
tgctttagacttga

SEQ ID NO: 1899455 - DNA, 15 bp, Homo sapiens
tgctttagacttgaa

SEQ ID NO: 1899456 - DNA, 16 bp, Homo sapiens
tgctttagacttgaaa

SEQ ID NO: 1899457 - DNA, 19 bp, Homo sapiens
tgctttagacttgaaaaga

SEQ ID NO: 1899458 - DNA, 21 bp, Homo sapiens
tgctttagacttgaaaagaga

SEQ ID NO: 1899459 - DNA, 13 bp, Homo sapiens
tgctttcctttcc

SEQ ID NO: 1899460 - DNA, 22 bp, Homo sapiens
tggaaaggccagcagccttcca

SEQ ID NO: 1899461 - DNA, 18 bp, Homo sapiens
tggaaagtgttcattgca

SEQ ID NO: 1899462 - DNA, 17 bp, Homo sapiens
tggaaatcaaatgtaaa

SEQ ID NO: 1899463 - DNA, 19 bp, Homo sapiens
tggaaatcaaatgtaaagt

SEQ ID NO: 1899464 - DNA, 16 bp, Homo sapiens
tggaaattgaaataaa

SEQ ID NO: 1899465 - DNA, 22 bp, Homo sapiens
tggaacacctaccaaaaaataa

SEQ ID NO: 1899466 - DNA, 22 bp, Homo sapiens
tggaacccccagcccagcagac

SEQ ID NO: 1899467 - DNA, 17 bp, Homo sapiens
tggaactgctgctgacc

SEQ ID NO: 1899468 - DNA, 17 bp, Homo sapiens
tggaagagaagagaaag

SEQ ID NO: 1899469 - DNA, 14 bp, Homo sapiens
tggaagcagtgccc

SEQ ID NO: 1899470 - DNA, 18 bp, Homo sapiens
tggaagcagtgcccaggt

SEQ ID NO: 1899471 - DNA, 19 bp, Homo sapiens
tggaagcagtgcccaggtg

SEQ ID NO: 1899472 - DNA, 20 bp, Homo sapiens
tggaagcagtgcccaggtgg

SEQ ID NO: 1899473 - DNA, 19 bp, Homo sapiens
tggaagtgaaaactttgta

SEQ ID NO: 1899474 - DNA, 19 bp, Homo sapiens
tggaagtgatgtatgttat

SEQ ID NO: 1899475 - DNA, 14 bp, Homo sapiens
tggaataagccttc

SEQ ID NO: 1899476 - DNA, 23 bp, Homo sapiens
tggaataagccttcgaaaagaaa

SEQ ID NO: 1899477 - DNA, 18 bp, Homo sapiens
tggaatttttttgtacga

SEQ ID NO: 1899478 - DNA, 22 bp, Homo sapiens
tggaccatgctgtctggcacag

SEQ ID NO: 1899479 - DNA, 23 bp, Homo sapiens
tggagaaaaatatctgtaagagt

SEQ ID NO: 1899480 - DNA, 19 bp, Homo sapiens
tggagaatcacaggctggg

SEQ ID NO: 1899481 - DNA, 20 bp, Homo sapiens
tggagaatcacaggctgggc

SEQ ID NO: 1899482 - DNA, 22 bp, Homo sapiens
tggagactgctcctgagccccc

SEQ ID NO: 1899483 - DNA, 23 bp, Homo sapiens
tggagactgctcctgagccccca

SEQ ID NO: 1899484 - DNA, 15 bp, Homo sapiens
tggagaggagccctg

SEQ ID NO: 1899485 - DNA, 17 bp, Homo sapiens
tggagaggagccctgcc

SEQ ID NO: 1899486 - DNA, 20 bp, Homo sapiens
tggagcctgcggggcagcag

SEQ ID NO: 1899487 - DNA, 15 bp, Homo sapiens
tggagggcctgggcc

SEQ ID NO: 1899488 - DNA, 16 bp, Homo sapiens
tggagtcatttctgat

SEQ ID NO: 1899489 - DNA, 17 bp, Homo sapiens
tggagtcatttctgatt

SEQ ID NO: 1899490 - DNA, 13 bp, Homo sapiens
tggagtctctctc

SEQ ID NO: 1899491 - DNA, 15 bp, Homo sapiens
tggagtctgggctcc

SEQ ID NO: 1899492 - DNA, 15 bp, Homo sapiens
tggataccattatat

SEQ ID NO: 1899493 - DNA, 21 bp, Homo sapiens
tggatgtgattgcctcaataa

SEQ ID NO: 1899494 - DNA, 21 bp, Homo sapiens
tggatgtttttagttctgact

SEQ ID NO: 1899495 - DNA, 17 bp, Homo sapiens
tggattcctccccaccc

SEQ ID NO: 1899496 - DNA, 22 bp, Homo sapiens
tggattcctccccaccctgtcc

SEQ ID NO: 1899497 - DNA, 14 bp, Homo sapiens
tggattgtagaact

SEQ ID NO: 1899498 - DNA, 19 bp, Homo sapiens
tggcaaatttgtgaactgt

SEQ ID NO: 1899499 - DNA, 18 bp, Homo sapiens
tggcaataaattttgaaa

SEQ ID NO: 1899500 - DNA, 20 bp, Homo sapiens
tggcaataaattttgaaaag

SEQ ID NO: 1899501 - DNA, 17 bp, Homo sapiens
tggcaatggtagtttct

SEQ ID NO: 1899502 - DNA, 19 bp, Homo sapiens
tggcaatggtagtttctgt

SEQ ID NO: 1899503 - DNA, 14 bp, Homo sapiens
tggcacagcctgca

SEQ ID NO: 1899504 - DNA, 14 bp, Homo sapiens
tggcacctgggttg

SEQ ID NO: 1899505 - DNA, 13 bp, Homo sapiens
tggcagcaggagg

SEQ ID NO: 1899506 - DNA, 15 bp, Homo sapiens
tggcagcaggaggga

SEQ ID NO: 1899507 - DNA, 17 bp, Homo sapiens
tggcagcaggagggact

SEQ ID NO: 1899508 - DNA, 14 bp, Homo sapiens
tggcagggcacagg

SEQ ID NO: 1899509 - DNA, 13 bp, Homo sapiens
tggcagtggctgt

SEQ ID NO: 1899510 - DNA, 14 bp, Homo sapiens
tggcagtggctgtg

SEQ ID NO: 1899511 - DNA, 21 bp, Homo sapiens
tggcagtggctgtgaaggagt

SEQ ID NO: 1899512 - DNA, 17 bp, Homo sapiens
tggccaattaaggcatc

SEQ ID NO: 1899513 - DNA, 20 bp, Homo sapiens
tggccacatcctcatggccc

SEQ ID NO: 1899514 - DNA, 14 bp, Homo sapiens
tggccagccaccac

SEQ ID NO: 1899515 - DNA, 22 bp, Homo sapiens
tggccaggaagtagcacaggct

SEQ ID NO: 1899516 - DNA, 16 bp, Homo sapiens
tggccccacctggccc

SEQ ID NO: 1899517 - DNA, 19 bp, Homo sapiens
tggccccacctggccctct

SEQ ID NO: 1899518 - DNA, 14 bp, Homo sapiens
tggccctggcagcc

SEQ ID NO: 1899519 - DNA, 19 bp, Homo sapiens
tggccggaaaacaagcctg

SEQ ID NO: 1899520 - DNA, 19 bp, Homo sapiens
tggcgggccctggagctca

SEQ ID NO: 1899521 - DNA, 19 bp, Homo sapiens
tggctccctcactctcagg

SEQ ID NO: 1899522 - DNA, 20 bp, Homo sapiens
tggctccctcactctcagga

SEQ ID NO: 1899523 - DNA, 15 bp, Homo sapiens
tggctgacctgacct

SEQ ID NO: 1899524 - DNA, 13 bp, Homo sapiens
tggcttacactgg

SEQ ID NO: 1899525 - DNA, 14 bp, Homo sapiens
tggcttcctctgct

SEQ ID NO: 1899526 - DNA, 20 bp, Homo sapiens
tggcttcctctgctgcatcc

SEQ ID NO: 1899527 - DNA, 22 bp, Homo sapiens
tggcttcctctgctgcatcccc

SEQ ID NO: 1899528 - DNA, 12 bp, Homo sapiens
tggcttctccca

SEQ ID NO: 1899529 - DNA, 13 bp, Homo sapiens
tggcttggccctg

SEQ ID NO: 1899530 - DNA, 19 bp, Homo sapiens
tggcttggccctggcagcc

SEQ ID NO: 1899531 - DNA, 21 bp, Homo sapiens
tgggaaagaaggcaaagtccc

SEQ ID NO: 1899532 - DNA, 18 bp, Homo sapiens
tgggacccagtggcaggg

SEQ ID NO: 1899533 - DNA, 15 bp, Homo sapiens
tgggactgctgtgaa

SEQ ID NO: 1899534 - DNA, 18 bp, Homo sapiens
tgggaggtcccagggccc

SEQ ID NO: 1899535 - DNA, 19 bp, Homo sapiens
tgggaggtcccagggccct

SEQ ID NO: 1899536 - DNA, 18 bp, Homo sapiens
tgggcactgctctcacct

SEQ ID NO: 1899537 - DNA, 20 bp, Homo sapiens
tgggcagcttgggctggcgg

SEQ ID NO: 1899538 - DNA, 14 bp, Homo sapiens
tgggcaggagactg

SEQ ID NO: 1899539 - DNA, 14 bp, Homo sapiens
tgggcccctgctca

SEQ ID NO: 1899540 - DNA, 21 bp, Homo sapiens
tgggcctccacctctgtgcag

SEQ ID NO: 1899541 - DNA, 18 bp, Homo sapiens
tgggcctcccactcccat

SEQ ID NO: 1899542 - DNA, 22 bp, Homo sapiens
tgggcctcccactcccatggct

SEQ ID NO: 1899543 - DNA, 19 bp, Homo sapiens
tgggcctggctccctcact

SEQ ID NO: 1899544 - DNA, 13 bp, Homo sapiens
tgggcggtccaga

SEQ ID NO: 1899545 - DNA, 15 bp, Homo sapiens
tgggctggcgggccc

SEQ ID NO: 1899546 - DNA, 12 bp, Homo sapiens
tgggctgggcac

SEQ ID NO: 1899547 - DNA, 18 bp, Homo sapiens
tggggctggcaccagcag

SEQ ID NO: 1899548 - DNA, 16 bp, Homo sapiens
tggggctgggggatgg

SEQ ID NO: 1899549 - DNA, 19 bp, Homo sapiens
tgggggacactgtggcagc

SEQ ID NO: 1899550 - DNA, 16 bp, Homo sapiens
tgggggatgggcctga

SEQ ID NO: 1899551 - DNA, 19 bp, Homo sapiens
tgggggccccgtctcaggt

SEQ ID NO: 1899552 - DNA, 17 bp, Homo sapiens
tgggggctcagcaaggc

SEQ ID NO: 1899553 - DNA, 15 bp, Homo sapiens
tgggggctgcagggc

SEQ ID NO: 1899554 - DNA, 18 bp, Homo sapiens
tgggggctgcagggctgg

SEQ ID NO: 1899555 - DNA, 21 bp, Homo sapiens
tgggggctgcagggctgggtc

SEQ ID NO: 1899556 - DNA, 21 bp, Homo sapiens
tggggggaacgcccacttccc

SEQ ID NO: 1899557 - DNA, 21 bp, Homo sapiens
tggggtctctcacagacagga

SEQ ID NO: 1899558 - DNA, 15 bp, Homo sapiens
tggggtgtgtgcagg

SEQ ID NO: 1899559 - DNA, 20 bp, Homo sapiens
tgggtactgtctcggcagag

SEQ ID NO: 1899560 - DNA, 23 bp, Homo sapiens
tgggtactttctgaaaatttata

SEQ ID NO: 1899561 - DNA, 13 bp, Homo sapiens
tgggtagctgtaa

SEQ ID NO: 1899562 - DNA, 17 bp, Homo sapiens
tgggtcagggtgtgagg

SEQ ID NO: 1899563 - DNA, 20 bp, Homo sapiens
tgggtcagggtgtgaggcca

SEQ ID NO: 1899564 - DNA, 19 bp, Homo sapiens
tggtaaaatgaagaattta

SEQ ID NO: 1899565 - DNA, 21 bp, Homo sapiens
tggtaacattttgacaactga

SEQ ID NO: 1899566 - DNA, 15 bp, Homo sapiens
tggtagcaaattttg

SEQ ID NO: 1899567 - DNA, 16 bp, Homo sapiens
tggtatttgtttaata

SEQ ID NO: 1899568 - DNA, 22 bp, Homo sapiens
tggtcagagagggaagctgagg

SEQ ID NO: 1899569 - DNA, 16 bp, Homo sapiens
tggtccatctctgaaa

SEQ ID NO: 1899570 - DNA, 17 bp, Homo sapiens
tggtccatctctgaaaa

SEQ ID NO: 1899571 - DNA, 18 bp, Homo sapiens
tggtctctcccagctctg

SEQ ID NO: 1899572 - DNA, 13 bp, Homo sapiens
tggtcttatattt

SEQ ID NO: 1899573 - DNA, 14 bp, Homo sapiens
ttgatttattaact

SEQ ID NO: 1899574 - DNA, 15 bp, Homo sapiens
ttgatttattaactt

SEQ ID NO: 1899575 - DNA, 17 bp, Homo sapiens
ttgatttattaacttaa

SEQ ID NO: 1899576 - DNA, 21 bp, Homo sapiens
ttgatttattaacttaataat

SEQ ID NO: 1899577 - DNA, 19 bp, Homo sapiens
ttgatttttttttttaatc

SEQ ID NO: 1899578 - DNA, 16 bp, Homo sapiens
ttgcaagcctcctgat

SEQ ID NO: 1899579 - DNA, 22 bp, Homo sapiens
ttgcaagggcggcctttcccac

SEQ ID NO: 1899580 - DNA, 18 bp, Homo sapiens
ttgcagcctcaaccaaca

SEQ ID NO: 1899581 - DNA, 23 bp, Homo sapiens
ttgcaggagcagtatcatgaagc

SEQ ID NO: 1899582 - DNA, 19 bp, Homo sapiens
ttgcagtgtgaatgctggg

SEQ ID NO: 1899583 - DNA, 19 bp, Homo sapiens
ttgcatctgggtagctgta

SEQ ID NO: 1899584 - DNA, 21 bp, Homo sapiens
ttgcatctgggtagctgtaag

SEQ ID NO: 1899585 - DNA, 21 bp, Homo sapiens
ttgcattccactttttgttac

SEQ ID NO: 1899586 - DNA, 20 bp, Homo sapiens
ttgcatttacgcctgtaaat

SEQ ID NO: 1899587 - DNA, 23 bp, Homo sapiens
ttgcatttacgcctgtaaatgta

SEQ ID NO: 1899588 - DNA, 12 bp, Homo sapiens
ttgcatttttgc

SEQ ID NO: 1899589 - DNA, 17 bp, Homo sapiens
ttgccagctgctgagcc

SEQ ID NO: 1899590 - DNA, 20 bp, Homo sapiens
ttgccagctgctgagccgca

SEQ ID NO: 1899591 - DNA, 20 bp, Homo sapiens
ttgccatgtgcttctgccac

SEQ ID NO: 1899592 - DNA, 20 bp, Homo sapiens
ttgcctataagccaaaatta

SEQ ID NO: 1899593 - DNA, 18 bp, Homo sapiens
ttgcctcagcttccccag

SEQ ID NO: 1899594 - DNA, 21 bp, Homo sapiens
ttgctctcttttattctgtgc

SEQ ID NO: 1899595 - DNA, 20 bp, Homo sapiens
ttgctgaaagatatgtatat

SEQ ID NO: 1899596 - DNA, 23 bp, Homo sapiens
ttgctgaaagatatgtatatttt

SEQ ID NO: 1899597 - DNA, 12 bp, Homo sapiens
ttgctgacttag

SEQ ID NO: 1899598 - DNA, 15 bp, Homo sapiens
ttgctggtaaaatga

SEQ ID NO: 1899599 - DNA, 16 bp, Homo sapiens
ttgctggtaaaatgaa

SEQ ID NO: 1899600 - DNA, 11 bp, Homo sapiens
ttgctttcctt

SEQ ID NO: 1899601 - DNA, 17 bp, Homo sapiens
ttgctttggaagtttta

SEQ ID NO: 1899602 - DNA, 18 bp, Homo sapiens
ttggaaatcaaatgtaaa

SEQ ID NO: 1899603 - DNA, 14 bp, Homo sapiens
ttggaaattgttaa

SEQ ID NO: 1899604 - DNA, 23 bp, Homo sapiens
ttggaaatttccattaaaggtgg

SEQ ID NO: 1899605 - DNA, 16 bp, Homo sapiens
ttggaacttacaaagg

SEQ ID NO: 1899606 - DNA, 15 bp, Homo sapiens
ttggaagttttaatc

SEQ ID NO: 1899607 - DNA, 21 bp, Homo sapiens
ttggaatgcactcagactgta

SEQ ID NO: 1899608 - DNA, 13 bp, Homo sapiens
ttggagctctgag

SEQ ID NO: 1899609 - DNA, 15 bp, Homo sapiens
ttggagggcctgggc

SEQ ID NO: 1899610 - DNA, 20 bp, Homo sapiens
ttggatgtttttagttctga

SEQ ID NO: 1899611 - DNA, 22 bp, Homo sapiens
ttggcaataaattttgaaaagt

SEQ ID NO: 1899612 - DNA, 22 bp, Homo sapiens
ttggctcccatcttttgttact

SEQ ID NO: 1899613 - DNA, 15 bp, Homo sapiens
ttggcttacatttga

SEQ ID NO: 1899614 - DNA, 14 bp, Homo sapiens
ttggcttcctctgc

SEQ ID NO: 1899615 - DNA, 16 bp, Homo sapiens
ttggcttcctctgctg

SEQ ID NO: 1899616 - DNA, 17 bp, Homo sapiens
ttggcttcctctgctgc

SEQ ID NO: 1899617 - DNA, 18 bp, Homo sapiens
ttggcttcctctgctgca

SEQ ID NO: 1899618 - DNA, 15 bp, Homo sapiens
ttgggacccagtggc

SEQ ID NO: 1899619 - DNA, 22 bp, Homo sapiens
ttgggacccagtggcagggcac

SEQ ID NO: 1899620 - DNA, 16 bp, Homo sapiens
ttgggcctcccactcc

SEQ ID NO: 1899621 - DNA, 23 bp, Homo sapiens
ttgggcctcccactcccatggct

SEQ ID NO: 1899622 - DNA, 22 bp, Homo sapiens
ttgggggaggggagactttgat

SEQ ID NO: 1899623 - DNA, 23 bp, Homo sapiens
ttgggggaggggagactttgatg

SEQ ID NO: 1899624 - DNA, 17 bp, Homo sapiens
ttggtatcaagaaagtc

SEQ ID NO: 1899625 - DNA, 18 bp, Homo sapiens
ttggtatttgtttaatac

SEQ ID NO: 1899626 - DNA, 18 bp, Homo sapiens
ttggttcattttcagatt

SEQ ID NO: 1899627 - DNA, 16 bp, Homo sapiens
ttggttttatgatgac

SEQ ID NO: 1899628 - DNA, 21 bp, Homo sapiens
ttgtaaaagaacagtaaacat

SEQ ID NO: 1899629 - DNA, 13 bp, Homo sapiens
ttgtaaatgactt

SEQ ID NO: 1899630 - DNA, 17 bp, Homo sapiens
ttgtaactaaaataatt

SEQ ID NO: 1899631 - DNA, 23 bp, Homo sapiens
ttgtaactaaaataattttgtaa

SEQ ID NO: 1899632 - DNA, 11 bp, Homo sapiens
ttgtaagaaat

SEQ ID NO: 1899633 - DNA, 13 bp, Homo sapiens
ttgtaattcagaa

SEQ ID NO: 1899634 - DNA, 18 bp, Homo sapiens
ttgtacagattctttatt

SEQ ID NO: 1899635 - DNA, 13 bp, Homo sapiens
ttgtactttgaaa

SEQ ID NO: 1899636 - DNA, 14 bp, Homo sapiens
ttgtagaacttgtt

SEQ ID NO: 1899637 - DNA, 19 bp, Homo sapiens
ttgtagaacttgttgctga

SEQ ID NO: 1899638 - DNA, 15 bp, Homo sapiens
ttgtagacattttga

SEQ ID NO: 1899639 - DNA, 12 bp, Homo sapiens
ttgtagatttga

SEQ ID NO: 1899640 - DNA, 20 bp, Homo sapiens
ttgtaggcgaatcatttgtt

SEQ ID NO: 1899641 - DNA, 17 bp, Homo sapiens
ttgtagttctttaaact

SEQ ID NO: 1899642 - DNA, 19 bp, Homo sapiens
ttgtataaatttatttact

SEQ ID NO: 1899643 - DNA, 17 bp, Homo sapiens
ttgtatagttatgtaaa

SEQ ID NO: 1899644 - DNA, 16 bp, Homo sapiens
ttgtatattggtttta

SEQ ID NO: 1899645 - DNA, 9 bp, Homo sapiens
ttgtatttt

SEQ ID NO: 1899646 - DNA, 23 bp, Homo sapiens
ttgtcaataaatggcccggacat

SEQ ID NO: 1899647 - DNA, 16 bp, Homo sapiens
ttgtcatcaccatgga

SEQ ID NO: 1899648 - DNA, 17 bp, Homo sapiens
ttgtcctattagtgtta

SEQ ID NO: 1899649 - DNA, 17 bp, Homo sapiens
ttgtcttaatggatgaa

SEQ ID NO: 1899650 - DNA, 19 bp, Homo sapiens
ttgtcttaatggatgaaat

SEQ ID NO: 1899651 - DNA, 22 bp, Homo sapiens
ttgttacatagaaagagtctga

SEQ ID NO: 1899652 - DNA, 22 bp, Homo sapiens
ttgttagcattttcaatgtgat

SEQ ID NO: 1899653 - DNA, 21 bp, Homo sapiens
ttgttcttggcaataaatttt

SEQ ID NO: 1899654 - DNA, 22 bp, Homo sapiens
ttgttgctgattttgaccttgt

SEQ ID NO: 1899655 - DNA, 17 bp, Homo sapiens
ttgtttaaaaatgcagt

SEQ ID NO: 1899656 - DNA, 20 bp, Homo sapiens
ttgtttctttctctgaggac

SEQ ID NO: 1899657 - DNA, 16 bp, Homo sapiens
tttaaaactcacctcc

SEQ ID NO: 1899658 - DNA, 19 bp, Homo sapiens
tttaaaatgttttctttgt

SEQ ID NO: 1899659 - DNA, 15 bp, Homo sapiens
tttaaactgtcgtgt

SEQ ID NO: 1899660 - DNA, 17 bp, Homo sapiens
tttaaagaaaaaaatgt

SEQ ID NO: 1899661 - DNA, 19 bp, Homo sapiens
tttaaattatgttttactg

SEQ ID NO: 1899662 - DNA, 14 bp, Homo sapiens
tttaacagggtctc

SEQ ID NO: 1899663 - DNA, 19 bp, Homo sapiens
tttaaccattccataatca

SEQ ID NO: 1899664 - DNA, 16 bp, Homo sapiens
tttaacctttgctgta

SEQ ID NO: 1899665 - DNA, 12 bp, Homo sapiens
tttaagaaagaa

SEQ ID NO: 1899666 - DNA, 17 bp, Homo sapiens
tttaatctactgcattt

SEQ ID NO: 1899667 - DNA, 17 bp, Homo sapiens
tttaattgaaagaatgt

SEQ ID NO: 1899668 - DNA, 17 bp, Homo sapiens
tttaattgtatttttgt

SEQ ID NO: 1899669 - DNA, 14 bp, Homo sapiens
tttacaacacttta

SEQ ID NO: 1899670 - DNA, 19 bp, Homo sapiens
tttacaacactttaatggg

SEQ ID NO: 1899671 - DNA, 16 bp, Homo sapiens
tttacgcctgtaaatg

SEQ ID NO: 1899672 - DNA, 18 bp, Homo sapiens
tttactgcattcttctga

SEQ ID NO: 1899673 - DNA, 19 bp, Homo sapiens
tttactgctttctgaatgt

SEQ ID NO: 1899674 - DNA, 14 bp, Homo sapiens
tttagaacaggttt

SEQ ID NO: 1899675 - DNA, 13 bp, Homo sapiens
tttagacttgaaa

SEQ ID NO: 1899676 - DNA, 15 bp, Homo sapiens
tttagttctgacttt

SEQ ID NO: 1899677 - DNA, 23 bp, Homo sapiens
tttagttctgactttgaatttat

SEQ ID NO: 1899678 - DNA, 14 bp, Homo sapiens
tttatagctttatt

SEQ ID NO: 1899679 - DNA, 21 bp, Homo sapiens
tttatatttattgactcttga

SEQ ID NO: 1899680 - DNA, 14 bp, Homo sapiens
tttatatttcaagt

SEQ ID NO: 1899681 - DNA, 15 bp, Homo sapiens
tttatatttcaagta

SEQ ID NO: 1899682 - DNA, 21 bp, Homo sapiens
tttatatttcaagtacactga

SEQ ID NO: 1899683 - DNA, 17 bp, Homo sapiens
tttatccaggaattgat

SEQ ID NO: 1899684 - DNA, 22 bp, Homo sapiens
tttatgctaatatttttaacaa

SEQ ID NO: 1899685 - DNA, 13 bp, Homo sapiens
tttattaaatttt

SEQ ID NO: 1899686 - DNA, 17 bp, Homo sapiens
tttattaacttaataat

SEQ ID NO: 1899687 - DNA, 13 bp, Homo sapiens
tttattaatcact

SEQ ID NO: 1899688 - DNA, 19 bp, Homo sapiens
tttattaatcactgtgtat

SEQ ID NO: 1899689 - DNA, 21 bp, Homo sapiens
tttattaatcactgtgtatat

SEQ ID NO: 1899690 - DNA, 16 bp, Homo sapiens
tttattaggaaaagat

SEQ ID NO: 1899691 - DNA, 18 bp, Homo sapiens
tttattaggaaaagatat

SEQ ID NO: 1899692 - DNA, 19 bp, Homo sapiens
tttattatttttctctctc

SEQ ID NO: 1899693 - DNA, 16 bp, Homo sapiens
tttatttcagcaaact

SEQ ID NO: 1899694 - DNA, 21 bp, Homo sapiens
tttattttaaaacagaagaat

SEQ ID NO: 1899695 - DNA, 18 bp, Homo sapiens
tttatttttaaattatgt

SEQ ID NO: 1899696 - DNA, 19 bp, Homo sapiens
tttatttttagaattttgt

SEQ ID NO: 1899697 - DNA, 13 bp, Homo sapiens
tttcaaatatcac

SEQ ID NO: 1899698 - DNA, 17 bp, Homo sapiens
tttcaatattttccttc

SEQ ID NO: 1899699 - DNA, 16 bp, Homo sapiens
tttcacagtgtgattt

SEQ ID NO: 1899700 - DNA, 23 bp, Homo sapiens
tttcactggccacagttgtttga

SEQ ID NO: 1899701 - DNA, 18 bp, Homo sapiens
tttcagaagctgatgagg

SEQ ID NO: 1899702 - DNA, 19 bp, Homo sapiens
tttcataagatattttatt

SEQ ID NO: 1899703 - DNA, 14 bp, Homo sapiens
tttcataataaata

SEQ ID NO: 1899704 - DNA, 17 bp, Homo sapiens
tttcatcagaacagctg

SEQ ID NO: 1899705 - DNA, 22 bp, Homo sapiens
aaatgagtccaaactggaatga

SEQ ID NO: 1899706 - DNA, 16 bp, Homo sapiens
aaatgcacacacctca

SEQ ID NO: 1899707 - DNA, 20 bp, Homo sapiens
aaatgcacacacctcatgct

SEQ ID NO: 1899708 - DNA, 16 bp, Homo sapiens
aaatgcatctttgatg

SEQ ID NO: 1899709 - DNA, 18 bp, Homo sapiens
aaatgcatctttgatgtg

SEQ ID NO: 1899710 - DNA, 19 bp, Homo sapiens
aaatgcatctttgatgtgt

SEQ ID NO: 1899711 - DNA, 21 bp, Homo sapiens
aaatgcctccaaagtattgta

SEQ ID NO: 1899712 - DNA, 15 bp, Homo sapiens
aaatgctgaacattg

SEQ ID NO: 1899713 - DNA, 20 bp, Homo sapiens
aaatgtcaaaagtagaactt

SEQ ID NO: 1899714 - DNA, 23 bp, Homo sapiens
aaatgtcaaaagtagaactttgt

SEQ ID NO: 1899715 - DNA, 18 bp, Homo sapiens
aaatgtctttcatgtaaa

SEQ ID NO: 1899716 - DNA, 16 bp, Homo sapiens
aaatgtggatgtgatt

SEQ ID NO: 1899717 - DNA, 14 bp, Homo sapiens
aaattaaacttcaa

SEQ ID NO: 1899718 - DNA, 17 bp, Homo sapiens
aaattaaggtgtttgaa

SEQ ID NO: 1899719 - DNA, 23 bp, Homo sapiens
aaattaaggtgtttgaaaatagt

SEQ ID NO: 1899720 - DNA, 20 bp, Homo sapiens
aaattacgtactaaggatac

SEQ ID NO: 1899721 - DNA, 15 bp, Homo sapiens
aaattatacaatgat

SEQ ID NO: 1899722 - DNA, 22 bp, Homo sapiens
aaattatgttttactgttcatt

SEQ ID NO: 1899723 - DNA, 19 bp, Homo sapiens
aaattccgagtctttctca

SEQ ID NO: 1899724 - DNA, 17 bp, Homo sapiens
aaattcctagtgtcttt

SEQ ID NO: 1899725 - DNA, 17 bp, Homo sapiens
aaattctgatttctttt

SEQ ID NO: 1899726 - DNA, 18 bp, Homo sapiens
aaattggagttttaaaaa

SEQ ID NO: 1899727 - DNA, 15 bp, Homo sapiens
aaattggggtttatt

SEQ ID NO: 1899728 - DNA, 22 bp, Homo sapiens
aaattgtccttgaagcttgtat

SEQ ID NO: 1899729 - DNA, 16 bp, Homo sapiens
aaattgtcttaatgga

SEQ ID NO: 1899730 - DNA, 11 bp, Homo sapiens
aaatttatata

SEQ ID NO: 1899731 - DNA, 14 bp, Homo sapiens
aaatttatataact

SEQ ID NO: 1899732 - DNA, 14 bp, Homo sapiens
aaatttatttactg

SEQ ID NO: 1899733 - DNA, 19 bp, Homo sapiens
aaatttatttactgctagt

SEQ ID NO: 1899734 - DNA, 21 bp, Homo sapiens
aaatttatttactgctagtct

SEQ ID NO: 1899735 - DNA, 19 bp, Homo sapiens
aaatttgctttttgagatg

SEQ ID NO: 1899736 - DNA, 21 bp, Homo sapiens
aaattttgaaaagtaatattt

SEQ ID NO: 1899737 - DNA, 18 bp, Homo sapiens
aaattttgtaagggagca

SEQ ID NO: 1899738 - DNA, 12 bp, Homo sapiens
aaatttttttgt

SEQ ID NO: 1899739 - DNA, 19 bp, Homo sapiens
aaatttttttgtatgaaaa

SEQ ID NO: 1899740 - DNA, 16 bp, Homo sapiens
aacaaaaaagagaaac

SEQ ID NO: 1899741 - DNA, 11 bp, Homo sapiens
aacaaaaataa

SEQ ID NO: 1899742 - DNA, 19 bp, Homo sapiens
aacaaagagaaaaaataca

SEQ ID NO: 1899743 - DNA, 16 bp, Homo sapiens
aacaaatggaagagaa

SEQ ID NO: 1899744 - DNA, 17 bp, Homo sapiens
aacaaccaaatgtgcat

SEQ ID NO: 1899745 - DNA, 14 bp, Homo sapiens
aacaagttgagcta

SEQ ID NO: 1899746 - DNA, 23 bp, Homo sapiens
aacaattctcccgggactctgca

SEQ ID NO: 1899747 - DNA, 12 bp, Homo sapiens
aacaattttcta

SEQ ID NO: 1899748 - DNA, 22 bp, Homo sapiens
aacacacagaaggggactgcca

SEQ ID NO: 1899749 - DNA, 12 bp, Homo sapiens
aacagaggatat

SEQ ID NO: 1899750 - DNA, 13 bp, Homo sapiens
aacagattttatt

SEQ ID NO: 1899751 - DNA, 18 bp, Homo sapiens
aacagattttattaatca

SEQ ID NO: 1899752 - DNA, 15 bp, Homo sapiens
aacagctgttgactc

SEQ ID NO: 1899753 - DNA, 18 bp, Homo sapiens
aacagggtctctagtgct

SEQ ID NO: 1899754 - DNA, 20 bp, Homo sapiens
aacagggtctctagtgctgt

SEQ ID NO: 1899755 - DNA, 20 bp, Homo sapiens
aacagtgtggcctcttctga

SEQ ID NO: 1899756 - DNA, 17 bp, Homo sapiens
aacatagccaaaatgtg

SEQ ID NO: 1899757 - DNA, 13 bp, Homo sapiens
aacatcattcctt

SEQ ID NO: 1899758 - DNA, 23 bp, Homo sapiens
aacatgcctcctcctgccctccg

SEQ ID NO: 1899759 - DNA, 21 bp, Homo sapiens
aacatggttcaggtacacata

SEQ ID NO: 1899760 - DNA, 16 bp, Homo sapiens
aacattccatttgctt

SEQ ID NO: 1899761 - DNA, 16 bp, Homo sapiens
aacattcgttctctaa

SEQ ID NO: 1899762 - DNA, 18 bp, Homo sapiens
aacattggcataattttt

SEQ ID NO: 1899763 - DNA, 16 bp, Homo sapiens
aacattgtagcctcaa

SEQ ID NO: 1899764 - DNA, 22 bp, Homo sapiens
aacattttgacaactgaaagaa

SEQ ID NO: 1899765 - DNA, 14 bp, Homo sapiens
aaccaaaaagaaaa

SEQ ID NO: 1899766 - DNA, 16 bp, Homo sapiens
aaccacaaaactcatc

SEQ ID NO: 1899767 - DNA, 11 bp, Homo sapiens
aaccactgaat

SEQ ID NO: 1899768 - DNA, 12 bp, Homo sapiens
aaccacttgtag

SEQ ID NO: 1899769 - DNA, 17 bp, Homo sapiens
aaccaggctttctagaa

SEQ ID NO: 1899770 - DNA, 13 bp, Homo sapiens
aaccccacctccc

SEQ ID NO: 1899771 - DNA, 12 bp, Homo sapiens
aacccctcgccc

SEQ ID NO: 1899772 - DNA, 20 bp, Homo sapiens
aacccctcgcccagtcccag

SEQ ID NO: 1899773 - DNA, 13 bp, Homo sapiens
aacctaggaggat

SEQ ID NO: 1899774 - DNA, 15 bp, Homo sapiens
aacctgaaagttcct

SEQ ID NO: 1899775 - DNA, 13 bp, Homo sapiens
aaccttactctga

SEQ ID NO: 1899776 - DNA, 17 bp, Homo sapiens
aaccttactctgagctc

SEQ ID NO: 1899777 - DNA, 16 bp, Homo sapiens
aacctttctataattt

SEQ ID NO: 1899778 - DNA, 17 bp, Homo sapiens
aacgttttctactttga

SEQ ID NO: 1899779 - DNA, 19 bp, Homo sapiens
aacgttttctactttgaaa

SEQ ID NO: 1899780 - DNA, 19 bp, Homo sapiens
aactaaaataattttgtaa

SEQ ID NO: 1899781 - DNA, 16 bp, Homo sapiens
aactaggattataatg

SEQ ID NO: 1899782 - DNA, 17 bp, Homo sapiens
aactatttaaagaaata

SEQ ID NO: 1899783 - DNA, 13 bp, Homo sapiens
aactcaatataaa

SEQ ID NO: 1899784 - DNA, 16 bp, Homo sapiens
aactcccaccctaccc

SEQ ID NO: 1899785 - DNA, 17 bp, Homo sapiens
aactcttctcattactt

SEQ ID NO: 1899786 - DNA, 13 bp, Homo sapiens
aactgaaatgtgg

SEQ ID NO: 1899787 - DNA, 15 bp, Homo sapiens
aactgcagaaaaaat

SEQ ID NO: 1899788 - DNA, 16 bp, Homo sapiens
aactgcagtcactgca

SEQ ID NO: 1899789 - DNA, 14 bp, Homo sapiens
aactgccagttttg

SEQ ID NO: 1899790 - DNA, 22 bp, Homo sapiens
aactgcgggaatactgtctctt

SEQ ID NO: 1899791 - DNA, 13 bp, Homo sapiens
aactgctgctgac

SEQ ID NO: 1899792 - DNA, 13 bp, Homo sapiens
aactgtcatgata

SEQ ID NO: 1899793 - DNA, 20 bp, Homo sapiens
aacttacatatttattttta

SEQ ID NO: 1899794 - DNA, 20 bp, Homo sapiens
aacttatattgtaagaaata

SEQ ID NO: 1899795 - DNA, 24 bp, Homo sapiens
aacttatgaagtaaagtttctgat

SEQ ID NO: 1899796 - DNA, 22 bp, Homo sapiens
aacttgttgctgattttgacct

SEQ ID NO: 1899797 - DNA, 13 bp, Homo sapiens
aactttgtatagt

SEQ ID NO: 1899798 - DNA, 14 bp, Homo sapiens
aactttgtatagtt

SEQ ID NO: 1899799 - DNA, 22 bp, Homo sapiens
aactttgtatagttatgtaaat

SEQ ID NO: 1899800 - DNA, 20 bp, Homo sapiens
aactttttgtaggatacttg

SEQ ID NO: 1899801 - DNA, 17 bp, Homo sapiens
aagaaaaaaaagaaagc

SEQ ID NO: 1899802 - DNA, 12 bp, Homo sapiens
aagaaagaaata

SEQ ID NO: 1899803 - DNA, 12 bp, Homo sapiens
aagaaagaggaa

SEQ ID NO: 1899804 - DNA, 20 bp, Homo sapiens
aagaaatatgtattctgtaa

SEQ ID NO: 1899805 - DNA, 13 bp, Homo sapiens
aagaaatgaagag

SEQ ID NO: 1899806 - DNA, 15 bp, Homo sapiens
aagaaattcctagtg

SEQ ID NO: 1899807 - DNA, 21 bp, Homo sapiens
aagaacaaagagaaaaaatac

SEQ ID NO: 1899808 - DNA, 14 bp, Homo sapiens
aagaacgtgcttgt

SEQ ID NO: 1899809 - DNA, 17 bp, Homo sapiens
aagaatagctttaatga

SEQ ID NO: 1899810 - DNA, 12 bp, Homo sapiens
aagaatgtaaag

SEQ ID NO: 1899811 - DNA, 16 bp, Homo sapiens
aagaatttactttgga

SEQ ID NO: 1899812 - DNA, 16 bp, Homo sapiens
aagacagcatttgtgt

SEQ ID NO: 1899813 - DNA, 21 bp, Homo sapiens
aagacagcccgatcctcccct

SEQ ID NO: 1899814 - DNA, 19 bp, Homo sapiens
aagacatttcaaataactg

SEQ ID NO: 1899815 - DNA, 20 bp, Homo sapiens
aagacatttcaaataactgc

SEQ ID NO: 1899816 - DNA, 23 bp, Homo sapiens
aagacttccccaagcctggcagg

SEQ ID NO: 1899817 - DNA, 15 bp, Homo sapiens
aagagaaaagaaaaa

SEQ ID NO: 1899818 - DNA, 13 bp, Homo sapiens
aagagaaccatgt

SEQ ID NO: 1899819 - DNA, 13 bp, Homo sapiens
aagagaacttttt

SEQ ID NO: 1899820 - DNA, 13 bp, Homo sapiens
aagagaagagaaa

SEQ ID NO: 1899821 - DNA, 15 bp, Homo sapiens
aagagaagagaaagg

SEQ ID NO: 1899822 - DNA, 14 bp, Homo sapiens
aagagacaggcagg

SEQ ID NO: 1899823 - DNA, 13 bp, Homo sapiens
aagagacctgaac

SEQ ID NO: 1899824 - DNA, 17 bp, Homo sapiens
aagagactgcttgacaa

SEQ ID NO: 1899825 - DNA, 15 bp, Homo sapiens
aagagaggacacaaa

SEQ ID NO: 1899826 - DNA, 13 bp, Homo sapiens
aagagccttaaaa

SEQ ID NO: 1899827 - DNA, 16 bp, Homo sapiens
aagaggaggcaggagg

SEQ ID NO: 1899828 - DNA, 20 bp, Homo sapiens
aagaggaggcaggaggagca

SEQ ID NO: 1899829 - DNA, 17 bp, Homo sapiens
aagagtggccccacctg

SEQ ID NO: 1899830 - DNA, 21 bp, Homo sapiens
aagagtggccccacctggccc

SEQ ID NO: 1899831 - DNA, 18 bp, Homo sapiens
aagagtttgtaaatgact

SEQ ID NO: 1899832 - DNA, 18 bp, Homo sapiens
aagataaaaaaacagctt

SEQ ID NO: 1899833 - DNA, 22 bp, Homo sapiens
aagataattgtactttgaaaac

SEQ ID NO: 1899834 - DNA, 19 bp, Homo sapiens
aagatatgtatatttttga

SEQ ID NO: 1899835 - DNA, 21 bp, Homo sapiens
aagatatgtatatttttgatc

SEQ ID NO: 1899836 - DNA, 20 bp, Homo sapiens
aagatcccagtgtgaagtat

SEQ ID NO: 1899837 - DNA, 19 bp, Homo sapiens
aagatgtagatttatttca

SEQ ID NO: 1899838 - DNA, 20 bp, Homo sapiens
aagatgttctggataccatt

SEQ ID NO: 1899839 - DNA, 22 bp, Homo sapiens
aagcaaaataacaaaaaagaga

SEQ ID NO: 1899840 - DNA, 15 bp, Homo sapiens
aagcaaccaaaaaga

SEQ ID NO: 1899841 - DNA, 14 bp, Homo sapiens
aagcaataaaactg

SEQ ID NO: 1899842 - DNA, 15 bp, Homo sapiens
aagcaataaaactgc

SEQ ID NO: 1899843 - DNA, 13 bp, Homo sapiens
aagcacaaaggaa

SEQ ID NO: 1899844 - DNA, 17 bp, Homo sapiens
aagcaccaaaataagaa

SEQ ID NO: 1899845 - DNA, 15 bp, Homo sapiens
aagcaccatcccctc

SEQ ID NO: 1899846 - DNA, 19 bp, Homo sapiens
aagcactaagactgcttct

SEQ ID NO: 1899847 - DNA, 17 bp, Homo sapiens
aagcactcctttaaagc

SEQ ID NO: 1899848 - DNA, 16 bp, Homo sapiens
aagcagtgcccaggtg

SEQ ID NO: 1899849 - DNA, 15 bp, Homo sapiens
aagcatctaaggaca

SEQ ID NO: 1899850 - DNA, 14 bp, Homo sapiens
aagcatctctgacc

SEQ ID NO: 1899851 - DNA, 20 bp, Homo sapiens
aagcatttggtttttcacat

SEQ ID NO: 1899852 - DNA, 22 bp, Homo sapiens
aagccaaaattaaggtgtttga

SEQ ID NO: 1899853 - DNA, 13 bp, Homo sapiens
aagccaagaggca

SEQ ID NO: 1899854 - DNA, 14 bp, Homo sapiens
aagccaccaacagc

SEQ ID NO: 1899855 - DNA, 21 bp, Homo sapiens
aagccaggttccacagaggac

SEQ ID NO: 1899856 - DNA, 23 bp, Homo sapiens
aagccaggttccacagaggacac

SEQ ID NO: 1899857 - DNA, 15 bp, Homo sapiens
aagcccaggagccca

SEQ ID NO: 1899858 - DNA, 15 bp, Homo sapiens
aagccccattaactg

SEQ ID NO: 1899859 - DNA, 13 bp, Homo sapiens
aagcctggcaggg

SEQ ID NO: 1899860 - DNA, 20 bp, Homo sapiens
aagcctggcaggggatccag

SEQ ID NO: 1899861 - DNA, 18 bp, Homo sapiens
aagccttcgaaaagaaat

SEQ ID NO: 1899862 - DNA, 15 bp, Homo sapiens
aagcgccctggcccc

SEQ ID NO: 1899863 - DNA, 15 bp, Homo sapiens
aagcgtatggcttta

SEQ ID NO: 1899864 - DNA, 22 bp, Homo sapiens
aagctaacagcagtttcaggta

SEQ ID NO: 1899865 - DNA, 14 bp, Homo sapiens
aagctgaggcccat

SEQ ID NO: 1899866 - DNA, 21 bp, Homo sapiens
aagctgaggcccatggccaca

SEQ ID NO: 1899867 - DNA, 15 bp, Homo sapiens
aagctgaggctgctg

SEQ ID NO: 1899868 - DNA, 15 bp, Homo sapiens
aagctggtttacaga

SEQ ID NO: 1899869 - DNA, 22 bp, Homo sapiens
aaggaaataccagttctgggca

SEQ ID NO: 1899870 - DNA, 17 bp, Homo sapiens
aaggaaggtagttcaag

SEQ ID NO: 1899871 - DNA, 23 bp, Homo sapiens
aaggaatctagccagtgaacata

SEQ ID NO: 1899872 - DNA, 21 bp, Homo sapiens
aaggacagtcctatttagaca

SEQ ID NO: 1899873 - DNA, 15 bp, Homo sapiens
aaggacttgtttccc

SEQ ID NO: 1899874 - DNA, 21 bp, Homo sapiens
aaggactttggcttacatttg

SEQ ID NO: 1899875 - DNA, 20 bp, Homo sapiens
aaggagcaggccctgggcct

SEQ ID NO: 1899876 - DNA, 14 bp, Homo sapiens
aaggaggccacctc

SEQ ID NO: 1899877 - DNA, 13 bp, Homo sapiens
aaggagttttgtt

SEQ ID NO: 1899878 - DNA, 20 bp, Homo sapiens
aaggagttttgttgtatttt

SEQ ID NO: 1899879 - DNA, 20 bp, Homo sapiens
aaggcaatttctctgcacac

SEQ ID NO: 1899880 - DNA, 15 bp, Homo sapiens
aaggcagaaagcaaa

SEQ ID NO: 1899881 - DNA, 19 bp, Homo sapiens
aaggcagaaagcaaaatta

SEQ ID NO: 1899882 - DNA, 17 bp, Homo sapiens
aaggccaatgggctaga

SEQ ID NO: 1899883 - DNA, 18 bp, Homo sapiens
aaggccaatgggctagag

SEQ ID NO: 1899884 - DNA, 13 bp, Homo sapiens
aaggcgctggagc

SEQ ID NO: 1899885 - DNA, 22 bp, Homo sapiens
aagggacttgtcccaagtctga

SEQ ID NO: 1899886 - DNA, 20 bp, Homo sapiens
aaggggacaagtagccacct

SEQ ID NO: 1899887 - DNA, 20 bp, Homo sapiens
aagggggacctcgggctgtt

SEQ ID NO: 1899888 - DNA, 19 bp, Homo sapiens
aaggtactttcatatttta

SEQ ID NO: 1899889 - DNA, 22 bp, Homo sapiens
aaggtagggtaggcagcctgag

SEQ ID NO: 1899890 - DNA, 17 bp, Homo sapiens
aagtaagtctcaaggta

SEQ ID NO: 1899891 - DNA, 14 bp, Homo sapiens
aagtagaggtggct

SEQ ID NO: 1899892 - DNA, 20 bp, Homo sapiens
aagtagttctgtatttgaaa

SEQ ID NO: 1899893 - DNA, 16 bp, Homo sapiens
aagtatctaaatttgg

SEQ ID NO: 1899894 - DNA, 15 bp, Homo sapiens
aagtatgttttactt

SEQ ID NO: 1899895 - DNA, 16 bp, Homo sapiens
aagtatttactgactg

SEQ ID NO: 1899896 - DNA, 15 bp, Homo sapiens
aagtattttcctgtt

SEQ ID NO: 1899897 - DNA, 15 bp, Homo sapiens
aagtcataatgaata

SEQ ID NO: 1899898 - DNA, 17 bp, Homo sapiens
aagtcataatgaataaa

SEQ ID NO: 1899899 - DNA, 19 bp, Homo sapiens
aagtcatttcaaaatatgt

SEQ ID NO: 1899900 - DNA, 22 bp, Homo sapiens
aagtccctgtaattgttgtttg

SEQ ID NO: 1899901 - DNA, 12 bp, Homo sapiens
aagtgaaaatat

SEQ ID NO: 1899902 - DNA, 14 bp, Homo sapiens
aagtgacggttcct

SEQ ID NO: 1899903 - DNA, 14 bp, Homo sapiens
aagtgcatcctgat

SEQ ID NO: 1899904 - DNA, 17 bp, Homo sapiens
aagtgccttagcatgtg

SEQ ID NO: 1899905 - DNA, 18 bp, Homo sapiens
aagtgctattacgaagtt

SEQ ID NO: 1899906 - DNA, 19 bp, Homo sapiens
aagtgcttgttttacataa

SEQ ID NO: 1899907 - DNA, 16 bp, Homo sapiens
aagtggactctctgac

SEQ ID NO: 1899908 - DNA, 21 bp, Homo sapiens
aagtggatattttcttaaaac

SEQ ID NO: 1899909 - DNA, 20 bp, Homo sapiens
aagtgttcattgcacaatat

SEQ ID NO: 1899910 - DNA, 18 bp, Homo sapiens
aagttagttccactgaga

SEQ ID NO: 1899911 - DNA, 23 bp, Homo sapiens
aagttccttctgtagcctgaaga

SEQ ID NO: 1899912 - DNA, 19 bp, Homo sapiens
aagttgtttcattgattta

SEQ ID NO: 1899913 - DNA, 14 bp, Homo sapiens
aagtttaaggaata

SEQ ID NO: 1899914 - DNA, 16 bp, Homo sapiens
aagtttgctgaaagat

SEQ ID NO: 1899915 - DNA, 13 bp, Homo sapiens
aataaaaatggat

SEQ ID NO: 1899916 - DNA, 19 bp, Homo sapiens
aataaaagcccaggagccc

SEQ ID NO: 1899917 - DNA, 16 bp, Homo sapiens
aataaaagtgctgccg

SEQ ID NO: 1899918 - DNA, 17 bp, Homo sapiens
aataaagagaaccatgt

SEQ ID NO: 1899919 - DNA, 16 bp, Homo sapiens
aataaatagacacttg

SEQ ID NO: 1899920 - DNA, 15 bp, Homo sapiens
aataaattttgaaaa

SEQ ID NO: 1899921 - DNA, 18 bp, Homo sapiens
aataaattttgaaaagta

SEQ ID NO: 1899922 - DNA, 22 bp, Homo sapiens
aataaattttgaaaagtaatat

SEQ ID NO: 1899923 - DNA, 22 bp, Homo sapiens
aataagccttcgaaaagaaatt

SEQ ID NO: 1899924 - DNA, 20 bp, Homo sapiens
aataataaagaatagcttta

SEQ ID NO: 1899925 - DNA, 15 bp, Homo sapiens
aataatgtctagatt

SEQ ID NO: 1899926 - DNA, 14 bp, Homo sapiens
aataattctttttt

SEQ ID NO: 1899927 - DNA, 15 bp, Homo sapiens
aataattctttttta

SEQ ID NO: 1899928 - DNA, 20 bp, Homo sapiens
aataattcttttttattaat

SEQ ID NO: 1899929 - DNA, 21 bp, Homo sapiens
aataattcttttttattaatc

SEQ ID NO: 1899930 - DNA, 13 bp, Homo sapiens
aataattgacagg

SEQ ID NO: 1899931 - DNA, 17 bp, Homo sapiens
aataatttgtggtgatt

SEQ ID NO: 1899932 - DNA, 15 bp, Homo sapiens
aataattttgtaatg

SEQ ID NO: 1899933 - DNA, 15 bp, Homo sapiens
aatacacagggaggg

SEQ ID NO: 1899934 - DNA, 23 bp, Homo sapiens
aatacatttaaaacattaaaata

SEQ ID NO: 1899935 - DNA, 13 bp, Homo sapiens
aataccagttctg

SEQ ID NO: 1899936 - DNA, 14 bp, Homo sapiens
aataccctgtacat

SEQ ID NO: 1899937 - DNA, 14 bp, Homo sapiens
aatactgaaccact

SEQ ID NO: 1899938 - DNA, 15 bp, Homo sapiens
aatactgaaccactt

SEQ ID NO: 1899939 - DNA, 14 bp, Homo sapiens
cacagcctgcactt

SEQ ID NO: 1899940 - DNA, 13 bp, Homo sapiens
cacagctctttaa

SEQ ID NO: 1899941 - DNA, 18 bp, Homo sapiens
cacagctgctctgtgacc

SEQ ID NO: 1899942 - DNA, 14 bp, Homo sapiens
cacaggcagggcag

SEQ ID NO: 1899943 - DNA, 18 bp, Homo sapiens
cacaggcagggcaggacc

SEQ ID NO: 1899944 - DNA, 22 bp, Homo sapiens
cacaggcagggcaggaccagcc

SEQ ID NO: 1899945 - DNA, 17 bp, Homo sapiens
cacaggctgagtgcagg

SEQ ID NO: 1899946 - DNA, 18 bp, Homo sapiens
cacaggctgagtgcaggc

SEQ ID NO: 1899947 - DNA, 13 bp, Homo sapiens
cacaggctgggct

SEQ ID NO: 1899948 - DNA, 13 bp, Homo sapiens
cacagggcctcag

SEQ ID NO: 1899949 - DNA, 14 bp, Homo sapiens
cacagggcctcagt

SEQ ID NO: 1899950 - DNA, 17 bp, Homo sapiens
cacagggcctcagtttc

SEQ ID NO: 1899951 - DNA, 19 bp, Homo sapiens
cacagggcctggcccatgt

SEQ ID NO: 1899952 - DNA, 15 bp, Homo sapiens
cacaggtgcccgcca

SEQ ID NO: 1899953 - DNA, 18 bp, Homo sapiens
cacaggtgcccgccacca

SEQ ID NO: 1899954 - DNA, 21 bp, Homo sapiens
cacatttaaaaataaatgtaa

SEQ ID NO: 1899955 - DNA, 19 bp, Homo sapiens
cacattttaaaaaatttgt

SEQ ID NO: 1899956 - DNA, 19 bp, Homo sapiens
caccaaaataagaaaagat

SEQ ID NO: 1899957 - DNA, 17 bp, Homo sapiens
caccaatcttactttgt

SEQ ID NO: 1899958 - DNA, 19 bp, Homo sapiens
caccaatcttactttgtaa

SEQ ID NO: 1899959 - DNA, 22 bp, Homo sapiens
caccaatcttactttgtaaatt

SEQ ID NO: 1899960 - DNA, 14 bp, Homo sapiens
caccactacagtaa

SEQ ID NO: 1899961 - DNA, 22 bp, Homo sapiens
caccactacagtaagctggttt

SEQ ID NO: 1899962 - DNA, 11 bp, Homo sapiens
caccagcaggc

SEQ ID NO: 1899963 - DNA, 12 bp, Homo sapiens
caccagcaggca

SEQ ID NO: 1899964 - DNA, 15 bp, Homo sapiens
caccagcccagaagt

SEQ ID NO: 1899965 - DNA, 21 bp, Homo sapiens
caccagcgcccccactcctcc

SEQ ID NO: 1899966 - DNA, 22 bp, Homo sapiens
caccagcgcccccactcctcct

SEQ ID NO: 1899967 - DNA, 17 bp, Homo sapiens
caccatttccccagggc

SEQ ID NO: 1899968 - DNA, 12 bp, Homo sapiens
caccccatccac

SEQ ID NO: 1899969 - DNA, 16 bp, Homo sapiens
caccctgctgagtctg

SEQ ID NO: 1899970 - DNA, 17 bp, Homo sapiens
caccctgcttggcccag

SEQ ID NO: 1899971 - DNA, 14 bp, Homo sapiens
caccctgtcccagg

SEQ ID NO: 1899972 - DNA, 21 bp, Homo sapiens
caccctgtcccaggcagcgcc

SEQ ID NO: 1899973 - DNA, 16 bp, Homo sapiens
cacccttggagctctg

SEQ ID NO: 1899974 - DNA, 20 bp, Homo sapiens
cacccttggagctctgagtt

SEQ ID NO: 1899975 - DNA, 13 bp, Homo sapiens
caccgtcccctcc

SEQ ID NO: 1899976 - DNA, 14 bp, Homo sapiens
cacctccccttgcc

SEQ ID NO: 1899977 - DNA, 16 bp, Homo sapiens
cacctccccttgccag

SEQ ID NO: 1899978 - DNA, 19 bp, Homo sapiens
cacctcctaaaaggcccag

SEQ ID NO: 1899979 - DNA, 20 bp, Homo sapiens
cacctcctaaaaggcccaga

SEQ ID NO: 1899980 - DNA, 12 bp, Homo sapiens
cacctctgcccc

SEQ ID NO: 1899981 - DNA, 21 bp, Homo sapiens
cacctctgccccttgggcctc

SEQ ID NO: 1899982 - DNA, 12 bp, Homo sapiens
cacctctgtgca

SEQ ID NO: 1899983 - DNA, 15 bp, Homo sapiens
cacctcttcctggcc

SEQ ID NO: 1899984 - DNA, 20 bp, Homo sapiens
cacgaaactggaataagcct

SEQ ID NO: 1899985 - DNA, 23 bp, Homo sapiens
cacgagcagacacccttggagct

SEQ ID NO: 1899986 - DNA, 16 bp, Homo sapiens
cacgcctagcctcacg

SEQ ID NO: 1899987 - DNA, 19 bp, Homo sapiens
cacgcctctccccaccttc

SEQ ID NO: 1899988 - DNA, 21 bp, Homo sapiens
cacgggtaaatctagtaccat

SEQ ID NO: 1899989 - DNA, 14 bp, Homo sapiens
cacgtcattgtgta

SEQ ID NO: 1899990 - DNA, 18 bp, Homo sapiens
cacgtcattgtgtaagga

SEQ ID NO: 1899991 - DNA, 23 bp, Homo sapiens
cacgtggtgacctcacacacctc

SEQ ID NO: 1899992 - DNA, 22 bp, Homo sapiens
cacgttttaaggactgactgag

SEQ ID NO: 1899993 - DNA, 14 bp, Homo sapiens
cacgttttgaaata

SEQ ID NO: 1899994 - DNA, 20 bp, Homo sapiens
cactaagaacaaaagaagca

SEQ ID NO: 1899995 - DNA, 19 bp, Homo sapiens
cagatgtcctaatggtgat

SEQ ID NO: 1899996 - DNA, 16 bp, Homo sapiens
cagatgttgaagacag

SEQ ID NO: 1899997 - DNA, 16 bp, Homo sapiens
cagatgtttaaaacac

SEQ ID NO: 1899998 - DNA, 16 bp, Homo sapiens
cagatgttttccactg

SEQ ID NO: 1899999 - DNA, 20 bp, Homo sapiens
cagcaaactgcgggaatact

SEQ ID NO: 1900000 - DNA, 19 bp, Homo sapiens
cagcaacgatcacaaatga

SEQ ID NO: 1900001 - DNA, 20 bp, Homo sapiens
cagcaacgatcacaaatgac

SEQ ID NO: 1900002 - DNA, 16 bp, Homo sapiens
cagcaaggccacctct

SEQ ID NO: 1900003 - DNA, 13 bp, Homo sapiens
cagcacgcctctc

SEQ ID NO: 1900004 - DNA, 14 bp, Homo sapiens
cagcacgcctctcc

SEQ ID NO: 1900005 - DNA, 18 bp, Homo sapiens
cagcacgcctctccccac

SEQ ID NO: 1900006 - DNA, 22 bp, Homo sapiens
cagcacgcctctccccaccttc

SEQ ID NO: 1900007 - DNA, 20 bp, Homo sapiens
cagcactggattgtagaact

SEQ ID NO: 1900008 - DNA, 21 bp, Homo sapiens
cagcactggattgtagaactt

SEQ ID NO: 1900009 - DNA, 14 bp, Homo sapiens
cagcagccagccaa

SEQ ID NO: 1900010 - DNA, 16 bp, Homo sapiens
cagcagccagccaaac

SEQ ID NO: 1900011 - DNA, 12 bp, Homo sapiens
cagcagccttcc

SEQ ID NO: 1900012 - DNA, 13 bp, Homo sapiens
cagcagccttcca

SEQ ID NO: 1900013 - DNA, 15 bp, Homo sapiens
cagcagccttccagt

SEQ ID NO: 1900014 - DNA, 22 bp, Homo sapiens
cagcaggagggacagtctcacc

SEQ ID NO: 1900015 - DNA, 16 bp, Homo sapiens
cagcaggagggactct

SEQ ID NO: 1900016 - DNA, 23 bp, Homo sapiens
cagcaggagggactctgtctggc

SEQ ID NO: 1900017 - DNA, 16 bp, Homo sapiens
cagcaggcactgaagc

SEQ ID NO: 1900018 - DNA, 21 bp, Homo sapiens
cagcaggcactgaagctgcgg

SEQ ID NO: 1900019 - DNA, 12 bp, Homo sapiens
cagcaggctcct

SEQ ID NO: 1900020 - DNA, 15 bp, Homo sapiens
cagcaggctcctcag

SEQ ID NO: 1900021 - DNA, 16 bp, Homo sapiens
cagcaggctcctcagc

SEQ ID NO: 1900022 - DNA, 17 bp, Homo sapiens
cagcaggctcctcagcc

SEQ ID NO: 1900023 - DNA, 23 bp, Homo sapiens
cagcaggctcctcagccctctct

SEQ ID NO: 1900024 - DNA, 11 bp, Homo sapiens
cagcagggcct

SEQ ID NO: 1900025 - DNA, 19 bp, Homo sapiens
cagcagtgggttcaggccc

SEQ ID NO: 1900026 - DNA, 12 bp, Homo sapiens
cagcataaagaa

SEQ ID NO: 1900027 - DNA, 17 bp, Homo sapiens
cagcataactaggatta

SEQ ID NO: 1900028 - DNA, 19 bp, Homo sapiens
cagcattacctctttggaa

SEQ ID NO: 1900029 - DNA, 16 bp, Homo sapiens
cagcatttgtgtgtta

SEQ ID NO: 1900030 - DNA, 22 bp, Homo sapiens
cagcatttgtgtgttacaatgt

SEQ ID NO: 1900031 - DNA, 19 bp, Homo sapiens
cagccaaacacacagaagg

SEQ ID NO: 1900032 - DNA, 15 bp, Homo sapiens
cagccaccctttctg

SEQ ID NO: 1900033 - DNA, 13 bp, Homo sapiens
cagcccacgctga

SEQ ID NO: 1900034 - DNA, 22 bp, Homo sapiens
cagcccacgctgactacagggc

SEQ ID NO: 1900035 - DNA, 17 bp, Homo sapiens
cagcccagaagtgcaga

SEQ ID NO: 1900036 - DNA, 20 bp, Homo sapiens
cagcccgatcctcccctgga

SEQ ID NO: 1900037 - DNA, 24 bp, Homo sapiens
cagcccgatcctcccctggactcc

SEQ ID NO: 1900038 - DNA, 16 bp, Homo sapiens
cagcctaggcttggct

SEQ ID NO: 1900039 - DNA, 21 bp, Homo sapiens
cagcctcaaatccaggaccct

SEQ ID NO: 1900040 - DNA, 13 bp, Homo sapiens
cagcctcccacag

SEQ ID NO: 1900041 - DNA, 12 bp, Homo sapiens
cagcctcccctt

SEQ ID NO: 1900042 - DNA, 20 bp, Homo sapiens
cagcctccctgacgtctgcc

SEQ ID NO: 1900043 - DNA, 18 bp, Homo sapiens
cagcctccgcttccctgg

SEQ ID NO: 1900044 - DNA, 14 bp, Homo sapiens
cagcctgcctctgc

SEQ ID NO: 1900045 - DNA, 19 bp, Homo sapiens
cagcctgcctctgccacag

SEQ ID NO: 1900046 - DNA, 21 bp, Homo sapiens
cagccttccagtggcttctcc

SEQ ID NO: 1900047 - DNA, 15 bp, Homo sapiens
cagcgaggctgggct

SEQ ID NO: 1900048 - DNA, 19 bp, Homo sapiens
cagcgaggctgggctggcc

SEQ ID NO: 1900049 - DNA, 20 bp, Homo sapiens
cagcgaggctgggctggcca

SEQ ID NO: 1900050 - DNA, 23 bp, Homo sapiens
cagcgccactgtccgctgtctcc

SEQ ID NO: 1900051 - DNA, 21 bp, Homo sapiens
cagcgcccccactcctcctcc

SEQ ID NO: 1900052 - DNA, 23 bp, Homo sapiens
cagcgcggacatcccctgctggc

SEQ ID NO: 1900053 - DNA, 14 bp, Homo sapiens
cagcggccctccca

SEQ ID NO: 1900054 - DNA, 17 bp, Homo sapiens
cagcggccctcccaggc

SEQ ID NO: 1900055 - DNA, 23 bp, Homo sapiens
atatgtatgtgtttagaattgaa

SEQ ID NO: 1900056 - DNA, 21 bp, Homo sapiens
atatgtggtccatctctgaaa

SEQ ID NO: 1900057 - DNA, 23 bp, Homo sapiens
atatgtggtccatctctgaaaac

SEQ ID NO: 1900058 - DNA, 16 bp, Homo sapiens
atatgtttccttccct

SEQ ID NO: 1900059 - DNA, 17 bp, Homo sapiens
atatgtttccttccctc

SEQ ID NO: 1900060 - DNA, 17 bp, Homo sapiens
atattactgtacatggg

SEQ ID NO: 1900061 - DNA, 20 bp, Homo sapiens
atattgcagtgtgaatgctg

SEQ ID NO: 1900062 - DNA, 15 bp, Homo sapiens
atattggttttatga

SEQ ID NO: 1900063 - DNA, 18 bp, Homo sapiens
atattggttttatgatga

SEQ ID NO: 1900064 - DNA, 19 bp, Homo sapiens
atattggttttatgatgac

SEQ ID NO: 1900065 - DNA, 12 bp, Homo sapiens
atattgtaagaa

SEQ ID NO: 1900066 - DNA, 22 bp, Homo sapiens
atatttatgactttcacatttg

SEQ ID NO: 1900067 - DNA, 19 bp, Homo sapiens
atatttatttatgctaata

SEQ ID NO: 1900068 - DNA, 14 bp, Homo sapiens
atatttgatttatt

SEQ ID NO: 1900069 - DNA, 18 bp, Homo sapiens
atatttgatttattaact

SEQ ID NO: 1900070 - DNA, 18 bp, Homo sapiens
atatttggcttatattct

SEQ ID NO: 1900071 - DNA, 14 bp, Homo sapiens
atattttcttaaaa

SEQ ID NO: 1900072 - DNA, 22 bp, Homo sapiens
atattttgacccaagtggatat

SEQ ID NO: 1900073 - DNA, 17 bp, Homo sapiens
atatttttatatgtgga

SEQ ID NO: 1900074 - DNA, 22 bp, Homo sapiens
atatttttcttatttatgtaac

SEQ ID NO: 1900075 - DNA, 15 bp, Homo sapiens
atatttttgatcttt

SEQ ID NO: 1900076 - DNA, 12 bp, Homo sapiens
atcaaaaaggct

SEQ ID NO: 1900077 - DNA, 13 bp, Homo sapiens
atcaaaaaggctt

SEQ ID NO: 1900078 - DNA, 16 bp, Homo sapiens
atcaaaaaggcttata

SEQ ID NO: 1900079 - DNA, 21 bp, Homo sapiens
atcaaaaaggcttataaaaca

SEQ ID NO: 1900080 - DNA, 21 bp, Homo sapiens
atcaaaacctttcaaatatca

SEQ ID NO: 1900081 - DNA, 11 bp, Homo sapiens
atcaaagtgct

SEQ ID NO: 1900082 - DNA, 12 bp, Homo sapiens
atcaagaaagtc

SEQ ID NO: 1900083 - DNA, 14 bp, Homo sapiens
atcaagagccttaa

SEQ ID NO: 1900084 - DNA, 16 bp, Homo sapiens
atcaagagccttaaaa

SEQ ID NO: 1900085 - DNA, 21 bp, Homo sapiens
atcaagagccttaaaacatca

SEQ ID NO: 1900086 - DNA, 14 bp, Homo sapiens
atcaatgagtgtga

SEQ ID NO: 1900087 - DNA, 16 bp, Homo sapiens
atcacaaatgacttta

SEQ ID NO: 1900088 - DNA, 13 bp, Homo sapiens
atcacaggctggg

SEQ ID NO: 1900089 - DNA, 21 bp, Homo sapiens
atcacaggctgggctgggcac

SEQ ID NO: 1900090 - DNA, 15 bp, Homo sapiens
atcacagggcctcag

SEQ ID NO: 1900091 - DNA, 17 bp, Homo sapiens
atcactggcatggtggt

SEQ ID NO: 1900092 - DNA, 15 bp, Homo sapiens
atcactgtgtatatt

SEQ ID NO: 1900093 - DNA, 17 bp, Homo sapiens
atcactgtgtatatttg

SEQ ID NO: 1900094 - DNA, 18 bp, Homo sapiens
atcactgtttagatttgc

SEQ ID NO: 1900095 - DNA, 22 bp, Homo sapiens
atcactgtttagatttgccata

SEQ ID NO: 1900096 - DNA, 13 bp, Homo sapiens
atcacttaaaaca

SEQ ID NO: 1900097 - DNA, 14 bp, Homo sapiens
atcacttaaaacac

SEQ ID NO: 1900098 - DNA, 18 bp, Homo sapiens
atcacttaaaacacgttt

SEQ ID NO: 1900099 - DNA, 15 bp, Homo sapiens
atcagaacagctgtt

SEQ ID NO: 1900100 - DNA, 13 bp, Homo sapiens
atcagcactggat

SEQ ID NO: 1900101 - DNA, 13 bp, Homo sapiens
atcaggggcagga

SEQ ID NO: 1900102 - DNA, 14 bp, Homo sapiens
atcatagttttatt

SEQ ID NO: 1900103 - DNA, 16 bp, Homo sapiens
atcatattatacagac

SEQ ID NO: 1900104 - DNA, 18 bp, Homo sapiens
atcatggctcttagaaac

SEQ ID NO: 1900105 - DNA, 17 bp, Homo sapiens
atccaaggaaataatgt

SEQ ID NO: 1900106 - DNA, 17 bp, Homo sapiens
atccacccctctggcac

SEQ ID NO: 1900107 - DNA, 16 bp, Homo sapiens
atccaccgtcccctcc

SEQ ID NO: 1900108 - DNA, 14 bp, Homo sapiens
atccagtttttcat

SEQ ID NO: 1900109 - DNA, 12 bp, Homo sapiens
atccccttccag

SEQ ID NO: 1900110 - DNA, 23 bp, Homo sapiens
atccccttccagctccctcccct

SEQ ID NO: 1900111 - DNA, 17 bp, Homo sapiens
atcccgtttccctccag

SEQ ID NO: 1900112 - DNA, 12 bp, Homo sapiens
atccctgctcac

SEQ ID NO: 1900113 - DNA, 20 bp, Homo sapiens
atcctagtttgctgtggcct

SEQ ID NO: 1900114 - DNA, 14 bp, Homo sapiens
atcctcatggccca

SEQ ID NO: 1900115 - DNA, 16 bp, Homo sapiens
atcctcccctggactc

SEQ ID NO: 1900116 - DNA, 15 bp, Homo sapiens
atcctgcactgactc

SEQ ID NO: 1900117 - DNA, 21 bp, Homo sapiens
atccttagatgtgtctcctgt

SEQ ID NO: 1900118 - DNA, 19 bp, Homo sapiens
atccttgtgtttatcagaa

SEQ ID NO: 1900119 - DNA, 22 bp, Homo sapiens
atcgagtgccgcatctcacagc

SEQ ID NO: 1900120 - DNA, 15 bp, Homo sapiens
atcggcatttgtttc

SEQ ID NO: 1900121 - DNA, 15 bp, Homo sapiens
atctaacagtaacac

SEQ ID NO: 1900122 - DNA, 15 bp, Homo sapiens
atctaaggaaacatt

SEQ ID NO: 1900123 - DNA, 13 bp, Homo sapiens
atctactgcattt

SEQ ID NO: 1900124 - DNA, 14 bp, Homo sapiens
atctactgcattta

SEQ ID NO: 1900125 - DNA, 18 bp, Homo sapiens
atctactgcatttaggga

SEQ ID NO: 1900126 - DNA, 17 bp, Homo sapiens
atctaggggagccttga

SEQ ID NO: 1900127 - DNA, 20 bp, Homo sapiens
atctaggggagccttgattc

SEQ ID NO: 1900128 - DNA, 12 bp, Homo sapiens
atctagtgtttg

SEQ ID NO: 1900129 - DNA, 15 bp, Homo sapiens
atctcacagctatgc

SEQ ID NO: 1900130 - DNA, 11 bp, Homo sapiens
atctctgaaaa

SEQ ID NO: 1900131 - DNA, 11 bp, Homo sapiens
atctcttcctt

SEQ ID NO: 1900132 - DNA, 12 bp, Homo sapiens
atctcttccttt

SEQ ID NO: 1900133 - DNA, 15 bp, Homo sapiens
atctcttcctttcct

SEQ ID NO: 1900134 - DNA, 16 bp, Homo sapiens
atctcttcctttcctt

SEQ ID NO: 1900135 - DNA, 14 bp, Homo sapiens
atctgagaatgaac

SEQ ID NO: 1900136 - DNA, 16 bp, Homo sapiens
atctgatatcagcact

SEQ ID NO: 1900137 - DNA, 19 bp, Homo sapiens
atctgatatcagcactgga

SEQ ID NO: 1900138 - DNA, 20 bp, Homo sapiens
atctgatatcagcactggat

SEQ ID NO: 1900139 - DNA, 12 bp, Homo sapiens
atctgccacctg

SEQ ID NO: 1900140 - DNA, 14 bp, Homo sapiens
atctgccacctgca

SEQ ID NO: 1900141 - DNA, 16 bp, Homo sapiens
atctgccacctgcaca

SEQ ID NO: 1900142 - DNA, 16 bp, Homo sapiens
atctgctgcagagcag

SEQ ID NO: 1900143 - DNA, 21 bp, Homo sapiens
atctggaccccatctgtgaat

SEQ ID NO: 1900144 - DNA, 22 bp, Homo sapiens
atctggaccccatctgtgaata

SEQ ID NO: 1900145 - DNA, 13 bp, Homo sapiens
atctgtgaataag

SEQ ID NO: 1900146 - DNA, 14 bp, Homo sapiens
atctgtgtaaaatc

SEQ ID NO: 1900147 - DNA, 20 bp, Homo sapiens
atcttaagtcataatgaata

SEQ ID NO: 1900148 - DNA, 12 bp, Homo sapiens
atcttactttgt

SEQ ID NO: 1900149 - DNA, 17 bp, Homo sapiens
atcttgctctcttttat

SEQ ID NO: 1900150 - DNA, 14 bp, Homo sapiens
atcttgtaaatatt

SEQ ID NO: 1900151 - DNA, 15 bp, Homo sapiens
atcttgtgaaaataa

SEQ ID NO: 1900152 - DNA, 19 bp, Homo sapiens
atcttgtgaaaataattga

SEQ ID NO: 1900153 - DNA, 17 bp, Homo sapiens
atctttaactgaactct

SEQ ID NO: 1900154 - DNA, 12 bp, Homo sapiens
atctttgagtgt

SEQ ID NO: 1900155 - DNA, 20 bp, Homo sapiens
attcctttttatttatatgt

SEQ ID NO: 1900156 - DNA, 16 bp, Homo sapiens
attcgtacataatact

SEQ ID NO: 1900157 - DNA, 16 bp, Homo sapiens
attctaataagctagt

SEQ ID NO: 1900158 - DNA, 19 bp, Homo sapiens
attctaataagctagttga

SEQ ID NO: 1900159 - DNA, 22 bp, Homo sapiens
attctattaaaggaaactttga

SEQ ID NO: 1900160 - DNA, 13 bp, Homo sapiens
attctatttgtgt

SEQ ID NO: 1900161 - DNA, 20 bp, Homo sapiens
attctcataatactgaaatg

SEQ ID NO: 1900162 - DNA, 18 bp, Homo sapiens
attctcccgggactctgc

SEQ ID NO: 1900163 - DNA, 14 bp, Homo sapiens
attctccctaaagt

SEQ ID NO: 1900164 - DNA, 18 bp, Homo sapiens
attctccctaaagtgttg

SEQ ID NO: 1900165 - DNA, 19 bp, Homo sapiens
attctccctaaagtgttgt

SEQ ID NO: 1900166 - DNA, 14 bp, Homo sapiens
attctgaccttaaa

SEQ ID NO: 1900167 - DNA, 18 bp, Homo sapiens
attctgaccttaaatgca

SEQ ID NO: 1900168 - DNA, 17 bp, Homo sapiens
attctgagtgaaaattt

SEQ ID NO: 1900169 - DNA, 20 bp, Homo sapiens
attctgatttcttttcacca

SEQ ID NO: 1900170 - DNA, 16 bp, Homo sapiens
attctggttgtaaatc

SEQ ID NO: 1900171 - DNA, 17 bp, Homo sapiens
attctggttgtaaatct

SEQ ID NO: 1900172 - DNA, 17 bp, Homo sapiens
attctgtaaaagaaaaa

SEQ ID NO: 1900173 - DNA, 22 bp, Homo sapiens
attctgtggaaaaataaaggaa

SEQ ID NO: 1900174 - DNA, 22 bp, Homo sapiens
attcttttttattaatcactgt

SEQ ID NO: 1900175 - DNA, 19 bp, Homo sapiens
attgaaggtttttgatagc

SEQ ID NO: 1900176 - DNA, 20 bp, Homo sapiens
attgaaggtttttgatagca

SEQ ID NO: 1900177 - DNA, 18 bp, Homo sapiens
attgacacagtaccattt

SEQ ID NO: 1900178 - DNA, 14 bp, Homo sapiens
attgactcttgagt

SEQ ID NO: 1900179 - DNA, 16 bp, Homo sapiens
attgactcttgagttg

SEQ ID NO: 1900180 - DNA, 22 bp, Homo sapiens
attgactcttgagttgtttttg

SEQ ID NO: 1900181 - DNA, 16 bp, Homo sapiens
attgagaatagaaatt

SEQ ID NO: 1900182 - DNA, 21 bp, Homo sapiens
attgagaccgtgaagatactt

SEQ ID NO: 1900183 - DNA, 16 bp, Homo sapiens
attgatacgtttatta

SEQ ID NO: 1900184 - DNA, 13 bp, Homo sapiens
attgcacaatata

SEQ ID NO: 1900185 - DNA, 20 bp, Homo sapiens
attgcagtgtgaatgctggg

SEQ ID NO: 1900186 - DNA, 18 bp, Homo sapiens
attgcatataacttatat

SEQ ID NO: 1900187 - DNA, 22 bp, Homo sapiens
attgcatataacttatattgta

SEQ ID NO: 1900188 - DNA, 20 bp, Homo sapiens
attgcatctgggtagctgta

SEQ ID NO: 1900189 - DNA, 16 bp, Homo sapiens
attgcctcaataaagc

SEQ ID NO: 1900190 - DNA, 15 bp, Homo sapiens
attgctgccaggatt

SEQ ID NO: 1900191 - DNA, 19 bp, Homo sapiens
attggtgtaaggtactttc

SEQ ID NO: 1900192 - DNA, 13 bp, Homo sapiens
attgtaaaagcat

SEQ ID NO: 1900193 - DNA, 19 bp, Homo sapiens
attgtaaaagcattttgta

SEQ ID NO: 1900194 - DNA, 12 bp, Homo sapiens
attgtaagaaat

SEQ ID NO: 1900195 - DNA, 14 bp, Homo sapiens
attgtaagaaatac

SEQ ID NO: 1900196 - DNA, 17 bp, Homo sapiens
attgtagacctgtttca

SEQ ID NO: 1900197 - DNA, 20 bp, Homo sapiens
attgtcctattagtgttata

SEQ ID NO: 1900198 - DNA, 21 bp, Homo sapiens
attgtcctattagtgttatat

SEQ ID NO: 1900199 - DNA, 15 bp, Homo sapiens
attgtcttaatggat

SEQ ID NO: 1900200 - DNA, 23 bp, Homo sapiens
attgtcttaatggatgaaatcat

SEQ ID NO: 1900201 - DNA, 17 bp, Homo sapiens
attgttgtttgtatgta

SEQ ID NO: 1900202 - DNA, 18 bp, Homo sapiens
attgttgtttgtatgtat

SEQ ID NO: 1900203 - DNA, 20 bp, Homo sapiens
attgtttctttaagaaagta

SEQ ID NO: 1900204 - DNA, 19 bp, Homo sapiens
attgttttgcattgtctgt

SEQ ID NO: 1900205 - DNA, 16 bp, Homo sapiens
atttaaaaataaatgt

SEQ ID NO: 1900206 - DNA, 19 bp, Homo sapiens
atttaacttttaaagaatt

SEQ ID NO: 1900207 - DNA, 12 bp, Homo sapiens
atttaagttttg

SEQ ID NO: 1900208 - DNA, 20 bp, Homo sapiens
atttaagttttgacaagctg

SEQ ID NO: 1900209 - DNA, 17 bp, Homo sapiens
atttaatggggaggaca

SEQ ID NO: 1900210 - DNA, 23 bp, Homo sapiens
atttacgcctgtaaatgtattca

SEQ ID NO: 1900211 - DNA, 16 bp, Homo sapiens
atttagatgcatatta

SEQ ID NO: 1900212 - DNA, 20 bp, Homo sapiens
atttagggagtattctaata

SEQ ID NO: 1900213 - DNA, 20 bp, Homo sapiens
atttagtaaatgctgaaata

SEQ ID NO: 1900214 - DNA, 20 bp, Homo sapiens
atttatataactgttgttga

SEQ ID NO: 1900215 - DNA, 13 bp, Homo sapiens
atttatatgtatg

SEQ ID NO: 1900216 - DNA, 16 bp, Homo sapiens
atttatatgtatgtgt

SEQ ID NO: 1900217 - DNA, 17 bp, Homo sapiens
atttatatgtatgtgtt

SEQ ID NO: 1900218 - DNA, 21 bp, Homo sapiens
atttatatgtatgtgtttaga

SEQ ID NO: 1900219 - DNA, 22 bp, Homo sapiens
atttatatttattgactcttga

SEQ ID NO: 1900220 - DNA, 20 bp, Homo sapiens
atttattaacttaataatca

SEQ ID NO: 1900221 - DNA, 21 bp, Homo sapiens
atttattaacttaataatcaa

SEQ ID NO: 1900222 - DNA, 16 bp, Homo sapiens
atttattgactcttga

SEQ ID NO: 1900223 - DNA, 14 bp, Homo sapiens
atttatttatgcta

SEQ ID NO: 1900224 - DNA, 20 bp, Homo sapiens
atttatttttaagaaagaaa

SEQ ID NO: 1900225 - DNA, 19 bp, Homo sapiens
atttattttttttaattgt

SEQ ID NO: 1900226 - DNA, 16 bp, Homo sapiens
atttcaaaatatgtgt

SEQ ID NO: 1900227 - DNA, 17 bp, Homo sapiens
atttcaagtacactgaa

SEQ ID NO: 1900228 - DNA, 12 bp, Homo sapiens
atttcacactgg

SEQ ID NO: 1900229 - DNA, 15 bp, Homo sapiens
atttcacttgaaatt

SEQ ID NO: 1900230 - DNA, 16 bp, Homo sapiens
atttcacttgaaatta

SEQ ID NO: 1900231 - DNA, 17 bp, Homo sapiens
atttcacttgaaattaa

SEQ ID NO: 1900232 - DNA, 21 bp, Homo sapiens
atttccattaaaggtggaaaa

SEQ ID NO: 1900233 - DNA, 18 bp, Homo sapiens
atttcctatgtattctgg

SEQ ID NO: 1900234 - DNA, 14 bp, Homo sapiens
atttctctttctct

SEQ ID NO: 1900235 - DNA, 13 bp, Homo sapiens
atttgaaagtgcc

SEQ ID NO: 1900236 - DNA, 20 bp, Homo sapiens
atttgaaagtgcctttgcag

SEQ ID NO: 1900237 - DNA, 14 bp, Homo sapiens
atttgaataatgtc

SEQ ID NO: 1900238 - DNA, 17 bp, Homo sapiens
atttgatgactgaaaat

SEQ ID NO: 1900239 - DNA, 15 bp, Homo sapiens
atttgatttattaac

SEQ ID NO: 1900240 - DNA, 17 bp, Homo sapiens
atttgcacacatttaaa

SEQ ID NO: 1900241 - DNA, 13 bp, Homo sapiens
atttgccatagag

SEQ ID NO: 1900242 - DNA, 16 bp, Homo sapiens
atttgcccctggcaaa

SEQ ID NO: 1900243 - DNA, 17 bp, Homo sapiens
atttgcccctggcaaat

SEQ ID NO: 1900244 - DNA, 18 bp, Homo sapiens
atttgcccctggcaaatg

SEQ ID NO: 1900245 - DNA, 15 bp, Homo sapiens
atttgctgcatgggt

SEQ ID NO: 1900246 - DNA, 13 bp, Homo sapiens
atttgctttggaa

SEQ ID NO: 1900247 - DNA, 14 bp, Homo sapiens
atttggcttcctct

SEQ ID NO: 1900248 - DNA, 21 bp, Homo sapiens
atttggggaccacagaggctg

SEQ ID NO: 1900249 - DNA, 20 bp, Homo sapiens
atttggtctctcccagctct

SEQ ID NO: 1900250 - DNA, 23 bp, Homo sapiens
atttgtaaaagaacagtaaacat

SEQ ID NO: 1900251 - DNA, 21 bp, Homo sapiens
atttgtacagattctttatta

SEQ ID NO: 1900252 - DNA, 19 bp, Homo sapiens
atttgtgtaaggactttgg

SEQ ID NO: 1900253 - DNA, 22 bp, Homo sapiens
atttgtgtaaggactttggctt

SEQ ID NO: 1900254 - DNA, 18 bp, Homo sapiens
atttgtttaataccctgt

SEQ ID NO: 1900255 - DNA, 20 bp, Homo sapiens
attttagaataaaattataa

SEQ ID NO: 1900256 - DNA, 15 bp, Homo sapiens
attttagaatgtcaa

SEQ ID NO: 1900257 - DNA, 20 bp, Homo sapiens
attttagttccttctataca

SEQ ID NO: 1900258 - DNA, 14 bp, Homo sapiens
attttcagaagctg

SEQ ID NO: 1900259 - DNA, 19 bp, Homo sapiens
attttcagacatttttgga

SEQ ID NO: 1900260 - DNA, 13 bp, Homo sapiens
attttcagattca

SEQ ID NO: 1900261 - DNA, 19 bp, Homo sapiens
attttcccccttggctctc

SEQ ID NO: 1900262 - DNA, 23 bp, Homo sapiens
attttcctttaatatgaaatttt

SEQ ID NO: 1900263 - DNA, 11 bp, Homo sapiens
attttctttcc

SEQ ID NO: 1900264 - DNA, 14 bp, Homo sapiens
attttctttccttt

SEQ ID NO: 1900265 - DNA, 23 bp, Homo sapiens
attttgaaaaattacctgtataa

SEQ ID NO: 1900266 - DNA, 12 bp, Homo sapiens
attttgaaaagt

SEQ ID NO: 1900267 - DNA, 16 bp, Homo sapiens
attttgaaaagtaata

SEQ ID NO: 1900268 - DNA, 12 bp, Homo sapiens
attttgaaataa

SEQ ID NO: 1900269 - DNA, 19 bp, Homo sapiens
attttgaaataaaaatgga

SEQ ID NO: 1900270 - DNA, 20 bp, Homo sapiens
attttgaaatattgatgcag

SEQ ID NO: 1900271 - DNA, 21 bp, Homo sapiens
attttgacccaagtggatatt

SEQ ID NO: 1900272 - DNA, 18 bp, Homo sapiens
attttgaccttgtattga

SEQ ID NO: 1900273 - DNA, 17 bp, Homo sapiens
attttgatgtaaagatg

SEQ ID NO: 1900274 - DNA, 16 bp, Homo sapiens
attttggttttctact

SEQ ID NO: 1900275 - DNA, 18 bp, Homo sapiens
attttggttttctactgt

SEQ ID NO: 1900276 - DNA, 16 bp, Homo sapiens
attttgtgtaagaaat

SEQ ID NO: 1900277 - DNA, 20 bp, Homo sapiens
attttgtgtaagaaatacag

SEQ ID NO: 1900278 - DNA, 21 bp, Homo sapiens
atttttaacaagtcatttcaa

SEQ ID NO: 1900279 - DNA, 17 bp, Homo sapiens
atttttaggacatgaaa

SEQ ID NO: 1900280 - DNA, 14 bp, Homo sapiens
atttttataagaaa

SEQ ID NO: 1900281 - DNA, 13 bp, Homo sapiens
atttttctttatt

SEQ ID NO: 1900282 - DNA, 21 bp, Homo sapiens
atttttgatctttgagtgtat

SEQ ID NO: 1900283 - DNA, 14 bp, Homo sapiens
atttttgcaggagc

SEQ ID NO: 1900284 - DNA, 14 bp, Homo sapiens
atttttgcttttga

SEQ ID NO: 1900285 - DNA, 17 bp, Homo sapiens
atttttggttgaataaa

SEQ ID NO: 1900286 - DNA, 17 bp, Homo sapiens
attttttttaattgtat

SEQ ID NO: 1900287 - DNA, 18 bp, Homo sapiens
attttttttaattgtatt

SEQ ID NO: 1900288 - DNA, 18 bp, Homo sapiens
atttttttttttaatcta

SEQ ID NO: 1900289 - DNA, 17 bp, Homo sapiens
caaaaatacatcaagga

SEQ ID NO: 1900290 - DNA, 15 bp, Homo sapiens
caaaaatcagcagat

SEQ ID NO: 1900291 - DNA, 15 bp, Homo sapiens
caaaacaaaggccta

SEQ ID NO: 1900292 - DNA, 13 bp, Homo sapiens
caaaaggtgtgcc

SEQ ID NO: 1900293 - DNA, 13 bp, Homo sapiens
caaaagtggtcag

SEQ ID NO: 1900294 - DNA, 22 bp, Homo sapiens
caaaataacaaaaaagagaaac

SEQ ID NO: 1900295 - DNA, 14 bp, Homo sapiens
caaaatacttttta

SEQ ID NO: 1900296 - DNA, 15 bp, Homo sapiens
caaaatactttttaa

SEQ ID NO: 1900297 - DNA, 15 bp, Homo sapiens
caaaatgaaaagaga

SEQ ID NO: 1900298 - DNA, 20 bp, Homo sapiens
caaaatgggagatcttctca

SEQ ID NO: 1900299 - DNA, 21 bp, Homo sapiens
caaaatgtgagtggttgaata

SEQ ID NO: 1900300 - DNA, 19 bp, Homo sapiens
caaaattaaggtgtttgaa

SEQ ID NO: 1900301 - DNA, 20 bp, Homo sapiens
caaaattaaggtgtttgaaa

SEQ ID NO: 1900302 - DNA, 18 bp, Homo sapiens
caaacaaatggaagagaa

SEQ ID NO: 1900303 - DNA, 15 bp, Homo sapiens
caaacacacagaagg

SEQ ID NO: 1900304 - DNA, 15 bp, Homo sapiens
caaacccaaaggacc

SEQ ID NO: 1900305 - DNA, 17 bp, Homo sapiens
caaacccaccctttcta

SEQ ID NO: 1900306 - DNA, 13 bp, Homo sapiens
caaacccctgacc

SEQ ID NO: 1900307 - DNA, 15 bp, Homo sapiens
caaaccttactctga

SEQ ID NO: 1900308 - DNA, 20 bp, Homo sapiens
caaactctcaaatcatgaag

SEQ ID NO: 1900309 - DNA, 20 bp, Homo sapiens
caaactggaatgagcagctt

SEQ ID NO: 1900310 - DNA, 22 bp, Homo sapiens
caaagacctagattattgaatt

SEQ ID NO: 1900311 - DNA, 16 bp, Homo sapiens
caaagagacagggccc

SEQ ID NO: 1900312 - DNA, 22 bp, Homo sapiens
caaagctctgaattcaggtccc

SEQ ID NO: 1900313 - DNA, 20 bp, Homo sapiens
caaaggagcattgcagtcac

SEQ ID NO: 1900314 - DNA, 20 bp, Homo sapiens
caaagtgggtactttctgaa

SEQ ID NO: 1900315 - DNA, 17 bp, Homo sapiens
caaagtttgctgaaaga

SEQ ID NO: 1900316 - DNA, 22 bp, Homo sapiens
caaataagcactcctttaaagc

SEQ ID NO: 1900317 - DNA, 12 bp, Homo sapiens
caaatcatgaag

SEQ ID NO: 1900318 - DNA, 21 bp, Homo sapiens
caaatccaggaccctgccagg

SEQ ID NO: 1900319 - DNA, 15 bp, Homo sapiens
caaatccgaaatcag

SEQ ID NO: 1900320 - DNA, 14 bp, Homo sapiens
caaatgactttatt

SEQ ID NO: 1900321 - DNA, 16 bp, Homo sapiens
caaatgactttattat

SEQ ID NO: 1900322 - DNA, 21 bp, Homo sapiens
caaatgcacacacctcatgct

SEQ ID NO: 1900323 - DNA, 15 bp, Homo sapiens
caaatgcatctttga

SEQ ID NO: 1900324 - DNA, 20 bp, Homo sapiens
caaatggaagagaagagaaa

SEQ ID NO: 1900325 - DNA, 17 bp, Homo sapiens
caaatgtgtgcccagct

SEQ ID NO: 1900326 - DNA, 16 bp, Homo sapiens
caaattaattgtgtga

SEQ ID NO: 1900327 - DNA, 22 bp, Homo sapiens
caaattccatagctcaataaaa

SEQ ID NO: 1900328 - DNA, 19 bp, Homo sapiens
caaatttaacttttaaaga

SEQ ID NO: 1900329 - DNA, 14 bp, Homo sapiens
caaatttgtgaact

SEQ ID NO: 1900330 - DNA, 20 bp, Homo sapiens
caaatttgtgaactgtcatg

SEQ ID NO: 1900331 - DNA, 20 bp, Homo sapiens
caacaatgtgttgtaaaaat

SEQ ID NO: 1900332 - DNA, 23 bp, Homo sapiens
caacaattctcccgggactctgc

SEQ ID NO: 1900333 - DNA, 13 bp, Homo sapiens
caacaattttcta

SEQ ID NO: 1900334 - DNA, 17 bp, Homo sapiens
aatacttgaaccataaa

SEQ ID NO: 1900335 - DNA, 19 bp, Homo sapiens
aatacttgaaccataaaat

SEQ ID NO: 1900336 - DNA, 22 bp, Homo sapiens
aatagaagctaaggtttagata

SEQ ID NO: 1900337 - DNA, 16 bp, Homo sapiens
aatagctttaatgata

SEQ ID NO: 1900338 - DNA, 14 bp, Homo sapiens
aataggatgggctt

SEQ ID NO: 1900339 - DNA, 13 bp, Homo sapiens
aataggattaatg

SEQ ID NO: 1900340 - DNA, 21 bp, Homo sapiens
aatagtatccagcacagattt

SEQ ID NO: 1900341 - DNA, 13 bp, Homo sapiens
aatagtgattttt

SEQ ID NO: 1900342 - DNA, 12 bp, Homo sapiens
aatataaaaaca

SEQ ID NO: 1900343 - DNA, 13 bp, Homo sapiens
aatataatattgt

SEQ ID NO: 1900344 - DNA, 12 bp, Homo sapiens
aatatattttag

SEQ ID NO: 1900345 - DNA, 17 bp, Homo sapiens
aatatatttttactgct

SEQ ID NO: 1900346 - DNA, 18 bp, Homo sapiens
aatatctaataaaaagtc

SEQ ID NO: 1900347 - DNA, 23 bp, Homo sapiens
aatatgaaattttttttcatgct

SEQ ID NO: 1900348 - DNA, 13 bp, Homo sapiens
aatatgggagaaa

SEQ ID NO: 1900349 - DNA, 18 bp, Homo sapiens
aatatggtcttttggtta

SEQ ID NO: 1900350 - DNA, 20 bp, Homo sapiens
aatatgtggtccatctctga

SEQ ID NO: 1900351 - DNA, 23 bp, Homo sapiens
aatatgtggtccatctctgaaaa

SEQ ID NO: 1900352 - DNA, 13 bp, Homo sapiens
aatcaaagtgcta

SEQ ID NO: 1900353 - DNA, 14 bp, Homo sapiens
aatcaaatatgtgg

SEQ ID NO: 1900354 - DNA, 15 bp, Homo sapiens
aatcaaatgtaaagt

SEQ ID NO: 1900355 - DNA, 17 bp, Homo sapiens
aatcaagagccttaaaa

SEQ ID NO: 1900356 - DNA, 10 bp, Homo sapiens
aatcactgtg

SEQ ID NO: 1900357 - DNA, 15 bp, Homo sapiens
aatcactgtgtatat

SEQ ID NO: 1900358 - DNA, 16 bp, Homo sapiens
aatcactgtgtatatt

SEQ ID NO: 1900359 - DNA, 18 bp, Homo sapiens
aatcactgtgtatatttg

SEQ ID NO: 1900360 - DNA, 14 bp, Homo sapiens
aatcatggctctta

SEQ ID NO: 1900361 - DNA, 18 bp, Homo sapiens
aatcatggctcttagaaa

SEQ ID NO: 1900362 - DNA, 21 bp, Homo sapiens
aatcatggctcttagaaactc

SEQ ID NO: 1900363 - DNA, 13 bp, Homo sapiens
aatcattgcaaac

SEQ ID NO: 1900364 - DNA, 11 bp, Homo sapiens
aatcatttgtt

SEQ ID NO: 1900365 - DNA, 23 bp, Homo sapiens
aatccaggaccctgccaggcaca

SEQ ID NO: 1900366 - DNA, 13 bp, Homo sapiens
aatccctgctcac

SEQ ID NO: 1900367 - DNA, 18 bp, Homo sapiens
aatccctgctcactgcag

SEQ ID NO: 1900368 - DNA, 18 bp, Homo sapiens
aatccctgtgttaattta

SEQ ID NO: 1900369 - DNA, 15 bp, Homo sapiens
aatcggggtataata

SEQ ID NO: 1900370 - DNA, 19 bp, Homo sapiens
aatcggggtataataggct

SEQ ID NO: 1900371 - DNA, 13 bp, Homo sapiens
aatctactgcatt

SEQ ID NO: 1900372 - DNA, 22 bp, Homo sapiens
aatctagccagtgaacataatt

SEQ ID NO: 1900373 - DNA, 21 bp, Homo sapiens
aatctggaccccatctgtgaa

SEQ ID NO: 1900374 - DNA, 22 bp, Homo sapiens
aatctggaccccatctgtgaat

SEQ ID NO: 1900375 - DNA, 13 bp, Homo sapiens
aatcttactttgt

SEQ ID NO: 1900376 - DNA, 17 bp, Homo sapiens
aatcttgtccaagttgt

SEQ ID NO: 1900377 - DNA, 17 bp, Homo sapiens
aatctttaactgaactc

SEQ ID NO: 1900378 - DNA, 21 bp, Homo sapiens
aatgaacaagcattctctcca

SEQ ID NO: 1900379 - DNA, 17 bp, Homo sapiens
aatgaacacagctcttt

SEQ ID NO: 1900380 - DNA, 21 bp, Homo sapiens
aatgaacacagctctttaaca

SEQ ID NO: 1900381 - DNA, 18 bp, Homo sapiens
aatgaagaatttaaagaa

SEQ ID NO: 1900382 - DNA, 15 bp, Homo sapiens
aatgacaggcctgtc

SEQ ID NO: 1900383 - DNA, 13 bp, Homo sapiens
aatgactttatta

SEQ ID NO: 1900384 - DNA, 14 bp, Homo sapiens
aatgactttcataa

SEQ ID NO: 1900385 - DNA, 15 bp, Homo sapiens
aatgatatgcttgta

SEQ ID NO: 1900386 - DNA, 18 bp, Homo sapiens
aatgatatgcttgtaact

SEQ ID NO: 1900387 - DNA, 14 bp, Homo sapiens
aatgcatctttgat

SEQ ID NO: 1900388 - DNA, 16 bp, Homo sapiens
aatgcctaaaagtttt

SEQ ID NO: 1900389 - DNA, 23 bp, Homo sapiens
aatgctgacccatgggcaggaga

SEQ ID NO: 1900390 - DNA, 18 bp, Homo sapiens
aatggaagagaagagaaa

SEQ ID NO: 1900391 - DNA, 20 bp, Homo sapiens
aatggacggtttaggtgaaa

SEQ ID NO: 1900392 - DNA, 18 bp, Homo sapiens
aatggagaattaaaactt

SEQ ID NO: 1900393 - DNA, 20 bp, Homo sapiens
aatggagttaaactttagtg

SEQ ID NO: 1900394 - DNA, 12 bp, Homo sapiens
aatggatgaaat

SEQ ID NO: 1900395 - DNA, 13 bp, Homo sapiens
aatggatgaaatc

SEQ ID NO: 1900396 - DNA, 17 bp, Homo sapiens
aatggcaagttttccat

SEQ ID NO: 1900397 - DNA, 19 bp, Homo sapiens
aatggcgtgaacccgggag

SEQ ID NO: 1900398 - DNA, 20 bp, Homo sapiens
aatggtactccacatatttc

SEQ ID NO: 1900399 - DNA, 18 bp, Homo sapiens
aatgtatcaaatacattt

SEQ ID NO: 1900400 - DNA, 14 bp, Homo sapiens
aatgtattcattct

SEQ ID NO: 1900401 - DNA, 15 bp, Homo sapiens
aatgtcaaatgtgaa

SEQ ID NO: 1900402 - DNA, 20 bp, Homo sapiens
aatgtccagtaagatcactg

SEQ ID NO: 1900403 - DNA, 19 bp, Homo sapiens
aatgtctagattttgaaaa

SEQ ID NO: 1900404 - DNA, 21 bp, Homo sapiens
aatgtctagattttgaaaaat

SEQ ID NO: 1900405 - DNA, 22 bp, Homo sapiens
aatgtgagtggttgaatatgat

SEQ ID NO: 1900406 - DNA, 19 bp, Homo sapiens
aatgtgatataaacagctt

SEQ ID NO: 1900407 - DNA, 20 bp, Homo sapiens
aatgtgtctatttctgaaag

SEQ ID NO: 1900408 - DNA, 15 bp, Homo sapiens
aatgtgttttggtcc

SEQ ID NO: 1900409 - DNA, 21 bp, Homo sapiens
aatgttttggtctgaaaagct

SEQ ID NO: 1900410 - DNA, 15 bp, Homo sapiens
aattaaaactttgta

SEQ ID NO: 1900411 - DNA, 17 bp, Homo sapiens
aattaaaactttgtaga

SEQ ID NO: 1900412 - DNA, 13 bp, Homo sapiens
aattaaggtgttt

SEQ ID NO: 1900413 - DNA, 18 bp, Homo sapiens
aattaaggtgtttgaaaa

SEQ ID NO: 1900414 - DNA, 17 bp, Homo sapiens
aattacaccacaagtat

SEQ ID NO: 1900415 - DNA, 14 bp, Homo sapiens
aattacctgtataa

SEQ ID NO: 1900416 - DNA, 16 bp, Homo sapiens
aattacctgtataatg

SEQ ID NO: 1900417 - DNA, 15 bp, Homo sapiens
aattattgatgaaaa

SEQ ID NO: 1900418 - DNA, 16 bp, Homo sapiens
aattcaaaatactttt

SEQ ID NO: 1900419 - DNA, 17 bp, Homo sapiens
aattcaccacagacttt

SEQ ID NO: 1900420 - DNA, 18 bp, Homo sapiens
aattcagaaatccttgta

SEQ ID NO: 1900421 - DNA, 21 bp, Homo sapiens
aattcaggtcccagttgctgt

SEQ ID NO: 1900422 - DNA, 23 bp, Homo sapiens
aattcagtgatgtgcctaaataa

SEQ ID NO: 1900423 - DNA, 17 bp, Homo sapiens
aattccgagtctttctc

SEQ ID NO: 1900424 - DNA, 19 bp, Homo sapiens
aattctcccgggactctgc

SEQ ID NO: 1900425 - DNA, 13 bp, Homo sapiens
aattctgatttct

SEQ ID NO: 1900426 - DNA, 21 bp, Homo sapiens
aattcttattactagactgcc

SEQ ID NO: 1900427 - DNA, 14 bp, Homo sapiens
aattcttttttatt

SEQ ID NO: 1900428 - DNA, 18 bp, Homo sapiens
aattcttttttattaatc

SEQ ID NO: 1900429 - DNA, 21 bp, Homo sapiens
aattcttttttattaatcact

SEQ ID NO: 1900430 - DNA, 16 bp, Homo sapiens
aattgaaggtttttga

SEQ ID NO: 1900431 - DNA, 18 bp, Homo sapiens
aattgaaggtttttgata

SEQ ID NO: 1900432 - DNA, 18 bp, Homo sapiens
aattgacaggcgaaagaa

SEQ ID NO: 1900433 - DNA, 17 bp, Homo sapiens
aattgagaatagaaatt

SEQ ID NO: 1900434 - DNA, 11 bp, Homo sapiens
aattgagaatg

SEQ ID NO: 1900435 - DNA, 14 bp, Homo sapiens
aattgtactttgaa

SEQ ID NO: 1900436 - DNA, 16 bp, Homo sapiens
aattgtactttgaaaa

SEQ ID NO: 1900437 - DNA, 15 bp, Homo sapiens
aattgtattctcata

SEQ ID NO: 1900438 - DNA, 19 bp, Homo sapiens
aattgtatttttgttgttg

SEQ ID NO: 1900439 - DNA, 15 bp, Homo sapiens
aattgtgtgaacttg

SEQ ID NO: 1900440 - DNA, 13 bp, Homo sapiens
aattgttgtttgt

SEQ ID NO: 1900441 - DNA, 17 bp, Homo sapiens
aattgttgtttgtatgt

SEQ ID NO: 1900442 - DNA, 19 bp, Homo sapiens
aattgttgtttgtatgtat

SEQ ID NO: 1900443 - DNA, 23 bp, Homo sapiens
aattgttgtttgtatgtataatt

SEQ ID NO: 1900444 - DNA, 17 bp, Homo sapiens
aatttaacttttaaaga

SEQ ID NO: 1900445 - DNA, 12 bp, Homo sapiens
aatttaagtttt

SEQ ID NO: 1900446 - DNA, 14 bp, Homo sapiens
aatttactgtgact

SEQ ID NO: 1900447 - DNA, 17 bp, Homo sapiens
aatttatataaagtatt

SEQ ID NO: 1900448 - DNA, 18 bp, Homo sapiens
aatttcacttgaaattaa

SEQ ID NO: 1900449 - DNA, 15 bp, Homo sapiens
aatttgtgaactgtc

SEQ ID NO: 1900450 - DNA, 23 bp, Homo sapiens
aattttcctttaatatgaaattt

SEQ ID NO: 1900451 - DNA, 20 bp, Homo sapiens
aattttgaaaagtaatattt

SEQ ID NO: 1900452 - DNA, 17 bp, Homo sapiens
aattttggttttctact

SEQ ID NO: 1900453 - DNA, 15 bp, Homo sapiens
aattttgtgtaagaa

SEQ ID NO: 1900454 - DNA, 20 bp, Homo sapiens
aattttttttcatgctttat

SEQ ID NO: 1900455 - DNA, 16 bp, Homo sapiens
acaaaattctttctgg

SEQ ID NO: 1900456 - DNA, 18 bp, Homo sapiens
acaaaggagtgagtgaaa

SEQ ID NO: 1900457 - DNA, 13 bp, Homo sapiens
acaaatgacttta

SEQ ID NO: 1900458 - DNA, 15 bp, Homo sapiens
acaaatgactttatt

SEQ ID NO: 1900459 - DNA, 17 bp, Homo sapiens
acaaatgactttattat

SEQ ID NO: 1900460 - DNA, 15 bp, Homo sapiens
acaaatgcatctttg

SEQ ID NO: 1900461 - DNA, 14 bp, Homo sapiens
acaaatggaagaga

SEQ ID NO: 1900462 - DNA, 22 bp, Homo sapiens
acaaattgttactccatatata

SEQ ID NO: 1900463 - DNA, 14 bp, Homo sapiens
acaaattttggttt

SEQ ID NO: 1900464 - DNA, 15 bp, Homo sapiens
acaacactttaatgg

SEQ ID NO: 1900465 - DNA, 22 bp, Homo sapiens
acaacagagactgaaatgtgtt

SEQ ID NO: 1900466 - DNA, 23 bp, Homo sapiens
acaaccttggcttggccctggca

SEQ ID NO: 1900467 - DNA, 13 bp, Homo sapiens
acaagctggctta

SEQ ID NO: 1900468 - DNA, 14 bp, Homo sapiens
acaaggaagaaatt

SEQ ID NO: 1900469 - DNA, 22 bp, Homo sapiens
acaaggggatccagtgtgtaaa

SEQ ID NO: 1900470 - DNA, 16 bp, Homo sapiens
acaagtcatttcaaaa

SEQ ID NO: 1900471 - DNA, 19 bp, Homo sapiens
agtggattcctccccaccc

SEQ ID NO: 1900472 - DNA, 17 bp, Homo sapiens
agtggcagggcacaggg

SEQ ID NO: 1900473 - DNA, 12 bp, Homo sapiens
agtggccccacc

SEQ ID NO: 1900474 - DNA, 21 bp, Homo sapiens
agtggcgaaatccctgctcac

SEQ ID NO: 1900475 - DNA, 14 bp, Homo sapiens
agtggctgtgaagg

SEQ ID NO: 1900476 - DNA, 16 bp, Homo sapiens
agtggctgtgaaggag

SEQ ID NO: 1900477 - DNA, 17 bp, Homo sapiens
agtgggtactttctgaa

SEQ ID NO: 1900478 - DNA, 20 bp, Homo sapiens
agtgggtactttctgaaaat

SEQ ID NO: 1900479 - DNA, 13 bp, Homo sapiens
agtggttgaatat

SEQ ID NO: 1900480 - DNA, 14 bp, Homo sapiens
agtggttgaatatg

SEQ ID NO: 1900481 - DNA, 18 bp, Homo sapiens
agtggttgaatatgatta

SEQ ID NO: 1900482 - DNA, 18 bp, Homo sapiens
agtgtactttgttaaaaa

SEQ ID NO: 1900483 - DNA, 16 bp, Homo sapiens
agtgtcttttttggcc

SEQ ID NO: 1900484 - DNA, 17 bp, Homo sapiens
agtgtgaagtatatatt

SEQ ID NO: 1900485 - DNA, 22 bp, Homo sapiens
agtgtgaagtatatattcccct

SEQ ID NO: 1900486 - DNA, 17 bp, Homo sapiens
agtgtggaaattaagaa

SEQ ID NO: 1900487 - DNA, 18 bp, Homo sapiens
agtgtggcctcttctgag

SEQ ID NO: 1900488 - DNA, 14 bp, Homo sapiens
agtgttatatgaac

SEQ ID NO: 1900489 - DNA, 14 bp, Homo sapiens
agtgttatgagcca

SEQ ID NO: 1900490 - DNA, 18 bp, Homo sapiens
agttaaaagcacaaagga

SEQ ID NO: 1900491 - DNA, 19 bp, Homo sapiens
agttaactgttccccttgg

SEQ ID NO: 1900492 - DNA, 17 bp, Homo sapiens
agttagagtgagtgctg

SEQ ID NO: 1900493 - DNA, 13 bp, Homo sapiens
agttagtgtagat

SEQ ID NO: 1900494 - DNA, 17 bp, Homo sapiens
agttatgtaaataattc

SEQ ID NO: 1900495 - DNA, 18 bp, Homo sapiens
agttatgtaaataattct

SEQ ID NO: 1900496 - DNA, 20 bp, Homo sapiens
agttatgtaaataattcttt

SEQ ID NO: 1900497 - DNA, 15 bp, Homo sapiens
agttcaagaaatgaa

SEQ ID NO: 1900498 - DNA, 15 bp, Homo sapiens
agttcaagatcaaaa

SEQ ID NO: 1900499 - DNA, 20 bp, Homo sapiens
agttcaagatcaaaaaggct

SEQ ID NO: 1900500 - DNA, 15 bp, Homo sapiens
agttccactgagacc

SEQ ID NO: 1900501 - DNA, 20 bp, Homo sapiens
agttcccatctcctttctct

SEQ ID NO: 1900502 - DNA, 13 bp, Homo sapiens
agttccttctgta

SEQ ID NO: 1900503 - DNA, 14 bp, Homo sapiens
agttctagaattct

SEQ ID NO: 1900504 - DNA, 20 bp, Homo sapiens
agttctgactttgaatttat

SEQ ID NO: 1900505 - DNA, 22 bp, Homo sapiens
agttctgactttgaatttatat

SEQ ID NO: 1900506 - DNA, 11 bp, Homo sapiens
agttctgggca

SEQ ID NO: 1900507 - DNA, 17 bp, Homo sapiens
agttctgtatttgaaag

SEQ ID NO: 1900508 - DNA, 22 bp, Homo sapiens
agttctgtatttgaaagtgcct

SEQ ID NO: 1900509 - DNA, 18 bp, Homo sapiens
agttgaatacttgaacca

SEQ ID NO: 1900510 - DNA, 17 bp, Homo sapiens
agttgagctatgactta

SEQ ID NO: 1900511 - DNA, 18 bp, Homo sapiens
agttgagctatgacttaa

SEQ ID NO: 1900512 - DNA, 21 bp, Homo sapiens
agttgctggtaaaatgaagaa

SEQ ID NO: 1900513 - DNA, 16 bp, Homo sapiens
agttgtcaataaatgg

SEQ ID NO: 1900514 - DNA, 22 bp, Homo sapiens
agttgttaccccaagcgccctg

SEQ ID NO: 1900515 - DNA, 24 bp, Homo sapiens
agttgttaccccaagcgccctggc

SEQ ID NO: 1900516 - DNA, 15 bp, Homo sapiens
agtttaaaaatctgc

SEQ ID NO: 1900517 - DNA, 20 bp, Homo sapiens
agtttaaaaatctgccacct

SEQ ID NO: 1900518 - DNA, 23 bp, Homo sapiens
agtttctgtcgttaaaaacagat

SEQ ID NO: 1900519 - DNA, 23 bp, Homo sapiens
agtttctgtggttggctgggaaa

SEQ ID NO: 1900520 - DNA, 21 bp, Homo sapiens
agtttgtaaatgactttcata

SEQ ID NO: 1900521 - DNA, 16 bp, Homo sapiens
agttttaacaaattaa

SEQ ID NO: 1900522 - DNA, 15 bp, Homo sapiens
agttttgacaagctg

SEQ ID NO: 1900523 - DNA, 18 bp, Homo sapiens
agttttgacaagctggct

SEQ ID NO: 1900524 - DNA, 13 bp, Homo sapiens
ataaaaaaaagaa

SEQ ID NO: 1900525 - DNA, 13 bp, Homo sapiens
ataaaagcccagg

SEQ ID NO: 1900526 - DNA, 15 bp, Homo sapiens
ataaaagcccaggag

SEQ ID NO: 1900527 - DNA, 21 bp, Homo sapiens
ataaaagtgccttagcatgtg

SEQ ID NO: 1900528 - DNA, 15 bp, Homo sapiens
ataaaagtgctgccg

SEQ ID NO: 1900529 - DNA, 19 bp, Homo sapiens
ataaaatgtccagtaagat

SEQ ID NO: 1900530 - DNA, 18 bp, Homo sapiens
ataaacaccactggatta

SEQ ID NO: 1900531 - DNA, 16 bp, Homo sapiens
ataaagagaaccatgt

SEQ ID NO: 1900532 - DNA, 15 bp, Homo sapiens
ataaaggaatctagc

SEQ ID NO: 1900533 - DNA, 12 bp, Homo sapiens
ataaagtatttt

SEQ ID NO: 1900534 - DNA, 21 bp, Homo sapiens
ataaagtgcaaacagaagtgc

SEQ ID NO: 1900535 - DNA, 14 bp, Homo sapiens
ataaatagacactt

SEQ ID NO: 1900536 - DNA, 23 bp, Homo sapiens
ataaatagacacttgagttaact

SEQ ID NO: 1900537 - DNA, 13 bp, Homo sapiens
ataaattatttgt

SEQ ID NO: 1900538 - DNA, 15 bp, Homo sapiens
ataaattgtcttaat

SEQ ID NO: 1900539 - DNA, 13 bp, Homo sapiens
ataaattttgaaa

SEQ ID NO: 1900540 - DNA, 22 bp, Homo sapiens
ataaattttgaaaagtaatatt

SEQ ID NO: 1900541 - DNA, 14 bp, Homo sapiens
ataactaggattat

SEQ ID NO: 1900542 - DNA, 20 bp, Homo sapiens
ataactaggattataatgct

SEQ ID NO: 1900543 - DNA, 15 bp, Homo sapiens
ataactgataatttt

SEQ ID NO: 1900544 - DNA, 11 bp, Homo sapiens
ataagaaaaga

SEQ ID NO: 1900545 - DNA, 22 bp, Homo sapiens
ataagaaaagatgtagatttat

SEQ ID NO: 1900546 - DNA, 22 bp, Homo sapiens
ataagagcttccaattttcctt

SEQ ID NO: 1900547 - DNA, 14 bp, Homo sapiens
ataagccaaaatta

SEQ ID NO: 1900548 - DNA, 18 bp, Homo sapiens
ataagccatgagaatgtt

SEQ ID NO: 1900549 - DNA, 18 bp, Homo sapiens
ataagccttcgaaaagaa

SEQ ID NO: 1900550 - DNA, 21 bp, Homo sapiens
ataagccttcgaaaagaaatt

SEQ ID NO: 1900551 - DNA, 22 bp, Homo sapiens
ataagccttcgaaaagaaattg

SEQ ID NO: 1900552 - DNA, 15 bp, Homo sapiens
ataagctagttgaat

SEQ ID NO: 1900553 - DNA, 21 bp, Homo sapiens
ataagctagttgaatacttga

SEQ ID NO: 1900554 - DNA, 22 bp, Homo sapiens
ataagctagttgaatacttgaa

SEQ ID NO: 1900555 - DNA, 16 bp, Homo sapiens
ataagctttgtaattc

SEQ ID NO: 1900556 - DNA, 15 bp, Homo sapiens
ataaggaacatttat

SEQ ID NO: 1900557 - DNA, 17 bp, Homo sapiens
ataaggtttaaaaagat

SEQ ID NO: 1900558 - DNA, 19 bp, Homo sapiens
ataagtgtgaccagttttg

SEQ ID NO: 1900559 - DNA, 23 bp, Homo sapiens
ataagtgtgaccagttttgatat

SEQ ID NO: 1900560 - DNA, 23 bp, Homo sapiens
ataataaagaatagctttaatga

SEQ ID NO: 1900561 - DNA, 13 bp, Homo sapiens
ataatactgaacc

SEQ ID NO: 1900562 - DNA, 15 bp, Homo sapiens
ataatactgaaccac

SEQ ID NO: 1900563 - DNA, 16 bp, Homo sapiens
ataatatctctaatat

SEQ ID NO: 1900564 - DNA, 20 bp, Homo sapiens
ataatatgtttccttccctc

SEQ ID NO: 1900565 - DNA, 16 bp, Homo sapiens
ataatcaagagcctta

SEQ ID NO: 1900566 - DNA, 22 bp, Homo sapiens
ataatcatggctcttagaaact

SEQ ID NO: 1900567 - DNA, 15 bp, Homo sapiens
ataatgtctagattt

SEQ ID NO: 1900568 - DNA, 20 bp, Homo sapiens
ataatgtctagattttgaaa

SEQ ID NO: 1900569 - DNA, 19 bp, Homo sapiens
ataatgtggattaaaacct

SEQ ID NO: 1900570 - DNA, 12 bp, Homo sapiens
ataatgttgtca

SEQ ID NO: 1900571 - DNA, 12 bp, Homo sapiens
ataattatgctt

SEQ ID NO: 1900572 - DNA, 22 bp, Homo sapiens
ataattgacaggcgaaagaaaa

SEQ ID NO: 1900573 - DNA, 13 bp, Homo sapiens
ataatttactgtg

SEQ ID NO: 1900574 - DNA, 18 bp, Homo sapiens
ataatttggtatccttat

SEQ ID NO: 1900575 - DNA, 12 bp, Homo sapiens
ataattttacaa

SEQ ID NO: 1900576 - DNA, 12 bp, Homo sapiens
ataattttcctt

SEQ ID NO: 1900577 - DNA, 22 bp, Homo sapiens
ataattttcctttaatatgaaa

SEQ ID NO: 1900578 - DNA, 15 bp, Homo sapiens
atacaaatgcatctt

SEQ ID NO: 1900579 - DNA, 22 bp, Homo sapiens
atacaaatgcatctttgatgtg

SEQ ID NO: 1900580 - DNA, 21 bp, Homo sapiens
atacaaatttaacttttaaag

SEQ ID NO: 1900581 - DNA, 16 bp, Homo sapiens
atacaaccagaaacaa

SEQ ID NO: 1900582 - DNA, 18 bp, Homo sapiens
atacaatcatagcattgt

SEQ ID NO: 1900583 - DNA, 13 bp, Homo sapiens
ataccaacctgaa

SEQ ID NO: 1900584 - DNA, 16 bp, Homo sapiens
atactaattctatgtc

SEQ ID NO: 1900585 - DNA, 17 bp, Homo sapiens
atactagaatcagatac

SEQ ID NO: 1900586 - DNA, 18 bp, Homo sapiens
atactgaaccacttgtag

SEQ ID NO: 1900587 - DNA, 19 bp, Homo sapiens
atactgaaccacttgtaga

SEQ ID NO: 1900588 - DNA, 14 bp, Homo sapiens
atactgatggaatt

SEQ ID NO: 1900589 - DNA, 13 bp, Homo sapiens
atactgatgtgtt

SEQ ID NO: 1900590 - DNA, 20 bp, Homo sapiens
atactgtacaatgactttat

SEQ ID NO: 1900591 - DNA, 19 bp, Homo sapiens
atacttgaaaaatgttata

SEQ ID NO: 1900592 - DNA, 12 bp, Homo sapiens
atacttgaacca

SEQ ID NO: 1900593 - DNA, 13 bp, Homo sapiens
atactttgtattg

SEQ ID NO: 1900594 - DNA, 21 bp, Homo sapiens
atagaacagtttacttggaaa

SEQ ID NO: 1900595 - DNA, 12 bp, Homo sapiens
atagagtgcagt

SEQ ID NO: 1900596 - DNA, 13 bp, Homo sapiens
atagagtgcagtg

SEQ ID NO: 1900597 - DNA, 13 bp, Homo sapiens
atagcatcactta

SEQ ID NO: 1900598 - DNA, 17 bp, Homo sapiens
atagcatcacttaaaac

SEQ ID NO: 1900599 - DNA, 15 bp, Homo sapiens
atagcattgtaaaag

SEQ ID NO: 1900600 - DNA, 18 bp, Homo sapiens
atagctcaataaaagaat

SEQ ID NO: 1900601 - DNA, 15 bp, Homo sapiens
atagtagtctttaaa

SEQ ID NO: 1900602 - DNA, 14 bp, Homo sapiens
atagtcaagacgaa

SEQ ID NO: 1900603 - DNA, 23 bp, Homo sapiens
atagtgtggaaattaagaagaaa

SEQ ID NO: 1900604 - DNA, 14 bp, Homo sapiens
atagttatgtaaat

SEQ ID NO: 1900605 - DNA, 15 bp, Homo sapiens
atagttatgtaaata

SEQ ID NO: 1900606 - DNA, 19 bp, Homo sapiens
atagttatgtaaataattc

SEQ ID NO: 1900607 - DNA, 13 bp, Homo sapiens
atataaacagctt

SEQ ID NO: 1900608 - DNA, 19 bp, Homo sapiens
atataaagtatttttataa

SEQ ID NO: 1900609 - DNA, 20 bp, Homo sapiens
atataacttatattgtaaga

SEQ ID NO: 1900610 - DNA, 17 bp, Homo sapiens
atataagcaaaatgaaa

SEQ ID NO: 1900611 - DNA, 18 bp, Homo sapiens
atataataaaagtgcctt

SEQ ID NO: 1900612 - DNA, 17 bp, Homo sapiens
atatatgtttttgaagg

SEQ ID NO: 1900613 - DNA, 22 bp, Homo sapiens
atatattttatttttagaattt

SEQ ID NO: 1900614 - DNA, 17 bp, Homo sapiens
atatatttttactgctt

SEQ ID NO: 1900615 - DNA, 21 bp, Homo sapiens
atatatttttcttatttatgt

SEQ ID NO: 1900616 - DNA, 13 bp, Homo sapiens
atatcaaattaat

SEQ ID NO: 1900617 - DNA, 15 bp, Homo sapiens
atatcagcactggat

SEQ ID NO: 1900618 - DNA, 21 bp, Homo sapiens
atatccacttgtccatgtgaa

SEQ ID NO: 1900619 - DNA, 20 bp, Homo sapiens
atatccatgagctgcactga

SEQ ID NO: 1900620 - DNA, 17 bp, Homo sapiens
atatgaacatacaaatg

SEQ ID NO: 1900621 - DNA, 19 bp, Homo sapiens
atatgaacatacaaatgca

SEQ ID NO: 1900622 - DNA, 23 bp, Homo sapiens
atatgataataatcatgatcaca

SEQ ID NO: 1900623 - DNA, 21 bp, Homo sapiens
atatgattaaaaatatcaaat

SEQ ID NO: 1900624 - DNA, 14 bp, Homo sapiens
atatgcacgttaaa

SEQ ID NO: 1900625 - DNA, 12 bp, Homo sapiens
atatgctgcatt

SEQ ID NO: 1900626 - DNA, 19 bp, Homo sapiens
atatgcttgtaactaaaat

SEQ ID NO: 1900627 - DNA, 15 bp, Homo sapiens
atatgggagaaatag

SEQ ID NO: 1900628 - DNA, 18 bp, Homo sapiens
atatgtatctttataatt

SEQ ID NO: 1900629 - DNA, 11 bp, Homo sapiens
atatgtatgtg

SEQ ID NO: 1900630 - DNA, 14 bp, Homo sapiens
atatgtatgtgttt

SEQ ID NO: 1900631 - DNA, 22 bp, Homo sapiens
atatgtatgtgtttagaattga

SEQ ID NO: 1900632 - DNA, 13 bp, Homo sapiens
cagctcagaacca

SEQ ID NO: 1900633 - DNA, 17 bp, Homo sapiens
cagctcagaaccacagc

SEQ ID NO: 1900634 - DNA, 15 bp, Homo sapiens
cagctccctcccctg

SEQ ID NO: 1900635 - DNA, 16 bp, Homo sapiens
cagctccctcccctgc

SEQ ID NO: 1900636 - DNA, 18 bp, Homo sapiens
cagctccctcccctgctc

SEQ ID NO: 1900637 - DNA, 19 bp, Homo sapiens
cagctcttcctagctggag

SEQ ID NO: 1900638 - DNA, 13 bp, Homo sapiens
cagctctttaaca

SEQ ID NO: 1900639 - DNA, 14 bp, Homo sapiens
cagctgctgagccg

SEQ ID NO: 1900640 - DNA, 15 bp, Homo sapiens
cagctgtgctgggag

SEQ ID NO: 1900641 - DNA, 19 bp, Homo sapiens
cagctgtgctgggaggtcc

SEQ ID NO: 1900642 - DNA, 15 bp, Homo sapiens
cagcttccagcagga

SEQ ID NO: 1900643 - DNA, 16 bp, Homo sapiens
cagcttccagcaggag

SEQ ID NO: 1900644 - DNA, 17 bp, Homo sapiens
cagcttccagcaggagg

SEQ ID NO: 1900645 - DNA, 16 bp, Homo sapiens
caggaaatgctgaccc

SEQ ID NO: 1900646 - DNA, 20 bp, Homo sapiens
caggaaatgctgacccatgg

SEQ ID NO: 1900647 - DNA, 20 bp, Homo sapiens
caggaagtagcacaggctga

SEQ ID NO: 1900648 - DNA, 22 bp, Homo sapiens
caggaagtagcacaggctgagt

SEQ ID NO: 1900649 - DNA, 15 bp, Homo sapiens
caggacaggggttcc

SEQ ID NO: 1900650 - DNA, 16 bp, Homo sapiens
caggacaggggttcct

SEQ ID NO: 1900651 - DNA, 21 bp, Homo sapiens
caggacaggggttccttctgg

SEQ ID NO: 1900652 - DNA, 15 bp, Homo sapiens
caggacccctgcagt

SEQ ID NO: 1900653 - DNA, 11 bp, Homo sapiens
caggagcccat

SEQ ID NO: 1900654 - DNA, 12 bp, Homo sapiens
caggagcccatt

SEQ ID NO: 1900655 - DNA, 23 bp, Homo sapiens
caggagcccatttggagggcctg

SEQ ID NO: 1900656 - DNA, 16 bp, Homo sapiens
caggagcctgcccagc

SEQ ID NO: 1900657 - DNA, 20 bp, Homo sapiens
caggagggactctgtctggc

SEQ ID NO: 1900658 - DNA, 22 bp, Homo sapiens
caggagggactctgtctggcca

SEQ ID NO: 1900659 - DNA, 24 bp, Homo sapiens
caggagggactctgtctggccagg

SEQ ID NO: 1900660 - DNA, 21 bp, Homo sapiens
caggataaacattccagagaa

SEQ ID NO: 1900661 - DNA, 16 bp, Homo sapiens
caggatatattttatt

SEQ ID NO: 1900662 - DNA, 17 bp, Homo sapiens
caggcagcgccactgtc

SEQ ID NO: 1900663 - DNA, 22 bp, Homo sapiens
caggcagcgccactgtccgctg

SEQ ID NO: 1900664 - DNA, 18 bp, Homo sapiens
caggcagggcaggaccag

SEQ ID NO: 1900665 - DNA, 22 bp, Homo sapiens
caggccaatatattttgaaata

SEQ ID NO: 1900666 - DNA, 13 bp, Homo sapiens
caggcccaccctg

SEQ ID NO: 1900667 - DNA, 15 bp, Homo sapiens
caggcccaccctgct

SEQ ID NO: 1900668 - DNA, 21 bp, Homo sapiens
caggcccggcatgaggccccg

SEQ ID NO: 1900669 - DNA, 15 bp, Homo sapiens
caggctcccaggagc

SEQ ID NO: 1900670 - DNA, 14 bp, Homo sapiens
caggctcctcagcc

SEQ ID NO: 1900671 - DNA, 17 bp, Homo sapiens
caggctcctcagccctc

SEQ ID NO: 1900672 - DNA, 17 bp, Homo sapiens
caggctgagtgcaggcc

SEQ ID NO: 1900673 - DNA, 19 bp, Homo sapiens
caggctgagtgcaggccca

SEQ ID NO: 1900674 - DNA, 20 bp, Homo sapiens
caggctgagtgcaggcccac

SEQ ID NO: 1900675 - DNA, 15 bp, Homo sapiens
caggctgctctcaaa

SEQ ID NO: 1900676 - DNA, 19 bp, Homo sapiens
caggctgggctgggcactg

SEQ ID NO: 1900677 - DNA, 15 bp, Homo sapiens
cagggatggcagtgg

SEQ ID NO: 1900678 - DNA, 11 bp, Homo sapiens
cagggcacaga

SEQ ID NO: 1900679 - DNA, 20 bp, Homo sapiens
cagggcacagggcctggccc

SEQ ID NO: 1900680 - DNA, 18 bp, Homo sapiens
cagggcaggaccagccca

SEQ ID NO: 1900681 - DNA, 21 bp, Homo sapiens
cagggcctcagtttccctatc

SEQ ID NO: 1900682 - DNA, 15 bp, Homo sapiens
cagggcctggcccat

SEQ ID NO: 1900683 - DNA, 18 bp, Homo sapiens
cagggcctggcccatgta

SEQ ID NO: 1900684 - DNA, 17 bp, Homo sapiens
cagggccttctgcctgc

SEQ ID NO: 1900685 - DNA, 17 bp, Homo sapiens
cagggctgagtgttctg

SEQ ID NO: 1900686 - DNA, 13 bp, Homo sapiens
cagggctgggtca

SEQ ID NO: 1900687 - DNA, 17 bp, Homo sapiens
cagggctgggtcagggg

SEQ ID NO: 1900688 - DNA, 20 bp, Homo sapiens
caggggatccagctcaaggg

SEQ ID NO: 1900689 - DNA, 21 bp, Homo sapiens
caggggatccagctcaaggga

SEQ ID NO: 1900690 - DNA, 21 bp, Homo sapiens
caggggtacacagagctaagg

SEQ ID NO: 1900691 - DNA, 15 bp, Homo sapiens
cagggtgtgaggcca

SEQ ID NO: 1900692 - DNA, 12 bp, Homo sapiens
caggtcccagtt

SEQ ID NO: 1900693 - DNA, 15 bp, Homo sapiens
caggtcccagttgct

SEQ ID NO: 1900694 - DNA, 21 bp, Homo sapiens
caggtcccagttgctgtcaca

SEQ ID NO: 1900695 - DNA, 18 bp, Homo sapiens
caggtgcccgccaccaca

SEQ ID NO: 1900696 - DNA, 17 bp, Homo sapiens
caggtggaggtggcatc

SEQ ID NO: 1900697 - DNA, 16 bp, Homo sapiens
caggttccttttaagt

SEQ ID NO: 1900698 - DNA, 10 bp, Homo sapiens
cagtaaacat

SEQ ID NO: 1900699 - DNA, 15 bp, Homo sapiens
cagtaagatcactgt

SEQ ID NO: 1900700 - DNA, 18 bp, Homo sapiens
ccctctctgaaggaggcc

SEQ ID NO: 1900701 - DNA, 13 bp, Homo sapiens
ccctctcttgcca

SEQ ID NO: 1900702 - DNA, 12 bp, Homo sapiens
ccctctgctcta

SEQ ID NO: 1900703 - DNA, 15 bp, Homo sapiens
ccctgacgtctgcca

SEQ ID NO: 1900704 - DNA, 18 bp, Homo sapiens
ccctgatcacctcagggc

SEQ ID NO: 1900705 - DNA, 14 bp, Homo sapiens
ccctgccaggcaca

SEQ ID NO: 1900706 - DNA, 17 bp, Homo sapiens
ccctgccaggcacaggc

SEQ ID NO: 1900707 - DNA, 18 bp, Homo sapiens
ccctgccaggcacaggca

SEQ ID NO: 1900708 - DNA, 13 bp, Homo sapiens
ccctgcctctccg

SEQ ID NO: 1900709 - DNA, 22 bp, Homo sapiens
ccctgcctctccgcccctgagc

SEQ ID NO: 1900710 - DNA, 13 bp, Homo sapiens
ccctgctcactgc

SEQ ID NO: 1900711 - DNA, 16 bp, Homo sapiens
ccctgctggccggaca

SEQ ID NO: 1900712 - DNA, 15 bp, Homo sapiens
ccctggaagcagtgc

SEQ ID NO: 1900713 - DNA, 15 bp, Homo sapiens
ccctggaccccagcc

SEQ ID NO: 1900714 - DNA, 16 bp, Homo sapiens
ccctggaccccagcct

SEQ ID NO: 1900715 - DNA, 17 bp, Homo sapiens
ccctggaccccagcctc

SEQ ID NO: 1900716 - DNA, 20 bp, Homo sapiens
ccctggagctcaagccgtgg

SEQ ID NO: 1900717 - DNA, 11 bp, Homo sapiens
ccctggcaaat

SEQ ID NO: 1900718 - DNA, 14 bp, Homo sapiens
ccctggcaaatgca

SEQ ID NO: 1900719 - DNA, 13 bp, Homo sapiens
ccctgggccaggg

SEQ ID NO: 1900720 - DNA, 22 bp, Homo sapiens
ccctgggccagggcgtggagag

SEQ ID NO: 1900721 - DNA, 13 bp, Homo sapiens
ccctgggcctcca

SEQ ID NO: 1900722 - DNA, 16 bp, Homo sapiens
ccctgggttagactgc

SEQ ID NO: 1900723 - DNA, 14 bp, Homo sapiens
ccctgtaggcctca

SEQ ID NO: 1900724 - DNA, 16 bp, Homo sapiens
ccctgtgttaatttaa

SEQ ID NO: 1900725 - DNA, 19 bp, Homo sapiens
ccctgtttcagaggctcag

SEQ ID NO: 1900726 - DNA, 13 bp, Homo sapiens
cccttatttaaaa

SEQ ID NO: 1900727 - DNA, 23 bp, Homo sapiens
cccttccatctgattccagcaca

SEQ ID NO: 1900728 - DNA, 14 bp, Homo sapiens
cccttctttttccc

SEQ ID NO: 1900729 - DNA, 23 bp, Homo sapiens
cccttctttttccctttcctttc

SEQ ID NO: 1900730 - DNA, 13 bp, Homo sapiens
cccttgccagctg

SEQ ID NO: 1900731 - DNA, 19 bp, Homo sapiens
cccttgggcctcccactcc

SEQ ID NO: 1900732 - DNA, 21 bp, Homo sapiens
cccttgggcctcccactccca

SEQ ID NO: 1900733 - DNA, 12 bp, Homo sapiens
ccctttcctttc

SEQ ID NO: 1900734 - DNA, 18 bp, Homo sapiens
ccctttctacttccaaga

SEQ ID NO: 1900735 - DNA, 15 bp, Homo sapiens
ccctttctggcacga

SEQ ID NO: 1900736 - DNA, 15 bp, Homo sapiens
cccttttctttcctt

SEQ ID NO: 1900737 - DNA, 17 bp, Homo sapiens
cccttttctttcctttt

SEQ ID NO: 1900738 - DNA, 20 bp, Homo sapiens
ccgaggacagcctgcctctg

SEQ ID NO: 1900739 - DNA, 20 bp, Homo sapiens
ccgaggctcgagctcggggc

SEQ ID NO: 1900740 - DNA, 19 bp, Homo sapiens
ccgatcctcccctggactc

SEQ ID NO: 1900741 - DNA, 13 bp, Homo sapiens
ccgcactgggagc

SEQ ID NO: 1900742 - DNA, 14 bp, Homo sapiens
ccgcagcacgcctc

SEQ ID NO: 1900743 - DNA, 17 bp, Homo sapiens
ccgcagcacgcctctcc

SEQ ID NO: 1900744 - DNA, 20 bp, Homo sapiens
ccgccggcaataaaagccca

SEQ ID NO: 1900745 - DNA, 21 bp, Homo sapiens
ccgccggcaataaaagcccag

SEQ ID NO: 1900746 - DNA, 14 bp, Homo sapiens
ccgctgtctccctc

SEQ ID NO: 1900747 - DNA, 15 bp, Homo sapiens
ccggaaaacaagcct

SEQ ID NO: 1900748 - DNA, 20 bp, Homo sapiens
ccggcaataaaagcccagga

SEQ ID NO: 1900749 - DNA, 23 bp, Homo sapiens
ccggcaataaaagcccaggagcc

SEQ ID NO: 1900750 - DNA, 14 bp, Homo sapiens
ccggcatgaggccc

SEQ ID NO: 1900751 - DNA, 21 bp, Homo sapiens
ccggctaagcaggcgcaaggg

SEQ ID NO: 1900752 - DNA, 14 bp, Homo sapiens
ccgggcccaggcag

SEQ ID NO: 1900753 - DNA, 17 bp, Homo sapiens
ccgtcccctcccaggga

SEQ ID NO: 1900754 - DNA, 16 bp, Homo sapiens
ccgttgcaaacccaaa

SEQ ID NO: 1900755 - DNA, 13 bp, Homo sapiens
cctaaaaggccca

SEQ ID NO: 1900756 - DNA, 14 bp, Homo sapiens
cctaaaaggcccag

SEQ ID NO: 1900757 - DNA, 21 bp, Homo sapiens
cctaacaacattgtagcctca

SEQ ID NO: 1900758 - DNA, 17 bp, Homo sapiens
cctaattctatgcctgt

SEQ ID NO: 1900759 - DNA, 11 bp, Homo sapiens
cctacacagga

SEQ ID NO: 1900760 - DNA, 15 bp, Homo sapiens
cctacacaggacagg

SEQ ID NO: 1900761 - DNA, 17 bp, Homo sapiens
cctacacaggacagggg

SEQ ID NO: 1900762 - DNA, 17 bp, Homo sapiens
cctacatgctttgtgaa

SEQ ID NO: 1900763 - DNA, 18 bp, Homo sapiens
cctacatgctttgtgaac

SEQ ID NO: 1900764 - DNA, 22 bp, Homo sapiens
cctagaagatcacagcagggcc

SEQ ID NO: 1900765 - DNA, 14 bp, Homo sapiens
cctagattattgaa

SEQ ID NO: 1900766 - DNA, 21 bp, Homo sapiens
cctagctatatgcattttatg

SEQ ID NO: 1900767 - DNA, 21 bp, Homo sapiens
cctagctggagaggagccctg

SEQ ID NO: 1900768 - DNA, 16 bp, Homo sapiens
cctagtttgctgtggc

SEQ ID NO: 1900769 - DNA, 18 bp, Homo sapiens
cctagtttgctgtggcct

SEQ ID NO: 1900770 - DNA, 19 bp, Homo sapiens
cctatcaaaaagatatcaa

SEQ ID NO: 1900771 - DNA, 14 bp, Homo sapiens
cctcaaaacaaagg

SEQ ID NO: 1900772 - DNA, 14 bp, Homo sapiens
cctcaaatccagga

SEQ ID NO: 1900773 - DNA, 16 bp, Homo sapiens
cctcaaatccaggacc

SEQ ID NO: 1900774 - DNA, 19 bp, Homo sapiens
cctcaaatgatgtgcctgc

SEQ ID NO: 1900775 - DNA, 13 bp, Homo sapiens
cctcaataaagct

SEQ ID NO: 1900776 - DNA, 16 bp, Homo sapiens
cctcacacacctctgc

SEQ ID NO: 1900777 - DNA, 22 bp, Homo sapiens
cctcagagaaatcactgaacct

SEQ ID NO: 1900778 - DNA, 18 bp, Homo sapiens
cctcagcttccccagtag

SEQ ID NO: 1900779 - DNA, 20 bp, Homo sapiens
cctcatggcccatcaggggc

SEQ ID NO: 1900780 - DNA, 23 bp, Homo sapiens
cctccaggtgttgttgagggcat

SEQ ID NO: 1900781 - DNA, 16 bp, Homo sapiens
cctccatccacccctc

SEQ ID NO: 1900782 - DNA, 11 bp, Homo sapiens
cctcccactcc

SEQ ID NO: 1900783 - DNA, 18 bp, Homo sapiens
cgatggatatatgttttt

SEQ ID NO: 1900784 - DNA, 22 bp, Homo sapiens
cgcaagcaccatcccctccggc

SEQ ID NO: 1900785 - DNA, 17 bp, Homo sapiens
cgcaccagcccagaagt

SEQ ID NO: 1900786 - DNA, 12 bp, Homo sapiens
cgcactgggagc

SEQ ID NO: 1900787 - DNA, 15 bp, Homo sapiens
cgcagcacgcctctc

SEQ ID NO: 1900788 - DNA, 18 bp, Homo sapiens
cgcagtcgtcagcctccc

SEQ ID NO: 1900789 - DNA, 15 bp, Homo sapiens
cgcatcagctgctca

SEQ ID NO: 1900790 - DNA, 13 bp, Homo sapiens
cgcatctcacagc

SEQ ID NO: 1900791 - DNA, 16 bp, Homo sapiens
cgccaggacttggcct

SEQ ID NO: 1900792 - DNA, 12 bp, Homo sapiens
cgcccacttccc

SEQ ID NO: 1900793 - DNA, 15 bp, Homo sapiens
cgcccagtcccagca

SEQ ID NO: 1900794 - DNA, 18 bp, Homo sapiens
cgcccagtcccagcagcc

SEQ ID NO: 1900795 - DNA, 21 bp, Homo sapiens
cgcccccactcctcctccttt

SEQ ID NO: 1900796 - DNA, 13 bp, Homo sapiens
cgccccgtccccc

SEQ ID NO: 1900797 - DNA, 13 bp, Homo sapiens
cgcccctgagccc

SEQ ID NO: 1900798 - DNA, 19 bp, Homo sapiens
cgcctccaacccctcgccc

SEQ ID NO: 1900799 - DNA, 12 bp, Homo sapiens
cgcctctcccca

SEQ ID NO: 1900800 - DNA, 20 bp, Homo sapiens
cgctaggtagagtctgaggg

SEQ ID NO: 1900801 - DNA, 21 bp, Homo sapiens
cgctaggtagagtctgagggc

SEQ ID NO: 1900802 - DNA, 21 bp, Homo sapiens
cgctctctcgtactctctctc

SEQ ID NO: 1900803 - DNA, 16 bp, Homo sapiens
cggaaagagagctgga

SEQ ID NO: 1900804 - DNA, 16 bp, Homo sapiens
cggatcaggctcccag

SEQ ID NO: 1900805 - DNA, 20 bp, Homo sapiens
cggatgtgtcctttctgaac

SEQ ID NO: 1900806 - DNA, 20 bp, Homo sapiens
cggcaataaaagcccaggag

SEQ ID NO: 1900807 - DNA, 15 bp, Homo sapiens
cggcagcgaggctgg

SEQ ID NO: 1900808 - DNA, 17 bp, Homo sapiens
cggcatgaggccccgag

SEQ ID NO: 1900809 - DNA, 22 bp, Homo sapiens
cggcatgaggccccgaggctcg

SEQ ID NO: 1900810 - DNA, 12 bp, Homo sapiens
cggccctcccag

SEQ ID NO: 1900811 - DNA, 14 bp, Homo sapiens
cggccgcactggga

SEQ ID NO: 1900812 - DNA, 21 bp, Homo sapiens
cggccggccgcactgggagca

SEQ ID NO: 1900813 - DNA, 14 bp, Homo sapiens
cggcctttcccact

SEQ ID NO: 1900814 - DNA, 13 bp, Homo sapiens
cggctaagcaggc

SEQ ID NO: 1900815 - DNA, 11 bp, Homo sapiens
cgggactctgc

SEQ ID NO: 1900816 - DNA, 12 bp, Homo sapiens
cgggcccaggca

SEQ ID NO: 1900817 - DNA, 14 bp, Homo sapiens
cgggccctggagct

SEQ ID NO: 1900818 - DNA, 13 bp, Homo sapiens
cggggcagcaggg

SEQ ID NO: 1900819 - DNA, 23 bp, Homo sapiens
cggggctgggggctgcagggctg

SEQ ID NO: 1900820 - DNA, 15 bp, Homo sapiens
cggggtccaggcatg

SEQ ID NO: 1900821 - DNA, 18 bp, Homo sapiens
cgggtctgtcagggttgg

SEQ ID NO: 1900822 - DNA, 23 bp, Homo sapiens
cggtgtgggggccccgtctcagg

SEQ ID NO: 1900823 - DNA, 13 bp, Homo sapiens
cgtaatcaaatat

SEQ ID NO: 1900824 - DNA, 21 bp, Homo sapiens
cgtacaagtagttctgtattt

SEQ ID NO: 1900825 - DNA, 16 bp, Homo sapiens
cgtacataatactgaa

SEQ ID NO: 1900826 - DNA, 14 bp, Homo sapiens
cgtcctcactggtc

SEQ ID NO: 1900827 - DNA, 16 bp, Homo sapiens
cgtgaagatactttgt

SEQ ID NO: 1900828 - DNA, 22 bp, Homo sapiens
cgtgaagatactttgtattgtc

SEQ ID NO: 1900829 - DNA, 16 bp, Homo sapiens
cgtgacaatgtttaca

SEQ ID NO: 1900830 - DNA, 17 bp, Homo sapiens
cgtggagaatcacaggc

SEQ ID NO: 1900831 - DNA, 18 bp, Homo sapiens
cgtggagaatcacaggct

SEQ ID NO: 1900832 - DNA, 14 bp, Homo sapiens
cgttaaaaacagat

SEQ ID NO: 1900833 - DNA, 18 bp, Homo sapiens
cgttgctgacttagaatc

SEQ ID NO: 1900834 - DNA, 21 bp, Homo sapiens
cgttgtgatgaagctgaggct

SEQ ID NO: 1900835 - DNA, 21 bp, Homo sapiens
cgtttattaggaaaagatatt

SEQ ID NO: 1900836 - DNA, 13 bp, Homo sapiens
cgtttccctccag

SEQ ID NO: 1900837 - DNA, 20 bp, Homo sapiens
cgttttctactttgaaatat

SEQ ID NO: 1900838 - DNA, 15 bp, Homo sapiens
ctaaaagaagcatct

SEQ ID NO: 1900839 - DNA, 12 bp, Homo sapiens
ctaaaaggccca

SEQ ID NO: 1900840 - DNA, 14 bp, Homo sapiens
ctaaaaggcccaga

SEQ ID NO: 1900841 - DNA, 13 bp, Homo sapiens
ctaaaagtaaaca

SEQ ID NO: 1900842 - DNA, 15 bp, Homo sapiens
ctaaaataattttgt

SEQ ID NO: 1900843 - DNA, 18 bp, Homo sapiens
ctaaaataattttgtaat

SEQ ID NO: 1900844 - DNA, 18 bp, Homo sapiens
ctaaaatgtctcaagtgc

SEQ ID NO: 1900845 - DNA, 14 bp, Homo sapiens
ctaaatttggaact

SEQ ID NO: 1900846 - DNA, 22 bp, Homo sapiens
ctaaatttggaacttacaaagg

SEQ ID NO: 1900847 - DNA, 21 bp, Homo sapiens
ctaacagcagtttcaggtaga

SEQ ID NO: 1900848 - DNA, 22 bp, Homo sapiens
ctaacgttttctactttgaaat

SEQ ID NO: 1900849 - DNA, 20 bp, Homo sapiens
ctaagaacaaaagaagcagc

SEQ ID NO: 1900850 - DNA, 21 bp, Homo sapiens
ctaaggacaaggtaaggaggg

SEQ ID NO: 1900851 - DNA, 21 bp, Homo sapiens
ctaagtgccaacaattttcta

SEQ ID NO: 1900852 - DNA, 22 bp, Homo sapiens
ctaataagctagttgaatactt

SEQ ID NO: 1900853 - DNA, 15 bp, Homo sapiens
ctaatatttttaaca

SEQ ID NO: 1900854 - DNA, 18 bp, Homo sapiens
ctaatatttttaacaagt

SEQ ID NO: 1900855 - DNA, 16 bp, Homo sapiens
ctaatcttgtgaaaat

SEQ ID NO: 1900856 - DNA, 18 bp, Homo sapiens
ctaattgctgccaggatt

SEQ ID NO: 1900857 - DNA, 22 bp, Homo sapiens
ctacacaggacaggggttcctt

SEQ ID NO: 1900858 - DNA, 21 bp, Homo sapiens
ctacacatataaattgtctta

SEQ ID NO: 1900859 - DNA, 17 bp, Homo sapiens
ctacagaaaagaaactc

SEQ ID NO: 1900860 - DNA, 17 bp, Homo sapiens
ctacatgctttgtgaac

SEQ ID NO: 1900861 - DNA, 14 bp, Homo sapiens
ctaccttacatcca

SEQ ID NO: 1900862 - DNA, 19 bp, Homo sapiens
ctactgcatttagggagta

SEQ ID NO: 1900863 - DNA, 22 bp, Homo sapiens
ctagaaagagccttaatgtatt

SEQ ID NO: 1900864 - DNA, 20 bp, Homo sapiens
ctagaacattccatttgctt

SEQ ID NO: 1900865 - DNA, 18 bp, Homo sapiens
ctagactgccacaaggaa

SEQ ID NO: 1900866 - DNA, 14 bp, Homo sapiens
ctagaggctggcaa

SEQ ID NO: 1900867 - DNA, 15 bp, Homo sapiens
ctagagtatattcct

SEQ ID NO: 1900868 - DNA, 23 bp, Homo sapiens
ctagagtatattcctctgctgaa

SEQ ID NO: 1900869 - DNA, 20 bp, Homo sapiens
ctagcacatgttgatttcct

SEQ ID NO: 1900870 - DNA, 20 bp, Homo sapiens
ctagcctcacgaaactggaa

SEQ ID NO: 1900871 - DNA, 13 bp, Homo sapiens
ctagctctccata

SEQ ID NO: 1900872 - DNA, 19 bp, Homo sapiens
ctagctggagaggagccct

SEQ ID NO: 1900873 - DNA, 21 bp, Homo sapiens
ctagctggagaggagccctgc

SEQ ID NO: 1900874 - DNA, 15 bp, Homo sapiens
ctaggcttggctcct

SEQ ID NO: 1900875 - DNA, 16 bp, Homo sapiens
ctagtaataaagactc

SEQ ID NO: 1900876 - DNA, 21 bp, Homo sapiens
ctagtctggaactgctgctga

SEQ ID NO: 1900877 - DNA, 12 bp, Homo sapiens
ctagtgtctttt

SEQ ID NO: 1900878 - DNA, 15 bp, Homo sapiens
ctagttgaatacttg

SEQ ID NO: 1900879 - DNA, 18 bp, Homo sapiens
ctagttgaatacttgaac

SEQ ID NO: 1900880 - DNA, 17 bp, Homo sapiens
ctagttgtcaataaatg

SEQ ID NO: 1900881 - DNA, 17 bp, Homo sapiens
ctagtttgctgtggcct

SEQ ID NO: 1900882 - DNA, 14 bp, Homo sapiens
ctataattttgata

SEQ ID NO: 1900883 - DNA, 21 bp, Homo sapiens
ctataccaactgggcctctga

SEQ ID NO: 1900884 - DNA, 12 bp, Homo sapiens
ctatagaaatga

SEQ ID NO: 1900885 - DNA, 15 bp, Homo sapiens
ctatagcatcactta

SEQ ID NO: 1900886 - DNA, 17 bp, Homo sapiens
ctatagcatcacttaaa

SEQ ID NO: 1900887 - DNA, 15 bp, Homo sapiens
ctatatgaaaaacaa

SEQ ID NO: 1900888 - DNA, 19 bp, Homo sapiens
ctatgatttaatttgaaat

SEQ ID NO: 1900889 - DNA, 15 bp, Homo sapiens
ctattagtgttatat

SEQ ID NO: 1900890 - DNA, 17 bp, Homo sapiens
ctattagtgttatatga

SEQ ID NO: 1900891 - DNA, 21 bp, Homo sapiens
ctattgtttctttaagaaagt

SEQ ID NO: 1900892 - DNA, 13 bp, Homo sapiens
ctatttaaagaaa

SEQ ID NO: 1900893 - DNA, 15 bp, Homo sapiens
ctatttagatgcata

SEQ ID NO: 1900894 - DNA, 17 bp, Homo sapiens
ctatttctctccttaat

SEQ ID NO: 1900895 - DNA, 14 bp, Homo sapiens
ctcaaaacaaaggc

SEQ ID NO: 1900896 - DNA, 12 bp, Homo sapiens
ctcaaacccctg

SEQ ID NO: 1900897 - DNA, 16 bp, Homo sapiens
ctcaaacccctgacct

SEQ ID NO: 1900898 - DNA, 23 bp, Homo sapiens
ctcaaatccaggaccctgccagg

SEQ ID NO: 1900899 - DNA, 16 bp, Homo sapiens
ctcaagccgtggccgg

SEQ ID NO: 1900900 - DNA, 20 bp, Homo sapiens
ctcaagtgcaatgccccctc

SEQ ID NO: 1900901 - DNA, 12 bp, Homo sapiens
ctcaataaagct

SEQ ID NO: 1900902 - DNA, 15 bp, Homo sapiens
ctcaatataaaaaca

SEQ ID NO: 1900903 - DNA, 12 bp, Homo sapiens
ctcaatttttgg

SEQ ID NO: 1900904 - DNA, 12 bp, Homo sapiens
ctcactctcagg

SEQ ID NO: 1900905 - DNA, 16 bp, Homo sapiens
ctcactctcttccttt

SEQ ID NO: 1900906 - DNA, 17 bp, Homo sapiens
ctcactctcttcctttc

SEQ ID NO: 1900907 - DNA, 19 bp, Homo sapiens
ctcactctcttcctttcat

SEQ ID NO: 1900908 - DNA, 21 bp, Homo sapiens
ctcagagaaatcactgaacct

SEQ ID NO: 1900909 - DNA, 22 bp, Homo sapiens
ctcagatcccacttttgccaga

SEQ ID NO: 1900910 - DNA, 15 bp, Homo sapiens
ctcagcaaggccacc

SEQ ID NO: 1900911 - DNA, 22 bp, Homo sapiens
ctcagcaaggccacctcttcct

SEQ ID NO: 1900912 - DNA, 19 bp, Homo sapiens
ctcagcattacctctttgg

SEQ ID NO: 1900913 - DNA, 20 bp, Homo sapiens
ctcagcattacctctttgga

SEQ ID NO: 1900914 - DNA, 22 bp, Homo sapiens
ctcagcattacctctttggaaa

SEQ ID NO: 1900915 - DNA, 16 bp, Homo sapiens
ctcagccctctcttgc

SEQ ID NO: 1900916 - DNA, 18 bp, Homo sapiens
ctcagccctctcttgcca

SEQ ID NO: 1900917 - DNA, 18 bp, Homo sapiens
ctcagctgtcaaggctca

SEQ ID NO: 1900918 - DNA, 14 bp, Homo sapiens
ctcagcttccccag

SEQ ID NO: 1900919 - DNA, 21 bp, Homo sapiens
ctcaggaaatgctgacccatg

SEQ ID NO: 1900920 - DNA, 20 bp, Homo sapiens
cctccccaccctgtcccagg

SEQ ID NO: 1900921 - DNA, 14 bp, Homo sapiens
cctcccctgctcag

SEQ ID NO: 1900922 - DNA, 14 bp, Homo sapiens
cctccccttcccag

SEQ ID NO: 1900923 - DNA, 15 bp, Homo sapiens
cctccccttcccaga

SEQ ID NO: 1900924 - DNA, 16 bp, Homo sapiens
cctcctaaaaggccca

SEQ ID NO: 1900925 - DNA, 17 bp, Homo sapiens
cctcctaaaaggcccag

SEQ ID NO: 1900926 - DNA, 19 bp, Homo sapiens
cctcctccctcccagctcc

SEQ ID NO: 1900927 - DNA, 13 bp, Homo sapiens
cctcctgccctcc

SEQ ID NO: 1900928 - DNA, 14 bp, Homo sapiens
cctcctgccctccg

SEQ ID NO: 1900929 - DNA, 21 bp, Homo sapiens
cctcctttcctttttctttcc

SEQ ID NO: 1900930 - DNA, 17 bp, Homo sapiens
cctcgcccagtcccagc

SEQ ID NO: 1900931 - DNA, 15 bp, Homo sapiens
cctctccgcccctga

SEQ ID NO: 1900932 - DNA, 13 bp, Homo sapiens
cctctgccccttg

SEQ ID NO: 1900933 - DNA, 20 bp, Homo sapiens
cctctgccccttgggcctcc

SEQ ID NO: 1900934 - DNA, 13 bp, Homo sapiens
cctctgccctctg

SEQ ID NO: 1900935 - DNA, 16 bp, Homo sapiens
cctctgccctctgctc

SEQ ID NO: 1900936 - DNA, 11 bp, Homo sapiens
cctctgctgca

SEQ ID NO: 1900937 - DNA, 19 bp, Homo sapiens
cctctgctgcatccccttc

SEQ ID NO: 1900938 - DNA, 22 bp, Homo sapiens
cctctgctgcatccccttccag

SEQ ID NO: 1900939 - DNA, 14 bp, Homo sapiens
cctcttcctggccg

SEQ ID NO: 1900940 - DNA, 17 bp, Homo sapiens
cctgaaggggttttctt

SEQ ID NO: 1900941 - DNA, 23 bp, Homo sapiens
cctgacagagggatggaggaaga

SEQ ID NO: 1900942 - DNA, 22 bp, Homo sapiens
cctgacctcaaatgatgtgcct

SEQ ID NO: 1900943 - DNA, 15 bp, Homo sapiens
cctgacgtctgccac

SEQ ID NO: 1900944 - DNA, 22 bp, Homo sapiens
cctgacgtctgccaccagcgcc

SEQ ID NO: 1900945 - DNA, 11 bp, Homo sapiens
cctgagcccac

SEQ ID NO: 1900946 - DNA, 16 bp, Homo sapiens
cctgagcccactgtgc

SEQ ID NO: 1900947 - DNA, 20 bp, Homo sapiens
cctgaggggagacagagcaa

SEQ ID NO: 1900948 - DNA, 23 bp, Homo sapiens
cctgaggtgatgaagacagcccg

SEQ ID NO: 1900949 - DNA, 21 bp, Homo sapiens
cctgagtagctgggattacag

SEQ ID NO: 1900950 - DNA, 15 bp, Homo sapiens
cctgagtgagagggg

SEQ ID NO: 1900951 - DNA, 16 bp, Homo sapiens
cctgagtgagagggga

SEQ ID NO: 1900952 - DNA, 15 bp, Homo sapiens
cctgatcacctcagg

SEQ ID NO: 1900953 - DNA, 18 bp, Homo sapiens
cctgatcacctcagggca

SEQ ID NO: 1900954 - DNA, 15 bp, Homo sapiens
cctgattattttcag

SEQ ID NO: 1900955 - DNA, 20 bp, Homo sapiens
cctgattctaaaatgtctca

SEQ ID NO: 1900956 - DNA, 16 bp, Homo sapiens
cctgcactgactctgg

SEQ ID NO: 1900957 - DNA, 18 bp, Homo sapiens
cctgcactgactctggaa

SEQ ID NO: 1900958 - DNA, 18 bp, Homo sapiens
cctgcacttgggggctca

SEQ ID NO: 1900959 - DNA, 20 bp, Homo sapiens
cctgcacttgggggctcagc

SEQ ID NO: 1900960 - DNA, 22 bp, Homo sapiens
cctgcacttgggggctcagcaa

SEQ ID NO: 1900961 - DNA, 22 bp, Homo sapiens
cctgcagttcccctggaagcag

SEQ ID NO: 1900962 - DNA, 19 bp, Homo sapiens
cctgccaggcacaggcagg

SEQ ID NO: 1900963 - DNA, 22 bp, Homo sapiens
cctgccaggcacaggcagggca

SEQ ID NO: 1900964 - DNA, 16 bp, Homo sapiens
cctgccccccagccta

SEQ ID NO: 1900965 - DNA, 16 bp, Homo sapiens
cctgcctctccgcccc

SEQ ID NO: 1900966 - DNA, 17 bp, Homo sapiens
cctgcctctccgcccct

SEQ ID NO: 1900967 - DNA, 22 bp, Homo sapiens
cctgcctctccgcccctgagcc

SEQ ID NO: 1900968 - DNA, 13 bp, Homo sapiens
cctgcctctgcca

SEQ ID NO: 1900969 - DNA, 15 bp, Homo sapiens
cctgcctctgccaca

SEQ ID NO: 1900970 - DNA, 17 bp, Homo sapiens
cctgcggggcagcaggg

SEQ ID NO: 1900971 - DNA, 23 bp, Homo sapiens
cctgcttcagcctcccacagtgc

SEQ ID NO: 1900972 - DNA, 20 bp, Homo sapiens
cctggaaaaacatgcgatgt

SEQ ID NO: 1900973 - DNA, 16 bp, Homo sapiens
cctggaagcagtgccc

SEQ ID NO: 1900974 - DNA, 12 bp, Homo sapiens
cctggactcccg

SEQ ID NO: 1900975 - DNA, 21 bp, Homo sapiens
cctggagctcaagccgtggcc

SEQ ID NO: 1900976 - DNA, 19 bp, Homo sapiens
cctggaggctcaaattttg

SEQ ID NO: 1900977 - DNA, 20 bp, Homo sapiens
cctggaggctcaaattttga

SEQ ID NO: 1900978 - DNA, 21 bp, Homo sapiens
cctggcagccatttctccatg

SEQ ID NO: 1900979 - DNA, 16 bp, Homo sapiens
cctggcaggggatcca

SEQ ID NO: 1900980 - DNA, 21 bp, Homo sapiens
cctggcccccacatggtgatg

SEQ ID NO: 1900981 - DNA, 14 bp, Homo sapiens
cctggctccctcac

SEQ ID NO: 1900982 - DNA, 20 bp, Homo sapiens
cctggctccctcactctcag

SEQ ID NO: 1900983 - DNA, 15 bp, Homo sapiens
cctgggcagcttggg

SEQ ID NO: 1900984 - DNA, 19 bp, Homo sapiens
cctgggcagcttgggctgg

SEQ ID NO: 1900985 - DNA, 20 bp, Homo sapiens
cctgggcagcttgggctggc

SEQ ID NO: 1900986 - DNA, 21 bp, Homo sapiens
cctgggcagcttgggctggcg

SEQ ID NO: 1900987 - DNA, 12 bp, Homo sapiens
cctgggcctcca

SEQ ID NO: 1900988 - DNA, 14 bp, Homo sapiens
cctgggcctccacc

SEQ ID NO: 1900989 - DNA, 15 bp, Homo sapiens
cctgggcctccacct

SEQ ID NO: 1900990 - DNA, 16 bp, Homo sapiens
cctgggcctccacctc

SEQ ID NO: 1900991 - DNA, 19 bp, Homo sapiens
cctgggcctccacctctgt

SEQ ID NO: 1900992 - DNA, 20 bp, Homo sapiens
cctgggcctccacctctgtg

SEQ ID NO: 1900993 - DNA, 14 bp, Homo sapiens
cctgggcctggctc

SEQ ID NO: 1900994 - DNA, 18 bp, Homo sapiens
cctggggcatccatgggg

SEQ ID NO: 1900995 - DNA, 20 bp, Homo sapiens
cctggtctttgagctcccac

SEQ ID NO: 1900996 - DNA, 21 bp, Homo sapiens
cctgtaaatgtattcattctt

SEQ ID NO: 1900997 - DNA, 18 bp, Homo sapiens
cctgtaaggggccagagc

SEQ ID NO: 1900998 - DNA, 21 bp, Homo sapiens
cctgtcatctgagaatgaaca

SEQ ID NO: 1900999 - DNA, 14 bp, Homo sapiens
cctgtcccaggcag

SEQ ID NO: 1901000 - DNA, 22 bp, Homo sapiens
cctgtcccaggcagcgccactg

SEQ ID NO: 1901001 - DNA, 23 bp, Homo sapiens
cctgtctctacagtagaaggaga

SEQ ID NO: 1901002 - DNA, 21 bp, Homo sapiens
cctgtgaagaaaggacctgca

SEQ ID NO: 1901003 - DNA, 19 bp, Homo sapiens
cctgtgtgacatcacaggg

SEQ ID NO: 1901004 - DNA, 21 bp, Homo sapiens
cctgtgtgacatcacagggcc

SEQ ID NO: 1901005 - DNA, 14 bp, Homo sapiens
cctgtgttaattta

SEQ ID NO: 1901006 - DNA, 17 bp, Homo sapiens
cctgtgttaatttaagt

SEQ ID NO: 1901007 - DNA, 15 bp, Homo sapiens
cctgtttcagaccag

SEQ ID NO: 1901008 - DNA, 12 bp, Homo sapiens
ccttacctggaa

SEQ ID NO: 1901009 - DNA, 15 bp, Homo sapiens
ccttactctgagctc

SEQ ID NO: 1901010 - DNA, 18 bp, Homo sapiens
ccttagatgtgtctcctg

SEQ ID NO: 1901011 - DNA, 19 bp, Homo sapiens
ccttatctagtgtttgatt

SEQ ID NO: 1901012 - DNA, 13 bp, Homo sapiens
ccttccagctccc

SEQ ID NO: 1901013 - DNA, 14 bp, Homo sapiens
ccttccagctccct

SEQ ID NO: 1901014 - DNA, 16 bp, Homo sapiens
ccttccagtggcttct

SEQ ID NO: 1901015 - DNA, 18 bp, Homo sapiens
ccttccagtggcttctcc

SEQ ID NO: 1901016 - DNA, 22 bp, Homo sapiens
ccttcccagaccccgcagcacg

SEQ ID NO: 1901017 - DNA, 19 bp, Homo sapiens
ccttcgtgacaatgtttac

SEQ ID NO: 1901018 - DNA, 12 bp, Homo sapiens
ccttctgggcat

SEQ ID NO: 1901019 - DNA, 19 bp, Homo sapiens
ccttcttgggactgctgtg

SEQ ID NO: 1901020 - DNA, 23 bp, Homo sapiens
ccttgcaaagaccataaagtcca

SEQ ID NO: 1901021 - DNA, 13 bp, Homo sapiens
ccttgccagctgc

SEQ ID NO: 1901022 - DNA, 22 bp, Homo sapiens
ccttgccagctgctgagccgca

SEQ ID NO: 1901023 - DNA, 16 bp, Homo sapiens
ccttggcttggccctg

SEQ ID NO: 1901024 - DNA, 21 bp, Homo sapiens
ccttggcttggccctggcagc

SEQ ID NO: 1901025 - DNA, 13 bp, Homo sapiens
ccttgggcctccc

SEQ ID NO: 1901026 - DNA, 14 bp, Homo sapiens
ccttgggcctccca

SEQ ID NO: 1901027 - DNA, 15 bp, Homo sapiens
ccttgggcctcccac

SEQ ID NO: 1901028 - DNA, 16 bp, Homo sapiens
ccttgggcctcccact

SEQ ID NO: 1901029 - DNA, 18 bp, Homo sapiens
ccttggtatttgtttaat

SEQ ID NO: 1901030 - DNA, 14 bp, Homo sapiens
ccttgtgctgccag

SEQ ID NO: 1901031 - DNA, 15 bp, Homo sapiens
ccttgtgctgccagt

SEQ ID NO: 1901032 - DNA, 20 bp, Homo sapiens
ccttgtgggtgtgagcagca

SEQ ID NO: 1901033 - DNA, 23 bp, Homo sapiens
cctttaccgaggacagcctgcct

SEQ ID NO: 1901034 - DNA, 16 bp, Homo sapiens
cctttctataatttta

SEQ ID NO: 1901035 - DNA, 17 bp, Homo sapiens
cctttctataattttac

SEQ ID NO: 1901036 - DNA, 22 bp, Homo sapiens
cctttctggcacgaaatggctg

SEQ ID NO: 1901037 - DNA, 20 bp, Homo sapiens
cctttcttagctgatgtctt

SEQ ID NO: 1901038 - DNA, 23 bp, Homo sapiens
cctttcttagctgatgtctttgg

SEQ ID NO: 1901039 - DNA, 23 bp, Homo sapiens
ccttttggtagtcggagcccccg

SEQ ID NO: 1901040 - DNA, 16 bp, Homo sapiens
cgaactgttgtataaa

SEQ ID NO: 1901041 - DNA, 17 bp, Homo sapiens
cgaagttcaagatcaaa

SEQ ID NO: 1901042 - DNA, 18 bp, Homo sapiens
cgaagttcaagatcaaaa

SEQ ID NO: 1901043 - DNA, 16 bp, Homo sapiens
cgaccagcaggctcct

SEQ ID NO: 1901044 - DNA, 18 bp, Homo sapiens
cgaccagcaggctcctca

SEQ ID NO: 1901045 - DNA, 19 bp, Homo sapiens
cgaccagcaggctcctcag

SEQ ID NO: 1901046 - DNA, 18 bp, Homo sapiens
cgacgctctctctcggaa

SEQ ID NO: 1901047 - DNA, 16 bp, Homo sapiens
cgacttgcatttttgc

SEQ ID NO: 1901048 - DNA, 16 bp, Homo sapiens
cgagcagggcaggccc

SEQ ID NO: 1901049 - DNA, 15 bp, Homo sapiens
cgaggacagcctgcc

SEQ ID NO: 1901050 - DNA, 17 bp, Homo sapiens
cgaggacagcctgcctc

SEQ ID NO: 1901051 - DNA, 22 bp, Homo sapiens
cgaggacagcctgcctctgcca

SEQ ID NO: 1901052 - DNA, 13 bp, Homo sapiens
cgagtctgaggcc

SEQ ID NO: 1901053 - DNA, 18 bp, Homo sapiens
cgagtctttctcactgcc

SEQ ID NO: 1901054 - DNA, 19 bp, Homo sapiens
cgagtctttctcactgcct

SEQ ID NO: 1901055 - DNA, 20 bp, Homo sapiens
cgagtctttctcactgcctt

SEQ ID NO: 1901056 - DNA, 23 bp, Homo sapiens
ctcaggaaatgctgacccatggg

SEQ ID NO: 1901057 - DNA, 21 bp, Homo sapiens
ctcatggcccatcaggggcag

SEQ ID NO: 1901058 - DNA, 19 bp, Homo sapiens
ctcattacttgttgcctat

SEQ ID NO: 1901059 - DNA, 18 bp, Homo sapiens
ctcattttcacagcacta

SEQ ID NO: 1901060 - DNA, 15 bp, Homo sapiens
ctccaactccacacc

SEQ ID NO: 1901061 - DNA, 15 bp, Homo sapiens
ctccacctctgtgca

SEQ ID NO: 1901062 - DNA, 19 bp, Homo sapiens
ctccacctctgtgcagggc

SEQ ID NO: 1901063 - DNA, 22 bp, Homo sapiens
ctccatccacccctctggcacc

SEQ ID NO: 1901064 - DNA, 19 bp, Homo sapiens
ctccatccctctcctctgc

SEQ ID NO: 1901065 - DNA, 16 bp, Homo sapiens
ctccatttcactggct

SEQ ID NO: 1901066 - DNA, 13 bp, Homo sapiens
ctcccaccctacc

SEQ ID NO: 1901067 - DNA, 19 bp, Homo sapiens
ctcccaccctttctgccag

SEQ ID NO: 1901068 - DNA, 16 bp, Homo sapiens
ctcccactcccatggc

SEQ ID NO: 1901069 - DNA, 15 bp, Homo sapiens
ctcccacttctgcca

SEQ ID NO: 1901070 - DNA, 13 bp, Homo sapiens
ctcccagctctgg

SEQ ID NO: 1901071 - DNA, 18 bp, Homo sapiens
ctcccaggagcctgccca

SEQ ID NO: 1901072 - DNA, 21 bp, Homo sapiens
ctcccaggagcctgcccagcc

SEQ ID NO: 1901073 - DNA, 17 bp, Homo sapiens
ctcccatggctctgggc

SEQ ID NO: 1901074 - DNA, 12 bp, Homo sapiens
ctccccaccctg

SEQ ID NO: 1901075 - DNA, 18 bp, Homo sapiens
ctccccaccctgtcccag

SEQ ID NO: 1901076 - DNA, 21 bp, Homo sapiens
ctccccaccctgtcccaggca

SEQ ID NO: 1901077 - DNA, 12 bp, Homo sapiens
ctccccaccttc

SEQ ID NO: 1901078 - DNA, 14 bp, Homo sapiens
ctcccctgctcaga

SEQ ID NO: 1901079 - DNA, 23 bp, Homo sapiens
ctcccctgctcagaatctgatac

SEQ ID NO: 1901080 - DNA, 12 bp, Homo sapiens
ctcccctgggca

SEQ ID NO: 1901081 - DNA, 13 bp, Homo sapiens
ctccccttcccag

SEQ ID NO: 1901082 - DNA, 17 bp, Homo sapiens
ctccccttgccagctgc

SEQ ID NO: 1901083 - DNA, 17 bp, Homo sapiens
ctccctcactctcagga

SEQ ID NO: 1901084 - DNA, 18 bp, Homo sapiens
ctccctcactctcaggaa

SEQ ID NO: 1901085 - DNA, 11 bp, Homo sapiens
ctccctcccag

SEQ ID NO: 1901086 - DNA, 15 bp, Homo sapiens
ctccgcccctgagcc

SEQ ID NO: 1901087 - DNA, 14 bp, Homo sapiens
ctccgcttccctgg

SEQ ID NO: 1901088 - DNA, 22 bp, Homo sapiens
ctcctaaggggcccctccttgt

SEQ ID NO: 1901089 - DNA, 13 bp, Homo sapiens
ctcctcagccctc

SEQ ID NO: 1901090 - DNA, 19 bp, Homo sapiens
ctcctcagccctctcttgc

SEQ ID NO: 1901091 - DNA, 14 bp, Homo sapiens
ctcctcctgccctc

SEQ ID NO: 1901092 - DNA, 17 bp, Homo sapiens
ctcctcctgccctccgc

SEQ ID NO: 1901093 - DNA, 19 bp, Homo sapiens
ctcctcctgccctccgccc

SEQ ID NO: 1901094 - DNA, 19 bp, Homo sapiens
ctcctcctttctttgctgt

SEQ ID NO: 1901095 - DNA, 11 bp, Homo sapiens
ctcctctgccc

SEQ ID NO: 1901096 - DNA, 15 bp, Homo sapiens
ctcctcttgggaatc

SEQ ID NO: 1901097 - DNA, 11 bp, Homo sapiens
ctcctgagccc

SEQ ID NO: 1901098 - DNA, 13 bp, Homo sapiens
ctcctgagccccc

SEQ ID NO: 1901099 - DNA, 17 bp, Homo sapiens
ctcctgagcccccagct

SEQ ID NO: 1901100 - DNA, 12 bp, Homo sapiens
ctcctgccctcc

SEQ ID NO: 1901101 - DNA, 13 bp, Homo sapiens
ctcctgccctccg

SEQ ID NO: 1901102 - DNA, 21 bp, Homo sapiens
ctcctgcctatgacacagaag

SEQ ID NO: 1901103 - DNA, 16 bp, Homo sapiens
ctccttgtgctgccag

SEQ ID NO: 1901104 - DNA, 18 bp, Homo sapiens
ctcgagctcggggctggg

SEQ ID NO: 1901105 - DNA, 12 bp, Homo sapiens
ctcgagtctgag

SEQ ID NO: 1901106 - DNA, 15 bp, Homo sapiens
ctcgattctttgaag

SEQ ID NO: 1901107 - DNA, 18 bp, Homo sapiens
ctcgcccagtcccagcag

SEQ ID NO: 1901108 - DNA, 19 bp, Homo sapiens
ctcgctacatttccgccac

SEQ ID NO: 1901109 - DNA, 18 bp, Homo sapiens
ctcggcagaggtggtctg

SEQ ID NO: 1901110 - DNA, 15 bp, Homo sapiens
ctcgtactctctctc

SEQ ID NO: 1901111 - DNA, 23 bp, Homo sapiens
ctcgtcctcactggtctacactg

SEQ ID NO: 1901112 - DNA, 20 bp, Homo sapiens
ctcgttcgctcgctctctcg

SEQ ID NO: 1901113 - DNA, 19 bp, Homo sapiens
ctctaacagtggacaaagt

SEQ ID NO: 1901114 - DNA, 17 bp, Homo sapiens
ctctagaggctggcaag

SEQ ID NO: 1901115 - DNA, 18 bp, Homo sapiens
ctctagtgctgtgaaaaa

SEQ ID NO: 1901116 - DNA, 19 bp, Homo sapiens
ctctagtgctgtgaaaaaa

SEQ ID NO: 1901117 - DNA, 14 bp, Homo sapiens
ctctcacagacagg

SEQ ID NO: 1901118 - DNA, 20 bp, Homo sapiens
ctctcaggaaatgctgaccc

SEQ ID NO: 1901119 - DNA, 14 bp, Homo sapiens
ctctccccacccag

SEQ ID NO: 1901120 - DNA, 11 bp, Homo sapiens
ctctcctctgc

SEQ ID NO: 1901121 - DNA, 13 bp, Homo sapiens
ctctcctctgccc

SEQ ID NO: 1901122 - DNA, 17 bp, Homo sapiens
ctctctcccctgctcca

SEQ ID NO: 1901123 - DNA, 15 bp, Homo sapiens
ctctctcttttccct

SEQ ID NO: 1901124 - DNA, 10 bp, Homo sapiens
ctctcttcct

SEQ ID NO: 1901125 - DNA, 15 bp, Homo sapiens
ctctcttcctttcat

SEQ ID NO: 1901126 - DNA, 20 bp, Homo sapiens
ctctcttttccctcctttcc

SEQ ID NO: 1901127 - DNA, 16 bp, Homo sapiens
ctctgaaggaggccac

SEQ ID NO: 1901128 - DNA, 21 bp, Homo sapiens
ctctgaaggaggccacctcct

SEQ ID NO: 1901129 - DNA, 16 bp, Homo sapiens
ctctgaattcaggtcc

SEQ ID NO: 1901130 - DNA, 15 bp, Homo sapiens
ctctgacccctgcct

SEQ ID NO: 1901131 - DNA, 15 bp, Homo sapiens
ctctgagctcatttg

SEQ ID NO: 1901132 - DNA, 17 bp, Homo sapiens
ctctgatgttcttccag

SEQ ID NO: 1901133 - DNA, 16 bp, Homo sapiens
ctctgcaaaggaaata

SEQ ID NO: 1901134 - DNA, 18 bp, Homo sapiens
ctctgcacacaagaggct

SEQ ID NO: 1901135 - DNA, 12 bp, Homo sapiens
ctctgccctctg

SEQ ID NO: 1901136 - DNA, 15 bp, Homo sapiens
ctctgctgcatcccc

SEQ ID NO: 1901137 - DNA, 17 bp, Homo sapiens
ctctgctgcatcccctt

SEQ ID NO: 1901138 - DNA, 20 bp, Homo sapiens
ctctggtacaatttcttttg

SEQ ID NO: 1901139 - DNA, 20 bp, Homo sapiens
ctctgtctggccagggagga

SEQ ID NO: 1901140 - DNA, 21 bp, Homo sapiens
ctctgtctggccagggaggag

SEQ ID NO: 1901141 - DNA, 14 bp, Homo sapiens
ctctgtgcagggca

SEQ ID NO: 1901142 - DNA, 17 bp, Homo sapiens
ctctgttgcccaggctg

SEQ ID NO: 1901143 - DNA, 19 bp, Homo sapiens
ctctgtttttcttctgaaa

SEQ ID NO: 1901144 - DNA, 21 bp, Homo sapiens
ctctgtttttcttctgaaata

SEQ ID NO: 1901145 - DNA, 13 bp, Homo sapiens
ctcttagaaactc

SEQ ID NO: 1901146 - DNA, 12 bp, Homo sapiens
ctcttcctttcc

SEQ ID NO: 1901147 - DNA, 18 bp, Homo sapiens
ctcttctcctgcagcctg

SEQ ID NO: 1901148 - DNA, 21 bp, Homo sapiens
ctcttgagttgtttttgtata

SEQ ID NO: 1901149 - DNA, 14 bp, Homo sapiens
ctcttggggaccaa

SEQ ID NO: 1901150 - DNA, 16 bp, Homo sapiens
ctcttttccaaacaca

SEQ ID NO: 1901151 - DNA, 13 bp, Homo sapiens
ctgaaaatgaact

SEQ ID NO: 1901152 - DNA, 20 bp, Homo sapiens
ctgaaaatgaactgtaaatg

SEQ ID NO: 1901153 - DNA, 13 bp, Homo sapiens
ctgaaaatttata

SEQ ID NO: 1901154 - DNA, 14 bp, Homo sapiens
ctgaaatacaacca

SEQ ID NO: 1901155 - DNA, 16 bp, Homo sapiens
ctgaaatgtggatgtg

SEQ ID NO: 1901156 - DNA, 19 bp, Homo sapiens
ctgaaatgtggatgtgatt

SEQ ID NO: 1901157 - DNA, 16 bp, Homo sapiens
ctgaaatgtgtttcct

SEQ ID NO: 1901158 - DNA, 22 bp, Homo sapiens
ctgaaccacttgtagatttgat

SEQ ID NO: 1901159 - DNA, 17 bp, Homo sapiens
ctgaagagtttgtaaat

SEQ ID NO: 1901160 - DNA, 21 bp, Homo sapiens
ctgaagagtttgtaaatgact

SEQ ID NO: 1901161 - DNA, 17 bp, Homo sapiens
ctgaaggaggccacctc

SEQ ID NO: 1901162 - DNA, 18 bp, Homo sapiens
ctgaaggaggccacctcc

SEQ ID NO: 1901163 - DNA, 20 bp, Homo sapiens
ctgaattcaccacagacttt

SEQ ID NO: 1901164 - DNA, 16 bp, Homo sapiens
ctgaatttttatgtgt

SEQ ID NO: 1901165 - DNA, 17 bp, Homo sapiens
ctgaccataacagtgcc

SEQ ID NO: 1901166 - DNA, 13 bp, Homo sapiens
ctgacccatgggc

SEQ ID NO: 1901167 - DNA, 13 bp, Homo sapiens
ctgacccctgtgt

SEQ ID NO: 1901168 - DNA, 14 bp, Homo sapiens
ctgacccctgtgtg

SEQ ID NO: 1901169 - DNA, 13 bp, Homo sapiens
ctgacgtctgcca

SEQ ID NO: 1901170 - DNA, 14 bp, Homo sapiens
ctgacgtctgccac

SEQ ID NO: 1901171 - DNA, 16 bp, Homo sapiens
ctgacgtctgccacca

SEQ ID NO: 1901172 - DNA, 21 bp, Homo sapiens
ctgacgtctgccaccagcgcc

SEQ ID NO: 1901173 - DNA, 15 bp, Homo sapiens
ctgactttgaattta

SEQ ID NO: 1901174 - DNA, 17 bp, Homo sapiens
ctgactttgaatttata

SEQ ID NO: 1901175 - DNA, 21 bp, Homo sapiens
ctgactttgaatttatataaa

SEQ ID NO: 1901176 - DNA, 20 bp, Homo sapiens
ctgacttttagccaccaggt

SEQ ID NO: 1901177 - DNA, 17 bp, Homo sapiens
ctgagacccttatttaa

SEQ ID NO: 1901178 - DNA, 15 bp, Homo sapiens
ctgagagtctagagg

SEQ ID NO: 1901179 - DNA, 18 bp, Homo sapiens
ctgagatggatggacaga

SEQ ID NO: 1901180 - DNA, 23 bp, Homo sapiens
ctgagatggatggacagacagac

SEQ ID NO: 1901181 - DNA, 18 bp, Homo sapiens
ctgagcccccagcttcca

SEQ ID NO: 1901182 - DNA, 23 bp, Homo sapiens
ctgaggacaagagaaaaaagcca

SEQ ID NO: 1901183 - DNA, 15 bp, Homo sapiens
ctgaggcccatggcc

SEQ ID NO: 1901184 - DNA, 19 bp, Homo sapiens
ctgaggcctaaaagtaaac

SEQ ID NO: 1901185 - DNA, 21 bp, Homo sapiens
ctgaggcctaaaagtaaacat

SEQ ID NO: 1901186 - DNA, 14 bp, Homo sapiens
ctgagggcttgtag

SEQ ID NO: 1901187 - DNA, 14 bp, Homo sapiens
ctgaggggagacag

SEQ ID NO: 1901188 - DNA, 13 bp, Homo sapiens
ctgagtgcaggcc

SEQ ID NO: 1901189 - DNA, 16 bp, Homo sapiens
ctgagtgcaggcccac

SEQ ID NO: 1901190 - DNA, 20 bp, Homo sapiens
ctgagtgcaggcccaccctg

SEQ ID NO: 1901191 - DNA, 16 bp, Homo sapiens
ctgagtgttctgggat

SEQ ID NO: 1901192 - DNA, 18 bp, Homo sapiens
ctgagttaggttccagca

SEQ ID NO: 1901193 - DNA, 13 bp, Homo sapiens
ctgagttcctgag

SEQ ID NO: 1901194 - DNA, 19 bp, Homo sapiens
ctgataccaaagagacagg

SEQ ID NO: 1901195 - DNA, 20 bp, Homo sapiens
ctgatagtagtctttaaaag

SEQ ID NO: 1901196 - DNA, 15 bp, Homo sapiens
ctgatcactgaaata

SEQ ID NO: 1901197 - DNA, 16 bp, Homo sapiens
ctgatctccgcagagg

SEQ ID NO: 1901198 - DNA, 15 bp, Homo sapiens
ctgatggttaaataa

SEQ ID NO: 1901199 - DNA, 20 bp, Homo sapiens
ctgattattttcagaagctg

SEQ ID NO: 1901200 - DNA, 17 bp, Homo sapiens
ctgattttgaccttgta

SEQ ID NO: 1901201 - DNA, 19 bp, Homo sapiens
ctgattttgaccttgtatt

SEQ ID NO: 1901202 - DNA, 22 bp, Homo sapiens
ctgcactgaatggctgacctga

SEQ ID NO: 1901203 - DNA, 24 bp, Homo sapiens
ctgcacttgggggctcagcaaggc

SEQ ID NO: 1901204 - DNA, 20 bp, Homo sapiens
ctgcagcctccgcttccctg

SEQ ID NO: 1901205 - DNA, 13 bp, Homo sapiens
ctgcagctgggga

SEQ ID NO: 1901206 - DNA, 12 bp, Homo sapiens
ctgcagggctgg

SEQ ID NO: 1901207 - DNA, 19 bp, Homo sapiens
ctgcagggctgggtcaggg

SEQ ID NO: 1901208 - DNA, 15 bp, Homo sapiens
ctgcagttcccctgg

SEQ ID NO: 1901209 - DNA, 15 bp, Homo sapiens
ctgcatatgcctaca

SEQ ID NO: 1901210 - DNA, 22 bp, Homo sapiens
ctgcatccccttccagctccct

SEQ ID NO: 1901211 - DNA, 16 bp, Homo sapiens
ctgcattcttctgatc

SEQ ID NO: 1901212 - DNA, 13 bp, Homo sapiens
ctgccaccagcgc

SEQ ID NO: 1901213 - DNA, 20 bp, Homo sapiens
ctgccaccagcgcccccact

SEQ ID NO: 1901214 - DNA, 14 bp, Homo sapiens
ctgccaggcacagg

SEQ ID NO: 1901215 - DNA, 15 bp, Homo sapiens
ctgccaggcacaggc

SEQ ID NO: 1901216 - DNA, 17 bp, Homo sapiens
ctgccaggcacaggcag

SEQ ID NO: 1901217 - DNA, 19 bp, Homo sapiens
ctgccaggcacaggcaggg

SEQ ID NO: 1901218 - DNA, 12 bp, Homo sapiens
ctgccaggcccg

SEQ ID NO: 1901219 - DNA, 17 bp, Homo sapiens
ctgccagggatggcagt

SEQ ID NO: 1901220 - DNA, 20 bp, Homo sapiens
ctgccagggatggcagtggc

SEQ ID NO: 1901221 - DNA, 17 bp, Homo sapiens
ctgcccagccccctggt

SEQ ID NO: 1901222 - DNA, 17 bp, Homo sapiens
ctgcccctaactcctgc

SEQ ID NO: 1901223 - DNA, 13 bp, Homo sapiens
ctgcctctgccac

SEQ ID NO: 1901224 - DNA, 17 bp, Homo sapiens
ctgcctgccttaagtga

SEQ ID NO: 1901225 - DNA, 18 bp, Homo sapiens
ctgcctgccttaagtgag

SEQ ID NO: 1901226 - DNA, 23 bp, Homo sapiens
ctgcctgctacttgagggccagg

SEQ ID NO: 1901227 - DNA, 14 bp, Homo sapiens
ctgcgctcggccct

SEQ ID NO: 1901228 - DNA, 15 bp, Homo sapiens
ctgcggggcagcagg

SEQ ID NO: 1901229 - DNA, 21 bp, Homo sapiens
ctgctcaagtctaccctgatc

SEQ ID NO: 1901230 - DNA, 12 bp, Homo sapiens
ctgctcactgca

SEQ ID NO: 1901231 - DNA, 12 bp, Homo sapiens
ctgctcactttt

SEQ ID NO: 1901232 - DNA, 12 bp, Homo sapiens
ctgctcctgagc

SEQ ID NO: 1901233 - DNA, 15 bp, Homo sapiens
ctgctcctgagcccc

SEQ ID NO: 1901234 - DNA, 20 bp, Homo sapiens
ctgctctcaaacccctgacc

SEQ ID NO: 1901235 - DNA, 23 bp, Homo sapiens
ctgctgaccataacagtgccagc

SEQ ID NO: 1901236 - DNA, 15 bp, Homo sapiens
ctgctgacccctgtg

SEQ ID NO: 1901237 - DNA, 21 bp, Homo sapiens
ctgctgacccctgtgtgacat

SEQ ID NO: 1901238 - DNA, 13 bp, Homo sapiens
ctgctgagccgca

SEQ ID NO: 1901239 - DNA, 22 bp, Homo sapiens
ctgctgagtctgttctggtaat

SEQ ID NO: 1901240 - DNA, 14 bp, Homo sapiens
ctgctgcagagcag

SEQ ID NO: 1901241 - DNA, 21 bp, Homo sapiens
ctgctgcagagcagtaaggga

SEQ ID NO: 1901242 - DNA, 15 bp, Homo sapiens
ctgctgcatcccctt

SEQ ID NO: 1901243 - DNA, 19 bp, Homo sapiens
ctgctgcatccccttccag

SEQ ID NO: 1901244 - DNA, 13 bp, Homo sapiens
ctgctgccaggcc

SEQ ID NO: 1901245 - DNA, 20 bp, Homo sapiens
ctgctgccaggcccggcatg

SEQ ID NO: 1901246 - DNA, 23 bp, Homo sapiens
ctgctgccaggcccggcatgagg

SEQ ID NO: 1901247 - DNA, 12 bp, Homo sapiens
ctgctgctgacc

SEQ ID NO: 1901248 - DNA, 18 bp, Homo sapiens
ctgctgctgacccctgtg

SEQ ID NO: 1901249 - DNA, 18 bp, Homo sapiens
ctgctgtgaacatgcctc

SEQ ID NO: 1901250 - DNA, 16 bp, Homo sapiens
ctgcttcagcctccca

SEQ ID NO: 1901251 - DNA, 16 bp, Homo sapiens
ctgcttcctttcttga

SEQ ID NO: 1901252 - DNA, 17 bp, Homo sapiens
ctgcttcctttcttgat

SEQ ID NO: 1901253 - DNA, 23 bp, Homo sapiens
ctgcttggcccagggggcttcct

SEQ ID NO: 1901254 - DNA, 14 bp, Homo sapiens
ctgctttagacttg

SEQ ID NO: 1901255 - DNA, 17 bp, Homo sapiens
ctgctttagacttgaaa

SEQ ID NO: 1901256 - DNA, 16 bp, Homo sapiens
ctgctttctgaatgta

SEQ ID NO: 1901257 - DNA, 23 bp, Homo sapiens
ctggaaaggccagcagccttcca

SEQ ID NO: 1901258 - DNA, 17 bp, Homo sapiens
ctggaactcttgacagc

SEQ ID NO: 1901259 - DNA, 13 bp, Homo sapiens
ctggaactgctgc

SEQ ID NO: 1901260 - DNA, 15 bp, Homo sapiens
ctggaactgctgctg

SEQ ID NO: 1901261 - DNA, 18 bp, Homo sapiens
ctggaactgctgctgacc

SEQ ID NO: 1901262 - DNA, 14 bp, Homo sapiens
ctggaagcagtgcc

SEQ ID NO: 1901263 - DNA, 19 bp, Homo sapiens
ctggaagcagtgcccaggt

SEQ ID NO: 1901264 - DNA, 20 bp, Homo sapiens
ctggaagcagtgcccaggtg

SEQ ID NO: 1901265 - DNA, 15 bp, Homo sapiens
ctggaccccagcctc

SEQ ID NO: 1901266 - DNA, 16 bp, Homo sapiens
ctggaccccagcctca

SEQ ID NO: 1901267 - DNA, 17 bp, Homo sapiens
ctggaccccagcctcaa

SEQ ID NO: 1901268 - DNA, 22 bp, Homo sapiens
ctggaccccatctgtgaataag

SEQ ID NO: 1901269 - DNA, 18 bp, Homo sapiens
ctggagaggagccctgcc

SEQ ID NO: 1901270 - DNA, 21 bp, Homo sapiens
ctggagaggagccctgcctct

SEQ ID NO: 1901271 - DNA, 18 bp, Homo sapiens
ctggagctcaagccgtgg

SEQ ID NO: 1901272 - DNA, 21 bp, Homo sapiens
ctggaggctcaaattttgagt

SEQ ID NO: 1901273 - DNA, 20 bp, Homo sapiens
ctggagtctctctctctcca

SEQ ID NO: 1901274 - DNA, 14 bp, Homo sapiens
ctggagtctgggct

SEQ ID NO: 1901275 - DNA, 23 bp, Homo sapiens
ctggatatccatgagctgcactg

SEQ ID NO: 1901276 - DNA, 18 bp, Homo sapiens
ctggattgtagaacttgt

SEQ ID NO: 1901277 - DNA, 21 bp, Homo sapiens
ctggcaagaaccagttgtttt

SEQ ID NO: 1901278 - DNA, 22 bp, Homo sapiens
ctggcaatggtagtttctgtgg

SEQ ID NO: 1901279 - DNA, 14 bp, Homo sapiens
ctggcaccagcagg

SEQ ID NO: 1901280 - DNA, 18 bp, Homo sapiens
ctggcacgaaatggctga

SEQ ID NO: 1901281 - DNA, 21 bp, Homo sapiens
ctggcaggggatccagctcaa

SEQ ID NO: 1901282 - DNA, 23 bp, Homo sapiens
ctggcaggggatccagctcaagg

SEQ ID NO: 1901283 - DNA, 16 bp, Homo sapiens
ctggcatatctctgtt

SEQ ID NO: 1901284 - DNA, 13 bp, Homo sapiens
ctggccagggagg

SEQ ID NO: 1901285 - DNA, 16 bp, Homo sapiens
ctggccagggaggagc

SEQ ID NO: 1901286 - DNA, 15 bp, Homo sapiens
ctggccctctctgaa

SEQ ID NO: 1901287 - DNA, 16 bp, Homo sapiens
ctggccctctctgaag

SEQ ID NO: 1901288 - DNA, 21 bp, Homo sapiens
ctggccctctctgaaggaggc

SEQ ID NO: 1901289 - DNA, 21 bp, Homo sapiens
ctggcgggccctggagctcaa

SEQ ID NO: 1901290 - DNA, 14 bp, Homo sapiens
ctggctccctcact

SEQ ID NO: 1901291 - DNA, 21 bp, Homo sapiens
ctggctccctcactctcagga

SEQ ID NO: 1901292 - DNA, 22 bp, Homo sapiens
ctgggaggtcccagggccctag

SEQ ID NO: 1901293 - DNA, 16 bp, Homo sapiens
ctgggatttctctaga

SEQ ID NO: 1901294 - DNA, 19 bp, Homo sapiens
ctgggcactgctctcacct

SEQ ID NO: 1901295 - DNA, 20 bp, Homo sapiens
ctgggcagcttgggctggcg

SEQ ID NO: 1901296 - DNA, 14 bp, Homo sapiens
ctgggcctccacct

SEQ ID NO: 1901297 - DNA, 17 bp, Homo sapiens
ctgggcctccacctctg

SEQ ID NO: 1901298 - DNA, 22 bp, Homo sapiens
ctgggcctccacctctgtgcag

SEQ ID NO: 1901299 - DNA, 12 bp, Homo sapiens
ctgggcctggct

SEQ ID NO: 1901300 - DNA, 23 bp, Homo sapiens
ctgggcctggctccctcactctc

SEQ ID NO: 1901301 - DNA, 22 bp, Homo sapiens
ctgggctgggcactgctctcac

SEQ ID NO: 1901302 - DNA, 19 bp, Homo sapiens
ctggggctggcaccagcag

SEQ ID NO: 1901303 - DNA, 14 bp, Homo sapiens
ctgggggactcctt

SEQ ID NO: 1901304 - DNA, 13 bp, Homo sapiens
ctgggggatgggc

SEQ ID NO: 1901305 - DNA, 19 bp, Homo sapiens
ctgggggctgcagggctgg

SEQ ID NO: 1901306 - DNA, 14 bp, Homo sapiens
ctgggttcatttgt

SEQ ID NO: 1901307 - DNA, 16 bp, Homo sapiens
ctgggtttggcaggca

SEQ ID NO: 1901308 - DNA, 19 bp, Homo sapiens
ctggtaaaatgaagaattt

SEQ ID NO: 1901309 - DNA, 19 bp, Homo sapiens
ctggtacaatttcttttgg

SEQ ID NO: 1901310 - DNA, 21 bp, Homo sapiens
ctggtacaatttcttttggtt

SEQ ID NO: 1901311 - DNA, 15 bp, Homo sapiens
ctggtctacactggt

SEQ ID NO: 1901312 - DNA, 23 bp, Homo sapiens
ctggtcttccttacctggaaaaa

SEQ ID NO: 1901313 - DNA, 19 bp, Homo sapiens
ctggtgatgcgcagttgct

SEQ ID NO: 1901314 - DNA, 20 bp, Homo sapiens
ctggtgatgcgcagttgctg

SEQ ID NO: 1901315 - DNA, 23 bp, Homo sapiens
ctggtggccccttctatgcccag

SEQ ID NO: 1901316 - DNA, 15 bp, Homo sapiens
ctggtgttataatac

SEQ ID NO: 1901317 - DNA, 18 bp, Homo sapiens
ctggttacaatttacagt

SEQ ID NO: 1901318 - DNA, 19 bp, Homo sapiens
ctgtaaatgtattcattct

SEQ ID NO: 1901319 - DNA, 16 bp, Homo sapiens
ctgtaaggcatgaagg

SEQ ID NO: 1901320 - DNA, 20 bp, Homo sapiens
ctgtaatcccagcactttgg

SEQ ID NO: 1901321 - DNA, 16 bp, Homo sapiens
ctgtaatgttaataat

SEQ ID NO: 1901322 - DNA, 16 bp, Homo sapiens
ctgtacatatctttga

SEQ ID NO: 1901323 - DNA, 17 bp, Homo sapiens
ctgtacatatctttgag

SEQ ID NO: 1901324 - DNA, 13 bp, Homo sapiens
ctgtagcctgaag

SEQ ID NO: 1901325 - DNA, 22 bp, Homo sapiens
ctgtagcctgaagagtttgtaa

SEQ ID NO: 1901326 - DNA, 12 bp, Homo sapiens
ctgtaggcctca

SEQ ID NO: 1901327 - DNA, 14 bp, Homo sapiens
ctgtatttgaaagt

SEQ ID NO: 1901328 - DNA, 19 bp, Homo sapiens
ctgtatttgaaagtgcctt

SEQ ID NO: 1901329 - DNA, 13 bp, Homo sapiens
ctgtcaaggctca

SEQ ID NO: 1901330 - DNA, 17 bp, Homo sapiens
ctgtcagggttggaaag

SEQ ID NO: 1901331 - DNA, 19 bp, Homo sapiens
ctgtccattcggaaccagg

SEQ ID NO: 1901332 - DNA, 11 bp, Homo sapiens
ctgtcccaggc

SEQ ID NO: 1901333 - DNA, 12 bp, Homo sapiens
ctgtcccaggca

SEQ ID NO: 1901334 - DNA, 15 bp, Homo sapiens
ctgtcgttaaaaaca

SEQ ID NO: 1901335 - DNA, 14 bp, Homo sapiens
ctgtctcccaccct

SEQ ID NO: 1901336 - DNA, 13 bp, Homo sapiens
ctgtctccctcct

SEQ ID NO: 1901337 - DNA, 15 bp, Homo sapiens
ctgtctcggcagagg

SEQ ID NO: 1901338 - DNA, 23 bp, Homo sapiens
ctgtctcggcagaggtggtctgg

SEQ ID NO: 1901339 - DNA, 13 bp, Homo sapiens
ctgtctggcacag

SEQ ID NO: 1901340 - DNA, 15 bp, Homo sapiens
ctgtctggcacagcc

SEQ ID NO: 1901341 - DNA, 13 bp, Homo sapiens
ctgtctggccagg

SEQ ID NO: 1901342 - DNA, 14 bp, Homo sapiens
ctgtctggccaggg

SEQ ID NO: 1901343 - DNA, 16 bp, Homo sapiens
ctgtctggccagggag

SEQ ID NO: 1901344 - DNA, 17 bp, Homo sapiens
ctgtctggccagggagg

SEQ ID NO: 1901345 - DNA, 19 bp, Homo sapiens
ctgtgaacatgcctcctcc

SEQ ID NO: 1901346 - DNA, 17 bp, Homo sapiens
ctgtgaatccagtgaaa

SEQ ID NO: 1901347 - DNA, 21 bp, Homo sapiens
ctgtgataagaggtactaata

SEQ ID NO: 1901348 - DNA, 13 bp, Homo sapiens
ctgtgcagggcac

SEQ ID NO: 1901349 - DNA, 16 bp, Homo sapiens
ctgtgcagggcacaga

SEQ ID NO: 1901350 - DNA, 23 bp, Homo sapiens
ctgtgcagtggagcagaaggcag

SEQ ID NO: 1901351 - DNA, 19 bp, Homo sapiens
ctgtgctgggaggtcccag

SEQ ID NO: 1901352 - DNA, 17 bp, Homo sapiens
ctgtggagactgctcct

SEQ ID NO: 1901353 - DNA, 19 bp, Homo sapiens
ctgtggagactgctcctga

SEQ ID NO: 1901354 - DNA, 21 bp, Homo sapiens
ctgtggagactgctcctgagc

SEQ ID NO: 1901355 - DNA, 23 bp, Homo sapiens
ctgtggagactgctcctgagccc

SEQ ID NO: 1901356 - DNA, 14 bp, Homo sapiens
ctgtggcagcagga

SEQ ID NO: 1901357 - DNA, 19 bp, Homo sapiens
ctgtggttggctgggaaat

SEQ ID NO: 1901358 - DNA, 16 bp, Homo sapiens
ctgtgtatatttgatt

SEQ ID NO: 1901359 - DNA, 20 bp, Homo sapiens
ctgtgtgacatcacagggcc

SEQ ID NO: 1901360 - DNA, 22 bp, Homo sapiens
ctgtgtgacatcacagggcctc

SEQ ID NO: 1901361 - DNA, 15 bp, Homo sapiens
ctgtgttaatttaag

SEQ ID NO: 1901362 - DNA, 21 bp, Homo sapiens
ctgtgttaatttaagttttga

SEQ ID NO: 1901363 - DNA, 17 bp, Homo sapiens
ctgttaaaggtcatatg

SEQ ID NO: 1901364 - DNA, 17 bp, Homo sapiens
ctgttacttgctttgag

SEQ ID NO: 1901365 - DNA, 15 bp, Homo sapiens
ctgttatgtgagaac

SEQ ID NO: 1901366 - DNA, 16 bp, Homo sapiens
ctgttatgtgagaaca

SEQ ID NO: 1901367 - DNA, 20 bp, Homo sapiens
ctgttccccttggtatttgt

SEQ ID NO: 1901368 - DNA, 22 bp, Homo sapiens
ctgtttagatttgccatagagt

SEQ ID NO: 1901369 - DNA, 19 bp, Homo sapiens
cttaaaacatcattccttt

SEQ ID NO: 1901370 - DNA, 21 bp, Homo sapiens
cttaaaaccaatcaataatag

SEQ ID NO: 1901371 - DNA, 13 bp, Homo sapiens
cttaaatgaacac

SEQ ID NO: 1901372 - DNA, 15 bp, Homo sapiens
cttaacatagccaaa

SEQ ID NO: 1901373 - DNA, 19 bp, Homo sapiens
cttaacatagccaaaatgt

SEQ ID NO: 1901374 - DNA, 12 bp, Homo sapiens
cttaactgttca

SEQ ID NO: 1901375 - DNA, 14 bp, Homo sapiens
cttaaggtggaaag

SEQ ID NO: 1901376 - DNA, 20 bp, Homo sapiens
cttaagtcataatgaataaa

SEQ ID NO: 1901377 - DNA, 19 bp, Homo sapiens
cttaagtgaggaaatcaaa

SEQ ID NO: 1901378 - DNA, 19 bp, Homo sapiens
cttaagttagttccactga

SEQ ID NO: 1901379 - DNA, 13 bp, Homo sapiens
cttaataatcaag

SEQ ID NO: 1901380 - DNA, 12 bp, Homo sapiens
cttaatgtattt

SEQ ID NO: 1901381 - DNA, 22 bp, Homo sapiens
cttacatccatcgtaattgttc

SEQ ID NO: 1901382 - DNA, 16 bp, Homo sapiens
cttacatttgaataat

SEQ ID NO: 1901383 - DNA, 12 bp, Homo sapiens
cttactttgtaa

SEQ ID NO: 1901384 - DNA, 20 bp, Homo sapiens
cttactttgtaaattctgat

SEQ ID NO: 1901385 - DNA, 21 bp, Homo sapiens
cttactttgtaaattctgatt

SEQ ID NO: 1901386 - DNA, 20 bp, Homo sapiens
cttagaatccctgtgttaat

SEQ ID NO: 1901387 - DNA, 16 bp, Homo sapiens
cttagatcatagtttt

SEQ ID NO: 1901388 - DNA, 18 bp, Homo sapiens
cttagatcatagttttat

SEQ ID NO: 1901389 - DNA, 14 bp, Homo sapiens
cttagctgatgtct

SEQ ID NO: 1901390 - DNA, 15 bp, Homo sapiens
cttataaaacagagt

SEQ ID NO: 1901391 - DNA, 14 bp, Homo sapiens
cttatattgtaaga

SEQ ID NO: 1901392 - DNA, 17 bp, Homo sapiens
cttatattgtaagaaat

SEQ ID NO: 1901393 - DNA, 12 bp, Homo sapiens
cttatcagaggc

SEQ ID NO: 1901394 - DNA, 18 bp, Homo sapiens
cttcaagctgctttttgt

SEQ ID NO: 1901395 - DNA, 22 bp, Homo sapiens
cttcagccaccctttctggcac

SEQ ID NO: 1901396 - DNA, 23 bp, Homo sapiens
cttcagccaccctttctggcacg

SEQ ID NO: 1901397 - DNA, 17 bp, Homo sapiens
cttccagtgaggcatct

SEQ ID NO: 1901398 - DNA, 15 bp, Homo sapiens
cttccatctcttcct

SEQ ID NO: 1901399 - DNA, 16 bp, Homo sapiens
cttccccaaataatat

SEQ ID NO: 1901400 - DNA, 17 bp, Homo sapiens
cttccctccatccaccc

SEQ ID NO: 1901401 - DNA, 22 bp, Homo sapiens
cttcccttccatctcttccttt

SEQ ID NO: 1901402 - DNA, 20 bp, Homo sapiens
cttcctagctggagaggagc

SEQ ID NO: 1901403 - DNA, 12 bp, Homo sapiens
cttcctctgctg

SEQ ID NO: 1901404 - DNA, 15 bp, Homo sapiens
cttcctctgctgcat

SEQ ID NO: 1901405 - DNA, 23 bp, Homo sapiens
cttcctgaggggagacagagcaa

SEQ ID NO: 1901406 - DNA, 15 bp, Homo sapiens
cttcctttcattcta

SEQ ID NO: 1901407 - DNA, 19 bp, Homo sapiens
cttcctttgactttctgtg

SEQ ID NO: 1901408 - DNA, 16 bp, Homo sapiens
cttcgaaaagaaattg

SEQ ID NO: 1901409 - DNA, 23 bp, Homo sapiens
cttcgaaaagaaattgtccttga

SEQ ID NO: 1901410 - DNA, 19 bp, Homo sapiens
cttcgtgacaatgtttaca

SEQ ID NO: 1901411 - DNA, 14 bp, Homo sapiens
cttctagtctggaa

SEQ ID NO: 1901412 - DNA, 20 bp, Homo sapiens
cttctggttacaatttacag

SEQ ID NO: 1901413 - DNA, 14 bp, Homo sapiens
cttcttgggactgc

SEQ ID NO: 1901414 - DNA, 21 bp, Homo sapiens
cttgaaaagagacaggcaggt

SEQ ID NO: 1901415 - DNA, 17 bp, Homo sapiens
cttgaagcttgtatctg

SEQ ID NO: 1901416 - DNA, 13 bp, Homo sapiens
cttgagggccagg

SEQ ID NO: 1901417 - DNA, 21 bp, Homo sapiens
cttgagttaactttttgtagg

SEQ ID NO: 1901418 - DNA, 21 bp, Homo sapiens
cttgagttgtttttgtatatt

SEQ ID NO: 1901419 - DNA, 23 bp, Homo sapiens
cttgagttgtttttgtatattgg

SEQ ID NO: 1901420 - DNA, 17 bp, Homo sapiens
cttgattcccttgttat

SEQ ID NO: 1901421 - DNA, 12 bp, Homo sapiens
cttgcatttttg

SEQ ID NO: 1901422 - DNA, 18 bp, Homo sapiens
cttgccagctgctgagcc

SEQ ID NO: 1901423 - DNA, 19 bp, Homo sapiens
cttgccagctgctgagccg

SEQ ID NO: 1901424 - DNA, 22 bp, Homo sapiens
cttgccagctgctgagccgcag

SEQ ID NO: 1901425 - DNA, 21 bp, Homo sapiens
cttgccatgcttcagtgaaca

SEQ ID NO: 1901426 - DNA, 18 bp, Homo sapiens
cttgctctcttttattct

SEQ ID NO: 1901427 - DNA, 21 bp, Homo sapiens
cttggaaatcaaatgtaaagt

SEQ ID NO: 1901428 - DNA, 22 bp, Homo sapiens
cttggcaataaattttgaaaag

SEQ ID NO: 1901429 - DNA, 23 bp, Homo sapiens
cttggcaataaattttgaaaagt

SEQ ID NO: 1901430 - DNA, 15 bp, Homo sapiens
cttggcccagggggc

SEQ ID NO: 1901431 - DNA, 16 bp, Homo sapiens
cttggccctggcagcc

SEQ ID NO: 1901432 - DNA, 15 bp, Homo sapiens
cttgggacatcctgt

SEQ ID NO: 1901433 - DNA, 15 bp, Homo sapiens
cttgggactgctgtg

SEQ ID NO: 1901434 - DNA, 13 bp, Homo sapiens
cttgggcctccca

SEQ ID NO: 1901435 - DNA, 17 bp, Homo sapiens
cttgggggctcagcaag

SEQ ID NO: 1901436 - DNA, 20 bp, Homo sapiens
cttgggggctcagcaaggcc

SEQ ID NO: 1901437 - DNA, 21 bp, Homo sapiens
cttgggggctcagcaaggcca

SEQ ID NO: 1901438 - DNA, 17 bp, Homo sapiens
cttggttcctggggcat

SEQ ID NO: 1901439 - DNA, 19 bp, Homo sapiens
cttggttcctggggcatcc

SEQ ID NO: 1901440 - DNA, 16 bp, Homo sapiens
cttgtaaatattgttt

SEQ ID NO: 1901441 - DNA, 14 bp, Homo sapiens
cttgtaactaaaat

SEQ ID NO: 1901442 - DNA, 20 bp, Homo sapiens
cttgtagttctttaaactgt

SEQ ID NO: 1901443 - DNA, 18 bp, Homo sapiens
cttgtatctgatatcagc

SEQ ID NO: 1901444 - DNA, 20 bp, Homo sapiens
cttgtatctgatatcagcac

SEQ ID NO: 1901445 - DNA, 20 bp, Homo sapiens
cttgtattgaagttaactgt

SEQ ID NO: 1901446 - DNA, 12 bp, Homo sapiens
cttgtcccaagt

SEQ ID NO: 1901447 - DNA, 21 bp, Homo sapiens
cttgtgaaaataattgacagg

SEQ ID NO: 1901448 - DNA, 12 bp, Homo sapiens
cttgttgacaga

SEQ ID NO: 1901449 - DNA, 20 bp, Homo sapiens
cttgttgcctataagccaaa

SEQ ID NO: 1901450 - DNA, 21 bp, Homo sapiens
ctttaatgatatgcttgtaac

SEQ ID NO: 1901451 - DNA, 19 bp, Homo sapiens
ctttaccgaggacagcctg

SEQ ID NO: 1901452 - DNA, 20 bp, Homo sapiens
ctttaccgaggacagcctgc

SEQ ID NO: 1901453 - DNA, 17 bp, Homo sapiens
ctttagacttgaaaaga

SEQ ID NO: 1901454 - DNA, 22 bp, Homo sapiens
ctttagcatactagaatcagat

SEQ ID NO: 1901455 - DNA, 19 bp, Homo sapiens
ctttagttataaaggaatc

SEQ ID NO: 1901456 - DNA, 20 bp, Homo sapiens
ctttattatttttctctctc

SEQ ID NO: 1901457 - DNA, 21 bp, Homo sapiens
ctttattatttttctctctct

SEQ ID NO: 1901458 - DNA, 17 bp, Homo sapiens
ctttcacatttggaatt

SEQ ID NO: 1901459 - DNA, 16 bp, Homo sapiens
ctttcaccccatccac

SEQ ID NO: 1901460 - DNA, 21 bp, Homo sapiens
ctttcaccccatccacatggg

SEQ ID NO: 1901461 - DNA, 23 bp, Homo sapiens
ctttcattctagtattctttatt

SEQ ID NO: 1901462 - DNA, 18 bp, Homo sapiens
ctttcatttgctttggaa

SEQ ID NO: 1901463 - DNA, 18 bp, Homo sapiens
ctttcattttctttcctt

SEQ ID NO: 1901464 - DNA, 17 bp, Homo sapiens
ctttcctttcctttcat

SEQ ID NO: 1901465 - DNA, 21 bp, Homo sapiens
ctttcctttttctttcctttc

SEQ ID NO: 1901466 - DNA, 20 bp, Homo sapiens
ctttcgacttgcatttttgc

SEQ ID NO: 1901467 - DNA, 14 bp, Homo sapiens
ctttctagaaagaa

SEQ ID NO: 1901468 - DNA, 14 bp, Homo sapiens
ctttctataatttt

SEQ ID NO: 1901469 - DNA, 18 bp, Homo sapiens
ctttctataattttacaa

SEQ ID NO: 1901470 - DNA, 15 bp, Homo sapiens
ctttctcactgcctt

SEQ ID NO: 1901471 - DNA, 14 bp, Homo sapiens
ctttctctgaggac

SEQ ID NO: 1901472 - DNA, 15 bp, Homo sapiens
ctttctctgaggaca

SEQ ID NO: 1901473 - DNA, 11 bp, Homo sapiens
ctttctgaaaa

SEQ ID NO: 1901474 - DNA, 16 bp, Homo sapiens
ctttctgaaaatttat

SEQ ID NO: 1901475 - DNA, 21 bp, Homo sapiens
ctttctgaaaatttatataac

SEQ ID NO: 1901476 - DNA, 22 bp, Homo sapiens
ctttctgaaaatttatataact

SEQ ID NO: 1901477 - DNA, 19 bp, Homo sapiens
ctttgaaaacaccagctgt

SEQ ID NO: 1901478 - DNA, 18 bp, Homo sapiens
ctttgatgtgttgttctt

SEQ ID NO: 1901479 - DNA, 18 bp, Homo sapiens
ctttggtcacttttagat

SEQ ID NO: 1901480 - DNA, 22 bp, Homo sapiens
ctttgtacacccatgaaagaaa

SEQ ID NO: 1901481 - DNA, 17 bp, Homo sapiens
ctttgtagacattttga

SEQ ID NO: 1901482 - DNA, 16 bp, Homo sapiens
ctttgtattgtcctat

SEQ ID NO: 1901483 - DNA, 15 bp, Homo sapiens
ctttgttcaataaag

SEQ ID NO: 1901484 - DNA, 22 bp, Homo sapiens
cttttaagtggactctctgaca

SEQ ID NO: 1901485 - DNA, 17 bp, Homo sapiens
cttttgctttcctttcc

SEQ ID NO: 1901486 - DNA, 17 bp, Homo sapiens
ctttttatttatatgta

SEQ ID NO: 1901487 - DNA, 19 bp, Homo sapiens
ctttttatttatatgtatg

SEQ ID NO: 1901488 - DNA, 12 bp, Homo sapiens
ctttttctttcc

SEQ ID NO: 1901489 - DNA, 20 bp, Homo sapiens
cttttttattaatcactgtg

SEQ ID NO: 1901490 - DNA, 18 bp, Homo sapiens
cttttttcaaaattcaaa

SEQ ID NO: 1901491 - DNA, 17 bp, Homo sapiens
gaaaaaaaaaaagaaag

SEQ ID NO: 1901492 - DNA, 20 bp, Homo sapiens
gaaaaaaaaaatgctgaaca

SEQ ID NO: 1901493 - DNA, 12 bp, Homo sapiens
gaaaaaaaaaga

SEQ ID NO: 1901494 - DNA, 13 bp, Homo sapiens
gaaaaaaaaagaa

SEQ ID NO: 1901495 - DNA, 16 bp, Homo sapiens
gaaaaaaaaagaaaaa

SEQ ID NO: 1901496 - DNA, 17 bp, Homo sapiens
gaaaaaaaaagaaaaaa

SEQ ID NO: 1901497 - DNA, 18 bp, Homo sapiens
gaaaaaaaaagaaaaaag

SEQ ID NO: 1901498 - DNA, 15 bp, Homo sapiens
gaaaaaaaagaaagc

SEQ ID NO: 1901499 - DNA, 16 bp, Homo sapiens
gaaaaaagagaaaaga

SEQ ID NO: 1901500 - DNA, 18 bp, Homo sapiens
gaaaaaagagaaaagaaa

SEQ ID NO: 1901501 - DNA, 22 bp, Homo sapiens
gaaaacaccagctgtatatatt

SEQ ID NO: 1901502 - DNA, 16 bp, Homo sapiens
gaaaacatggaacagt

SEQ ID NO: 1901503 - DNA, 13 bp, Homo sapiens
gaaaaccaaacaa

SEQ ID NO: 1901504 - DNA, 14 bp, Homo sapiens
gaaaagaaactcta

SEQ ID NO: 1901505 - DNA, 22 bp, Homo sapiens
gaaaagaaactctatggtctta

SEQ ID NO: 1901506 - DNA, 19 bp, Homo sapiens
gaaaagatgtagatttatt

SEQ ID NO: 1901507 - DNA, 19 bp, Homo sapiens
gaaaagctgtgtactttat

SEQ ID NO: 1901508 - DNA, 20 bp, Homo sapiens
gaaaagtaatatttattaaa

SEQ ID NO: 1901509 - DNA, 19 bp, Homo sapiens
gaaaataagccatgagaat

SEQ ID NO: 1901510 - DNA, 20 bp, Homo sapiens
gaaaataattgacaggcgaa

SEQ ID NO: 1901511 - DNA, 20 bp, Homo sapiens
gaaaatagtttattttaaaa

SEQ ID NO: 1901512 - DNA, 23 bp, Homo sapiens
gaaaatagtttattttaaaacaa

SEQ ID NO: 1901513 - DNA, 17 bp, Homo sapiens
gaaaatctgaattggaa

SEQ ID NO: 1901514 - DNA, 18 bp, Homo sapiens
gaaaatctgaattggaat

SEQ ID NO: 1901515 - DNA, 20 bp, Homo sapiens
gaaaatctgaattggaatgc

SEQ ID NO: 1901516 - DNA, 11 bp, Homo sapiens
gaaaatttata

SEQ ID NO: 1901517 - DNA, 15 bp, Homo sapiens
gaaaatttatataac

SEQ ID NO: 1901518 - DNA, 16 bp, Homo sapiens
gaaaatttatataact

SEQ ID NO: 1901519 - DNA, 23 bp, Homo sapiens
gaaacaatgtgtctatttctgaa

SEQ ID NO: 1901520 - DNA, 21 bp, Homo sapiens
gaaacatgttgccaaaatggt

SEQ ID NO: 1901521 - DNA, 18 bp, Homo sapiens
gaaactaggtctgatatt

SEQ ID NO: 1901522 - DNA, 15 bp, Homo sapiens
gaaactcccacccta

SEQ ID NO: 1901523 - DNA, 14 bp, Homo sapiens
gaaactggaataag

SEQ ID NO: 1901524 - DNA, 15 bp, Homo sapiens
gaaactggaataagc

SEQ ID NO: 1901525 - DNA, 17 bp, Homo sapiens
gaaactggaataagcct

SEQ ID NO: 1901526 - DNA, 20 bp, Homo sapiens
gaaagctttgttgaaagaaa

SEQ ID NO: 1901527 - DNA, 20 bp, Homo sapiens
gaaaggcagggcaagaacag

SEQ ID NO: 1901528 - DNA, 20 bp, Homo sapiens
gaaaggccagcagccttcca

SEQ ID NO: 1901529 - DNA, 22 bp, Homo sapiens
gaaagtccaagccgtaggaccc

SEQ ID NO: 1901530 - DNA, 23 bp, Homo sapiens
gaaagtccaagccgtaggaccca

SEQ ID NO: 1901531 - DNA, 16 bp, Homo sapiens
gaaatacacagggagg

SEQ ID NO: 1901532 - DNA, 18 bp, Homo sapiens
gaaatagacagcatgaga

SEQ ID NO: 1901533 - DNA, 20 bp, Homo sapiens
gaaatagtcatttgtgaatt

SEQ ID NO: 1901534 - DNA, 22 bp, Homo sapiens
gaaatagtgtggaaattaagaa

SEQ ID NO: 1901535 - DNA, 16 bp, Homo sapiens
gaaatcaaagtgctat

SEQ ID NO: 1901536 - DNA, 17 bp, Homo sapiens
gaaatcaaagtgctatt

SEQ ID NO: 1901537 - DNA, 16 bp, Homo sapiens
gaaatcatatttggaa

SEQ ID NO: 1901538 - DNA, 19 bp, Homo sapiens
gaaatccctgctcactgca

SEQ ID NO: 1901539 - DNA, 15 bp, Homo sapiens
gaaattaagaagaaa

SEQ ID NO: 1901540 - DNA, 16 bp, Homo sapiens
gaaattaagaagaaac

SEQ ID NO: 1901541 - DNA, 18 bp, Homo sapiens
gaaattcctagtgtcttt

SEQ ID NO: 1901542 - DNA, 15 bp, Homo sapiens
gaaattgtccttgaa

SEQ ID NO: 1901543 - DNA, 19 bp, Homo sapiens
gaaatttgcccctggcaaa

SEQ ID NO: 1901544 - DNA, 20 bp, Homo sapiens
gaacaagttgagctatgact

SEQ ID NO: 1901545 - DNA, 21 bp, Homo sapiens
gaacaagttgagctatgactt

SEQ ID NO: 1901546 - DNA, 23 bp, Homo sapiens
gaacacagctctttaacatggtt

SEQ ID NO: 1901547 - DNA, 12 bp, Homo sapiens
gaacagtaaaca

SEQ ID NO: 1901548 - DNA, 13 bp, Homo sapiens
gaacatacaaatg

SEQ ID NO: 1901549 - DNA, 23 bp, Homo sapiens
gaacatacaaatgcatctttgat

SEQ ID NO: 1901550 - DNA, 19 bp, Homo sapiens
gaacatgcctcctcctgcc

SEQ ID NO: 1901551 - DNA, 20 bp, Homo sapiens
gaacattaggccccagcaac

SEQ ID NO: 1901552 - DNA, 15 bp, Homo sapiens
gaaccacttgtagat

SEQ ID NO: 1901553 - DNA, 18 bp, Homo sapiens
gaaccacttgtagatttg

SEQ ID NO: 1901554 - DNA, 20 bp, Homo sapiens
gaacccccagcccagcagac

SEQ ID NO: 1901555 - DNA, 21 bp, Homo sapiens
gaacgtttggttcaaatgtgt

SEQ ID NO: 1901556 - DNA, 13 bp, Homo sapiens
gaactcaatataa

SEQ ID NO: 1901557 - DNA, 19 bp, Homo sapiens
gaactcttctcattacttg

SEQ ID NO: 1901558 - DNA, 18 bp, Homo sapiens
gaactgacattaaaataa

SEQ ID NO: 1901559 - DNA, 17 bp, Homo sapiens
gaactgcagtcactgca

SEQ ID NO: 1901560 - DNA, 11 bp, Homo sapiens
gaactgctgct

SEQ ID NO: 1901561 - DNA, 23 bp, Homo sapiens
gaactgctgctgacccctgtgtg

SEQ ID NO: 1901562 - DNA, 16 bp, Homo sapiens
gaactgggcatatttc

SEQ ID NO: 1901563 - DNA, 14 bp, Homo sapiens
gaactgttgtataa

SEQ ID NO: 1901564 - DNA, 21 bp, Homo sapiens
gaacttccctccatccacccc

SEQ ID NO: 1901565 - DNA, 22 bp, Homo sapiens
gaacttgttgctgattttgacc

SEQ ID NO: 1901566 - DNA, 20 bp, Homo sapiens
gaagaaacagctatgagagg

SEQ ID NO: 1901567 - DNA, 19 bp, Homo sapiens
gaagaaggacttgtttccc

SEQ ID NO: 1901568 - DNA, 12 bp, Homo sapiens
gaagaatttaaa

SEQ ID NO: 1901569 - DNA, 12 bp, Homo sapiens
gaagagccccac

SEQ ID NO: 1901570 - DNA, 20 bp, Homo sapiens
gaagagccccactctcagag

SEQ ID NO: 1901571 - DNA, 23 bp, Homo sapiens
gaagagccccactctcagaggcc

SEQ ID NO: 1901572 - DNA, 18 bp, Homo sapiens
gaagatcacagcagggcc

SEQ ID NO: 1901573 - DNA, 18 bp, Homo sapiens
gaagcaagaatggaggaa

SEQ ID NO: 1901574 - DNA, 17 bp, Homo sapiens
gaagcactaagactgct

SEQ ID NO: 1901575 - DNA, 17 bp, Homo sapiens
gaagctgaggcccatgg

SEQ ID NO: 1901576 - DNA, 13 bp, Homo sapiens
gaagctgaggctg

SEQ ID NO: 1901577 - DNA, 18 bp, Homo sapiens
gaagcttgtatctgatat

SEQ ID NO: 1901578 - DNA, 17 bp, Homo sapiens
gaaggaggccacctcct

SEQ ID NO: 1901579 - DNA, 21 bp, Homo sapiens
gaaggcaataccaacctgaaa

SEQ ID NO: 1901580 - DNA, 15 bp, Homo sapiens
gaaggcagaaagcaa

SEQ ID NO: 1901581 - DNA, 18 bp, Homo sapiens
gaaggcagaaagcaaaat

SEQ ID NO: 1901582 - DNA, 18 bp, Homo sapiens
gaagtagcacaggctgag

SEQ ID NO: 1901583 - DNA, 22 bp, Homo sapiens
gaagtgacggttcctacacagg

SEQ ID NO: 1901584 - DNA, 18 bp, Homo sapiens
gaagtgcatgggtcaggg

SEQ ID NO: 1901585 - DNA, 20 bp, Homo sapiens
gaagtgcatgggtcagggtg

SEQ ID NO: 1901586 - DNA, 13 bp, Homo sapiens
gaagtggtgacat

SEQ ID NO: 1901587 - DNA, 22 bp, Homo sapiens
gaagttaactgttccccttggt

SEQ ID NO: 1901588 - DNA, 12 bp, Homo sapiens
gaataaactaga

SEQ ID NO: 1901589 - DNA, 13 bp, Homo sapiens
gaataaagtgcaa

SEQ ID NO: 1901590 - DNA, 21 bp, Homo sapiens
gaataagccattctgactcat

SEQ ID NO: 1901591 - DNA, 18 bp, Homo sapiens
gaataatgtctagatttt

SEQ ID NO: 1901592 - DNA, 20 bp, Homo sapiens
gaataatgtctagattttga

SEQ ID NO: 1901593 - DNA, 13 bp, Homo sapiens
gaatagaaatttg

SEQ ID NO: 1901594 - DNA, 16 bp, Homo sapiens
gaatagaaatttgccc

SEQ ID NO: 1901595 - DNA, 17 bp, Homo sapiens
gaatagaagctaaggtt

SEQ ID NO: 1901596 - DNA, 22 bp, Homo sapiens
gaatagctttaatgatatgctt

SEQ ID NO: 1901597 - DNA, 17 bp, Homo sapiens
gaatatgggagaaatag

SEQ ID NO: 1901598 - DNA, 22 bp, Homo sapiens
gaatcacaggctgggctgggca

SEQ ID NO: 1901599 - DNA, 14 bp, Homo sapiens
gaatcatttgttca

SEQ ID NO: 1901600 - DNA, 17 bp, Homo sapiens
gaatctagccagtgaac

SEQ ID NO: 1901601 - DNA, 23 bp, Homo sapiens
gaatctatttttcttcagactga

SEQ ID NO: 1901602 - DNA, 18 bp, Homo sapiens
gaatctgctccaactcca

SEQ ID NO: 1901603 - DNA, 13 bp, Homo sapiens
gaatcttgtccaa

SEQ ID NO: 1901604 - DNA, 16 bp, Homo sapiens
gaatgaagaattcaga

SEQ ID NO: 1901605 - DNA, 23 bp, Homo sapiens
gaatgaggaataataagttaaac

SEQ ID NO: 1901606 - DNA, 13 bp, Homo sapiens
gaatgcactcaga

SEQ ID NO: 1901607 - DNA, 12 bp, Homo sapiens
gaatgctgggcc

SEQ ID NO: 1901608 - DNA, 23 bp, Homo sapiens
gaatggcagcatgcaaacttgga

SEQ ID NO: 1901609 - DNA, 13 bp, Homo sapiens
gaatgtaaagcaa

SEQ ID NO: 1901610 - DNA, 18 bp, Homo sapiens
gaattacaccacaagtat

SEQ ID NO: 1901611 - DNA, 17 bp, Homo sapiens
gaattcaaatattcttt

SEQ ID NO: 1901612 - DNA, 22 bp, Homo sapiens
gaattgatacgtttattaggaa

SEQ ID NO: 1901613 - DNA, 13 bp, Homo sapiens
gaatttatataaa

SEQ ID NO: 1901614 - DNA, 12 bp, Homo sapiens
gaatttgtttaa

SEQ ID NO: 1901615 - DNA, 15 bp, Homo sapiens
gaatttttatgtgtg

SEQ ID NO: 1901616 - DNA, 18 bp, Homo sapiens
gaatttttatgtgtgatt

SEQ ID NO: 1901617 - DNA, 13 bp, Homo sapiens
gaatttttttgta

SEQ ID NO: 1901618 - DNA, 17 bp, Homo sapiens
gacaaagcattctaaat

SEQ ID NO: 1901619 - DNA, 18 bp, Homo sapiens
gacaaatgaaataataaa

SEQ ID NO: 1901620 - DNA, 17 bp, Homo sapiens
gacaactgaaagaaaaa

SEQ ID NO: 1901621 - DNA, 17 bp, Homo sapiens
gacaatagcattagaaa

SEQ ID NO: 1901622 - DNA, 14 bp, Homo sapiens
gacaccacagcctc

SEQ ID NO: 1901623 - DNA, 16 bp, Homo sapiens
gacaccacagcctccc

SEQ ID NO: 1901624 - DNA, 19 bp, Homo sapiens
gacaccacagcctcccctt

SEQ ID NO: 1901625 - DNA, 15 bp, Homo sapiens
gacagacaccacagc

SEQ ID NO: 1901626 - DNA, 21 bp, Homo sapiens
gacagacaccacagcctcccc

SEQ ID NO: 1901627 - DNA, 20 bp, Homo sapiens
gacagagcaacccctggacc

SEQ ID NO: 1901628 - DNA, 12 bp, Homo sapiens
gacagcatgaga

SEQ ID NO: 1901629 - DNA, 14 bp, Homo sapiens
gacaggggttcctt

SEQ ID NO: 1901630 - DNA, 20 bp, Homo sapiens
gacaggggttccttctgggc

SEQ ID NO: 1901631 - DNA, 17 bp, Homo sapiens
gacatcaagctcaaggc

SEQ ID NO: 1901632 - DNA, 15 bp, Homo sapiens
gacatcacagggcct

SEQ ID NO: 1901633 - DNA, 13 bp, Homo sapiens
gacatcactggca

SEQ ID NO: 1901634 - DNA, 17 bp, Homo sapiens
gacatcccctgctggcc

SEQ ID NO: 1901635 - DNA, 20 bp, Homo sapiens
gacatcctgtcatctgagaa

SEQ ID NO: 1901636 - DNA, 23 bp, Homo sapiens
gacatcctgtcatctgagaatga

SEQ ID NO: 1901637 - DNA, 23 bp, Homo sapiens
gacatgaaaatagcaatattctt

SEQ ID NO: 1901638 - DNA, 18 bp, Homo sapiens
gaccaaggctctgaaata

SEQ ID NO: 1901639 - DNA, 17 bp, Homo sapiens
gaccacagaggctgtgg

SEQ ID NO: 1901640 - DNA, 18 bp, Homo sapiens
gaccagaagacaaaggcc

SEQ ID NO: 1901641 - DNA, 20 bp, Homo sapiens
gaccagaagacaaaggccca

SEQ ID NO: 1901642 - DNA, 16 bp, Homo sapiens
gaccagcaggctcctc

SEQ ID NO: 1901643 - DNA, 19 bp, Homo sapiens
gaccagcaggctcctcagc

SEQ ID NO: 1901644 - DNA, 23 bp, Homo sapiens
gaccagccagggaaagactggca

SEQ ID NO: 1901645 - DNA, 14 bp, Homo sapiens
gaccagcccacgct

SEQ ID NO: 1901646 - DNA, 23 bp, Homo sapiens
gaccagcccacgctgactacagg

SEQ ID NO: 1901647 - DNA, 16 bp, Homo sapiens
gaccataacagtgcca

SEQ ID NO: 1901648 - DNA, 20 bp, Homo sapiens
gaccatgctgtctggcacag

SEQ ID NO: 1901649 - DNA, 17 bp, Homo sapiens
gacccagtggcagggca

SEQ ID NO: 1901650 - DNA, 20 bp, Homo sapiens
gacccagtggcagggcacag

SEQ ID NO: 1901651 - DNA, 17 bp, Homo sapiens
gacccatgggcaggaga

SEQ ID NO: 1901652 - DNA, 21 bp, Homo sapiens
gaccccactggagtctctctc

SEQ ID NO: 1901653 - DNA, 12 bp, Homo sapiens
gaccccagcctc

SEQ ID NO: 1901654 - DNA, 20 bp, Homo sapiens
gaccccgcagcacgcctctc

SEQ ID NO: 1901655 - DNA, 21 bp, Homo sapiens
gaccccgcagcacgcctctcc

SEQ ID NO: 1901656 - DNA, 20 bp, Homo sapiens
gacccctgcagttcccctgg

SEQ ID NO: 1901657 - DNA, 13 bp, Homo sapiens
gaccctccaaggc

SEQ ID NO: 1901658 - DNA, 16 bp, Homo sapiens
gaccctgccaggcaca

SEQ ID NO: 1901659 - DNA, 17 bp, Homo sapiens
gaccctgccaggcacag

SEQ ID NO: 1901660 - DNA, 18 bp, Homo sapiens
gaccctgccaggcacagg

SEQ ID NO: 1901661 - DNA, 21 bp, Homo sapiens
gaccctgccaggcacaggcag

SEQ ID NO: 1901662 - DNA, 22 bp, Homo sapiens
gacctcaaatgatgtgcctgct

SEQ ID NO: 1901663 - DNA, 16 bp, Homo sapiens
gacctcacacacctct

SEQ ID NO: 1901664 - DNA, 17 bp, Homo sapiens
gacctcacacacctctg

SEQ ID NO: 1901665 - DNA, 20 bp, Homo sapiens
gacctcacacacctctgccc

SEQ ID NO: 1901666 - DNA, 23 bp, Homo sapiens
gacctcacacacctctgcccctt

SEQ ID NO: 1901667 - DNA, 17 bp, Homo sapiens
gacctcctaaataaatt

SEQ ID NO: 1901668 - DNA, 14 bp, Homo sapiens
gacctcgggctgtt

SEQ ID NO: 1901669 - DNA, 15 bp, Homo sapiens
gacctcgggctgttc

SEQ ID NO: 1901670 - DNA, 15 bp, Homo sapiens
gacctgcctgtctcc

SEQ ID NO: 1901671 - DNA, 18 bp, Homo sapiens
gaccttgtattgaagtta

SEQ ID NO: 1901672 - DNA, 14 bp, Homo sapiens
gacgcaccagccca

SEQ ID NO: 1901673 - DNA, 16 bp, Homo sapiens
gacggttcctacacag

SEQ ID NO: 1901674 - DNA, 22 bp, Homo sapiens
gacggttcctacacaggacagg

SEQ ID NO: 1901675 - DNA, 19 bp, Homo sapiens
gactaaaaatatcacactg

SEQ ID NO: 1901676 - DNA, 12 bp, Homo sapiens
gactacagggcc

SEQ ID NO: 1901677 - DNA, 15 bp, Homo sapiens
gactctaaagtctgt

SEQ ID NO: 1901678 - DNA, 19 bp, Homo sapiens
gactctagtactgtgaatc

SEQ ID NO: 1901679 - DNA, 14 bp, Homo sapiens
gactctctgacaaa

SEQ ID NO: 1901680 - DNA, 20 bp, Homo sapiens
gactctgtctggccagggag

SEQ ID NO: 1901681 - DNA, 16 bp, Homo sapiens
gactcttgagttgttt

SEQ ID NO: 1901682 - DNA, 13 bp, Homo sapiens
gactgaattcaaa

SEQ ID NO: 1901683 - DNA, 13 bp, Homo sapiens
gactgaggccttt

SEQ ID NO: 1901684 - DNA, 12 bp, Homo sapiens
gactgccacctc

SEQ ID NO: 1901685 - DNA, 14 bp, Homo sapiens
gactgccacctccc

SEQ ID NO: 1901686 - DNA, 15 bp, Homo sapiens
gactgccacctcccc

SEQ ID NO: 1901687 - DNA, 16 bp, Homo sapiens
gactgccacctcccct

SEQ ID NO: 1901688 - DNA, 13 bp, Homo sapiens
gactgccagctct

SEQ ID NO: 1901689 - DNA, 14 bp, Homo sapiens
gactgccagctctt

SEQ ID NO: 1901690 - DNA, 18 bp, Homo sapiens
gactgccagctcttccta

SEQ ID NO: 1901691 - DNA, 21 bp, Homo sapiens
gactgccagctcttcctagct

SEQ ID NO: 1901692 - DNA, 14 bp, Homo sapiens
gactgctcctgagc

SEQ ID NO: 1901693 - DNA, 22 bp, Homo sapiens
gactgctcctgagcccccagct

SEQ ID NO: 1901694 - DNA, 20 bp, Homo sapiens
gactgctgtgaacatgcctc

SEQ ID NO: 1901695 - DNA, 17 bp, Homo sapiens
gactgcttgacaaagga

SEQ ID NO: 1901696 - DNA, 19 bp, Homo sapiens
gactggatctgcaggtggg

SEQ ID NO: 1901697 - DNA, 20 bp, Homo sapiens
gacttagaatccctgtgtta

SEQ ID NO: 1901698 - DNA, 21 bp, Homo sapiens
gacttagaatccctgtgttaa

SEQ ID NO: 1901699 - DNA, 23 bp, Homo sapiens
gacttagaatccctgtgttaatt

SEQ ID NO: 1901700 - DNA, 20 bp, Homo sapiens
gacttccccaagcctggcag

SEQ ID NO: 1901701 - DNA, 21 bp, Homo sapiens
gacttgaaaagagacaggcag

SEQ ID NO: 1901702 - DNA, 22 bp, Homo sapiens
gacttgaaaagagacaggcagg

SEQ ID NO: 1901703 - DNA, 14 bp, Homo sapiens
gactttgaatttat

SEQ ID NO: 1901704 - DNA, 15 bp, Homo sapiens
gactttgaatttata

SEQ ID NO: 1901705 - DNA, 22 bp, Homo sapiens
gactttgatgtcagcagttgct

SEQ ID NO: 1901706 - DNA, 11 bp, Homo sapiens
gagaaaagaaa

SEQ ID NO: 1901707 - DNA, 14 bp, Homo sapiens
gagaaaagaaaaaa

SEQ ID NO: 1901708 - DNA, 18 bp, Homo sapiens
gagaacattaggccccag

SEQ ID NO: 1901709 - DNA, 11 bp, Homo sapiens
gagaagagccc

SEQ ID NO: 1901710 - DNA, 11 bp, Homo sapiens
gagaatgaaca

SEQ ID NO: 1901711 - DNA, 22 bp, Homo sapiens
gagaatgaacaaagaccaattt

SEQ ID NO: 1901712 - DNA, 15 bp, Homo sapiens
gagacagactagaag

SEQ ID NO: 1901713 - DNA, 15 bp, Homo sapiens
gagactgcttgacaa

SEQ ID NO: 1901714 - DNA, 16 bp, Homo sapiens
gagactgcttgacaaa

SEQ ID NO: 1901715 - DNA, 11 bp, Homo sapiens
gagacttctgt

SEQ ID NO: 1901716 - DNA, 13 bp, Homo sapiens
gagactttgatgt

SEQ ID NO: 1901717 - DNA, 15 bp, Homo sapiens
gagagaagagcccca

SEQ ID NO: 1901718 - DNA, 19 bp, Homo sapiens
gagagcgaccagcaggctc

SEQ ID NO: 1901719 - DNA, 15 bp, Homo sapiens
gagagggaagctgag

SEQ ID NO: 1901720 - DNA, 14 bp, Homo sapiens
gagaggggaggcca

SEQ ID NO: 1901721 - DNA, 18 bp, Homo sapiens
gagatccttgtgtttatc

SEQ ID NO: 1901722 - DNA, 11 bp, Homo sapiens
gagcaagagga

SEQ ID NO: 1901723 - DNA, 17 bp, Homo sapiens
gagcagcacccatccac

SEQ ID NO: 1901724 - DNA, 22 bp, Homo sapiens
gagcaggattgccaggtatttt

SEQ ID NO: 1901725 - DNA, 16 bp, Homo sapiens
gagcagggcaggcccc

SEQ ID NO: 1901726 - DNA, 13 bp, Homo sapiens
gagcccactgtgc

SEQ ID NO: 1901727 - DNA, 18 bp, Homo sapiens
gagcccatttggagggcc

SEQ ID NO: 1901728 - DNA, 12 bp, Homo sapiens
gagccccactct

SEQ ID NO: 1901729 - DNA, 17 bp, Homo sapiens
gagcccccagcttccag

SEQ ID NO: 1901730 - DNA, 21 bp, Homo sapiens
gagcccccagcttccagcagg

SEQ ID NO: 1901731 - DNA, 22 bp, Homo sapiens
gagccctcagtcggggcaggcc

SEQ ID NO: 1901732 - DNA, 22 bp, Homo sapiens
gagccctgcctctccgcccctg

SEQ ID NO: 1901733 - DNA, 13 bp, Homo sapiens
gagccgcagagaa

SEQ ID NO: 1901734 - DNA, 18 bp, Homo sapiens
gagcctgcggggcagcag

SEQ ID NO: 1901735 - DNA, 19 bp, Homo sapiens
gagcctgcggggcagcagg

SEQ ID NO: 1901736 - DNA, 14 bp, Homo sapiens
gagcgaccagcagg

SEQ ID NO: 1901737 - DNA, 16 bp, Homo sapiens
gagcgttagaggggcc

SEQ ID NO: 1901738 - DNA, 13 bp, Homo sapiens
gagctaaggccaa

SEQ ID NO: 1901739 - DNA, 19 bp, Homo sapiens
gagctcactgtggtgtctg

SEQ ID NO: 1901740 - DNA, 20 bp, Homo sapiens
gagctcccacttctgccaga

SEQ ID NO: 1901741 - DNA, 14 bp, Homo sapiens
gagctcggggctgg

SEQ ID NO: 1901742 - DNA, 15 bp, Homo sapiens
gagctcggggctggg

SEQ ID NO: 1901743 - DNA, 12 bp, Homo sapiens
gaggaaatcaaa

SEQ ID NO: 1901744 - DNA, 18 bp, Homo sapiens
gaggaactttcaaaagtc

SEQ ID NO: 1901745 - DNA, 21 bp, Homo sapiens
gaggacagcctgcctctgcca

SEQ ID NO: 1901746 - DNA, 13 bp, Homo sapiens
gaggagccctgcc

SEQ ID NO: 1901747 - DNA, 18 bp, Homo sapiens
gaggagccctgcctctcc

SEQ ID NO: 1901748 - DNA, 15 bp, Homo sapiens
gaggaggcagagagg

SEQ ID NO: 1901749 - DNA, 13 bp, Homo sapiens
gaggaggcaggag

SEQ ID NO: 1901750 - DNA, 20 bp, Homo sapiens
gaggagtggattcctcccca

SEQ ID NO: 1901751 - DNA, 19 bp, Homo sapiens
gaggagtggcatctggggc

SEQ ID NO: 1901752 - DNA, 14 bp, Homo sapiens
gaggattagtttag

SEQ ID NO: 1901753 - DNA, 20 bp, Homo sapiens
gaggattggctcccatcttt

SEQ ID NO: 1901754 - DNA, 22 bp, Homo sapiens
gaggcagcagtgggttcaggcc

SEQ ID NO: 1901755 - DNA, 21 bp, Homo sapiens
gaggcagttcgaccagccagg

SEQ ID NO: 1901756 - DNA, 16 bp, Homo sapiens
gaggcagtttgaggat

SEQ ID NO: 1901757 - DNA, 18 bp, Homo sapiens
gaggccaaacaggccctc

SEQ ID NO: 1901758 - DNA, 20 bp, Homo sapiens
gaggccaagagtggccccac

SEQ ID NO: 1901759 - DNA, 12 bp, Homo sapiens
gaggccacctcc

SEQ ID NO: 1901760 - DNA, 16 bp, Homo sapiens
gaggcccatggccaca

SEQ ID NO: 1901761 - DNA, 19 bp, Homo sapiens
gaggcggagcttgcagtga

SEQ ID NO: 1901762 - DNA, 20 bp, Homo sapiens
gaggcggagcttgcagtgag

SEQ ID NO: 1901763 - DNA, 21 bp, Homo sapiens
gaggctcgagctcggggctgg

SEQ ID NO: 1901764 - DNA, 16 bp, Homo sapiens
gaggctgctgccaggc

SEQ ID NO: 1901765 - DNA, 21 bp, Homo sapiens
gaggctgctgccaggcccggc

SEQ ID NO: 1901766 - DNA, 12 bp, Homo sapiens
gaggctggcaag

SEQ ID NO: 1901767 - DNA, 15 bp, Homo sapiens
gaggctgtggtcaga

SEQ ID NO: 1901768 - DNA, 14 bp, Homo sapiens
gagggaagctgagg

SEQ ID NO: 1901769 - DNA, 16 bp, Homo sapiens
gagggaagctgaggcc

SEQ ID NO: 1901770 - DNA, 18 bp, Homo sapiens
gagggaagctgaggccca

SEQ ID NO: 1901771 - DNA, 22 bp, Homo sapiens
gagggactctgtctggccaggg

SEQ ID NO: 1901772 - DNA, 23 bp, Homo sapiens
gagggactctgtctggccaggga

SEQ ID NO: 1901773 - DNA, 15 bp, Homo sapiens
gagggcctgggcctg

SEQ ID NO: 1901774 - DNA, 17 bp, Homo sapiens
gagggcctgggcctggc

SEQ ID NO: 1901775 - DNA, 19 bp, Homo sapiens
gaggggccagcggccctcc

SEQ ID NO: 1901776 - DNA, 23 bp, Homo sapiens
gagggtttttaaaaataaagcaa

SEQ ID NO: 1901777 - DNA, 20 bp, Homo sapiens
gaggtgctggttccatgcct

SEQ ID NO: 1901778 - DNA, 18 bp, Homo sapiens
gagtagccatgaggaggc

SEQ ID NO: 1901779 - DNA, 20 bp, Homo sapiens
gagtagccatgaggaggcag

SEQ ID NO: 1901780 - DNA, 13 bp, Homo sapiens
gagtagctcgtcc

SEQ ID NO: 1901781 - DNA, 12 bp, Homo sapiens
gagtctgggctc

SEQ ID NO: 1901782 - DNA, 20 bp, Homo sapiens
gagtctgtgtggccagcagc

SEQ ID NO: 1901783 - DNA, 19 bp, Homo sapiens
gagtgaaactcccacccta

SEQ ID NO: 1901784 - DNA, 14 bp, Homo sapiens
gagtgagacagact

SEQ ID NO: 1901785 - DNA, 18 bp, Homo sapiens
gagtgagaggggaggcca

SEQ ID NO: 1901786 - DNA, 20 bp, Homo sapiens
gagtgagaggggaggccaag

SEQ ID NO: 1901787 - DNA, 15 bp, Homo sapiens
gagtgcaggcccacc

SEQ ID NO: 1901788 - DNA, 16 bp, Homo sapiens
gagtgcaggcccaccc

SEQ ID NO: 1901789 - DNA, 18 bp, Homo sapiens
gagtgccaacttctttca

SEQ ID NO: 1901790 - DNA, 19 bp, Homo sapiens
gagtgccgcatctcacagc

SEQ ID NO: 1901791 - DNA, 20 bp, Homo sapiens
gagtggccccacctggccct

SEQ ID NO: 1901792 - DNA, 23 bp, Homo sapiens
gagtgttctgggatttctctaga

SEQ ID NO: 1901793 - DNA, 19 bp, Homo sapiens
gataacaatgttttaacaa

SEQ ID NO: 1901794 - DNA, 12 bp, Homo sapiens
gataagaaaacc

SEQ ID NO: 1901795 - DNA, 19 bp, Homo sapiens
gataataatcatgatcaca

SEQ ID NO: 1901796 - DNA, 20 bp, Homo sapiens
gataatgtggattaaaacct

SEQ ID NO: 1901797 - DNA, 16 bp, Homo sapiens
gataattgtactttga

SEQ ID NO: 1901798 - DNA, 17 bp, Homo sapiens
gataattgtactttgaa

SEQ ID NO: 1901799 - DNA, 21 bp, Homo sapiens
gataccaaagagacagggccc

SEQ ID NO: 1901800 - DNA, 11 bp, Homo sapiens
gatactctggg

SEQ ID NO: 1901801 - DNA, 13 bp, Homo sapiens
gatactctgggaa

SEQ ID NO: 1901802 - DNA, 16 bp, Homo sapiens
gatagcaggaggaact

SEQ ID NO: 1901803 - DNA, 13 bp, Homo sapiens
gatagtgggacca

SEQ ID NO: 1901804 - DNA, 20 bp, Homo sapiens
gatatattttatttttagaa

SEQ ID NO: 1901805 - DNA, 22 bp, Homo sapiens
gatatgcttgtaactaaaataa

SEQ ID NO: 1901806 - DNA, 17 bp, Homo sapiens
gatatgtatatttttga

SEQ ID NO: 1901807 - DNA, 17 bp, Homo sapiens
gatattttcttaaaacc

SEQ ID NO: 1901808 - DNA, 14 bp, Homo sapiens
gatatttttatagg

SEQ ID NO: 1901809 - DNA, 23 bp, Homo sapiens
gatcaaaaaggcttataaaacag

SEQ ID NO: 1901810 - DNA, 16 bp, Homo sapiens
gatcacagcagggcct

SEQ ID NO: 1901811 - DNA, 21 bp, Homo sapiens
gatcacagcagggccttctgc

SEQ ID NO: 1901812 - DNA, 20 bp, Homo sapiens
gatcactgaaataaaagcta

SEQ ID NO: 1901813 - DNA, 20 bp, Homo sapiens
gatcagatagcaggaggaac

SEQ ID NO: 1901814 - DNA, 14 bp, Homo sapiens
gatcatagttttat

SEQ ID NO: 1901815 - DNA, 18 bp, Homo sapiens
gatcatagttttatttat

SEQ ID NO: 1901816 - DNA, 19 bp, Homo sapiens
gatcatagttttatttata

SEQ ID NO: 1901817 - DNA, 14 bp, Homo sapiens
gatccagctcaagg

SEQ ID NO: 1901818 - DNA, 19 bp, Homo sapiens
gatccagctcaagggagta

SEQ ID NO: 1901819 - DNA, 20 bp, Homo sapiens
gatccttgtgtttatcagaa

SEQ ID NO: 1901820 - DNA, 19 bp, Homo sapiens
gatcgagaccatcctggct

SEQ ID NO: 1901821 - DNA, 16 bp, Homo sapiens
gatctgctgcagagca

SEQ ID NO: 1901822 - DNA, 17 bp, Homo sapiens
gatctgctgcagagcag

SEQ ID NO: 1901823 - DNA, 15 bp, Homo sapiens
gatgaagctgaggct

SEQ ID NO: 1901824 - DNA, 19 bp, Homo sapiens
gatgaagctgaggctgctg

SEQ ID NO: 1901825 - DNA, 17 bp, Homo sapiens
gatgacaacaaattttg

SEQ ID NO: 1901826 - DNA, 19 bp, Homo sapiens
gatgagggagacagaccac

SEQ ID NO: 1901827 - DNA, 14 bp, Homo sapiens
gatgattgaagaaa

SEQ ID NO: 1901828 - DNA, 17 bp, Homo sapiens
gatgcattaaaagaaaa

SEQ ID NO: 1901829 - DNA, 18 bp, Homo sapiens
gatgcattaaaagaaaat

SEQ ID NO: 1901830 - DNA, 15 bp, Homo sapiens
gatgcgcagttgctg

SEQ ID NO: 1901831 - DNA, 13 bp, Homo sapiens
gatggaatttttt

SEQ ID NO: 1901832 - DNA, 13 bp, Homo sapiens
gatggacagacag

SEQ ID NO: 1901833 - DNA, 14 bp, Homo sapiens
gatggcagtggctg

SEQ ID NO: 1901834 - DNA, 19 bp, Homo sapiens
gatgggatgattgaagaaa

SEQ ID NO: 1901835 - DNA, 20 bp, Homo sapiens
gatgggatgattgaagaaac

SEQ ID NO: 1901836 - DNA, 14 bp, Homo sapiens
gatgtaaagatgtt

SEQ ID NO: 1901837 - DNA, 13 bp, Homo sapiens
gatgtaattttgt

SEQ ID NO: 1901838 - DNA, 19 bp, Homo sapiens
gatgtcagcagttgctggt

SEQ ID NO: 1901839 - DNA, 15 bp, Homo sapiens
gatgtgctgcagtgc

SEQ ID NO: 1901840 - DNA, 23 bp, Homo sapiens
gatgttgaggcgagcagggcagg

SEQ ID NO: 1901841 - DNA, 15 bp, Homo sapiens
gatgttttccactga

SEQ ID NO: 1901842 - DNA, 19 bp, Homo sapiens
gatgtttttagttctgact

SEQ ID NO: 1901843 - DNA, 21 bp, Homo sapiens
gatgtttttagttctgacttt

SEQ ID NO: 1901844 - DNA, 21 bp, Homo sapiens
gattagtaggaaaggactgag

SEQ ID NO: 1901845 - DNA, 13 bp, Homo sapiens
gattcccttgtta

SEQ ID NO: 1901846 - DNA, 17 bp, Homo sapiens
gattcctccccaccctg

SEQ ID NO: 1901847 - DNA, 22 bp, Homo sapiens
gattcctccccaccctgtccca

SEQ ID NO: 1901848 - DNA, 16 bp, Homo sapiens
gattctaaaatgtctc

SEQ ID NO: 1901849 - DNA, 23 bp, Homo sapiens
gattctcttgcctcagcttcccc

SEQ ID NO: 1901850 - DNA, 20 bp, Homo sapiens
gattctgaccttaaatgcaa

SEQ ID NO: 1901851 - DNA, 23 bp, Homo sapiens
gattctgaccttaaatgcaacca

SEQ ID NO: 1901852 - DNA, 14 bp, Homo sapiens
gattgtagaacttg

SEQ ID NO: 1901853 - DNA, 21 bp, Homo sapiens
gatttaaccattccataatca

SEQ ID NO: 1901854 - DNA, 12 bp, Homo sapiens
gatttattaact

SEQ ID NO: 1901855 - DNA, 20 bp, Homo sapiens
gatttattaacttaataatc

SEQ ID NO: 1901856 - DNA, 18 bp, Homo sapiens
gatttatttcatcatatt

SEQ ID NO: 1901857 - DNA, 13 bp, Homo sapiens
gatttgccataga

SEQ ID NO: 1901858 - DNA, 14 bp, Homo sapiens
gattttattaatca

SEQ ID NO: 1901859 - DNA, 13 bp, Homo sapiens
gattttgaccttg

SEQ ID NO: 1901860 - DNA, 23 bp, Homo sapiens
gcaaaataacaaaaaagagaaac

SEQ ID NO: 1901861 - DNA, 22 bp, Homo sapiens
gcaaacctttctataattttac

SEQ ID NO: 1901862 - DNA, 14 bp, Homo sapiens
gcaaagaactctta

SEQ ID NO: 1901863 - DNA, 15 bp, Homo sapiens
gcaaatttgtgaact

SEQ ID NO: 1901864 - DNA, 15 bp, Homo sapiens
gcaaccaaaaagaaa

SEQ ID NO: 1901865 - DNA, 14 bp, Homo sapiens
gcaacccctggacc

SEQ ID NO: 1901866 - DNA, 19 bp, Homo sapiens
gcaacccctggaccccagc

SEQ ID NO: 1901867 - DNA, 22 bp, Homo sapiens
gcaacccctggaccccagcctc

SEQ ID NO: 1901868 - DNA, 20 bp, Homo sapiens
gcaacgatcacaaatgactt

SEQ ID NO: 1901869 - DNA, 21 bp, Homo sapiens
gcaacgatcacaaatgacttt

SEQ ID NO: 1901870 - DNA, 22 bp, Homo sapiens
gcaacgatcacaaatgacttta

SEQ ID NO: 1901871 - DNA, 13 bp, Homo sapiens
gcaagaaaagagt

SEQ ID NO: 1901872 - DNA, 13 bp, Homo sapiens
gcaaggccacctc

SEQ ID NO: 1901873 - DNA, 14 bp, Homo sapiens
gcaaggccacctct

SEQ ID NO: 1901874 - DNA, 20 bp, Homo sapiens
gcaaggccacctcttcctgg

SEQ ID NO: 1901875 - DNA, 21 bp, Homo sapiens
gcaagggcggcctttcccact

SEQ ID NO: 1901876 - DNA, 17 bp, Homo sapiens
gcaataaaactgctagt

SEQ ID NO: 1901877 - DNA, 19 bp, Homo sapiens
gcaataaaagcccaggagc

SEQ ID NO: 1901878 - DNA, 13 bp, Homo sapiens
gcaataaattttg

SEQ ID NO: 1901879 - DNA, 18 bp, Homo sapiens
gcaataaattttgaaaag

SEQ ID NO: 1901880 - DNA, 18 bp, Homo sapiens
gcaatgccccctcccctc

SEQ ID NO: 1901881 - DNA, 20 bp, Homo sapiens
gcaatgccccctcccctcct

SEQ ID NO: 1901882 - DNA, 19 bp, Homo sapiens
gcaatggtagtttctgtgg

SEQ ID NO: 1901883 - DNA, 19 bp, Homo sapiens
gcaattctcgattctttga

SEQ ID NO: 1901884 - DNA, 17 bp, Homo sapiens
gcacaccaatcttactt

SEQ ID NO: 1901885 - DNA, 20 bp, Homo sapiens
gcacaccaatcttactttgt

SEQ ID NO: 1901886 - DNA, 13 bp, Homo sapiens
gcacaggcagggc

SEQ ID NO: 1901887 - DNA, 15 bp, Homo sapiens
gcacaggcagggcag

SEQ ID NO: 1901888 - DNA, 19 bp, Homo sapiens
gcacaggctgagtgcaggc

SEQ ID NO: 1901889 - DNA, 21 bp, Homo sapiens
gcacaggctgagtgcaggccc

SEQ ID NO: 1901890 - DNA, 23 bp, Homo sapiens
gcacaggctgagtgcaggcccac

SEQ ID NO: 1901891 - DNA, 18 bp, Homo sapiens
gcacagggcctggcccat

SEQ ID NO: 1901892 - DNA, 12 bp, Homo sapiens
gcaccagcaggc

SEQ ID NO: 1901893 - DNA, 17 bp, Homo sapiens
gcaccatcccctccggc

SEQ ID NO: 1901894 - DNA, 16 bp, Homo sapiens
gcacccatccaccgtc

SEQ ID NO: 1901895 - DNA, 23 bp, Homo sapiens
gcacccatccaccgtcccctccc

SEQ ID NO: 1901896 - DNA, 20 bp, Homo sapiens
gcacgcctctccccaccttc

SEQ ID NO: 1901897 - DNA, 13 bp, Homo sapiens
gcacgtgcacaaa

SEQ ID NO: 1901898 - DNA, 13 bp, Homo sapiens
gcactgactctgg

SEQ ID NO: 1901899 - DNA, 18 bp, Homo sapiens
gcactggattgtagaact

SEQ ID NO: 1901900 - DNA, 22 bp, Homo sapiens
gcactggattgtagaacttgtt

SEQ ID NO: 1901901 - DNA, 19 bp, Homo sapiens
gcacttgggggctcagcaa

SEQ ID NO: 1901902 - DNA, 21 bp, Homo sapiens
gcacttgggggctcagcaagg

SEQ ID NO: 1901903 - DNA, 22 bp, Homo sapiens
gcacttgggggctcagcaaggc

SEQ ID NO: 1901904 - DNA, 23 bp, Homo sapiens
gcactttgacagcgcacagctgc

SEQ ID NO: 1901905 - DNA, 16 bp, Homo sapiens
gcagaaggctttttta

SEQ ID NO: 1901906 - DNA, 20 bp, Homo sapiens
gcagaagtaggggaagaata

SEQ ID NO: 1901907 - DNA, 19 bp, Homo sapiens
gcagacacccttggagctc

SEQ ID NO: 1901908 - DNA, 22 bp, Homo sapiens
gcagacatcaagctcaaggcaa

SEQ ID NO: 1901909 - DNA, 15 bp, Homo sapiens
gcagaccctgcccct

SEQ ID NO: 1901910 - DNA, 21 bp, Homo sapiens
gcagagaagtgacggttccta

SEQ ID NO: 1901911 - DNA, 18 bp, Homo sapiens
gcagaggtggtctggtgc

SEQ ID NO: 1901912 - DNA, 17 bp, Homo sapiens
gcagcaataatttctgt

SEQ ID NO: 1901913 - DNA, 17 bp, Homo sapiens
gcagcacgcctctcccc

SEQ ID NO: 1901914 - DNA, 14 bp, Homo sapiens
gcagcaggagggac

SEQ ID NO: 1901915 - DNA, 17 bp, Homo sapiens
gcagcaggagggactct

SEQ ID NO: 1901916 - DNA, 22 bp, Homo sapiens
gcagcaggagggactctgtctg

SEQ ID NO: 1901917 - DNA, 22 bp, Homo sapiens
gcagccatttctccatggagtt

SEQ ID NO: 1901918 - DNA, 17 bp, Homo sapiens
gcagcctccgcttccct

SEQ ID NO: 1901919 - DNA, 14 bp, Homo sapiens
gcagcctctgatct

SEQ ID NO: 1901920 - DNA, 16 bp, Homo sapiens
gcagcctctgatctgt

SEQ ID NO: 1901921 - DNA, 12 bp, Homo sapiens
gcagccttccag

SEQ ID NO: 1901922 - DNA, 20 bp, Homo sapiens
gcagccttccagtggcttct

SEQ ID NO: 1901923 - DNA, 14 bp, Homo sapiens
gcagcgaggctggg

SEQ ID NO: 1901924 - DNA, 14 bp, Homo sapiens
gcagcgccactgtc

SEQ ID NO: 1901925 - DNA, 21 bp, Homo sapiens
gcagctgtcaccactacagta

SEQ ID NO: 1901926 - DNA, 15 bp, Homo sapiens
gcagcttgggctggc

SEQ ID NO: 1901927 - DNA, 19 bp, Homo sapiens
gcagcttgggctggcgggc

SEQ ID NO: 1901928 - DNA, 14 bp, Homo sapiens
gcaggacactgcag

SEQ ID NO: 1901929 - DNA, 13 bp, Homo sapiens
gcaggagcagtat

SEQ ID NO: 1901930 - DNA, 17 bp, Homo sapiens
gcaggagcagtatcatg

SEQ ID NO: 1901931 - DNA, 21 bp, Homo sapiens
gcaggagggacagtctcacca

SEQ ID NO: 1901932 - DNA, 17 bp, Homo sapiens
gcaggcactgaagctgc

SEQ ID NO: 1901933 - DNA, 19 bp, Homo sapiens
gcaggccaggggaggggtg

SEQ ID NO: 1901934 - DNA, 17 bp, Homo sapiens
gcaggccctgggcctcc

SEQ ID NO: 1901935 - DNA, 19 bp, Homo sapiens
gcaggccctgggcctccac

SEQ ID NO: 1901936 - DNA, 22 bp, Homo sapiens
gcaggcgcaagggaggcccagc

SEQ ID NO: 1901937 - DNA, 14 bp, Homo sapiens
gcaggctcctcagc

SEQ ID NO: 1901938 - DNA, 18 bp, Homo sapiens
gcaggctcctcagccctc

SEQ ID NO: 1901939 - DNA, 20 bp, Homo sapiens
gcaggctcctcagccctctc

SEQ ID NO: 1901940 - DNA, 21 bp, Homo sapiens
gcaggctcctcagccctctct

SEQ ID NO: 1901941 - DNA, 15 bp, Homo sapiens
gcagggacagggccg

SEQ ID NO: 1901942 - DNA, 19 bp, Homo sapiens
gcagggcacagaaggctgg

SEQ ID NO: 1901943 - DNA, 14 bp, Homo sapiens
gcagggcacagggc

SEQ ID NO: 1901944 - DNA, 22 bp, Homo sapiens
gcagggcacagggcctggccca

SEQ ID NO: 1901945 - DNA, 21 bp, Homo sapiens
gcagggcaggaccagcccacg

SEQ ID NO: 1901946 - DNA, 14 bp, Homo sapiens
gcagggcaggcccc

SEQ ID NO: 1901947 - DNA, 18 bp, Homo sapiens
gcagggccttctgcctgc

SEQ ID NO: 1901948 - DNA, 19 bp, Homo sapiens
gcagggccttctgcctgct

SEQ ID NO: 1901949 - DNA, 21 bp, Homo sapiens
gcagggccttctgcctgctga

SEQ ID NO: 1901950 - DNA, 13 bp, Homo sapiens
gcaggtgggatga

SEQ ID NO: 1901951 - DNA, 12 bp, Homo sapiens
gcagtatcatga

SEQ ID NO: 1901952 - DNA, 14 bp, Homo sapiens
gcagtcactttgac

SEQ ID NO: 1901953 - DNA, 14 bp, Homo sapiens
gcagtcgtcagcct

SEQ ID NO: 1901954 - DNA, 15 bp, Homo sapiens
gcagtcgtcagcctc

SEQ ID NO: 1901955 - DNA, 17 bp, Homo sapiens
gcagtcgtcagcctccc

SEQ ID NO: 1901956 - DNA, 20 bp, Homo sapiens
gcagtcgtcagcctccctga

SEQ ID NO: 1901957 - DNA, 16 bp, Homo sapiens
gcagtgatgtttgcca

SEQ ID NO: 1901958 - DNA, 23 bp, Homo sapiens
gcagtgatgtttgccatttgctg

SEQ ID NO: 1901959 - DNA, 16 bp, Homo sapiens
gcagtggctgtgaagg

SEQ ID NO: 1901960 - DNA, 14 bp, Homo sapiens
gcagtgtgtaaagt

SEQ ID NO: 1901961 - DNA, 17 bp, Homo sapiens
gcagttcccctggaagc

SEQ ID NO: 1901962 - DNA, 18 bp, Homo sapiens
gcagttcgaccagccagg

SEQ ID NO: 1901963 - DNA, 18 bp, Homo sapiens
gcagttgctggtaaaatg

SEQ ID NO: 1901964 - DNA, 19 bp, Homo sapiens
gcagttgctggtaaaatga

SEQ ID NO: 1901965 - DNA, 16 bp, Homo sapiens
gcataactaggattat

SEQ ID NO: 1901966 - DNA, 15 bp, Homo sapiens
gcatataacttatat

SEQ ID NO: 1901967 - DNA, 23 bp, Homo sapiens
gcatataacttatattgtaagaa

SEQ ID NO: 1901968 - DNA, 14 bp, Homo sapiens
gcatccccttccag

SEQ ID NO: 1901969 - DNA, 21 bp, Homo sapiens
gcatctcacagctatgcaaaa

SEQ ID NO: 1901970 - DNA, 12 bp, Homo sapiens
gcatctctctgg

SEQ ID NO: 1901971 - DNA, 15 bp, Homo sapiens
gcatctctgaccaga

SEQ ID NO: 1901972 - DNA, 20 bp, Homo sapiens
gcatctgacctctaccttca

SEQ ID NO: 1901973 - DNA, 15 bp, Homo sapiens
gcatctttgatgtgt

SEQ ID NO: 1901974 - DNA, 13 bp, Homo sapiens
gcatgaggccccg

SEQ ID NO: 1901975 - DNA, 20 bp, Homo sapiens
gcatgcaaacttggatcaga

SEQ ID NO: 1901976 - DNA, 18 bp, Homo sapiens
gcatgggtcagggtgtga

SEQ ID NO: 1901977 - DNA, 22 bp, Homo sapiens
gcatggtggttgggacccagtg

SEQ ID NO: 1901978 - DNA, 15 bp, Homo sapiens
gcatgttggactctg

SEQ ID NO: 1901979 - DNA, 14 bp, Homo sapiens
gcattaaaagaaaa

SEQ ID NO: 1901980 - DNA, 14 bp, Homo sapiens
gcattcttctgatc

SEQ ID NO: 1901981 - DNA, 22 bp, Homo sapiens
gcattgtaagcgtatggcttta

SEQ ID NO: 1901982 - DNA, 11 bp, Homo sapiens
gcattgtctgt

SEQ ID NO: 1901983 - DNA, 19 bp, Homo sapiens
gcatttagggagtattcta

SEQ ID NO: 1901984 - DNA, 16 bp, Homo sapiens
gcatttggcttcctct

SEQ ID NO: 1901985 - DNA, 23 bp, Homo sapiens
gcatttggcttcctctgctgcat

SEQ ID NO: 1901986 - DNA, 15 bp, Homo sapiens
gcatttgtgtgttac

SEQ ID NO: 1901987 - DNA, 20 bp, Homo sapiens
gcattttcccccttggctct

SEQ ID NO: 1901988 - DNA, 13 bp, Homo sapiens
gccaaacacacag

SEQ ID NO: 1901989 - DNA, 14 bp, Homo sapiens
gccaagagtggccc

SEQ ID NO: 1901990 - DNA, 12 bp, Homo sapiens
gccaagcaggca

SEQ ID NO: 1901991 - DNA, 22 bp, Homo sapiens
gccaagggggacctcgggctgt

SEQ ID NO: 1901992 - DNA, 15 bp, Homo sapiens
gccaatcagaagcta

SEQ ID NO: 1901993 - DNA, 13 bp, Homo sapiens
gccaatgggctag

SEQ ID NO: 1901994 - DNA, 15 bp, Homo sapiens
gccaatgggctagag

SEQ ID NO: 1901995 - DNA, 17 bp, Homo sapiens
gccacaaggaagaaatt

SEQ ID NO: 1901996 - DNA, 23 bp, Homo sapiens
gccacaaggaagaaattaactta

SEQ ID NO: 1901997 - DNA, 16 bp, Homo sapiens
gccacagcaaggctgt

SEQ ID NO: 1901998 - DNA, 15 bp, Homo sapiens
gccaccagcgccccc

SEQ ID NO: 1901999 - DNA, 16 bp, Homo sapiens
gccaccctttctggca

SEQ ID NO: 1902000 - DNA, 18 bp, Homo sapiens
gccacctccccttgccag

SEQ ID NO: 1902001 - DNA, 21 bp, Homo sapiens
gccacctccccttgccagctg

SEQ ID NO: 1902002 - DNA, 22 bp, Homo sapiens
gccacctccccttgccagctgc

SEQ ID NO: 1902003 - DNA, 24 bp, Homo sapiens
gccacctccccttgccagctgctg

SEQ ID NO: 1902004 - DNA, 21 bp, Homo sapiens
gccacctcctaaaaggcccag

SEQ ID NO: 1902005 - DNA, 15 bp, Homo sapiens
gccacctcttcctgg

SEQ ID NO: 1902006 - DNA, 12 bp, Homo sapiens
gccacctgcaca

SEQ ID NO: 1902007 - DNA, 15 bp, Homo sapiens
gccactgtccgctgt

SEQ ID NO: 1902008 - DNA, 18 bp, Homo sapiens
gccactgtccgctgtctc

SEQ ID NO: 1902009 - DNA, 23 bp, Homo sapiens
gccactgtccgctgtctccctcc

SEQ ID NO: 1902010 - DNA, 22 bp, Homo sapiens
gccagacgctcattcagcatct

SEQ ID NO: 1902011 - DNA, 13 bp, Homo sapiens
gccagcagccttc

SEQ ID NO: 1902012 - DNA, 15 bp, Homo sapiens
gccagcagccttcca

SEQ ID NO: 1902013 - DNA, 18 bp, Homo sapiens
gccagcggccctcccagg

SEQ ID NO: 1902014 - DNA, 19 bp, Homo sapiens
gccagcggccctcccaggc

SEQ ID NO: 1902015 - DNA, 13 bp, Homo sapiens
gccagctcttcct

SEQ ID NO: 1902016 - DNA, 17 bp, Homo sapiens
gccagctcttcctagct

SEQ ID NO: 1902017 - DNA, 21 bp, Homo sapiens
gccagctcttcctagctggag

SEQ ID NO: 1902018 - DNA, 16 bp, Homo sapiens
gccagctgctgagccg

SEQ ID NO: 1902019 - DNA, 19 bp, Homo sapiens
gccagctgctgagccgcag

SEQ ID NO: 1902020 - DNA, 22 bp, Homo sapiens
gccagctgctgagccgcagaga

SEQ ID NO: 1902021 - DNA, 19 bp, Homo sapiens
gccaggaagtagcacaggc

SEQ ID NO: 1902022 - DNA, 15 bp, Homo sapiens
gccaggcacaggcag

SEQ ID NO: 1902023 - DNA, 19 bp, Homo sapiens
gccaggcacaggcagggca

SEQ ID NO: 1902024 - DNA, 20 bp, Homo sapiens
gccaggcacaggcagggcag

SEQ ID NO: 1902025 - DNA, 22 bp, Homo sapiens
gccaggcccggcatgaggcccc

SEQ ID NO: 1902026 - DNA, 13 bp, Homo sapiens
gccaggctgctct

SEQ ID NO: 1902027 - DNA, 19 bp, Homo sapiens
gccagggaaagactggcaa

SEQ ID NO: 1902028 - DNA, 18 bp, Homo sapiens
gccagggaggagccccag

SEQ ID NO: 1902029 - DNA, 15 bp, Homo sapiens
gccagggatggcagt

SEQ ID NO: 1902030 - DNA, 16 bp, Homo sapiens
gccagggatggcagtg

SEQ ID NO: 1902031 - DNA, 19 bp, Homo sapiens
gccagttgtggcaaccctg

SEQ ID NO: 1902032 - DNA, 20 bp, Homo sapiens
gccagttttgtttcctttca

SEQ ID NO: 1902033 - DNA, 17 bp, Homo sapiens
gccatagagtacactgc

SEQ ID NO: 1902034 - DNA, 19 bp, Homo sapiens
gccatagagtacactgcct

SEQ ID NO: 1902035 - DNA, 18 bp, Homo sapiens
gccatttaggcaaataag

SEQ ID NO: 1902036 - DNA, 15 bp, Homo sapiens
gcccacttccctggg

SEQ ID NO: 1902037 - DNA, 16 bp, Homo sapiens
gcccacttccctgggt

SEQ ID NO: 1902038 - DNA, 13 bp, Homo sapiens
gcccagaatactg

SEQ ID NO: 1902039 - DNA, 19 bp, Homo sapiens
gcccagagagaagagcccc

SEQ ID NO: 1902040 - DNA, 21 bp, Homo sapiens
gcccagagagaagagccccac

SEQ ID NO: 1902041 - DNA, 22 bp, Homo sapiens
gcccagagagaagagccccact

SEQ ID NO: 1902042 - DNA, 22 bp, Homo sapiens
gcccagcagacatcaagctcaa

SEQ ID NO: 1902043 - DNA, 17 bp, Homo sapiens
gcccagcgcggacatcc

SEQ ID NO: 1902044 - DNA, 10 bp, Homo sapiens
gcccagctgt

SEQ ID NO: 1902045 - DNA, 24 bp, Homo sapiens
gcccagctgtgctgggaggtccca

SEQ ID NO: 1902046 - DNA, 16 bp, Homo sapiens
gcccagcttccatgct

SEQ ID NO: 1902047 - DNA, 16 bp, Homo sapiens
gcccaggatatatttt

SEQ ID NO: 1902048 - DNA, 18 bp, Homo sapiens
gcccaggatatattttat

SEQ ID NO: 1902049 - DNA, 22 bp, Homo sapiens
gcccaggcagagagcgaccagc

SEQ ID NO: 1902050 - DNA, 15 bp, Homo sapiens
gcccaggctggagtg

SEQ ID NO: 1902051 - DNA, 19 bp, Homo sapiens
gcccaggctggagtgcagt

SEQ ID NO: 1902052 - DNA, 20 bp, Homo sapiens
gcccagggggcttcctgagg

SEQ ID NO: 1902053 - DNA, 16 bp, Homo sapiens
gcccagtcccagcagc

SEQ ID NO: 1902054 - DNA, 17 bp, Homo sapiens
gcccagtcccagcagcc

SEQ ID NO: 1902055 - DNA, 22 bp, Homo sapiens
gcccatcaggggcaggaaccag

SEQ ID NO: 1902056 - DNA, 16 bp, Homo sapiens
gcccatttggagggcc

SEQ ID NO: 1902057 - DNA, 20 bp, Homo sapiens
gcccatttggagggcctggg

SEQ ID NO: 1902058 - DNA, 19 bp, Homo sapiens
gccccactctcagaggccc

SEQ ID NO: 1902059 - DNA, 13 bp, Homo sapiens
gcccccactcctc

SEQ ID NO: 1902060 - DNA, 14 bp, Homo sapiens
gcccccactcctcc

SEQ ID NO: 1902061 - DNA, 18 bp, Homo sapiens
gcccccagcttccagcag

SEQ ID NO: 1902062 - DNA, 15 bp, Homo sapiens
gccccctcccctcct

SEQ ID NO: 1902063 - DNA, 15 bp, Homo sapiens
gccccgtccccccat

SEQ ID NO: 1902064 - DNA, 17 bp, Homo sapiens
gccccgtccccccatcc

SEQ ID NO: 1902065 - DNA, 11 bp, Homo sapiens
gcccctgagcc

SEQ ID NO: 1902066 - DNA, 15 bp, Homo sapiens
gcccctgagcccact

SEQ ID NO: 1902067 - DNA, 14 bp, Homo sapiens
gcccctgattcact

SEQ ID NO: 1902068 - DNA, 12 bp, Homo sapiens
gcccctggcaaa

SEQ ID NO: 1902069 - DNA, 13 bp, Homo sapiens
gcccctggcaaat

SEQ ID NO: 1902070 - DNA, 19 bp, Homo sapiens
gccccttgggcctcccact

SEQ ID NO: 1902071 - DNA, 20 bp, Homo sapiens
gccccttgggcctcccactc

SEQ ID NO: 1902072 - DNA, 16 bp, Homo sapiens
gcccggcatgaggccc

SEQ ID NO: 1902073 - DNA, 17 bp, Homo sapiens
gcccggcatgaggcccc

SEQ ID NO: 1902074 - DNA, 14 bp, Homo sapiens
gcccgggcccaggc

SEQ ID NO: 1902075 - DNA, 21 bp, Homo sapiens
gcccgggcccaggcagagagc

SEQ ID NO: 1902076 - DNA, 22 bp, Homo sapiens
gccctagaagatcacagcaggg

SEQ ID NO: 1902077 - DNA, 19 bp, Homo sapiens
gccctcagtcggggcaggc

SEQ ID NO: 1902078 - DNA, 23 bp, Homo sapiens
gccctccagtaccttctgccaga

SEQ ID NO: 1902079 - DNA, 19 bp, Homo sapiens
gccctccgccccgtccccc

SEQ ID NO: 1902080 - DNA, 12 bp, Homo sapiens
gccctctcttgc

SEQ ID NO: 1902081 - DNA, 14 bp, Homo sapiens
gccctctcttgcca

SEQ ID NO: 1902082 - DNA, 17 bp, Homo sapiens
gccctgcctctccgccc

SEQ ID NO: 1902083 - DNA, 17 bp, Homo sapiens
gccctggcccccacatg

SEQ ID NO: 1902084 - DNA, 11 bp, Homo sapiens
gccctgggcct

SEQ ID NO: 1902085 - DNA, 22 bp, Homo sapiens
gccctgggcctccacctctgtg

SEQ ID NO: 1902086 - DNA, 23 bp, Homo sapiens
gccctgggcctccacctctgtgc

SEQ ID NO: 1902087 - DNA, 15 bp, Homo sapiens
gccgcatctcacagc

SEQ ID NO: 1902088 - DNA, 18 bp, Homo sapiens
gccgcatctcacagctat

SEQ ID NO: 1902089 - DNA, 20 bp, Homo sapiens
gccgccgctaggtagagtct

SEQ ID NO: 1902090 - DNA, 15 bp, Homo sapiens
gccggaaagagagct

SEQ ID NO: 1902091 - DNA, 18 bp, Homo sapiens
gccggaaagagagctgga

SEQ ID NO: 1902092 - DNA, 19 bp, Homo sapiens
gccggcaataaaagcccag

SEQ ID NO: 1902093 - DNA, 17 bp, Homo sapiens
gccgtaggacccagttt

SEQ ID NO: 1902094 - DNA, 16 bp, Homo sapiens
gcctaaaagtaaacat

SEQ ID NO: 1902095 - DNA, 16 bp, Homo sapiens
gcctaggcttggctcc

SEQ ID NO: 1902096 - DNA, 17 bp, Homo sapiens
gcctcacgaaactggaa

SEQ ID NO: 1902097 - DNA, 17 bp, Homo sapiens
gcctcagcttccccagt

SEQ ID NO: 1902098 - DNA, 17 bp, Homo sapiens
gcctccaacccctcgcc

SEQ ID NO: 1902099 - DNA, 14 bp, Homo sapiens
gcctccacctctgt

SEQ ID NO: 1902100 - DNA, 23 bp, Homo sapiens
gcctccacctctgtgcagggcac

SEQ ID NO: 1902101 - DNA, 14 bp, Homo sapiens
gcctcccacagtgc

SEQ ID NO: 1902102 - DNA, 17 bp, Homo sapiens
gcctccccttcccagac

SEQ ID NO: 1902103 - DNA, 18 bp, Homo sapiens
gcctccctgacgtctgcc

SEQ ID NO: 1902104 - DNA, 14 bp, Homo sapiens
gcctcctcctgccc

SEQ ID NO: 1902105 - DNA, 16 bp, Homo sapiens
gcctcctcctgccctc

SEQ ID NO: 1902106 - DNA, 22 bp, Homo sapiens
gcctcctcctgccctccgcccc

SEQ ID NO: 1902107 - DNA, 16 bp, Homo sapiens
gcctctccccaccttc

SEQ ID NO: 1902108 - DNA, 19 bp, Homo sapiens
gcctctccgcccctgagcc

SEQ ID NO: 1902109 - DNA, 21 bp, Homo sapiens
gcctctccgcccctgagccca

SEQ ID NO: 1902110 - DNA, 24 bp, Homo sapiens
gcctctccgcccctgagcccactg

SEQ ID NO: 1902111 - DNA, 17 bp, Homo sapiens
gcctctgatctgtgcag

SEQ ID NO: 1902112 - DNA, 15 bp, Homo sapiens
gcctctgccacagca

SEQ ID NO: 1902113 - DNA, 20 bp, Homo sapiens
gcctctgccacagcaaggct

SEQ ID NO: 1902114 - DNA, 19 bp, Homo sapiens
gcctctggctctacacata

SEQ ID NO: 1902115 - DNA, 21 bp, Homo sapiens
gcctcttctcctgcagcctga

SEQ ID NO: 1902116 - DNA, 17 bp, Homo sapiens
gcctgaagagtttgtaa

SEQ ID NO: 1902117 - DNA, 18 bp, Homo sapiens
gcctgaagagtttgtaaa

SEQ ID NO: 1902118 - DNA, 19 bp, Homo sapiens
gcctgagggaggaggcagg

SEQ ID NO: 1902119 - DNA, 22 bp, Homo sapiens
gcctgagtgagaggggaggcca

SEQ ID NO: 1902120 - DNA, 19 bp, Homo sapiens
gcctgcacttgggggctca

SEQ ID NO: 1902121 - DNA, 13 bp, Homo sapiens
gcctgcctctgcc

SEQ ID NO: 1902122 - DNA, 15 bp, Homo sapiens
gcctgcctctgccac

SEQ ID NO: 1902123 - DNA, 20 bp, Homo sapiens
gcctgccttaagtgaggaaa

SEQ ID NO: 1902124 - DNA, 17 bp, Homo sapiens
gcctgcggggcagcagg

SEQ ID NO: 1902125 - DNA, 21 bp, Homo sapiens
gcctgctacttgagggccagg

SEQ ID NO: 1902126 - DNA, 22 bp, Homo sapiens
gcctggcccatgtatggccagg

SEQ ID NO: 1902127 - DNA, 22 bp, Homo sapiens
gcctggctccctcactctcagg

SEQ ID NO: 1902128 - DNA, 23 bp, Homo sapiens
gcctggctccctcactctcagga

SEQ ID NO: 1902129 - DNA, 15 bp, Homo sapiens
gcctgggcaataaag

SEQ ID NO: 1902130 - DNA, 17 bp, Homo sapiens
gcctgggcctggctccc

SEQ ID NO: 1902131 - DNA, 22 bp, Homo sapiens
gcctgtaaatgtattcattctt

SEQ ID NO: 1902132 - DNA, 18 bp, Homo sapiens
gccttagcatgtgttgca

SEQ ID NO: 1902133 - DNA, 19 bp, Homo sapiens
gccttccagtggcttctcc

SEQ ID NO: 1902134 - DNA, 16 bp, Homo sapiens
gccttctgcctgctga

SEQ ID NO: 1902135 - DNA, 20 bp, Homo sapiens
gccttgattcccttgttatt

SEQ ID NO: 1902136 - DNA, 15 bp, Homo sapiens
gccttggggacaacc

SEQ ID NO: 1902137 - DNA, 16 bp, Homo sapiens
gcctttgcagctcaga

SEQ ID NO: 1902138 - DNA, 21 bp, Homo sapiens
gcgaccagcaggctcctcagc

SEQ ID NO: 1902139 - DNA, 15 bp, Homo sapiens
gcgagagtccctgca

SEQ ID NO: 1902140 - DNA, 12 bp, Homo sapiens
gcgagcagggca

SEQ ID NO: 1902141 - DNA, 17 bp, Homo sapiens
gcgagcagggcaggccc

SEQ ID NO: 1902142 - DNA, 19 bp, Homo sapiens
gcgcaagggaggcccagcg

SEQ ID NO: 1902143 - DNA, 12 bp, Homo sapiens
gcgcccccactc

SEQ ID NO: 1902144 - DNA, 13 bp, Homo sapiens
gcgcccccactcc

SEQ ID NO: 1902145 - DNA, 16 bp, Homo sapiens
gcgcccccactcctcc

SEQ ID NO: 1902146 - DNA, 19 bp, Homo sapiens
gcgcccccactcctcctcc

SEQ ID NO: 1902147 - DNA, 20 bp, Homo sapiens
ggaagaaggacttgtttccc

SEQ ID NO: 1902148 - DNA, 19 bp, Homo sapiens
ggaagaatttactttggaa

SEQ ID NO: 1902149 - DNA, 15 bp, Homo sapiens
ggaagagaagagaaa

SEQ ID NO: 1902150 - DNA, 16 bp, Homo sapiens
ggaagagaagagaaag

SEQ ID NO: 1902151 - DNA, 20 bp, Homo sapiens
ggaagagaagagaaaggaca

SEQ ID NO: 1902152 - DNA, 18 bp, Homo sapiens
ggaagcagtgcccaggtg

SEQ ID NO: 1902153 - DNA, 16 bp, Homo sapiens
ggaagctgaggcccat

SEQ ID NO: 1902154 - DNA, 21 bp, Homo sapiens
ggaagctgaggcccatggcca

SEQ ID NO: 1902155 - DNA, 22 bp, Homo sapiens
ggaagctgaggcccatggccac

SEQ ID NO: 1902156 - DNA, 12 bp, Homo sapiens
ggaaggcaattt

SEQ ID NO: 1902157 - DNA, 14 bp, Homo sapiens
ggaagtagcacagg

SEQ ID NO: 1902158 - DNA, 17 bp, Homo sapiens
ggaagtagcacaggctg

SEQ ID NO: 1902159 - DNA, 21 bp, Homo sapiens
ggaatggaaaaagcagaaggc

SEQ ID NO: 1902160 - DNA, 23 bp, Homo sapiens
ggacactgtggcagcaggaggga

SEQ ID NO: 1902161 - DNA, 15 bp, Homo sapiens
ggacagcctgcctct

SEQ ID NO: 1902162 - DNA, 19 bp, Homo sapiens
ggacagcctgcctctgcca

SEQ ID NO: 1902163 - DNA, 18 bp, Homo sapiens
ggaccacaggtgcccgcc

SEQ ID NO: 1902164 - DNA, 13 bp, Homo sapiens
ggaccagcccacg

SEQ ID NO: 1902165 - DNA, 17 bp, Homo sapiens
ggaccagcttggctcag

SEQ ID NO: 1902166 - DNA, 18 bp, Homo sapiens
ggaccagcttggctcagg

SEQ ID NO: 1902167 - DNA, 18 bp, Homo sapiens
ggacccagtggcagggca

SEQ ID NO: 1902168 - DNA, 12 bp, Homo sapiens
ggaccccagcct

SEQ ID NO: 1902169 - DNA, 13 bp, Homo sapiens
ggaccccagcctc

SEQ ID NO: 1902170 - DNA, 14 bp, Homo sapiens
ggaccccagcctca

SEQ ID NO: 1902171 - DNA, 18 bp, Homo sapiens
ggaccccatctgtgaata

SEQ ID NO: 1902172 - DNA, 20 bp, Homo sapiens
ggaccccatctgtgaataag

SEQ ID NO: 1902173 - DNA, 22 bp, Homo sapiens
ggaccctagctatatgcatttt

SEQ ID NO: 1902174 - DNA, 20 bp, Homo sapiens
ggaccctgccaggcacaggc

SEQ ID NO: 1902175 - DNA, 24 bp, Homo sapiens
ggaccctgccaggcacaggcaggg

SEQ ID NO: 1902176 - DNA, 21 bp, Homo sapiens
ggactcagcagatgcgtagca

SEQ ID NO: 1902177 - DNA, 22 bp, Homo sapiens
ggactctgtctggccagggagg

SEQ ID NO: 1902178 - DNA, 15 bp, Homo sapiens
ggactgccacctccc

SEQ ID NO: 1902179 - DNA, 23 bp, Homo sapiens
ggactgccacctccccttgccag

SEQ ID NO: 1902180 - DNA, 13 bp, Homo sapiens
ggactgctgtgaa

SEQ ID NO: 1902181 - DNA, 13 bp, Homo sapiens
ggagaatcacagg

SEQ ID NO: 1902182 - DNA, 15 bp, Homo sapiens
ggagaatcacaggct

SEQ ID NO: 1902183 - DNA, 18 bp, Homo sapiens
ggagaatcacaggctggg

SEQ ID NO: 1902184 - DNA, 20 bp, Homo sapiens
ggagaatgcaccatactcat

SEQ ID NO: 1902185 - DNA, 20 bp, Homo sapiens
ggagactgctcctgagcccc

SEQ ID NO: 1902186 - DNA, 21 bp, Homo sapiens
ggagactgctcctgagccccc

SEQ ID NO: 1902187 - DNA, 19 bp, Homo sapiens
ggagactttgatgtcagca

SEQ ID NO: 1902188 - DNA, 21 bp, Homo sapiens
ggagactttgatgtcagcagt

SEQ ID NO: 1902189 - DNA, 18 bp, Homo sapiens
ggagatccttgtgtttat

SEQ ID NO: 1902190 - DNA, 16 bp, Homo sapiens
ggagattgtggggaga

SEQ ID NO: 1902191 - DNA, 16 bp, Homo sapiens
ggagcagaaggcagga

SEQ ID NO: 1902192 - DNA, 20 bp, Homo sapiens
ggagcagaaggcaggaccat

SEQ ID NO: 1902193 - DNA, 18 bp, Homo sapiens
ggagcccatttggagggc

SEQ ID NO: 1902194 - DNA, 22 bp, Homo sapiens
ggagcccatttggagggcctgg

SEQ ID NO: 1902195 - DNA, 19 bp, Homo sapiens
ggagccctgggccagggcg

SEQ ID NO: 1902196 - DNA, 22 bp, Homo sapiens
ggagcctgcggggcagcagggg

SEQ ID NO: 1902197 - DNA, 20 bp, Homo sapiens
ggagctcactgtggtgtctg

SEQ ID NO: 1902198 - DNA, 21 bp, Homo sapiens
ggaggaagaactgaaaggctt

SEQ ID NO: 1902199 - DNA, 13 bp, Homo sapiens
ggaggagccccag

SEQ ID NO: 1902200 - DNA, 22 bp, Homo sapiens
ggaggagtggattcctccccac

SEQ ID NO: 1902201 - DNA, 23 bp, Homo sapiens
ggaggagtggattcctccccacc

SEQ ID NO: 1902202 - DNA, 13 bp, Homo sapiens
ggaggcagagagg

SEQ ID NO: 1902203 - DNA, 16 bp, Homo sapiens
ggaggcaggaggagca

SEQ ID NO: 1902204 - DNA, 13 bp, Homo sapiens
ggaggccacctcc

SEQ ID NO: 1902205 - DNA, 18 bp, Homo sapiens
ggaggccacctcctaaaa

SEQ ID NO: 1902206 - DNA, 20 bp, Homo sapiens
ggaggcggagcttgcagtga

SEQ ID NO: 1902207 - DNA, 20 bp, Homo sapiens
ggagggactctgtctggcca

SEQ ID NO: 1902208 - DNA, 12 bp, Homo sapiens
ggaggggccaga

SEQ ID NO: 1902209 - DNA, 14 bp, Homo sapiens
ggaggtcccagggc

SEQ ID NO: 1902210 - DNA, 16 bp, Homo sapiens
ggaggtcccagggccc

SEQ ID NO: 1902211 - DNA, 21 bp, Homo sapiens
ggagtgagtgaaactcccacc

SEQ ID NO: 1902212 - DNA, 23 bp, Homo sapiens
ggagtggattcctccccaccctg

SEQ ID NO: 1902213 - DNA, 18 bp, Homo sapiens
ggataaacattccagaga

SEQ ID NO: 1902214 - DNA, 22 bp, Homo sapiens
ggatatccatgagctgcactga

SEQ ID NO: 1902215 - DNA, 16 bp, Homo sapiens
ggatatgggctaccag

SEQ ID NO: 1902216 - DNA, 13 bp, Homo sapiens
ggatattttctta

SEQ ID NO: 1902217 - DNA, 18 bp, Homo sapiens
ggatcaggctcccaggag

SEQ ID NO: 1902218 - DNA, 20 bp, Homo sapiens
ggatcctgcactgactctgg

SEQ ID NO: 1902219 - DNA, 20 bp, Homo sapiens
ggatgagggagacagaccac

SEQ ID NO: 1902220 - DNA, 15 bp, Homo sapiens
ggatgattgaagaaa

SEQ ID NO: 1902221 - DNA, 19 bp, Homo sapiens
ggatgccaagaagtttaag

SEQ ID NO: 1902222 - DNA, 18 bp, Homo sapiens
ggatgctcccccagggaa

SEQ ID NO: 1902223 - DNA, 21 bp, Homo sapiens
ggatggcagtggctgtgaagg

SEQ ID NO: 1902224 - DNA, 12 bp, Homo sapiens
ggattcctcccc

SEQ ID NO: 1902225 - DNA, 17 bp, Homo sapiens
ggattcctccccaccct

SEQ ID NO: 1902226 - DNA, 18 bp, Homo sapiens
ggcaaatgcacacacctc

SEQ ID NO: 1902227 - DNA, 15 bp, Homo sapiens
ggcaagaaccagttg

SEQ ID NO: 1902228 - DNA, 17 bp, Homo sapiens
ggcaagaaggcattttt

SEQ ID NO: 1902229 - DNA, 16 bp, Homo sapiens
ggcaataaaagcccag

SEQ ID NO: 1902230 - DNA, 22 bp, Homo sapiens
ggcaataaaagcccaggagccc

SEQ ID NO: 1902231 - DNA, 17 bp, Homo sapiens
ggcaataaattttgaaa

SEQ ID NO: 1902232 - DNA, 19 bp, Homo sapiens
ggcaataaattttgaaaag

SEQ ID NO: 1902233 - DNA, 16 bp, Homo sapiens
ggcaatggtagtttct

SEQ ID NO: 1902234 - DNA, 13 bp, Homo sapiens
ggcacagcctgca

SEQ ID NO: 1902235 - DNA, 13 bp, Homo sapiens
ggcacaggcaggg

SEQ ID NO: 1902236 - DNA, 12 bp, Homo sapiens
ggcacagggcct

SEQ ID NO: 1902237 - DNA, 17 bp, Homo sapiens
ggcacagtaccatataa

SEQ ID NO: 1902238 - DNA, 11 bp, Homo sapiens
ggcactgctct

SEQ ID NO: 1902239 - DNA, 16 bp, Homo sapiens
ggcagagagggtcact

SEQ ID NO: 1902240 - DNA, 15 bp, Homo sapiens
ggcagaggtggtctg

SEQ ID NO: 1902241 - DNA, 13 bp, Homo sapiens
ggcagcaggaggg

SEQ ID NO: 1902242 - DNA, 16 bp, Homo sapiens
ggcagcaggagggact

SEQ ID NO: 1902243 - DNA, 17 bp, Homo sapiens
ggcagcccgcatcagct

SEQ ID NO: 1902244 - DNA, 14 bp, Homo sapiens
ggcagcctgagagt

SEQ ID NO: 1902245 - DNA, 14 bp, Homo sapiens
ggcagcgaggctgg

SEQ ID NO: 1902246 - DNA, 19 bp, Homo sapiens
ggcaggacactgcagaaca

SEQ ID NO: 1902247 - DNA, 14 bp, Homo sapiens
ggcaggaccagccc

SEQ ID NO: 1902248 - DNA, 15 bp, Homo sapiens
ggcagggcacagggc

SEQ ID NO: 1902249 - DNA, 22 bp, Homo sapiens
ggcagggcacagggcctggccc

SEQ ID NO: 1902250 - DNA, 13 bp, Homo sapiens
ggcatgaggcccc

SEQ ID NO: 1902251 - DNA, 22 bp, Homo sapiens
ggcatgttggactctgagctca

SEQ ID NO: 1902252 - DNA, 14 bp, Homo sapiens
ggcatttggcttcc

SEQ ID NO: 1902253 - DNA, 16 bp, Homo sapiens
ggcatttggcttcctc

SEQ ID NO: 1902254 - DNA, 20 bp, Homo sapiens
ggcatttggcttcctctgct

SEQ ID NO: 1902255 - DNA, 23 bp, Homo sapiens
ggcatttggcttcctctgctgca

SEQ ID NO: 1902256 - DNA, 14 bp, Homo sapiens
ggccacagttgttt

SEQ ID NO: 1902257 - DNA, 11 bp, Homo sapiens
ggccacctcct

SEQ ID NO: 1902258 - DNA, 22 bp, Homo sapiens
ggccacctcctaaaaggcccag

SEQ ID NO: 1902259 - DNA, 20 bp, Homo sapiens
ggccacctcttcctggccgg

SEQ ID NO: 1902260 - DNA, 22 bp, Homo sapiens
ggccacctcttcctggccggtg

SEQ ID NO: 1902261 - DNA, 17 bp, Homo sapiens
ggccagcagccttccag

SEQ ID NO: 1902262 - DNA, 15 bp, Homo sapiens
ggccagcggccctcc

SEQ ID NO: 1902263 - DNA, 17 bp, Homo sapiens
ggccagcggccctccca

SEQ ID NO: 1902264 - DNA, 19 bp, Homo sapiens
ggccagcggccctcccagg

SEQ ID NO: 1902265 - DNA, 21 bp, Homo sapiens
ggccaggaagtagcacaggct

SEQ ID NO: 1902266 - DNA, 23 bp, Homo sapiens
ggccaggaagtagcacaggctga

SEQ ID NO: 1902267 - DNA, 22 bp, Homo sapiens
ggcccaagagtctggggaccag

SEQ ID NO: 1902268 - DNA, 21 bp, Homo sapiens
ggcccaccctgcttggcccag

SEQ ID NO: 1902269 - DNA, 22 bp, Homo sapiens
ggcccactgtgcagtggagcag

SEQ ID NO: 1902270 - DNA, 23 bp, Homo sapiens
ggcccagagagaagagccccact

SEQ ID NO: 1902271 - DNA, 14 bp, Homo sapiens
ggcccatcaggggc

SEQ ID NO: 1902272 - DNA, 15 bp, Homo sapiens
ggcccatggccacat

SEQ ID NO: 1902273 - DNA, 15 bp, Homo sapiens
ggccccacctggccc

SEQ ID NO: 1902274 - DNA, 18 bp, Homo sapiens
ggccccgtctcaggtctg

SEQ ID NO: 1902275 - DNA, 17 bp, Homo sapiens
ggcccggcatgaggccc

SEQ ID NO: 1902276 - DNA, 22 bp, Homo sapiens
ggccctagaagatcacagcagg

SEQ ID NO: 1902277 - DNA, 14 bp, Homo sapiens
ggccctcccaggcg

SEQ ID NO: 1902278 - DNA, 21 bp, Homo sapiens
ggccctctctgaaggaggcca

SEQ ID NO: 1902279 - DNA, 23 bp, Homo sapiens
ggccctctctgaaggaggccacc

SEQ ID NO: 1902280 - DNA, 12 bp, Homo sapiens
ggccctggagct

SEQ ID NO: 1902281 - DNA, 15 bp, Homo sapiens
ggccctgggcctcca

SEQ ID NO: 1902282 - DNA, 18 bp, Homo sapiens
ggccctgggcctccacct

SEQ ID NO: 1902283 - DNA, 12 bp, Homo sapiens
gcgccctggccc

SEQ ID NO: 1902284 - DNA, 21 bp, Homo sapiens
gcgcggacatcccctgctggc

SEQ ID NO: 1902285 - DNA, 21 bp, Homo sapiens
gcggatttctctttctctctc

SEQ ID NO: 1902286 - DNA, 12 bp, Homo sapiens
gcgggtctgtca

SEQ ID NO: 1902287 - DNA, 14 bp, Homo sapiens
gcggtccagaagga

SEQ ID NO: 1902288 - DNA, 22 bp, Homo sapiens
gcggtccagaaggagcaggccc

SEQ ID NO: 1902289 - DNA, 18 bp, Homo sapiens
gcgtattttgtatttaaa

SEQ ID NO: 1902290 - DNA, 13 bp, Homo sapiens
gcgtggggctccc

SEQ ID NO: 1902291 - DNA, 16 bp, Homo sapiens
gctaaggccaatgggc

SEQ ID NO: 1902292 - DNA, 21 bp, Homo sapiens
gctaaggccaatgggctagag

SEQ ID NO: 1902293 - DNA, 17 bp, Homo sapiens
gctaatcttgtgaaaat

SEQ ID NO: 1902294 - DNA, 21 bp, Homo sapiens
gctacatttccgccacatccc

SEQ ID NO: 1902295 - DNA, 22 bp, Homo sapiens
gctactatgatttaatttgaaa

SEQ ID NO: 1902296 - DNA, 22 bp, Homo sapiens
gctacttgagggccaggatgct

SEQ ID NO: 1902297 - DNA, 15 bp, Homo sapiens
gctagcacaatgtgt

SEQ ID NO: 1902298 - DNA, 16 bp, Homo sapiens
gctagtcttaagaact

SEQ ID NO: 1902299 - DNA, 15 bp, Homo sapiens
gctagttgaatactt

SEQ ID NO: 1902300 - DNA, 18 bp, Homo sapiens
gctagttgaatacttgaa

SEQ ID NO: 1902301 - DNA, 19 bp, Homo sapiens
gctagttgaatacttgaac

SEQ ID NO: 1902302 - DNA, 23 bp, Homo sapiens
gctatagctttagccgtgtcacg

SEQ ID NO: 1902303 - DNA, 18 bp, Homo sapiens
gctatgatgttagttttc

SEQ ID NO: 1902304 - DNA, 16 bp, Homo sapiens
gctcaagccgtggccg

SEQ ID NO: 1902305 - DNA, 17 bp, Homo sapiens
gctcaagccgtggccgg

SEQ ID NO: 1902306 - DNA, 16 bp, Homo sapiens
gctcaaggcaatgggc

SEQ ID NO: 1902307 - DNA, 18 bp, Homo sapiens
gctcaaggcaatgggcta

SEQ ID NO: 1902308 - DNA, 12 bp, Homo sapiens
gctcaataaaag

SEQ ID NO: 1902309 - DNA, 18 bp, Homo sapiens
gctcactgtggtgtctgt

SEQ ID NO: 1902310 - DNA, 17 bp, Homo sapiens
gctcagcaaggccacct

SEQ ID NO: 1902311 - DNA, 18 bp, Homo sapiens
gctcattcagcatctgac

SEQ ID NO: 1902312 - DNA, 14 bp, Homo sapiens
gctccctcactctc

SEQ ID NO: 1902313 - DNA, 18 bp, Homo sapiens
gctccctcactctcagga

SEQ ID NO: 1902314 - DNA, 15 bp, Homo sapiens
gctccgtagcttcta

SEQ ID NO: 1902315 - DNA, 12 bp, Homo sapiens
gctccgtctgac

SEQ ID NO: 1902316 - DNA, 13 bp, Homo sapiens
gctcctcagccct

SEQ ID NO: 1902317 - DNA, 18 bp, Homo sapiens
gctcctcagccctctctt

SEQ ID NO: 1902318 - DNA, 21 bp, Homo sapiens
gctcctcagccctctcttgcc

SEQ ID NO: 1902319 - DNA, 19 bp, Homo sapiens
gctcctttctgatcttcac

SEQ ID NO: 1902320 - DNA, 15 bp, Homo sapiens
gctcgctctctcgta

SEQ ID NO: 1902321 - DNA, 23 bp, Homo sapiens
gctcggggctgggggctgcaggg

SEQ ID NO: 1902322 - DNA, 13 bp, Homo sapiens
gctcgtcctcact

SEQ ID NO: 1902323 - DNA, 14 bp, Homo sapiens
gctcgtcctcactg

SEQ ID NO: 1902324 - DNA, 15 bp, Homo sapiens
gctctccatactttg

SEQ ID NO: 1902325 - DNA, 20 bp, Homo sapiens
gctctcgaggcagcagtggg

SEQ ID NO: 1902326 - DNA, 20 bp, Homo sapiens
gctctctcgtactctctctc

SEQ ID NO: 1902327 - DNA, 21 bp, Homo sapiens
gctctgaattcaggtcccagt

SEQ ID NO: 1902328 - DNA, 18 bp, Homo sapiens
gctctgactctgccaggg

SEQ ID NO: 1902329 - DNA, 21 bp, Homo sapiens
gctctgactctgccagggtgg

SEQ ID NO: 1902330 - DNA, 15 bp, Homo sapiens
gctgaacattgcata

SEQ ID NO: 1902331 - DNA, 23 bp, Homo sapiens
gctgaccataacagtgccagctt

SEQ ID NO: 1902332 - DNA, 20 bp, Homo sapiens
gctgacccatgggcaggaga

SEQ ID NO: 1902333 - DNA, 21 bp, Homo sapiens
gctgacccatgggcaggagac

SEQ ID NO: 1902334 - DNA, 13 bp, Homo sapiens
gctgacctgacct

SEQ ID NO: 1902335 - DNA, 17 bp, Homo sapiens
gctgactacagggccgc

SEQ ID NO: 1902336 - DNA, 20 bp, Homo sapiens
gctgagacccttatttaaaa

SEQ ID NO: 1902337 - DNA, 17 bp, Homo sapiens
gctgaggcccatggcca

SEQ ID NO: 1902338 - DNA, 16 bp, Homo sapiens
gctgaggctgctgcca

SEQ ID NO: 1902339 - DNA, 17 bp, Homo sapiens
gctgaggctgctgccag

SEQ ID NO: 1902340 - DNA, 18 bp, Homo sapiens
gctgaggctgctgccagg

SEQ ID NO: 1902341 - DNA, 20 bp, Homo sapiens
gctgagtgcaggcccaccct

SEQ ID NO: 1902342 - DNA, 12 bp, Homo sapiens
gctgatgaggaa

SEQ ID NO: 1902343 - DNA, 18 bp, Homo sapiens
gctgattttgaccttgta

SEQ ID NO: 1902344 - DNA, 17 bp, Homo sapiens
gctgcagggctgggtca

SEQ ID NO: 1902345 - DNA, 20 bp, Homo sapiens
gctgcagggctgggtcaggg

SEQ ID NO: 1902346 - DNA, 16 bp, Homo sapiens
gctgcatccccttcca

SEQ ID NO: 1902347 - DNA, 14 bp, Homo sapiens
gctgccaggcccgg

SEQ ID NO: 1902348 - DNA, 17 bp, Homo sapiens
gctgcctgctgcgctcg

SEQ ID NO: 1902349 - DNA, 19 bp, Homo sapiens
gctgctgacccctgtgtga

SEQ ID NO: 1902350 - DNA, 18 bp, Homo sapiens
gctgctgagccgcagaga

SEQ ID NO: 1902351 - DNA, 14 bp, Homo sapiens
gctggaaaggccag

SEQ ID NO: 1902352 - DNA, 21 bp, Homo sapiens
gctggaaaggccagcagcctt

SEQ ID NO: 1902353 - DNA, 14 bp, Homo sapiens
gctggagaaaaata

SEQ ID NO: 1902354 - DNA, 15 bp, Homo sapiens
gctggagaggagccc

SEQ ID NO: 1902355 - DNA, 16 bp, Homo sapiens
gctggagaggagccct

SEQ ID NO: 1902356 - DNA, 22 bp, Homo sapiens
gctggagcctgcggggcagcag

SEQ ID NO: 1902357 - DNA, 16 bp, Homo sapiens
gctggagtctgggctc

SEQ ID NO: 1902358 - DNA, 19 bp, Homo sapiens
gctggagtgcagtggcgaa

SEQ ID NO: 1902359 - DNA, 15 bp, Homo sapiens
gctggcaccagcagg

SEQ ID NO: 1902360 - DNA, 14 bp, Homo sapiens
gctggcgggccctg

SEQ ID NO: 1902361 - DNA, 15 bp, Homo sapiens
gctggcgggccctgg

SEQ ID NO: 1902362 - DNA, 15 bp, Homo sapiens
gctgggaggtcccag

SEQ ID NO: 1902363 - DNA, 20 bp, Homo sapiens
gctgggaggtcccagggccc

SEQ ID NO: 1902364 - DNA, 21 bp, Homo sapiens
gctgggaggtcccagggccct

SEQ ID NO: 1902365 - DNA, 22 bp, Homo sapiens
gctgggaggtcccagggcccta

SEQ ID NO: 1902366 - DNA, 13 bp, Homo sapiens
gctggggaagaat

SEQ ID NO: 1902367 - DNA, 18 bp, Homo sapiens
gctgggggatgggcctga

SEQ ID NO: 1902368 - DNA, 18 bp, Homo sapiens
gctgggggctgcagggct

SEQ ID NO: 1902369 - DNA, 13 bp, Homo sapiens
gctgggtcagggg

SEQ ID NO: 1902370 - DNA, 14 bp, Homo sapiens
gctgggtcaggggt

SEQ ID NO: 1902371 - DNA, 23 bp, Homo sapiens
gctggtaaaatgaagaatttaaa

SEQ ID NO: 1902372 - DNA, 18 bp, Homo sapiens
gctgtaaggcatgaagga

SEQ ID NO: 1902373 - DNA, 19 bp, Homo sapiens
gctgtaaggcatgaaggat

SEQ ID NO: 1902374 - DNA, 14 bp, Homo sapiens
gctgtatatatttt

SEQ ID NO: 1902375 - DNA, 14 bp, Homo sapiens
gctgtcaaggctca

SEQ ID NO: 1902376 - DNA, 15 bp, Homo sapiens
gctgtcagtgtttgg

SEQ ID NO: 1902377 - DNA, 15 bp, Homo sapiens
gctgtctggcacagc

SEQ ID NO: 1902378 - DNA, 18 bp, Homo sapiens
gctgtgaacatgcctcct

SEQ ID NO: 1902379 - DNA, 19 bp, Homo sapiens
gctgtgaacatgcctcctc

SEQ ID NO: 1902380 - DNA, 17 bp, Homo sapiens
gctgttacagttttctt

SEQ ID NO: 1902381 - DNA, 15 bp, Homo sapiens
gcttactgtgttaaa

SEQ ID NO: 1902382 - DNA, 20 bp, Homo sapiens
gcttactgtgttaaaatttt

SEQ ID NO: 1902383 - DNA, 12 bp, Homo sapiens
gcttataaaaca

SEQ ID NO: 1902384 - DNA, 14 bp, Homo sapiens
gcttcagcctccca

SEQ ID NO: 1902385 - DNA, 21 bp, Homo sapiens
gcttcagcctcccacagtgct

SEQ ID NO: 1902386 - DNA, 22 bp, Homo sapiens
gcttcatgttcccaaaatcacc

SEQ ID NO: 1902387 - DNA, 14 bp, Homo sapiens
gcttccagcaggag

SEQ ID NO: 1902388 - DNA, 15 bp, Homo sapiens
gcttccagcaggagg

SEQ ID NO: 1902389 - DNA, 23 bp, Homo sapiens
gcttcccaaatgtgtgcccagct

SEQ ID NO: 1902390 - DNA, 19 bp, Homo sapiens
gcttccctggttcaagcga

SEQ ID NO: 1902391 - DNA, 12 bp, Homo sapiens
gcttcctctgct

SEQ ID NO: 1902392 - DNA, 14 bp, Homo sapiens
gcttcctctgctgc

SEQ ID NO: 1902393 - DNA, 20 bp, Homo sapiens
gcttcctctgctgcatcccc

SEQ ID NO: 1902394 - DNA, 22 bp, Homo sapiens
gcttcctctgctgcatcccctt

SEQ ID NO: 1902395 - DNA, 23 bp, Homo sapiens
gcttcctctgctgcatccccttc

SEQ ID NO: 1902396 - DNA, 22 bp, Homo sapiens
gcttctagtctggaactgctgc

SEQ ID NO: 1902397 - DNA, 22 bp, Homo sapiens
gcttctctgtttttcttctgaa

SEQ ID NO: 1902398 - DNA, 16 bp, Homo sapiens
gcttggatgtttttag

SEQ ID NO: 1902399 - DNA, 22 bp, Homo sapiens
gcttggatgtttttagttctga

SEQ ID NO: 1902400 - DNA, 12 bp, Homo sapiens
gcttggccctgg

SEQ ID NO: 1902401 - DNA, 14 bp, Homo sapiens
gcttggccctggca

SEQ ID NO: 1902402 - DNA, 17 bp, Homo sapiens
gcttgtaactaaaataa

SEQ ID NO: 1902403 - DNA, 12 bp, Homo sapiens
gcttgtggaaga

SEQ ID NO: 1902404 - DNA, 13 bp, Homo sapiens
gcttgttgacaga

SEQ ID NO: 1902405 - DNA, 14 bp, Homo sapiens
gctttagacttgaa

SEQ ID NO: 1902406 - DNA, 18 bp, Homo sapiens
gctttagacttgaaaaga

SEQ ID NO: 1902407 - DNA, 17 bp, Homo sapiens
gctttcctttccttttt

SEQ ID NO: 1902408 - DNA, 14 bp, Homo sapiens
gctttctgaatgta

SEQ ID NO: 1902409 - DNA, 21 bp, Homo sapiens
gctttctttcgtttgtttgtt

SEQ ID NO: 1902410 - DNA, 11 bp, Homo sapiens
gctttgagttg

SEQ ID NO: 1902411 - DNA, 18 bp, Homo sapiens
ggaaaagagaactttttt

SEQ ID NO: 1902412 - DNA, 15 bp, Homo sapiens
ggaaaaggcatatat

SEQ ID NO: 1902413 - DNA, 15 bp, Homo sapiens
ggaaaatctattttt

SEQ ID NO: 1902414 - DNA, 19 bp, Homo sapiens
ggaaaggccagcagccttc

SEQ ID NO: 1902415 - DNA, 23 bp, Homo sapiens
ggaaagtaagggaagcagaagga

SEQ ID NO: 1902416 - DNA, 15 bp, Homo sapiens
ggaaatatgcactgc

SEQ ID NO: 1902417 - DNA, 17 bp, Homo sapiens
ggaaatcaaagtgctat

SEQ ID NO: 1902418 - DNA, 17 bp, Homo sapiens
ggaaatcaaatgtaaag

SEQ ID NO: 1902419 - DNA, 23 bp, Homo sapiens
ggaacaagttgagctatgactta

SEQ ID NO: 1902420 - DNA, 22 bp, Homo sapiens
ggccctgggcctccacctctgt

SEQ ID NO: 1902421 - DNA, 16 bp, Homo sapiens
ggccgcactgggagca

SEQ ID NO: 1902422 - DNA, 23 bp, Homo sapiens
ggccgccggcaataaaagcccag

SEQ ID NO: 1902423 - DNA, 17 bp, Homo sapiens
ggcctacatgctttgtg

SEQ ID NO: 1902424 - DNA, 18 bp, Homo sapiens
ggcctacatgctttgtga

SEQ ID NO: 1902425 - DNA, 15 bp, Homo sapiens
ggcctccacctctgt

SEQ ID NO: 1902426 - DNA, 17 bp, Homo sapiens
ggcctccacctctgtgc

SEQ ID NO: 1902427 - DNA, 21 bp, Homo sapiens
ggcctctgcaaaggaaatacc

SEQ ID NO: 1902428 - DNA, 20 bp, Homo sapiens
ggcctgagtgagaggggagg

SEQ ID NO: 1902429 - DNA, 15 bp, Homo sapiens
ggcctgggcctggct

SEQ ID NO: 1902430 - DNA, 18 bp, Homo sapiens
ggcgcaagggaggcccag

SEQ ID NO: 1902431 - DNA, 20 bp, Homo sapiens
ggcgcaagggaggcccagcg

SEQ ID NO: 1902432 - DNA, 15 bp, Homo sapiens
ggcgggccctggagc

SEQ ID NO: 1902433 - DNA, 16 bp, Homo sapiens
ggcgggccctggagct

SEQ ID NO: 1902434 - DNA, 20 bp, Homo sapiens
ggctcccgcctccaacccct

SEQ ID NO: 1902435 - DNA, 21 bp, Homo sapiens
ggctcccgcctccaacccctc

SEQ ID NO: 1902436 - DNA, 17 bp, Homo sapiens
ggctccctcactctcag

SEQ ID NO: 1902437 - DNA, 19 bp, Homo sapiens
ggctccctcactctcagga

SEQ ID NO: 1902438 - DNA, 13 bp, Homo sapiens
ggctcctcagccc

SEQ ID NO: 1902439 - DNA, 19 bp, Homo sapiens
ggctcgagctcggggctgg

SEQ ID NO: 1902440 - DNA, 12 bp, Homo sapiens
ggctctacacat

SEQ ID NO: 1902441 - DNA, 17 bp, Homo sapiens
ggctctcaatgctgttt

SEQ ID NO: 1902442 - DNA, 15 bp, Homo sapiens
ggctctgggcggtcc

SEQ ID NO: 1902443 - DNA, 15 bp, Homo sapiens
ggctcttagaaactc

SEQ ID NO: 1902444 - DNA, 13 bp, Homo sapiens
ggctgagtgcagg

SEQ ID NO: 1902445 - DNA, 20 bp, Homo sapiens
ggctgagtgcaggcccaccc

SEQ ID NO: 1902446 - DNA, 14 bp, Homo sapiens
ggctgagtgttctg

SEQ ID NO: 1902447 - DNA, 13 bp, Homo sapiens
ggctgcagggctg

SEQ ID NO: 1902448 - DNA, 23 bp, Homo sapiens
ggctggcgggccctggagctcaa

SEQ ID NO: 1902449 - DNA, 14 bp, Homo sapiens
ggctgggctgggca

SEQ ID NO: 1902450 - DNA, 15 bp, Homo sapiens
ggctgggggctgcag

SEQ ID NO: 1902451 - DNA, 22 bp, Homo sapiens
ggctgtcagtgtttggtgcacg

SEQ ID NO: 1902452 - DNA, 23 bp, Homo sapiens
ggcttcccaaatgtgtgcccagc

SEQ ID NO: 1902453 - DNA, 16 bp, Homo sapiens
ggcttggccctggcag

SEQ ID NO: 1902454 - DNA, 13 bp, Homo sapiens
ggcttgtagttct

SEQ ID NO: 1902455 - DNA, 22 bp, Homo sapiens
ggctttatttttttgaactctt

SEQ ID NO: 1902456 - DNA, 15 bp, Homo sapiens
ggcttttggtgaatt

SEQ ID NO: 1902457 - DNA, 16 bp, Homo sapiens
gggaagctgaggccca

SEQ ID NO: 1902458 - DNA, 23 bp, Homo sapiens
gggaagctgaggcccatggccac

SEQ ID NO: 1902459 - DNA, 15 bp, Homo sapiens
gggacaaccttggct

SEQ ID NO: 1902460 - DNA, 22 bp, Homo sapiens
gggacactgtggcagcaggagg

SEQ ID NO: 1902461 - DNA, 12 bp, Homo sapiens
gggacagtctca

SEQ ID NO: 1902462 - DNA, 17 bp, Homo sapiens
gggacccagtggcaggg

SEQ ID NO: 1902463 - DNA, 20 bp, Homo sapiens
gggacccagtggcagggcac

SEQ ID NO: 1902464 - DNA, 19 bp, Homo sapiens
gggactcccaggaccctgt

SEQ ID NO: 1902465 - DNA, 17 bp, Homo sapiens
gggactctgtctggcca

SEQ ID NO: 1902466 - DNA, 13 bp, Homo sapiens
gggagacagacca

SEQ ID NO: 1902467 - DNA, 19 bp, Homo sapiens
gggagccctgggccagggc

SEQ ID NO: 1902468 - DNA, 21 bp, Homo sapiens
gggaggagccccagtggtgag

SEQ ID NO: 1902469 - DNA, 19 bp, Homo sapiens
gggaggccaagagtggccc

SEQ ID NO: 1902470 - DNA, 20 bp, Homo sapiens
gggaggcggagcttgcagtg

SEQ ID NO: 1902471 - DNA, 14 bp, Homo sapiens
gggaggtcccaggg

SEQ ID NO: 1902472 - DNA, 24 bp, Homo sapiens
gggagtaagtagaggtggcttcag

SEQ ID NO: 1902473 - DNA, 15 bp, Homo sapiens
gggatgattgaagaa

SEQ ID NO: 1902474 - DNA, 14 bp, Homo sapiens
gggatggggctggg

SEQ ID NO: 1902475 - DNA, 16 bp, Homo sapiens
gggcactgctctcacc

SEQ ID NO: 1902476 - DNA, 11 bp, Homo sapiens
gggcagcaggg

SEQ ID NO: 1902477 - DNA, 12 bp, Homo sapiens
gggcagcagggg

SEQ ID NO: 1902478 - DNA, 14 bp, Homo sapiens
gggcaggaccagcc

SEQ ID NO: 1902479 - DNA, 15 bp, Homo sapiens
gggcaggaccagccc

SEQ ID NO: 1902480 - DNA, 16 bp, Homo sapiens
gggcaggaccagccca

SEQ ID NO: 1902481 - DNA, 16 bp, Homo sapiens
gggcaggccaggggag

SEQ ID NO: 1902482 - DNA, 14 bp, Homo sapiens
gggcatccatgggg

SEQ ID NO: 1902483 - DNA, 14 bp, Homo sapiens
gggcatttggcttc

SEQ ID NO: 1902484 - DNA, 15 bp, Homo sapiens
gggcatttggcttcc

SEQ ID NO: 1902485 - DNA, 17 bp, Homo sapiens
gggcatttggcttcctc

SEQ ID NO: 1902486 - DNA, 18 bp, Homo sapiens
gggcatttggcttcctct

SEQ ID NO: 1902487 - DNA, 18 bp, Homo sapiens
gggccagcggccctccca

SEQ ID NO: 1902488 - DNA, 13 bp, Homo sapiens
gggcccctgctca

SEQ ID NO: 1902489 - DNA, 16 bp, Homo sapiens
gggcccgggcccaggc

SEQ ID NO: 1902490 - DNA, 14 bp, Homo sapiens
gggccgcctgtcct

SEQ ID NO: 1902491 - DNA, 17 bp, Homo sapiens
gggcctccacctctgtg

SEQ ID NO: 1902492 - DNA, 16 bp, Homo sapiens
gggcctcccactccca

SEQ ID NO: 1902493 - DNA, 18 bp, Homo sapiens
gggctcagcaaggccacc

SEQ ID NO: 1902494 - DNA, 21 bp, Homo sapiens
gggctcagcaaggccacctct

SEQ ID NO: 1902495 - DNA, 19 bp, Homo sapiens
gggctcccgcctccaaccc

SEQ ID NO: 1902496 - DNA, 14 bp, Homo sapiens
gggctgcagggctg

SEQ ID NO: 1902497 - DNA, 16 bp, Homo sapiens
gggctgcagggctggg

SEQ ID NO: 1902498 - DNA, 14 bp, Homo sapiens
gggctggcaccagc

SEQ ID NO: 1902499 - DNA, 19 bp, Homo sapiens
gggctgggggatgggcctg

SEQ ID NO: 1902500 - DNA, 18 bp, Homo sapiens
ggggacactgtggcagca

SEQ ID NO: 1902501 - DNA, 21 bp, Homo sapiens
ggggacactgtggcagcagga

SEQ ID NO: 1902502 - DNA, 17 bp, Homo sapiens
ggggaccacagaggctg

SEQ ID NO: 1902503 - DNA, 12 bp, Homo sapiens
ggggcagcaggg

SEQ ID NO: 1902504 - DNA, 15 bp, Homo sapiens
ggggcaggccagggg

SEQ ID NO: 1902505 - DNA, 17 bp, Homo sapiens
ggggccagcggccctcc

SEQ ID NO: 1902506 - DNA, 16 bp, Homo sapiens
ggggccccgtctcagg

SEQ ID NO: 1902507 - DNA, 15 bp, Homo sapiens
ggggctcagcaaggc

SEQ ID NO: 1902508 - DNA, 20 bp, Homo sapiens
ggggctcagcaaggccacct

SEQ ID NO: 1902509 - DNA, 21 bp, Homo sapiens
ggggctcagcaaggccacctc

SEQ ID NO: 1902510 - DNA, 15 bp, Homo sapiens
ggggctgcagggctg

SEQ ID NO: 1902511 - DNA, 16 bp, Homo sapiens
ggggctgcagggctgg

SEQ ID NO: 1902512 - DNA, 11 bp, Homo sapiens
ggggctggggg

SEQ ID NO: 1902513 - DNA, 17 bp, Homo sapiens
gggggacactgtggcag

SEQ ID NO: 1902514 - DNA, 15 bp, Homo sapiens
gggggacctcgggct

SEQ ID NO: 1902515 - DNA, 19 bp, Homo sapiens
gggggctcagcaaggccac

SEQ ID NO: 1902516 - DNA, 23 bp, Homo sapiens
ggggtctctcacagacaggaccc

SEQ ID NO: 1902517 - DNA, 18 bp, Homo sapiens
ggggttccttctgggcat

SEQ ID NO: 1902518 - DNA, 14 bp, Homo sapiens
gggtcactggggga

SEQ ID NO: 1902519 - DNA, 14 bp, Homo sapiens
gggtcgcctgtcct

SEQ ID NO: 1902520 - DNA, 24 bp, Homo sapiens
gggtctctcacagacaggacccct

SEQ ID NO: 1902521 - DNA, 18 bp, Homo sapiens
gggttagactgccagctc

SEQ ID NO: 1902522 - DNA, 15 bp, Homo sapiens
gggtttcagggctga

SEQ ID NO: 1902523 - DNA, 13 bp, Homo sapiens
ggtaaaatgaaga

SEQ ID NO: 1902524 - DNA, 20 bp, Homo sapiens
ggtaaaatgaagaatttaaa

SEQ ID NO: 1902525 - DNA, 12 bp, Homo sapiens
ggtacacagagc

SEQ ID NO: 1902526 - DNA, 22 bp, Homo sapiens
ggtactgtctcggcagaggtgg

SEQ ID NO: 1902527 - DNA, 17 bp, Homo sapiens
ggtagcaaattttggac

SEQ ID NO: 1902528 - DNA, 21 bp, Homo sapiens
ggtagctgtaaggcatgaagg

SEQ ID NO: 1902529 - DNA, 13 bp, Homo sapiens
ggtagttcaagaa

SEQ ID NO: 1902530 - DNA, 14 bp, Homo sapiens
ggtagttcaagaaa

SEQ ID NO: 1902531 - DNA, 14 bp, Homo sapiens
ggtattagaaagtg

SEQ ID NO: 1902532 - DNA, 15 bp, Homo sapiens
ggtcaagctggaaag

SEQ ID NO: 1902533 - DNA, 18 bp, Homo sapiens
ggtcccagttgctgtcac

SEQ ID NO: 1902534 - DNA, 18 bp, Homo sapiens
ggtcctggaggctcaaat

SEQ ID NO: 1902535 - DNA, 17 bp, Homo sapiens
ggtctctcccagctctg

SEQ ID NO: 1902536 - DNA, 18 bp, Homo sapiens
ggtcttccttacctggaa

SEQ ID NO: 1902537 - DNA, 19 bp, Homo sapiens
ggtcttgcaaaattcctga

SEQ ID NO: 1902538 - DNA, 10 bp, Homo sapiens
ggtctttgag

SEQ ID NO: 1902539 - DNA, 17 bp, Homo sapiens
ggtctttgagctcccac

SEQ ID NO: 1902540 - DNA, 22 bp, Homo sapiens
ggtctttggttatttctgtgca

SEQ ID NO: 1902541 - DNA, 18 bp, Homo sapiens
ggtgactgaattcacaga

SEQ ID NO: 1902542 - DNA, 22 bp, Homo sapiens
ggtgatgttgacatcactggca

SEQ ID NO: 1902543 - DNA, 22 bp, Homo sapiens
ggtgccaccgtccctctgcaga

SEQ ID NO: 1902544 - DNA, 22 bp, Homo sapiens
ggtggccccttctatgcccagc

SEQ ID NO: 1902545 - DNA, 13 bp, Homo sapiens
ggtgtgaggccac

SEQ ID NO: 1902546 - DNA, 17 bp, Homo sapiens
ggtgtgtgcagggctgc

SEQ ID NO: 1902547 - DNA, 17 bp, Homo sapiens
ggttaatgtgtggcata

SEQ ID NO: 1902548 - DNA, 18 bp, Homo sapiens
ggttaccgatttcaaagt

SEQ ID NO: 1902549 - DNA, 21 bp, Homo sapiens
ggttcattttcagattcaggc

SEQ ID NO: 1902550 - DNA, 23 bp, Homo sapiens
ggttcattttcagattcaggcat

SEQ ID NO: 1902551 - DNA, 16 bp, Homo sapiens
ggttccttctgggcat

SEQ ID NO: 1902552 - DNA, 12 bp, Homo sapiens
ggttctaacttc

SEQ ID NO: 1902553 - DNA, 14 bp, Homo sapiens
ggttctaacttctg

SEQ ID NO: 1902554 - DNA, 19 bp, Homo sapiens
ggttggctgggaaatcgag

SEQ ID NO: 1902555 - DNA, 20 bp, Homo sapiens
ggtttccaacaattcagcat

SEQ ID NO: 1902556 - DNA, 11 bp, Homo sapiens
ggttttatgat

SEQ ID NO: 1902557 - DNA, 12 bp, Homo sapiens
gtaaaagaaaaa

SEQ ID NO: 1902558 - DNA, 19 bp, Homo sapiens
gtaaaagcagcataaagaa

SEQ ID NO: 1902559 - DNA, 15 bp, Homo sapiens
gtaaaagttaagatc

SEQ ID NO: 1902560 - DNA, 17 bp, Homo sapiens
gtaaagttgtcttttaa

SEQ ID NO: 1902561 - DNA, 14 bp, Homo sapiens
gtaaataattcttt

SEQ ID NO: 1902562 - DNA, 21 bp, Homo sapiens
gtaaatattgttttgcattgt

SEQ ID NO: 1902563 - DNA, 16 bp, Homo sapiens
gtaaatgactttcata

SEQ ID NO: 1902564 - DNA, 12 bp, Homo sapiens
gtaaattctgat

SEQ ID NO: 1902565 - DNA, 13 bp, Homo sapiens
gtaaattctgatt

SEQ ID NO: 1902566 - DNA, 22 bp, Homo sapiens
gtaactaaaataattttgtaat

SEQ ID NO: 1902567 - DNA, 16 bp, Homo sapiens
gtaagaaatacagact

SEQ ID NO: 1902568 - DNA, 13 bp, Homo sapiens
gtaagaaatactg

SEQ ID NO: 1902569 - DNA, 13 bp, Homo sapiens
gtaagatcactgt

SEQ ID NO: 1902570 - DNA, 20 bp, Homo sapiens
gtaagctggtgttataatac

SEQ ID NO: 1902571 - DNA, 19 bp, Homo sapiens
gtaaggaaaaataaaagtg

SEQ ID NO: 1902572 - DNA, 14 bp, Homo sapiens
gtaaggcatgaagg

SEQ ID NO: 1902573 - DNA, 15 bp, Homo sapiens
gtaagtagaggtggc

SEQ ID NO: 1902574 - DNA, 15 bp, Homo sapiens
gtaataaagactcta

SEQ ID NO: 1902575 - DNA, 14 bp, Homo sapiens
gtaatatttattaa

SEQ ID NO: 1902576 - DNA, 17 bp, Homo sapiens
gtaatatttattaaatt

SEQ ID NO: 1902577 - DNA, 21 bp, Homo sapiens
gtaatatttattaaatttttt

SEQ ID NO: 1902578 - DNA, 20 bp, Homo sapiens
gtaatctagttgtcaataaa

SEQ ID NO: 1902579 - DNA, 16 bp, Homo sapiens
gtaatgtatacttgaa

SEQ ID NO: 1902580 - DNA, 20 bp, Homo sapiens
gtaattttgtgtaagaaata

SEQ ID NO: 1902581 - DNA, 13 bp, Homo sapiens
gtacaagtagttc

SEQ ID NO: 1902582 - DNA, 17 bp, Homo sapiens
gtacaagtagttctgta

SEQ ID NO: 1902583 - DNA, 17 bp, Homo sapiens
gtacacccatgaaagaa

SEQ ID NO: 1902584 - DNA, 18 bp, Homo sapiens
gtacacccatgaaagaaa

SEQ ID NO: 1902585 - DNA, 17 bp, Homo sapiens
gtacactgaatttttat

SEQ ID NO: 1902586 - DNA, 17 bp, Homo sapiens
gtacactgcctgcctta

SEQ ID NO: 1902587 - DNA, 22 bp, Homo sapiens
gtacacttcagttatcttgatc

SEQ ID NO: 1902588 - DNA, 14 bp, Homo sapiens
gtacataatactga

SEQ ID NO: 1902589 - DNA, 16 bp, Homo sapiens
gtacataatactgaac

SEQ ID NO: 1902590 - DNA, 18 bp, Homo sapiens
gtacataatactgaacca

SEQ ID NO: 1902591 - DNA, 19 bp, Homo sapiens
gtacatactgaaaaataca

SEQ ID NO: 1902592 - DNA, 22 bp, Homo sapiens
gtacatgggactatgcttttct

SEQ ID NO: 1902593 - DNA, 13 bp, Homo sapiens
gtacgcaattctc

SEQ ID NO: 1902594 - DNA, 12 bp, Homo sapiens
gtactctctctc

SEQ ID NO: 1902595 - DNA, 13 bp, Homo sapiens
gtactctctctct

SEQ ID NO: 1902596 - DNA, 11 bp, Homo sapiens
gtactgtgaat

SEQ ID NO: 1902597 - DNA, 15 bp, Homo sapiens
gtactttctgaaaat

SEQ ID NO: 1902598 - DNA, 20 bp, Homo sapiens
gtactttctgaaaatttata

SEQ ID NO: 1902599 - DNA, 22 bp, Homo sapiens
gtactttctgaaaatttatata

SEQ ID NO: 1902600 - DNA, 13 bp, Homo sapiens
gtagaactttgta

SEQ ID NO: 1902601 - DNA, 14 bp, Homo sapiens
gtagacattttgaa

SEQ ID NO: 1902602 - DNA, 12 bp, Homo sapiens
gtagatttattt

SEQ ID NO: 1902603 - DNA, 19 bp, Homo sapiens
gtagatttatttcatcata

SEQ ID NO: 1902604 - DNA, 12 bp, Homo sapiens
gtagatttgatt

SEQ ID NO: 1902605 - DNA, 16 bp, Homo sapiens
gtagatttgatttttt

SEQ ID NO: 1902606 - DNA, 12 bp, Homo sapiens
gtagcacaggct

SEQ ID NO: 1902607 - DNA, 19 bp, Homo sapiens
gtagccatgaggaggcaga

SEQ ID NO: 1902608 - DNA, 23 bp, Homo sapiens
gtagccatgaggaggcagagagg

SEQ ID NO: 1902609 - DNA, 21 bp, Homo sapiens
gtagcctcaatcgagtgagac

SEQ ID NO: 1902610 - DNA, 22 bp, Homo sapiens
gtagcctcaatcgagtgagaca

SEQ ID NO: 1902611 - DNA, 15 bp, Homo sapiens
gtaggtgtcctgccc

SEQ ID NO: 1902612 - DNA, 15 bp, Homo sapiens
gtagtcggagccccc

SEQ ID NO: 1902613 - DNA, 20 bp, Homo sapiens
gtagttcaagaaatgaagag

SEQ ID NO: 1902614 - DNA, 16 bp, Homo sapiens
gtagttctgtatttga

SEQ ID NO: 1902615 - DNA, 22 bp, Homo sapiens
gtagtttgaatatttaagcaat

SEQ ID NO: 1902616 - DNA, 15 bp, Homo sapiens
gtatatgagttttaa

SEQ ID NO: 1902617 - DNA, 13 bp, Homo sapiens
gtatatgctgcat

SEQ ID NO: 1902618 - DNA, 17 bp, Homo sapiens
gtatattctattttaca

SEQ ID NO: 1902619 - DNA, 18 bp, Homo sapiens
gtatattctattttacaa

SEQ ID NO: 1902620 - DNA, 20 bp, Homo sapiens
gtatatttgatttattaact

SEQ ID NO: 1902621 - DNA, 19 bp, Homo sapiens
gtatcaaatacatttaaaa

SEQ ID NO: 1902622 - DNA, 14 bp, Homo sapiens
gtatcatgaagcct

SEQ ID NO: 1902623 - DNA, 22 bp, Homo sapiens
gtatccttatctagtgtttgat

SEQ ID NO: 1902624 - DNA, 15 bp, Homo sapiens
gtatctgtgaactga

SEQ ID NO: 1902625 - DNA, 13 bp, Homo sapiens
gtatgaaaacatg

SEQ ID NO: 1902626 - DNA, 15 bp, Homo sapiens
gtatgaatctatttg

SEQ ID NO: 1902627 - DNA, 13 bp, Homo sapiens
gtatgtgtttaga

SEQ ID NO: 1902628 - DNA, 16 bp, Homo sapiens
gtattgaagttaactg

SEQ ID NO: 1902629 - DNA, 21 bp, Homo sapiens
gtattgattatataagcaaaa

SEQ ID NO: 1902630 - DNA, 15 bp, Homo sapiens
gtattttagaataaa

SEQ ID NO: 1902631 - DNA, 17 bp, Homo sapiens
gtattttgtatttaaaa

SEQ ID NO: 1902632 - DNA, 10 bp, Homo sapiens
gtatttttat

SEQ ID NO: 1902633 - DNA, 14 bp, Homo sapiens
gtatttttataatg

SEQ ID NO: 1902634 - DNA, 18 bp, Homo sapiens
gtatttttataatgactg

SEQ ID NO: 1902635 - DNA, 23 bp, Homo sapiens
gtatttttataatgactggtctt

SEQ ID NO: 1902636 - DNA, 24 bp, Homo sapiens
gtcaagctggaaaggccagcagcc

SEQ ID NO: 1902637 - DNA, 19 bp, Homo sapiens
gtcacccctgcctaaagat

SEQ ID NO: 1902638 - DNA, 23 bp, Homo sapiens
gtcactgggggacactgtggcag

SEQ ID NO: 1902639 - DNA, 11 bp, Homo sapiens
gtcactttgac

SEQ ID NO: 1902640 - DNA, 23 bp, Homo sapiens
gtcagagagggaagctgaggccc

SEQ ID NO: 1902641 - DNA, 23 bp, Homo sapiens
gtcagcagttgctggtaaaatga

SEQ ID NO: 1902642 - DNA, 14 bp, Homo sapiens
gtcatatgtttgct

SEQ ID NO: 1902643 - DNA, 15 bp, Homo sapiens
gtcatctgagaatga

SEQ ID NO: 1902644 - DNA, 12 bp, Homo sapiens
gtccagaaggag

SEQ ID NO: 1902645 - DNA, 18 bp, Homo sapiens
gtccagtaagatcactgt

SEQ ID NO: 1902646 - DNA, 21 bp, Homo sapiens
gtccagtaagatcactgttta

SEQ ID NO: 1902647 - DNA, 16 bp, Homo sapiens
gtccatctctgaaaac

SEQ ID NO: 1902648 - DNA, 16 bp, Homo sapiens
gtcccaagtctgacag

SEQ ID NO: 1902649 - DNA, 14 bp, Homo sapiens
gtcccagcagccag

SEQ ID NO: 1902650 - DNA, 17 bp, Homo sapiens
gtcccagcagccagcca

SEQ ID NO: 1902651 - DNA, 10 bp, Homo sapiens
gtcccaggca

SEQ ID NO: 1902652 - DNA, 19 bp, Homo sapiens
gtcccaggcagcgccactg

SEQ ID NO: 1902653 - DNA, 22 bp, Homo sapiens
gtcccaggcagcgccactgtcc

SEQ ID NO: 1902654 - DNA, 15 bp, Homo sapiens
gtcccagggccctag

SEQ ID NO: 1902655 - DNA, 17 bp, Homo sapiens
gtcccagttgctgtcac

SEQ ID NO: 1902656 - DNA, 14 bp, Homo sapiens
gtccccccatcccg

SEQ ID NO: 1902657 - DNA, 23 bp, Homo sapiens
gtccccccatcccgtttccctcc

SEQ ID NO: 1902658 - DNA, 14 bp, Homo sapiens
gtccctctgcagat

SEQ ID NO: 1902659 - DNA, 19 bp, Homo sapiens
gtccgctgtctccctcctg

SEQ ID NO: 1902660 - DNA, 21 bp, Homo sapiens
gtcctaatggtgatgcagtct

SEQ ID NO: 1902661 - DNA, 20 bp, Homo sapiens
gtcctattagtgttatatga

SEQ ID NO: 1902662 - DNA, 20 bp, Homo sapiens
gtccttgttcccctaatcta

SEQ ID NO: 1902663 - DNA, 12 bp, Homo sapiens
gtcggggcaggc

SEQ ID NO: 1902664 - DNA, 12 bp, Homo sapiens
gtctatcttgta

SEQ ID NO: 1902665 - DNA, 20 bp, Homo sapiens
gtctcaccatttccccaggg

SEQ ID NO: 1902666 - DNA, 22 bp, Homo sapiens
gtctcaccatttccccagggca

SEQ ID NO: 1902667 - DNA, 20 bp, Homo sapiens
gtctcccaccctttctgcca

SEQ ID NO: 1902668 - DNA, 22 bp, Homo sapiens
gtctcccaccctttctgccagg

SEQ ID NO: 1902669 - DNA, 12 bp, Homo sapiens
gtctccctcctg

SEQ ID NO: 1902670 - DNA, 12 bp, Homo sapiens
gtctcggcagag

SEQ ID NO: 1902671 - DNA, 18 bp, Homo sapiens
gtctctagtgctgtgaaa

SEQ ID NO: 1902672 - DNA, 14 bp, Homo sapiens
gtctctcacagaca

SEQ ID NO: 1902673 - DNA, 16 bp, Homo sapiens
gtctctcacagacagg

SEQ ID NO: 1902674 - DNA, 17 bp, Homo sapiens
gtctctcccagctctgg

SEQ ID NO: 1902675 - DNA, 21 bp, Homo sapiens
gtctgagttgttaccccaagc

SEQ ID NO: 1902676 - DNA, 20 bp, Homo sapiens
gtctgccaccagcgccccca

SEQ ID NO: 1902677 - DNA, 17 bp, Homo sapiens
gtctggaactgctgctg

SEQ ID NO: 1902678 - DNA, 13 bp, Homo sapiens
gtctggccaggga

SEQ ID NO: 1902679 - DNA, 15 bp, Homo sapiens
gtctggccagggagg

SEQ ID NO: 1902680 - DNA, 21 bp, Homo sapiens
gtctggccagggaggagcccc

SEQ ID NO: 1902681 - DNA, 22 bp, Homo sapiens
gtctggccagggaggagcccca

SEQ ID NO: 1902682 - DNA, 23 bp, Homo sapiens
gtctgttggcaaatttgtgaact

SEQ ID NO: 1902683 - DNA, 24 bp, Homo sapiens
gtctgttggcaaatttgtgaactg

SEQ ID NO: 1902684 - DNA, 17 bp, Homo sapiens
gtcttaatggatgaaat

SEQ ID NO: 1902685 - DNA, 18 bp, Homo sapiens
gtcttagtttgaatgaaa

SEQ ID NO: 1902686 - DNA, 21 bp, Homo sapiens
gtcttatatttacaacacttt

SEQ ID NO: 1902687 - DNA, 17 bp, Homo sapiens
gtcttccttacctggaa

SEQ ID NO: 1902688 - DNA, 18 bp, Homo sapiens
gtcttgcgggtctgtcag

SEQ ID NO: 1902689 - DNA, 16 bp, Homo sapiens
gtctttaaaagatata

SEQ ID NO: 1902690 - DNA, 16 bp, Homo sapiens
gtctttctcactgcct

SEQ ID NO: 1902691 - DNA, 18 bp, Homo sapiens
gtctttctcactgccttt

SEQ ID NO: 1902692 - DNA, 16 bp, Homo sapiens
gtcttttggttatgaa

SEQ ID NO: 1902693 - DNA, 15 bp, Homo sapiens
gtgaaaaaaaaaatg

SEQ ID NO: 1902694 - DNA, 22 bp, Homo sapiens
gtgaaaataagccatgagaatg

SEQ ID NO: 1902695 - DNA, 13 bp, Homo sapiens
gtgaaactcccac

SEQ ID NO: 1902696 - DNA, 17 bp, Homo sapiens
gtgaacatgcctcctcc

SEQ ID NO: 1902697 - DNA, 18 bp, Homo sapiens
gtgaacatgcctcctcct

SEQ ID NO: 1902698 - DNA, 13 bp, Homo sapiens
gtgaactgtcatg

SEQ ID NO: 1902699 - DNA, 14 bp, Homo sapiens
gtgaacttggaagc

SEQ ID NO: 1902700 - DNA, 18 bp, Homo sapiens
gtgaaggagtaatgggat

SEQ ID NO: 1902701 - DNA, 13 bp, Homo sapiens
gtgaatgctgggc

SEQ ID NO: 1902702 - DNA, 20 bp, Homo sapiens
gtgacctcacacacctctgc

SEQ ID NO: 1902703 - DNA, 24 bp, Homo sapiens
gtgacggttcctacacaggacagg

SEQ ID NO: 1902704 - DNA, 21 bp, Homo sapiens
gtgagaacattaggccccagc

SEQ ID NO: 1902705 - DNA, 12 bp, Homo sapiens
gtgagacagact

SEQ ID NO: 1902706 - DNA, 14 bp, Homo sapiens
gtgaggaaatcaaa

SEQ ID NO: 1902707 - DNA, 18 bp, Homo sapiens
gtgagggtaagtattttc

SEQ ID NO: 1902708 - DNA, 17 bp, Homo sapiens
gtgagtgaaactcccac

SEQ ID NO: 1902709 - DNA, 18 bp, Homo sapiens
gtgagtgaaactcccacc

SEQ ID NO: 1902710 - DNA, 20 bp, Homo sapiens
gtgatctgctgcagagcagt

SEQ ID NO: 1902711 - DNA, 14 bp, Homo sapiens
gtgatgaagctgag

SEQ ID NO: 1902712 - DNA, 16 bp, Homo sapiens
gtgattgcctcaataa

SEQ ID NO: 1902713 - DNA, 20 bp, Homo sapiens
gtgattgcctcaataaagct

SEQ ID NO: 1902714 - DNA, 12 bp, Homo sapiens
gtgcaggcccac

SEQ ID NO: 1902715 - DNA, 13 bp, Homo sapiens
gtgcaggcccacc

SEQ ID NO: 1902716 - DNA, 18 bp, Homo sapiens
gtgccagcttctttgcag

SEQ ID NO: 1902717 - DNA, 12 bp, Homo sapiens
gtgcctgcttca

SEQ ID NO: 1902718 - DNA, 21 bp, Homo sapiens
gtgcctgcttcagcctcccac

SEQ ID NO: 1902719 - DNA, 16 bp, Homo sapiens
gtgctgggaggtccca

SEQ ID NO: 1902720 - DNA, 21 bp, Homo sapiens
gtgctgggaggtcccagggcc

SEQ ID NO: 1902721 - DNA, 23 bp, Homo sapiens
gtgctggttccatgcctgctctc

SEQ ID NO: 1902722 - DNA, 17 bp, Homo sapiens
gtggaaattaagaagaa

SEQ ID NO: 1902723 - DNA, 19 bp, Homo sapiens
gtggaaattaagaagaaac

SEQ ID NO: 1902724 - DNA, 19 bp, Homo sapiens
gtggagaatcacaggctgg

SEQ ID NO: 1902725 - DNA, 21 bp, Homo sapiens
gtggagaatcacaggctgggc

SEQ ID NO: 1902726 - DNA, 15 bp, Homo sapiens
gtggagactgctcct

SEQ ID NO: 1902727 - DNA, 16 bp, Homo sapiens
gtggatgcaatttttc

SEQ ID NO: 1902728 - DNA, 13 bp, Homo sapiens
gtggattcctccc

SEQ ID NO: 1902729 - DNA, 18 bp, Homo sapiens
gtggcagggcacagggcc

SEQ ID NO: 1902730 - DNA, 19 bp, Homo sapiens
gtggcagggcacagggcct

SEQ ID NO: 1902731 - DNA, 18 bp, Homo sapiens
gtggcatatggaagggac

SEQ ID NO: 1902732 - DNA, 11 bp, Homo sapiens
gtggccccacc

SEQ ID NO: 1902733 - DNA, 13 bp, Homo sapiens
gtggccccacctg

SEQ ID NO: 1902734 - DNA, 22 bp, Homo sapiens
gtggccccttctatgcccagct

SEQ ID NO: 1902735 - DNA, 19 bp, Homo sapiens
gtggccggggtccaggcat

SEQ ID NO: 1902736 - DNA, 17 bp, Homo sapiens
gtggccttaactgttca

SEQ ID NO: 1902737 - DNA, 17 bp, Homo sapiens
gtggcgaaatccctgct

SEQ ID NO: 1902738 - DNA, 13 bp, Homo sapiens
gtggcttctccca

SEQ ID NO: 1902739 - DNA, 15 bp, Homo sapiens
gtggcttctcccaac

SEQ ID NO: 1902740 - DNA, 23 bp, Homo sapiens
gtgggctgttacttgctttgagt

SEQ ID NO: 1902741 - DNA, 20 bp, Homo sapiens
gtgggggccccgtctcaggt

SEQ ID NO: 1902742 - DNA, 18 bp, Homo sapiens
gtgggtactttctgaaaa

SEQ ID NO: 1902743 - DNA, 15 bp, Homo sapiens
gtgggtgtgagcagc

SEQ ID NO: 1902744 - DNA, 12 bp, Homo sapiens
gtggtcagagag

SEQ ID NO: 1902745 - DNA, 13 bp, Homo sapiens
gtggtcagagagg

SEQ ID NO: 1902746 - DNA, 23 bp, Homo sapiens
gtggtcagagagggaagctgagg

SEQ ID NO: 1902747 - DNA, 15 bp, Homo sapiens
gtggtccatctctga

SEQ ID NO: 1902748 - DNA, 17 bp, Homo sapiens
gtggtccatctctgaaa

SEQ ID NO: 1902749 - DNA, 18 bp, Homo sapiens
gtgtaagaaatacagact

SEQ ID NO: 1902750 - DNA, 18 bp, Homo sapiens
gtgtctactctaggactg

SEQ ID NO: 1902751 - DNA, 23 bp, Homo sapiens
gtgtctactctaggactgggccc

SEQ ID NO: 1902752 - DNA, 15 bp, Homo sapiens
gtgtctatttctgaa

SEQ ID NO: 1902753 - DNA, 18 bp, Homo sapiens
gtgtctcctgtttcagac

SEQ ID NO: 1902754 - DNA, 17 bp, Homo sapiens
gtgtgaacttggaagca

SEQ ID NO: 1902755 - DNA, 16 bp, Homo sapiens
gtgtgaatgctgggcc

SEQ ID NO: 1902756 - DNA, 14 bp, Homo sapiens
gtgtgaggccacac

SEQ ID NO: 1902757 - DNA, 19 bp, Homo sapiens
gtgtggaaattaagaagaa

SEQ ID NO: 1902758 - DNA, 21 bp, Homo sapiens
gtgtgtaagatgtcttcctat

SEQ ID NO: 1902759 - DNA, 18 bp, Homo sapiens
gtgttaatttaagttttg

SEQ ID NO: 1902760 - DNA, 14 bp, Homo sapiens
gtgttatatgaaca

SEQ ID NO: 1902761 - DNA, 23 bp, Homo sapiens
gtgttatatgaacatacaaatgc

SEQ ID NO: 1902762 - DNA, 22 bp, Homo sapiens
gtgttatttatttctttctatt

SEQ ID NO: 1902763 - DNA, 16 bp, Homo sapiens
gtgttcattgcacaat

SEQ ID NO: 1902764 - DNA, 15 bp, Homo sapiens
gttacttcagccacc

SEQ ID NO: 1902765 - DNA, 22 bp, Homo sapiens
gttagactgccagctcttccta

SEQ ID NO: 1902766 - DNA, 20 bp, Homo sapiens
gttattttgatgtaaagatg

SEQ ID NO: 1902767 - DNA, 19 bp, Homo sapiens
gttatttttataagaaaac

SEQ ID NO: 1902768 - DNA, 20 bp, Homo sapiens
gttcaagaaatgaagagctg

SEQ ID NO: 1902769 - DNA, 14 bp, Homo sapiens
gttcaagatcaaaa

SEQ ID NO: 1902770 - DNA, 16 bp, Homo sapiens
gttcagtattgcaata

SEQ ID NO: 1902771 - DNA, 17 bp, Homo sapiens
gttccaaccactgaatc

SEQ ID NO: 1902772 - DNA, 18 bp, Homo sapiens
gttccatgcctgctctcg

SEQ ID NO: 1902773 - DNA, 12 bp, Homo sapiens
gttcccctggaa

SEQ ID NO: 1902774 - DNA, 21 bp, Homo sapiens
gttcccctggaagcagtgccc

SEQ ID NO: 1902775 - DNA, 16 bp, Homo sapiens
gttcctacacaggaca

SEQ ID NO: 1902776 - DNA, 17 bp, Homo sapiens
gttcctacacaggacag

SEQ ID NO: 1902777 - DNA, 18 bp, Homo sapiens
gttcctacacaggacagg

SEQ ID NO: 1902778 - DNA, 21 bp, Homo sapiens
gttccttctatacatgtttgc

SEQ ID NO: 1902779 - DNA, 15 bp, Homo sapiens
gttctgtatttgaaa

SEQ ID NO: 1902780 - DNA, 14 bp, Homo sapiens
gttctttaaactgt

SEQ ID NO: 1902781 - DNA, 22 bp, Homo sapiens
gttctttcatttgctttggaag

SEQ ID NO: 1902782 - DNA, 16 bp, Homo sapiens
gttgaagacaggggtc

SEQ ID NO: 1902783 - DNA, 13 bp, Homo sapiens
gttgaatatgatt

SEQ ID NO: 1902784 - DNA, 19 bp, Homo sapiens
gttgactctagtactgtga

SEQ ID NO: 1902785 - DNA, 21 bp, Homo sapiens
gttgactctagtactgtgaat

SEQ ID NO: 1902786 - DNA, 15 bp, Homo sapiens
gttgagctatgactt

SEQ ID NO: 1902787 - DNA, 23 bp, Homo sapiens
gttgagggcatttggcttcctct

SEQ ID NO: 1902788 - DNA, 23 bp, Homo sapiens
gttgataaggaacatttatccag

SEQ ID NO: 1902789 - DNA, 14 bp, Homo sapiens
gttgattaaagatg

SEQ ID NO: 1902790 - DNA, 15 bp, Homo sapiens
gttgcagctgtcacc

SEQ ID NO: 1902791 - DNA, 13 bp, Homo sapiens
gttgcccaggctg

SEQ ID NO: 1902792 - DNA, 13 bp, Homo sapiens
gttgctgattttg

SEQ ID NO: 1902793 - DNA, 20 bp, Homo sapiens
gttgctgattttgaccttgt

SEQ ID NO: 1902794 - DNA, 16 bp, Homo sapiens
gttggaatctgctcca

SEQ ID NO: 1902795 - DNA, 19 bp, Homo sapiens
gttggccaggctgctctca

SEQ ID NO: 1902796 - DNA, 16 bp, Homo sapiens
gttgggacccagtggc

SEQ ID NO: 1902797 - DNA, 23 bp, Homo sapiens
gttgtacttcatttctagagaaa

SEQ ID NO: 1902798 - DNA, 19 bp, Homo sapiens
gttgtataaatttatttac

SEQ ID NO: 1902799 - DNA, 12 bp, Homo sapiens
gttgtattcatt

SEQ ID NO: 1902800 - DNA, 22 bp, Homo sapiens
gttgtcaagaatagcattgtaa

SEQ ID NO: 1902801 - DNA, 14 bp, Homo sapiens
gttgtcaataaatg

SEQ ID NO: 1902802 - DNA, 21 bp, Homo sapiens
gttgtgatgaagctgaggctg

SEQ ID NO: 1902803 - DNA, 13 bp, Homo sapiens
gttgtggcaaccc

SEQ ID NO: 1902804 - DNA, 13 bp, Homo sapiens
gttgtttgtatgt

SEQ ID NO: 1902805 - DNA, 21 bp, Homo sapiens
gttgtttttgtatattggttt

SEQ ID NO: 1902806 - DNA, 17 bp, Homo sapiens
gtttaaaaatctgccac

SEQ ID NO: 1902807 - DNA, 18 bp, Homo sapiens
gtttaaaaatctgccacc

SEQ ID NO: 1902808 - DNA, 22 bp, Homo sapiens
gtttaaaaatctgccacctgca

SEQ ID NO: 1902809 - DNA, 21 bp, Homo sapiens
gtttaaagtgaatttttaaag

SEQ ID NO: 1902810 - DNA, 14 bp, Homo sapiens
gtttagaattgaag

SEQ ID NO: 1902811 - DNA, 18 bp, Homo sapiens
gtttcataagctttgtaa

SEQ ID NO: 1902812 - DNA, 21 bp, Homo sapiens
gtttccctatctgcaaaatgg

SEQ ID NO: 1902813 - DNA, 11 bp, Homo sapiens
gtttccctcca

SEQ ID NO: 1902814 - DNA, 19 bp, Homo sapiens
gtttctttctctgaggaca

SEQ ID NO: 1902815 - DNA, 16 bp, Homo sapiens
gtttgaaaatagttta

SEQ ID NO: 1902816 - DNA, 23 bp, Homo sapiens
gtttgaatatttaagcaataaaa

SEQ ID NO: 1902817 - DNA, 22 bp, Homo sapiens
gtttgcatttacgcctgtaaat

SEQ ID NO: 1902818 - DNA, 13 bp, Homo sapiens
gtttggttcaaat

SEQ ID NO: 1902819 - DNA, 15 bp, Homo sapiens
gtttgtaacaagaaa

SEQ ID NO: 1902820 - DNA, 14 bp, Homo sapiens
gtttgtttgtttca

SEQ ID NO: 1902821 - DNA, 19 bp, Homo sapiens
gttttaaacatagaaagtt

SEQ ID NO: 1902822 - DNA, 17 bp, Homo sapiens
gttttaacaagaagcaa

SEQ ID NO: 1902823 - DNA, 18 bp, Homo sapiens
gttttaaggactgactga

SEQ ID NO: 1902824 - DNA, 14 bp, Homo sapiens
gttttatttatatt

SEQ ID NO: 1902825 - DNA, 11 bp, Homo sapiens
gttttcacagt

SEQ ID NO: 1902826 - DNA, 14 bp, Homo sapiens
gttttctactgtta

SEQ ID NO: 1902827 - DNA, 15 bp, Homo sapiens
gttttctactttgaa

SEQ ID NO: 1902828 - DNA, 23 bp, Homo sapiens
gttttctactttgaaatatttaa

SEQ ID NO: 1902829 - DNA, 16 bp, Homo sapiens
gttttggaagtgatgt

SEQ ID NO: 1902830 - DNA, 18 bp, Homo sapiens
gttttgtatatgctgcat

SEQ ID NO: 1902831 - DNA, 20 bp, Homo sapiens
gttttgtatatgctgcattg

SEQ ID NO: 1902832 - DNA, 19 bp, Homo sapiens
gttttgtttcctttcactg

SEQ ID NO: 1902833 - DNA, 19 bp, Homo sapiens
gtttttagttctgactttg

SEQ ID NO: 1902834 - DNA, 20 bp, Homo sapiens
gtttttgaaggcagaaagca

SEQ ID NO: 1902835 - DNA, 19 bp, Homo sapiens
gtttttgatagcattgtaa

SEQ ID NO: 1902836 - DNA, 14 bp, Homo sapiens
gtttttgtatattg

SEQ ID NO: 1902837 - DNA, 9 bp, Homo sapiens
gttttttgt

SEQ ID NO: 1902838 - DNA, 15 bp, Homo sapiens
taaaaaaaagaaaaa

SEQ ID NO: 1902839 - DNA, 17 bp, Homo sapiens
taaaaaaaagaaaaaag

SEQ ID NO: 1902840 - DNA, 14 bp, Homo sapiens
taaaaacagtgcta

SEQ ID NO: 1902841 - DNA, 19 bp, Homo sapiens
taaaacagagtaatcttgt

SEQ ID NO: 1902842 - DNA, 20 bp, Homo sapiens
taaaacatcattccttttta

SEQ ID NO: 1902843 - DNA, 15 bp, Homo sapiens
taaaacattaaaata

SEQ ID NO: 1902844 - DNA, 16 bp, Homo sapiens
taaaacattaaaatat

SEQ ID NO: 1902845 - DNA, 16 bp, Homo sapiens
taaaaccaatcaataa

SEQ ID NO: 1902846 - DNA, 23 bp, Homo sapiens
taaaactgctcatttcatgaagc

SEQ ID NO: 1902847 - DNA, 16 bp, Homo sapiens
taaaactttgtagaca

SEQ ID NO: 1902848 - DNA, 22 bp, Homo sapiens
taaaactttgtagacattttga

SEQ ID NO: 1902849 - DNA, 17 bp, Homo sapiens
taaaagaaaataaaaaa

SEQ ID NO: 1902850 - DNA, 17 bp, Homo sapiens
taaaagaacagtaaaca

SEQ ID NO: 1902851 - DNA, 18 bp, Homo sapiens
taaaagaatctgatactt

SEQ ID NO: 1902852 - DNA, 12 bp, Homo sapiens
taaaagcccagg

SEQ ID NO: 1902853 - DNA, 17 bp, Homo sapiens
taaaagcccaggagccc

SEQ ID NO: 1902854 - DNA, 18 bp, Homo sapiens
taaaagcccaggagccca

SEQ ID NO: 1902855 - DNA, 13 bp, Homo sapiens
taaaaggcccaga

SEQ ID NO: 1902856 - DNA, 12 bp, Homo sapiens
taaaagtaaaca

SEQ ID NO: 1902857 - DNA, 14 bp, Homo sapiens
taaaagtaaacatt

SEQ ID NO: 1902858 - DNA, 20 bp, Homo sapiens
taaaagttgaccaatgaaat

SEQ ID NO: 1902859 - DNA, 16 bp, Homo sapiens
taaaataattttgtaa

SEQ ID NO: 1902860 - DNA, 21 bp, Homo sapiens
taaaataattttgtaatgtat

SEQ ID NO: 1902861 - DNA, 16 bp, Homo sapiens
taaaatgaagaattta

SEQ ID NO: 1902862 - DNA, 12 bp, Homo sapiens
taaaatgaattt

SEQ ID NO: 1902863 - DNA, 15 bp, Homo sapiens
taaaatgatcaaggc

SEQ ID NO: 1902864 - DNA, 19 bp, Homo sapiens
taaaatgtccagtaagatc

SEQ ID NO: 1902865 - DNA, 20 bp, Homo sapiens
taaaatgtccagtaagatca

SEQ ID NO: 1902866 - DNA, 19 bp, Homo sapiens
taaacagttatgaaaactt

SEQ ID NO: 1902867 - DNA, 21 bp, Homo sapiens
taaacagttttccttatcaga

SEQ ID NO: 1902868 - DNA, 13 bp, Homo sapiens
taaacgtggagaa

SEQ ID NO: 1902869 - DNA, 17 bp, Homo sapiens
taaactgtcgtgtcata

SEQ ID NO: 1902870 - DNA, 23 bp, Homo sapiens
taaagaattctttttacatctat

SEQ ID NO: 1902871 - DNA, 21 bp, Homo sapiens
taaagacaaagacatttcaaa

SEQ ID NO: 1902872 - DNA, 17 bp, Homo sapiens
taaagagaaccatgtgc

SEQ ID NO: 1902873 - DNA, 19 bp, Homo sapiens
taaagatgagctttgtcta

SEQ ID NO: 1902874 - DNA, 23 bp, Homo sapiens
taaagcatatccattcagaatga

SEQ ID NO: 1902875 - DNA, 14 bp, Homo sapiens
taaaggtggaaaat

SEQ ID NO: 1902876 - DNA, 17 bp, Homo sapiens
taaagtatactcttagg

SEQ ID NO: 1902877 - DNA, 16 bp, Homo sapiens
taaagtatttttataa

SEQ ID NO: 1902878 - DNA, 21 bp, Homo sapiens
taaagtatttttataatgact

SEQ ID NO: 1902879 - DNA, 21 bp, Homo sapiens
taaagtgaatttttaaagaca

SEQ ID NO: 1902880 - DNA, 17 bp, Homo sapiens
taaataattctttttta

SEQ ID NO: 1902881 - DNA, 19 bp, Homo sapiens
taaatattgttttgcattg

SEQ ID NO: 1902882 - DNA, 19 bp, Homo sapiens
taaatgaacacagctcttt

SEQ ID NO: 1902883 - DNA, 15 bp, Homo sapiens
taaattctgatttct

SEQ ID NO: 1902884 - DNA, 18 bp, Homo sapiens
taaattgtattctcataa

SEQ ID NO: 1902885 - DNA, 15 bp, Homo sapiens
taaatttatttactg

SEQ ID NO: 1902886 - DNA, 18 bp, Homo sapiens
taaatttatttactgcta

SEQ ID NO: 1902887 - DNA, 14 bp, Homo sapiens
taaattttgaaaag

SEQ ID NO: 1902888 - DNA, 15 bp, Homo sapiens
taaatttttttgtat

SEQ ID NO: 1902889 - DNA, 15 bp, Homo sapiens
taacaaaaaagagaa

SEQ ID NO: 1902890 - DNA, 15 bp, Homo sapiens
taacagcagtttcag

SEQ ID NO: 1902891 - DNA, 17 bp, Homo sapiens
taacataggcttataca

SEQ ID NO: 1902892 - DNA, 20 bp, Homo sapiens
taacatgggcaaaatggcta

SEQ ID NO: 1902893 - DNA, 23 bp, Homo sapiens
taacatggttcaggtacacatat

SEQ ID NO: 1902894 - DNA, 19 bp, Homo sapiens
taacatgtgaaaagaatag

SEQ ID NO: 1902895 - DNA, 20 bp, Homo sapiens
taactaaaataattttgtaa

SEQ ID NO: 1902896 - DNA, 17 bp, Homo sapiens
taactgcagaaaaaata

SEQ ID NO: 1902897 - DNA, 14 bp, Homo sapiens
taactgttcagtat

SEQ ID NO: 1902898 - DNA, 23 bp, Homo sapiens
taactgttcagtattgcaataaa

SEQ ID NO: 1902899 - DNA, 17 bp, Homo sapiens
taacttaataatcaaga

SEQ ID NO: 1902900 - DNA, 17 bp, Homo sapiens
taacttaccctgtatat

SEQ ID NO: 1902901 - DNA, 18 bp, Homo sapiens
taacttatattgtaagaa

SEQ ID NO: 1902902 - DNA, 20 bp, Homo sapiens
taacttatattgtaagaaat

SEQ ID NO: 1902903 - DNA, 17 bp, Homo sapiens
taagaacaaaagaagca

SEQ ID NO: 1902904 - DNA, 22 bp, Homo sapiens
taagaacaaagagaaaaaatac

SEQ ID NO: 1902905 - DNA, 19 bp, Homo sapiens
taagaactgctttctttcg

SEQ ID NO: 1902906 - DNA, 22 bp, Homo sapiens
taagaactgctttctttcgttt

SEQ ID NO: 1902907 - DNA, 15 bp, Homo sapiens
taagaggaggcagga

SEQ ID NO: 1902908 - DNA, 20 bp, Homo sapiens
taagaggaggcaggaggagc

SEQ ID NO: 1902909 - DNA, 20 bp, Homo sapiens
taagataattgtactttgaa

SEQ ID NO: 1902910 - DNA, 20 bp, Homo sapiens
taagatcactgtttagattt

SEQ ID NO: 1902911 - DNA, 12 bp, Homo sapiens
taagcaataaaa

SEQ ID NO: 1902912 - DNA, 19 bp, Homo sapiens
taagcactcctttaaagcc

SEQ ID NO: 1902913 - DNA, 17 bp, Homo sapiens
taagcatctaaggacaa

SEQ ID NO: 1902914 - DNA, 23 bp, Homo sapiens
taagcatctaaggacaaggtaag

SEQ ID NO: 1902915 - DNA, 17 bp, Homo sapiens
taagccaaaattaaggt

SEQ ID NO: 1902916 - DNA, 19 bp, Homo sapiens
taagccaaaattaaggtgt

SEQ ID NO: 1902917 - DNA, 17 bp, Homo sapiens
taagccatgagaatgtt

SEQ ID NO: 1902918 - DNA, 19 bp, Homo sapiens
taagccattctgactcata

SEQ ID NO: 1902919 - DNA, 20 bp, Homo sapiens
taagccttcgaaaagaaatt

SEQ ID NO: 1902920 - DNA, 22 bp, Homo sapiens
taagcgtatggctttatttttt

SEQ ID NO: 1902921 - DNA, 15 bp, Homo sapiens
taaggagacttctgt

SEQ ID NO: 1902922 - DNA, 16 bp, Homo sapiens
taaggagacttctgtc

SEQ ID NO: 1902923 - DNA, 18 bp, Homo sapiens
taaggccaatgggctaga

SEQ ID NO: 1902924 - DNA, 17 bp, Homo sapiens
taagggaacaagttgag

SEQ ID NO: 1902925 - DNA, 23 bp, Homo sapiens
taagggaacaagttgagctatga

SEQ ID NO: 1902926 - DNA, 12 bp, Homo sapiens
taaggtgtttga

SEQ ID NO: 1902927 - DNA, 15 bp, Homo sapiens
taaggtgtttgaaaa

SEQ ID NO: 1902928 - DNA, 17 bp, Homo sapiens
taaggtgtttgaaaata

SEQ ID NO: 1902929 - DNA, 17 bp, Homo sapiens
taaggttttttttgtac

SEQ ID NO: 1902930 - DNA, 14 bp, Homo sapiens
taagtagaggtggc

SEQ ID NO: 1902931 - DNA, 15 bp, Homo sapiens
taagtcataatgaat

SEQ ID NO: 1902932 - DNA, 16 bp, Homo sapiens
taagtggactctctga

SEQ ID NO: 1902933 - DNA, 18 bp, Homo sapiens
taagtggactctctgaca

SEQ ID NO: 1902934 - DNA, 20 bp, Homo sapiens
taagttagttccactgagac

SEQ ID NO: 1902935 - DNA, 16 bp, Homo sapiens
taagttggtaaagtat

SEQ ID NO: 1902936 - DNA, 21 bp, Homo sapiens
taagttttgacaagctggctt

SEQ ID NO: 1902937 - DNA, 22 bp, Homo sapiens
taataaaagtgccttagcatgt

SEQ ID NO: 1902938 - DNA, 13 bp, Homo sapiens
taataagacccca

SEQ ID NO: 1902939 - DNA, 12 bp, Homo sapiens
taataagctagt

SEQ ID NO: 1902940 - DNA, 21 bp, Homo sapiens
taataagctagttgaatactt

SEQ ID NO: 1902941 - DNA, 16 bp, Homo sapiens
taataataaagaatag

SEQ ID NO: 1902942 - DNA, 12 bp, Homo sapiens
taataatcaaga

SEQ ID NO: 1902943 - DNA, 14 bp, Homo sapiens
taataatcaagagc

SEQ ID NO: 1902944 - DNA, 19 bp, Homo sapiens
taataatcaagagccttaa

SEQ ID NO: 1902945 - DNA, 16 bp, Homo sapiens
taataccctgtacata

SEQ ID NO: 1902946 - DNA, 20 bp, Homo sapiens
taatactgaaccacttgtag

SEQ ID NO: 1902947 - DNA, 18 bp, Homo sapiens
taataggctctgcctgac

SEQ ID NO: 1902948 - DNA, 22 bp, Homo sapiens
taatagtatccagcacagattt

SEQ ID NO: 1902949 - DNA, 21 bp, Homo sapiens
taatagtcttgcagaaaatga

SEQ ID NO: 1902950 - DNA, 14 bp, Homo sapiens
taatatgaaatttt

SEQ ID NO: 1902951 - DNA, 18 bp, Homo sapiens
taatatgtttccttccct

SEQ ID NO: 1902952 - DNA, 18 bp, Homo sapiens
taatcaagagccttaaaa

SEQ ID NO: 1902953 - DNA, 23 bp, Homo sapiens
taatcaagagccttaaaacatca

SEQ ID NO: 1902954 - DNA, 10 bp, Homo sapiens
taatcactgt

SEQ ID NO: 1902955 - DNA, 15 bp, Homo sapiens
taatcactgtgtata

SEQ ID NO: 1902956 - DNA, 20 bp, Homo sapiens
taatcactgtgtatatttga

SEQ ID NO: 1902957 - DNA, 17 bp, Homo sapiens
taatcctagtttgctgt

SEQ ID NO: 1902958 - DNA, 17 bp, Homo sapiens
taatcggggtataatag

SEQ ID NO: 1902959 - DNA, 14 bp, Homo sapiens
taatctactgcatt

SEQ ID NO: 1902960 - DNA, 16 bp, Homo sapiens
taatctagttgtcaat

SEQ ID NO: 1902961 - DNA, 14 bp, Homo sapiens
taatgaataaacag

SEQ ID NO: 1902962 - DNA, 15 bp, Homo sapiens
taatgacaggcctgt

SEQ ID NO: 1902963 - DNA, 20 bp, Homo sapiens
taatgacaggcctgtccaac

SEQ ID NO: 1902964 - DNA, 20 bp, Homo sapiens
taatgactggtcttccttac

SEQ ID NO: 1902965 - DNA, 23 bp, Homo sapiens
taatgactggtcttccttacctg

SEQ ID NO: 1902966 - DNA, 15 bp, Homo sapiens
taatgatatgcttgt

SEQ ID NO: 1902967 - DNA, 16 bp, Homo sapiens
taatgatatgcttgta

SEQ ID NO: 1902968 - DNA, 13 bp, Homo sapiens
taatggatgaaat

SEQ ID NO: 1902969 - DNA, 15 bp, Homo sapiens
taatggatgaaatca

SEQ ID NO: 1902970 - DNA, 17 bp, Homo sapiens
taatggatgaaatcata

SEQ ID NO: 1902971 - DNA, 16 bp, Homo sapiens
taattcttttttatta

SEQ ID NO: 1902972 - DNA, 18 bp, Homo sapiens
taattcttttttattaat

SEQ ID NO: 1902973 - DNA, 19 bp, Homo sapiens
taattcttttttattaatc

SEQ ID NO: 1902974 - DNA, 20 bp, Homo sapiens
taattcttttttattaatca

SEQ ID NO: 1902975 - DNA, 15 bp, Homo sapiens
taattgaaagaatgt

SEQ ID NO: 1902976 - DNA, 16 bp, Homo sapiens
taattgtactttgaaa

SEQ ID NO: 1902977 - DNA, 19 bp, Homo sapiens
taattgtactttgaaaaca

SEQ ID NO: 1902978 - DNA, 12 bp, Homo sapiens
taattgtatttt

SEQ ID NO: 1902979 - DNA, 22 bp, Homo sapiens
taattgtgcaagcttttcctaa

SEQ ID NO: 1902980 - DNA, 19 bp, Homo sapiens
taattgtgtgaacttggaa

SEQ ID NO: 1902981 - DNA, 18 bp, Homo sapiens
taattgttgtttgtatgt

SEQ ID NO: 1902982 - DNA, 14 bp, Homo sapiens
taatttaagttttg

SEQ ID NO: 1902983 - DNA, 15 bp, Homo sapiens
taatttaagttttga

SEQ ID NO: 1902984 - DNA, 15 bp, Homo sapiens
taatttgtaagaata

SEQ ID NO: 1902985 - DNA, 17 bp, Homo sapiens
taatttgtggtgatttg

SEQ ID NO: 1902986 - DNA, 19 bp, Homo sapiens
taattttgtaatgtatcaa

SEQ ID NO: 1902987 - DNA, 12 bp, Homo sapiens
tacaaagctctg

SEQ ID NO: 1902988 - DNA, 23 bp, Homo sapiens
tacaaatgcctccaaagtattgt

SEQ ID NO: 1902989 - DNA, 15 bp, Homo sapiens
tacaagtagttctgt

SEQ ID NO: 1902990 - DNA, 13 bp, Homo sapiens
tacaatgacttta

SEQ ID NO: 1902991 - DNA, 18 bp, Homo sapiens
tacaatgactttattgca

SEQ ID NO: 1902992 - DNA, 14 bp, Homo sapiens
tacaccacaagtat

SEQ ID NO: 1902993 - DNA, 22 bp, Homo sapiens
tacactgaatttttatgtgtga

SEQ ID NO: 1902994 - DNA, 16 bp, Homo sapiens
tacactgcctgcctta

SEQ ID NO: 1902995 - DNA, 20 bp, Homo sapiens
tacactggcaatggtagttt

SEQ ID NO: 1902996 - DNA, 22 bp, Homo sapiens
tacactggcaatggtagtttct

SEQ ID NO: 1902997 - DNA, 24 bp, Homo sapiens
tacactggcaatggtagtttctgt

SEQ ID NO: 1902998 - DNA, 19 bp, Homo sapiens
tacagaccgaactgttgta

SEQ ID NO: 1902999 - DNA, 11 bp, Homo sapiens
tacagatgttt

SEQ ID NO: 1903000 - DNA, 21 bp, Homo sapiens
tacagatgttttccactgagc

SEQ ID NO: 1903001 - DNA, 16 bp, Homo sapiens
tacataactgataatt

SEQ ID NO: 1903002 - DNA, 20 bp, Homo sapiens
tacataatactgaaccactt

SEQ ID NO: 1903003 - DNA, 15 bp, Homo sapiens
tacatatcaaaacat

SEQ ID NO: 1903004 - DNA, 14 bp, Homo sapiens
tacatgcttgttga

SEQ ID NO: 1903005 - DNA, 13 bp, Homo sapiens
tacatgggactat

SEQ ID NO: 1903006 - DNA, 16 bp, Homo sapiens
tacattgtgaatgctg

SEQ ID NO: 1903007 - DNA, 19 bp, Homo sapiens
tacatttaaaacattaaaa

SEQ ID NO: 1903008 - DNA, 20 bp, Homo sapiens
tacatttaaaacattaaaat

SEQ ID NO: 1903009 - DNA, 14 bp, Homo sapiens
taccaactgggcct

SEQ ID NO: 1903010 - DNA, 19 bp, Homo sapiens
taccccaagcgccctggcc

SEQ ID NO: 1903011 - DNA, 15 bp, Homo sapiens
tacccctgcagctgg

SEQ ID NO: 1903012 - DNA, 20 bp, Homo sapiens
taccctgtacatatctttga

SEQ ID NO: 1903013 - DNA, 23 bp, Homo sapiens
taccctgtacatatctttgagtt

SEQ ID NO: 1903014 - DNA, 22 bp, Homo sapiens
taccgaggacagcctgcctctg

SEQ ID NO: 1903015 - DNA, 11 bp, Homo sapiens
tacctgcaccg

SEQ ID NO: 1903016 - DNA, 22 bp, Homo sapiens
tacctgtataatggagaattaa

SEQ ID NO: 1903017 - DNA, 16 bp, Homo sapiens
tacgaagttcaagatc

SEQ ID NO: 1903018 - DNA, 20 bp, Homo sapiens
tacgcctgtaaatgtattca

SEQ ID NO: 1903019 - DNA, 22 bp, Homo sapiens
tacggatcctgcactgactctg

SEQ ID NO: 1903020 - DNA, 23 bp, Homo sapiens
tacggatcctgcactgactctgg

SEQ ID NO: 1903021 - DNA, 16 bp, Homo sapiens
tacggcaagaaggcat

SEQ ID NO: 1903022 - DNA, 22 bp, Homo sapiens
tacgtaaaaatctctcatttgt

SEQ ID NO: 1903023 - DNA, 23 bp, Homo sapiens
tacgtttattaggaaaagatatt

SEQ ID NO: 1903024 - DNA, 17 bp, Homo sapiens
tactaaaaatagaaaaa

SEQ ID NO: 1903025 - DNA, 20 bp, Homo sapiens
tactaaggatacaggctgga

SEQ ID NO: 1903026 - DNA, 14 bp, Homo sapiens
tactacctgtaatg

SEQ ID NO: 1903027 - DNA, 14 bp, Homo sapiens
tactcacagccagc

SEQ ID NO: 1903028 - DNA, 23 bp, Homo sapiens
tactcggatgtgtcctttctgaa

SEQ ID NO: 1903029 - DNA, 12 bp, Homo sapiens
tactctgagctc

SEQ ID NO: 1903030 - DNA, 13 bp, Homo sapiens
tactctgagctca

SEQ ID NO: 1903031 - DNA, 13 bp, Homo sapiens
tactctgggaact

SEQ ID NO: 1903032 - DNA, 15 bp, Homo sapiens
tactgaaatgcttta

SEQ ID NO: 1903033 - DNA, 13 bp, Homo sapiens
tactgactgctta

SEQ ID NO: 1903034 - DNA, 16 bp, Homo sapiens
tactgataaagaaaga

SEQ ID NO: 1903035 - DNA, 17 bp, Homo sapiens
tactgcattcttctgat

SEQ ID NO: 1903036 - DNA, 15 bp, Homo sapiens
tactgcatttaggga

SEQ ID NO: 1903037 - DNA, 13 bp, Homo sapiens
tactgctttctga

SEQ ID NO: 1903038 - DNA, 15 bp, Homo sapiens
tactgctttctgaat

SEQ ID NO: 1903039 - DNA, 18 bp, Homo sapiens
tactgctttctgaatgta

SEQ ID NO: 1903040 - DNA, 22 bp, Homo sapiens
tactggccaaggctatttttca

SEQ ID NO: 1903041 - DNA, 14 bp, Homo sapiens
tactgtgactttat

SEQ ID NO: 1903042 - DNA, 21 bp, Homo sapiens
tacttgaaccataaaatgtcc

SEQ ID NO: 1903043 - DNA, 21 bp, Homo sapiens
tacttgataacaatgttttaa

SEQ ID NO: 1903044 - DNA, 21 bp, Homo sapiens
tacttgtattcctaactgttt

SEQ ID NO: 1903045 - DNA, 13 bp, Homo sapiens
tactttctgaaaa

SEQ ID NO: 1903046 - DNA, 22 bp, Homo sapiens
ctattacgaagttcaagatcaa

SEQ ID NO: 1903047 - DNA, 23 bp, Homo sapiens
ctattacgaagttcaagatcaaa

SEQ ID NO: 1903048 - DNA, 13 bp, Homo sapiens
ctattactgcaga

SEQ ID NO: 1903049 - DNA, 18 bp, Homo sapiens
ctattagtgttatatgaa

SEQ ID NO: 1903050 - DNA, 19 bp, Homo sapiens
ctattagtgttatatgaac

SEQ ID NO: 1903051 - DNA, 21 bp, Homo sapiens
ctatttaaagaaatatgtatt

SEQ ID NO: 1903052 - DNA, 15 bp, Homo sapiens
ctatttagacatgta

SEQ ID NO: 1903053 - DNA, 20 bp, Homo sapiens
ctatttataatgaataaaca

SEQ ID NO: 1903054 - DNA, 23 bp, Homo sapiens
ctatttcatcagaacagctgttg

SEQ ID NO: 1903055 - DNA, 13 bp, Homo sapiens
ctatttctgaaag

SEQ ID NO: 1903056 - DNA, 19 bp, Homo sapiens
ctatttttcagaactgtta

SEQ ID NO: 1903057 - DNA, 15 bp, Homo sapiens
ctcaaatccaggacc

SEQ ID NO: 1903058 - DNA, 20 bp, Homo sapiens
ctcaaatccaggaccctgcc

SEQ ID NO: 1903059 - DNA, 22 bp, Homo sapiens
ctcaaatccaggaccctgccag

SEQ ID NO: 1903060 - DNA, 22 bp, Homo sapiens
ctcaaattctccctaaagtgtt

SEQ ID NO: 1903061 - DNA, 14 bp, Homo sapiens
ctcacacacctctg

SEQ ID NO: 1903062 - DNA, 15 bp, Homo sapiens
ctcacacacctctgc

SEQ ID NO: 1903063 - DNA, 17 bp, Homo sapiens
ctcacacacctctgccc

SEQ ID NO: 1903064 - DNA, 16 bp, Homo sapiens
ctcacagacaggaccc

SEQ ID NO: 1903065 - DNA, 22 bp, Homo sapiens
ctcacagacaggacccctgcag

SEQ ID NO: 1903066 - DNA, 23 bp, Homo sapiens
ctcacagacaggacccctgcagt

SEQ ID NO: 1903067 - DNA, 16 bp, Homo sapiens
ctcacagctatgcaaa

SEQ ID NO: 1903068 - DNA, 16 bp, Homo sapiens
ctcaccatttccccag

SEQ ID NO: 1903069 - DNA, 19 bp, Homo sapiens
ctcaccatttccccagggc

SEQ ID NO: 1903070 - DNA, 22 bp, Homo sapiens
ctcacctgtcgcacccactgtg

SEQ ID NO: 1903071 - DNA, 13 bp, Homo sapiens
ctcactctcagga

SEQ ID NO: 1903072 - DNA, 15 bp, Homo sapiens
ctcactctcttcctt

SEQ ID NO: 1903073 - DNA, 22 bp, Homo sapiens
ctcagattgtaatatgtaaatg

SEQ ID NO: 1903074 - DNA, 16 bp, Homo sapiens
ctcagcaaggccacct

SEQ ID NO: 1903075 - DNA, 18 bp, Homo sapiens
ctcagcaaggccacctct

SEQ ID NO: 1903076 - DNA, 21 bp, Homo sapiens
ctcagcaaggccacctcttcc

SEQ ID NO: 1903077 - DNA, 15 bp, Homo sapiens
ctcagcattacctct

SEQ ID NO: 1903078 - DNA, 13 bp, Homo sapiens
ctcagccctctct

SEQ ID NO: 1903079 - DNA, 19 bp, Homo sapiens
ctcagctgtcaaggctcag

SEQ ID NO: 1903080 - DNA, 19 bp, Homo sapiens
ctcagcttccccagtagct

SEQ ID NO: 1903081 - DNA, 19 bp, Homo sapiens
ctcaggaaatgctgaccca

SEQ ID NO: 1903082 - DNA, 13 bp, Homo sapiens
ctcaggtctgagt

SEQ ID NO: 1903083 - DNA, 21 bp, Homo sapiens
ctcagtcggggcaggccaggg

SEQ ID NO: 1903084 - DNA, 22 bp, Homo sapiens
ctcagtcggggcaggccagggg

SEQ ID NO: 1903085 - DNA, 20 bp, Homo sapiens
ctcatatcccctatttaaca

SEQ ID NO: 1903086 - DNA, 20 bp, Homo sapiens
ctcatggcccatcaggggca

SEQ ID NO: 1903087 - DNA, 15 bp, Homo sapiens
ctcattcagcatctg

SEQ ID NO: 1903088 - DNA, 18 bp, Homo sapiens
ctcatttggggaccacag

SEQ ID NO: 1903089 - DNA, 21 bp, Homo sapiens
ctcatttggggaccacagagg

SEQ ID NO: 1903090 - DNA, 22 bp, Homo sapiens
ctcatttggggaccacagaggc

SEQ ID NO: 1903091 - DNA, 22 bp, Homo sapiens
ctccaaaccttactctgagctc

SEQ ID NO: 1903092 - DNA, 23 bp, Homo sapiens
ctccaacccctcgcccagtccca

SEQ ID NO: 1903093 - DNA, 18 bp, Homo sapiens
ctccaactggattataaa

SEQ ID NO: 1903094 - DNA, 19 bp, Homo sapiens
ctccaaggccaggccttgg

SEQ ID NO: 1903095 - DNA, 20 bp, Homo sapiens
ctccaaggccaggccttggg

SEQ ID NO: 1903096 - DNA, 21 bp, Homo sapiens
ctccaggtgttgttgagggca

SEQ ID NO: 1903097 - DNA, 11 bp, Homo sapiens
ctccatccctc

SEQ ID NO: 1903098 - DNA, 18 bp, Homo sapiens
ctccatccctctcctctg

SEQ ID NO: 1903099 - DNA, 21 bp, Homo sapiens
ctccatccctctcctctgccc

SEQ ID NO: 1903100 - DNA, 20 bp, Homo sapiens
ctccattcatacacaacgta

SEQ ID NO: 1903101 - DNA, 14 bp, Homo sapiens
ctcccaccctaccc

SEQ ID NO: 1903102 - DNA, 21 bp, Homo sapiens
ctcccaccctttctgccaggg

SEQ ID NO: 1903103 - DNA, 17 bp, Homo sapiens
ctcccactcccatggct

SEQ ID NO: 1903104 - DNA, 17 bp, Homo sapiens
ctcccacttctgccaga

SEQ ID NO: 1903105 - DNA, 19 bp, Homo sapiens
ctcccaggagcctgcccag

SEQ ID NO: 1903106 - DNA, 20 bp, Homo sapiens
ctcccagggagcaagggcag

SEQ ID NO: 1903107 - DNA, 17 bp, Homo sapiens
ctccccaccctgtccca

SEQ ID NO: 1903108 - DNA, 19 bp, Homo sapiens
ctccccaccctgtcccagg

SEQ ID NO: 1903109 - DNA, 20 bp, Homo sapiens
ctccccaccctgtcccaggc

SEQ ID NO: 1903110 - DNA, 14 bp, Homo sapiens
ctcccctggactcc

SEQ ID NO: 1903111 - DNA, 14 bp, Homo sapiens
ctccccttcccaga

SEQ ID NO: 1903112 - DNA, 15 bp, Homo sapiens
ctccccttcccagac

SEQ ID NO: 1903113 - DNA, 16 bp, Homo sapiens
ctccccttcccagacc

SEQ ID NO: 1903114 - DNA, 13 bp, Homo sapiens
ctccccttgccag

SEQ ID NO: 1903115 - DNA, 15 bp, Homo sapiens
ctccccttgccagct

SEQ ID NO: 1903116 - DNA, 15 bp, Homo sapiens
ctccctcactctcag

SEQ ID NO: 1903117 - DNA, 16 bp, Homo sapiens
ctccctcactctcagg

SEQ ID NO: 1903118 - DNA, 13 bp, Homo sapiens
ctccctcccctgc

SEQ ID NO: 1903119 - DNA, 15 bp, Homo sapiens
ctccctgacgtctgc

SEQ ID NO: 1903120 - DNA, 18 bp, Homo sapiens
ctccgccccgtcccccca

SEQ ID NO: 1903121 - DNA, 14 bp, Homo sapiens
ctcctaaataaatt

SEQ ID NO: 1903122 - DNA, 17 bp, Homo sapiens
ctcctcagccctctctt

SEQ ID NO: 1903123 - DNA, 18 bp, Homo sapiens
ctcctcagccctctcttg

SEQ ID NO: 1903124 - DNA, 14 bp, Homo sapiens
ctcctccctcccag

SEQ ID NO: 1903125 - DNA, 13 bp, Homo sapiens
ctcctcctccttt

SEQ ID NO: 1903126 - DNA, 14 bp, Homo sapiens
ctcctcctcctttc

SEQ ID NO: 1903127 - DNA, 12 bp, Homo sapiens
ctcctgagcccc

SEQ ID NO: 1903128 - DNA, 14 bp, Homo sapiens
ctcctgagccccca

SEQ ID NO: 1903129 - DNA, 19 bp, Homo sapiens
ctcctgagcccccagcttc

SEQ ID NO: 1903130 - DNA, 22 bp, Homo sapiens
ctcctgagcccccagcttccag

SEQ ID NO: 1903131 - DNA, 23 bp, Homo sapiens
ctcctgagcccccagcttccagc

SEQ ID NO: 1903132 - DNA, 16 bp, Homo sapiens
ctcctgcagcctgaga

SEQ ID NO: 1903133 - DNA, 14 bp, Homo sapiens
ctcctgccctccgc

SEQ ID NO: 1903134 - DNA, 22 bp, Homo sapiens
ctcctgccctccgccccgtccc

SEQ ID NO: 1903135 - DNA, 23 bp, Homo sapiens
ctcctgccctccgccccgtcccc

SEQ ID NO: 1903136 - DNA, 17 bp, Homo sapiens
ctcctgtttcagaccag

SEQ ID NO: 1903137 - DNA, 17 bp, Homo sapiens
ctcctttaccgaggaca

SEQ ID NO: 1903138 - DNA, 23 bp, Homo sapiens
ctcctttaccgaggacagcctgc

SEQ ID NO: 1903139 - DNA, 14 bp, Homo sapiens
ctcgcccagtccca

SEQ ID NO: 1903140 - DNA, 16 bp, Homo sapiens
ctcgcccagtcccagc

SEQ ID NO: 1903141 - DNA, 19 bp, Homo sapiens
ctcgcccagtcccagcagc

SEQ ID NO: 1903142 - DNA, 16 bp, Homo sapiens
ctcgctctgttgccca

SEQ ID NO: 1903143 - DNA, 13 bp, Homo sapiens
ctcggaactcccg

SEQ ID NO: 1903144 - DNA, 20 bp, Homo sapiens
ctcgtactctctctcttttc

SEQ ID NO: 1903145 - DNA, 15 bp, Homo sapiens
ctcgttcgctcgctc

SEQ ID NO: 1903146 - DNA, 13 bp, Homo sapiens
ctctaggactggg

SEQ ID NO: 1903147 - DNA, 18 bp, Homo sapiens
ctctagggaccagaacca

SEQ ID NO: 1903148 - DNA, 16 bp, Homo sapiens
ctctagtactgtgaat

SEQ ID NO: 1903149 - DNA, 12 bp, Homo sapiens
ctctagtgctgt

SEQ ID NO: 1903150 - DNA, 13 bp, Homo sapiens
ctctagtgctgtg

SEQ ID NO: 1903151 - DNA, 14 bp, Homo sapiens
ctctagtgctgtga

SEQ ID NO: 1903152 - DNA, 15 bp, Homo sapiens
ctctagtgctgtgaa

SEQ ID NO: 1903153 - DNA, 16 bp, Homo sapiens
ctctagtgctgtgaaa

SEQ ID NO: 1903154 - DNA, 23 bp, Homo sapiens
ctctatttagatgcatattactg

SEQ ID NO: 1903155 - DNA, 19 bp, Homo sapiens
ctctcaatgctgtttgggt

SEQ ID NO: 1903156 - DNA, 19 bp, Homo sapiens
ctctcaatttttggttgaa

SEQ ID NO: 1903157 - DNA, 17 bp, Homo sapiens
ctctcactctcttcctt

SEQ ID NO: 1903158 - DNA, 18 bp, Homo sapiens
ctctcactctcttccttt

SEQ ID NO: 1903159 - DNA, 19 bp, Homo sapiens
ctctcactctcttcctttc

SEQ ID NO: 1903160 - DNA, 21 bp, Homo sapiens
ctctcactctcttcctttcat

SEQ ID NO: 1903161 - DNA, 15 bp, Homo sapiens
ctctcagaggcccca

SEQ ID NO: 1903162 - DNA, 19 bp, Homo sapiens
ctctcaggaaatgctgacc

SEQ ID NO: 1903163 - DNA, 15 bp, Homo sapiens
ctctccatactttga

SEQ ID NO: 1903164 - DNA, 13 bp, Homo sapiens
ctctccatccctc

SEQ ID NO: 1903165 - DNA, 14 bp, Homo sapiens
ctctccccaccttc

SEQ ID NO: 1903166 - DNA, 17 bp, Homo sapiens
ctctccgcccctgagcc

SEQ ID NO: 1903167 - DNA, 14 bp, Homo sapiens
ctctctctcttttc

SEQ ID NO: 1903168 - DNA, 15 bp, Homo sapiens
ctctctctcttttcc

SEQ ID NO: 1903169 - DNA, 17 bp, Homo sapiens
ctctctgaaggaggcca

SEQ ID NO: 1903170 - DNA, 20 bp, Homo sapiens
ctctctgaaggaggccacct

SEQ ID NO: 1903171 - DNA, 12 bp, Homo sapiens
ctctctgacaaa

SEQ ID NO: 1903172 - DNA, 17 bp, Homo sapiens
ctctcttttccctcctt

SEQ ID NO: 1903173 - DNA, 18 bp, Homo sapiens
ctctcttttccctccttt

SEQ ID NO: 1903174 - DNA, 16 bp, Homo sapiens
ctctgaaaacaagaga

SEQ ID NO: 1903175 - DNA, 15 bp, Homo sapiens
ctctgaaggaggcca

SEQ ID NO: 1903176 - DNA, 19 bp, Homo sapiens
ctctgaaggaggccacctc

SEQ ID NO: 1903177 - DNA, 20 bp, Homo sapiens
ctctgaaggaggccacctcc

SEQ ID NO: 1903178 - DNA, 20 bp, Homo sapiens
ctctgaattcaggtcccagt

SEQ ID NO: 1903179 - DNA, 17 bp, Homo sapiens
ctctgactctgccaggg

SEQ ID NO: 1903180 - DNA, 19 bp, Homo sapiens
ctctgactctgccagggtg

SEQ ID NO: 1903181 - DNA, 19 bp, Homo sapiens
ctctgagctcattaataaa

SEQ ID NO: 1903182 - DNA, 14 bp, Homo sapiens
cctcagccctctct

SEQ ID NO: 1903183 - DNA, 16 bp, Homo sapiens
cctcagccctctcttg

SEQ ID NO: 1903184 - DNA, 15 bp, Homo sapiens
cctcagcttccccag

SEQ ID NO: 1903185 - DNA, 18 bp, Homo sapiens
cctcagtcggggcaggcc

SEQ ID NO: 1903186 - DNA, 21 bp, Homo sapiens
cctcagtcggggcaggccagg

SEQ ID NO: 1903187 - DNA, 19 bp, Homo sapiens
cctcagtttccctatctgc

SEQ ID NO: 1903188 - DNA, 20 bp, Homo sapiens
cctccaacccctcgcccagt

SEQ ID NO: 1903189 - DNA, 12 bp, Homo sapiens
cctccacctctg

SEQ ID NO: 1903190 - DNA, 13 bp, Homo sapiens
cctccacctctgt

SEQ ID NO: 1903191 - DNA, 15 bp, Homo sapiens
cctccacctctgtgc

SEQ ID NO: 1903192 - DNA, 22 bp, Homo sapiens
cctccacctctgtgcagggcac

SEQ ID NO: 1903193 - DNA, 20 bp, Homo sapiens
cctccagtaccttctgccag

SEQ ID NO: 1903194 - DNA, 15 bp, Homo sapiens
cctcccacagtgctg

SEQ ID NO: 1903195 - DNA, 14 bp, Homo sapiens
cctcccactcccat

SEQ ID NO: 1903196 - DNA, 15 bp, Homo sapiens
cctcccactcccatg

SEQ ID NO: 1903197 - DNA, 18 bp, Homo sapiens
cctcccactcccatggct

SEQ ID NO: 1903198 - DNA, 21 bp, Homo sapiens
cctcccagggagcaagggcag

SEQ ID NO: 1903199 - DNA, 13 bp, Homo sapiens
cctcccctccttt

SEQ ID NO: 1903200 - DNA, 12 bp, Homo sapiens
cctccccttccc

SEQ ID NO: 1903201 - DNA, 17 bp, Homo sapiens
cctccctgacgtctgcc

SEQ ID NO: 1903202 - DNA, 15 bp, Homo sapiens
cctcctaaaaggccc

SEQ ID NO: 1903203 - DNA, 12 bp, Homo sapiens
cctcctgccctc

SEQ ID NO: 1903204 - DNA, 13 bp, Homo sapiens
cctcgcccagtcc

SEQ ID NO: 1903205 - DNA, 15 bp, Homo sapiens
cctcgcccagtccca

SEQ ID NO: 1903206 - DNA, 16 bp, Homo sapiens
cctcgcccagtcccag

SEQ ID NO: 1903207 - DNA, 23 bp, Homo sapiens
cctcgcccagtcccagcagccag

SEQ ID NO: 1903208 - DNA, 14 bp, Homo sapiens
cctctccccacctt

SEQ ID NO: 1903209 - DNA, 18 bp, Homo sapiens
cctctccccaccttcttg

SEQ ID NO: 1903210 - DNA, 18 bp, Homo sapiens
cctctccgcccctgagcc

SEQ ID NO: 1903211 - DNA, 19 bp, Homo sapiens
cctctccgcccctgagccc

SEQ ID NO: 1903212 - DNA, 20 bp, Homo sapiens
cctctctgaaggaggccacc

SEQ ID NO: 1903213 - DNA, 22 bp, Homo sapiens
cctctctgaaggaggccacctc

SEQ ID NO: 1903214 - DNA, 23 bp, Homo sapiens
cctctctgaaggaggccacctcc

SEQ ID NO: 1903215 - DNA, 15 bp, Homo sapiens
cctctgatctgtgca

SEQ ID NO: 1903216 - DNA, 16 bp, Homo sapiens
cctctgccacagcaag

SEQ ID NO: 1903217 - DNA, 19 bp, Homo sapiens
cctctgccccttgggcctc

SEQ ID NO: 1903218 - DNA, 21 bp, Homo sapiens
cctctgccccttgggcctccc

SEQ ID NO: 1903219 - DNA, 22 bp, Homo sapiens
cctctgccccttgggcctccca

SEQ ID NO: 1903220 - DNA, 17 bp, Homo sapiens
cctctgccctctgctct

SEQ ID NO: 1903221 - DNA, 18 bp, Homo sapiens
cctctgccctctgctcta

SEQ ID NO: 1903222 - DNA, 11 bp, Homo sapiens
cctctgctcta

SEQ ID NO: 1903223 - DNA, 12 bp, Homo sapiens
cctctgctgcat

SEQ ID NO: 1903224 - DNA, 15 bp, Homo sapiens
cctctgctgcatccc

SEQ ID NO: 1903225 - DNA, 16 bp, Homo sapiens
cctctgctgcatcccc

SEQ ID NO: 1903226 - DNA, 14 bp, Homo sapiens
cctctgtgcagggc

SEQ ID NO: 1903227 - DNA, 23 bp, Homo sapiens
cctgaacccagaaacaacacaat

SEQ ID NO: 1903228 - DNA, 20 bp, Homo sapiens
cctgagatggatggacagac

SEQ ID NO: 1903229 - DNA, 22 bp, Homo sapiens
cctgagatggatggacagacag

SEQ ID NO: 1903230 - DNA, 13 bp, Homo sapiens
cctgagcccccag

SEQ ID NO: 1903231 - DNA, 15 bp, Homo sapiens
cctgaggggagacag

SEQ ID NO: 1903232 - DNA, 18 bp, Homo sapiens
cctgaggggagacagagc

SEQ ID NO: 1903233 - DNA, 19 bp, Homo sapiens
cctgattattttcagaagc

SEQ ID NO: 1903234 - DNA, 18 bp, Homo sapiens
cctgattcactgcctatg

SEQ ID NO: 1903235 - DNA, 21 bp, Homo sapiens
cctgcacttgggggctcagca

SEQ ID NO: 1903236 - DNA, 17 bp, Homo sapiens
cctgcagtcacccctgc

SEQ ID NO: 1903237 - DNA, 15 bp, Homo sapiens
cctgccaggcacagg

SEQ ID NO: 1903238 - DNA, 16 bp, Homo sapiens
cctgccaggcacaggc

SEQ ID NO: 1903239 - DNA, 20 bp, Homo sapiens
cctgccaggcacaggcaggg

SEQ ID NO: 1903240 - DNA, 20 bp, Homo sapiens
cctgcccctaactcctgcct

SEQ ID NO: 1903241 - DNA, 18 bp, Homo sapiens
cctgcctctccgcccctg

SEQ ID NO: 1903242 - DNA, 11 bp, Homo sapiens
cctgcctctgc

SEQ ID NO: 1903243 - DNA, 14 bp, Homo sapiens
cctgcctctgccac

SEQ ID NO: 1903244 - DNA, 18 bp, Homo sapiens
cctgcctctgccacagca

SEQ ID NO: 1903245 - DNA, 14 bp, Homo sapiens
cctgccttaagtga

SEQ ID NO: 1903246 - DNA, 16 bp, Homo sapiens
cctgcggggcagcagg

SEQ ID NO: 1903247 - DNA, 21 bp, Homo sapiens
cctgctacttgagggccagga

SEQ ID NO: 1903248 - DNA, 21 bp, Homo sapiens
cctgctcgatgctcacagggc

SEQ ID NO: 1903249 - DNA, 21 bp, Homo sapiens
cctgctgaccataacagtgcc

SEQ ID NO: 1903250 - DNA, 13 bp, Homo sapiens
cctgcttggccca

SEQ ID NO: 1903251 - DNA, 13 bp, Homo sapiens
cctggaaaaacat

SEQ ID NO: 1903252 - DNA, 15 bp, Homo sapiens
cctggaagcagtgcc

SEQ ID NO: 1903253 - DNA, 20 bp, Homo sapiens
cctggaagcagtgcccaggt

SEQ ID NO: 1903254 - DNA, 13 bp, Homo sapiens
cctggaccccagc

SEQ ID NO: 1903255 - DNA, 15 bp, Homo sapiens
cctggagctcaagcc

SEQ ID NO: 1903256 - DNA, 22 bp, Homo sapiens
cctggcagcccgcatcagctgc

SEQ ID NO: 1903257 - DNA, 21 bp, Homo sapiens
cctggcccatgtatggccagg

SEQ ID NO: 1903258 - DNA, 21 bp, Homo sapiens
cctggctccctcactctcagg

SEQ ID NO: 1903259 - DNA, 14 bp, Homo sapiens
cctgggccagggcg

SEQ ID NO: 1903260 - DNA, 19 bp, Homo sapiens
cctgggccagggcgtggag

SEQ ID NO: 1903261 - DNA, 13 bp, Homo sapiens
cctgggcctggct

SEQ ID NO: 1903262 - DNA, 15 bp, Homo sapiens
cctgggcctggctcc

SEQ ID NO: 1903263 - DNA, 16 bp, Homo sapiens
cctgggcctggctccc

SEQ ID NO: 1903264 - DNA, 19 bp, Homo sapiens
cctgggcctggctccctca

SEQ ID NO: 1903265 - DNA, 12 bp, Homo sapiens
cctggggcatcc

SEQ ID NO: 1903266 - DNA, 21 bp, Homo sapiens
cctgggttagactgccagctc

SEQ ID NO: 1903267 - DNA, 13 bp, Homo sapiens
cctggtctttgag

SEQ ID NO: 1903268 - DNA, 18 bp, Homo sapiens
cctgtaatcccagcactt

SEQ ID NO: 1903269 - DNA, 23 bp, Homo sapiens
cctgtaattgttgtttgtatgta

SEQ ID NO: 1903270 - DNA, 19 bp, Homo sapiens
cctgtcccaggcagcgcca

SEQ ID NO: 1903271 - DNA, 22 bp, Homo sapiens
cctgtgtgacatcacagggcct

SEQ ID NO: 1903272 - DNA, 13 bp, Homo sapiens
cctgtgttaattt

SEQ ID NO: 1903273 - DNA, 19 bp, Homo sapiens
ccttaagtgaggaaatcaa

SEQ ID NO: 1903274 - DNA, 13 bp, Homo sapiens
ccttacctggaaa

SEQ ID NO: 1903275 - DNA, 14 bp, Homo sapiens
ccttacctggaaaa

SEQ ID NO: 1903276 - DNA, 13 bp, Homo sapiens
ccttactctgagc

SEQ ID NO: 1903277 - DNA, 19 bp, Homo sapiens
ccttagatgtgtctcctgt

SEQ ID NO: 1903278 - DNA, 18 bp, Homo sapiens
ccttagcatgtgttgcag

SEQ ID NO: 1903279 - DNA, 21 bp, Homo sapiens
ccttagcatgtgttgcagctg

SEQ ID NO: 1903280 - DNA, 23 bp, Homo sapiens
ccttagcatgtgttgcagctgtc

SEQ ID NO: 1903281 - DNA, 12 bp, Homo sapiens
ccttccagctcc

SEQ ID NO: 1903282 - DNA, 19 bp, Homo sapiens
ccttccagctccctcccct

SEQ ID NO: 1903283 - DNA, 21 bp, Homo sapiens
ccttccagctccctcccctgc

SEQ ID NO: 1903284 - DNA, 22 bp, Homo sapiens
ccttccagtggcttctcccaac

SEQ ID NO: 1903285 - DNA, 16 bp, Homo sapiens
ccttccatctcttcct

SEQ ID NO: 1903286 - DNA, 17 bp, Homo sapiens
ccttccatctcttcctt

SEQ ID NO: 1903287 - DNA, 18 bp, Homo sapiens
ccttcccagaccccgcag

SEQ ID NO: 1903288 - DNA, 22 bp, Homo sapiens
ccttcgaaaagaaattgtcctt

SEQ ID NO: 1903289 - DNA, 20 bp, Homo sapiens
ccttcgtgacaatgtttaca

SEQ ID NO: 1903290 - DNA, 23 bp, Homo sapiens
ccttctatacatgtttgcagtgt

SEQ ID NO: 1903291 - DNA, 19 bp, Homo sapiens
ccttctatagcatcactta

SEQ ID NO: 1903292 - DNA, 21 bp, Homo sapiens
ccttctatagcatcacttaaa

SEQ ID NO: 1903293 - DNA, 19 bp, Homo sapiens
ccttctatgcccagctgtg

SEQ ID NO: 1903294 - DNA, 20 bp, Homo sapiens
ccttctctctcaatttttgg

SEQ ID NO: 1903295 - DNA, 22 bp, Homo sapiens
ccttctttttccctttcctttc

SEQ ID NO: 1903296 - DNA, 14 bp, Homo sapiens
ccttgaagcttgta

SEQ ID NO: 1903297 - DNA, 19 bp, Homo sapiens
ccttgattcccttgttatt

SEQ ID NO: 1903298 - DNA, 23 bp, Homo sapiens
ccttgccagctgctgagccgcag

SEQ ID NO: 1903299 - DNA, 20 bp, Homo sapiens
ccttggcttggccctggcag

SEQ ID NO: 1903300 - DNA, 17 bp, Homo sapiens
ccttgggcctcccactc

SEQ ID NO: 1903301 - DNA, 23 bp, Homo sapiens
ccttgggcctcccactcccatgg

SEQ ID NO: 1903302 - DNA, 12 bp, Homo sapiens
ccttggttcctg

SEQ ID NO: 1903303 - DNA, 19 bp, Homo sapiens
ccttgtattgaagttaact

SEQ ID NO: 1903304 - DNA, 21 bp, Homo sapiens
ccttgtatttagtaagtgctt

SEQ ID NO: 1903305 - DNA, 22 bp, Homo sapiens
cctttaccgaggacagcctgcc

SEQ ID NO: 1903306 - DNA, 11 bp, Homo sapiens
cctttcctttc

SEQ ID NO: 1903307 - DNA, 13 bp, Homo sapiens
cctttcctttcat

SEQ ID NO: 1903308 - DNA, 12 bp, Homo sapiens
cctttcctttcc

SEQ ID NO: 1903309 - DNA, 11 bp, Homo sapiens
cctttcctttt

SEQ ID NO: 1903310 - DNA, 16 bp, Homo sapiens
cctttctgatcttcac

SEQ ID NO: 1903311 - DNA, 15 bp, Homo sapiens
cctttgactttctgt

SEQ ID NO: 1903312 - DNA, 19 bp, Homo sapiens
cctttgattagagaccaga

SEQ ID NO: 1903313 - DNA, 15 bp, Homo sapiens
cctttgctgtagtgt

SEQ ID NO: 1903314 - DNA, 12 bp, Homo sapiens
ccttttctttcc

SEQ ID NO: 1903315 - DNA, 20 bp, Homo sapiens
cctttttatttatatgtatg

SEQ ID NO: 1903316 - DNA, 13 bp, Homo sapiens
cctttttgcttga

SEQ ID NO: 1903317 - DNA, 18 bp, Homo sapiens
cgaaagaaaactctattt

SEQ ID NO: 1903318 - DNA, 12 bp, Homo sapiens
cgaaagaggcac

SEQ ID NO: 1903319 - DNA, 23 bp, Homo sapiens
cgaaagaggcacccttccatctg

SEQ ID NO: 1903320 - DNA, 15 bp, Homo sapiens
cgaaatccctgctca

SEQ ID NO: 1903321 - DNA, 22 bp, Homo sapiens
cgaaatccctgctcactgcagc

SEQ ID NO: 1903322 - DNA, 13 bp, Homo sapiens
cgaaatggctgaa

SEQ ID NO: 1903323 - DNA, 21 bp, Homo sapiens
cgaactgggcatatttctaat

SEQ ID NO: 1903324 - DNA, 14 bp, Homo sapiens
cgaatcatttgttc

SEQ ID NO: 1903325 - DNA, 15 bp, Homo sapiens
cgaccagcaggctcc

SEQ ID NO: 1903326 - DNA, 21 bp, Homo sapiens
cgaccagcaggctcctcagcc

SEQ ID NO: 1903327 - DNA, 21 bp, Homo sapiens
cgagcagacacccttggagct

SEQ ID NO: 1903328 - DNA, 13 bp, Homo sapiens
cgagcagggcagg

SEQ ID NO: 1903329 - DNA, 16 bp, Homo sapiens
cgagctcggggctggg

SEQ ID NO: 1903330 - DNA, 18 bp, Homo sapiens
cgaggacagcctgcctct

SEQ ID NO: 1903331 - DNA, 21 bp, Homo sapiens
cgaggacagcctgcctctgcc

SEQ ID NO: 1903332 - DNA, 12 bp, Homo sapiens
cgaggctgggct

SEQ ID NO: 1903333 - DNA, 21 bp, Homo sapiens
cgagggtggtttacctgcacc

SEQ ID NO: 1903334 - DNA, 20 bp, Homo sapiens
cgagtgccgcatctcacagc

SEQ ID NO: 1903335 - DNA, 15 bp, Homo sapiens
cgatcacaaatgact

SEQ ID NO: 1903336 - DNA, 17 bp, Homo sapiens
cgatcacaaatgacttt

SEQ ID NO: 1903337 - DNA, 19 bp, Homo sapiens
cgatcacaaatgactttat

SEQ ID NO: 1903338 - DNA, 21 bp, Homo sapiens
cgatcacaaatgactttatta

SEQ ID NO: 1903339 - DNA, 23 bp, Homo sapiens
cgattctttgaagagatgacaac

SEQ ID NO: 1903340 - DNA, 18 bp, Homo sapiens
cgcaagggaggcccagcg

SEQ ID NO: 1903341 - DNA, 23 bp, Homo sapiens
cgcaattctcgattctttgaaga

SEQ ID NO: 1903342 - DNA, 17 bp, Homo sapiens
cgcagtcgtcagcctcc

SEQ ID NO: 1903343 - DNA, 16 bp, Homo sapiens
cgcatcagctgctcag

SEQ ID NO: 1903344 - DNA, 15 bp, Homo sapiens
cgccaccacacccaa

SEQ ID NO: 1903345 - DNA, 14 bp, Homo sapiens
cgcccagtcccagc

SEQ ID NO: 1903346 - DNA, 18 bp, Homo sapiens
cgcccccactcctcctcc

SEQ ID NO: 1903347 - DNA, 16 bp, Homo sapiens
cgccccgtccccccat

SEQ ID NO: 1903348 - DNA, 12 bp, Homo sapiens
cgcccctgagcc

SEQ ID NO: 1903349 - DNA, 14 bp, Homo sapiens
cgccctggccccca

SEQ ID NO: 1903350 - DNA, 17 bp, Homo sapiens
cgccctggcccccacat

SEQ ID NO: 1903351 - DNA, 21 bp, Homo sapiens
cgccggcaataaaagcccagg

SEQ ID NO: 1903352 - DNA, 22 bp, Homo sapiens
cgccggcaataaaagcccagga

SEQ ID NO: 1903353 - DNA, 21 bp, Homo sapiens
cgcctccaacccctcgcccag

SEQ ID NO: 1903354 - DNA, 14 bp, Homo sapiens
cgcctctccccacc

SEQ ID NO: 1903355 - DNA, 18 bp, Homo sapiens
cgcctctccccaccttct

SEQ ID NO: 1903356 - DNA, 15 bp, Homo sapiens
cgcctgtaaatgtat

SEQ ID NO: 1903357 - DNA, 17 bp, Homo sapiens
cgcggacatcccctgct

SEQ ID NO: 1903358 - DNA, 16 bp, Homo sapiens
cgcggatttctctttc

SEQ ID NO: 1903359 - DNA, 22 bp, Homo sapiens
cgcggatttctctttctctctc

SEQ ID NO: 1903360 - DNA, 22 bp, Homo sapiens
cgctacatttccgccacatccc

SEQ ID NO: 1903361 - DNA, 20 bp, Homo sapiens
cgctactatgatttaatttg

SEQ ID NO: 1903362 - DNA, 18 bp, Homo sapiens
cgctcattcagcatctga

SEQ ID NO: 1903363 - DNA, 13 bp, Homo sapiens
cgctgtctccctc

SEQ ID NO: 1903364 - DNA, 17 bp, Homo sapiens
cgcttaaggtggaaagt

SEQ ID NO: 1903365 - DNA, 18 bp, Homo sapiens
cgctttatgcccttgcct

SEQ ID NO: 1903366 - DNA, 16 bp, Homo sapiens
cggaaggcgctggagc

SEQ ID NO: 1903367 - DNA, 17 bp, Homo sapiens
cggatcaggctcccagg

SEQ ID NO: 1903368 - DNA, 19 bp, Homo sapiens
cggatttctctttctctct

SEQ ID NO: 1903369 - DNA, 20 bp, Homo sapiens
cggatttctctttctctctc

SEQ ID NO: 1903370 - DNA, 17 bp, Homo sapiens
cggcaataaaagcccag

SEQ ID NO: 1903371 - DNA, 19 bp, Homo sapiens
cggcaataaaagcccagga

SEQ ID NO: 1903372 - DNA, 13 bp, Homo sapiens
cggcatgaggccc

SEQ ID NO: 1903373 - DNA, 14 bp, Homo sapiens
cggcatgaggcccc

SEQ ID NO: 1903374 - DNA, 13 bp, Homo sapiens
cggccctcccagg

SEQ ID NO: 1903375 - DNA, 14 bp, Homo sapiens
cggccctcccaggc

SEQ ID NO: 1903376 - DNA, 15 bp, Homo sapiens
cggccctcccaggcg

SEQ ID NO: 1903377 - DNA, 15 bp, Homo sapiens
cgggcatcattctct

SEQ ID NO: 1903378 - DNA, 17 bp, Homo sapiens
cgggctgttctggtggc

SEQ ID NO: 1903379 - DNA, 16 bp, Homo sapiens
cggggcaggccagggg

SEQ ID NO: 1903380 - DNA, 19 bp, Homo sapiens
cggggctgggggctgcagg

SEQ ID NO: 1903381 - DNA, 21 bp, Homo sapiens
cggggctgggggctgcagggc

SEQ ID NO: 1903382 - DNA, 23 bp, Homo sapiens
cggtctcggatcaggctcccagg

SEQ ID NO: 1903383 - DNA, 20 bp, Homo sapiens
cggtgtgggggccccgtctc

SEQ ID NO: 1903384 - DNA, 15 bp, Homo sapiens
cgtacataatactga

SEQ ID NO: 1903385 - DNA, 14 bp, Homo sapiens
cgtactaaggatac

SEQ ID NO: 1903386 - DNA, 15 bp, Homo sapiens
cgtcagcctccctga

SEQ ID NO: 1903387 - DNA, 17 bp, Homo sapiens
cgtcagcctccctgacg

SEQ ID NO: 1903388 - DNA, 11 bp, Homo sapiens
cgtccccccat

SEQ ID NO: 1903389 - DNA, 14 bp, Homo sapiens
cgtccccccatccc

SEQ ID NO: 1903390 - DNA, 18 bp, Homo sapiens
cgtctgccaccagcgccc

SEQ ID NO: 1903391 - DNA, 19 bp, Homo sapiens
cgtgaagatactttgtatt

SEQ ID NO: 1903392 - DNA, 17 bp, Homo sapiens
cgtgacaatgtttacaa

SEQ ID NO: 1903393 - DNA, 20 bp, Homo sapiens
cgtggagaatcacaggctgg

SEQ ID NO: 1903394 - DNA, 14 bp, Homo sapiens
cgtgtcagggctga

SEQ ID NO: 1903395 - DNA, 21 bp, Homo sapiens
cgttaaaaacagatttggaaa

SEQ ID NO: 1903396 - DNA, 15 bp, Homo sapiens
cgtttactcacagcc

SEQ ID NO: 1903397 - DNA, 23 bp, Homo sapiens
cgtttattaggaaaagatatttt

SEQ ID NO: 1903398 - DNA, 16 bp, Homo sapiens
cgttttaaggactgac

SEQ ID NO: 1903399 - DNA, 21 bp, Homo sapiens
ctaaaagaagcatctctgacc

SEQ ID NO: 1903400 - DNA, 15 bp, Homo sapiens
ctaaaagtaaacatt

SEQ ID NO: 1903401 - DNA, 15 bp, Homo sapiens
ctaaaattttttcct

SEQ ID NO: 1903402 - DNA, 17 bp, Homo sapiens
ctaaacattatttttct

SEQ ID NO: 1903403 - DNA, 16 bp, Homo sapiens
ctaaagcctcaaaaca

SEQ ID NO: 1903404 - DNA, 22 bp, Homo sapiens
ctaactgttttgtatatgctgc

SEQ ID NO: 1903405 - DNA, 16 bp, Homo sapiens
ctaagaggaggcagga

SEQ ID NO: 1903406 - DNA, 15 bp, Homo sapiens
ctaaggccaatgggc

SEQ ID NO: 1903407 - DNA, 19 bp, Homo sapiens
ctaaggccaatgggctaga

SEQ ID NO: 1903408 - DNA, 17 bp, Homo sapiens
ctaaggggcccctcctt

SEQ ID NO: 1903409 - DNA, 14 bp, Homo sapiens
ctaaggtaagaacg

SEQ ID NO: 1903410 - DNA, 22 bp, Homo sapiens
ctaatatccacttgtccatgtg

SEQ ID NO: 1903411 - DNA, 14 bp, Homo sapiens
ctaatcttgtgaaa

SEQ ID NO: 1903412 - DNA, 15 bp, Homo sapiens
ctaattctatgcctg

SEQ ID NO: 1903413 - DNA, 23 bp, Homo sapiens
ctacagtaagctggtttacagat

SEQ ID NO: 1903414 - DNA, 19 bp, Homo sapiens
ctacatgcttgttgacaga

SEQ ID NO: 1903415 - DNA, 14 bp, Homo sapiens
ctaccctgatcacc

SEQ ID NO: 1903416 - DNA, 21 bp, Homo sapiens
ctacgtttactcacagccagc

SEQ ID NO: 1903417 - DNA, 18 bp, Homo sapiens
ctactctaggactgggcc

SEQ ID NO: 1903418 - DNA, 17 bp, Homo sapiens
ctactgataaagaaaga

SEQ ID NO: 1903419 - DNA, 14 bp, Homo sapiens
ctactgttatgtga

SEQ ID NO: 1903420 - DNA, 17 bp, Homo sapiens
ctactgttatgtgagaa

SEQ ID NO: 1903421 - DNA, 12 bp, Homo sapiens
ctactttgaaat

SEQ ID NO: 1903422 - DNA, 22 bp, Homo sapiens
ctagaagatcacagcagggcct

SEQ ID NO: 1903423 - DNA, 15 bp, Homo sapiens
ctagaggctggcaag

SEQ ID NO: 1903424 - DNA, 18 bp, Homo sapiens
ctagattattgaattctt

SEQ ID NO: 1903425 - DNA, 19 bp, Homo sapiens
ctagcatttcccaacacaa

SEQ ID NO: 1903426 - DNA, 23 bp, Homo sapiens
ctagcctcacgctcctttctgat

SEQ ID NO: 1903427 - DNA, 14 bp, Homo sapiens
ctaggactgggccc

SEQ ID NO: 1903428 - DNA, 17 bp, Homo sapiens
ctaggattataatgctg

SEQ ID NO: 1903429 - DNA, 19 bp, Homo sapiens
ctaggattataatgctgcc

SEQ ID NO: 1903430 - DNA, 17 bp, Homo sapiens
ctagggagccctgggcc

SEQ ID NO: 1903431 - DNA, 20 bp, Homo sapiens
ctagggagccctgggccagg

SEQ ID NO: 1903432 - DNA, 12 bp, Homo sapiens
ctaggtctgata

SEQ ID NO: 1903433 - DNA, 14 bp, Homo sapiens
ctagtactgtgaat

SEQ ID NO: 1903434 - DNA, 16 bp, Homo sapiens
ctagtattctttatta

SEQ ID NO: 1903435 - DNA, 20 bp, Homo sapiens
ctagtcaacagtaccctggt

SEQ ID NO: 1903436 - DNA, 14 bp, Homo sapiens
ctagtgctgtgaaa

SEQ ID NO: 1903437 - DNA, 17 bp, Homo sapiens
ctagtgctgtgaaaaaa

SEQ ID NO: 1903438 - DNA, 13 bp, Homo sapiens
ctagttgaatact

SEQ ID NO: 1903439 - DNA, 17 bp, Homo sapiens
ctagttgaatacttgaa

SEQ ID NO: 1903440 - DNA, 20 bp, Homo sapiens
ctagttgaatacttgaacca

SEQ ID NO: 1903441 - DNA, 23 bp, Homo sapiens
ctagttgaatacttgaaccataa

SEQ ID NO: 1903442 - DNA, 13 bp, Homo sapiens
ctagttgtcaata

SEQ ID NO: 1903443 - DNA, 16 bp, Homo sapiens
ctagttgtcaataaat

SEQ ID NO: 1903444 - DNA, 16 bp, Homo sapiens
ctataattttgatagt

SEQ ID NO: 1903445 - DNA, 23 bp, Homo sapiens
ctatacatgtttgcagtgttaag

SEQ ID NO: 1903446 - DNA, 14 bp, Homo sapiens
ctatgaacagacca

SEQ ID NO: 1903447 - DNA, 21 bp, Homo sapiens
ctatgagaattgggattacat

SEQ ID NO: 1903448 - DNA, 20 bp, Homo sapiens
ctatgatttaatttgaaata

SEQ ID NO: 1903449 - DNA, 14 bp, Homo sapiens
ctatgcaaaaagct

SEQ ID NO: 1903450 - DNA, 22 bp, Homo sapiens
ctatgcccagctgtgctgggag

SEQ ID NO: 1903451 - DNA, 11 bp, Homo sapiens
ctatggtctta

SEQ ID NO: 1903452 - DNA, 17 bp, Homo sapiens
ctatggtcttatattta

SEQ ID NO: 1903453 - DNA, 16 bp, Homo sapiens
ctatgtattctgggta

SEQ ID NO: 1903454 - DNA, 22 bp, Homo sapiens
ctattaagtatgtcaacagcca

SEQ ID NO: 1903455 - DNA, 18 bp, Homo sapiens
ctattacgaagttcaaga

SEQ ID NO: 1903456 - DNA, 20 bp, Homo sapiens
cctaggcttggctcctttca

SEQ ID NO: 1903457 - DNA, 15 bp, Homo sapiens
cctattagtgttata

SEQ ID NO: 1903458 - DNA, 16 bp, Homo sapiens
cctattagtgttatat

SEQ ID NO: 1903459 - DNA, 23 bp, Homo sapiens
cctcaaatccaggaccctgccag

SEQ ID NO: 1903460 - DNA, 24 bp, Homo sapiens
cctcaaatccaggaccctgccagg

SEQ ID NO: 1903461 - DNA, 15 bp, Homo sapiens
cctcacacacctctg

SEQ ID NO: 1903462 - DNA, 18 bp, Homo sapiens
cctcacacacctctgccc

SEQ ID NO: 1903463 - DNA, 12 bp, Homo sapiens
cctcagccctct

SEQ ID NO: 1903464 - DNA, 22 bp, Homo sapiens
ctgcatttagggagtattctaa

SEQ ID NO: 1903465 - DNA, 19 bp, Homo sapiens
ctgccacaaggaagaaatt

SEQ ID NO: 1903466 - DNA, 14 bp, Homo sapiens
ctgccaccagcgcc

SEQ ID NO: 1903467 - DNA, 17 bp, Homo sapiens
ctgccaccagcgccccc

SEQ ID NO: 1903468 - DNA, 18 bp, Homo sapiens
ctgccaccagcgccccca

SEQ ID NO: 1903469 - DNA, 21 bp, Homo sapiens
ctgccaccagcgcccccactc

SEQ ID NO: 1903470 - DNA, 22 bp, Homo sapiens
ctgccaccagcgcccccactcc

SEQ ID NO: 1903471 - DNA, 19 bp, Homo sapiens
ctgccagctcttcctagct

SEQ ID NO: 1903472 - DNA, 21 bp, Homo sapiens
ctgccagctcttcctagctgg

SEQ ID NO: 1903473 - DNA, 13 bp, Homo sapiens
ctgccaggcacag

SEQ ID NO: 1903474 - DNA, 18 bp, Homo sapiens
ctgccaggcacaggcagg

SEQ ID NO: 1903475 - DNA, 19 bp, Homo sapiens
ctgccaggcccggcatgag

SEQ ID NO: 1903476 - DNA, 12 bp, Homo sapiens
ctgccagggatg

SEQ ID NO: 1903477 - DNA, 16 bp, Homo sapiens
ctgccagggatggcag

SEQ ID NO: 1903478 - DNA, 18 bp, Homo sapiens
ctgccagggatggcagtg

SEQ ID NO: 1903479 - DNA, 21 bp, Homo sapiens
ctgccagggatggcagtggct

SEQ ID NO: 1903480 - DNA, 18 bp, Homo sapiens
ctgccagggtggggctct

SEQ ID NO: 1903481 - DNA, 13 bp, Homo sapiens
ctgccagttttgt

SEQ ID NO: 1903482 - DNA, 19 bp, Homo sapiens
ctgccccccagcctaggct

SEQ ID NO: 1903483 - DNA, 16 bp, Homo sapiens
ctgccccttgggcctc

SEQ ID NO: 1903484 - DNA, 20 bp, Homo sapiens
ctgccccttgggcctcccac

SEQ ID NO: 1903485 - DNA, 23 bp, Homo sapiens
ctgccccttgggcctcccactcc

SEQ ID NO: 1903486 - DNA, 19 bp, Homo sapiens
ctgcctatgaacagaccat

SEQ ID NO: 1903487 - DNA, 20 bp, Homo sapiens
ctgcctatgacacagaagcc

SEQ ID NO: 1903488 - DNA, 21 bp, Homo sapiens
ctgcctcattttcacagcact

SEQ ID NO: 1903489 - DNA, 12 bp, Homo sapiens
ctgcctctgcca

SEQ ID NO: 1903490 - DNA, 17 bp, Homo sapiens
ctgcctctgccacagca

SEQ ID NO: 1903491 - DNA, 20 bp, Homo sapiens
ctgcctgccttaagtgagga

SEQ ID NO: 1903492 - DNA, 22 bp, Homo sapiens
ctgcctgccttaagtgaggaaa

SEQ ID NO: 1903493 - DNA, 15 bp, Homo sapiens
ctgcctgctgaccat

SEQ ID NO: 1903494 - DNA, 15 bp, Homo sapiens
ctgcgtcataaggag

SEQ ID NO: 1903495 - DNA, 18 bp, Homo sapiens
ctgcgtcataaggagact

SEQ ID NO: 1903496 - DNA, 23 bp, Homo sapiens
ctgctcaagtctaccctgatcac

SEQ ID NO: 1903497 - DNA, 17 bp, Homo sapiens
ctgctcctgagccccca

SEQ ID NO: 1903498 - DNA, 18 bp, Homo sapiens
ctgctcctgagcccccag

SEQ ID NO: 1903499 - DNA, 20 bp, Homo sapiens
ctgctcctgagcccccagct

SEQ ID NO: 1903500 - DNA, 23 bp, Homo sapiens
ctgctctcaaacccctgacctca

SEQ ID NO: 1903501 - DNA, 20 bp, Homo sapiens
ctgctgaccataacagtgcc

SEQ ID NO: 1903502 - DNA, 17 bp, Homo sapiens
ctgctgacccctgtgtg

SEQ ID NO: 1903503 - DNA, 15 bp, Homo sapiens
ctgctgagccgcaga

SEQ ID NO: 1903504 - DNA, 13 bp, Homo sapiens
ctgctgcatcccc

SEQ ID NO: 1903505 - DNA, 18 bp, Homo sapiens
ctgctgcatccccttcca

SEQ ID NO: 1903506 - DNA, 11 bp, Homo sapiens
ctgctgccagg

SEQ ID NO: 1903507 - DNA, 15 bp, Homo sapiens
ctgctgctgacccct

SEQ ID NO: 1903508 - DNA, 16 bp, Homo sapiens
ctgctgctgacccctg

SEQ ID NO: 1903509 - DNA, 17 bp, Homo sapiens
ctgctgctgacccctgt

SEQ ID NO: 1903510 - DNA, 21 bp, Homo sapiens
ctgctgtatcttccagaacct

SEQ ID NO: 1903511 - DNA, 20 bp, Homo sapiens
ctgctgtgaacatgcctcct

SEQ ID NO: 1903512 - DNA, 22 bp, Homo sapiens
ctgctgtgaacatgcctcctcc

SEQ ID NO: 1903513 - DNA, 16 bp, Homo sapiens
ctgcttataaacattt

SEQ ID NO: 1903514 - DNA, 20 bp, Homo sapiens
ctgcttcctataattttgat

SEQ ID NO: 1903515 - DNA, 14 bp, Homo sapiens
ctgcttggcccagg

SEQ ID NO: 1903516 - DNA, 15 bp, Homo sapiens
ctgcttggcccaggg

SEQ ID NO: 1903517 - DNA, 14 bp, Homo sapiens
ctggaaaggccagc

SEQ ID NO: 1903518 - DNA, 16 bp, Homo sapiens
ctggaagcagtgccca

SEQ ID NO: 1903519 - DNA, 18 bp, Homo sapiens
ctggacaccccacgggag

SEQ ID NO: 1903520 - DNA, 12 bp, Homo sapiens
ctggaccccagc

SEQ ID NO: 1903521 - DNA, 13 bp, Homo sapiens
ctggagaaaaata

SEQ ID NO: 1903522 - DNA, 22 bp, Homo sapiens
ctggagcctgcggggcagcagg

SEQ ID NO: 1903523 - DNA, 14 bp, Homo sapiens
ctggagtctctctc

SEQ ID NO: 1903524 - DNA, 20 bp, Homo sapiens
ctggattgtagaacttgttg

SEQ ID NO: 1903525 - DNA, 20 bp, Homo sapiens
ctggcaaatgcacacacctc

SEQ ID NO: 1903526 - DNA, 22 bp, Homo sapiens
ctggcaaatgcacacacctcat

SEQ ID NO: 1903527 - DNA, 17 bp, Homo sapiens
ctggcaagaaaagagtt

SEQ ID NO: 1903528 - DNA, 20 bp, Homo sapiens
ctggcaagaaccagttgttt

SEQ ID NO: 1903529 - DNA, 15 bp, Homo sapiens
ctggcacagcctgca

SEQ ID NO: 1903530 - DNA, 16 bp, Homo sapiens
ctggcaccagcaggca

SEQ ID NO: 1903531 - DNA, 19 bp, Homo sapiens
ctggcagcccgcatcagct

SEQ ID NO: 1903532 - DNA, 20 bp, Homo sapiens
ctggcaggggatccagctca

SEQ ID NO: 1903533 - DNA, 21 bp, Homo sapiens
ctggcatggtggttgggaccc

SEQ ID NO: 1903534 - DNA, 21 bp, Homo sapiens
ctggccagggaggagccccag

SEQ ID NO: 1903535 - DNA, 21 bp, Homo sapiens
ctggcccatgtatggccagga

SEQ ID NO: 1903536 - DNA, 13 bp, Homo sapiens
ctggcccccacat

SEQ ID NO: 1903537 - DNA, 16 bp, Homo sapiens
ctggcctcagggctct

SEQ ID NO: 1903538 - DNA, 14 bp, Homo sapiens
ctggcgggccctgg

SEQ ID NO: 1903539 - DNA, 16 bp, Homo sapiens
ctggctctacacatat

SEQ ID NO: 1903540 - DNA, 21 bp, Homo sapiens
ctgggagggcggagaattctt

SEQ ID NO: 1903541 - DNA, 17 bp, Homo sapiens
ctgggaggtcccagggc

SEQ ID NO: 1903542 - DNA, 20 bp, Homo sapiens
ctgggaggtcccagggccct

SEQ ID NO: 1903543 - DNA, 23 bp, Homo sapiens
ctgggaggtcccagggccctaga

SEQ ID NO: 1903544 - DNA, 17 bp, Homo sapiens
ctgggcactgctctcac

SEQ ID NO: 1903545 - DNA, 18 bp, Homo sapiens
ctgggcactgctctcacc

SEQ ID NO: 1903546 - DNA, 16 bp, Homo sapiens
ctgggcagcttgggct

SEQ ID NO: 1903547 - DNA, 15 bp, Homo sapiens
ctgggcctccacctc

SEQ ID NO: 1903548 - DNA, 20 bp, Homo sapiens
ctgggcctccacctctgtgc

SEQ ID NO: 1903549 - DNA, 12 bp, Homo sapiens
ctgggctggcca

SEQ ID NO: 1903550 - DNA, 15 bp, Homo sapiens
ctgggggacactgtg

SEQ ID NO: 1903551 - DNA, 19 bp, Homo sapiens
ctgggggacactgtggcag

SEQ ID NO: 1903552 - DNA, 20 bp, Homo sapiens
ctgggggacactgtggcagc

SEQ ID NO: 1903553 - DNA, 14 bp, Homo sapiens
ctgggggctgcagg

SEQ ID NO: 1903554 - DNA, 17 bp, Homo sapiens
ctgggggctgcagggct

SEQ ID NO: 1903555 - DNA, 15 bp, Homo sapiens
ctgggtagctgtaag

SEQ ID NO: 1903556 - DNA, 13 bp, Homo sapiens
ctgggtattctat

SEQ ID NO: 1903557 - DNA, 21 bp, Homo sapiens
ctgggtcaggggtacacagag

SEQ ID NO: 1903558 - DNA, 22 bp, Homo sapiens
ctgggtcaggggtacacagagc

SEQ ID NO: 1903559 - DNA, 16 bp, Homo sapiens
ctgggttagactgcca

SEQ ID NO: 1903560 - DNA, 18 bp, Homo sapiens
ctgggttagactgccagc

SEQ ID NO: 1903561 - DNA, 21 bp, Homo sapiens
ctgggttagactgccagctct

SEQ ID NO: 1903562 - DNA, 23 bp, Homo sapiens
ctgggttagactgccagctcttc

SEQ ID NO: 1903563 - DNA, 16 bp, Homo sapiens
ctgggttcatttgtga

SEQ ID NO: 1903564 - DNA, 15 bp, Homo sapiens
ctggtaaaatgaaga

SEQ ID NO: 1903565 - DNA, 17 bp, Homo sapiens
ctggtaaaatgaagaat

SEQ ID NO: 1903566 - DNA, 22 bp, Homo sapiens
ctggtaaaatgaagaatttaaa

SEQ ID NO: 1903567 - DNA, 20 bp, Homo sapiens
ctggtcttccttacctggaa

SEQ ID NO: 1903568 - DNA, 12 bp, Homo sapiens
ctggtctttgag

SEQ ID NO: 1903569 - DNA, 13 bp, Homo sapiens
ctggtggcccctt

SEQ ID NO: 1903570 - DNA, 15 bp, Homo sapiens
ctggtggccccttct

SEQ ID NO: 1903571 - DNA, 14 bp, Homo sapiens
ctgtaaaagaaaaa

SEQ ID NO: 1903572 - DNA, 16 bp, Homo sapiens
ctgtaaatgtattcat

SEQ ID NO: 1903573 - DNA, 18 bp, Homo sapiens
ctgtaaatgtattcattc

SEQ ID NO: 1903574 - DNA, 17 bp, Homo sapiens
ctgtaaggcatgaagga

SEQ ID NO: 1903575 - DNA, 16 bp, Homo sapiens
ctgtaatcccagcact

SEQ ID NO: 1903576 - DNA, 15 bp, Homo sapiens
ctgtacaatgacttt

SEQ ID NO: 1903577 - DNA, 15 bp, Homo sapiens
ctgtacatgggacta

SEQ ID NO: 1903578 - DNA, 14 bp, Homo sapiens
ctgtagcctgaaga

SEQ ID NO: 1903579 - DNA, 13 bp, Homo sapiens
ctgtaggcctcag

SEQ ID NO: 1903580 - DNA, 18 bp, Homo sapiens
ctgtatatatttttctta

SEQ ID NO: 1903581 - DNA, 21 bp, Homo sapiens
ctgtatatcagggtacaaaaa

SEQ ID NO: 1903582 - DNA, 21 bp, Homo sapiens
ctgtatttgaaagtgcctttg

SEQ ID NO: 1903583 - DNA, 19 bp, Homo sapiens
ctgtcacttgcattccact

SEQ ID NO: 1903584 - DNA, 14 bp, Homo sapiens
ctgtcagaatattc

SEQ ID NO: 1903585 - DNA, 22 bp, Homo sapiens
ctgtcatgatacgcttaaggtg

SEQ ID NO: 1903586 - DNA, 20 bp, Homo sapiens
ctgtccattcggaaccaggc

SEQ ID NO: 1903587 - DNA, 21 bp, Homo sapiens
ctgtccatttttattcagggg

SEQ ID NO: 1903588 - DNA, 22 bp, Homo sapiens
ctgtcccaggcagcgccactgt

SEQ ID NO: 1903589 - DNA, 19 bp, Homo sapiens
ctgtccgctgtctccctcc

SEQ ID NO: 1903590 - DNA, 23 bp, Homo sapiens
ctgtctcccaccctttctgccag

SEQ ID NO: 1903591 - DNA, 15 bp, Homo sapiens
ctgtctccctcctga

SEQ ID NO: 1903592 - DNA, 15 bp, Homo sapiens
ctgtctggccaggga

SEQ ID NO: 1903593 - DNA, 18 bp, Homo sapiens
ctgtctgttgtattcatt

SEQ ID NO: 1903594 - DNA, 14 bp, Homo sapiens
ctgtcttaattttc

SEQ ID NO: 1903595 - DNA, 17 bp, Homo sapiens
ctgtgaacatgcctcct

SEQ ID NO: 1903596 - DNA, 18 bp, Homo sapiens
ctgtgaacatgcctcctc

SEQ ID NO: 1903597 - DNA, 15 bp, Homo sapiens
ctgtgcagggcacag

SEQ ID NO: 1903598 - DNA, 22 bp, Homo sapiens
ctgtgcgtggggctcccgcctc

SEQ ID NO: 1903599 - DNA, 22 bp, Homo sapiens
ctgtgctgggaggtcccagggc

SEQ ID NO: 1903600 - DNA, 22 bp, Homo sapiens
ctgtggagactgctcctgagcc

SEQ ID NO: 1903601 - DNA, 20 bp, Homo sapiens
ctgtggcagcaggagggact

SEQ ID NO: 1903602 - DNA, 16 bp, Homo sapiens
ctgtggtcagagaggg

SEQ ID NO: 1903603 - DNA, 18 bp, Homo sapiens
ctgtggttggctgggaaa

SEQ ID NO: 1903604 - DNA, 12 bp, Homo sapiens
ctgtgtaaaatc

SEQ ID NO: 1903605 - DNA, 15 bp, Homo sapiens
ctgtgtaccactggg

SEQ ID NO: 1903606 - DNA, 12 bp, Homo sapiens
ctgtgtatattt

SEQ ID NO: 1903607 - DNA, 16 bp, Homo sapiens
ctgtgttaatttaagt

SEQ ID NO: 1903608 - DNA, 15 bp, Homo sapiens
ctgttagtattgatt

SEQ ID NO: 1903609 - DNA, 15 bp, Homo sapiens
ctgttccccttggta

SEQ ID NO: 1903610 - DNA, 11 bp, Homo sapiens
ctgttgactct

SEQ ID NO: 1903611 - DNA, 22 bp, Homo sapiens
ctgttgactctagtactgtgaa

SEQ ID NO: 1903612 - DNA, 14 bp, Homo sapiens
ctgttgcccaggct

SEQ ID NO: 1903613 - DNA, 16 bp, Homo sapiens
ctgtttcagaggctca

SEQ ID NO: 1903614 - DNA, 19 bp, Homo sapiens
ctgttttgtatatgctgca

SEQ ID NO: 1903615 - DNA, 20 bp, Homo sapiens
ctgttttgtatatgctgcat

SEQ ID NO: 1903616 - DNA, 19 bp, Homo sapiens
ctgtttttcttctgaaata

SEQ ID NO: 1903617 - DNA, 13 bp, Homo sapiens
cttaaaacatcat

SEQ ID NO: 1903618 - DNA, 23 bp, Homo sapiens
cttaaaataaaacactgtttccc

SEQ ID NO: 1903619 - DNA, 22 bp, Homo sapiens
cttaaatgcaaccatttgaaac

SEQ ID NO: 1903620 - DNA, 21 bp, Homo sapiens
cttaactggactgaattcaaa

SEQ ID NO: 1903621 - DNA, 21 bp, Homo sapiens
cttaactgttcagtattgcaa

SEQ ID NO: 1903622 - DNA, 18 bp, Homo sapiens
cttaagtgaggaaatcaa

SEQ ID NO: 1903623 - DNA, 21 bp, Homo sapiens
cttaagttagttccactgaga

SEQ ID NO: 1903624 - DNA, 21 bp, Homo sapiens
cttaataatcaagagccttaa

SEQ ID NO: 1903625 - DNA, 14 bp, Homo sapiens
cttaatggatgaaa

SEQ ID NO: 1903626 - DNA, 16 bp, Homo sapiens
cttaatttatgtaagg

SEQ ID NO: 1903627 - DNA, 23 bp, Homo sapiens
cttacaaagggtctatcttgtaa

SEQ ID NO: 1903628 - DNA, 21 bp, Homo sapiens
cttacactggcaatggtagtt

SEQ ID NO: 1903629 - DNA, 20 bp, Homo sapiens
cttactctgagctcattaat

SEQ ID NO: 1903630 - DNA, 20 bp, Homo sapiens
cttactgtgttaaaattttt

SEQ ID NO: 1903631 - DNA, 15 bp, Homo sapiens
cttactttgtaaatt

SEQ ID NO: 1903632 - DNA, 16 bp, Homo sapiens
cttagaaactcaggaa

SEQ ID NO: 1903633 - DNA, 20 bp, Homo sapiens
cttataaaacagagtaatct

SEQ ID NO: 1903634 - DNA, 23 bp, Homo sapiens
cttataaacatttaaagacaaag

SEQ ID NO: 1903635 - DNA, 17 bp, Homo sapiens
gtaagctggtttacaga

SEQ ID NO: 1903636 - DNA, 13 bp, Homo sapiens
gtaagtgcttgtt

SEQ ID NO: 1903637 - DNA, 16 bp, Homo sapiens
gtaagtgcttgtttta

SEQ ID NO: 1903638 - DNA, 12 bp, Homo sapiens
gtaataataaag

SEQ ID NO: 1903639 - DNA, 13 bp, Homo sapiens
gtaatatttatta

SEQ ID NO: 1903640 - DNA, 15 bp, Homo sapiens
gtaatatttattaaa

SEQ ID NO: 1903641 - DNA, 16 bp, Homo sapiens
gtaatatttattaaat

SEQ ID NO: 1903642 - DNA, 18 bp, Homo sapiens
gtaatatttattaaattt

SEQ ID NO: 1903643 - DNA, 17 bp, Homo sapiens
gtaatcttgttggttca

SEQ ID NO: 1903644 - DNA, 17 bp, Homo sapiens
gtaatgtatacttgaaa

SEQ ID NO: 1903645 - DNA, 19 bp, Homo sapiens
gtaattgttgtttgtatgt

SEQ ID NO: 1903646 - DNA, 14 bp, Homo sapiens
gtaattttgtgtaa

SEQ ID NO: 1903647 - DNA, 16 bp, Homo sapiens
gtaattttgtgtaaga

SEQ ID NO: 1903648 - DNA, 15 bp, Homo sapiens
gtacaagtagttctg

SEQ ID NO: 1903649 - DNA, 20 bp, Homo sapiens
gtacaatgactttattgcat

SEQ ID NO: 1903650 - DNA, 21 bp, Homo sapiens
gtacaatgactttattgcatc

SEQ ID NO: 1903651 - DNA, 15 bp, Homo sapiens
gtacacagagctaag

SEQ ID NO: 1903652 - DNA, 13 bp, Homo sapiens
gtacagatatgca

SEQ ID NO: 1903653 - DNA, 15 bp, Homo sapiens
gtacataatactgaa

SEQ ID NO: 1903654 - DNA, 18 bp, Homo sapiens
gtacatactgaaaaatac

SEQ ID NO: 1903655 - DNA, 21 bp, Homo sapiens
gtacgactcttttccaaacac

SEQ ID NO: 1903656 - DNA, 19 bp, Homo sapiens
gtactgtctcggcagaggt

SEQ ID NO: 1903657 - DNA, 21 bp, Homo sapiens
gtactgtctcggcagaggtgg

SEQ ID NO: 1903658 - DNA, 23 bp, Homo sapiens
gtactttctgaaaatttatataa

SEQ ID NO: 1903659 - DNA, 13 bp, Homo sapiens
gtactttgaaaac

SEQ ID NO: 1903660 - DNA, 15 bp, Homo sapiens
gtagaactttgtata

SEQ ID NO: 1903661 - DNA, 15 bp, Homo sapiens
gtagacggaacagtg

SEQ ID NO: 1903662 - DNA, 23 bp, Homo sapiens
gtagagacagggtttcaccatgt

SEQ ID NO: 1903663 - DNA, 12 bp, Homo sapiens
gtagagtctgag

SEQ ID NO: 1903664 - DNA, 14 bp, Homo sapiens
gtagagtctgaggg

SEQ ID NO: 1903665 - DNA, 21 bp, Homo sapiens
gtagagtctgagggcttgtag

SEQ ID NO: 1903666 - DNA, 22 bp, Homo sapiens
gtagattccatttactgcattc

SEQ ID NO: 1903667 - DNA, 21 bp, Homo sapiens
gtagatttatttcatcatatt

SEQ ID NO: 1903668 - DNA, 14 bp, Homo sapiens
gtagcacaggctga

SEQ ID NO: 1903669 - DNA, 21 bp, Homo sapiens
gtagccacctgagttcctgag

SEQ ID NO: 1903670 - DNA, 16 bp, Homo sapiens
gtagccatgaggaggc

SEQ ID NO: 1903671 - DNA, 20 bp, Homo sapiens
gtagctgtaaggcatgaagg

SEQ ID NO: 1903672 - DNA, 19 bp, Homo sapiens
gtaggaaaaataaaaacag

SEQ ID NO: 1903673 - DNA, 21 bp, Homo sapiens
gtaggggggtttcagggctga

SEQ ID NO: 1903674 - DNA, 22 bp, Homo sapiens
gtagtatgataggttattttga

SEQ ID NO: 1903675 - DNA, 15 bp, Homo sapiens
gtagttcaagaaatg

SEQ ID NO: 1903676 - DNA, 19 bp, Homo sapiens
gtagttcaagaaatgaaga

SEQ ID NO: 1903677 - DNA, 15 bp, Homo sapiens
gtagttctgtatttg

SEQ ID NO: 1903678 - DNA, 17 bp, Homo sapiens
gtagttctttaaactgt

SEQ ID NO: 1903679 - DNA, 14 bp, Homo sapiens
gtataaatttattt

SEQ ID NO: 1903680 - DNA, 19 bp, Homo sapiens
gtataatggagaattaaaa

SEQ ID NO: 1903681 - DNA, 14 bp, Homo sapiens
gtatagttatgtaa

SEQ ID NO: 1903682 - DNA, 15 bp, Homo sapiens
gtatagttatgtaaa

SEQ ID NO: 1903683 - DNA, 18 bp, Homo sapiens
gtatagttatgtaaataa

SEQ ID NO: 1903684 - DNA, 13 bp, Homo sapiens
gtatattggtttt

SEQ ID NO: 1903685 - DNA, 19 bp, Homo sapiens
gtatattggttttatgatg

SEQ ID NO: 1903686 - DNA, 17 bp, Homo sapiens
gtatatttgatttatta

SEQ ID NO: 1903687 - DNA, 23 bp, Homo sapiens
gtatatttgatttattaacttaa

SEQ ID NO: 1903688 - DNA, 19 bp, Homo sapiens
gtatcaacacacattttaa

SEQ ID NO: 1903689 - DNA, 19 bp, Homo sapiens
gtatctgatatcagcactg

SEQ ID NO: 1903690 - DNA, 20 bp, Homo sapiens
gtatgaaaacatggaacagt

SEQ ID NO: 1903691 - DNA, 24 bp, Homo sapiens
gtatgataggttattttgatgtaa

SEQ ID NO: 1903692 - DNA, 13 bp, Homo sapiens
gtatgatctgtgt

SEQ ID NO: 1903693 - DNA, 19 bp, Homo sapiens
gtatgatctgtgtaaaatc

SEQ ID NO: 1903694 - DNA, 22 bp, Homo sapiens
gtatggctttatttttttgaac

SEQ ID NO: 1903695 - DNA, 15 bp, Homo sapiens
gtatgtataattcaa

SEQ ID NO: 1903696 - DNA, 18 bp, Homo sapiens
gtatgtgtttagaattga

SEQ ID NO: 1903697 - DNA, 19 bp, Homo sapiens
gtattctaataagctagtt

SEQ ID NO: 1903698 - DNA, 15 bp, Homo sapiens
gtatttgatgtattc

SEQ ID NO: 1903699 - DNA, 13 bp, Homo sapiens
gtatttgtttaat

SEQ ID NO: 1903700 - DNA, 16 bp, Homo sapiens
gtcaaaagtagaactt

SEQ ID NO: 1903701 - DNA, 23 bp, Homo sapiens
gtcaaaagtagaactttgtatag

SEQ ID NO: 1903702 - DNA, 21 bp, Homo sapiens
gtcaagaatagcattgtaaaa

SEQ ID NO: 1903703 - DNA, 21 bp, Homo sapiens
gtcaccactacagtaagctgg

SEQ ID NO: 1903704 - DNA, 17 bp, Homo sapiens
gtcactggggcccaaga

SEQ ID NO: 1903705 - DNA, 22 bp, Homo sapiens
gtcactggggcccaagagtctg

SEQ ID NO: 1903706 - DNA, 22 bp, Homo sapiens
gtcactgggggacactgtggca

SEQ ID NO: 1903707 - DNA, 11 bp, Homo sapiens
gtcacttttag

SEQ ID NO: 1903708 - DNA, 14 bp, Homo sapiens
gtcagcagttgctg

SEQ ID NO: 1903709 - DNA, 12 bp, Homo sapiens
gtcagcctccct

SEQ ID NO: 1903710 - DNA, 13 bp, Homo sapiens
gtcagcctccctg

SEQ ID NO: 1903711 - DNA, 14 bp, Homo sapiens
gtcataatgaataa

SEQ ID NO: 1903712 - DNA, 13 bp, Homo sapiens
gtcatacatagga

SEQ ID NO: 1903713 - DNA, 18 bp, Homo sapiens
gtcatactcgagtctgag

SEQ ID NO: 1903714 - DNA, 12 bp, Homo sapiens
gtcatttctgat

SEQ ID NO: 1903715 - DNA, 19 bp, Homo sapiens
gtccagaaggagcaggccc

SEQ ID NO: 1903716 - DNA, 17 bp, Homo sapiens
gtccagggtaagctggt

SEQ ID NO: 1903717 - DNA, 14 bp, Homo sapiens
gtccagtaagatca

SEQ ID NO: 1903718 - DNA, 15 bp, Homo sapiens
gtccatctctgaaaa

SEQ ID NO: 1903719 - DNA, 17 bp, Homo sapiens
gtcccaagtctgacagc

SEQ ID NO: 1903720 - DNA, 15 bp, Homo sapiens
gtcccagcagccagc

SEQ ID NO: 1903721 - DNA, 16 bp, Homo sapiens
gtcccaggcagcgcca

SEQ ID NO: 1903722 - DNA, 16 bp, Homo sapiens
gtcccagttgctgtca

SEQ ID NO: 1903723 - DNA, 13 bp, Homo sapiens
gtccccccatccc

SEQ ID NO: 1903724 - DNA, 12 bp, Homo sapiens
gtcccctcccag

SEQ ID NO: 1903725 - DNA, 12 bp, Homo sapiens
gtccctctgcag

SEQ ID NO: 1903726 - DNA, 18 bp, Homo sapiens
gtccgctgtctccctcct

SEQ ID NO: 1903727 - DNA, 21 bp, Homo sapiens
gtcctattagtgttatatgaa

SEQ ID NO: 1903728 - DNA, 14 bp, Homo sapiens
gtcctcactggtct

SEQ ID NO: 1903729 - DNA, 20 bp, Homo sapiens
gtcctcactggtctacactg

SEQ ID NO: 1903730 - DNA, 17 bp, Homo sapiens
gtccttgaagcttgtat

SEQ ID NO: 1903731 - DNA, 17 bp, Homo sapiens
gtcggggcaggccaggg

SEQ ID NO: 1903732 - DNA, 17 bp, Homo sapiens
gtcggggtcaagctgga

SEQ ID NO: 1903733 - DNA, 14 bp, Homo sapiens
gtcgtcagcctccc

SEQ ID NO: 1903734 - DNA, 17 bp, Homo sapiens
gtctaccctgatcacct

SEQ ID NO: 1903735 - DNA, 21 bp, Homo sapiens
gtctactctaggactgggccc

SEQ ID NO: 1903736 - DNA, 15 bp, Homo sapiens
gtctagattttgaaa

SEQ ID NO: 1903737 - DNA, 17 bp, Homo sapiens
gtctatatgaaaaacaa

SEQ ID NO: 1903738 - DNA, 20 bp, Homo sapiens
gtctatttcatcagaacagc

SEQ ID NO: 1903739 - DNA, 22 bp, Homo sapiens
gtctatttcatcagaacagctg

SEQ ID NO: 1903740 - DNA, 14 bp, Homo sapiens
gtctatttctgaaa

SEQ ID NO: 1903741 - DNA, 15 bp, Homo sapiens
gtctcaccatttccc

SEQ ID NO: 1903742 - DNA, 19 bp, Homo sapiens
gtctcaccatttccccagg

SEQ ID NO: 1903743 - DNA, 21 bp, Homo sapiens
gtctcaccatttccccagggc

SEQ ID NO: 1903744 - DNA, 21 bp, Homo sapiens
gtctcccaccctttctgccag

SEQ ID NO: 1903745 - DNA, 20 bp, Homo sapiens
gtctcggatcaggctcccag

SEQ ID NO: 1903746 - DNA, 13 bp, Homo sapiens
gtctcggcagagg

SEQ ID NO: 1903747 - DNA, 14 bp, Homo sapiens
gtctcggcagaggt

SEQ ID NO: 1903748 - DNA, 17 bp, Homo sapiens
gtctcggcagaggtggt

SEQ ID NO: 1903749 - DNA, 14 bp, Homo sapiens
gtctctagtgctgt

SEQ ID NO: 1903750 - DNA, 16 bp, Homo sapiens
gtctctagtgctgtga

SEQ ID NO: 1903751 - DNA, 12 bp, Homo sapiens
gtctctcacaga

SEQ ID NO: 1903752 - DNA, 20 bp, Homo sapiens
gtctgagggcttgtagttct

SEQ ID NO: 1903753 - DNA, 17 bp, Homo sapiens
gtctgccaccagcgccc

SEQ ID NO: 1903754 - DNA, 22 bp, Homo sapiens
gtctgccaccagcgcccccact

SEQ ID NO: 1903755 - DNA, 18 bp, Homo sapiens
gtctggaactgctgctga

SEQ ID NO: 1903756 - DNA, 21 bp, Homo sapiens
gtctggaactgctgctgaccc

SEQ ID NO: 1903757 - DNA, 18 bp, Homo sapiens
gtctggcccactgtgcag

SEQ ID NO: 1903758 - DNA, 19 bp, Homo sapiens
gtctgtgtggccagcagcc

SEQ ID NO: 1903759 - DNA, 23 bp, Homo sapiens
gtctgtgtggccagcagcctctg

SEQ ID NO: 1903760 - DNA, 20 bp, Homo sapiens
gtctgtgttccaaccactga

SEQ ID NO: 1903761 - DNA, 19 bp, Homo sapiens
gtctgttgattaaagatga

SEQ ID NO: 1903762 - DNA, 20 bp, Homo sapiens
gtctgttggcaaatttgtga

SEQ ID NO: 1903763 - DNA, 16 bp, Homo sapiens
gtctttgagctcccac

SEQ ID NO: 1903764 - DNA, 12 bp, Homo sapiens
gtgaacagattt

SEQ ID NO: 1903765 - DNA, 13 bp, Homo sapiens
gtgaagatacttt

SEQ ID NO: 1903766 - DNA, 24 bp, Homo sapiens
gtgaatgctgtgggaaggcaattt

SEQ ID NO: 1903767 - DNA, 21 bp, Homo sapiens
gtgacctcacacacctctgcc

SEQ ID NO: 1903768 - DNA, 13 bp, Homo sapiens
gtgacggttccta

SEQ ID NO: 1903769 - DNA, 16 bp, Homo sapiens
gtgagtggttgaatat

SEQ ID NO: 1903770 - DNA, 16 bp, Homo sapiens
gtgatataaacagctt

SEQ ID NO: 1903771 - DNA, 15 bp, Homo sapiens
gtgatgaagctgagg

SEQ ID NO: 1903772 - DNA, 18 bp, Homo sapiens
ggctgagtgcaggcccac

SEQ ID NO: 1903773 - DNA, 22 bp, Homo sapiens
ggctgagtgcaggcccaccctg

SEQ ID NO: 1903774 - DNA, 17 bp, Homo sapiens
ggctgctgccaggcccg

SEQ ID NO: 1903775 - DNA, 15 bp, Homo sapiens
ggctggcaccagcag

SEQ ID NO: 1903776 - DNA, 11 bp, Homo sapiens
ggctgggaaat

SEQ ID NO: 1903777 - DNA, 19 bp, Homo sapiens
ggctgggcactgctctcac

SEQ ID NO: 1903778 - DNA, 20 bp, Homo sapiens
ggctgggcactgctctcacc

SEQ ID NO: 1903779 - DNA, 18 bp, Homo sapiens
ggctgggggatgggcctg

SEQ ID NO: 1903780 - DNA, 19 bp, Homo sapiens
ggctgggggatgggcctga

SEQ ID NO: 1903781 - DNA, 18 bp, Homo sapiens
ggctgggggctgcagggc

SEQ ID NO: 1903782 - DNA, 20 bp, Homo sapiens
ggctgggggctgcagggctg

SEQ ID NO: 1903783 - DNA, 15 bp, Homo sapiens
ggctgttctggtggc

SEQ ID NO: 1903784 - DNA, 18 bp, Homo sapiens
ggctgttctggtggcccc

SEQ ID NO: 1903785 - DNA, 14 bp, Homo sapiens
ggcttcctctgctg

SEQ ID NO: 1903786 - DNA, 17 bp, Homo sapiens
ggcttcctctgctgcat

SEQ ID NO: 1903787 - DNA, 13 bp, Homo sapiens
ggcttggccctgg

SEQ ID NO: 1903788 - DNA, 14 bp, Homo sapiens
ggcttggtcacttc

SEQ ID NO: 1903789 - DNA, 20 bp, Homo sapiens
gggaaaaagttgatgtcaat

SEQ ID NO: 1903790 - DNA, 23 bp, Homo sapiens
gggaaatcgagtgccgcatctca

SEQ ID NO: 1903791 - DNA, 15 bp, Homo sapiens
gggaagctgaggccc

SEQ ID NO: 1903792 - DNA, 20 bp, Homo sapiens
gggacaagtagccacctgag

SEQ ID NO: 1903793 - DNA, 19 bp, Homo sapiens
gggacactgtggcagcagg

SEQ ID NO: 1903794 - DNA, 17 bp, Homo sapiens
gggaccacagaggctgt

SEQ ID NO: 1903795 - DNA, 19 bp, Homo sapiens
gggaccacagaggctgtgg

SEQ ID NO: 1903796 - DNA, 21 bp, Homo sapiens
gggaccacaggtgcccgccac

SEQ ID NO: 1903797 - DNA, 24 bp, Homo sapiens
gggaccctccaaggccaggccttg

SEQ ID NO: 1903798 - DNA, 21 bp, Homo sapiens
gggactccttccttgaaccct

SEQ ID NO: 1903799 - DNA, 21 bp, Homo sapiens
gggactctgtctggccaggga

SEQ ID NO: 1903800 - DNA, 23 bp, Homo sapiens
gggactctgtctggccagggagg

SEQ ID NO: 1903801 - DNA, 15 bp, Homo sapiens
gggactgtcaatgga

SEQ ID NO: 1903802 - DNA, 18 bp, Homo sapiens
gggacttgtcccaagtct

SEQ ID NO: 1903803 - DNA, 20 bp, Homo sapiens
gggagccccaccctagccct

SEQ ID NO: 1903804 - DNA, 14 bp, Homo sapiens
gggagccctgggcc

SEQ ID NO: 1903805 - DNA, 14 bp, Homo sapiens
gggaggagccccag

SEQ ID NO: 1903806 - DNA, 13 bp, Homo sapiens
gggaggaggcagg

SEQ ID NO: 1903807 - DNA, 23 bp, Homo sapiens
gggaggagtggattcctccccac

SEQ ID NO: 1903808 - DNA, 16 bp, Homo sapiens
gggaggggagactttg

SEQ ID NO: 1903809 - DNA, 17 bp, Homo sapiens
gggaggtcccagggccc

SEQ ID NO: 1903810 - DNA, 15 bp, Homo sapiens
gggaggtgctggttc

SEQ ID NO: 1903811 - DNA, 18 bp, Homo sapiens
gggagtaagtagaggtgg

SEQ ID NO: 1903812 - DNA, 20 bp, Homo sapiens
gggagtaagtagaggtggct

SEQ ID NO: 1903813 - DNA, 17 bp, Homo sapiens
gggagtagacttgcttt

SEQ ID NO: 1903814 - DNA, 15 bp, Homo sapiens
gggatggcagtggct

SEQ ID NO: 1903815 - DNA, 14 bp, Homo sapiens
gggatgggcctgag

SEQ ID NO: 1903816 - DNA, 14 bp, Homo sapiens
gggcacagggcctg

SEQ ID NO: 1903817 - DNA, 16 bp, Homo sapiens
gggcacagggcctggc

SEQ ID NO: 1903818 - DNA, 20 bp, Homo sapiens
gggcacagggcctggcccat

SEQ ID NO: 1903819 - DNA, 19 bp, Homo sapiens
gggcacgtggttgagtggg

SEQ ID NO: 1903820 - DNA, 16 bp, Homo sapiens
gggcagcttgggctgg

SEQ ID NO: 1903821 - DNA, 23 bp, Homo sapiens
gggcagcttgggctggcgggccc

SEQ ID NO: 1903822 - DNA, 13 bp, Homo sapiens
gggcaggaccagc

SEQ ID NO: 1903823 - DNA, 18 bp, Homo sapiens
gggcaggaccagcccacg

SEQ ID NO: 1903824 - DNA, 23 bp, Homo sapiens
gggcatccatggggtctctcaca

SEQ ID NO: 1903825 - DNA, 20 bp, Homo sapiens
gggcatttggcttcctctgc

SEQ ID NO: 1903826 - DNA, 21 bp, Homo sapiens
gggcatttggcttcctctgct

SEQ ID NO: 1903827 - DNA, 23 bp, Homo sapiens
gggcatttggcttcctctgctgc

SEQ ID NO: 1903828 - DNA, 11 bp, Homo sapiens
gggcccaggca

SEQ ID NO: 1903829 - DNA, 13 bp, Homo sapiens
gggccctggagct

SEQ ID NO: 1903830 - DNA, 15 bp, Homo sapiens
gggccgagcctgcct

SEQ ID NO: 1903831 - DNA, 13 bp, Homo sapiens
gggcctccacctc

SEQ ID NO: 1903832 - DNA, 12 bp, Homo sapiens
gggcctcccact

SEQ ID NO: 1903833 - DNA, 13 bp, Homo sapiens
gggcctcccactc

SEQ ID NO: 1903834 - DNA, 20 bp, Homo sapiens
gggcctcccactcccatggc

SEQ ID NO: 1903835 - DNA, 23 bp, Homo sapiens
gggcctcccactcccatggctct

SEQ ID NO: 1903836 - DNA, 18 bp, Homo sapiens
gggccttctgcctgctga

SEQ ID NO: 1903837 - DNA, 16 bp, Homo sapiens
gggcggagaattctta

SEQ ID NO: 1903838 - DNA, 16 bp, Homo sapiens
gggctcagcaaggcca

SEQ ID NO: 1903839 - DNA, 17 bp, Homo sapiens
gggctcagcaaggccac

SEQ ID NO: 1903840 - DNA, 20 bp, Homo sapiens
gggctcagcaaggccacctc

SEQ ID NO: 1903841 - DNA, 18 bp, Homo sapiens
gggctcccgcctccaacc

SEQ ID NO: 1903842 - DNA, 19 bp, Homo sapiens
gggctctgactctgccagg

SEQ ID NO: 1903843 - DNA, 16 bp, Homo sapiens
gggctgggcactgctc

SEQ ID NO: 1903844 - DNA, 20 bp, Homo sapiens
gggctgggcactgctctcac

SEQ ID NO: 1903845 - DNA, 22 bp, Homo sapiens
gggctgggcactgctctcacct

SEQ ID NO: 1903846 - DNA, 19 bp, Homo sapiens
gggctgggggctgcagggc

SEQ ID NO: 1903847 - DNA, 13 bp, Homo sapiens
gggctgttacttg

SEQ ID NO: 1903848 - DNA, 14 bp, Homo sapiens
ggggaccacagagg

SEQ ID NO: 1903849 - DNA, 15 bp, Homo sapiens
ggggactgccacctc

SEQ ID NO: 1903850 - DNA, 13 bp, Homo sapiens
ggggcaggccagg

SEQ ID NO: 1903851 - DNA, 16 bp, Homo sapiens
ggggccagcggccctc

SEQ ID NO: 1903852 - DNA, 20 bp, Homo sapiens
ggggccagcggccctcccag

SEQ ID NO: 1903853 - DNA, 22 bp, Homo sapiens
ggggccagcggccctcccaggc

SEQ ID NO: 1903854 - DNA, 23 bp, Homo sapiens
ggggccagcggccctcccaggcg

SEQ ID NO: 1903855 - DNA, 19 bp, Homo sapiens
ggggctggcaccagcaggc

SEQ ID NO: 1903856 - DNA, 19 bp, Homo sapiens
gggggacactgtggcagca

SEQ ID NO: 1903857 - DNA, 15 bp, Homo sapiens
ggggtacacagagct

SEQ ID NO: 1903858 - DNA, 22 bp, Homo sapiens
gggtacacagagctaaggccaa

SEQ ID NO: 1903859 - DNA, 13 bp, Homo sapiens
gggtcactggggg

SEQ ID NO: 1903860 - DNA, 13 bp, Homo sapiens
gggtgtgaggcca

SEQ ID NO: 1903861 - DNA, 19 bp, Homo sapiens
gggttcatttgtgatgaca

SEQ ID NO: 1903862 - DNA, 13 bp, Homo sapiens
gggttccttctgg

SEQ ID NO: 1903863 - DNA, 14 bp, Homo sapiens
gggtttcagggctg

SEQ ID NO: 1903864 - DNA, 14 bp, Homo sapiens
ggtaaaatgaagaa

SEQ ID NO: 1903865 - DNA, 13 bp, Homo sapiens
ggtaaaattttgt

SEQ ID NO: 1903866 - DNA, 16 bp, Homo sapiens
ggtacaatttcttttg

SEQ ID NO: 1903867 - DNA, 14 bp, Homo sapiens
ggtacacagagcta

SEQ ID NO: 1903868 - DNA, 17 bp, Homo sapiens
ggtactgtaatgttaat

SEQ ID NO: 1903869 - DNA, 23 bp, Homo sapiens
ggtactgtctcggcagaggtggt

SEQ ID NO: 1903870 - DNA, 15 bp, Homo sapiens
ggtactttctgaaaa

SEQ ID NO: 1903871 - DNA, 14 bp, Homo sapiens
ggtagtcaaaggca

SEQ ID NO: 1903872 - DNA, 19 bp, Homo sapiens
ggtagttcaagaaatgaag

SEQ ID NO: 1903873 - DNA, 21 bp, Homo sapiens
ggtatttgtttaataccctgt

SEQ ID NO: 1903874 - DNA, 16 bp, Homo sapiens
ggtcagagagggaagc

SEQ ID NO: 1903875 - DNA, 22 bp, Homo sapiens
ggtcagagagggaagctgaggc

SEQ ID NO: 1903876 - DNA, 21 bp, Homo sapiens
ggtcagggtgtgaggccacac

SEQ ID NO: 1903877 - DNA, 22 bp, Homo sapiens
ggtcatatgtttgcttgtattt

SEQ ID NO: 1903878 - DNA, 20 bp, Homo sapiens
ggtccagaaggagcaggccc

SEQ ID NO: 1903879 - DNA, 19 bp, Homo sapiens
ggtccatctctgaaaacaa

SEQ ID NO: 1903880 - DNA, 16 bp, Homo sapiens
ggtcccagggccctag

SEQ ID NO: 1903881 - DNA, 17 bp, Homo sapiens
ggtcccagttgctgtca

SEQ ID NO: 1903882 - DNA, 18 bp, Homo sapiens
ggtctcgggggtgggctc

SEQ ID NO: 1903883 - DNA, 19 bp, Homo sapiens
ggtctctagtgctgtgaaa

SEQ ID NO: 1903884 - DNA, 18 bp, Homo sapiens
ggtctctcccagctctgg

SEQ ID NO: 1903885 - DNA, 16 bp, Homo sapiens
ggtcttgcatttaaaa

SEQ ID NO: 1903886 - DNA, 15 bp, Homo sapiens
ggtgaatttgtttaa

SEQ ID NO: 1903887 - DNA, 20 bp, Homo sapiens
ggtgacctcacacacctctg

SEQ ID NO: 1903888 - DNA, 22 bp, Homo sapiens
ggtgccggaaagagagctggag

SEQ ID NO: 1903889 - DNA, 14 bp, Homo sapiens
ggtggtctggtgcc

SEQ ID NO: 1903890 - DNA, 17 bp, Homo sapiens
ggttcaaacctgtgaag

SEQ ID NO: 1903891 - DNA, 19 bp, Homo sapiens
ggttccatgcctgctctcg

SEQ ID NO: 1903892 - DNA, 17 bp, Homo sapiens
ggttcctacacaggaca

SEQ ID NO: 1903893 - DNA, 24 bp, Homo sapiens
ggttgcctggacaccccacgggag

SEQ ID NO: 1903894 - DNA, 16 bp, Homo sapiens
ggtttactcagggtct

SEQ ID NO: 1903895 - DNA, 18 bp, Homo sapiens
ggtttccaacaattcagc

SEQ ID NO: 1903896 - DNA, 14 bp, Homo sapiens
gtaaaatgaagaat

SEQ ID NO: 1903897 - DNA, 22 bp, Homo sapiens
gtaaagaaatacacagggaggg

SEQ ID NO: 1903898 - DNA, 19 bp, Homo sapiens
gtaaagcaaccaaaaagaa

SEQ ID NO: 1903899 - DNA, 20 bp, Homo sapiens
gtaaagcaaccaaaaagaaa

SEQ ID NO: 1903900 - DNA, 14 bp, Homo sapiens
gtaaatgctgaaat

SEQ ID NO: 1903901 - DNA, 17 bp, Homo sapiens
gtaaatgtattcattct

SEQ ID NO: 1903902 - DNA, 15 bp, Homo sapiens
gtaaattctgatttc

SEQ ID NO: 1903903 - DNA, 14 bp, Homo sapiens
gtaaattctgggtt

SEQ ID NO: 1903904 - DNA, 19 bp, Homo sapiens
gtaaattgtattctcataa

SEQ ID NO: 1903905 - DNA, 13 bp, Homo sapiens
gtaagaaatacag

SEQ ID NO: 1903906 - DNA, 18 bp, Homo sapiens
gtaagatcactgtttaga

SEQ ID NO: 1903907 - DNA, 14 bp, Homo sapiens
gtaagcgtatggct

SEQ ID NO: 1903908 - DNA, 21 bp, Homo sapiens
ggaccatgctgtctggcacag

SEQ ID NO: 1903909 - DNA, 17 bp, Homo sapiens
ggaccctccaaggccag

SEQ ID NO: 1903910 - DNA, 21 bp, Homo sapiens
ggaccctccaaggccaggcct

SEQ ID NO: 1903911 - DNA, 21 bp, Homo sapiens
ggaccctgccaggcacaggca

SEQ ID NO: 1903912 - DNA, 13 bp, Homo sapiens
ggacctcgggctg

SEQ ID NO: 1903913 - DNA, 13 bp, Homo sapiens
ggactctaaagtc

SEQ ID NO: 1903914 - DNA, 13 bp, Homo sapiens
ggactctctgaca

SEQ ID NO: 1903915 - DNA, 14 bp, Homo sapiens
ggactctctgacaa

SEQ ID NO: 1903916 - DNA, 10 bp, Homo sapiens
ggactgccac

SEQ ID NO: 1903917 - DNA, 14 bp, Homo sapiens
ggactgccacctcc

SEQ ID NO: 1903918 - DNA, 21 bp, Homo sapiens
ggactgccacctccccttgcc

SEQ ID NO: 1903919 - DNA, 23 bp, Homo sapiens
ggactgctgtgaacatgcctcct

SEQ ID NO: 1903920 - DNA, 15 bp, Homo sapiens
ggacttgtcccaagt

SEQ ID NO: 1903921 - DNA, 16 bp, Homo sapiens
ggagaatcacaggctg

SEQ ID NO: 1903922 - DNA, 19 bp, Homo sapiens
ggagaatcacaggctgggc

SEQ ID NO: 1903923 - DNA, 13 bp, Homo sapiens
ggagacagaccac

SEQ ID NO: 1903924 - DNA, 14 bp, Homo sapiens
ggagacagaccact

SEQ ID NO: 1903925 - DNA, 14 bp, Homo sapiens
ggagcaggccctgg

SEQ ID NO: 1903926 - DNA, 20 bp, Homo sapiens
ggagcaggccctgggcctcc

SEQ ID NO: 1903927 - DNA, 17 bp, Homo sapiens
ggagccccagtggtgag

SEQ ID NO: 1903928 - DNA, 19 bp, Homo sapiens
ggagccctgcctctccgcc

SEQ ID NO: 1903929 - DNA, 21 bp, Homo sapiens
ggagctcaagccgtggccggg

SEQ ID NO: 1903930 - DNA, 23 bp, Homo sapiens
ggagctcactgtggtgtctgtgt

SEQ ID NO: 1903931 - DNA, 16 bp, Homo sapiens
ggaggagccccagtgg

SEQ ID NO: 1903932 - DNA, 16 bp, Homo sapiens
ggaggagtggattcct

SEQ ID NO: 1903933 - DNA, 14 bp, Homo sapiens
ggaggagtggcatc

SEQ ID NO: 1903934 - DNA, 22 bp, Homo sapiens
ggaggccaagagtggccccacc

SEQ ID NO: 1903935 - DNA, 21 bp, Homo sapiens
ggaggcccagcgcggacatcc

SEQ ID NO: 1903936 - DNA, 13 bp, Homo sapiens
ggagggacagtct

SEQ ID NO: 1903937 - DNA, 22 bp, Homo sapiens
ggagggcctgggcctggctccc

SEQ ID NO: 1903938 - DNA, 23 bp, Homo sapiens
ggagggcctgggcctggctccct

SEQ ID NO: 1903939 - DNA, 13 bp, Homo sapiens
ggaggtcccaggg

SEQ ID NO: 1903940 - DNA, 15 bp, Homo sapiens
ggaggtcccagggcc

SEQ ID NO: 1903941 - DNA, 13 bp, Homo sapiens
ggaggtgctggtt

SEQ ID NO: 1903942 - DNA, 19 bp, Homo sapiens
ggagtaagtagaggtggct

SEQ ID NO: 1903943 - DNA, 13 bp, Homo sapiens
ggagtctgggctc

SEQ ID NO: 1903944 - DNA, 14 bp, Homo sapiens
ggagtctgggctcc

SEQ ID NO: 1903945 - DNA, 15 bp, Homo sapiens
ggagtctgggctcct

SEQ ID NO: 1903946 - DNA, 12 bp, Homo sapiens
ggagtgcagtgg

SEQ ID NO: 1903947 - DNA, 22 bp, Homo sapiens
ggagtgcagtggcgaaatccct

SEQ ID NO: 1903948 - DNA, 18 bp, Homo sapiens
ggagtggattcctcccca

SEQ ID NO: 1903949 - DNA, 19 bp, Homo sapiens
ggatcagatagcaggagga

SEQ ID NO: 1903950 - DNA, 13 bp, Homo sapiens
ggatggcagtggc

SEQ ID NO: 1903951 - DNA, 14 bp, Homo sapiens
ggatggcagtggct

SEQ ID NO: 1903952 - DNA, 20 bp, Homo sapiens
ggatggcagtggctgtgaag

SEQ ID NO: 1903953 - DNA, 18 bp, Homo sapiens
ggattcctccccaccctg

SEQ ID NO: 1903954 - DNA, 20 bp, Homo sapiens
ggcaaagcagcaacacacat

SEQ ID NO: 1903955 - DNA, 22 bp, Homo sapiens
ggcaaatgcacacacctcatgc

SEQ ID NO: 1903956 - DNA, 15 bp, Homo sapiens
ggcaaatttgtgaac

SEQ ID NO: 1903957 - DNA, 12 bp, Homo sapiens
ggcaagaaggca

SEQ ID NO: 1903958 - DNA, 16 bp, Homo sapiens
ggcaagcagactgttc

SEQ ID NO: 1903959 - DNA, 17 bp, Homo sapiens
ggcaatggtagtttctg

SEQ ID NO: 1903960 - DNA, 12 bp, Homo sapiens
ggcacagcctgc

SEQ ID NO: 1903961 - DNA, 12 bp, Homo sapiens
ggcacaggcagg

SEQ ID NO: 1903962 - DNA, 14 bp, Homo sapiens
ggcacaggcagggc

SEQ ID NO: 1903963 - DNA, 15 bp, Homo sapiens
ggcacaggcagggca

SEQ ID NO: 1903964 - DNA, 18 bp, Homo sapiens
ggcacagggcctggccca

SEQ ID NO: 1903965 - DNA, 12 bp, Homo sapiens
ggcaccagcagg

SEQ ID NO: 1903966 - DNA, 13 bp, Homo sapiens
ggcaccagcaggc

SEQ ID NO: 1903967 - DNA, 15 bp, Homo sapiens
ggcaccagcaggcac

SEQ ID NO: 1903968 - DNA, 19 bp, Homo sapiens
ggcaccagtagcaggcccg

SEQ ID NO: 1903969 - DNA, 15 bp, Homo sapiens
ggcacgaaatggctg

SEQ ID NO: 1903970 - DNA, 21 bp, Homo sapiens
ggcactgccgccgctaggtag

SEQ ID NO: 1903971 - DNA, 17 bp, Homo sapiens
ggcagaaagcaaaatta

SEQ ID NO: 1903972 - DNA, 17 bp, Homo sapiens
ggcagagagcgaccagc

SEQ ID NO: 1903973 - DNA, 13 bp, Homo sapiens
ggcagcctgagag

SEQ ID NO: 1903974 - DNA, 15 bp, Homo sapiens
ggcaggaccagccca

SEQ ID NO: 1903975 - DNA, 18 bp, Homo sapiens
ggcaggaccagcccacgc

SEQ ID NO: 1903976 - DNA, 23 bp, Homo sapiens
ggcaggagactgtggagactgct

SEQ ID NO: 1903977 - DNA, 22 bp, Homo sapiens
ggcaggcccccggggaggggcc

SEQ ID NO: 1903978 - DNA, 16 bp, Homo sapiens
ggcagggcacagggcc

SEQ ID NO: 1903979 - DNA, 19 bp, Homo sapiens
ggcagggcacagggcctgg

SEQ ID NO: 1903980 - DNA, 23 bp, Homo sapiens
ggcaggggatccagctcaaggga

SEQ ID NO: 1903981 - DNA, 22 bp, Homo sapiens
ggcatccatggggtctctcaca

SEQ ID NO: 1903982 - DNA, 16 bp, Homo sapiens
ggcatctctctgggat

SEQ ID NO: 1903983 - DNA, 14 bp, Homo sapiens
ggcatgaggccccg

SEQ ID NO: 1903984 - DNA, 15 bp, Homo sapiens
ggcatttggcttcct

SEQ ID NO: 1903985 - DNA, 19 bp, Homo sapiens
ggcatttggcttcctctgc

SEQ ID NO: 1903986 - DNA, 22 bp, Homo sapiens
ggcatttggcttcctctgctgc

SEQ ID NO: 1903987 - DNA, 23 bp, Homo sapiens
ggcatttgtttctttctctgagg

SEQ ID NO: 1903988 - DNA, 15 bp, Homo sapiens
ggcattttgagaatg

SEQ ID NO: 1903989 - DNA, 14 bp, Homo sapiens
ggccaagagtggcc

SEQ ID NO: 1903990 - DNA, 17 bp, Homo sapiens
ggccaatgggctagagg

SEQ ID NO: 1903991 - DNA, 15 bp, Homo sapiens
ggccacacccagagt

SEQ ID NO: 1903992 - DNA, 16 bp, Homo sapiens
ggccacagttgtttga

SEQ ID NO: 1903993 - DNA, 16 bp, Homo sapiens
ggccacctcttcctgg

SEQ ID NO: 1903994 - DNA, 13 bp, Homo sapiens
ggccagcggccct

SEQ ID NO: 1903995 - DNA, 14 bp, Homo sapiens
ggccagcggccctc

SEQ ID NO: 1903996 - DNA, 21 bp, Homo sapiens
ggccagcggccctcccaggcg

SEQ ID NO: 1903997 - DNA, 19 bp, Homo sapiens
ggccaggaagtagcacagg

SEQ ID NO: 1903998 - DNA, 22 bp, Homo sapiens
ggccaggaagtagcacaggctg

SEQ ID NO: 1903999 - DNA, 17 bp, Homo sapiens
ggccaggctgctctcaa

SEQ ID NO: 1904000 - DNA, 20 bp, Homo sapiens
ggcccaagagtctggggacc

SEQ ID NO: 1904001 - DNA, 18 bp, Homo sapiens
ggcccagagagaagagcc

SEQ ID NO: 1904002 - DNA, 19 bp, Homo sapiens
ggcccagggggcttcctga

SEQ ID NO: 1904003 - DNA, 15 bp, Homo sapiens
ggcccatcaggggca

SEQ ID NO: 1904004 - DNA, 16 bp, Homo sapiens
ggcccatcaggggcag

SEQ ID NO: 1904005 - DNA, 19 bp, Homo sapiens
ggcccatcaggggcaggaa

SEQ ID NO: 1904006 - DNA, 13 bp, Homo sapiens
ggcccccacatgg

SEQ ID NO: 1904007 - DNA, 19 bp, Homo sapiens
ggccccgtctcaggtctga

SEQ ID NO: 1904008 - DNA, 13 bp, Homo sapiens
ggcccgagggtgg

SEQ ID NO: 1904009 - DNA, 13 bp, Homo sapiens
ggcccggcatgag

SEQ ID NO: 1904010 - DNA, 15 bp, Homo sapiens
ggcccggcatgaggc

SEQ ID NO: 1904011 - DNA, 19 bp, Homo sapiens
ggcccggcatgaggccccg

SEQ ID NO: 1904012 - DNA, 16 bp, Homo sapiens
ggcccgggcccaggca

SEQ ID NO: 1904013 - DNA, 13 bp, Homo sapiens
ggccctcccaggc

SEQ ID NO: 1904014 - DNA, 16 bp, Homo sapiens
ggccctggagctcaag

SEQ ID NO: 1904015 - DNA, 16 bp, Homo sapiens
ggccctgggcctccac

SEQ ID NO: 1904016 - DNA, 16 bp, Homo sapiens
ggccggccgcactggg

SEQ ID NO: 1904017 - DNA, 16 bp, Homo sapiens
ggcctaaaagtaaaca

SEQ ID NO: 1904018 - DNA, 13 bp, Homo sapiens
ggcctccacctct

SEQ ID NO: 1904019 - DNA, 23 bp, Homo sapiens
ggcctccacctctgtgcagggca

SEQ ID NO: 1904020 - DNA, 11 bp, Homo sapiens
ggcctcccact

SEQ ID NO: 1904021 - DNA, 19 bp, Homo sapiens
ggcctcccactcccatggc

SEQ ID NO: 1904022 - DNA, 12 bp, Homo sapiens
ggcctggcccat

SEQ ID NO: 1904023 - DNA, 15 bp, Homo sapiens
ggcctggcccatgta

SEQ ID NO: 1904024 - DNA, 14 bp, Homo sapiens
ggcctggctccctc

SEQ ID NO: 1904025 - DNA, 23 bp, Homo sapiens
ggcctggctccctcactctcagg

SEQ ID NO: 1904026 - DNA, 18 bp, Homo sapiens
ggcgaaatccctgctcac

SEQ ID NO: 1904027 - DNA, 12 bp, Homo sapiens
ggcgggccctgg

SEQ ID NO: 1904028 - DNA, 20 bp, Homo sapiens
ggcgggtggatcacgaggtc

SEQ ID NO: 1904029 - DNA, 18 bp, Homo sapiens
ggcggtccagaaggagca

SEQ ID NO: 1904030 - DNA, 16 bp, Homo sapiens
ggctaaggtaagaacg

SEQ ID NO: 1904031 - DNA, 12 bp, Homo sapiens
ggctcaaatttt

SEQ ID NO: 1904032 - DNA, 16 bp, Homo sapiens
ggctcagattgtaata

SEQ ID NO: 1904033 - DNA, 14 bp, Homo sapiens
ggctcagcaaggcc

SEQ ID NO: 1904034 - DNA, 17 bp, Homo sapiens
ggctcagcaaggccacc

SEQ ID NO: 1904035 - DNA, 21 bp, Homo sapiens
ggctcagcaaggccacctctt

SEQ ID NO: 1904036 - DNA, 20 bp, Homo sapiens
ggctcccaggagcctgccca

SEQ ID NO: 1904037 - DNA, 21 bp, Homo sapiens
ggctcccaggagcctgcccag

SEQ ID NO: 1904038 - DNA, 22 bp, Homo sapiens
ggctcccaggagcctgcccagc

SEQ ID NO: 1904039 - DNA, 17 bp, Homo sapiens
ggctcccgcctccaacc

SEQ ID NO: 1904040 - DNA, 15 bp, Homo sapiens
ggctccctcactctc

SEQ ID NO: 1904041 - DNA, 18 bp, Homo sapiens
ggctccctcactctcagg

SEQ ID NO: 1904042 - DNA, 16 bp, Homo sapiens
ggctcctcagccctct

SEQ ID NO: 1904043 - DNA, 18 bp, Homo sapiens
ggctcgagctcggggctg

SEQ ID NO: 1904044 - DNA, 20 bp, Homo sapiens
ggctctgactctgccagggt

SEQ ID NO: 1904045 - DNA, 15 bp, Homo sapiens
ggctgagtgcaggcc

SEQ ID NO: 1904046 - DNA, 22 bp, Homo sapiens
gctagtcaacagtaccctggtt

SEQ ID NO: 1904047 - DNA, 22 bp, Homo sapiens
gctagttgaatacttgaaccat

SEQ ID NO: 1904048 - DNA, 19 bp, Homo sapiens
gctcaaggcaatgggctac

SEQ ID NO: 1904049 - DNA, 21 bp, Homo sapiens
gctcaagggagtaagtagagg

SEQ ID NO: 1904050 - DNA, 15 bp, Homo sapiens
gctcagaaccacagc

SEQ ID NO: 1904051 - DNA, 15 bp, Homo sapiens
gctcagcaaggccac

SEQ ID NO: 1904052 - DNA, 19 bp, Homo sapiens
gctcagctgtcaaggctca

SEQ ID NO: 1904053 - DNA, 22 bp, Homo sapiens
gctcattcagcatctgacctct

SEQ ID NO: 1904054 - DNA, 18 bp, Homo sapiens
gctccaactccacaccct

SEQ ID NO: 1904055 - DNA, 23 bp, Homo sapiens
gctccaccccgcaagcaccatcc

SEQ ID NO: 1904056 - DNA, 18 bp, Homo sapiens
gctccattcatacacaac

SEQ ID NO: 1904057 - DNA, 20 bp, Homo sapiens
gctcccaggagcctgcccag

SEQ ID NO: 1904058 - DNA, 16 bp, Homo sapiens
gctccctcactctcag

SEQ ID NO: 1904059 - DNA, 15 bp, Homo sapiens
gctccctcccctgct

SEQ ID NO: 1904060 - DNA, 14 bp, Homo sapiens
gctccggcacccac

SEQ ID NO: 1904061 - DNA, 19 bp, Homo sapiens
gctcctcagccctctcttg

SEQ ID NO: 1904062 - DNA, 20 bp, Homo sapiens
gctcgagctcggggctgggg

SEQ ID NO: 1904063 - DNA, 22 bp, Homo sapiens
gctcggggctgggggctgcagg

SEQ ID NO: 1904064 - DNA, 16 bp, Homo sapiens
gctctgcctgacagag

SEQ ID NO: 1904065 - DNA, 21 bp, Homo sapiens
gctctgggcggtccagaagga

SEQ ID NO: 1904066 - DNA, 22 bp, Homo sapiens
gctctgttgcccaggctggagt

SEQ ID NO: 1904067 - DNA, 14 bp, Homo sapiens
gctcttagaaactc

SEQ ID NO: 1904068 - DNA, 21 bp, Homo sapiens
gctgaaagatatgtatatttt

SEQ ID NO: 1904069 - DNA, 17 bp, Homo sapiens
gctgacataattctaag

SEQ ID NO: 1904070 - DNA, 16 bp, Homo sapiens
gctgacccatgggcag

SEQ ID NO: 1904071 - DNA, 19 bp, Homo sapiens
gctgacccatgggcaggag

SEQ ID NO: 1904072 - DNA, 16 bp, Homo sapiens
gctgactacagggccg

SEQ ID NO: 1904073 - DNA, 13 bp, Homo sapiens
gctgacttagaat

SEQ ID NO: 1904074 - DNA, 11 bp, Homo sapiens
gctgaggccca

SEQ ID NO: 1904075 - DNA, 19 bp, Homo sapiens
gctgaggcccatggccaca

SEQ ID NO: 1904076 - DNA, 19 bp, Homo sapiens
gctgaggctgctgccaggc

SEQ ID NO: 1904077 - DNA, 21 bp, Homo sapiens
gctgaggctgctgccaggccc

SEQ ID NO: 1904078 - DNA, 14 bp, Homo sapiens
gctgagtgcaggcc

SEQ ID NO: 1904079 - DNA, 15 bp, Homo sapiens
gctgagtgcaggccc

SEQ ID NO: 1904080 - DNA, 22 bp, Homo sapiens
gctgagtgcaggcccaccctgc

SEQ ID NO: 1904081 - DNA, 16 bp, Homo sapiens
gctgattttgaccttg

SEQ ID NO: 1904082 - DNA, 11 bp, Homo sapiens
gctgcagggct

SEQ ID NO: 1904083 - DNA, 13 bp, Homo sapiens
gctgcagggctgg

SEQ ID NO: 1904084 - DNA, 15 bp, Homo sapiens
gctgcagggctgggt

SEQ ID NO: 1904085 - DNA, 14 bp, Homo sapiens
gctgcatatgccta

SEQ ID NO: 1904086 - DNA, 15 bp, Homo sapiens
gctgcatccccttcc

SEQ ID NO: 1904087 - DNA, 17 bp, Homo sapiens
gctgcatccccttccag

SEQ ID NO: 1904088 - DNA, 14 bp, Homo sapiens
gctgcattgagact

SEQ ID NO: 1904089 - DNA, 13 bp, Homo sapiens
gctgccaggcccg

SEQ ID NO: 1904090 - DNA, 17 bp, Homo sapiens
gctgccaggcccggcat

SEQ ID NO: 1904091 - DNA, 20 bp, Homo sapiens
gctgctctcaaacccctgac

SEQ ID NO: 1904092 - DNA, 15 bp, Homo sapiens
gctgctgagccgcag

SEQ ID NO: 1904093 - DNA, 14 bp, Homo sapiens
gctgctgccaggcc

SEQ ID NO: 1904094 - DNA, 20 bp, Homo sapiens
gctgctgtgtgtggcttctg

SEQ ID NO: 1904095 - DNA, 19 bp, Homo sapiens
gctggaaaggccagcagcc

SEQ ID NO: 1904096 - DNA, 18 bp, Homo sapiens
gctggagaggagccctgc

SEQ ID NO: 1904097 - DNA, 22 bp, Homo sapiens
gctggagaggagccctgcctct

SEQ ID NO: 1904098 - DNA, 13 bp, Homo sapiens
gctggagtctggg

SEQ ID NO: 1904099 - DNA, 15 bp, Homo sapiens
gctggagtgcagtgg

SEQ ID NO: 1904100 - DNA, 18 bp, Homo sapiens
gctggcaagaaccagttg

SEQ ID NO: 1904101 - DNA, 14 bp, Homo sapiens
gctggcaccagcag

SEQ ID NO: 1904102 - DNA, 16 bp, Homo sapiens
gctggcaccagcaggc

SEQ ID NO: 1904103 - DNA, 14 bp, Homo sapiens
gctggccggacacc

SEQ ID NO: 1904104 - DNA, 19 bp, Homo sapiens
gctgggcactgctctcacc

SEQ ID NO: 1904105 - DNA, 13 bp, Homo sapiens
gctgggctggcca

SEQ ID NO: 1904106 - DNA, 14 bp, Homo sapiens
gctgggctgggcac

SEQ ID NO: 1904107 - DNA, 14 bp, Homo sapiens
gctgggggctgcag

SEQ ID NO: 1904108 - DNA, 15 bp, Homo sapiens
gctgggggctgcagg

SEQ ID NO: 1904109 - DNA, 15 bp, Homo sapiens
gctgggtcaggggta

SEQ ID NO: 1904110 - DNA, 18 bp, Homo sapiens
gctgtagtgtttcttttt

SEQ ID NO: 1904111 - DNA, 17 bp, Homo sapiens
gctgtatatatttttct

SEQ ID NO: 1904112 - DNA, 13 bp, Homo sapiens
gctgtctccctcc

SEQ ID NO: 1904113 - DNA, 14 bp, Homo sapiens
gctgtctccctcct

SEQ ID NO: 1904114 - DNA, 15 bp, Homo sapiens
gctgtctccctcctg

SEQ ID NO: 1904115 - DNA, 23 bp, Homo sapiens
gctgtctgttgtattcattgtgg

SEQ ID NO: 1904116 - DNA, 16 bp, Homo sapiens
gctgtgaacatgcctc

SEQ ID NO: 1904117 - DNA, 18 bp, Homo sapiens
gctgtgctgggaggtccc

SEQ ID NO: 1904118 - DNA, 21 bp, Homo sapiens
gctgtgctgggaggtcccagg

SEQ ID NO: 1904119 - DNA, 19 bp, Homo sapiens
gctgttacagttttcttca

SEQ ID NO: 1904120 - DNA, 20 bp, Homo sapiens
gctgttacttgctttgagtt

SEQ ID NO: 1904121 - DNA, 18 bp, Homo sapiens
gctgttagtattgattca

SEQ ID NO: 1904122 - DNA, 21 bp, Homo sapiens
gctgttagtattgattcaaat

SEQ ID NO: 1904123 - DNA, 22 bp, Homo sapiens
gctgttgactctagtactgtga

SEQ ID NO: 1904124 - DNA, 23 bp, Homo sapiens
gctgttggcctctgcaaaggaaa

SEQ ID NO: 1904125 - DNA, 20 bp, Homo sapiens
gcttaactggactgaattca

SEQ ID NO: 1904126 - DNA, 12 bp, Homo sapiens
gcttacatttga

SEQ ID NO: 1904127 - DNA, 14 bp, Homo sapiens
gcttacgtagttct

SEQ ID NO: 1904128 - DNA, 19 bp, Homo sapiens
gcttataaaacagagtaat

SEQ ID NO: 1904129 - DNA, 22 bp, Homo sapiens
gcttataaaacagagtaatctt

SEQ ID NO: 1904130 - DNA, 23 bp, Homo sapiens
gcttatgatagcaaatggcctca

SEQ ID NO: 1904131 - DNA, 18 bp, Homo sapiens
gcttcagcctcccacagt

SEQ ID NO: 1904132 - DNA, 12 bp, Homo sapiens
gcttccagcagg

SEQ ID NO: 1904133 - DNA, 17 bp, Homo sapiens
gcttccagcaggaggga

SEQ ID NO: 1904134 - DNA, 14 bp, Homo sapiens
gcttccccagtagc

SEQ ID NO: 1904135 - DNA, 19 bp, Homo sapiens
gcttcctctgctgcatccc

SEQ ID NO: 1904136 - DNA, 23 bp, Homo sapiens
gcttcctgaggggagacagagca

SEQ ID NO: 1904137 - DNA, 23 bp, Homo sapiens
gcttctagtctggaactgctgct

SEQ ID NO: 1904138 - DNA, 13 bp, Homo sapiens
gcttggcccaggg

SEQ ID NO: 1904139 - DNA, 14 bp, Homo sapiens
gcttggcccagggg

SEQ ID NO: 1904140 - DNA, 17 bp, Homo sapiens
gcttggccctggcagcc

SEQ ID NO: 1904141 - DNA, 12 bp, Homo sapiens
gcttgggctggc

SEQ ID NO: 1904142 - DNA, 13 bp, Homo sapiens
gcttgggctggcg

SEQ ID NO: 1904143 - DNA, 15 bp, Homo sapiens
gcttggtgagtctgt

SEQ ID NO: 1904144 - DNA, 16 bp, Homo sapiens
gcttgtatctgatatc

SEQ ID NO: 1904145 - DNA, 17 bp, Homo sapiens
gcttgtatctgatatca

SEQ ID NO: 1904146 - DNA, 21 bp, Homo sapiens
gcttgtatctgatatcagcac

SEQ ID NO: 1904147 - DNA, 21 bp, Homo sapiens
gcttgtggaagacaagtctgt

SEQ ID NO: 1904148 - DNA, 15 bp, Homo sapiens
gctttagacttgaaa

SEQ ID NO: 1904149 - DNA, 15 bp, Homo sapiens
gctttcctaaaacag

SEQ ID NO: 1904150 - DNA, 13 bp, Homo sapiens
gctttctgaatgt

SEQ ID NO: 1904151 - DNA, 17 bp, Homo sapiens
gctttggtcacttttag

SEQ ID NO: 1904152 - DNA, 15 bp, Homo sapiens
gcttttcctgggaca

SEQ ID NO: 1904153 - DNA, 20 bp, Homo sapiens
ggaaacattggcataatttt

SEQ ID NO: 1904154 - DNA, 15 bp, Homo sapiens
ggaaagagagctgga

SEQ ID NO: 1904155 - DNA, 16 bp, Homo sapiens
ggaaagcaaaataaca

SEQ ID NO: 1904156 - DNA, 22 bp, Homo sapiens
ggaaaggccagcagccttccag

SEQ ID NO: 1904157 - DNA, 16 bp, Homo sapiens
ggaaataccagttctg

SEQ ID NO: 1904158 - DNA, 20 bp, Homo sapiens
ggaaatcaaagtgctattac

SEQ ID NO: 1904159 - DNA, 18 bp, Homo sapiens
ggaaatcaaatgtaaagt

SEQ ID NO: 1904160 - DNA, 19 bp, Homo sapiens
ggaaattaagaagaaacta

SEQ ID NO: 1904161 - DNA, 13 bp, Homo sapiens
ggaagcagaagga

SEQ ID NO: 1904162 - DNA, 15 bp, Homo sapiens
ggaagcagtgcccag

SEQ ID NO: 1904163 - DNA, 16 bp, Homo sapiens
ggaagcagtgcccagg

SEQ ID NO: 1904164 - DNA, 11 bp, Homo sapiens
ggaagctagac

SEQ ID NO: 1904165 - DNA, 13 bp, Homo sapiens
ggaagctgaggcc

SEQ ID NO: 1904166 - DNA, 14 bp, Homo sapiens
ggaagctgaggccc

SEQ ID NO: 1904167 - DNA, 18 bp, Homo sapiens
ggaagtagcacaggctga

SEQ ID NO: 1904168 - DNA, 16 bp, Homo sapiens
ggaagttaaaagcaca

SEQ ID NO: 1904169 - DNA, 22 bp, Homo sapiens
ggaatctagccagtgaacataa

SEQ ID NO: 1904170 - DNA, 20 bp, Homo sapiens
ggacactaagaggaggcagg

SEQ ID NO: 1904171 - DNA, 16 bp, Homo sapiens
ggacactgtggcagca

SEQ ID NO: 1904172 - DNA, 19 bp, Homo sapiens
ggacactgtggcagcagga

SEQ ID NO: 1904173 - DNA, 13 bp, Homo sapiens
ggacagcctgcct

SEQ ID NO: 1904174 - DNA, 17 bp, Homo sapiens
ggacagcctgcctctgc

SEQ ID NO: 1904175 - DNA, 20 bp, Homo sapiens
ggacagcctgcctctgccac

SEQ ID NO: 1904176 - DNA, 15 bp, Homo sapiens
ggacaggggttcctt

SEQ ID NO: 1904177 - DNA, 14 bp, Homo sapiens
ggacatcccctgct

SEQ ID NO: 1904178 - DNA, 21 bp, Homo sapiens
ggacatcctgtcatctgagaa

SEQ ID NO: 1904179 - DNA, 13 bp, Homo sapiens
ggaccacagaggc

SEQ ID NO: 1904180 - DNA, 16 bp, Homo sapiens
ggaccacagaggctgt

SEQ ID NO: 1904181 - DNA, 20 bp, Homo sapiens
ggaccacaggtgcccgccac

SEQ ID NO: 1904182 - DNA, 16 bp, Homo sapiens
ggaccagcccacgctg

SEQ ID NO: 1904183 - DNA, 23 bp, Homo sapiens
gcaaattccatagctcaataaaa

SEQ ID NO: 1904184 - DNA, 18 bp, Homo sapiens
gcaaccatatagaaagct

SEQ ID NO: 1904185 - DNA, 13 bp, Homo sapiens
gcaacccctggac

SEQ ID NO: 1904186 - DNA, 16 bp, Homo sapiens
gcaacgatcacaaatg

SEQ ID NO: 1904187 - DNA, 18 bp, Homo sapiens
gcaagcaccatcccctcc

SEQ ID NO: 1904188 - DNA, 19 bp, Homo sapiens
gcaagggcggcctttccca

SEQ ID NO: 1904189 - DNA, 13 bp, Homo sapiens
gcaagtgtgaata

SEQ ID NO: 1904190 - DNA, 16 bp, Homo sapiens
gcaagtgtgaatactg

SEQ ID NO: 1904191 - DNA, 14 bp, Homo sapiens
gcaataaattttga

SEQ ID NO: 1904192 - DNA, 15 bp, Homo sapiens
gcaataaattttgaa

SEQ ID NO: 1904193 - DNA, 16 bp, Homo sapiens
gcaataaattttgaaa

SEQ ID NO: 1904194 - DNA, 22 bp, Homo sapiens
gcaataacagtagtgttacatg

SEQ ID NO: 1904195 - DNA, 17 bp, Homo sapiens
gcaataccaacctgaaa

SEQ ID NO: 1904196 - DNA, 18 bp, Homo sapiens
gcaataccaacctgaaag

SEQ ID NO: 1904197 - DNA, 12 bp, Homo sapiens
gcaatgccccct

SEQ ID NO: 1904198 - DNA, 19 bp, Homo sapiens
gcaatgccccctcccctcc

SEQ ID NO: 1904199 - DNA, 22 bp, Homo sapiens
gcacaccaatcttactttgtaa

SEQ ID NO: 1904200 - DNA, 16 bp, Homo sapiens
gcacaggcagggcagg

SEQ ID NO: 1904201 - DNA, 21 bp, Homo sapiens
gcacaggcagggcaggaccag

SEQ ID NO: 1904202 - DNA, 13 bp, Homo sapiens
gcacaggctgagt

SEQ ID NO: 1904203 - DNA, 17 bp, Homo sapiens
gcacaggctgagtgcag

SEQ ID NO: 1904204 - DNA, 18 bp, Homo sapiens
gcacaggctgagtgcagg

SEQ ID NO: 1904205 - DNA, 22 bp, Homo sapiens
gcacaggctgagtgcaggccca

SEQ ID NO: 1904206 - DNA, 11 bp, Homo sapiens
gcacagggcct

SEQ ID NO: 1904207 - DNA, 14 bp, Homo sapiens
gcacaggtattttt

SEQ ID NO: 1904208 - DNA, 13 bp, Homo sapiens
gcaccatactcat

SEQ ID NO: 1904209 - DNA, 13 bp, Homo sapiens
gcaccatcccctc

SEQ ID NO: 1904210 - DNA, 22 bp, Homo sapiens
gcacccatccaccgtcccctcc

SEQ ID NO: 1904211 - DNA, 15 bp, Homo sapiens
gcacgcctctcccca

SEQ ID NO: 1904212 - DNA, 18 bp, Homo sapiens
gcacgcctctccccacct

SEQ ID NO: 1904213 - DNA, 21 bp, Homo sapiens
gcactgaatggctgacctgac

SEQ ID NO: 1904214 - DNA, 14 bp, Homo sapiens
gcactgactctgga

SEQ ID NO: 1904215 - DNA, 16 bp, Homo sapiens
gcactgactctggaaa

SEQ ID NO: 1904216 - DNA, 17 bp, Homo sapiens
gcactgactctggaaaa

SEQ ID NO: 1904217 - DNA, 18 bp, Homo sapiens
gcactgactctggaaaag

SEQ ID NO: 1904218 - DNA, 13 bp, Homo sapiens
gcactgctctcac

SEQ ID NO: 1904219 - DNA, 23 bp, Homo sapiens
gcacttgggggctcagcaaggcc

SEQ ID NO: 1904220 - DNA, 19 bp, Homo sapiens
gcagaacttccctccatcc

SEQ ID NO: 1904221 - DNA, 20 bp, Homo sapiens
gcagacttttaaagacttgc

SEQ ID NO: 1904222 - DNA, 20 bp, Homo sapiens
gcagagaagtgacggttcct

SEQ ID NO: 1904223 - DNA, 19 bp, Homo sapiens
gcagagagcgaccagcagg

SEQ ID NO: 1904224 - DNA, 20 bp, Homo sapiens
gcagagagcgaccagcaggc

SEQ ID NO: 1904225 - DNA, 20 bp, Homo sapiens
gcagaggtggtctggtgcca

SEQ ID NO: 1904226 - DNA, 17 bp, Homo sapiens
gcagatacactgctctc

SEQ ID NO: 1904227 - DNA, 14 bp, Homo sapiens
gcagcaacacacat

SEQ ID NO: 1904228 - DNA, 15 bp, Homo sapiens
gcagcacagctgaga

SEQ ID NO: 1904229 - DNA, 14 bp, Homo sapiens
gcagcacgcctctc

SEQ ID NO: 1904230 - DNA, 20 bp, Homo sapiens
gcagcacgcctctccccacc

SEQ ID NO: 1904231 - DNA, 21 bp, Homo sapiens
gcagcacgcctctccccacct

SEQ ID NO: 1904232 - DNA, 12 bp, Homo sapiens
gcagcaggaggg

SEQ ID NO: 1904233 - DNA, 20 bp, Homo sapiens
gcagcaggggccaagcaggc

SEQ ID NO: 1904234 - DNA, 22 bp, Homo sapiens
gcagcatgcaaacttggatcag

SEQ ID NO: 1904235 - DNA, 17 bp, Homo sapiens
gcagccatttctccatg

SEQ ID NO: 1904236 - DNA, 22 bp, Homo sapiens
gcagcccgcatcagctgctcag

SEQ ID NO: 1904237 - DNA, 24 bp, Homo sapiens
gcagccttccagtggcttctccca

SEQ ID NO: 1904238 - DNA, 20 bp, Homo sapiens
gcagctcagaaccacagcaa

SEQ ID NO: 1904239 - DNA, 18 bp, Homo sapiens
gcagctgtcaccactaca

SEQ ID NO: 1904240 - DNA, 18 bp, Homo sapiens
gcagcttgggctggcggg

SEQ ID NO: 1904241 - DNA, 19 bp, Homo sapiens
gcaggacactgcagaacag

SEQ ID NO: 1904242 - DNA, 13 bp, Homo sapiens
gcaggaccagccc

SEQ ID NO: 1904243 - DNA, 14 bp, Homo sapiens
gcaggaccagccca

SEQ ID NO: 1904244 - DNA, 15 bp, Homo sapiens
gcaggaccagcccac

SEQ ID NO: 1904245 - DNA, 16 bp, Homo sapiens
gcaggcccaccctgct

SEQ ID NO: 1904246 - DNA, 20 bp, Homo sapiens
gcaggcccaccctgcttggc

SEQ ID NO: 1904247 - DNA, 20 bp, Homo sapiens
gcaggccctgggcctccacc

SEQ ID NO: 1904248 - DNA, 16 bp, Homo sapiens
gcaggctcctcagccc

SEQ ID NO: 1904249 - DNA, 16 bp, Homo sapiens
gcagggcacagaaggc

SEQ ID NO: 1904250 - DNA, 13 bp, Homo sapiens
gcagggcacaggg

SEQ ID NO: 1904251 - DNA, 16 bp, Homo sapiens
gcagggcaggaccagc

SEQ ID NO: 1904252 - DNA, 18 bp, Homo sapiens
gcagggcaggaccagccc

SEQ ID NO: 1904253 - DNA, 13 bp, Homo sapiens
gcagggcaggccc

SEQ ID NO: 1904254 - DNA, 15 bp, Homo sapiens
gcagggctgggtcag

SEQ ID NO: 1904255 - DNA, 16 bp, Homo sapiens
gcaggggccaagcagg

SEQ ID NO: 1904256 - DNA, 19 bp, Homo sapiens
gcaggggccaagcaggcac

SEQ ID NO: 1904257 - DNA, 16 bp, Homo sapiens
gcagtaaatatttact

SEQ ID NO: 1904258 - DNA, 13 bp, Homo sapiens
gcagtcgtcagcc

SEQ ID NO: 1904259 - DNA, 14 bp, Homo sapiens
gcagtgcccaggtg

SEQ ID NO: 1904260 - DNA, 12 bp, Homo sapiens
gcagtgtcttag

SEQ ID NO: 1904261 - DNA, 18 bp, Homo sapiens
gcagtgtgaatgctgggc

SEQ ID NO: 1904262 - DNA, 17 bp, Homo sapiens
gcagtgttatttatttc

SEQ ID NO: 1904263 - DNA, 23 bp, Homo sapiens
gcagttatgtgacctcacgtgca

SEQ ID NO: 1904264 - DNA, 19 bp, Homo sapiens
gcagtttgaggattagttt

SEQ ID NO: 1904265 - DNA, 21 bp, Homo sapiens
gcatatgcctacaaagctctg

SEQ ID NO: 1904266 - DNA, 23 bp, Homo sapiens
gcatattctagtaataaagactc

SEQ ID NO: 1904267 - DNA, 17 bp, Homo sapiens
gcatattctgatgtttc

SEQ ID NO: 1904268 - DNA, 20 bp, Homo sapiens
gcatcacttaaaacacgttt

SEQ ID NO: 1904269 - DNA, 19 bp, Homo sapiens
gcatcagctgctcagatcc

SEQ ID NO: 1904270 - DNA, 23 bp, Homo sapiens
gcatccatggggtctctcacaga

SEQ ID NO: 1904271 - DNA, 12 bp, Homo sapiens
gcatccccttcc

SEQ ID NO: 1904272 - DNA, 17 bp, Homo sapiens
gcatccccttccagctc

SEQ ID NO: 1904273 - DNA, 21 bp, Homo sapiens
gcatccccttccagctccctc

SEQ ID NO: 1904274 - DNA, 23 bp, Homo sapiens
gcatccccttccagctccctccc

SEQ ID NO: 1904275 - DNA, 13 bp, Homo sapiens
gcatctttgatgt

SEQ ID NO: 1904276 - DNA, 17 bp, Homo sapiens
gcatctttgatgtgttg

SEQ ID NO: 1904277 - DNA, 21 bp, Homo sapiens
gcatgaacagctaattgtacc

SEQ ID NO: 1904278 - DNA, 21 bp, Homo sapiens
gcatgaggccccgaggctcga

SEQ ID NO: 1904279 - DNA, 23 bp, Homo sapiens
gcatgggtcagggtgtgaggcca

SEQ ID NO: 1904280 - DNA, 13 bp, Homo sapiens
gcatggtggttgg

SEQ ID NO: 1904281 - DNA, 20 bp, Homo sapiens
gcatgtgttgcagctgtcac

SEQ ID NO: 1904282 - DNA, 17 bp, Homo sapiens
gcattagtgggaaaaag

SEQ ID NO: 1904283 - DNA, 21 bp, Homo sapiens
gcattccactttttgttacat

SEQ ID NO: 1904284 - DNA, 21 bp, Homo sapiens
gcattcttctgatcactgaaa

SEQ ID NO: 1904285 - DNA, 23 bp, Homo sapiens
gcattgagttttgaaagatgagt

SEQ ID NO: 1904286 - DNA, 12 bp, Homo sapiens
gcattgtctgtt

SEQ ID NO: 1904287 - DNA, 18 bp, Homo sapiens
gcatttagggagtattct

SEQ ID NO: 1904288 - DNA, 20 bp, Homo sapiens
gcatttggcttcctctgctg

SEQ ID NO: 1904289 - DNA, 21 bp, Homo sapiens
gcatttggcttcctctgctgc

SEQ ID NO: 1904290 - DNA, 22 bp, Homo sapiens
gcatttggcttcctctgctgca

SEQ ID NO: 1904291 - DNA, 20 bp, Homo sapiens
gcattttttttttttaaagg

SEQ ID NO: 1904292 - DNA, 16 bp, Homo sapiens
gccaacagaacacttg

SEQ ID NO: 1904293 - DNA, 13 bp, Homo sapiens
gccaagggggacc

SEQ ID NO: 1904294 - DNA, 17 bp, Homo sapiens
gccaagggggacctcgg

SEQ ID NO: 1904295 - DNA, 13 bp, Homo sapiens
gccacatccctct

SEQ ID NO: 1904296 - DNA, 21 bp, Homo sapiens
gccaccaacagccactcagaa

SEQ ID NO: 1904297 - DNA, 24 bp, Homo sapiens
gccaccacgcctagcctcacgctc

SEQ ID NO: 1904298 - DNA, 23 bp, Homo sapiens
gccaccactgactataccaactg

SEQ ID NO: 1904299 - DNA, 13 bp, Homo sapiens
gccaccagcgccc

SEQ ID NO: 1904300 - DNA, 19 bp, Homo sapiens
gccaccagcgcccccactc

SEQ ID NO: 1904301 - DNA, 20 bp, Homo sapiens
gccaccagcgcccccactcc

SEQ ID NO: 1904302 - DNA, 21 bp, Homo sapiens
gccaccagcgcccccactcct

SEQ ID NO: 1904303 - DNA, 20 bp, Homo sapiens
gccacctcctaaaaggccca

SEQ ID NO: 1904304 - DNA, 22 bp, Homo sapiens
gccacctcctaaaaggcccaga

SEQ ID NO: 1904305 - DNA, 14 bp, Homo sapiens
gccacctcttcctg

SEQ ID NO: 1904306 - DNA, 18 bp, Homo sapiens
gccacctcttcctggccg

SEQ ID NO: 1904307 - DNA, 16 bp, Homo sapiens
gccacctgagttcctg

SEQ ID NO: 1904308 - DNA, 15 bp, Homo sapiens
gccagatgtcctaat

SEQ ID NO: 1904309 - DNA, 18 bp, Homo sapiens
gccagcagcctctgatct

SEQ ID NO: 1904310 - DNA, 14 bp, Homo sapiens
gccagcagccttcc

SEQ ID NO: 1904311 - DNA, 16 bp, Homo sapiens
gccagcagccttccag

SEQ ID NO: 1904312 - DNA, 19 bp, Homo sapiens
gccagccaaacacacagaa

SEQ ID NO: 1904313 - DNA, 20 bp, Homo sapiens
gccagccaaacacacagaag

SEQ ID NO: 1904314 - DNA, 22 bp, Homo sapiens
gccagccaaacacacagaaggg

SEQ ID NO: 1904315 - DNA, 16 bp, Homo sapiens
gccagcggccctccca

SEQ ID NO: 1904316 - DNA, 17 bp, Homo sapiens
gccagcggccctcccag

SEQ ID NO: 1904317 - DNA, 20 bp, Homo sapiens
gccagcggccctcccaggcg

SEQ ID NO: 1904318 - DNA, 20 bp, Homo sapiens
gccagctgctgagccgcaga

SEQ ID NO: 1904319 - DNA, 17 bp, Homo sapiens
gccaggaagtagcacag

SEQ ID NO: 1904320 - DNA, 20 bp, Homo sapiens
gccaggatgctcccccaggg

SEQ ID NO: 1904321 - DNA, 17 bp, Homo sapiens
gccaggcacaggcaggg

SEQ ID NO: 1904322 - DNA, 20 bp, Homo sapiens
gccagggaaagactggcaag

SEQ ID NO: 1904323 - DNA, 11 bp, Homo sapiens
gccagggatgg

SEQ ID NO: 1904324 - DNA, 14 bp, Homo sapiens
gccagggatggcag

SEQ ID NO: 1904325 - DNA, 22 bp, Homo sapiens
gccagggatggcagtggctgtg

SEQ ID NO: 1904326 - DNA, 17 bp, Homo sapiens
gccaggtatttttctat

SEQ ID NO: 1904327 - DNA, 18 bp, Homo sapiens
gccatagagtacactgcc

SEQ ID NO: 1904328 - DNA, 20 bp, Homo sapiens
gccatgagaatgttttagca

SEQ ID NO: 1904329 - DNA, 22 bp, Homo sapiens
gccatgagaatgttttagcaca

SEQ ID NO: 1904330 - DNA, 19 bp, Homo sapiens
gccatgaggaggcagagag

SEQ ID NO: 1904331 - DNA, 18 bp, Homo sapiens
gccatgtacccattgcag

SEQ ID NO: 1904332 - DNA, 16 bp, Homo sapiens
gccatgtgcttctgcc

SEQ ID NO: 1904333 - DNA, 17 bp, Homo sapiens
gccattctgactcatat

SEQ ID NO: 1904334 - DNA, 20 bp, Homo sapiens
gcccaccctgcttggcccag

SEQ ID NO: 1904335 - DNA, 21 bp, Homo sapiens
gcccaccctgcttggcccagg

SEQ ID NO: 1904336 - DNA, 23 bp, Homo sapiens
gcccaccctgcttggcccagggg

SEQ ID NO: 1904337 - DNA, 18 bp, Homo sapiens
gcccacgctgactacagg

SEQ ID NO: 1904338 - DNA, 19 bp, Homo sapiens
gcccacgctgactacaggg

SEQ ID NO: 1904339 - DNA, 11 bp, Homo sapiens
gcccacttccc

SEQ ID NO: 1904340 - DNA, 17 bp, Homo sapiens
gcccagaatactgatgg

SEQ ID NO: 1904341 - DNA, 23 bp, Homo sapiens
gcccagagagaagagccccactc

SEQ ID NO: 1904342 - DNA, 23 bp, Homo sapiens
gcccagcagacatcaagctcaag

SEQ ID NO: 1904343 - DNA, 17 bp, Homo sapiens
gcccagctgtgctggga

SEQ ID NO: 1904344 - DNA, 19 bp, Homo sapiens
gcccagctgtgctgggagg

SEQ ID NO: 1904345 - DNA, 15 bp, Homo sapiens
gcccagcttccatgc

SEQ ID NO: 1904346 - DNA, 11 bp, Homo sapiens
gcccaggagcc

SEQ ID NO: 1904347 - DNA, 14 bp, Homo sapiens
gcccaggagcccat

SEQ ID NO: 1904348 - DNA, 15 bp, Homo sapiens
gcccaggcagagagc

SEQ ID NO: 1904349 - DNA, 15 bp, Homo sapiens
gcccagtcccagcag

SEQ ID NO: 1904350 - DNA, 20 bp, Homo sapiens
gcccagtcccagcagccagc

SEQ ID NO: 1904351 - DNA, 14 bp, Homo sapiens
gcccatcaggggca

SEQ ID NO: 1904352 - DNA, 15 bp, Homo sapiens
gcccatgtatggcca

SEQ ID NO: 1904353 - DNA, 16 bp, Homo sapiens
gcccatgtatggccag

SEQ ID NO: 1904354 - DNA, 17 bp, Homo sapiens
gcccatgtatggccagg

SEQ ID NO: 1904355 - DNA, 17 bp, Homo sapiens
gcccatgtgttccctct

SEQ ID NO: 1904356 - DNA, 17 bp, Homo sapiens
gcccatttggagggcct

SEQ ID NO: 1904357 - DNA, 15 bp, Homo sapiens
gccccacctggccct

SEQ ID NO: 1904358 - DNA, 16 bp, Homo sapiens
gccccactctcagagg

SEQ ID NO: 1904359 - DNA, 21 bp, Homo sapiens
gccccactctcagaggcccca

SEQ ID NO: 1904360 - DNA, 16 bp, Homo sapiens
gcccccactcctcctc

SEQ ID NO: 1904361 - DNA, 12 bp, Homo sapiens
gcccccagcttc

SEQ ID NO: 1904362 - DNA, 13 bp, Homo sapiens
gccccctcccctc

SEQ ID NO: 1904363 - DNA, 14 bp, Homo sapiens
gccccctcccctcc

SEQ ID NO: 1904364 - DNA, 14 bp, Homo sapiens
gccccgtctcaggt

SEQ ID NO: 1904365 - DNA, 17 bp, Homo sapiens
gccccgtctcaggtctg

SEQ ID NO: 1904366 - DNA, 13 bp, Homo sapiens
gcccctgagccca

SEQ ID NO: 1904367 - DNA, 21 bp, Homo sapiens
gccccttctatgcccagctgt

SEQ ID NO: 1904368 - DNA, 15 bp, Homo sapiens
gccccttgggcctcc

SEQ ID NO: 1904369 - DNA, 17 bp, Homo sapiens
gcccgatcctcccctgg

SEQ ID NO: 1904370 - DNA, 20 bp, Homo sapiens
gcccgatcctcccctggact

SEQ ID NO: 1904371 - DNA, 15 bp, Homo sapiens
gcccggcatgaggcc

SEQ ID NO: 1904372 - DNA, 15 bp, Homo sapiens
gcccgggcccaggca

SEQ ID NO: 1904373 - DNA, 18 bp, Homo sapiens
gccctcagtcggggcagg

SEQ ID NO: 1904374 - DNA, 13 bp, Homo sapiens
gccctcccaggcg

SEQ ID NO: 1904375 - DNA, 20 bp, Homo sapiens
gccctctctgaaggaggcca

SEQ ID NO: 1904376 - DNA, 22 bp, Homo sapiens
gccctctctgaaggaggccacc

SEQ ID NO: 1904377 - DNA, 13 bp, Homo sapiens
gccctctgctcta

SEQ ID NO: 1904378 - DNA, 13 bp, Homo sapiens
gccctgatctccg

SEQ ID NO: 1904379 - DNA, 13 bp, Homo sapiens
gccctgcctctcc

SEQ ID NO: 1904380 - DNA, 21 bp, Homo sapiens
gccctgcctctccgcccctga

SEQ ID NO: 1904381 - DNA, 13 bp, Homo sapiens
gccctgggccagg

SEQ ID NO: 1904382 - DNA, 14 bp, Homo sapiens
gccctgggcctcca

SEQ ID NO: 1904383 - DNA, 21 bp, Homo sapiens
gccctgggcctccacctctgt

SEQ ID NO: 1904384 - DNA, 12 bp, Homo sapiens
gccgcactggga

SEQ ID NO: 1904385 - DNA, 15 bp, Homo sapiens
gccgcactgggagca

SEQ ID NO: 1904386 - DNA, 23 bp, Homo sapiens
gccgccgctaggtagagtctgag

SEQ ID NO: 1904387 - DNA, 13 bp, Homo sapiens
gccgctaggtaga

SEQ ID NO: 1904388 - DNA, 23 bp, Homo sapiens
gccgctaggtagagtctgagggc

SEQ ID NO: 1904389 - DNA, 17 bp, Homo sapiens
gccggaaagagagctgg

SEQ ID NO: 1904390 - DNA, 20 bp, Homo sapiens
gccggcaataaaagcccagg

SEQ ID NO: 1904391 - DNA, 21 bp, Homo sapiens
gccggcaataaaagcccagga

SEQ ID NO: 1904392 - DNA, 23 bp, Homo sapiens
gccggcaataaaagcccaggagc

SEQ ID NO: 1904393 - DNA, 19 bp, Homo sapiens
gccgtggccggggtccagg

SEQ ID NO: 1904394 - DNA, 18 bp, Homo sapiens
gccgttgctgacttagaa

SEQ ID NO: 1904395 - DNA, 19 bp, Homo sapiens
gccgttgctgacttagaat

SEQ ID NO: 1904396 - DNA, 15 bp, Homo sapiens
gcctacaaagctctg

SEQ ID NO: 1904397 - DNA, 15 bp, Homo sapiens
gcctaggcttggctc

SEQ ID NO: 1904398 - DNA, 19 bp, Homo sapiens
gcctataagccaaaattaa

SEQ ID NO: 1904399 - DNA, 15 bp, Homo sapiens
gcctcaaatccagga

SEQ ID NO: 1904400 - DNA, 20 bp, Homo sapiens
gcctcagtttccctatctgc

SEQ ID NO: 1904401 - DNA, 21 bp, Homo sapiens
gcctcagtttccctatctgca

SEQ ID NO: 1904402 - DNA, 20 bp, Homo sapiens
gcctccaacccctcgcccag

SEQ ID NO: 1904403 - DNA, 17 bp, Homo sapiens
gcctccacctctgtgca

SEQ ID NO: 1904404 - DNA, 13 bp, Homo sapiens
gcctcccactccc

SEQ ID NO: 1904405 - DNA, 15 bp, Homo sapiens
gcctcccactcccat

SEQ ID NO: 1904406 - DNA, 18 bp, Homo sapiens
gcctcccactcccatggc

SEQ ID NO: 1904407 - DNA, 21 bp, Homo sapiens
gcctcccactcccatggctct

SEQ ID NO: 1904408 - DNA, 15 bp, Homo sapiens
gcctccccttcccag

SEQ ID NO: 1904409 - DNA, 19 bp, Homo sapiens
gcctccccttcccagaccc

SEQ ID NO: 1904410 - DNA, 21 bp, Homo sapiens
gcctccctgacgtctgccacc

SEQ ID NO: 1904411 - DNA, 15 bp, Homo sapiens
gcctccgcttccctg

SEQ ID NO: 1904412 - DNA, 13 bp, Homo sapiens
gcctcctcctgcc

SEQ ID NO: 1904413 - DNA, 13 bp, Homo sapiens
gcctcctgccatg

SEQ ID NO: 1904414 - DNA, 13 bp, Homo sapiens
gcctctccccacc

SEQ ID NO: 1904415 - DNA, 22 bp, Homo sapiens
gcctctccgcccctgagcccac

SEQ ID NO: 1904416 - DNA, 20 bp, Homo sapiens
gcctcttctcctgcagcctg

SEQ ID NO: 1904417 - DNA, 15 bp, Homo sapiens
gcctcttctgagctt

SEQ ID NO: 1904418 - DNA, 18 bp, Homo sapiens
gcctgagggaggaggcag

SEQ ID NO: 1904419 - DNA, 21 bp, Homo sapiens
gcctgcacttgggggctcagc

SEQ ID NO: 1904420 - DNA, 12 bp, Homo sapiens
gcctgcctctgc

SEQ ID NO: 1904421 - DNA, 17 bp, Homo sapiens
gcctgcctctgccacag

SEQ ID NO: 1904422 - DNA, 19 bp, Homo sapiens
gcctgcctctgccacagca

SEQ ID NO: 1904423 - DNA, 16 bp, Homo sapiens
gcctgcggggcagcag

SEQ ID NO: 1904424 - DNA, 18 bp, Homo sapiens
gcctgcggggcagcaggg

SEQ ID NO: 1904425 - DNA, 14 bp, Homo sapiens
gcctggcaggggat

SEQ ID NO: 1904426 - DNA, 12 bp, Homo sapiens
gcctggctccct

SEQ ID NO: 1904427 - DNA, 16 bp, Homo sapiens
gcctggctccctcact

SEQ ID NO: 1904428 - DNA, 19 bp, Homo sapiens
gcctggctccctcactctc

SEQ ID NO: 1904429 - DNA, 21 bp, Homo sapiens
gcctggctccctcactctcag

SEQ ID NO: 1904430 - DNA, 13 bp, Homo sapiens
gcctgggatctcg

SEQ ID NO: 1904431 - DNA, 22 bp, Homo sapiens
gcctgggcaataaagtgagacc

SEQ ID NO: 1904432 - DNA, 22 bp, Homo sapiens
gcctggtgatgcgcagttgctg

SEQ ID NO: 1904433 - DNA, 13 bp, Homo sapiens
gcctgtaaatgta

SEQ ID NO: 1904434 - DNA, 20 bp, Homo sapiens
gcctgtaatcccagcacttt

SEQ ID NO: 1904435 - DNA, 21 bp, Homo sapiens
gcctgtctcccaccctttctg

SEQ ID NO: 1904436 - DNA, 22 bp, Homo sapiens
gccttaaagacaagacagcatt

SEQ ID NO: 1904437 - DNA, 21 bp, Homo sapiens
gccttaagtgaggaaatcaaa

SEQ ID NO: 1904438 - DNA, 22 bp, Homo sapiens
gccttaagtgaggaaatcaaag

SEQ ID NO: 1904439 - DNA, 16 bp, Homo sapiens
gccttagcatgtgttg

SEQ ID NO: 1904440 - DNA, 16 bp, Homo sapiens
gccttccagtggcttc

SEQ ID NO: 1904441 - DNA, 17 bp, Homo sapiens
gccttccagtggcttct

SEQ ID NO: 1904442 - DNA, 18 bp, Homo sapiens
gccttccagtggcttctc

SEQ ID NO: 1904443 - DNA, 16 bp, Homo sapiens
gccttcgaaaagaaat

SEQ ID NO: 1904444 - DNA, 13 bp, Homo sapiens
gcctttgaggttt

SEQ ID NO: 1904445 - DNA, 21 bp, Homo sapiens
gcctttgcagctcagaaccac

SEQ ID NO: 1904446 - DNA, 17 bp, Homo sapiens
gcgaaatccctgctcac

SEQ ID NO: 1904447 - DNA, 18 bp, Homo sapiens
gcgaggctgggctggcca

SEQ ID NO: 1904448 - DNA, 18 bp, Homo sapiens
gcgcaagggaggcccagc

SEQ ID NO: 1904449 - DNA, 14 bp, Homo sapiens
gcgccctggccccc

SEQ ID NO: 1904450 - DNA, 23 bp, Homo sapiens
gcgcggatttctctttctctctc

SEQ ID NO: 1904451 - DNA, 20 bp, Homo sapiens
gctaacatggtaaaaccccg

SEQ ID NO: 1904452 - DNA, 15 bp, Homo sapiens
gctacatttccgcca

SEQ ID NO: 1904453 - DNA, 20 bp, Homo sapiens
gctactatgatttaatttga

SEQ ID NO: 1904454 - DNA, 21 bp, Homo sapiens
gctagcctcacgaaactggaa

SEQ ID NO: 1904455 - DNA, 13 bp, Homo sapiens
gctagtcaacagt

SEQ ID NO: 1904456 - DNA, 16 bp, Homo sapiens
tccccaagcctggcag

SEQ ID NO: 1904457 - DNA, 21 bp, Homo sapiens
tccccacccagacctgcctgt

SEQ ID NO: 1904458 - DNA, 13 bp, Homo sapiens
tccccagggcacg

SEQ ID NO: 1904459 - DNA, 21 bp, Homo sapiens
tccccctgtttcagaggctca

SEQ ID NO: 1904460 - DNA, 15 bp, Homo sapiens
tcccctaaagcctca

SEQ ID NO: 1904461 - DNA, 14 bp, Homo sapiens
tcccctcccaggga

SEQ ID NO: 1904462 - DNA, 19 bp, Homo sapiens
tcccctggaagcagtgccc

SEQ ID NO: 1904463 - DNA, 16 bp, Homo sapiens
tccccttccagctccc

SEQ ID NO: 1904464 - DNA, 18 bp, Homo sapiens
tccccttccagctccctc

SEQ ID NO: 1904465 - DNA, 14 bp, Homo sapiens
tccccttcccagac

SEQ ID NO: 1904466 - DNA, 22 bp, Homo sapiens
tccccttgccagctgctgagcc

SEQ ID NO: 1904467 - DNA, 11 bp, Homo sapiens
tcccctttctt

SEQ ID NO: 1904468 - DNA, 18 bp, Homo sapiens
tcccctttttctttccct

SEQ ID NO: 1904469 - DNA, 14 bp, Homo sapiens
tcccgggactctgc

SEQ ID NO: 1904470 - DNA, 17 bp, Homo sapiens
tcccgtttccctccagg

SEQ ID NO: 1904471 - DNA, 14 bp, Homo sapiens
tccctcactctcag

SEQ ID NO: 1904472 - DNA, 15 bp, Homo sapiens
tccctccatccaccc

SEQ ID NO: 1904473 - DNA, 13 bp, Homo sapiens
tccctcccctgct

SEQ ID NO: 1904474 - DNA, 18 bp, Homo sapiens
tccctctcctctgccctc

SEQ ID NO: 1904475 - DNA, 16 bp, Homo sapiens
tccctgacgtctgcca

SEQ ID NO: 1904476 - DNA, 15 bp, Homo sapiens
tccctgctcactgca

SEQ ID NO: 1904477 - DNA, 24 bp, Homo sapiens
tccctgctgtatcttccagaacct

SEQ ID NO: 1904478 - DNA, 17 bp, Homo sapiens
tccctggcctcagggct

SEQ ID NO: 1904479 - DNA, 21 bp, Homo sapiens
tccctgggttagactgccagc

SEQ ID NO: 1904480 - DNA, 18 bp, Homo sapiens
tccctggttcaagcgatt

SEQ ID NO: 1904481 - DNA, 20 bp, Homo sapiens
tccctgtaattgttgtttgt

SEQ ID NO: 1904482 - DNA, 21 bp, Homo sapiens
tccctgtaattgttgtttgta

SEQ ID NO: 1904483 - DNA, 19 bp, Homo sapiens
tcccttccatctcttcctt

SEQ ID NO: 1904484 - DNA, 12 bp, Homo sapiens
tccgcttccctg

SEQ ID NO: 1904485 - DNA, 16 bp, Homo sapiens
tccgcttccctggttc

SEQ ID NO: 1904486 - DNA, 16 bp, Homo sapiens
tccggcaccagtagca

SEQ ID NO: 1904487 - DNA, 18 bp, Homo sapiens
tccggctaagcaggcgca

SEQ ID NO: 1904488 - DNA, 15 bp, Homo sapiens
tccgtagcttctagt

SEQ ID NO: 1904489 - DNA, 17 bp, Homo sapiens
tccgttgcaaacccaaa

SEQ ID NO: 1904490 - DNA, 20 bp, Homo sapiens
tcctaatggtgatgcagtct

SEQ ID NO: 1904491 - DNA, 12 bp, Homo sapiens
tcctacacagga

SEQ ID NO: 1904492 - DNA, 14 bp, Homo sapiens
tcctacacaggaca

SEQ ID NO: 1904493 - DNA, 13 bp, Homo sapiens
tcctattagtgtt

SEQ ID NO: 1904494 - DNA, 19 bp, Homo sapiens
tcctattagtgttatatga

SEQ ID NO: 1904495 - DNA, 17 bp, Homo sapiens
tcctcaaaatgggagat

SEQ ID NO: 1904496 - DNA, 18 bp, Homo sapiens
tcctcactggtctacact

SEQ ID NO: 1904497 - DNA, 13 bp, Homo sapiens
tcctcagccctct

SEQ ID NO: 1904498 - DNA, 20 bp, Homo sapiens
tcctccccaccctgtcccag

SEQ ID NO: 1904499 - DNA, 16 bp, Homo sapiens
tcctcctgccctccgc

SEQ ID NO: 1904500 - DNA, 17 bp, Homo sapiens
tcctcctttctttgctg

SEQ ID NO: 1904501 - DNA, 19 bp, Homo sapiens
tcctctgctgcatcccctt

SEQ ID NO: 1904502 - DNA, 13 bp, Homo sapiens
tcctgagccccca

SEQ ID NO: 1904503 - DNA, 15 bp, Homo sapiens
tcctgattattttca

SEQ ID NO: 1904504 - DNA, 16 bp, Homo sapiens
tcctgattctaaaatg

SEQ ID NO: 1904505 - DNA, 21 bp, Homo sapiens
tcctgcactgactctggaaaa

SEQ ID NO: 1904506 - DNA, 16 bp, Homo sapiens
tcctgccctccgcccc

SEQ ID NO: 1904507 - DNA, 17 bp, Homo sapiens
tcctgttgtcaagaata

SEQ ID NO: 1904508 - DNA, 16 bp, Homo sapiens
tccttaagagacaatt

SEQ ID NO: 1904509 - DNA, 14 bp, Homo sapiens
tccttacctggaaa

SEQ ID NO: 1904510 - DNA, 17 bp, Homo sapiens
tccttcagatattttta

SEQ ID NO: 1904511 - DNA, 13 bp, Homo sapiens
tccttgaagcttg

SEQ ID NO: 1904512 - DNA, 16 bp, Homo sapiens
tccttgaagcttgtat

SEQ ID NO: 1904513 - DNA, 22 bp, Homo sapiens
tccttgaagcttgtatctgata

SEQ ID NO: 1904514 - DNA, 15 bp, Homo sapiens
tccttgtgctgccag

SEQ ID NO: 1904515 - DNA, 19 bp, Homo sapiens
tcctttaacctttgctgta

SEQ ID NO: 1904516 - DNA, 15 bp, Homo sapiens
tcctttcattttctt

SEQ ID NO: 1904517 - DNA, 12 bp, Homo sapiens
tcctttcctttc

SEQ ID NO: 1904518 - DNA, 15 bp, Homo sapiens
tcctttcctttcatt

SEQ ID NO: 1904519 - DNA, 14 bp, Homo sapiens
tcctttcctttctt

SEQ ID NO: 1904520 - DNA, 13 bp, Homo sapiens
tcctttccttttt

SEQ ID NO: 1904521 - DNA, 14 bp, Homo sapiens
tcctttctttgctg

SEQ ID NO: 1904522 - DNA, 17 bp, Homo sapiens
tcctttgcagtgtctta

SEQ ID NO: 1904523 - DNA, 13 bp, Homo sapiens
tcctttttattta

SEQ ID NO: 1904524 - DNA, 23 bp, Homo sapiens
tcctttttatttatatgtatgtg

SEQ ID NO: 1904525 - DNA, 18 bp, Homo sapiens
tcctttttctttcctttc

SEQ ID NO: 1904526 - DNA, 14 bp, Homo sapiens
tcgaggagctagaa

SEQ ID NO: 1904527 - DNA, 18 bp, Homo sapiens
tcgaggagctagaacatt

SEQ ID NO: 1904528 - DNA, 14 bp, Homo sapiens
tcgagtgagacaga

SEQ ID NO: 1904529 - DNA, 23 bp, Homo sapiens
tcgagtgagacagactagaagtt

SEQ ID NO: 1904530 - DNA, 18 bp, Homo sapiens
tcgcccagtcccagcagc

SEQ ID NO: 1904531 - DNA, 19 bp, Homo sapiens
tcgcccagtcccagcagcc

SEQ ID NO: 1904532 - DNA, 21 bp, Homo sapiens
tcgctctctcgtactctctct

SEQ ID NO: 1904533 - DNA, 18 bp, Homo sapiens
tcgctctgttgcccaggc

SEQ ID NO: 1904534 - DNA, 15 bp, Homo sapiens
tcggcagaggtggtc

SEQ ID NO: 1904535 - DNA, 16 bp, Homo sapiens
tcggggctgggggctg

SEQ ID NO: 1904536 - DNA, 19 bp, Homo sapiens
tcgggggggaccctccaag

SEQ ID NO: 1904537 - DNA, 23 bp, Homo sapiens
tcgggggggaccctccaaggcca

SEQ ID NO: 1904538 - DNA, 16 bp, Homo sapiens
tcggggtcaagctgga

SEQ ID NO: 1904539 - DNA, 22 bp, Homo sapiens
tcgtaataggtgtcatggatag

SEQ ID NO: 1904540 - DNA, 18 bp, Homo sapiens
tcgtgacaatgtttacaa

SEQ ID NO: 1904541 - DNA, 23 bp, Homo sapiens
tctaaaaaaataaacaaagtgaa

SEQ ID NO: 1904542 - DNA, 21 bp, Homo sapiens
tctaaactttattccaagtca

SEQ ID NO: 1904543 - DNA, 21 bp, Homo sapiens
tctaattggctttactatttt

SEQ ID NO: 1904544 - DNA, 21 bp, Homo sapiens
tctacacatataaattgtctt

SEQ ID NO: 1904545 - DNA, 24 bp, Homo sapiens
tctactgcatttagggagtattct

SEQ ID NO: 1904546 - DNA, 15 bp, Homo sapiens
tctacttccaagact

SEQ ID NO: 1904547 - DNA, 13 bp, Homo sapiens
tctactttgaaat

SEQ ID NO: 1904548 - DNA, 17 bp, Homo sapiens
tctactttgaaatattt

SEQ ID NO: 1904549 - DNA, 13 bp, Homo sapiens
tctagaaagaata

SEQ ID NO: 1904550 - DNA, 18 bp, Homo sapiens
tctagaattctagaaaga

SEQ ID NO: 1904551 - DNA, 16 bp, Homo sapiens
tctagaggctggcaag

SEQ ID NO: 1904552 - DNA, 14 bp, Homo sapiens
tctagattttgaaa

SEQ ID NO: 1904553 - DNA, 17 bp, Homo sapiens
tctagattttgaaaaat

SEQ ID NO: 1904554 - DNA, 17 bp, Homo sapiens
tctagggaccagaacca

SEQ ID NO: 1904555 - DNA, 13 bp, Homo sapiens
tctagtgctgtga

SEQ ID NO: 1904556 - DNA, 16 bp, Homo sapiens
tctagtgctgtgaaaa

SEQ ID NO: 1904557 - DNA, 23 bp, Homo sapiens
tctagtgctgtgaaaaaaaaaat

SEQ ID NO: 1904558 - DNA, 17 bp, Homo sapiens
tctagtgtttgattgtc

SEQ ID NO: 1904559 - DNA, 20 bp, Homo sapiens
tctataaagtgaacagattt

SEQ ID NO: 1904560 - DNA, 14 bp, Homo sapiens
tctatacatgtttg

SEQ ID NO: 1904561 - DNA, 20 bp, Homo sapiens
tctatagcatcacttaaaac

SEQ ID NO: 1904562 - DNA, 13 bp, Homo sapiens
tctatgcctgtct

SEQ ID NO: 1904563 - DNA, 20 bp, Homo sapiens
tctatgtctagcacatgttg

SEQ ID NO: 1904564 - DNA, 18 bp, Homo sapiens
tctattaagccattgaaa

SEQ ID NO: 1904565 - DNA, 20 bp, Homo sapiens
tctattaagccattgaaaga

SEQ ID NO: 1904566 - DNA, 11 bp, Homo sapiens
tctattttaca

SEQ ID NO: 1904567 - DNA, 19 bp, Homo sapiens
tctcaaagccccattaact

SEQ ID NO: 1904568 - DNA, 20 bp, Homo sapiens
tctcaagtgcaatgccccct

SEQ ID NO: 1904569 - DNA, 14 bp, Homo sapiens
tctcacagacagga

SEQ ID NO: 1904570 - DNA, 16 bp, Homo sapiens
tcaatgagatggtggc

SEQ ID NO: 1904571 - DNA, 15 bp, Homo sapiens
tcaatttaaataacc

SEQ ID NO: 1904572 - DNA, 21 bp, Homo sapiens
tcacaataaagagaaccatgt

SEQ ID NO: 1904573 - DNA, 20 bp, Homo sapiens
tcacagacaggacccctgca

SEQ ID NO: 1904574 - DNA, 20 bp, Homo sapiens
tcacagcagggccttctgcc

SEQ ID NO: 1904575 - DNA, 19 bp, Homo sapiens
tcacaggctgggctgggca

SEQ ID NO: 1904576 - DNA, 19 bp, Homo sapiens
tcaccatttccccagggca

SEQ ID NO: 1904577 - DNA, 17 bp, Homo sapiens
tcaccttggttcctggg

SEQ ID NO: 1904578 - DNA, 22 bp, Homo sapiens
tcactaagaacaaaagaagcag

SEQ ID NO: 1904579 - DNA, 11 bp, Homo sapiens
tcactctcttc

SEQ ID NO: 1904580 - DNA, 15 bp, Homo sapiens
tcactctcttccttt

SEQ ID NO: 1904581 - DNA, 16 bp, Homo sapiens
tcactctcttcctttc

SEQ ID NO: 1904582 - DNA, 17 bp, Homo sapiens
tcactctcttcctttca

SEQ ID NO: 1904583 - DNA, 14 bp, Homo sapiens
tcactgaaataaaa

SEQ ID NO: 1904584 - DNA, 23 bp, Homo sapiens
tcactgaaataaaagctatataa

SEQ ID NO: 1904585 - DNA, 14 bp, Homo sapiens
tcactgcagcctcc

SEQ ID NO: 1904586 - DNA, 22 bp, Homo sapiens
tcactgcagcctccgcttccct

SEQ ID NO: 1904587 - DNA, 20 bp, Homo sapiens
tcactgggggacactgtggc

SEQ ID NO: 1904588 - DNA, 12 bp, Homo sapiens
tcactgtgtata

SEQ ID NO: 1904589 - DNA, 15 bp, Homo sapiens
tcactgtgtatattt

SEQ ID NO: 1904590 - DNA, 17 bp, Homo sapiens
tcactgtttagatttgc

SEQ ID NO: 1904591 - DNA, 16 bp, Homo sapiens
tcacttcgtggctaag

SEQ ID NO: 1904592 - DNA, 15 bp, Homo sapiens
tcactttccctgatc

SEQ ID NO: 1904593 - DNA, 20 bp, Homo sapiens
tcagaactgttaaaggtcat

SEQ ID NO: 1904594 - DNA, 12 bp, Homo sapiens
tcagaagaaaga

SEQ ID NO: 1904595 - DNA, 19 bp, Homo sapiens
tcagaatattctttttata

SEQ ID NO: 1904596 - DNA, 16 bp, Homo sapiens
tcagagaaatgtctgt

SEQ ID NO: 1904597 - DNA, 23 bp, Homo sapiens
tcagagagggaagctgaggccca

SEQ ID NO: 1904598 - DNA, 15 bp, Homo sapiens
tcagatacaaaacta

SEQ ID NO: 1904599 - DNA, 13 bp, Homo sapiens
tcagatgtttaaa

SEQ ID NO: 1904600 - DNA, 16 bp, Homo sapiens
tcagatgtttaaaaca

SEQ ID NO: 1904601 - DNA, 16 bp, Homo sapiens
tcagcaaggccacctc

SEQ ID NO: 1904602 - DNA, 18 bp, Homo sapiens
tcagcaaggccacctctt

SEQ ID NO: 1904603 - DNA, 23 bp, Homo sapiens
tcagcaaggccacctcttcctgg

SEQ ID NO: 1904604 - DNA, 21 bp, Homo sapiens
tcagcactggattgtagaact

SEQ ID NO: 1904605 - DNA, 16 bp, Homo sapiens
tcagcagttgctggta

SEQ ID NO: 1904606 - DNA, 19 bp, Homo sapiens
tcagcagttgctggtaaaa

SEQ ID NO: 1904607 - DNA, 16 bp, Homo sapiens
tcagccaccctttctg

SEQ ID NO: 1904608 - DNA, 20 bp, Homo sapiens
tcagccaccctttctggcac

SEQ ID NO: 1904609 - DNA, 13 bp, Homo sapiens
tcagccctctctt

SEQ ID NO: 1904610 - DNA, 21 bp, Homo sapiens
tcagcctcccacagtgctggg

SEQ ID NO: 1904611 - DNA, 22 bp, Homo sapiens
tcagcctccctgacgtctgcca

SEQ ID NO: 1904612 - DNA, 12 bp, Homo sapiens
tcagcctggatt

SEQ ID NO: 1904613 - DNA, 21 bp, Homo sapiens
tcagctacccctgcagctggg

SEQ ID NO: 1904614 - DNA, 12 bp, Homo sapiens
tcagctgctcag

SEQ ID NO: 1904615 - DNA, 18 bp, Homo sapiens
tcaggaggccaaggtggg

SEQ ID NO: 1904616 - DNA, 14 bp, Homo sapiens
tcaggcccatcagc

SEQ ID NO: 1904617 - DNA, 17 bp, Homo sapiens
tcaggcccatcagctac

SEQ ID NO: 1904618 - DNA, 12 bp, Homo sapiens
tcaggctcccag

SEQ ID NO: 1904619 - DNA, 23 bp, Homo sapiens
tcaggctgtcagtgtttggtgca

SEQ ID NO: 1904620 - DNA, 21 bp, Homo sapiens
tcaggtagaggtgcatgccta

SEQ ID NO: 1904621 - DNA, 20 bp, Homo sapiens
tcagtcggggcaggccaggg

SEQ ID NO: 1904622 - DNA, 18 bp, Homo sapiens
tcagtttccctatctgca

SEQ ID NO: 1904623 - DNA, 13 bp, Homo sapiens
tcataaagaaaaa

SEQ ID NO: 1904624 - DNA, 18 bp, Homo sapiens
tcataagaggttctaact

SEQ ID NO: 1904625 - DNA, 20 bp, Homo sapiens
tcataagaggttctaacttc

SEQ ID NO: 1904626 - DNA, 14 bp, Homo sapiens
tcataagctttgta

SEQ ID NO: 1904627 - DNA, 15 bp, Homo sapiens
tcataataaatagac

SEQ ID NO: 1904628 - DNA, 16 bp, Homo sapiens
tcataataaatagaca

SEQ ID NO: 1904629 - DNA, 17 bp, Homo sapiens
tcataatgaataaagtg

SEQ ID NO: 1904630 - DNA, 17 bp, Homo sapiens
tcatactcgagtctgag

SEQ ID NO: 1904631 - DNA, 22 bp, Homo sapiens
tcatagcattgtctatttttct

SEQ ID NO: 1904632 - DNA, 21 bp, Homo sapiens
tcatagtgatagagtgcagtg

SEQ ID NO: 1904633 - DNA, 20 bp, Homo sapiens
tcatattttaaacagaggat

SEQ ID NO: 1904634 - DNA, 15 bp, Homo sapiens
tcatcagaacagctg

SEQ ID NO: 1904635 - DNA, 18 bp, Homo sapiens
tcatcagaacagctgttg

SEQ ID NO: 1904636 - DNA, 17 bp, Homo sapiens
tcatcatattatacaga

SEQ ID NO: 1904637 - DNA, 19 bp, Homo sapiens
tcatctgagaatgaacaaa

SEQ ID NO: 1904638 - DNA, 15 bp, Homo sapiens
tcatgaaattaccct

SEQ ID NO: 1904639 - DNA, 22 bp, Homo sapiens
tcatggcccatcaggggcagga

SEQ ID NO: 1904640 - DNA, 16 bp, Homo sapiens
tcatggtttataaaaa

SEQ ID NO: 1904641 - DNA, 16 bp, Homo sapiens
tcatgtacatttgaaa

SEQ ID NO: 1904642 - DNA, 20 bp, Homo sapiens
tcatgtacttttaaattata

SEQ ID NO: 1904643 - DNA, 15 bp, Homo sapiens
tcatgttagagttac

SEQ ID NO: 1904644 - DNA, 18 bp, Homo sapiens
tcattcctttttatttat

SEQ ID NO: 1904645 - DNA, 20 bp, Homo sapiens
tcattcctttttatttatat

SEQ ID NO: 1904646 - DNA, 19 bp, Homo sapiens
tcattcttaatttatgtaa

SEQ ID NO: 1904647 - DNA, 15 bp, Homo sapiens
tcattgatttagtaa

SEQ ID NO: 1904648 - DNA, 11 bp, Homo sapiens
tcattgcaaac

SEQ ID NO: 1904649 - DNA, 12 bp, Homo sapiens
tcattgcacaat

SEQ ID NO: 1904650 - DNA, 17 bp, Homo sapiens
tcattgccacccctgtc

SEQ ID NO: 1904651 - DNA, 18 bp, Homo sapiens
tcattgtgtaaggaaaaa

SEQ ID NO: 1904652 - DNA, 15 bp, Homo sapiens
tcatttctagagaaa

SEQ ID NO: 1904653 - DNA, 16 bp, Homo sapiens
tcatttgctttggaag

SEQ ID NO: 1904654 - DNA, 18 bp, Homo sapiens
tcattttctttcctttcc

SEQ ID NO: 1904655 - DNA, 23 bp, Homo sapiens
tccaaaatttgaaatattaaaat

SEQ ID NO: 1904656 - DNA, 23 bp, Homo sapiens
tccaaaccttactctgagctcat

SEQ ID NO: 1904657 - DNA, 16 bp, Homo sapiens
tccaaactggaatgag

SEQ ID NO: 1904658 - DNA, 20 bp, Homo sapiens
tccaacatctttctttttaa

SEQ ID NO: 1904659 - DNA, 23 bp, Homo sapiens
tccaacatctttctttttaagaa

SEQ ID NO: 1904660 - DNA, 18 bp, Homo sapiens
tccaacccctcgcccagt

SEQ ID NO: 1904661 - DNA, 19 bp, Homo sapiens
tccaacccctcgcccagtc

SEQ ID NO: 1904662 - DNA, 24 bp, Homo sapiens
tccaacccctcgcccagtcccagc

SEQ ID NO: 1904663 - DNA, 16 bp, Homo sapiens
tccaatctcagtcact

SEQ ID NO: 1904664 - DNA, 12 bp, Homo sapiens
tccacctctgtg

SEQ ID NO: 1904665 - DNA, 22 bp, Homo sapiens
tccactgagcatcacaataaag

SEQ ID NO: 1904666 - DNA, 17 bp, Homo sapiens
tccagaaggagcaggcc

SEQ ID NO: 1904667 - DNA, 18 bp, Homo sapiens
tccagcacagatttgctt

SEQ ID NO: 1904668 - DNA, 12 bp, Homo sapiens
tccagcaggagg

SEQ ID NO: 1904669 - DNA, 17 bp, Homo sapiens
tccagcaggagggacag

SEQ ID NO: 1904670 - DNA, 18 bp, Homo sapiens
tccagctccctcccctgc

SEQ ID NO: 1904671 - DNA, 21 bp, Homo sapiens
tccagctccctcccctgctca

SEQ ID NO: 1904672 - DNA, 21 bp, Homo sapiens
tccaggtgttgttgagggcat

SEQ ID NO: 1904673 - DNA, 18 bp, Homo sapiens
tccagtaagatcactgtt

SEQ ID NO: 1904674 - DNA, 19 bp, Homo sapiens
tccagtaagatcactgttt

SEQ ID NO: 1904675 - DNA, 22 bp, Homo sapiens
tccagtaagatcactgtttaga

SEQ ID NO: 1904676 - DNA, 13 bp, Homo sapiens
tccagtggcttct

SEQ ID NO: 1904677 - DNA, 13 bp, Homo sapiens
tccataatcatgt

SEQ ID NO: 1904678 - DNA, 19 bp, Homo sapiens
tccatccacccctctggca

SEQ ID NO: 1904679 - DNA, 18 bp, Homo sapiens
tccatccctctcctctgc

SEQ ID NO: 1904680 - DNA, 15 bp, Homo sapiens
tccatctctgaaaac

SEQ ID NO: 1904681 - DNA, 19 bp, Homo sapiens
tccatctcttcctttcctt

SEQ ID NO: 1904682 - DNA, 17 bp, Homo sapiens
tccatctggttttctct

SEQ ID NO: 1904683 - DNA, 21 bp, Homo sapiens
tccatctggttttctctccag

SEQ ID NO: 1904684 - DNA, 23 bp, Homo sapiens
tccatggggtctctcacagacag

SEQ ID NO: 1904685 - DNA, 13 bp, Homo sapiens
tccattaaaggtg

SEQ ID NO: 1904686 - DNA, 15 bp, Homo sapiens
tccatttcactggct

SEQ ID NO: 1904687 - DNA, 15 bp, Homo sapiens
tcccaacactcttgg

SEQ ID NO: 1904688 - DNA, 15 bp, Homo sapiens
tcccaagtctgacag

SEQ ID NO: 1904689 - DNA, 21 bp, Homo sapiens
tcccacagtgctgggattaca

SEQ ID NO: 1904690 - DNA, 21 bp, Homo sapiens
tataatgactggtcttcctta

SEQ ID NO: 1904691 - DNA, 14 bp, Homo sapiens
tataattttgatag

SEQ ID NO: 1904692 - DNA, 20 bp, Homo sapiens
tatacaaatttaacttttaa

SEQ ID NO: 1904693 - DNA, 23 bp, Homo sapiens
tataccaactgggcctctgatgt

SEQ ID NO: 1904694 - DNA, 14 bp, Homo sapiens
tatagcatcactta

SEQ ID NO: 1904695 - DNA, 13 bp, Homo sapiens
tatagctttattt

SEQ ID NO: 1904696 - DNA, 23 bp, Homo sapiens
tatagtttaaaaatctgccacct

SEQ ID NO: 1904697 - DNA, 14 bp, Homo sapiens
tatataaagtattt

SEQ ID NO: 1904698 - DNA, 18 bp, Homo sapiens
tatatatttttcttattt

SEQ ID NO: 1904699 - DNA, 19 bp, Homo sapiens
tatatgaacatacaaatgc

SEQ ID NO: 1904700 - DNA, 13 bp, Homo sapiens
tatatgtatgtgt

SEQ ID NO: 1904701 - DNA, 15 bp, Homo sapiens
tatatgtatgtgttt

SEQ ID NO: 1904702 - DNA, 22 bp, Homo sapiens
tatatgtatgtgtttagaattg

SEQ ID NO: 1904703 - DNA, 19 bp, Homo sapiens
tatattcccctaagatttg

SEQ ID NO: 1904704 - DNA, 17 bp, Homo sapiens
tatattctgtggaaaaa

SEQ ID NO: 1904705 - DNA, 12 bp, Homo sapiens
tatattgtaaga

SEQ ID NO: 1904706 - DNA, 22 bp, Homo sapiens
tatattgtaagaaatactgtac

SEQ ID NO: 1904707 - DNA, 23 bp, Homo sapiens
tatatttcacactggagtgaatg

SEQ ID NO: 1904708 - DNA, 22 bp, Homo sapiens
tatatttgatttattaacttaa

SEQ ID NO: 1904709 - DNA, 22 bp, Homo sapiens
tatatttttactgctttctgaa

SEQ ID NO: 1904710 - DNA, 21 bp, Homo sapiens
tatatttttgatctttgagtg

SEQ ID NO: 1904711 - DNA, 22 bp, Homo sapiens
tatatttttgatctttgagtgt

SEQ ID NO: 1904712 - DNA, 19 bp, Homo sapiens
tatcaaaaagatatcaaag

SEQ ID NO: 1904713 - DNA, 13 bp, Homo sapiens
tatcaaactgctt

SEQ ID NO: 1904714 - DNA, 21 bp, Homo sapiens
tatcaaaggcacatggaatat

SEQ ID NO: 1904715 - DNA, 15 bp, Homo sapiens
tatcaaattaattgt

SEQ ID NO: 1904716 - DNA, 20 bp, Homo sapiens
tatcaaattaattgtgtgaa

SEQ ID NO: 1904717 - DNA, 12 bp, Homo sapiens
tatcagcactgg

SEQ ID NO: 1904718 - DNA, 13 bp, Homo sapiens
tatccacttgtcc

SEQ ID NO: 1904719 - DNA, 16 bp, Homo sapiens
tatcttgtaaatattg

SEQ ID NO: 1904720 - DNA, 13 bp, Homo sapiens
tatgataataatc

SEQ ID NO: 1904721 - DNA, 24 bp, Homo sapiens
tatgataggttattttgatgtaaa

SEQ ID NO: 1904722 - DNA, 19 bp, Homo sapiens
tatgatgttagttttcctt

SEQ ID NO: 1904723 - DNA, 12 bp, Homo sapiens
tatgattaaaaa

SEQ ID NO: 1904724 - DNA, 17 bp, Homo sapiens
tatgattaaaaatatca

SEQ ID NO: 1904725 - DNA, 20 bp, Homo sapiens
tatgcctacaaagctctgaa

SEQ ID NO: 1904726 - DNA, 22 bp, Homo sapiens
tatgctaatatttttaacaagt

SEQ ID NO: 1904727 - DNA, 18 bp, Homo sapiens
tatgcttgtaactaaaat

SEQ ID NO: 1904728 - DNA, 14 bp, Homo sapiens
tatgcttttctcaa

SEQ ID NO: 1904729 - DNA, 18 bp, Homo sapiens
tatggaggttcaatgaga

SEQ ID NO: 1904730 - DNA, 14 bp, Homo sapiens
tatgggagaaatag

SEQ ID NO: 1904731 - DNA, 15 bp, Homo sapiens
tatgtaaataattct

SEQ ID NO: 1904732 - DNA, 17 bp, Homo sapiens
tatgtaaataattcttt

SEQ ID NO: 1904733 - DNA, 22 bp, Homo sapiens
tatgtaacaaagtttgctgaaa

SEQ ID NO: 1904734 - DNA, 14 bp, Homo sapiens
tatgtactacatga

SEQ ID NO: 1904735 - DNA, 15 bp, Homo sapiens
tatgtagacaatata

SEQ ID NO: 1904736 - DNA, 16 bp, Homo sapiens
tatgtatgtgtttaga

SEQ ID NO: 1904737 - DNA, 21 bp, Homo sapiens
tatgtatgtgtttagaattga

SEQ ID NO: 1904738 - DNA, 22 bp, Homo sapiens
tatgtattctgggtattctatt

SEQ ID NO: 1904739 - DNA, 13 bp, Homo sapiens
tatgtattctgta

SEQ ID NO: 1904740 - DNA, 18 bp, Homo sapiens
tatgtggtccatctctga

SEQ ID NO: 1904741 - DNA, 19 bp, Homo sapiens
tatgtggtccatctctgaa

SEQ ID NO: 1904742 - DNA, 20 bp, Homo sapiens
tatgtggtccatctctgaaa

SEQ ID NO: 1904743 - DNA, 21 bp, Homo sapiens
tatgtggtccatctctgaaaa

SEQ ID NO: 1904744 - DNA, 16 bp, Homo sapiens
tatgtgtttagaattg

SEQ ID NO: 1904745 - DNA, 16 bp, Homo sapiens
tatgtttttgaaggca

SEQ ID NO: 1904746 - DNA, 17 bp, Homo sapiens
tattaaatttttttgta

SEQ ID NO: 1904747 - DNA, 20 bp, Homo sapiens
tattaaatttttttgtatga

SEQ ID NO: 1904748 - DNA, 22 bp, Homo sapiens
tattaaatttttttgtatgaaa

SEQ ID NO: 1904749 - DNA, 20 bp, Homo sapiens
tattaagtaagtctcaaggt

SEQ ID NO: 1904750 - DNA, 22 bp, Homo sapiens
tattaatcactgtgtatatttg

SEQ ID NO: 1904751 - DNA, 14 bp, Homo sapiens
tattaattatttaa

SEQ ID NO: 1904752 - DNA, 20 bp, Homo sapiens
tattacgaagttcaagatca

SEQ ID NO: 1904753 - DNA, 21 bp, Homo sapiens
tattacgaagttcaagatcaa

SEQ ID NO: 1904754 - DNA, 17 bp, Homo sapiens
tattaggaaaagatatt

SEQ ID NO: 1904755 - DNA, 13 bp, Homo sapiens
tattagtgttata

SEQ ID NO: 1904756 - DNA, 23 bp, Homo sapiens
tattagtgttatatgaacataca

SEQ ID NO: 1904757 - DNA, 12 bp, Homo sapiens
tattcattctta

SEQ ID NO: 1904758 - DNA, 18 bp, Homo sapiens
tattcattgtggtcatag

SEQ ID NO: 1904759 - DNA, 20 bp, Homo sapiens
tattctaaaaaaataaacaa

SEQ ID NO: 1904760 - DNA, 23 bp, Homo sapiens
tattctaaaaaaataaacaaagt

SEQ ID NO: 1904761 - DNA, 17 bp, Homo sapiens
tattctaataagctagt

SEQ ID NO: 1904762 - DNA, 19 bp, Homo sapiens
tattctatttgtgtaagga

SEQ ID NO: 1904763 - DNA, 12 bp, Homo sapiens
tattctatttta

SEQ ID NO: 1904764 - DNA, 15 bp, Homo sapiens
tattctctaactatt

SEQ ID NO: 1904765 - DNA, 13 bp, Homo sapiens
tattgatgaaaat

SEQ ID NO: 1904766 - DNA, 14 bp, Homo sapiens
tattggttttatga

SEQ ID NO: 1904767 - DNA, 17 bp, Homo sapiens
tattgtaagaaatactg

SEQ ID NO: 1904768 - DNA, 19 bp, Homo sapiens
tattgtaagaaatactgta

SEQ ID NO: 1904769 - DNA, 17 bp, Homo sapiens
tattgtcctattagtgt

SEQ ID NO: 1904770 - DNA, 18 bp, Homo sapiens
tattgtcctattagtgtt

SEQ ID NO: 1904771 - DNA, 19 bp, Homo sapiens
tatttaaagaaatatgtat

SEQ ID NO: 1904772 - DNA, 18 bp, Homo sapiens
tatttaagaagccaaggg

SEQ ID NO: 1904773 - DNA, 12 bp, Homo sapiens
tatttaagcaat

SEQ ID NO: 1904774 - DNA, 16 bp, Homo sapiens
tatttaagcaataaaa

SEQ ID NO: 1904775 - DNA, 20 bp, Homo sapiens
tatttagatgcatattactg

SEQ ID NO: 1904776 - DNA, 12 bp, Homo sapiens
tatttatatgta

SEQ ID NO: 1904777 - DNA, 19 bp, Homo sapiens
tatttatatgtatgtgttt

SEQ ID NO: 1904778 - DNA, 11 bp, Homo sapiens
tatttattaaa

SEQ ID NO: 1904779 - DNA, 15 bp, Homo sapiens
tatttattgactctt

SEQ ID NO: 1904780 - DNA, 15 bp, Homo sapiens
tatttatttatgcta

SEQ ID NO: 1904781 - DNA, 19 bp, Homo sapiens
tatttcaagtacactgaat

SEQ ID NO: 1904782 - DNA, 18 bp, Homo sapiens
tatttcagcaaacttgtt

SEQ ID NO: 1904783 - DNA, 20 bp, Homo sapiens
tatttcatcagaacagctgt

SEQ ID NO: 1904784 - DNA, 19 bp, Homo sapiens
tatttgatttattaactta

SEQ ID NO: 1904785 - DNA, 23 bp, Homo sapiens
tatttgtaaaagaacagtaaaca

SEQ ID NO: 1904786 - DNA, 13 bp, Homo sapiens
tattttaaaacaa

SEQ ID NO: 1904787 - DNA, 12 bp, Homo sapiens
tattttgaaata

SEQ ID NO: 1904788 - DNA, 16 bp, Homo sapiens
tattttgtatttaaaa

SEQ ID NO: 1904789 - DNA, 14 bp, Homo sapiens
tatttttataatga

SEQ ID NO: 1904790 - DNA, 12 bp, Homo sapiens
tatttttatagg

SEQ ID NO: 1904791 - DNA, 19 bp, Homo sapiens
tatttttctctctctctcg

SEQ ID NO: 1904792 - DNA, 21 bp, Homo sapiens
tatttttctctctctctcgtt

SEQ ID NO: 1904793 - DNA, 16 bp, Homo sapiens
tattttttttaattgt

SEQ ID NO: 1904794 - DNA, 17 bp, Homo sapiens
tcaaaaaggcttataaa

SEQ ID NO: 1904795 - DNA, 23 bp, Homo sapiens
tcaaaagtagaactttgtatagt

SEQ ID NO: 1904796 - DNA, 12 bp, Homo sapiens
tcaaaattcaaa

SEQ ID NO: 1904797 - DNA, 17 bp, Homo sapiens
tcaaacacctctgtatt

SEQ ID NO: 1904798 - DNA, 11 bp, Homo sapiens
tcaaactgctt

SEQ ID NO: 1904799 - DNA, 18 bp, Homo sapiens
tcaaagcaccaaaataag

SEQ ID NO: 1904800 - DNA, 20 bp, Homo sapiens
tcaaagcaccaaaataagaa

SEQ ID NO: 1904801 - DNA, 21 bp, Homo sapiens
tcaaagcaccaaaataagaaa

SEQ ID NO: 1904802 - DNA, 22 bp, Homo sapiens
tcaaagcaccaaaataagaaaa

SEQ ID NO: 1904803 - DNA, 17 bp, Homo sapiens
tcaaagccccattaact

SEQ ID NO: 1904804 - DNA, 18 bp, Homo sapiens
tcaaagccccattaactg

SEQ ID NO: 1904805 - DNA, 21 bp, Homo sapiens
tcaaagccccattaactgctt

SEQ ID NO: 1904806 - DNA, 14 bp, Homo sapiens
tcaaagtgctatta

SEQ ID NO: 1904807 - DNA, 16 bp, Homo sapiens
tcaaagtggatgcaat

SEQ ID NO: 1904808 - DNA, 22 bp, Homo sapiens
tcaaatacatttaaaacattaa

SEQ ID NO: 1904809 - DNA, 13 bp, Homo sapiens
tcaaattaattgt

SEQ ID NO: 1904810 - DNA, 16 bp, Homo sapiens
tcaaattaattgtgtg

SEQ ID NO: 1904811 - DNA, 18 bp, Homo sapiens
tcaaattaattgtgtgaa

SEQ ID NO: 1904812 - DNA, 16 bp, Homo sapiens
tcaacagcaagtgtga

SEQ ID NO: 1904813 - DNA, 12 bp, Homo sapiens
tcaaccacaaaa

SEQ ID NO: 1904814 - DNA, 15 bp, Homo sapiens
tcaagaaatgaagag

SEQ ID NO: 1904815 - DNA, 16 bp, Homo sapiens
tcaagaaatgaagagc

SEQ ID NO: 1904816 - DNA, 18 bp, Homo sapiens
tcaagagccttaaaacat

SEQ ID NO: 1904817 - DNA, 18 bp, Homo sapiens
gtgatgaagctgaggctg

SEQ ID NO: 1904818 - DNA, 19 bp, Homo sapiens
gtgcaaacagaagtgcatc

SEQ ID NO: 1904819 - DNA, 20 bp, Homo sapiens
gtgcaatgccccctcccctc

SEQ ID NO: 1904820 - DNA, 22 bp, Homo sapiens
gtgcaatgccccctcccctcct

SEQ ID NO: 1904821 - DNA, 16 bp, Homo sapiens
gtgcaggcccaccctg

SEQ ID NO: 1904822 - DNA, 21 bp, Homo sapiens
gtgcagggcacagaaggctgg

SEQ ID NO: 1904823 - DNA, 11 bp, Homo sapiens
gtgcagggctg

SEQ ID NO: 1904824 - DNA, 16 bp, Homo sapiens
gtgccagcttctttgc

SEQ ID NO: 1904825 - DNA, 15 bp, Homo sapiens
gtgcccgccaccaca

SEQ ID NO: 1904826 - DNA, 19 bp, Homo sapiens
gtgccggaaagagagctgg

SEQ ID NO: 1904827 - DNA, 21 bp, Homo sapiens
gtgccggaaagagagctggag

SEQ ID NO: 1904828 - DNA, 13 bp, Homo sapiens
gtgcctgcttcag

SEQ ID NO: 1904829 - DNA, 23 bp, Homo sapiens
gtgccttagcatgtgttgcagct

SEQ ID NO: 1904830 - DNA, 11 bp, Homo sapiens
gtgctacagaa

SEQ ID NO: 1904831 - DNA, 16 bp, Homo sapiens
gtgctccgtagcttct

SEQ ID NO: 1904832 - DNA, 13 bp, Homo sapiens
gtgctgccagtca

SEQ ID NO: 1904833 - DNA, 15 bp, Homo sapiens
tgaatactgcttgaa

SEQ ID NO: 1904834 - DNA, 18 bp, Homo sapiens
tgaatactgcttgaataa

SEQ ID NO: 1904835 - DNA, 21 bp, Homo sapiens
tgaatactgcttgaataaaca

SEQ ID NO: 1904836 - DNA, 13 bp, Homo sapiens
tgaatacttgaac

SEQ ID NO: 1904837 - DNA, 13 bp, Homo sapiens
tgaatatgattaa

SEQ ID NO: 1904838 - DNA, 21 bp, Homo sapiens
tgaatatgattaaaaatatca

SEQ ID NO: 1904839 - DNA, 16 bp, Homo sapiens
tgaatattgccattat

SEQ ID NO: 1904840 - DNA, 14 bp, Homo sapiens
tgaatatttaagca

SEQ ID NO: 1904841 - DNA, 15 bp, Homo sapiens
tgaatatttaagcaa

SEQ ID NO: 1904842 - DNA, 21 bp, Homo sapiens
tgaatatttaagcaataaaac

SEQ ID NO: 1904843 - DNA, 15 bp, Homo sapiens
tgaatttttatgtgt

SEQ ID NO: 1904844 - DNA, 19 bp, Homo sapiens
tgacaacaaattttggttt

SEQ ID NO: 1904845 - DNA, 22 bp, Homo sapiens
tgacaacaaattttggttttct

SEQ ID NO: 1904846 - DNA, 23 bp, Homo sapiens
tgacagagagagatactctggga

SEQ ID NO: 1904847 - DNA, 22 bp, Homo sapiens
tgacagagggatggaggaagaa

SEQ ID NO: 1904848 - DNA, 17 bp, Homo sapiens
tgacagcgcacagctgc

SEQ ID NO: 1904849 - DNA, 13 bp, Homo sapiens
tgacataattcta

SEQ ID NO: 1904850 - DNA, 19 bp, Homo sapiens
tgacatcacagggcctcag

SEQ ID NO: 1904851 - DNA, 20 bp, Homo sapiens
tgacatcacagggcctcagt

SEQ ID NO: 1904852 - DNA, 16 bp, Homo sapiens
tgacatcactggcatg

SEQ ID NO: 1904853 - DNA, 21 bp, Homo sapiens
tgaccataacagtgccagctt

SEQ ID NO: 1904854 - DNA, 19 bp, Homo sapiens
tgacccaacagcctctgtg

SEQ ID NO: 1904855 - DNA, 20 bp, Homo sapiens
tgacccaacagcctctgtgg

SEQ ID NO: 1904856 - DNA, 22 bp, Homo sapiens
tgacctcacacacctctgcccc

SEQ ID NO: 1904857 - DNA, 23 bp, Homo sapiens
tgacctcacacacctctgcccct

SEQ ID NO: 1904858 - DNA, 14 bp, Homo sapiens
tgaccttaaatgca

SEQ ID NO: 1904859 - DNA, 23 bp, Homo sapiens
tgacggttcctacacaggacagg

SEQ ID NO: 1904860 - DNA, 19 bp, Homo sapiens
tgacgtacaagtagttctg

SEQ ID NO: 1904861 - DNA, 23 bp, Homo sapiens
tgacgtacaagtagttctgtatt

SEQ ID NO: 1904862 - DNA, 14 bp, Homo sapiens
tgactacagggccg

SEQ ID NO: 1904863 - DNA, 21 bp, Homo sapiens
tgactataccaactgggcctc

SEQ ID NO: 1904864 - DNA, 22 bp, Homo sapiens
tgactataccaactgggcctct

SEQ ID NO: 1904865 - DNA, 23 bp, Homo sapiens
tgactataccaactgggcctctg

SEQ ID NO: 1904866 - DNA, 19 bp, Homo sapiens
tgactctagtactgtgaat

SEQ ID NO: 1904867 - DNA, 16 bp, Homo sapiens
tgactcttacacactg

SEQ ID NO: 1904868 - DNA, 21 bp, Homo sapiens
tgactcttgagttgtttttgt

SEQ ID NO: 1904869 - DNA, 22 bp, Homo sapiens
tgactcttgagttgtttttgta

SEQ ID NO: 1904870 - DNA, 19 bp, Homo sapiens
tgactgaggcagtttgagg

SEQ ID NO: 1904871 - DNA, 21 bp, Homo sapiens
tgactgtggtagccagcatcg

SEQ ID NO: 1904872 - DNA, 22 bp, Homo sapiens
tgacttaacatagccaaaatgt

SEQ ID NO: 1904873 - DNA, 19 bp, Homo sapiens
tgacttagaatccctgtgt

SEQ ID NO: 1904874 - DNA, 23 bp, Homo sapiens
tgactttcacatttggaatttaa

SEQ ID NO: 1904875 - DNA, 17 bp, Homo sapiens
tgactttcataataaat

SEQ ID NO: 1904876 - DNA, 18 bp, Homo sapiens
tgactttgaatttatata

SEQ ID NO: 1904877 - DNA, 19 bp, Homo sapiens
tgagaacattaggccccag

SEQ ID NO: 1904878 - DNA, 13 bp, Homo sapiens
tgagaatgaacaa

SEQ ID NO: 1904879 - DNA, 14 bp, Homo sapiens
tgagaatgaacaaa

SEQ ID NO: 1904880 - DNA, 18 bp, Homo sapiens
tgagaatgtcttgcttga

SEQ ID NO: 1904881 - DNA, 15 bp, Homo sapiens
tgagacccttattta

SEQ ID NO: 1904882 - DNA, 20 bp, Homo sapiens
tgagaccgtgaagatacttt

SEQ ID NO: 1904883 - DNA, 21 bp, Homo sapiens
tgagatcaaaaaaatatatga

SEQ ID NO: 1904884 - DNA, 23 bp, Homo sapiens
tgagatggtggcattttgagaat

SEQ ID NO: 1904885 - DNA, 15 bp, Homo sapiens
tgagcaacaagaatc

SEQ ID NO: 1904886 - DNA, 14 bp, Homo sapiens
tgagctatgactta

SEQ ID NO: 1904887 - DNA, 19 bp, Homo sapiens
tgagctatgacttaacata

SEQ ID NO: 1904888 - DNA, 20 bp, Homo sapiens
tgagctcccacttctgccag

SEQ ID NO: 1904889 - DNA, 15 bp, Homo sapiens
tgaggaaatcaaagt

SEQ ID NO: 1904890 - DNA, 13 bp, Homo sapiens
tgaggacaagaga

SEQ ID NO: 1904891 - DNA, 20 bp, Homo sapiens
tgaggattagtttagaacag

SEQ ID NO: 1904892 - DNA, 21 bp, Homo sapiens
tgaggattagtttagaacagg

SEQ ID NO: 1904893 - DNA, 15 bp, Homo sapiens
tgaggcatctctctg

SEQ ID NO: 1904894 - DNA, 18 bp, Homo sapiens
tgaggccacacccagagt

SEQ ID NO: 1904895 - DNA, 14 bp, Homo sapiens
tgaggcccatggcc

SEQ ID NO: 1904896 - DNA, 16 bp, Homo sapiens
tgaggcccatggccac

SEQ ID NO: 1904897 - DNA, 19 bp, Homo sapiens
tgaggccgttgctgactta

SEQ ID NO: 1904898 - DNA, 22 bp, Homo sapiens
tgaggccgttgctgacttagaa

SEQ ID NO: 1904899 - DNA, 17 bp, Homo sapiens
tgaggctgctgccaggc

SEQ ID NO: 1904900 - DNA, 18 bp, Homo sapiens
tgagggcatttggcttcc

SEQ ID NO: 1904901 - DNA, 19 bp, Homo sapiens
tgagggcatttggcttcct

SEQ ID NO: 1904902 - DNA, 23 bp, Homo sapiens
tgagggcatttggcttcctctgc

SEQ ID NO: 1904903 - DNA, 21 bp, Homo sapiens
tgaggtgatgaagacagcccg

SEQ ID NO: 1904904 - DNA, 17 bp, Homo sapiens
tgagtctgttctggtaa

SEQ ID NO: 1904905 - DNA, 15 bp, Homo sapiens
tgagtgagaggggag

SEQ ID NO: 1904906 - DNA, 15 bp, Homo sapiens
tgagtgcaggcccac

SEQ ID NO: 1904907 - DNA, 12 bp, Homo sapiens
tgagtgttctgg

SEQ ID NO: 1904908 - DNA, 21 bp, Homo sapiens
tgagttggaagcggtttgcat

SEQ ID NO: 1904909 - DNA, 16 bp, Homo sapiens
tgagttgtttttgtat

SEQ ID NO: 1904910 - DNA, 20 bp, Homo sapiens
tgataaggaacatttatcca

SEQ ID NO: 1904911 - DNA, 14 bp, Homo sapiens
tgataattttcctt

SEQ ID NO: 1904912 - DNA, 17 bp, Homo sapiens
tgataattttcctttaa

SEQ ID NO: 1904913 - DNA, 18 bp, Homo sapiens
tgatagcaaatggcctca

SEQ ID NO: 1904914 - DNA, 19 bp, Homo sapiens
tgatagtagtctttaaaag

SEQ ID NO: 1904915 - DNA, 13 bp, Homo sapiens
tgatatatgtatc

SEQ ID NO: 1904916 - DNA, 14 bp, Homo sapiens
tgatatatgtatct

SEQ ID NO: 1904917 - DNA, 17 bp, Homo sapiens
tgatatatgtatcttta

SEQ ID NO: 1904918 - DNA, 20 bp, Homo sapiens
tgatattcaaatggacaaac

SEQ ID NO: 1904919 - DNA, 12 bp, Homo sapiens
tgatctgtgcag

SEQ ID NO: 1904920 - DNA, 14 bp, Homo sapiens
tgatctgtgcaggg

SEQ ID NO: 1904921 - DNA, 18 bp, Homo sapiens
tgatgaagctgaggctgc

SEQ ID NO: 1904922 - DNA, 19 bp, Homo sapiens
tgatgacataagtcagcaa

SEQ ID NO: 1904923 - DNA, 21 bp, Homo sapiens
tgatgacgtacaagtagttct

SEQ ID NO: 1904924 - DNA, 16 bp, Homo sapiens
tgatgatgttgtaaaa

SEQ ID NO: 1904925 - DNA, 17 bp, Homo sapiens
tgatgcattaaaagaaa

SEQ ID NO: 1904926 - DNA, 19 bp, Homo sapiens
tgatgcattaaaagaaaat

SEQ ID NO: 1904927 - DNA, 16 bp, Homo sapiens
tgatgcgcagttgctg

SEQ ID NO: 1904928 - DNA, 19 bp, Homo sapiens
tgatgctatcagttttata

SEQ ID NO: 1904929 - DNA, 14 bp, Homo sapiens
tgatgtattctgtg

SEQ ID NO: 1904930 - DNA, 23 bp, Homo sapiens
tgatgtcagcagttgctggtaaa

SEQ ID NO: 1904931 - DNA, 16 bp, Homo sapiens
tgatgtgcctgcttca

SEQ ID NO: 1904932 - DNA, 20 bp, Homo sapiens
tctctgaaggaggccacctc

SEQ ID NO: 1904933 - DNA, 13 bp, Homo sapiens
tctctgctggacg

SEQ ID NO: 1904934 - DNA, 17 bp, Homo sapiens
tctcttccacttggtct

SEQ ID NO: 1904935 - DNA, 13 bp, Homo sapiens
tctcttcctttcc

SEQ ID NO: 1904936 - DNA, 14 bp, Homo sapiens
tctcttcctttcct

SEQ ID NO: 1904937 - DNA, 19 bp, Homo sapiens
tctcttttccctcctttcc

SEQ ID NO: 1904938 - DNA, 22 bp, Homo sapiens
tctcttttccctcctttccttt

SEQ ID NO: 1904939 - DNA, 14 bp, Homo sapiens
tctcttttttaagt

SEQ ID NO: 1904940 - DNA, 17 bp, Homo sapiens
tctgaaaatttatataa

SEQ ID NO: 1904941 - DNA, 18 bp, Homo sapiens
tctgaaaatttatataac

SEQ ID NO: 1904942 - DNA, 23 bp, Homo sapiens
tctgaatgtagacggaacagtgt

SEQ ID NO: 1904943 - DNA, 14 bp, Homo sapiens
tctgaattcaggtc

SEQ ID NO: 1904944 - DNA, 13 bp, Homo sapiens
tctgacagccaga

SEQ ID NO: 1904945 - DNA, 15 bp, Homo sapiens
tctgacagccagagc

SEQ ID NO: 1904946 - DNA, 11 bp, Homo sapiens
tctgagctcat

SEQ ID NO: 1904947 - DNA, 14 bp, Homo sapiens
tctgaggacaagag

SEQ ID NO: 1904948 - DNA, 17 bp, Homo sapiens
tctgaggacaagagaaa

SEQ ID NO: 1904949 - DNA, 17 bp, Homo sapiens
tctgagggcttgtagtt

SEQ ID NO: 1904950 - DNA, 19 bp, Homo sapiens
tctgagggcttgtagttct

SEQ ID NO: 1904951 - DNA, 20 bp, Homo sapiens
tctgagggcttgtagttctt

SEQ ID NO: 1904952 - DNA, 19 bp, Homo sapiens
tctgatagtagtctttaaa

SEQ ID NO: 1904953 - DNA, 22 bp, Homo sapiens
tctgcactgaatggctgacctg

SEQ ID NO: 1904954 - DNA, 20 bp, Homo sapiens
tctgccacagggacttgcct

SEQ ID NO: 1904955 - DNA, 16 bp, Homo sapiens
tctgccaccagcgccc

SEQ ID NO: 1904956 - DNA, 23 bp, Homo sapiens
tctgccagggatggcagtggctg

SEQ ID NO: 1904957 - DNA, 21 bp, Homo sapiens
tctgccccttgggcctcccac

SEQ ID NO: 1904958 - DNA, 22 bp, Homo sapiens
tctgccccttgggcctcccact

SEQ ID NO: 1904959 - DNA, 12 bp, Homo sapiens
tctgctgaacaa

SEQ ID NO: 1904960 - DNA, 13 bp, Homo sapiens
tctgctgaacaaa

SEQ ID NO: 1904961 - DNA, 17 bp, Homo sapiens
tctgctgcatccccttc

SEQ ID NO: 1904962 - DNA, 19 bp, Homo sapiens
tctgctgcatccccttcca

SEQ ID NO: 1904963 - DNA, 16 bp, Homo sapiens
tctgctttagacttga

SEQ ID NO: 1904964 - DNA, 19 bp, Homo sapiens
tctgctttagacttgaaaa

SEQ ID NO: 1904965 - DNA, 20 bp, Homo sapiens
tctggaccccatctgtgaat

SEQ ID NO: 1904966 - DNA, 23 bp, Homo sapiens
tctggaccccatctgtgaataag

SEQ ID NO: 1904967 - DNA, 17 bp, Homo sapiens
tctggccagggaggagc

SEQ ID NO: 1904968 - DNA, 22 bp, Homo sapiens
tctggggctggcaccagcaggc

SEQ ID NO: 1904969 - DNA, 20 bp, Homo sapiens
tctgggggactccttccttg

SEQ ID NO: 1904970 - DNA, 13 bp, Homo sapiens
tctggttacaatt

SEQ ID NO: 1904971 - DNA, 18 bp, Homo sapiens
tctgtacatctctactta

SEQ ID NO: 1904972 - DNA, 23 bp, Homo sapiens
tctgtagcctgaagagtttgtaa

SEQ ID NO: 1904973 - DNA, 12 bp, Homo sapiens
tctgtatttgaa

SEQ ID NO: 1904974 - DNA, 15 bp, Homo sapiens
tctgtatttgaaagt

SEQ ID NO: 1904975 - DNA, 18 bp, Homo sapiens
tctgtatttgaaagtgcc

SEQ ID NO: 1904976 - DNA, 22 bp, Homo sapiens
tctgtatttgaaagtgcctttg

SEQ ID NO: 1904977 - DNA, 21 bp, Homo sapiens
tctgtcagggttggaaagtcc

SEQ ID NO: 1904978 - DNA, 14 bp, Homo sapiens
tctgtctggccagg

SEQ ID NO: 1904979 - DNA, 16 bp, Homo sapiens
tctgtctggccaggga

SEQ ID NO: 1904980 - DNA, 12 bp, Homo sapiens
tctgtgaataag

SEQ ID NO: 1904981 - DNA, 18 bp, Homo sapiens
tctgtgcagggtattaac

SEQ ID NO: 1904982 - DNA, 21 bp, Homo sapiens
tctgtggaaaaataaaggaaa

SEQ ID NO: 1904983 - DNA, 22 bp, Homo sapiens
tctgtggaaaaataaaggaaat

SEQ ID NO: 1904984 - DNA, 13 bp, Homo sapiens
tctgtggttggct

SEQ ID NO: 1904985 - DNA, 15 bp, Homo sapiens
tctgtgtttaaagtg

SEQ ID NO: 1904986 - DNA, 18 bp, Homo sapiens
tctgtttttcttctgaaa

SEQ ID NO: 1904987 - DNA, 19 bp, Homo sapiens
tctgtttttcttctgaaat

SEQ ID NO: 1904988 - DNA, 20 bp, Homo sapiens
tcttaaaaccaatcaataat

SEQ ID NO: 1904989 - DNA, 13 bp, Homo sapiens
tcttaatttatgt

SEQ ID NO: 1904990 - DNA, 20 bp, Homo sapiens
tcttaatttatgtaaggttt

SEQ ID NO: 1904991 - DNA, 20 bp, Homo sapiens
tcttactttgtaaattctga

SEQ ID NO: 1904992 - DNA, 22 bp, Homo sapiens
tcttactttgtaaattctgatt

SEQ ID NO: 1904993 - DNA, 16 bp, Homo sapiens
tcttagatcatagttt

SEQ ID NO: 1904994 - DNA, 15 bp, Homo sapiens
tcttagtttgaatga

SEQ ID NO: 1904995 - DNA, 12 bp, Homo sapiens
tcttatttatgt

SEQ ID NO: 1904996 - DNA, 16 bp, Homo sapiens
tcttatttatgtaaca

SEQ ID NO: 1904997 - DNA, 18 bp, Homo sapiens
tcttatttatgtaacaaa

SEQ ID NO: 1904998 - DNA, 17 bp, Homo sapiens
tcttcacatgtaacttt

SEQ ID NO: 1904999 - DNA, 13 bp, Homo sapiens
tcttccagaacct

SEQ ID NO: 1905000 - DNA, 18 bp, Homo sapiens
tcttccttacctggaaaa

SEQ ID NO: 1905001 - DNA, 12 bp, Homo sapiens
tcttcctttcat

SEQ ID NO: 1905002 - DNA, 20 bp, Homo sapiens
tcttctgagcttacgtagtt

SEQ ID NO: 1905003 - DNA, 21 bp, Homo sapiens
tcttgagttgtttttgtatat

SEQ ID NO: 1905004 - DNA, 21 bp, Homo sapiens
tcttgccaaaaagcacaagat

SEQ ID NO: 1905005 - DNA, 20 bp, Homo sapiens
tcttgcctcagcttccccag

SEQ ID NO: 1905006 - DNA, 17 bp, Homo sapiens
tcttggcaataaatttt

SEQ ID NO: 1905007 - DNA, 19 bp, Homo sapiens
tcttggcaataaattttga

SEQ ID NO: 1905008 - DNA, 17 bp, Homo sapiens
tcttgtgaaaataattg

SEQ ID NO: 1905009 - DNA, 18 bp, Homo sapiens
tcttgtgtctactctagg

SEQ ID NO: 1905010 - DNA, 21 bp, Homo sapiens
tctttattatttttctctctc

SEQ ID NO: 1905011 - DNA, 21 bp, Homo sapiens
tctttcatttgctttggaagt

SEQ ID NO: 1905012 - DNA, 12 bp, Homo sapiens
tctttctcactg

SEQ ID NO: 1905013 - DNA, 16 bp, Homo sapiens
tctttctcactgcctt

SEQ ID NO: 1905014 - DNA, 16 bp, Homo sapiens
tctttctctctggcct

SEQ ID NO: 1905015 - DNA, 20 bp, Homo sapiens
tctttgaagagatgacaaca

SEQ ID NO: 1905016 - DNA, 14 bp, Homo sapiens
tctttgatgtgttg

SEQ ID NO: 1905017 - DNA, 19 bp, Homo sapiens
tcttttccaaacacaggca

SEQ ID NO: 1905018 - DNA, 17 bp, Homo sapiens
tcttttgctttcctttc

SEQ ID NO: 1905019 - DNA, 20 bp, Homo sapiens
tcttttggttatgaatactt

SEQ ID NO: 1905020 - DNA, 22 bp, Homo sapiens
tctttttacattgtgaatgctg

SEQ ID NO: 1905021 - DNA, 19 bp, Homo sapiens
tctttttccctttcctttc

SEQ ID NO: 1905022 - DNA, 20 bp, Homo sapiens
tctttttccctttcctttcc

SEQ ID NO: 1905023 - DNA, 15 bp, Homo sapiens
tcttttttattaatc

SEQ ID NO: 1905024 - DNA, 18 bp, Homo sapiens
tgaaaaaaaaaatgctga

SEQ ID NO: 1905025 - DNA, 12 bp, Homo sapiens
tgaaaaatacag

SEQ ID NO: 1905026 - DNA, 23 bp, Homo sapiens
tgaaaaattacctgtataatgga

SEQ ID NO: 1905027 - DNA, 16 bp, Homo sapiens
tgaaaagagacaggca

SEQ ID NO: 1905028 - DNA, 22 bp, Homo sapiens
tgaaaatagtttattttaaaac

SEQ ID NO: 1905029 - DNA, 17 bp, Homo sapiens
tgaaaatttatataact

SEQ ID NO: 1905030 - DNA, 18 bp, Homo sapiens
tgaaactccagatgccac

SEQ ID NO: 1905031 - DNA, 16 bp, Homo sapiens
tgaaagaaaaagtaca

SEQ ID NO: 1905032 - DNA, 18 bp, Homo sapiens
tgaaagaaaacttttatg

SEQ ID NO: 1905033 - DNA, 15 bp, Homo sapiens
tgaaagatatgtata

SEQ ID NO: 1905034 - DNA, 16 bp, Homo sapiens
tgaaagatatgtatat

SEQ ID NO: 1905035 - DNA, 17 bp, Homo sapiens
tgaaaggcagggcaaga

SEQ ID NO: 1905036 - DNA, 23 bp, Homo sapiens
tgaaagttccttctgtagcctga

SEQ ID NO: 1905037 - DNA, 17 bp, Homo sapiens
tgaaataacacagcagt

SEQ ID NO: 1905038 - DNA, 17 bp, Homo sapiens
tgcattgaatactctga

SEQ ID NO: 1905039 - DNA, 20 bp, Homo sapiens
tgcatttacgcctgtaaatg

SEQ ID NO: 1905040 - DNA, 19 bp, Homo sapiens
tgcattttatgtgaccttg

SEQ ID NO: 1905041 - DNA, 23 bp, Homo sapiens
tgccacaaggaagaaattaactt

SEQ ID NO: 1905042 - DNA, 19 bp, Homo sapiens
tgccacagcaaggctgtcg

SEQ ID NO: 1905043 - DNA, 14 bp, Homo sapiens
tgccaccagcgccc

SEQ ID NO: 1905044 - DNA, 21 bp, Homo sapiens
tgccacctccccttgccagct

SEQ ID NO: 1905045 - DNA, 21 bp, Homo sapiens
tgccagatgtcctaatggtga

SEQ ID NO: 1905046 - DNA, 15 bp, Homo sapiens
tgccagctcttccta

SEQ ID NO: 1905047 - DNA, 20 bp, Homo sapiens
tgccagctcttcctagctgg

SEQ ID NO: 1905048 - DNA, 19 bp, Homo sapiens
tgccagctgctgagccgca

SEQ ID NO: 1905049 - DNA, 16 bp, Homo sapiens
tgccaggcacaggcag

SEQ ID NO: 1905050 - DNA, 17 bp, Homo sapiens
tgccaggcacaggcagg

SEQ ID NO: 1905051 - DNA, 18 bp, Homo sapiens
tgccaggcacaggcaggg

SEQ ID NO: 1905052 - DNA, 21 bp, Homo sapiens
tgccaggcacaggcagggcag

SEQ ID NO: 1905053 - DNA, 22 bp, Homo sapiens
tgccaggcccggcatgaggccc

SEQ ID NO: 1905054 - DNA, 16 bp, Homo sapiens
tgccagtcagcctgga

SEQ ID NO: 1905055 - DNA, 20 bp, Homo sapiens
tgccatgcttcagtgaacat

SEQ ID NO: 1905056 - DNA, 12 bp, Homo sapiens
tgccatttgctg

SEQ ID NO: 1905057 - DNA, 22 bp, Homo sapiens
tgcccagccccctggtctttga

SEQ ID NO: 1905058 - DNA, 18 bp, Homo sapiens
tgcccagctgtgctggga

SEQ ID NO: 1905059 - DNA, 21 bp, Homo sapiens
tgccccctcccctcctttacc

SEQ ID NO: 1905060 - DNA, 17 bp, Homo sapiens
tgccccttgggcctccc

SEQ ID NO: 1905061 - DNA, 17 bp, Homo sapiens
tgccctccgccccgtcc

SEQ ID NO: 1905062 - DNA, 21 bp, Homo sapiens
tgcctataagccaaaattaag

SEQ ID NO: 1905063 - DNA, 16 bp, Homo sapiens
tgcctcctcctgccct

SEQ ID NO: 1905064 - DNA, 23 bp, Homo sapiens
tgcctgctacttgagggccagga

SEQ ID NO: 1905065 - DNA, 14 bp, Homo sapiens
tgcctgctgaccat

SEQ ID NO: 1905066 - DNA, 14 bp, Homo sapiens
tgcctggcagccat

SEQ ID NO: 1905067 - DNA, 19 bp, Homo sapiens
tgcctgtaatcccagcact

SEQ ID NO: 1905068 - DNA, 24 bp, Homo sapiens
tgccttaaagacaagacagcattt

SEQ ID NO: 1905069 - DNA, 15 bp, Homo sapiens
tgccttaagtgagga

SEQ ID NO: 1905070 - DNA, 11 bp, Homo sapiens
tgccttagcat

SEQ ID NO: 1905071 - DNA, 14 bp, Homo sapiens
tgccttagcatgtg

SEQ ID NO: 1905072 - DNA, 18 bp, Homo sapiens
tgcctttgcagctcagaa

SEQ ID NO: 1905073 - DNA, 13 bp, Homo sapiens
tgcggggcagcag

SEQ ID NO: 1905074 - DNA, 14 bp, Homo sapiens
tgcggggcagcagg

SEQ ID NO: 1905075 - DNA, 22 bp, Homo sapiens
tgctatgatgttagttttcctt

SEQ ID NO: 1905076 - DNA, 19 bp, Homo sapiens
tgctattacgaagttcaag

SEQ ID NO: 1905077 - DNA, 15 bp, Homo sapiens
tgctattctgagtga

SEQ ID NO: 1905078 - DNA, 12 bp, Homo sapiens
tgctcctgagcc

SEQ ID NO: 1905079 - DNA, 21 bp, Homo sapiens
tgctcctgagcccccagcttc

SEQ ID NO: 1905080 - DNA, 20 bp, Homo sapiens
tgctctcaaacccctgacct

SEQ ID NO: 1905081 - DNA, 21 bp, Homo sapiens
tgctctcaaacccctgacctc

SEQ ID NO: 1905082 - DNA, 20 bp, Homo sapiens
tgctctcaccttggttcctg

SEQ ID NO: 1905083 - DNA, 21 bp, Homo sapiens
tgctctcgaggcagcagtggg

SEQ ID NO: 1905084 - DNA, 21 bp, Homo sapiens
tgctgaacattgcatataact

SEQ ID NO: 1905085 - DNA, 21 bp, Homo sapiens
tgctgaccataacagtgccag

SEQ ID NO: 1905086 - DNA, 23 bp, Homo sapiens
tgctgaccataacagtgccagct

SEQ ID NO: 1905087 - DNA, 23 bp, Homo sapiens
tgctgacccaacagcctctgtgg

SEQ ID NO: 1905088 - DNA, 21 bp, Homo sapiens
tgctgacccatgggcaggaga

SEQ ID NO: 1905089 - DNA, 14 bp, Homo sapiens
tgctgacccctgtg

SEQ ID NO: 1905090 - DNA, 14 bp, Homo sapiens
tgctgacttagaat

SEQ ID NO: 1905091 - DNA, 15 bp, Homo sapiens
tgctgacttagaatc

SEQ ID NO: 1905092 - DNA, 16 bp, Homo sapiens
tgctgagtctgttctg

SEQ ID NO: 1905093 - DNA, 16 bp, Homo sapiens
tgctgattttgacctt

SEQ ID NO: 1905094 - DNA, 14 bp, Homo sapiens
tgctgcatcccctt

SEQ ID NO: 1905095 - DNA, 15 bp, Homo sapiens
tgctgcatccccttc

SEQ ID NO: 1905096 - DNA, 14 bp, Homo sapiens
tgctgccaggcccg

SEQ ID NO: 1905097 - DNA, 23 bp, Homo sapiens
tgctgccaggcccggcatgaggc

SEQ ID NO: 1905098 - DNA, 19 bp, Homo sapiens
tgctgctgacccctgtgtg

SEQ ID NO: 1905099 - DNA, 20 bp, Homo sapiens
tgctgggaggtcccagggcc

SEQ ID NO: 1905100 - DNA, 14 bp, Homo sapiens
tgctggtaaaatga

SEQ ID NO: 1905101 - DNA, 21 bp, Homo sapiens
tgctgtcacaaaggagtgagt

SEQ ID NO: 1905102 - DNA, 12 bp, Homo sapiens
tgctgtgaaaaa

SEQ ID NO: 1905103 - DNA, 18 bp, Homo sapiens
tgctgtgaacatgcctcc

SEQ ID NO: 1905104 - DNA, 18 bp, Homo sapiens
tgctgtgaagctggaact

SEQ ID NO: 1905105 - DNA, 18 bp, Homo sapiens
tgctgtgtgtggcttctg

SEQ ID NO: 1905106 - DNA, 23 bp, Homo sapiens
tgcttagtatctaataatgaagt

SEQ ID NO: 1905107 - DNA, 13 bp, Homo sapiens
tgcttcctttctt

SEQ ID NO: 1905108 - DNA, 19 bp, Homo sapiens
tgcttgaagcaaacagttg

SEQ ID NO: 1905109 - DNA, 20 bp, Homo sapiens
tgcttgaagcaaacagttga

SEQ ID NO: 1905110 - DNA, 13 bp, Homo sapiens
tgcttggcccagg

SEQ ID NO: 1905111 - DNA, 17 bp, Homo sapiens
tgcttgtggaagacaag

SEQ ID NO: 1905112 - DNA, 15 bp, Homo sapiens
tgctttctgaatgta

SEQ ID NO: 1905113 - DNA, 18 bp, Homo sapiens
tgctttctgaatgtagac

SEQ ID NO: 1905114 - DNA, 19 bp, Homo sapiens
tgctttggtcacttttaga

SEQ ID NO: 1905115 - DNA, 17 bp, Homo sapiens
tggaaaggccagcagcc

SEQ ID NO: 1905116 - DNA, 14 bp, Homo sapiens
tggaaagtgttcat

SEQ ID NO: 1905117 - DNA, 20 bp, Homo sapiens
tggaaattaagaagaaacta

SEQ ID NO: 1905118 - DNA, 16 bp, Homo sapiens
tggaactgctgctgac

SEQ ID NO: 1905119 - DNA, 19 bp, Homo sapiens
tggaactgctgctgacccc

SEQ ID NO: 1905120 - DNA, 20 bp, Homo sapiens
tggaacttacaaagggtcta

SEQ ID NO: 1905121 - DNA, 18 bp, Homo sapiens
tggaagcggtttgcattt

SEQ ID NO: 1905122 - DNA, 18 bp, Homo sapiens
tggaagtgaaaactttgt

SEQ ID NO: 1905123 - DNA, 18 bp, Homo sapiens
tggaataaaaattccaga

SEQ ID NO: 1905124 - DNA, 17 bp, Homo sapiens
tggaataagccttcgaa

SEQ ID NO: 1905125 - DNA, 16 bp, Homo sapiens
tggacaccccacggga

SEQ ID NO: 1905126 - DNA, 14 bp, Homo sapiens
tggaccccagcctc

SEQ ID NO: 1905127 - DNA, 15 bp, Homo sapiens
tggaccccagcctca

SEQ ID NO: 1905128 - DNA, 18 bp, Homo sapiens
tggaccccatctgtgaat

SEQ ID NO: 1905129 - DNA, 14 bp, Homo sapiens
tggactctaaagtc

SEQ ID NO: 1905130 - DNA, 12 bp, Homo sapiens
tggactctctga

SEQ ID NO: 1905131 - DNA, 14 bp, Homo sapiens
tgtacgcaattctc

SEQ ID NO: 1905132 - DNA, 14 bp, Homo sapiens
tgtactttgaaaac

SEQ ID NO: 1905133 - DNA, 23 bp, Homo sapiens
tgtactttgttaaaaacactgct

SEQ ID NO: 1905134 - DNA, 22 bp, Homo sapiens
tgtagaacttgttgctgatttt

SEQ ID NO: 1905135 - DNA, 15 bp, Homo sapiens
tgtagacattttgaa

SEQ ID NO: 1905136 - DNA, 15 bp, Homo sapiens
tgtagatttatttca

SEQ ID NO: 1905137 - DNA, 17 bp, Homo sapiens
tgtagcctgaagagttt

SEQ ID NO: 1905138 - DNA, 17 bp, Homo sapiens
tgtagtgtgttttcata

SEQ ID NO: 1905139 - DNA, 14 bp, Homo sapiens
tgtagtgtttcttt

SEQ ID NO: 1905140 - DNA, 12 bp, Homo sapiens
tgtagttcttta

SEQ ID NO: 1905141 - DNA, 14 bp, Homo sapiens
tgtagttctttaaa

SEQ ID NO: 1905142 - DNA, 14 bp, Homo sapiens
tgtataaatttatt

SEQ ID NO: 1905143 - DNA, 22 bp, Homo sapiens
tgtatacttgaaaaatgttata

SEQ ID NO: 1905144 - DNA, 13 bp, Homo sapiens
tgtatagttatgt

SEQ ID NO: 1905145 - DNA, 15 bp, Homo sapiens
tgtatagttatgtaa

SEQ ID NO: 1905146 - DNA, 17 bp, Homo sapiens
tgtatagttatgtaaat

SEQ ID NO: 1905147 - DNA, 19 bp, Homo sapiens
tgtatagttatgtaaataa

SEQ ID NO: 1905148 - DNA, 13 bp, Homo sapiens
tgtatatattttt

SEQ ID NO: 1905149 - DNA, 22 bp, Homo sapiens
tgtatatttgatttattaactt

SEQ ID NO: 1905150 - DNA, 14 bp, Homo sapiens
tgtatcttccagaa

SEQ ID NO: 1905151 - DNA, 15 bp, Homo sapiens
tgtatggccaggaag

SEQ ID NO: 1905152 - DNA, 15 bp, Homo sapiens
tgtatgtataattca

SEQ ID NO: 1905153 - DNA, 19 bp, Homo sapiens
tgtatgtgtttagaattga

SEQ ID NO: 1905154 - DNA, 16 bp, Homo sapiens
tgtattaattatttaa

SEQ ID NO: 1905155 - DNA, 17 bp, Homo sapiens
tgtattaattatttaaa

SEQ ID NO: 1905156 - DNA, 17 bp, Homo sapiens
tgtattatatgtaacta

SEQ ID NO: 1905157 - DNA, 18 bp, Homo sapiens
tgtattatcaatgaaaat

SEQ ID NO: 1905158 - DNA, 16 bp, Homo sapiens
tgtattctatttgtgt

SEQ ID NO: 1905159 - DNA, 18 bp, Homo sapiens
tgtattctcataatactg

SEQ ID NO: 1905160 - DNA, 17 bp, Homo sapiens
tgtattgaagttaactg

SEQ ID NO: 1905161 - DNA, 12 bp, Homo sapiens
tgtatttgaaag

SEQ ID NO: 1905162 - DNA, 12 bp, Homo sapiens
tgtcaaaagtag

SEQ ID NO: 1905163 - DNA, 21 bp, Homo sapiens
tgtcaaaagtagaactttgta

SEQ ID NO: 1905164 - DNA, 22 bp, Homo sapiens
tgtcaaaagtagaactttgtat

SEQ ID NO: 1905165 - DNA, 12 bp, Homo sapiens
tgtcaataaatt

SEQ ID NO: 1905166 - DNA, 23 bp, Homo sapiens
tgtcactccaaaccttactctga

SEQ ID NO: 1905167 - DNA, 16 bp, Homo sapiens
tgtcagggttggaaag

SEQ ID NO: 1905168 - DNA, 20 bp, Homo sapiens
tgtcatactcgagtctgagg

SEQ ID NO: 1905169 - DNA, 13 bp, Homo sapiens
tgtcatctgagaa

SEQ ID NO: 1905170 - DNA, 16 bp, Homo sapiens
tgtcatctgagaatga

SEQ ID NO: 1905171 - DNA, 17 bp, Homo sapiens
tgtccagtaagatcact

SEQ ID NO: 1905172 - DNA, 19 bp, Homo sapiens
tgtccagtaagatcactgt

SEQ ID NO: 1905173 - DNA, 22 bp, Homo sapiens
tgtccagtaagatcactgttta

SEQ ID NO: 1905174 - DNA, 11 bp, Homo sapiens
tgtcccaggca

SEQ ID NO: 1905175 - DNA, 18 bp, Homo sapiens
tgtcctaatggtgatgca

SEQ ID NO: 1905176 - DNA, 21 bp, Homo sapiens
tgtcctgccccccagcctagg

SEQ ID NO: 1905177 - DNA, 17 bp, Homo sapiens
tgtccttgaagcttgta

SEQ ID NO: 1905178 - DNA, 22 bp, Homo sapiens
tgtccttgaagcttgtatctga

SEQ ID NO: 1905179 - DNA, 12 bp, Homo sapiens
tgtctagatttt

SEQ ID NO: 1905180 - DNA, 18 bp, Homo sapiens
tgtctagattttgaaaaa

SEQ ID NO: 1905181 - DNA, 13 bp, Homo sapiens
tgtctatttctga

SEQ ID NO: 1905182 - DNA, 16 bp, Homo sapiens
tgtctatttctgaaag

SEQ ID NO: 1905183 - DNA, 22 bp, Homo sapiens
tgtctcccaccctttctgccag

SEQ ID NO: 1905184 - DNA, 13 bp, Homo sapiens
tgtctcctgtttc

SEQ ID NO: 1905185 - DNA, 16 bp, Homo sapiens
tgtctcttttttaagt

SEQ ID NO: 1905186 - DNA, 20 bp, Homo sapiens
tgtctggcacagcctgcact

SEQ ID NO: 1905187 - DNA, 15 bp, Homo sapiens
tgtctggccagggag

SEQ ID NO: 1905188 - DNA, 19 bp, Homo sapiens
tgtctgttggcaaatttgt

SEQ ID NO: 1905189 - DNA, 16 bp, Homo sapiens
tgtctgttgtattcat

SEQ ID NO: 1905190 - DNA, 18 bp, Homo sapiens
tgtcttaattttctttca

SEQ ID NO: 1905191 - DNA, 17 bp, Homo sapiens
tgtcttgctaacaggat

SEQ ID NO: 1905192 - DNA, 16 bp, Homo sapiens
tgtcttgcttgattga

SEQ ID NO: 1905193 - DNA, 17 bp, Homo sapiens
tgtgaaaaaaaaaatgc

SEQ ID NO: 1905194 - DNA, 20 bp, Homo sapiens
tgtgaaaaaaaaaatgctga

SEQ ID NO: 1905195 - DNA, 19 bp, Homo sapiens
tgtgaacatgcctcctcct

SEQ ID NO: 1905196 - DNA, 15 bp, Homo sapiens
tgtgaacttggaagc

SEQ ID NO: 1905197 - DNA, 21 bp, Homo sapiens
tgtgaatactgcttgaataaa

SEQ ID NO: 1905198 - DNA, 14 bp, Homo sapiens
tgtgaccagttttg

SEQ ID NO: 1905199 - DNA, 20 bp, Homo sapiens
tgtgaccagttttgatattt

SEQ ID NO: 1905200 - DNA, 13 bp, Homo sapiens
tgtgaggccacac

SEQ ID NO: 1905201 - DNA, 19 bp, Homo sapiens
tgtgatgaagctgaggctg

SEQ ID NO: 1905202 - DNA, 21 bp, Homo sapiens
tgtgattgcctcaataaagct

SEQ ID NO: 1905203 - DNA, 15 bp, Homo sapiens
tgtgcagggcacaga

SEQ ID NO: 1905204 - DNA, 21 bp, Homo sapiens
tgtgcccagaatactgatgga

SEQ ID NO: 1905205 - DNA, 23 bp, Homo sapiens
tgtgcctaaataagttataaaga

SEQ ID NO: 1905206 - DNA, 14 bp, Homo sapiens
tgtgcctgcttcag

SEQ ID NO: 1905207 - DNA, 17 bp, Homo sapiens
tgtgctccgtagcttct

SEQ ID NO: 1905208 - DNA, 19 bp, Homo sapiens
tgtggaaaaataaaggaaa

SEQ ID NO: 1905209 - DNA, 16 bp, Homo sapiens
tgtggaagacaagtct

SEQ ID NO: 1905210 - DNA, 17 bp, Homo sapiens
tgtggagtcatttctga

SEQ ID NO: 1905211 - DNA, 13 bp, Homo sapiens
tgtggcagcagga

SEQ ID NO: 1905212 - DNA, 13 bp, Homo sapiens
tgtggccagcagc

SEQ ID NO: 1905213 - DNA, 16 bp, Homo sapiens
tgtggcctcttctgag

SEQ ID NO: 1905214 - DNA, 14 bp, Homo sapiens
tgtggtcagagagg

SEQ ID NO: 1905215 - DNA, 16 bp, Homo sapiens
tgtggtccatctctga

SEQ ID NO: 1905216 - DNA, 14 bp, Homo sapiens
tgtgtcctttctga

SEQ ID NO: 1905217 - DNA, 15 bp, Homo sapiens
tgtgtcctttctgaa

SEQ ID NO: 1905218 - DNA, 12 bp, Homo sapiens
tgtgtctcctgt

SEQ ID NO: 1905219 - DNA, 22 bp, Homo sapiens
tgtgtgaagcttaagggtcata

SEQ ID NO: 1905220 - DNA, 13 bp, Homo sapiens
tgtgtgcccagct

SEQ ID NO: 1905221 - DNA, 14 bp, Homo sapiens
tgtgtgcccagctt

SEQ ID NO: 1905222 - DNA, 17 bp, Homo sapiens
tgtgtggagtcatttct

SEQ ID NO: 1905223 - DNA, 20 bp, Homo sapiens
tgtgtggagtcatttctgat

SEQ ID NO: 1905224 - DNA, 14 bp, Homo sapiens
tgtgttaatttaag

SEQ ID NO: 1905225 - DNA, 16 bp, Homo sapiens
tgtgttccaaccactg

SEQ ID NO: 1905226 - DNA, 18 bp, Homo sapiens
tgtgtttaaagtgaattt

SEQ ID NO: 1905227 - DNA, 23 bp, Homo sapiens
tgttaagataattgtactttgaa

SEQ ID NO: 1905228 - DNA, 13 bp, Homo sapiens
tgttaagcatcta

SEQ ID NO: 1905229 - DNA, 15 bp, Homo sapiens
tgttaatttaagttt

SEQ ID NO: 1905230 - DNA, 16 bp, Homo sapiens
tgttaatttaagtttt

SEQ ID NO: 1905231 - DNA, 18 bp, Homo sapiens
tgttacactttttggaag

SEQ ID NO: 1905232 - DNA, 15 bp, Homo sapiens
tgttacatgtatcaa

SEQ ID NO: 1905233 - DNA, 23 bp, Homo sapiens
tgttaccccaagcgccctggccc

SEQ ID NO: 1905234 - DNA, 17 bp, Homo sapiens
tgttagattaagaaata

SEQ ID NO: 1905235 - DNA, 20 bp, Homo sapiens
tgttagattaagaaatagac

SEQ ID NO: 1905236 - DNA, 13 bp, Homo sapiens
tgttatatgaaca

SEQ ID NO: 1905237 - DNA, 14 bp, Homo sapiens
tgttatatgaacat

SEQ ID NO: 1905238 - DNA, 15 bp, Homo sapiens
tgttatgtgagaaca

SEQ ID NO: 1905239 - DNA, 17 bp, Homo sapiens
tgttatttgatgactga

SEQ ID NO: 1905240 - DNA, 20 bp, Homo sapiens
tgttcaataaaggaaatatg

SEQ ID NO: 1905241 - DNA, 14 bp, Homo sapiens
tgttctaaaatata

SEQ ID NO: 1905242 - DNA, 17 bp, Homo sapiens
tgttcttggcaataaat

SEQ ID NO: 1905243 - DNA, 20 bp, Homo sapiens
tgttcttggcaataaatttt

SEQ ID NO: 1905244 - DNA, 14 bp, Homo sapiens
tgttgaagacaggg

SEQ ID NO: 1905245 - DNA, 20 bp, Homo sapiens
tgttgaggcgagcagggcag

SEQ ID NO: 1905246 - DNA, 13 bp, Homo sapiens
tgttgcccaggct

SEQ ID NO: 1905247 - DNA, 23 bp, Homo sapiens
tgttgcctataagccaaaattaa

SEQ ID NO: 1905248 - DNA, 13 bp, Homo sapiens
tgttggactctga

SEQ ID NO: 1905249 - DNA, 15 bp, Homo sapiens
tgttggcctctgcaa

SEQ ID NO: 1905250 - DNA, 15 bp, Homo sapiens
tgttgtaaaatgaat

SEQ ID NO: 1905251 - DNA, 14 bp, Homo sapiens
tgttgtattcattg

SEQ ID NO: 1905252 - DNA, 11 bp, Homo sapiens
tgttgtcaaga

SEQ ID NO: 1905253 - DNA, 19 bp, Homo sapiens
tgttgttgataaggaacat

SEQ ID NO: 1905254 - DNA, 21 bp, Homo sapiens
tgttgttgataaggaacattt

SEQ ID NO: 1905255 - DNA, 12 bp, Homo sapiens
tgttgtttgtat

SEQ ID NO: 1905256 - DNA, 20 bp, Homo sapiens
tgtttaaaacaccttctata

SEQ ID NO: 1905257 - DNA, 19 bp, Homo sapiens
tgtttaataccctgtacat

SEQ ID NO: 1905258 - DNA, 12 bp, Homo sapiens
tgtttagaattg

SEQ ID NO: 1905259 - DNA, 14 bp, Homo sapiens
tgtttagaattgaa

SEQ ID NO: 1905260 - DNA, 17 bp, Homo sapiens
tgtttagaattgaaggt

SEQ ID NO: 1905261 - DNA, 17 bp, Homo sapiens
tgtttagatttgccata

SEQ ID NO: 1905262 - DNA, 22 bp, Homo sapiens
tgtttagctacgtttactcaca

SEQ ID NO: 1905263 - DNA, 17 bp, Homo sapiens
ttcttcacatgtaactt

SEQ ID NO: 1905264 - DNA, 19 bp, Homo sapiens
ttcttcagactgaggcctt

SEQ ID NO: 1905265 - DNA, 13 bp, Homo sapiens
ttctttaaactgt

SEQ ID NO: 1905266 - DNA, 13 bp, Homo sapiens
ttctttcctttcc

SEQ ID NO: 1905267 - DNA, 12 bp, Homo sapiens
ttctttgaagag

SEQ ID NO: 1905268 - DNA, 13 bp, Homo sapiens
ttcttttgctttc

SEQ ID NO: 1905269 - DNA, 17 bp, Homo sapiens
ttctttttccctttcct

SEQ ID NO: 1905270 - DNA, 15 bp, Homo sapiens
ttcttttttattaat

SEQ ID NO: 1905271 - DNA, 21 bp, Homo sapiens
ttcttttttattaatcactgt

SEQ ID NO: 1905272 - DNA, 20 bp, Homo sapiens
ttcttttttcccctttcttg

SEQ ID NO: 1905273 - DNA, 21 bp, Homo sapiens
ttgaaaacaccagctgtatat

SEQ ID NO: 1905274 - DNA, 13 bp, Homo sapiens
ttgaaaagagaca

SEQ ID NO: 1905275 - DNA, 22 bp, Homo sapiens
ttgaaaagtaatatttattaaa

SEQ ID NO: 1905276 - DNA, 17 bp, Homo sapiens
ttgaaagaatgtaaagc

SEQ ID NO: 1905277 - DNA, 14 bp, Homo sapiens
ttgaaagagatggc

SEQ ID NO: 1905278 - DNA, 16 bp, Homo sapiens
ttgaagcttgtatctg

SEQ ID NO: 1905279 - DNA, 17 bp, Homo sapiens
ttgaagcttgtatctga

SEQ ID NO: 1905280 - DNA, 17 bp, Homo sapiens
ttgaaggcagaaagcaa

SEQ ID NO: 1905281 - DNA, 16 bp, Homo sapiens
ttgaataatgtctaga

SEQ ID NO: 1905282 - DNA, 21 bp, Homo sapiens
ttgaatatttaagcaataaaa

SEQ ID NO: 1905283 - DNA, 14 bp, Homo sapiens
ttgaatttatataa

SEQ ID NO: 1905284 - DNA, 21 bp, Homo sapiens
ttgaatttatataaagtattt

SEQ ID NO: 1905285 - DNA, 23 bp, Homo sapiens
ttgaatttatttttaagaaagaa

SEQ ID NO: 1905286 - DNA, 14 bp, Homo sapiens
ttgacaagctggct

SEQ ID NO: 1905287 - DNA, 15 bp, Homo sapiens
ttgacaagctggctt

SEQ ID NO: 1905288 - DNA, 12 bp, Homo sapiens
ttgaccttgtat

SEQ ID NO: 1905289 - DNA, 16 bp, Homo sapiens
ttgaccttgtattgaa

SEQ ID NO: 1905290 - DNA, 19 bp, Homo sapiens
ttgacgtattattgtcctt

SEQ ID NO: 1905291 - DNA, 16 bp, Homo sapiens
ttgagaggaacaagaa

SEQ ID NO: 1905292 - DNA, 14 bp, Homo sapiens
ttgagctatgactt

SEQ ID NO: 1905293 - DNA, 12 bp, Homo sapiens
ttgagctcccac

SEQ ID NO: 1905294 - DNA, 16 bp, Homo sapiens
ttgaggagcactgaaa

SEQ ID NO: 1905295 - DNA, 15 bp, Homo sapiens
ttgaggttttggtaa

SEQ ID NO: 1905296 - DNA, 22 bp, Homo sapiens
ttgagtgtattctatttgtgta

SEQ ID NO: 1905297 - DNA, 14 bp, Homo sapiens
ttgataattttcct

SEQ ID NO: 1905298 - DNA, 18 bp, Homo sapiens
ttgataattttcctttaa

SEQ ID NO: 1905299 - DNA, 13 bp, Homo sapiens
ttgatgatgttgt

SEQ ID NO: 1905300 - DNA, 19 bp, Homo sapiens
ttgatgcattaaaagaaaa

SEQ ID NO: 1905301 - DNA, 23 bp, Homo sapiens
ttgatgcattaaaagaaaataaa

SEQ ID NO: 1905302 - DNA, 21 bp, Homo sapiens
ttgatgggatgattgaagaaa

SEQ ID NO: 1905303 - DNA, 18 bp, Homo sapiens
ttgatgtcagcagttgct

SEQ ID NO: 1905304 - DNA, 12 bp, Homo sapiens
ttgatgtgttgt

SEQ ID NO: 1905305 - DNA, 13 bp, Homo sapiens
ttgatgtgttgtt

SEQ ID NO: 1905306 - DNA, 13 bp, Homo sapiens
ttgattaaagatg

SEQ ID NO: 1905307 - DNA, 16 bp, Homo sapiens
ttgattagagaccaga

SEQ ID NO: 1905308 - DNA, 13 bp, Homo sapiens
ttgatttgagatt

SEQ ID NO: 1905309 - DNA, 22 bp, Homo sapiens
ttgcaaaggagctcactgtggt

SEQ ID NO: 1905310 - DNA, 14 bp, Homo sapiens
ttgcacaatatatt

SEQ ID NO: 1905311 - DNA, 15 bp, Homo sapiens
ttgcagtcactttga

SEQ ID NO: 1905312 - DNA, 22 bp, Homo sapiens
ttgcagtgtgaatgctgggccc

SEQ ID NO: 1905313 - DNA, 18 bp, Homo sapiens
ttgcatctgggtagctgt

SEQ ID NO: 1905314 - DNA, 22 bp, Homo sapiens
ttgccagctgctgagccgcaga

SEQ ID NO: 1905315 - DNA, 14 bp, Homo sapiens
ttgctgacttagaa

SEQ ID NO: 1905316 - DNA, 21 bp, Homo sapiens
ttgctgattttgaccttgtat

SEQ ID NO: 1905317 - DNA, 14 bp, Homo sapiens
ttgctggtacacac

SEQ ID NO: 1905318 - DNA, 12 bp, Homo sapiens
ttgctgtcacaa

SEQ ID NO: 1905319 - DNA, 14 bp, Homo sapiens
ttgctgtcacaaag

SEQ ID NO: 1905320 - DNA, 23 bp, Homo sapiens
ttgcttagtatctaataatgaag

SEQ ID NO: 1905321 - DNA, 13 bp, Homo sapiens
ttgcttatattga

SEQ ID NO: 1905322 - DNA, 19 bp, Homo sapiens
ttggaaatcaaatgtaaag

SEQ ID NO: 1905323 - DNA, 20 bp, Homo sapiens
ttggaagtgaaaactttgta

SEQ ID NO: 1905324 - DNA, 20 bp, Homo sapiens
ttggcaaatttgtgaactgt

SEQ ID NO: 1905325 - DNA, 20 bp, Homo sapiens
ttggcaataaattttgaaaa

SEQ ID NO: 1905326 - DNA, 17 bp, Homo sapiens
ttggctcccatcttttg

SEQ ID NO: 1905327 - DNA, 15 bp, Homo sapiens
ttggcttcctctgct

SEQ ID NO: 1905328 - DNA, 19 bp, Homo sapiens
ttggggaccacagaggctg

SEQ ID NO: 1905329 - DNA, 15 bp, Homo sapiens
ttgggggctcagcaa

SEQ ID NO: 1905330 - DNA, 16 bp, Homo sapiens
ttggtatcaagaaagt

SEQ ID NO: 1905331 - DNA, 13 bp, Homo sapiens
ttggtatccttat

SEQ ID NO: 1905332 - DNA, 17 bp, Homo sapiens
tttgatgtcagcagttg

SEQ ID NO: 1905333 - DNA, 14 bp, Homo sapiens
tttgcagctcagaa

SEQ ID NO: 1905334 - DNA, 14 bp, Homo sapiens
tttgcagtgtctta

SEQ ID NO: 1905335 - DNA, 17 bp, Homo sapiens
tttgcagtgttaagata

SEQ ID NO: 1905336 - DNA, 16 bp, Homo sapiens
tttgcccctggcaaat

SEQ ID NO: 1905337 - DNA, 19 bp, Homo sapiens
tttgctgaaagatatgtat

SEQ ID NO: 1905338 - DNA, 16 bp, Homo sapiens
tttgctttcctttcct

SEQ ID NO: 1905339 - DNA, 16 bp, Homo sapiens
tttggaaagactggac

SEQ ID NO: 1905340 - DNA, 23 bp, Homo sapiens
tttggctctcctcagaagaaaga

SEQ ID NO: 1905341 - DNA, 16 bp, Homo sapiens
tttggcttcctctgct

SEQ ID NO: 1905342 - DNA, 19 bp, Homo sapiens
tttggcttcctctgctgca

SEQ ID NO: 1905343 - DNA, 20 bp, Homo sapiens
tttggttatgaatactttgc

SEQ ID NO: 1905344 - DNA, 14 bp, Homo sapiens
tttggttgaataaa

SEQ ID NO: 1905345 - DNA, 23 bp, Homo sapiens
tttgtaaaagaacagtaaacatt

SEQ ID NO: 1905346 - DNA, 22 bp, Homo sapiens
tttgtaaatgactttcataata

SEQ ID NO: 1905347 - DNA, 12 bp, Homo sapiens
tttgtaaattct

SEQ ID NO: 1905348 - DNA, 20 bp, Homo sapiens
tttgtaaattctgatttctt

SEQ ID NO: 1905349 - DNA, 19 bp, Homo sapiens
tttgtaataataaagaata

SEQ ID NO: 1905350 - DNA, 20 bp, Homo sapiens
tttgtacgacgtcagatgtt

SEQ ID NO: 1905351 - DNA, 16 bp, Homo sapiens
tttgtagacattttga

SEQ ID NO: 1905352 - DNA, 14 bp, Homo sapiens
tttgtatagttatg

SEQ ID NO: 1905353 - DNA, 19 bp, Homo sapiens
tttgtatagttatgtaaat

SEQ ID NO: 1905354 - DNA, 18 bp, Homo sapiens
tttgtatattggttttat

SEQ ID NO: 1905355 - DNA, 20 bp, Homo sapiens
tttgtatattggttttatga

SEQ ID NO: 1905356 - DNA, 13 bp, Homo sapiens
tttgtattgtcct

SEQ ID NO: 1905357 - DNA, 20 bp, Homo sapiens
tttgtcttgcgggtctgtca

SEQ ID NO: 1905358 - DNA, 13 bp, Homo sapiens
tttgtggtgattt

SEQ ID NO: 1905359 - DNA, 16 bp, Homo sapiens
tttgttactcttggga

SEQ ID NO: 1905360 - DNA, 13 bp, Homo sapiens
tttgttgtatttt

SEQ ID NO: 1905361 - DNA, 14 bp, Homo sapiens
ttttaagaaagaaa

SEQ ID NO: 1905362 - DNA, 18 bp, Homo sapiens
ttttaatctactgcattt

SEQ ID NO: 1905363 - DNA, 21 bp, Homo sapiens
ttttaatctctaacagtggac

SEQ ID NO: 1905364 - DNA, 12 bp, Homo sapiens
ttttaattgtat

SEQ ID NO: 1905365 - DNA, 14 bp, Homo sapiens
ttttaattgtattt

SEQ ID NO: 1905366 - DNA, 22 bp, Homo sapiens
ttttaattgtatttttgttgtt

SEQ ID NO: 1905367 - DNA, 14 bp, Homo sapiens
ttttacattgtgaa

SEQ ID NO: 1905368 - DNA, 22 bp, Homo sapiens
ttttactttttttttattttat

SEQ ID NO: 1905369 - DNA, 13 bp, Homo sapiens
ttttagaataaaa

SEQ ID NO: 1905370 - DNA, 16 bp, Homo sapiens
ttttatataataaaag

SEQ ID NO: 1905371 - DNA, 11 bp, Homo sapiens
ttttatatttc

SEQ ID NO: 1905372 - DNA, 15 bp, Homo sapiens
ttttatatttcaagt

SEQ ID NO: 1905373 - DNA, 13 bp, Homo sapiens
ttttattaatcac

SEQ ID NO: 1905374 - DNA, 21 bp, Homo sapiens
ttttattaatcactgtgtata

SEQ ID NO: 1905375 - DNA, 22 bp, Homo sapiens
ttttattaatcactgtgtatat

SEQ ID NO: 1905376 - DNA, 23 bp, Homo sapiens
ttttcaccattcgtacataatac

SEQ ID NO: 1905377 - DNA, 12 bp, Homo sapiens
ttttcagaactg

SEQ ID NO: 1905378 - DNA, 17 bp, Homo sapiens
ttttcagaactgttaaa

SEQ ID NO: 1905379 - DNA, 16 bp, Homo sapiens
ttttcataagatattt

SEQ ID NO: 1905380 - DNA, 19 bp, Homo sapiens
ttttcataagatattttat

SEQ ID NO: 1905381 - DNA, 15 bp, Homo sapiens
ttttccctcctttcc

SEQ ID NO: 1905382 - DNA, 13 bp, Homo sapiens
ttttcctgttcta

SEQ ID NO: 1905383 - DNA, 16 bp, Homo sapiens
ttttctactttgaaat

SEQ ID NO: 1905384 - DNA, 13 bp, Homo sapiens
ttttctatgaatc

SEQ ID NO: 1905385 - DNA, 13 bp, Homo sapiens
ttttctcttcata

SEQ ID NO: 1905386 - DNA, 13 bp, Homo sapiens
ttttcttcatcaa

SEQ ID NO: 1905387 - DNA, 14 bp, Homo sapiens
ttttcttctgaaat

SEQ ID NO: 1905388 - DNA, 16 bp, Homo sapiens
ttttcttgataatttt

SEQ ID NO: 1905389 - DNA, 10 bp, Homo sapiens
ttttctttcc

SEQ ID NO: 1905390 - DNA, 15 bp, Homo sapiens
ttttcttttgctttc

SEQ ID NO: 1905391 - DNA, 19 bp, Homo sapiens
ttttcttttttcccctttc

SEQ ID NO: 1905392 - DNA, 13 bp, Homo sapiens
ttttgaaaaatta

SEQ ID NO: 1905393 - DNA, 20 bp, Homo sapiens
ttttgaaaagtaatatttat

SEQ ID NO: 1905394 - DNA, 16 bp, Homo sapiens
ttttgaaataaaaatg

SEQ ID NO: 1905395 - DNA, 17 bp, Homo sapiens
ttttgaaataaaaatgg

SEQ ID NO: 1905396 - DNA, 15 bp, Homo sapiens
ttttgaccttgtatt

SEQ ID NO: 1905397 - DNA, 19 bp, Homo sapiens
ttttgatctttgagtgtat

SEQ ID NO: 1905398 - DNA, 15 bp, Homo sapiens
ttttgcattgtctgt

SEQ ID NO: 1905399 - DNA, 20 bp, Homo sapiens
ttttggttgaataaactaga

SEQ ID NO: 1905400 - DNA, 13 bp, Homo sapiens
ttttggttttcta

SEQ ID NO: 1905401 - DNA, 18 bp, Homo sapiens
ttttgtttttctgcttta

SEQ ID NO: 1905402 - DNA, 22 bp, Homo sapiens
tttttaatctactgcatttagg

SEQ ID NO: 1905403 - DNA, 20 bp, Homo sapiens
tttttaatgctaatcttgtg

SEQ ID NO: 1905404 - DNA, 13 bp, Homo sapiens
tttttatttatat

SEQ ID NO: 1905405 - DNA, 13 bp, Homo sapiens
tttttccagttca

SEQ ID NO: 1905406 - DNA, 18 bp, Homo sapiens
tttttcttatttatgtaa

SEQ ID NO: 1905407 - DNA, 20 bp, Homo sapiens
tttttgaactcttctcatta

SEQ ID NO: 1905408 - DNA, 13 bp, Homo sapiens
tttttgatagcat

SEQ ID NO: 1905409 - DNA, 22 bp, Homo sapiens
tttttgtatattggttttatga

SEQ ID NO: 1905410 - DNA, 16 bp, Homo sapiens
tttttgtttttctgct

SEQ ID NO: 1905411 - DNA, 13 bp, Homo sapiens
ttttttgtacgca

SEQ ID NO: 1905412 - DNA, 13 bp, Homo sapiens
ttttttgtatgaa

SEQ ID NO: 1905413 - DNA, 13 bp, Homo sapiens
ttttttgtttgtt

SEQ ID NO: 1905414 - DNA, 14 bp, Homo sapiens
tttttttgtacgac

SEQ ID NO: 1905415 - DNA, 22 bp, Homo sapiens
ttactttgtaaattctgatttc

SEQ ID NO: 1905416 - DNA, 19 bp, Homo sapiens
ttagaaaaggaaataggtt

SEQ ID NO: 1905417 - DNA, 14 bp, Homo sapiens
ttagaacaggtttt

SEQ ID NO: 1905418 - DNA, 23 bp, Homo sapiens
ttagaatccctgtgttaatttaa

SEQ ID NO: 1905419 - DNA, 13 bp, Homo sapiens
ttagaatgtcaat

SEQ ID NO: 1905420 - DNA, 16 bp, Homo sapiens
ttagaattgaaggttt

SEQ ID NO: 1905421 - DNA, 20 bp, Homo sapiens
ttagacttgaaaagagacag

SEQ ID NO: 1905422 - DNA, 15 bp, Homo sapiens
ttagatcatagtttt

SEQ ID NO: 1905423 - DNA, 16 bp, Homo sapiens
ttagatcatagtttta

SEQ ID NO: 1905424 - DNA, 19 bp, Homo sapiens
ttagatgcatattactgta

SEQ ID NO: 1905425 - DNA, 23 bp, Homo sapiens
ttagatttgccatagagtacact

SEQ ID NO: 1905426 - DNA, 21 bp, Homo sapiens
ttagcagctgactttcaaagt

SEQ ID NO: 1905427 - DNA, 15 bp, Homo sapiens
ttagcatgtgttgca

SEQ ID NO: 1905428 - DNA, 18 bp, Homo sapiens
ttagggagtattctaata

SEQ ID NO: 1905429 - DNA, 17 bp, Homo sapiens
ttagtatctaataatga

SEQ ID NO: 1905430 - DNA, 14 bp, Homo sapiens
ttagtattgattca

SEQ ID NO: 1905431 - DNA, 15 bp, Homo sapiens
ttagttccactgaga

SEQ ID NO: 1905432 - DNA, 13 bp, Homo sapiens
ttagttctgactt

SEQ ID NO: 1905433 - DNA, 15 bp, Homo sapiens
ttagttctgactttg

SEQ ID NO: 1905434 - DNA, 11 bp, Homo sapiens
ttagtttagaa

SEQ ID NO: 1905435 - DNA, 22 bp, Homo sapiens
ttataaaacagagtaatcttgt

SEQ ID NO: 1905436 - DNA, 12 bp, Homo sapiens
ttataatgactg

SEQ ID NO: 1905437 - DNA, 13 bp, Homo sapiens
ttatataagcaaa

SEQ ID NO: 1905438 - DNA, 19 bp, Homo sapiens
ttatataataaaagtgcct

SEQ ID NO: 1905439 - DNA, 12 bp, Homo sapiens
ttatatgtatgt

SEQ ID NO: 1905440 - DNA, 15 bp, Homo sapiens
ttatatgtatgtgtt

SEQ ID NO: 1905441 - DNA, 21 bp, Homo sapiens
ttatatgtatgtgtttagaat

SEQ ID NO: 1905442 - DNA, 16 bp, Homo sapiens
ttatattgtaagaaat

SEQ ID NO: 1905443 - DNA, 18 bp, Homo sapiens
ttatatttcaagtacact

SEQ ID NO: 1905444 - DNA, 16 bp, Homo sapiens
ttatcaatagcccagg

SEQ ID NO: 1905445 - DNA, 14 bp, Homo sapiens
ttatgactttcaca

SEQ ID NO: 1905446 - DNA, 15 bp, Homo sapiens
ttatgatgacgtaca

SEQ ID NO: 1905447 - DNA, 23 bp, Homo sapiens
ttatgatgacgtacaagtagttc

SEQ ID NO: 1905448 - DNA, 14 bp, Homo sapiens
ttatgtgagaacat

SEQ ID NO: 1905449 - DNA, 20 bp, Homo sapiens
ttatgtttgccactttgcaa

SEQ ID NO: 1905450 - DNA, 18 bp, Homo sapiens
ttatgtttttgtactctg

SEQ ID NO: 1905451 - DNA, 20 bp, Homo sapiens
ttattaaatttttttgtatg

SEQ ID NO: 1905452 - DNA, 17 bp, Homo sapiens
ttattaacttaataatc

SEQ ID NO: 1905453 - DNA, 12 bp, Homo sapiens
ttattaatcact

SEQ ID NO: 1905454 - DNA, 14 bp, Homo sapiens
ttattaatcactgt

SEQ ID NO: 1905455 - DNA, 16 bp, Homo sapiens
ttattgactcttgagt

SEQ ID NO: 1905456 - DNA, 17 bp, Homo sapiens
ttattgactcttgagtt

SEQ ID NO: 1905457 - DNA, 13 bp, Homo sapiens
ttattgatgaaaa

SEQ ID NO: 1905458 - DNA, 13 bp, Homo sapiens
ttatttatatgta

SEQ ID NO: 1905459 - DNA, 20 bp, Homo sapiens
ttcaaaagtttgtttgctta

SEQ ID NO: 1905460 - DNA, 15 bp, Homo sapiens
ttcaaaatatgtgta

SEQ ID NO: 1905461 - DNA, 23 bp, Homo sapiens
ttcaaagcaccaaaataagaaaa

SEQ ID NO: 1905462 - DNA, 19 bp, Homo sapiens
ttcaacagcaagtgtgaat

SEQ ID NO: 1905463 - DNA, 16 bp, Homo sapiens
ttcaagcgattctctt

SEQ ID NO: 1905464 - DNA, 23 bp, Homo sapiens
ttcaagcgattctcttgcctcag

SEQ ID NO: 1905465 - DNA, 14 bp, Homo sapiens
ttcaagctgctttt

SEQ ID NO: 1905466 - DNA, 16 bp, Homo sapiens
ttcaatatatttgtat

SEQ ID NO: 1905467 - DNA, 20 bp, Homo sapiens
ttcacatttggaatttaaag

SEQ ID NO: 1905468 - DNA, 13 bp, Homo sapiens
ttcaccattcgta

SEQ ID NO: 1905469 - DNA, 13 bp, Homo sapiens
ttcagaaatcctt

SEQ ID NO: 1905470 - DNA, 13 bp, Homo sapiens
ttcagaactgtta

SEQ ID NO: 1905471 - DNA, 15 bp, Homo sapiens
ttcagaactgttaaa

SEQ ID NO: 1905472 - DNA, 14 bp, Homo sapiens
ttcagaccagcccc

SEQ ID NO: 1905473 - DNA, 19 bp, Homo sapiens
ttcagactgaggccttttg

SEQ ID NO: 1905474 - DNA, 12 bp, Homo sapiens
ttcagaggctca

SEQ ID NO: 1905475 - DNA, 13 bp, Homo sapiens
ttcagcatctgac

SEQ ID NO: 1905476 - DNA, 17 bp, Homo sapiens
ttcaggggaaacttgat

SEQ ID NO: 1905477 - DNA, 15 bp, Homo sapiens
ttcagtgatgtgcct

SEQ ID NO: 1905478 - DNA, 23 bp, Homo sapiens
ttcagtgcattatctacttgtgt

SEQ ID NO: 1905479 - DNA, 14 bp, Homo sapiens
ttcataagatattt

SEQ ID NO: 1905480 - DNA, 14 bp, Homo sapiens
ttcataagctttgt

SEQ ID NO: 1905481 - DNA, 18 bp, Homo sapiens
ttcataagctttgtaatt

SEQ ID NO: 1905482 - DNA, 21 bp, Homo sapiens
ttcataataaatagacacttg

SEQ ID NO: 1905483 - DNA, 23 bp, Homo sapiens
ttcatctctagggaccagaacca

SEQ ID NO: 1905484 - DNA, 14 bp, Homo sapiens
ttcatgctttatca

SEQ ID NO: 1905485 - DNA, 14 bp, Homo sapiens
ttcatgtaaaaagt

SEQ ID NO: 1905486 - DNA, 19 bp, Homo sapiens
ttcattggtactgccttaa

SEQ ID NO: 1905487 - DNA, 12 bp, Homo sapiens
ttcatttgcttt

SEQ ID NO: 1905488 - DNA, 16 bp, Homo sapiens
ttcattttctttcctt

SEQ ID NO: 1905489 - DNA, 20 bp, Homo sapiens
ttccaagacttattttcaca

SEQ ID NO: 1905490 - DNA, 21 bp, Homo sapiens
ttccaatagaacagtttactt

SEQ ID NO: 1905491 - DNA, 14 bp, Homo sapiens
cccaggcagcgcca

SEQ ID NO: 1905492 - DNA, 18 bp, Homo sapiens
cccaggctggagtgcagt

SEQ ID NO: 1905493 - DNA, 13 bp, Homo sapiens
cccagggcacgtg

SEQ ID NO: 1905494 - DNA, 13 bp, Homo sapiens
atgggtcagggtg

SEQ ID NO: 1905495 - DNA, 21 bp, Homo sapiens
atgggtcagggtgtgaggcca

SEQ ID NO: 1905496 - DNA, 15 bp, Homo sapiens
atggtaaaattttgt

SEQ ID NO: 1905497 - DNA, 15 bp, Homo sapiens
atggtacttaggtag

SEQ ID NO: 1905498 - DNA, 18 bp, Homo sapiens
atggtagtttctgtggtt

SEQ ID NO: 1905499 - DNA, 16 bp, Homo sapiens
atggttacatatcaaa

SEQ ID NO: 1905500 - DNA, 20 bp, Homo sapiens
atgtaactttggttaaaatc

SEQ ID NO: 1905501 - DNA, 19 bp, Homo sapiens
atgtaaggtcacatttagt

SEQ ID NO: 1905502 - DNA, 20 bp, Homo sapiens
atgtaaggttttttttgtac

SEQ ID NO: 1905503 - DNA, 21 bp, Homo sapiens
atgtaaggttttttttgtacg

SEQ ID NO: 1905504 - DNA, 16 bp, Homo sapiens
atgtaattttgtgtaa

SEQ ID NO: 1905505 - DNA, 17 bp, Homo sapiens
atgtacatttgaaaata

SEQ ID NO: 1905506 - DNA, 18 bp, Homo sapiens
atgtagacggaacagtgt

SEQ ID NO: 1905507 - DNA, 20 bp, Homo sapiens
atgtagatttatttcatcat

SEQ ID NO: 1905508 - DNA, 13 bp, Homo sapiens
atgtatacttgaa

SEQ ID NO: 1905509 - DNA, 14 bp, Homo sapiens
atgtatacttgaaa

SEQ ID NO: 1905510 - DNA, 23 bp, Homo sapiens
atgtatacttgaaaaatgttata

SEQ ID NO: 1905511 - DNA, 16 bp, Homo sapiens
atgtatgtgtttagaa

SEQ ID NO: 1905512 - DNA, 17 bp, Homo sapiens
atgtcaaaagtagaact

SEQ ID NO: 1905513 - DNA, 20 bp, Homo sapiens
atgtcaaaagtagaactttg

SEQ ID NO: 1905514 - DNA, 18 bp, Homo sapiens
atgtccagtaagatcact

SEQ ID NO: 1905515 - DNA, 22 bp, Homo sapiens
atgtcgtagttactctcaggca

SEQ ID NO: 1905516 - DNA, 23 bp, Homo sapiens
atgtctagcacatgttgatttcc

SEQ ID NO: 1905517 - DNA, 15 bp, Homo sapiens
atgtctcaagtgcaa

SEQ ID NO: 1905518 - DNA, 23 bp, Homo sapiens
atgtctcaagtgcaatgccccct

SEQ ID NO: 1905519 - DNA, 16 bp, Homo sapiens
atgtctttcatgtaaa

SEQ ID NO: 1905520 - DNA, 16 bp, Homo sapiens
atgtgagtggttgaat

SEQ ID NO: 1905521 - DNA, 19 bp, Homo sapiens
atgtgagtggttgaatatg

SEQ ID NO: 1905522 - DNA, 22 bp, Homo sapiens
atgtgagtggttgaatatgatt

SEQ ID NO: 1905523 - DNA, 18 bp, Homo sapiens
atgtgatataaacagctt

SEQ ID NO: 1905524 - DNA, 14 bp, Homo sapiens
atgtgatgctggaa

SEQ ID NO: 1905525 - DNA, 20 bp, Homo sapiens
atgtgattgcctcaataaag

SEQ ID NO: 1905526 - DNA, 21 bp, Homo sapiens
atgtggattaaaaccttaaga

SEQ ID NO: 1905527 - DNA, 17 bp, Homo sapiens
atgtggtccatctctga

SEQ ID NO: 1905528 - DNA, 18 bp, Homo sapiens
atgtggtccatctctgaa

SEQ ID NO: 1905529 - DNA, 19 bp, Homo sapiens
atgtggtccatctctgaaa

SEQ ID NO: 1905530 - DNA, 22 bp, Homo sapiens
atgtggtccatctctgaaaaca

SEQ ID NO: 1905531 - DNA, 21 bp, Homo sapiens
atgtggttaattttgcatatc

SEQ ID NO: 1905532 - DNA, 16 bp, Homo sapiens
atgtgtcctttctgaa

SEQ ID NO: 1905533 - DNA, 23 bp, Homo sapiens
atgtgtctcctgtttcagaccag

SEQ ID NO: 1905534 - DNA, 19 bp, Homo sapiens
atgtgtctgccacattaac

SEQ ID NO: 1905535 - DNA, 14 bp, Homo sapiens
atgtgtgcccagct

SEQ ID NO: 1905536 - DNA, 19 bp, Homo sapiens
atgtgttgcagctgtcacc

SEQ ID NO: 1905537 - DNA, 12 bp, Homo sapiens
atgtgtttagaa

SEQ ID NO: 1905538 - DNA, 17 bp, Homo sapiens
atgtgtttagaattgaa

SEQ ID NO: 1905539 - DNA, 14 bp, Homo sapiens
atgttagttttaga

SEQ ID NO: 1905540 - DNA, 15 bp, Homo sapiens
atgttagttttcctt

SEQ ID NO: 1905541 - DNA, 13 bp, Homo sapiens
atgttccctccgg

SEQ ID NO: 1905542 - DNA, 21 bp, Homo sapiens
atgttgacatcactggcatgg

SEQ ID NO: 1905543 - DNA, 15 bp, Homo sapiens
atgttgtaaaatgaa

SEQ ID NO: 1905544 - DNA, 16 bp, Homo sapiens
atgttgtaaaatgaat

SEQ ID NO: 1905545 - DNA, 18 bp, Homo sapiens
atgttgtaaaatgaattt

SEQ ID NO: 1905546 - DNA, 21 bp, Homo sapiens
atgttttaaacatagaaagtt

SEQ ID NO: 1905547 - DNA, 17 bp, Homo sapiens
atgttttagcacagcgt

SEQ ID NO: 1905548 - DNA, 21 bp, Homo sapiens
atgttttggtctgaaaagctg

SEQ ID NO: 1905549 - DNA, 22 bp, Homo sapiens
atgtttttagttctgactttga

SEQ ID NO: 1905550 - DNA, 14 bp, Homo sapiens
atgtttttgaaggc

SEQ ID NO: 1905551 - DNA, 17 bp, Homo sapiens
attaaaaaatcaaatca

SEQ ID NO: 1905552 - DNA, 15 bp, Homo sapiens
attaaatttttttgt

SEQ ID NO: 1905553 - DNA, 20 bp, Homo sapiens
attaaatttttttgtatgaa

SEQ ID NO: 1905554 - DNA, 21 bp, Homo sapiens
attaaatttttttgtatgaaa

SEQ ID NO: 1905555 - DNA, 12 bp, Homo sapiens
attaatcactgt

SEQ ID NO: 1905556 - DNA, 13 bp, Homo sapiens
attaatcactgtg

SEQ ID NO: 1905557 - DNA, 16 bp, Homo sapiens
attaatcactgtgtat

SEQ ID NO: 1905558 - DNA, 17 bp, Homo sapiens
attaatcactgtgtata

SEQ ID NO: 1905559 - DNA, 18 bp, Homo sapiens
attaatcactgtgtatat

SEQ ID NO: 1905560 - DNA, 19 bp, Homo sapiens
attaatcactgtgtatatt

SEQ ID NO: 1905561 - DNA, 23 bp, Homo sapiens
attaatcactgtgtatatttgat

SEQ ID NO: 1905562 - DNA, 16 bp, Homo sapiens
attaatcataaagaaa

SEQ ID NO: 1905563 - DNA, 16 bp, Homo sapiens
attaattatcgtgtct

SEQ ID NO: 1905564 - DNA, 14 bp, Homo sapiens
attaattgtgtgaa

SEQ ID NO: 1905565 - DNA, 22 bp, Homo sapiens
attacaccacaagtatctaaat

SEQ ID NO: 1905566 - DNA, 17 bp, Homo sapiens
attacgaagttcaagat

SEQ ID NO: 1905567 - DNA, 15 bp, Homo sapiens
attacttgttgccta

SEQ ID NO: 1905568 - DNA, 15 bp, Homo sapiens
attaggaaaagatat

SEQ ID NO: 1905569 - DNA, 17 bp, Homo sapiens
attaggaaaagatattt

SEQ ID NO: 1905570 - DNA, 20 bp, Homo sapiens
attaggaaaagatattttta

SEQ ID NO: 1905571 - DNA, 15 bp, Homo sapiens
attaggccccagcaa

SEQ ID NO: 1905572 - DNA, 13 bp, Homo sapiens
attagtttagaac

SEQ ID NO: 1905573 - DNA, 22 bp, Homo sapiens
attatacagaccgaactgttgt

SEQ ID NO: 1905574 - DNA, 17 bp, Homo sapiens
attatcaatgaaaattt

SEQ ID NO: 1905575 - DNA, 13 bp, Homo sapiens
attgtactttgaa

SEQ ID NO: 1905576 - DNA, 14 bp, Homo sapiens
attgtactttgaaa

SEQ ID NO: 1905577 - DNA, 15 bp, Homo sapiens
attgtactttgaaaa

SEQ ID NO: 1905578 - DNA, 17 bp, Homo sapiens
attgtagaacttgttgc

SEQ ID NO: 1905579 - DNA, 12 bp, Homo sapiens
attgtccttgaa

SEQ ID NO: 1905580 - DNA, 22 bp, Homo sapiens
attgtccttgaagcttgtatct

SEQ ID NO: 1905581 - DNA, 23 bp, Homo sapiens
attgtccttgaagcttgtatctg

SEQ ID NO: 1905582 - DNA, 11 bp, Homo sapiens
attgtgaatgc

SEQ ID NO: 1905583 - DNA, 15 bp, Homo sapiens
attgtggggagagaa

SEQ ID NO: 1905584 - DNA, 15 bp, Homo sapiens
attgttctctaggaa

SEQ ID NO: 1905585 - DNA, 14 bp, Homo sapiens
attgttcttttcaa

SEQ ID NO: 1905586 - DNA, 20 bp, Homo sapiens
atttaaaacattaaaatata

SEQ ID NO: 1905587 - DNA, 18 bp, Homo sapiens
atttaaagaaaaaaatgt

SEQ ID NO: 1905588 - DNA, 19 bp, Homo sapiens
atttaaagaaaaaaatgtc

SEQ ID NO: 1905589 - DNA, 23 bp, Homo sapiens
atttaaagaaatatgtattctgt

SEQ ID NO: 1905590 - DNA, 21 bp, Homo sapiens
atttaaagtgtggaaagcaaa

SEQ ID NO: 1905591 - DNA, 22 bp, Homo sapiens
atttaaccattccataatcatg

SEQ ID NO: 1905592 - DNA, 18 bp, Homo sapiens
atttaacttttaaagaat

SEQ ID NO: 1905593 - DNA, 18 bp, Homo sapiens
atttaagcaataaaactg

SEQ ID NO: 1905594 - DNA, 18 bp, Homo sapiens
atttaatttgaaatatgg

SEQ ID NO: 1905595 - DNA, 15 bp, Homo sapiens
atttacgcctgtaaa

SEQ ID NO: 1905596 - DNA, 16 bp, Homo sapiens
atttacgcctgtaaat

SEQ ID NO: 1905597 - DNA, 16 bp, Homo sapiens
atttagggagtattct

SEQ ID NO: 1905598 - DNA, 24 bp, Homo sapiens
atttagggagtattctaataagct

SEQ ID NO: 1905599 - DNA, 17 bp, Homo sapiens
atttatataactgttgt

SEQ ID NO: 1905600 - DNA, 14 bp, Homo sapiens
atttatatgtatgt

SEQ ID NO: 1905601 - DNA, 15 bp, Homo sapiens
atttatatttattga

SEQ ID NO: 1905602 - DNA, 15 bp, Homo sapiens
atttatccaggaatt

SEQ ID NO: 1905603 - DNA, 19 bp, Homo sapiens
atttatccaggaattgata

SEQ ID NO: 1905604 - DNA, 21 bp, Homo sapiens
atttatccaggaattgatacg

SEQ ID NO: 1905605 - DNA, 22 bp, Homo sapiens
atttatgtaacaaagtttgctg

SEQ ID NO: 1905606 - DNA, 15 bp, Homo sapiens
atttatgttttcaca

SEQ ID NO: 1905607 - DNA, 21 bp, Homo sapiens
atttattaaatttttttgtat

SEQ ID NO: 1905608 - DNA, 13 bp, Homo sapiens
atttattaactta

SEQ ID NO: 1905609 - DNA, 17 bp, Homo sapiens
atttattaacttaataa

SEQ ID NO: 1905610 - DNA, 14 bp, Homo sapiens
atttattgactctt

SEQ ID NO: 1905611 - DNA, 19 bp, Homo sapiens
atttattgactcttgagtt

SEQ ID NO: 1905612 - DNA, 17 bp, Homo sapiens
atttatttactgctagt

SEQ ID NO: 1905613 - DNA, 14 bp, Homo sapiens
atttatttcatcat

SEQ ID NO: 1905614 - DNA, 19 bp, Homo sapiens
atttcatcagaacagctgt

SEQ ID NO: 1905615 - DNA, 17 bp, Homo sapiens
atttccattaaaggtgg

SEQ ID NO: 1905616 - DNA, 18 bp, Homo sapiens
atttcccaacacaaagat

SEQ ID NO: 1905617 - DNA, 15 bp, Homo sapiens
atttccccagggcac

SEQ ID NO: 1905618 - DNA, 16 bp, Homo sapiens
atttgaaagtgccttt

SEQ ID NO: 1905619 - DNA, 17 bp, Homo sapiens
atttgaaagtgcctttg

SEQ ID NO: 1905620 - DNA, 20 bp, Homo sapiens
atttgaataatgtctagatt

SEQ ID NO: 1905621 - DNA, 21 bp, Homo sapiens
atttgaataatgtctagattt

SEQ ID NO: 1905622 - DNA, 12 bp, Homo sapiens
atttgagatttt

SEQ ID NO: 1905623 - DNA, 18 bp, Homo sapiens
atttgatgactgaaaatg

SEQ ID NO: 1905624 - DNA, 14 bp, Homo sapiens
atttgatttattaa

SEQ ID NO: 1905625 - DNA, 17 bp, Homo sapiens
atttgatttattaactt

SEQ ID NO: 1905626 - DNA, 18 bp, Homo sapiens
atttgatttattaactta

SEQ ID NO: 1905627 - DNA, 16 bp, Homo sapiens
atttgatttgtacaga

SEQ ID NO: 1905628 - DNA, 21 bp, Homo sapiens
atttgccatagagtacactgc

SEQ ID NO: 1905629 - DNA, 15 bp, Homo sapiens
atttgctcatatgaa

SEQ ID NO: 1905630 - DNA, 22 bp, Homo sapiens
atttgcttaaatatccatatta

SEQ ID NO: 1905631 - DNA, 22 bp, Homo sapiens
atttggaatgtacatactgaaa

SEQ ID NO: 1905632 - DNA, 16 bp, Homo sapiens
atttggagggcctggg

SEQ ID NO: 1905633 - DNA, 20 bp, Homo sapiens
atttggcttcctctgctgca

SEQ ID NO: 1905634 - DNA, 23 bp, Homo sapiens
atttggggaccacagaggctgtg

SEQ ID NO: 1905635 - DNA, 17 bp, Homo sapiens
aaagtgtggaaagcaaa

SEQ ID NO: 1905636 - DNA, 22 bp, Homo sapiens
aaagtgttcattgcacaatata

SEQ ID NO: 1905637 - DNA, 14 bp, Homo sapiens
aaagtttgtttgct

SEQ ID NO: 1905638 - DNA, 15 bp, Homo sapiens
aaataaaaaaaagaa

SEQ ID NO: 1905639 - DNA, 17 bp, Homo sapiens
aaataaaaaaaagaaaa

SEQ ID NO: 1905640 - DNA, 15 bp, Homo sapiens
aaataaacgagtgaa

SEQ ID NO: 1905641 - DNA, 12 bp, Homo sapiens
aaataagaaaag

SEQ ID NO: 1905642 - DNA, 21 bp, Homo sapiens
aaataattcttttttattaat

SEQ ID NO: 1905643 - DNA, 22 bp, Homo sapiens
aaataattcttttttattaatc

SEQ ID NO: 1905644 - DNA, 14 bp, Homo sapiens
aaataattttgtaa

SEQ ID NO: 1905645 - DNA, 20 bp, Homo sapiens
aaatagtgtggaaattaaga

SEQ ID NO: 1905646 - DNA, 20 bp, Homo sapiens
aaatagtttattttaaaaca

SEQ ID NO: 1905647 - DNA, 22 bp, Homo sapiens
aaatatatttttatatgtggaa

SEQ ID NO: 1905648 - DNA, 12 bp, Homo sapiens
aaatatcaaatt

SEQ ID NO: 1905649 - DNA, 20 bp, Homo sapiens
aaatatcaaattaattgtgt

SEQ ID NO: 1905650 - DNA, 12 bp, Homo sapiens
aaatatgtgtat

SEQ ID NO: 1905651 - DNA, 22 bp, Homo sapiens
aaatatttagatgtaattttgt

SEQ ID NO: 1905652 - DNA, 13 bp, Homo sapiens
aaatcaaagtgct

SEQ ID NO: 1905653 - DNA, 14 bp, Homo sapiens
aaatcaaagtgcta

SEQ ID NO: 1905654 - DNA, 19 bp, Homo sapiens
aaatcatatttggaataaa

SEQ ID NO: 1905655 - DNA, 17 bp, Homo sapiens
aaatcatgaagtgatat

SEQ ID NO: 1905656 - DNA, 13 bp, Homo sapiens
aaatccaggaccc

SEQ ID NO: 1905657 - DNA, 20 bp, Homo sapiens
aaatctaaaaattgaactac

SEQ ID NO: 1905658 - DNA, 15 bp, Homo sapiens
aaatgaaataataaa

SEQ ID NO: 1905659 - DNA, 18 bp, Homo sapiens
aaatgaacacagctcttt

SEQ ID NO: 1905660 - DNA, 16 bp, Homo sapiens
aaatgaagaatttaaa

SEQ ID NO: 1905661 - DNA, 18 bp, Homo sapiens
aaatgaagaatttaaaga

SEQ ID NO: 1905662 - DNA, 14 bp, Homo sapiens
aaatgactttatta

SEQ ID NO: 1905663 - DNA, 21 bp, Homo sapiens
aaatgactttattatttattt

SEQ ID NO: 1905664 - DNA, 12 bp, Homo sapiens
aaatgctgaaca

SEQ ID NO: 1905665 - DNA, 21 bp, Homo sapiens
aaatgggttaatcctgaattc

SEQ ID NO: 1905666 - DNA, 21 bp, Homo sapiens
aaatgtccagtaagatcactg

SEQ ID NO: 1905667 - DNA, 22 bp, Homo sapiens
aaatgtccagtaagatcactgt

SEQ ID NO: 1905668 - DNA, 13 bp, Homo sapiens
aaatgtggatgtg

SEQ ID NO: 1905669 - DNA, 12 bp, Homo sapiens
aaattaaggtgt

SEQ ID NO: 1905670 - DNA, 19 bp, Homo sapiens
aaattaaggtgtttgaaaa

SEQ ID NO: 1905671 - DNA, 21 bp, Homo sapiens
aaattaaggtgtttgaaaata

SEQ ID NO: 1905672 - DNA, 13 bp, Homo sapiens
aaattaattgtgt

SEQ ID NO: 1905673 - DNA, 15 bp, Homo sapiens
aaattaattgtgtga

SEQ ID NO: 1905674 - DNA, 16 bp, Homo sapiens
aaattaattgtgtgaa

SEQ ID NO: 1905675 - DNA, 15 bp, Homo sapiens
aaattagttcccatt

SEQ ID NO: 1905676 - DNA, 20 bp, Homo sapiens
aaattatacaatgatatcca

SEQ ID NO: 1905677 - DNA, 14 bp, Homo sapiens
aaattatggtaaaa

SEQ ID NO: 1905678 - DNA, 12 bp, Homo sapiens
aaattcagattg

SEQ ID NO: 1905679 - DNA, 13 bp, Homo sapiens
aaattccagaatg

SEQ ID NO: 1905680 - DNA, 12 bp, Homo sapiens
aaattctgattt

SEQ ID NO: 1905681 - DNA, 20 bp, Homo sapiens
aaattctgggttcatttgtg

SEQ ID NO: 1905682 - DNA, 21 bp, Homo sapiens
aaattgtccttgaagcttgta

SEQ ID NO: 1905683 - DNA, 23 bp, Homo sapiens
aaattgtccttgaagcttgtatc

SEQ ID NO: 1905684 - DNA, 19 bp, Homo sapiens
aaattgttactccatatat

SEQ ID NO: 1905685 - DNA, 16 bp, Homo sapiens
aaatttaacttttaaa

SEQ ID NO: 1905686 - DNA, 20 bp, Homo sapiens
aaatttcacttgaaattaaa

SEQ ID NO: 1905687 - DNA, 17 bp, Homo sapiens
aaatttgcccctggcaa

SEQ ID NO: 1905688 - DNA, 13 bp, Homo sapiens
aaattttgaaaag

SEQ ID NO: 1905689 - DNA, 18 bp, Homo sapiens
aaatttttttgatgtgct

SEQ ID NO: 1905690 - DNA, 20 bp, Homo sapiens
aaatttttttgtatgaaaac

SEQ ID NO: 1905691 - DNA, 18 bp, Homo sapiens
aacaactgaaatgtggat

SEQ ID NO: 1905692 - DNA, 22 bp, Homo sapiens
aacaacttatgactaaaaatat

SEQ ID NO: 1905693 - DNA, 22 bp, Homo sapiens
aacaagagactgcttgacaaag

SEQ ID NO: 1905694 - DNA, 21 bp, Homo sapiens
aacaagttgagctatgactta

SEQ ID NO: 1905695 - DNA, 15 bp, Homo sapiens
aacaataaagcaata

SEQ ID NO: 1905696 - DNA, 23 bp, Homo sapiens
aacaataggatgggcttctgtgc

SEQ ID NO: 1905697 - DNA, 21 bp, Homo sapiens
aacaatgtgtctatttctgaa

SEQ ID NO: 1905698 - DNA, 17 bp, Homo sapiens
aacacgtcattgtgtaa

SEQ ID NO: 1905699 - DNA, 19 bp, Homo sapiens
aacacgtcattgtgtaagg

SEQ ID NO: 1905700 - DNA, 21 bp, Homo sapiens
aacactcattcttttttctat

SEQ ID NO: 1905701 - DNA, 14 bp, Homo sapiens
aacagattctttta

SEQ ID NO: 1905702 - DNA, 16 bp, Homo sapiens
aacagctatgagagga

SEQ ID NO: 1905703 - DNA, 22 bp, Homo sapiens
aacagcttcatgttcccaaaat

SEQ ID NO: 1905704 - DNA, 16 bp, Homo sapiens
aacaggccctcctccc

SEQ ID NO: 1905705 - DNA, 23 bp, Homo sapiens
aacagggtctctagtgctgtgaa

SEQ ID NO: 1905706 - DNA, 21 bp, Homo sapiens
aacagtaccctggttgtgtgt

SEQ ID NO: 1905707 - DNA, 14 bp, Homo sapiens
aacatacaaatgca

SEQ ID NO: 1905708 - DNA, 15 bp, Homo sapiens
aacatacaaatgcat

SEQ ID NO: 1905709 - DNA, 22 bp, Homo sapiens
aacatacaaatgcatctttgat

SEQ ID NO: 1905710 - DNA, 12 bp, Homo sapiens
aacatgcctcct

SEQ ID NO: 1905711 - DNA, 13 bp, Homo sapiens
aacatgcctcctc

SEQ ID NO: 1905712 - DNA, 15 bp, Homo sapiens
aacatgcctcctcct

SEQ ID NO: 1905713 - DNA, 21 bp, Homo sapiens
aacatgcctcctcctgccctc

SEQ ID NO: 1905714 - DNA, 13 bp, Homo sapiens
aacattaaaatat

SEQ ID NO: 1905715 - DNA, 13 bp, Homo sapiens
aaccacgaatgag

SEQ ID NO: 1905716 - DNA, 17 bp, Homo sapiens
aaccactgaatctggac

SEQ ID NO: 1905717 - DNA, 21 bp, Homo sapiens
aaccaggctttctagaaagaa

SEQ ID NO: 1905718 - DNA, 18 bp, Homo sapiens
aaccataaaatgtccagt

SEQ ID NO: 1905719 - DNA, 17 bp, Homo sapiens
aacccaaaggacccaag

SEQ ID NO: 1905720 - DNA, 15 bp, Homo sapiens
aacccaccctttcta

SEQ ID NO: 1905721 - DNA, 16 bp, Homo sapiens
aacccctcgcccagtc

SEQ ID NO: 1905722 - DNA, 21 bp, Homo sapiens
aacctgaaagttccttctgta

SEQ ID NO: 1905723 - DNA, 17 bp, Homo sapiens
aacgatcacaaatgact

SEQ ID NO: 1905724 - DNA, 17 bp, Homo sapiens
aacgcccacttccctgg

SEQ ID NO: 1905725 - DNA, 16 bp, Homo sapiens
aacgtaatcaaatatg

SEQ ID NO: 1905726 - DNA, 20 bp, Homo sapiens
aacgtggagaatcacaggct

SEQ ID NO: 1905727 - DNA, 20 bp, Homo sapiens
aacgttttctactttgaaat

SEQ ID NO: 1905728 - DNA, 17 bp, Homo sapiens
aactaaaataattttgt

SEQ ID NO: 1905729 - DNA, 20 bp, Homo sapiens
aactactacctgtaatgaca

SEQ ID NO: 1905730 - DNA, 20 bp, Homo sapiens
aactagattacattcagttg

SEQ ID NO: 1905731 - DNA, 14 bp, Homo sapiens
aactctatttagat

SEQ ID NO: 1905732 - DNA, 22 bp, Homo sapiens
aactctgttacactttttggaa

SEQ ID NO: 1905733 - DNA, 23 bp, Homo sapiens
aactctgttacactttttggaag

SEQ ID NO: 1905734 - DNA, 16 bp, Homo sapiens
aactcttctcattact

SEQ ID NO: 1905735 - DNA, 14 bp, Homo sapiens
aactgaaatgtgga

SEQ ID NO: 1905736 - DNA, 19 bp, Homo sapiens
aactgccagttttgtttcc

SEQ ID NO: 1905737 - DNA, 17 bp, Homo sapiens
aactgctgctgacccct

SEQ ID NO: 1905738 - DNA, 18 bp, Homo sapiens
aactgctgctgacccctg

SEQ ID NO: 1905739 - DNA, 18 bp, Homo sapiens
aactgcttcctataattt

SEQ ID NO: 1905740 - DNA, 23 bp, Homo sapiens
aactgcttcctataattttgata

SEQ ID NO: 1905741 - DNA, 15 bp, Homo sapiens
aactgtcgtgtcata

SEQ ID NO: 1905742 - DNA, 13 bp, Homo sapiens
aactgttgtataa

SEQ ID NO: 1905743 - DNA, 15 bp, Homo sapiens
aactgttgtataaat

SEQ ID NO: 1905744 - DNA, 13 bp, Homo sapiens
aactgttgttgat

SEQ ID NO: 1905745 - DNA, 18 bp, Homo sapiens
aactgttgttgataagga

SEQ ID NO: 1905746 - DNA, 15 bp, Homo sapiens
aacttaataatcaag

SEQ ID NO: 1905747 - DNA, 17 bp, Homo sapiens
aacttaataatcaagag

SEQ ID NO: 1905748 - DNA, 20 bp, Homo sapiens
aacttaataatcaagagcct

SEQ ID NO: 1905749 - DNA, 23 bp, Homo sapiens
aacttacaaagggtctatcttgt

SEQ ID NO: 1905750 - DNA, 21 bp, Homo sapiens
aacttatattgtaagaaatac

SEQ ID NO: 1905751 - DNA, 22 bp, Homo sapiens
aacttatgaagtaaagtttctg

SEQ ID NO: 1905752 - DNA, 15 bp, Homo sapiens
aacttcagacacaaa

SEQ ID NO: 1905753 - DNA, 22 bp, Homo sapiens
aacttggatcagatagcaggag

SEQ ID NO: 1905754 - DNA, 16 bp, Homo sapiens
aacttgttgctgattt

SEQ ID NO: 1905755 - DNA, 21 bp, Homo sapiens
aactttgtagacattttgaaa

SEQ ID NO: 1905756 - DNA, 20 bp, Homo sapiens
aagaaaaaaaaaaagaaaga

SEQ ID NO: 1905757 - DNA, 16 bp, Homo sapiens
aagaaaaaaaaaatat

SEQ ID NO: 1905758 - DNA, 14 bp, Homo sapiens
aagaaaaaaaaaga

SEQ ID NO: 1905759 - DNA, 15 bp, Homo sapiens
aagaaaaaaaaagaa

SEQ ID NO: 1905760 - DNA, 18 bp, Homo sapiens
aagaaaaaaaaagaaaaa

SEQ ID NO: 1905761 - DNA, 13 bp, Homo sapiens
aagaaaaaaatgt

SEQ ID NO: 1905762 - DNA, 11 bp, Homo sapiens
aagaaaaaagt

SEQ ID NO: 1905763 - DNA, 17 bp, Homo sapiens
aagaaactatacatcat

SEQ ID NO: 1905764 - DNA, 17 bp, Homo sapiens
aagaaagaggaaaagaa

SEQ ID NO: 1905765 - DNA, 16 bp, Homo sapiens
aagaaagcatagacat

SEQ ID NO: 1905766 - DNA, 13 bp, Homo sapiens
aagaaatactgta

SEQ ID NO: 1905767 - DNA, 22 bp, Homo sapiens
actctctctcttttccctcctt

SEQ ID NO: 1905768 - DNA, 13 bp, Homo sapiens
actctctgacaaa

SEQ ID NO: 1905769 - DNA, 13 bp, Homo sapiens
actctcttccttt

SEQ ID NO: 1905770 - DNA, 14 bp, Homo sapiens
actctcttcctttc

SEQ ID NO: 1905771 - DNA, 18 bp, Homo sapiens
actctgaccacttaaaaa

SEQ ID NO: 1905772 - DNA, 17 bp, Homo sapiens
actctgccagggtgggg

SEQ ID NO: 1905773 - DNA, 15 bp, Homo sapiens
actctgtctggccag

SEQ ID NO: 1905774 - DNA, 16 bp, Homo sapiens
actcttgagttgtttt

SEQ ID NO: 1905775 - DNA, 22 bp, Homo sapiens
actcttgagttgtttttgtata

SEQ ID NO: 1905776 - DNA, 14 bp, Homo sapiens
actgaaagaaaaag

SEQ ID NO: 1905777 - DNA, 13 bp, Homo sapiens
actgaattcaaat

SEQ ID NO: 1905778 - DNA, 19 bp, Homo sapiens
actgaatttttatgtgtga

SEQ ID NO: 1905779 - DNA, 12 bp, Homo sapiens
actgactctgga

SEQ ID NO: 1905780 - DNA, 21 bp, Homo sapiens
actgactctggaaaaggcata

SEQ ID NO: 1905781 - DNA, 12 bp, Homo sapiens
actgactgaggc

SEQ ID NO: 1905782 - DNA, 15 bp, Homo sapiens
actgagcatcacaat

SEQ ID NO: 1905783 - DNA, 21 bp, Homo sapiens
actgagcatcacaataaagag

SEQ ID NO: 1905784 - DNA, 18 bp, Homo sapiens
actgaggcagtttgagga

SEQ ID NO: 1905785 - DNA, 15 bp, Homo sapiens
actgataaagaaaga

SEQ ID NO: 1905786 - DNA, 18 bp, Homo sapiens
actgcagactataaaatc

SEQ ID NO: 1905787 - DNA, 13 bp, Homo sapiens
actgcagtcactg

SEQ ID NO: 1905788 - DNA, 16 bp, Homo sapiens
actgcattcttctgat

SEQ ID NO: 1905789 - DNA, 16 bp, Homo sapiens
actgcatttagggagt

SEQ ID NO: 1905790 - DNA, 15 bp, Homo sapiens
actgccacaaggaag

SEQ ID NO: 1905791 - DNA, 13 bp, Homo sapiens
actgccacctccc

SEQ ID NO: 1905792 - DNA, 23 bp, Homo sapiens
actgccacctccccttgccagct

SEQ ID NO: 1905793 - DNA, 14 bp, Homo sapiens
actgcctgccttaa

SEQ ID NO: 1905794 - DNA, 20 bp, Homo sapiens
actgcctttgtttagaagag

SEQ ID NO: 1905795 - DNA, 19 bp, Homo sapiens
actgctattttcctgttct

SEQ ID NO: 1905796 - DNA, 15 bp, Homo sapiens
actgctcctgagccc

SEQ ID NO: 1905797 - DNA, 18 bp, Homo sapiens
actgctcctgagccccca

SEQ ID NO: 1905798 - DNA, 13 bp, Homo sapiens
actgctctcacct

SEQ ID NO: 1905799 - DNA, 16 bp, Homo sapiens
actgctgctgacccct

SEQ ID NO: 1905800 - DNA, 21 bp, Homo sapiens
actgctgctgacccctgtgtg

SEQ ID NO: 1905801 - DNA, 15 bp, Homo sapiens
actgcttataaacat

SEQ ID NO: 1905802 - DNA, 22 bp, Homo sapiens
actgcttataaacatttaaaga

SEQ ID NO: 1905803 - DNA, 17 bp, Homo sapiens
actgcttcctataattt

SEQ ID NO: 1905804 - DNA, 17 bp, Homo sapiens
actgctttctttcgttt

SEQ ID NO: 1905805 - DNA, 17 bp, Homo sapiens
actggaataagccttcg

SEQ ID NO: 1905806 - DNA, 21 bp, Homo sapiens
actggcaatggtagtttctgt

SEQ ID NO: 1905807 - DNA, 23 bp, Homo sapiens
actggcaatggtagtttctgtgg

SEQ ID NO: 1905808 - DNA, 19 bp, Homo sapiens
actgggatggaatggcagc

SEQ ID NO: 1905809 - DNA, 22 bp, Homo sapiens
actgggcccgagggtggtttac

SEQ ID NO: 1905810 - DNA, 23 bp, Homo sapiens
actgggggacactgtggcagcag

SEQ ID NO: 1905811 - DNA, 13 bp, Homo sapiens
actggtccatctg

SEQ ID NO: 1905812 - DNA, 20 bp, Homo sapiens
actggtctacactggttgcc

SEQ ID NO: 1905813 - DNA, 21 bp, Homo sapiens
actgtacatgggactatgctt

SEQ ID NO: 1905814 - DNA, 23 bp, Homo sapiens
actgtattgggaagttactgtta

SEQ ID NO: 1905815 - DNA, 14 bp, Homo sapiens
actgtcatgatacg

SEQ ID NO: 1905816 - DNA, 19 bp, Homo sapiens
actgtccgctgtctccctc

SEQ ID NO: 1905817 - DNA, 17 bp, Homo sapiens
actgtctcggcagaggt

SEQ ID NO: 1905818 - DNA, 16 bp, Homo sapiens
actgtgaaagttggaa

SEQ ID NO: 1905819 - DNA, 15 bp, Homo sapiens
actgtggagactgct

SEQ ID NO: 1905820 - DNA, 13 bp, Homo sapiens
actgtggcagcag

SEQ ID NO: 1905821 - DNA, 17 bp, Homo sapiens
actgtggcagcaggagg

SEQ ID NO: 1905822 - DNA, 13 bp, Homo sapiens
actgtgtatattt

SEQ ID NO: 1905823 - DNA, 16 bp, Homo sapiens
actgtgtatatttgat

SEQ ID NO: 1905824 - DNA, 22 bp, Homo sapiens
actgtgtgtgtcctacacaatg

SEQ ID NO: 1905825 - DNA, 14 bp, Homo sapiens
actgttacttgata

SEQ ID NO: 1905826 - DNA, 17 bp, Homo sapiens
actgttatgtgagaaca

SEQ ID NO: 1905827 - DNA, 14 bp, Homo sapiens
actgttcagtattg

SEQ ID NO: 1905828 - DNA, 15 bp, Homo sapiens
actgttccccttggt

SEQ ID NO: 1905829 - DNA, 19 bp, Homo sapiens
actgttgtataaatttatt

SEQ ID NO: 1905830 - DNA, 19 bp, Homo sapiens
acttaaatgaacacagctc

SEQ ID NO: 1905831 - DNA, 20 bp, Homo sapiens
acttaacatagccaaaatgt

SEQ ID NO: 1905832 - DNA, 23 bp, Homo sapiens
acttaataatcaagagccttaaa

SEQ ID NO: 1905833 - DNA, 16 bp, Homo sapiens
acttaatatgttttat

SEQ ID NO: 1905834 - DNA, 23 bp, Homo sapiens
acttacaaagggtctatcttgta

SEQ ID NO: 1905835 - DNA, 18 bp, Homo sapiens
acttagaatccctgtgtt

SEQ ID NO: 1905836 - DNA, 18 bp, Homo sapiens
acttatattgtaagaaat

SEQ ID NO: 1905837 - DNA, 19 bp, Homo sapiens
acttatattgtaagaaata

SEQ ID NO: 1905838 - DNA, 21 bp, Homo sapiens
acttatgaagtaaagtttctg

SEQ ID NO: 1905839 - DNA, 21 bp, Homo sapiens
acttatgactaaaaatatcac

SEQ ID NO: 1905840 - DNA, 11 bp, Homo sapiens
acttcagccac

SEQ ID NO: 1905841 - DNA, 22 bp, Homo sapiens
acttcagccaccctttctggca

SEQ ID NO: 1905842 - DNA, 23 bp, Homo sapiens
acttcagccaccctttctggcac

SEQ ID NO: 1905843 - DNA, 15 bp, Homo sapiens
acttcagttatcttg

SEQ ID NO: 1905844 - DNA, 23 bp, Homo sapiens
acttccctgggttagactgccag

SEQ ID NO: 1905845 - DNA, 17 bp, Homo sapiens
acttgaaaagagacagg

SEQ ID NO: 1905846 - DNA, 21 bp, Homo sapiens
acttgaaaagagacaggcagg

SEQ ID NO: 1905847 - DNA, 22 bp, Homo sapiens
acttgaaaagagacaggcaggt

SEQ ID NO: 1905848 - DNA, 19 bp, Homo sapiens
acttgaaccataaaatgtc

SEQ ID NO: 1905849 - DNA, 17 bp, Homo sapiens
acttgatttgagatttt

SEQ ID NO: 1905850 - DNA, 15 bp, Homo sapiens
acttgctttgagttg

SEQ ID NO: 1905851 - DNA, 23 bp, Homo sapiens
acttgctttggtcacttttagat

SEQ ID NO: 1905852 - DNA, 13 bp, Homo sapiens
acttggaaattgt

SEQ ID NO: 1905853 - DNA, 16 bp, Homo sapiens
acttgggggctcagca

SEQ ID NO: 1905854 - DNA, 23 bp, Homo sapiens
acttggtctgggtttggcaggca

SEQ ID NO: 1905855 - DNA, 12 bp, Homo sapiens
acttgtagattt

SEQ ID NO: 1905856 - DNA, 13 bp, Homo sapiens
acttgtagatttg

SEQ ID NO: 1905857 - DNA, 18 bp, Homo sapiens
acttgtatattctatttt

SEQ ID NO: 1905858 - DNA, 20 bp, Homo sapiens
acttgtatattctattttac

SEQ ID NO: 1905859 - DNA, 15 bp, Homo sapiens
acttgttgcctataa

SEQ ID NO: 1905860 - DNA, 16 bp, Homo sapiens
acttgttgctgatttt

SEQ ID NO: 1905861 - DNA, 20 bp, Homo sapiens
acttgttgctgattttgacc

SEQ ID NO: 1905862 - DNA, 17 bp, Homo sapiens
actttagtgctacagaa

SEQ ID NO: 1905863 - DNA, 13 bp, Homo sapiens
actttattgcatc

SEQ ID NO: 1905864 - DNA, 20 bp, Homo sapiens
actttctgaaaatttatata

SEQ ID NO: 1905865 - DNA, 14 bp, Homo sapiens
actttgaatttata

SEQ ID NO: 1905866 - DNA, 15 bp, Homo sapiens
actttgaatttatat

SEQ ID NO: 1905867 - DNA, 20 bp, Homo sapiens
actttgaatttatataaagt

SEQ ID NO: 1905868 - DNA, 21 bp, Homo sapiens
actttgacagcgcacagctgc

SEQ ID NO: 1905869 - DNA, 12 bp, Homo sapiens
actttgatgtca

SEQ ID NO: 1905870 - DNA, 22 bp, Homo sapiens
actttgcagcacagctgagagg

SEQ ID NO: 1905871 - DNA, 16 bp, Homo sapiens
actttgtaaattctga

SEQ ID NO: 1905872 - DNA, 21 bp, Homo sapiens
actttgtaaattctgatttct

SEQ ID NO: 1905873 - DNA, 18 bp, Homo sapiens
actttgtatagttatgta

SEQ ID NO: 1905874 - DNA, 23 bp, Homo sapiens
actttgtatagttatgtaaataa

SEQ ID NO: 1905875 - DNA, 15 bp, Homo sapiens
agaaaaaaaaagaaa

SEQ ID NO: 1905876 - DNA, 17 bp, Homo sapiens
agaaaaaaaaagaaaaa

SEQ ID NO: 1905877 - DNA, 16 bp, Homo sapiens
agaaaaaaagaaatta

SEQ ID NO: 1905878 - DNA, 19 bp, Homo sapiens
agaaaaaaatgtcaaaagt

SEQ ID NO: 1905879 - DNA, 17 bp, Homo sapiens
agaaaaaagagaaaaga

SEQ ID NO: 1905880 - DNA, 18 bp, Homo sapiens
agaaaaaagagaaaagaa

SEQ ID NO: 1905881 - DNA, 12 bp, Homo sapiens
agaaaaaagttg

SEQ ID NO: 1905882 - DNA, 15 bp, Homo sapiens
agaaaaaatattgta

SEQ ID NO: 1905883 - DNA, 10 bp, Homo sapiens
agaaaagaaa

SEQ ID NO: 1905884 - DNA, 11 bp, Homo sapiens
agaaaagaaaa

SEQ ID NO: 1905885 - DNA, 13 bp, Homo sapiens
agaaaagaaaaaa

SEQ ID NO: 1905886 - DNA, 18 bp, Homo sapiens
agaaaagaaaaaaaaaga

SEQ ID NO: 1905887 - DNA, 23 bp, Homo sapiens
agaaaaggaaataggttttaggt

SEQ ID NO: 1905888 - DNA, 22 bp, Homo sapiens
agaaaataaaaaaaagaaaaaa

SEQ ID NO: 1905889 - DNA, 16 bp, Homo sapiens
agaaaggacctgcaaa

SEQ ID NO: 1905890 - DNA, 22 bp, Homo sapiens
agaaatacacagggaggggatg

SEQ ID NO: 1905891 - DNA, 12 bp, Homo sapiens
agaaattaactt

SEQ ID NO: 1905892 - DNA, 15 bp, Homo sapiens
agaaattgtccttga

SEQ ID NO: 1905893 - DNA, 18 bp, Homo sapiens
agaaatttgcccctggca

SEQ ID NO: 1905894 - DNA, 19 bp, Homo sapiens
agaaatttgcccctggcaa

SEQ ID NO: 1905895 - DNA, 15 bp, Homo sapiens
agaacagctgttgac

SEQ ID NO: 1905896 - DNA, 17 bp, Homo sapiens
agaacaggtttttttgt

SEQ ID NO: 1905897 - DNA, 14 bp, Homo sapiens
agaacagtaaacat

SEQ ID NO: 1905898 - DNA, 17 bp, Homo sapiens
agaacattaggccccag

SEQ ID NO: 1905899 - DNA, 13 bp, Homo sapiens
aggtacacatatt

SEQ ID NO: 1905900 - DNA, 23 bp, Homo sapiens
aggtactttcatattttaaacag

SEQ ID NO: 1905901 - DNA, 15 bp, Homo sapiens
aggtagagtctgagg

SEQ ID NO: 1905902 - DNA, 19 bp, Homo sapiens
aggtagttcaagaaatgaa

SEQ ID NO: 1905903 - DNA, 14 bp, Homo sapiens
aggtatttttctat

SEQ ID NO: 1905904 - DNA, 14 bp, Homo sapiens
aggtcccagggccc

SEQ ID NO: 1905905 - DNA, 16 bp, Homo sapiens
aggtcccagttgctgt

SEQ ID NO: 1905906 - DNA, 13 bp, Homo sapiens
aggtctgagttgt

SEQ ID NO: 1905907 - DNA, 20 bp, Homo sapiens
aggtctgagttgttacccca

SEQ ID NO: 1905908 - DNA, 21 bp, Homo sapiens
aggtctttttacattgtgaat

SEQ ID NO: 1905909 - DNA, 22 bp, Homo sapiens
aggtgatctgctgcagagcagt

SEQ ID NO: 1905910 - DNA, 15 bp, Homo sapiens
aggtgcccgccacca

SEQ ID NO: 1905911 - DNA, 17 bp, Homo sapiens
aggtggcaggtgagcaa

SEQ ID NO: 1905912 - DNA, 14 bp, Homo sapiens
aggtggtctggtgc

SEQ ID NO: 1905913 - DNA, 21 bp, Homo sapiens
aggtgtcatggatagattttc

SEQ ID NO: 1905914 - DNA, 14 bp, Homo sapiens
aggtgtgcctggca

SEQ ID NO: 1905915 - DNA, 19 bp, Homo sapiens
aggtgtgcctggcagccat

SEQ ID NO: 1905916 - DNA, 13 bp, Homo sapiens
aggtgtttgaaaa

SEQ ID NO: 1905917 - DNA, 18 bp, Homo sapiens
aggttttttttgtacgca

SEQ ID NO: 1905918 - DNA, 21 bp, Homo sapiens
agtaagatcactgtttagatt

SEQ ID NO: 1905919 - DNA, 21 bp, Homo sapiens
agtaagctggtttacagatgt

SEQ ID NO: 1905920 - DNA, 17 bp, Homo sapiens
agtaagtgcttgtttta

SEQ ID NO: 1905921 - DNA, 20 bp, Homo sapiens
agtaataaaacatgagctta

SEQ ID NO: 1905922 - DNA, 15 bp, Homo sapiens
agtaatatttattaa

SEQ ID NO: 1905923 - DNA, 12 bp, Homo sapiens
agtaccctggtt

SEQ ID NO: 1905924 - DNA, 14 bp, Homo sapiens
agtaccttctgcca

SEQ ID NO: 1905925 - DNA, 13 bp, Homo sapiens
agtactgtgaatc

SEQ ID NO: 1905926 - DNA, 17 bp, Homo sapiens
agtactgtgaatccagt

SEQ ID NO: 1905927 - DNA, 18 bp, Homo sapiens
agtagaactttgtatagt

SEQ ID NO: 1905928 - DNA, 21 bp, Homo sapiens
agtagaactttgtatagttat

SEQ ID NO: 1905929 - DNA, 14 bp, Homo sapiens
agtagcacaggctg

SEQ ID NO: 1905930 - DNA, 22 bp, Homo sapiens
agtagctcgtcctcactggtct

SEQ ID NO: 1905931 - DNA, 19 bp, Homo sapiens
agtaggggaagaataattt

SEQ ID NO: 1905932 - DNA, 17 bp, Homo sapiens
agtagttctgtatttga

SEQ ID NO: 1905933 - DNA, 13 bp, Homo sapiens
agtataaaaacaa

SEQ ID NO: 1905934 - DNA, 14 bp, Homo sapiens
agtataacatgtcg

SEQ ID NO: 1905935 - DNA, 22 bp, Homo sapiens
agtatagtttaaaaatctgcca

SEQ ID NO: 1905936 - DNA, 22 bp, Homo sapiens
agtatattcctctgctgaacaa

SEQ ID NO: 1905937 - DNA, 14 bp, Homo sapiens
agtatctaaatttg

SEQ ID NO: 1905938 - DNA, 14 bp, Homo sapiens
agtatgttttactt

SEQ ID NO: 1905939 - DNA, 11 bp, Homo sapiens
agtattgtaca

SEQ ID NO: 1905940 - DNA, 17 bp, Homo sapiens
agtcacccctgcctaaa

SEQ ID NO: 1905941 - DNA, 23 bp, Homo sapiens
agtcactctaggactctgcactg

SEQ ID NO: 1905942 - DNA, 18 bp, Homo sapiens
agtcatttcaaaatatgt

SEQ ID NO: 1905943 - DNA, 14 bp, Homo sapiens
agtcatttctgatt

SEQ ID NO: 1905944 - DNA, 15 bp, Homo sapiens
agtcatttctgattt

SEQ ID NO: 1905945 - DNA, 15 bp, Homo sapiens
agtcatttgtgaatt

SEQ ID NO: 1905946 - DNA, 19 bp, Homo sapiens
agtcccagcagccagccaa

SEQ ID NO: 1905947 - DNA, 16 bp, Homo sapiens
agtccctgtaattgtt

SEQ ID NO: 1905948 - DNA, 18 bp, Homo sapiens
agtcgtcagcctccctga

SEQ ID NO: 1905949 - DNA, 21 bp, Homo sapiens
agtctcaccatttccccaggg

SEQ ID NO: 1905950 - DNA, 22 bp, Homo sapiens
agtctcaccatttccccagggc

SEQ ID NO: 1905951 - DNA, 23 bp, Homo sapiens
agtctcaccatttccccagggca

SEQ ID NO: 1905952 - DNA, 23 bp, Homo sapiens
agtctctctctctccatccctct

SEQ ID NO: 1905953 - DNA, 14 bp, Homo sapiens
agtctgcatatatt

SEQ ID NO: 1905954 - DNA, 19 bp, Homo sapiens
agtctttctcactgccttt

SEQ ID NO: 1905955 - DNA, 21 bp, Homo sapiens
agtgaaaatttttttgatgtg

SEQ ID NO: 1905956 - DNA, 15 bp, Homo sapiens
agtgaaactcccacc

SEQ ID NO: 1905957 - DNA, 20 bp, Homo sapiens
agtgaagtaaaagttaagat

SEQ ID NO: 1905958 - DNA, 15 bp, Homo sapiens
agtgagctcctgcct

SEQ ID NO: 1905959 - DNA, 17 bp, Homo sapiens
agtgaggaaatcaaagt

SEQ ID NO: 1905960 - DNA, 17 bp, Homo sapiens
agtgaggaatggcagtg

SEQ ID NO: 1905961 - DNA, 20 bp, Homo sapiens
agtgagtgaaactcccaccc

SEQ ID NO: 1905962 - DNA, 20 bp, Homo sapiens
agtgatgtatgttatttgat

SEQ ID NO: 1905963 - DNA, 20 bp, Homo sapiens
agtgatgtttgccatttgct

SEQ ID NO: 1905964 - DNA, 22 bp, Homo sapiens
agtgatgtttgccatttgctgg

SEQ ID NO: 1905965 - DNA, 22 bp, Homo sapiens
agtgcaaacagaagtgcatcct

SEQ ID NO: 1905966 - DNA, 18 bp, Homo sapiens
agtgcaatgccccctccc

SEQ ID NO: 1905967 - DNA, 12 bp, Homo sapiens
agtgcagaactg

SEQ ID NO: 1905968 - DNA, 13 bp, Homo sapiens
agtgcatcctgat

SEQ ID NO: 1905969 - DNA, 16 bp, Homo sapiens
agtgcatgggtcaggg

SEQ ID NO: 1905970 - DNA, 18 bp, Homo sapiens
agtgcatgggtcagggtg

SEQ ID NO: 1905971 - DNA, 12 bp, Homo sapiens
agtgctgtgaaa

SEQ ID NO: 1905972 - DNA, 13 bp, Homo sapiens
agtgctgtgaaaa

SEQ ID NO: 1905973 - DNA, 16 bp, Homo sapiens
agtgctgtgaaaaaaa

SEQ ID NO: 1905974 - DNA, 23 bp, Homo sapiens
agtggactctctgacaaagtggg

SEQ ID NO: 1905975 - DNA, 14 bp, Homo sapiens
agtggattcctccc

SEQ ID NO: 1905976 - DNA, 12 bp, Homo sapiens
agtggcagggca

SEQ ID NO: 1905977 - DNA, 16 bp, Homo sapiens
agtggcagggcacagg

SEQ ID NO: 1905978 - DNA, 20 bp, Homo sapiens
agtggcagggcacagggcct

SEQ ID NO: 1905979 - DNA, 15 bp, Homo sapiens
agtggcatctggggc

SEQ ID NO: 1905980 - DNA, 13 bp, Homo sapiens
agtggccccacct

SEQ ID NO: 1905981 - DNA, 16 bp, Homo sapiens
agtggccccacctggc

SEQ ID NO: 1905982 - DNA, 18 bp, Homo sapiens
agtggccccacctggccc

SEQ ID NO: 1905983 - DNA, 18 bp, Homo sapiens
agtggcgaaatccctgct

SEQ ID NO: 1905984 - DNA, 23 bp, Homo sapiens
agtggcgaaatccctgctcactg

SEQ ID NO: 1905985 - DNA, 17 bp, Homo sapiens
agtggggggaacgccca

SEQ ID NO: 1905986 - DNA, 18 bp, Homo sapiens
agtggggggaacgcccac

SEQ ID NO: 1905987 - DNA, 19 bp, Homo sapiens
agtggggggaacgcccact

SEQ ID NO: 1905988 - DNA, 20 bp, Homo sapiens
agtgtagattccatttactg

SEQ ID NO: 1905989 - DNA, 16 bp, Homo sapiens
agtgtgaccagttttg

SEQ ID NO: 1905990 - DNA, 17 bp, Homo sapiens
agtgtgcagtatctgtg

SEQ ID NO: 1905991 - DNA, 12 bp, Homo sapiens
agtgtgttttca

SEQ ID NO: 1905992 - DNA, 15 bp, Homo sapiens
agtgtgttttcataa

SEQ ID NO: 1905993 - DNA, 18 bp, Homo sapiens
agtgtgttttcataacaa

SEQ ID NO: 1905994 - DNA, 15 bp, Homo sapiens
agtgttaagataatt

SEQ ID NO: 1905995 - DNA, 15 bp, Homo sapiens
agtgttatatgaaca

SEQ ID NO: 1905996 - DNA, 20 bp, Homo sapiens
agtgttatatgaacatacaa

SEQ ID NO: 1905997 - DNA, 15 bp, Homo sapiens
agttaccagtgcctt

SEQ ID NO: 1905998 - DNA, 19 bp, Homo sapiens
agttaccttaggcccctga

SEQ ID NO: 1905999 - DNA, 15 bp, Homo sapiens
agttagttccactga

SEQ ID NO: 1906000 - DNA, 17 bp, Homo sapiens
agttagttccactgaga

SEQ ID NO: 1906001 - DNA, 13 bp, Homo sapiens
agttatgtaaata

SEQ ID NO: 1906002 - DNA, 16 bp, Homo sapiens
agttcccattctttca

SEQ ID NO: 1906003 - DNA, 23 bp, Homo sapiens
agttcccctggaagcagtgccca

SEQ ID NO: 1906004 - DNA, 14 bp, Homo sapiens
agttccttctgtag

SEQ ID NO: 1906005 - DNA, 14 bp, Homo sapiens
agttctaccggctt

SEQ ID NO: 1906006 - DNA, 19 bp, Homo sapiens
agttctgactttgaattta

SEQ ID NO: 1906007 - DNA, 16 bp, Homo sapiens
agttctgtatttgaaa

SEQ ID NO: 1906008 - DNA, 20 bp, Homo sapiens
agttctgtatttgaaagtgc

SEQ ID NO: 1906009 - DNA, 15 bp, Homo sapiens
agttgaccaatgaaa

SEQ ID NO: 1906010 - DNA, 18 bp, Homo sapiens
agttgctggtaaaatgaa

SEQ ID NO: 1906011 - DNA, 12 bp, Homo sapiens
agttgctgtcac

SEQ ID NO: 1906012 - DNA, 18 bp, Homo sapiens
agttgtcttttaaactac

SEQ ID NO: 1906013 - DNA, 20 bp, Homo sapiens
agttgttagattaagaaata

SEQ ID NO: 1906014 - DNA, 13 bp, Homo sapiens
agttgtttgatgc

SEQ ID NO: 1906015 - DNA, 15 bp, Homo sapiens
agttgtttttgtata

SEQ ID NO: 1906016 - DNA, 22 bp, Homo sapiens
agttgtttttgtatattggttt

SEQ ID NO: 1906017 - DNA, 23 bp, Homo sapiens
agtttaattgaaagaatgtaaag

SEQ ID NO: 1906018 - DNA, 12 bp, Homo sapiens
agtttagaacag

SEQ ID NO: 1906019 - DNA, 16 bp, Homo sapiens
agtttagaacaggttt

SEQ ID NO: 1906020 - DNA, 16 bp, Homo sapiens
agtttattttaaaaca

SEQ ID NO: 1906021 - DNA, 23 bp, Homo sapiens
agtttattttaaaacaataggat

SEQ ID NO: 1906022 - DNA, 22 bp, Homo sapiens
agtttctgtcgttaaaaacaga

SEQ ID NO: 1906023 - DNA, 21 bp, Homo sapiens
agtttctgtggttggctggga

SEQ ID NO: 1906024 - DNA, 20 bp, Homo sapiens
agtttgctgaaagatatgta

SEQ ID NO: 1906025 - DNA, 16 bp, Homo sapiens
agtttgtaaatgactt

SEQ ID NO: 1906026 - DNA, 23 bp, Homo sapiens
agttttatttatatttattgact

SEQ ID NO: 1906027 - DNA, 22 bp, Homo sapiens
agttttcatgtgctcagaatta

SEQ ID NO: 1906028 - DNA, 19 bp, Homo sapiens
agttttgacaagctggctt

SEQ ID NO: 1906029 - DNA, 12 bp, Homo sapiens
agttttgtttca

SEQ ID NO: 1906030 - DNA, 20 bp, Homo sapiens
agtttttcataagatatttt

SEQ ID NO: 1906031 - DNA, 14 bp, Homo sapiens
caaccttggcttgg

SEQ ID NO: 1906032 - DNA, 22 bp, Homo sapiens
caaccttggcttggccctggca

SEQ ID NO: 1906033 - DNA, 18 bp, Homo sapiens
caacgtaatcaaatatgt

SEQ ID NO: 1906034 - DNA, 15 bp, Homo sapiens
caactaatttttgta

SEQ ID NO: 1906035 - DNA, 13 bp, Homo sapiens
caactgggcctct

SEQ ID NO: 1906036 - DNA, 12 bp, Homo sapiens
caagaaatgaag

SEQ ID NO: 1906037 - DNA, 21 bp, Homo sapiens
caagaagcaatgttataaagt

SEQ ID NO: 1906038 - DNA, 20 bp, Homo sapiens
caagagactgcttgacaaag

SEQ ID NO: 1906039 - DNA, 12 bp, Homo sapiens
caagagccttaa

SEQ ID NO: 1906040 - DNA, 22 bp, Homo sapiens
caagaggacaatctagctctcc

SEQ ID NO: 1906041 - DNA, 18 bp, Homo sapiens
caagagtggccccacctg

SEQ ID NO: 1906042 - DNA, 20 bp, Homo sapiens
caagagtggccccacctggc

SEQ ID NO: 1906043 - DNA, 21 bp, Homo sapiens
caagagtggccccacctggcc

SEQ ID NO: 1906044 - DNA, 22 bp, Homo sapiens
caagagtggccccacctggccc

SEQ ID NO: 1906045 - DNA, 16 bp, Homo sapiens
caagatcaaaaaggct

SEQ ID NO: 1906046 - DNA, 17 bp, Homo sapiens
caagcaccatcccctcc

SEQ ID NO: 1906047 - DNA, 13 bp, Homo sapiens
caagcatgtggat

SEQ ID NO: 1906048 - DNA, 16 bp, Homo sapiens
caagccgtaggaccca

SEQ ID NO: 1906049 - DNA, 17 bp, Homo sapiens
caagccgtaggacccag

SEQ ID NO: 1906050 - DNA, 17 bp, Homo sapiens
caagcgattctcttgcc

SEQ ID NO: 1906051 - DNA, 17 bp, Homo sapiens
caagcgccctggccccc

SEQ ID NO: 1906052 - DNA, 18 bp, Homo sapiens
caagcgccctggccccca

SEQ ID NO: 1906053 - DNA, 23 bp, Homo sapiens
caagcgccctggcccccacatgg

SEQ ID NO: 1906054 - DNA, 18 bp, Homo sapiens
caaggaagaaattaactt

SEQ ID NO: 1906055 - DNA, 13 bp, Homo sapiens
caaggaatacaag

SEQ ID NO: 1906056 - DNA, 15 bp, Homo sapiens
caaggcaatgggcta

SEQ ID NO: 1906057 - DNA, 15 bp, Homo sapiens
caaggcactaatgtt

SEQ ID NO: 1906058 - DNA, 13 bp, Homo sapiens
caaggccacctct

SEQ ID NO: 1906059 - DNA, 21 bp, Homo sapiens
caaggccacctcttcctggcc

SEQ ID NO: 1906060 - DNA, 23 bp, Homo sapiens
caaggtagggtaggcagcctgag

SEQ ID NO: 1906061 - DNA, 13 bp, Homo sapiens
caagtaaacattc

SEQ ID NO: 1906062 - DNA, 16 bp, Homo sapiens
caagtacagtactttg

SEQ ID NO: 1906063 - DNA, 19 bp, Homo sapiens
caagtagttctgtatttga

SEQ ID NO: 1906064 - DNA, 20 bp, Homo sapiens
caagtagttctgtatttgaa

SEQ ID NO: 1906065 - DNA, 23 bp, Homo sapiens
caagtagttctgtatttgaaagt

SEQ ID NO: 1906066 - DNA, 14 bp, Homo sapiens
caagtctgtggctt

SEQ ID NO: 1906067 - DNA, 13 bp, Homo sapiens
caagtgcaatgcc

SEQ ID NO: 1906068 - DNA, 15 bp, Homo sapiens
caagtttgagagtgg

SEQ ID NO: 1906069 - DNA, 20 bp, Homo sapiens
caataaaaaatatattttta

SEQ ID NO: 1906070 - DNA, 17 bp, Homo sapiens
caataaaagcccaggag

SEQ ID NO: 1906071 - DNA, 23 bp, Homo sapiens
caataaaagcctttgaaaatact

SEQ ID NO: 1906072 - DNA, 14 bp, Homo sapiens
caataaattttgaa

SEQ ID NO: 1906073 - DNA, 22 bp, Homo sapiens
caataaattttgaaaagtaata

SEQ ID NO: 1906074 - DNA, 22 bp, Homo sapiens
caataataagtccatctgtcac

SEQ ID NO: 1906075 - DNA, 18 bp, Homo sapiens
caataatttgtggtgatt

SEQ ID NO: 1906076 - DNA, 14 bp, Homo sapiens
caataccccatgga

SEQ ID NO: 1906077 - DNA, 21 bp, Homo sapiens
caataggatgggcttctgtgc

SEQ ID NO: 1906078 - DNA, 18 bp, Homo sapiens
caatatattttgaaatat

SEQ ID NO: 1906079 - DNA, 17 bp, Homo sapiens
caatatatttttactgc

SEQ ID NO: 1906080 - DNA, 18 bp, Homo sapiens
caatatatttttactgct

SEQ ID NO: 1906081 - DNA, 11 bp, Homo sapiens
caatcaataat

SEQ ID NO: 1906082 - DNA, 16 bp, Homo sapiens
caatcttactttgtaa

SEQ ID NO: 1906083 - DNA, 14 bp, Homo sapiens
caatgatatccaat

SEQ ID NO: 1906084 - DNA, 18 bp, Homo sapiens
caatgccccctcccctcc

SEQ ID NO: 1906085 - DNA, 20 bp, Homo sapiens
caatgccccctcccctcctt

SEQ ID NO: 1906086 - DNA, 18 bp, Homo sapiens
caatgtcaatgaacaagc

SEQ ID NO: 1906087 - DNA, 14 bp, Homo sapiens
caatgtgtgttgct

SEQ ID NO: 1906088 - DNA, 16 bp, Homo sapiens
caatttctctgcacac

SEQ ID NO: 1906089 - DNA, 22 bp, Homo sapiens
caatttctctgcacacaagagg

SEQ ID NO: 1906090 - DNA, 21 bp, Homo sapiens
caattttccttcagatatttt

SEQ ID NO: 1906091 - DNA, 19 bp, Homo sapiens
caatttttggttgaataaa

SEQ ID NO: 1906092 - DNA, 13 bp, Homo sapiens
cacaaatgacttt

SEQ ID NO: 1906093 - DNA, 15 bp, Homo sapiens
cacaaggaagaaatt

SEQ ID NO: 1906094 - DNA, 22 bp, Homo sapiens
cacaatatatttttactgcttt

SEQ ID NO: 1906095 - DNA, 13 bp, Homo sapiens
cacacacctctgc

SEQ ID NO: 1906096 - DNA, 21 bp, Homo sapiens
cacaccaatcttactttgtaa

SEQ ID NO: 1906097 - DNA, 12 bp, Homo sapiens
cacacctctgcc

SEQ ID NO: 1906098 - DNA, 21 bp, Homo sapiens
cacacctctgccccttgggcc

SEQ ID NO: 1906099 - DNA, 16 bp, Homo sapiens
cacacctgtaattcca

SEQ ID NO: 1906100 - DNA, 20 bp, Homo sapiens
cacacgtggtgacctcacac

SEQ ID NO: 1906101 - DNA, 13 bp, Homo sapiens
cacagaaggctgg

SEQ ID NO: 1906102 - DNA, 18 bp, Homo sapiens
cacagaaggggactgcca

SEQ ID NO: 1906103 - DNA, 15 bp, Homo sapiens
cacagaggacacaga

SEQ ID NO: 1906104 - DNA, 14 bp, Homo sapiens
cacagaggctgtgg

SEQ ID NO: 1906105 - DNA, 21 bp, Homo sapiens
cacagcaacgatcacaaatga

SEQ ID NO: 1906106 - DNA, 12 bp, Homo sapiens
cacagcagggcc

SEQ ID NO: 1906107 - DNA, 19 bp, Homo sapiens
cacagcagggccttctgcc

SEQ ID NO: 1906108 - DNA, 12 bp, Homo sapiens
cacagcctcccc

SEQ ID NO: 1906109 - DNA, 18 bp, Homo sapiens
cacagcctccccttccca

SEQ ID NO: 1906110 - DNA, 19 bp, Homo sapiens
cacagcctccccttcccag

SEQ ID NO: 1906111 - DNA, 22 bp, Homo sapiens
cacagcctccccttcccagacc

SEQ ID NO: 1906112 - DNA, 22 bp, Homo sapiens
cacagcgttatgtgtctgccac

SEQ ID NO: 1906113 - DNA, 18 bp, Homo sapiens
cacaggacaggggttcct

SEQ ID NO: 1906114 - DNA, 14 bp, Homo sapiens
cacaggctgagtgc

SEQ ID NO: 1906115 - DNA, 21 bp, Homo sapiens
cacaggctgagtgcaggccca

SEQ ID NO: 1906116 - DNA, 16 bp, Homo sapiens
cacaggctgggctggg

SEQ ID NO: 1906117 - DNA, 17 bp, Homo sapiens
cacaggctgggctgggc

SEQ ID NO: 1906118 - DNA, 19 bp, Homo sapiens
cacaggctgggctgggcac

SEQ ID NO: 1906119 - DNA, 21 bp, Homo sapiens
cacagggaggggatgatgact

SEQ ID NO: 1906120 - DNA, 13 bp, Homo sapiens
cacagggcctggc

SEQ ID NO: 1906121 - DNA, 14 bp, Homo sapiens
cacagggcctggcc

SEQ ID NO: 1906122 - DNA, 18 bp, Homo sapiens
cacagggcctggcccatg

SEQ ID NO: 1906123 - DNA, 14 bp, Homo sapiens
cacagtgtgatttt

SEQ ID NO: 1906124 - DNA, 23 bp, Homo sapiens
cacatataaattgtcttaatgga

SEQ ID NO: 1906125 - DNA, 14 bp, Homo sapiens
cacatatttttcca

SEQ ID NO: 1906126 - DNA, 19 bp, Homo sapiens
cacatcctcatggcccatc

SEQ ID NO: 1906127 - DNA, 16 bp, Homo sapiens
cacatgggtactgtct

SEQ ID NO: 1906128 - DNA, 18 bp, Homo sapiens
caccaaaataagaaaaga

SEQ ID NO: 1906129 - DNA, 18 bp, Homo sapiens
caccaactactacctgta

SEQ ID NO: 1906130 - DNA, 18 bp, Homo sapiens
caccacagcctccccttc

SEQ ID NO: 1906131 - DNA, 20 bp, Homo sapiens
caccacagcctccccttccc

SEQ ID NO: 1906132 - DNA, 22 bp, Homo sapiens
caccacagcctccccttcccag

SEQ ID NO: 1906133 - DNA, 14 bp, Homo sapiens
caccagcccagaag

SEQ ID NO: 1906134 - DNA, 20 bp, Homo sapiens
caccagcgcccccactcctc

SEQ ID NO: 1906135 - DNA, 16 bp, Homo sapiens
caccagttgcccagat

SEQ ID NO: 1906136 - DNA, 19 bp, Homo sapiens
cacccagacctgcctgtct

SEQ ID NO: 1906137 - DNA, 17 bp, Homo sapiens
cacccctctggcacctg

SEQ ID NO: 1906138 - DNA, 16 bp, Homo sapiens
cacccgactccagtcc

SEQ ID NO: 1906139 - DNA, 16 bp, Homo sapiens
caccctgcttggccca

SEQ ID NO: 1906140 - DNA, 18 bp, Homo sapiens
caccctgtcccaggcagc

SEQ ID NO: 1906141 - DNA, 19 bp, Homo sapiens
cacccttccatctgattcc

SEQ ID NO: 1906142 - DNA, 15 bp, Homo sapiens
caccctttctgccag

SEQ ID NO: 1906143 - DNA, 17 bp, Homo sapiens
caccctttctgccaggg

SEQ ID NO: 1906144 - DNA, 18 bp, Homo sapiens
caccctttctgccaggga

SEQ ID NO: 1906145 - DNA, 15 bp, Homo sapiens
caccctttctggcac

SEQ ID NO: 1906146 - DNA, 14 bp, Homo sapiens
caccgccgtcggaa

SEQ ID NO: 1906147 - DNA, 14 bp, Homo sapiens
cacctcatgctagc

SEQ ID NO: 1906148 - DNA, 17 bp, Homo sapiens
cacctccccttgccagc

SEQ ID NO: 1906149 - DNA, 20 bp, Homo sapiens
cacctccccttgccagctgc

SEQ ID NO: 1906150 - DNA, 17 bp, Homo sapiens
cacctcctaaaaggccc

SEQ ID NO: 1906151 - DNA, 18 bp, Homo sapiens
cacctcctaaaaggccca

SEQ ID NO: 1906152 - DNA, 22 bp, Homo sapiens
cacctcctaaaaggcccagaga

SEQ ID NO: 1906153 - DNA, 22 bp, Homo sapiens
cacctctgccccttgggcctcc

SEQ ID NO: 1906154 - DNA, 16 bp, Homo sapiens
cacctcttcctggccg

SEQ ID NO: 1906155 - DNA, 16 bp, Homo sapiens
cacctggccctctctg

SEQ ID NO: 1906156 - DNA, 21 bp, Homo sapiens
caccttcttgggactgctgtg

SEQ ID NO: 1906157 - DNA, 14 bp, Homo sapiens
caccttggttcctg

SEQ ID NO: 1906158 - DNA, 18 bp, Homo sapiens
cacgcctagcctcacgct

SEQ ID NO: 1906159 - DNA, 13 bp, Homo sapiens
cacgcctctcccc

SEQ ID NO: 1906160 - DNA, 15 bp, Homo sapiens
cacgcctctccccac

SEQ ID NO: 1906161 - DNA, 15 bp, Homo sapiens
cacgtcattgtgtaa

SEQ ID NO: 1906162 - DNA, 13 bp, Homo sapiens
cacgttttaagga

SEQ ID NO: 1906163 - DNA, 16 bp, Homo sapiens
ccatgagctgcactga

SEQ ID NO: 1906164 - DNA, 13 bp, Homo sapiens
ccatgaggaggca

SEQ ID NO: 1906165 - DNA, 14 bp, Homo sapiens
ccatgaggaggcag

SEQ ID NO: 1906166 - DNA, 15 bp, Homo sapiens
ccatgaggaggcaga

SEQ ID NO: 1906167 - DNA, 21 bp, Homo sapiens
ccatgctgtctggcacagcct

SEQ ID NO: 1906168 - DNA, 14 bp, Homo sapiens
ccatgggcaggaga

SEQ ID NO: 1906169 - DNA, 17 bp, Homo sapiens
ccatggggtctctcaca

SEQ ID NO: 1906170 - DNA, 23 bp, Homo sapiens
ccatggggtctctcacagacagg

SEQ ID NO: 1906171 - DNA, 17 bp, Homo sapiens
cccaaatgtgtgcccag

SEQ ID NO: 1906172 - DNA, 15 bp, Homo sapiens
cccaagcctggcagg

SEQ ID NO: 1906173 - DNA, 17 bp, Homo sapiens
cccaagcgccctggccc

SEQ ID NO: 1906174 - DNA, 18 bp, Homo sapiens
cccaagcgccctggcccc

SEQ ID NO: 1906175 - DNA, 20 bp, Homo sapiens
cccaagcgccctggccccca

SEQ ID NO: 1906176 - DNA, 20 bp, Homo sapiens
cccacccagacctgcctgtc

SEQ ID NO: 1906177 - DNA, 11 bp, Homo sapiens
cccaccctgct

SEQ ID NO: 1906178 - DNA, 13 bp, Homo sapiens
cccaccctgtccc

SEQ ID NO: 1906179 - DNA, 14 bp, Homo sapiens
cccacgctgactac

SEQ ID NO: 1906180 - DNA, 17 bp, Homo sapiens
cccactcccatggctct

SEQ ID NO: 1906181 - DNA, 14 bp, Homo sapiens
cccactcctcctcc

SEQ ID NO: 1906182 - DNA, 14 bp, Homo sapiens
cccactctcagagg

SEQ ID NO: 1906183 - DNA, 16 bp, Homo sapiens
cccactggagtctctc

SEQ ID NO: 1906184 - DNA, 20 bp, Homo sapiens
cccactgtgcgtggggctcc

SEQ ID NO: 1906185 - DNA, 14 bp, Homo sapiens
cccagacctgcctg

SEQ ID NO: 1906186 - DNA, 17 bp, Homo sapiens
cccagcaacacgtcatt

SEQ ID NO: 1906187 - DNA, 14 bp, Homo sapiens
cccagctccacccc

SEQ ID NO: 1906188 - DNA, 15 bp, Homo sapiens
cccagctgtgctggg

SEQ ID NO: 1906189 - DNA, 17 bp, Homo sapiens
cccagcttccagcagga

SEQ ID NO: 1906190 - DNA, 18 bp, Homo sapiens
cccagcttccagcaggag

SEQ ID NO: 1906191 - DNA, 17 bp, Homo sapiens
cccaggagcctgcccag

SEQ ID NO: 1906192 - DNA, 19 bp, Homo sapiens
cccaggagcctgcccagcc

SEQ ID NO: 1906193 - DNA, 15 bp, Homo sapiens
cccaggatatatttt

SEQ ID NO: 1906194 - DNA, 17 bp, Homo sapiens
cccaggatatattttat

SEQ ID NO: 1906195 - DNA, 13 bp, Homo sapiens
cccaggctggagt

SEQ ID NO: 1906196 - DNA, 14 bp, Homo sapiens
cccagggcacgtgg

SEQ ID NO: 1906197 - DNA, 14 bp, Homo sapiens
cccaggtggctgtg

SEQ ID NO: 1906198 - DNA, 15 bp, Homo sapiens
cccaggtggctgtgg

SEQ ID NO: 1906199 - DNA, 14 bp, Homo sapiens
cccagtcccagcag

SEQ ID NO: 1906200 - DNA, 15 bp, Homo sapiens
cccagtcccagcagc

SEQ ID NO: 1906201 - DNA, 13 bp, Homo sapiens
cccagtggcaggg

SEQ ID NO: 1906202 - DNA, 16 bp, Homo sapiens
cccagtggcagggcac

SEQ ID NO: 1906203 - DNA, 17 bp, Homo sapiens
cccagtggcagggcaca

SEQ ID NO: 1906204 - DNA, 20 bp, Homo sapiens
cccagtggcagggcacaggg

SEQ ID NO: 1906205 - DNA, 22 bp, Homo sapiens
cccagtggcagggcacagggcc

SEQ ID NO: 1906206 - DNA, 15 bp, Homo sapiens
cccagttgctgtcac

SEQ ID NO: 1906207 - DNA, 21 bp, Homo sapiens
cccatcccgtttccctccagg

SEQ ID NO: 1906208 - DNA, 13 bp, Homo sapiens
cccatctgtgaat

SEQ ID NO: 1906209 - DNA, 16 bp, Homo sapiens
cccatctgtgaataag

SEQ ID NO: 1906210 - DNA, 14 bp, Homo sapiens
cccatggaccatgc

SEQ ID NO: 1906211 - DNA, 16 bp, Homo sapiens
cccatgggcaggagac

SEQ ID NO: 1906212 - DNA, 20 bp, Homo sapiens
cccatgtatggccaggaagt

SEQ ID NO: 1906213 - DNA, 15 bp, Homo sapiens
cccattgcagaccct

SEQ ID NO: 1906214 - DNA, 14 bp, Homo sapiens
cccatttggagggc

SEQ ID NO: 1906215 - DNA, 17 bp, Homo sapiens
ccccaaccccagacccc

SEQ ID NO: 1906216 - DNA, 16 bp, Homo sapiens
ccccaagcctggcagg

SEQ ID NO: 1906217 - DNA, 13 bp, Homo sapiens
ccccaagcgccct

SEQ ID NO: 1906218 - DNA, 16 bp, Homo sapiens
ccccaataccccatgg

SEQ ID NO: 1906219 - DNA, 16 bp, Homo sapiens
ccccaccctgtcccag

SEQ ID NO: 1906220 - DNA, 18 bp, Homo sapiens
ccccaccctgtcccaggc

SEQ ID NO: 1906221 - DNA, 13 bp, Homo sapiens
ccccactcctcct

SEQ ID NO: 1906222 - DNA, 14 bp, Homo sapiens
ccccactcctcctc

SEQ ID NO: 1906223 - DNA, 13 bp, Homo sapiens
ccccactctcaga

SEQ ID NO: 1906224 - DNA, 17 bp, Homo sapiens
ccccactctcagaggcc

SEQ ID NO: 1906225 - DNA, 20 bp, Homo sapiens
ccccactctcagaggcccca

SEQ ID NO: 1906226 - DNA, 16 bp, Homo sapiens
ccccagcaacacgtca

SEQ ID NO: 1906227 - DNA, 19 bp, Homo sapiens
ccccagcaacacgtcattg

SEQ ID NO: 1906228 - DNA, 15 bp, Homo sapiens
ccccagccctccagt

SEQ ID NO: 1906229 - DNA, 17 bp, Homo sapiens
ccccagcttccagcagg

SEQ ID NO: 1906230 - DNA, 21 bp, Homo sapiens
ccccagcttccagcaggaggg

SEQ ID NO: 1906231 - DNA, 19 bp, Homo sapiens
ccccagtggtgagaagact

SEQ ID NO: 1906232 - DNA, 20 bp, Homo sapiens
ccccatcccgtttccctcca

SEQ ID NO: 1906233 - DNA, 13 bp, Homo sapiens
cccccactcctcc

SEQ ID NO: 1906234 - DNA, 18 bp, Homo sapiens
cccccagcttccagcagg

SEQ ID NO: 1906235 - DNA, 14 bp, Homo sapiens
ccccctcccctcct

SEQ ID NO: 1906236 - DNA, 16 bp, Homo sapiens
ccccctcccctccttt

SEQ ID NO: 1906237 - DNA, 16 bp, Homo sapiens
ccccgcagcacgcctc

SEQ ID NO: 1906238 - DNA, 17 bp, Homo sapiens
ccccgcagcacgcctct

SEQ ID NO: 1906239 - DNA, 19 bp, Homo sapiens
ccccgcagtcgtcagcctc

SEQ ID NO: 1906240 - DNA, 13 bp, Homo sapiens
ccccgtctcaggt

SEQ ID NO: 1906241 - DNA, 19 bp, Homo sapiens
cccctaaagcctcaaaaca

SEQ ID NO: 1906242 - DNA, 15 bp, Homo sapiens
cccctcccctccttt

SEQ ID NO: 1906243 - DNA, 14 bp, Homo sapiens
cccctcgcccagtc

SEQ ID NO: 1906244 - DNA, 12 bp, Homo sapiens
cccctgagccca

SEQ ID NO: 1906245 - DNA, 13 bp, Homo sapiens
cccctgagcccac

SEQ ID NO: 1906246 - DNA, 14 bp, Homo sapiens
cccctgagcccact

SEQ ID NO: 1906247 - DNA, 18 bp, Homo sapiens
cccctggaagcagtgccc

SEQ ID NO: 1906248 - DNA, 19 bp, Homo sapiens
cccctggaccccagcctca

SEQ ID NO: 1906249 - DNA, 17 bp, Homo sapiens
ccccttccagctccctc

SEQ ID NO: 1906250 - DNA, 19 bp, Homo sapiens
ccccttccagctccctccc

SEQ ID NO: 1906251 - DNA, 12 bp, Homo sapiens
ccccttcccaga

SEQ ID NO: 1906252 - DNA, 15 bp, Homo sapiens
ccccttcccagaccc

SEQ ID NO: 1906253 - DNA, 12 bp, Homo sapiens
ccccttgccagc

SEQ ID NO: 1906254 - DNA, 19 bp, Homo sapiens
ccccttgccagctgctgag

SEQ ID NO: 1906255 - DNA, 21 bp, Homo sapiens
cccgaaagaggcacccttcca

SEQ ID NO: 1906256 - DNA, 22 bp, Homo sapiens
cccgaaagaggcacccttccat

SEQ ID NO: 1906257 - DNA, 24 bp, Homo sapiens
cccgaaagaggcacccttccatct

SEQ ID NO: 1906258 - DNA, 18 bp, Homo sapiens
cccgcagcacgcctctcc

SEQ ID NO: 1906259 - DNA, 19 bp, Homo sapiens
cccgcctccaacccctcgc

SEQ ID NO: 1906260 - DNA, 13 bp, Homo sapiens
cccgggactctgc

SEQ ID NO: 1906261 - DNA, 16 bp, Homo sapiens
cccgtccccccatccc

SEQ ID NO: 1906262 - DNA, 15 bp, Homo sapiens
cccgtttccctccag

SEQ ID NO: 1906263 - DNA, 13 bp, Homo sapiens
ccctaaagcctca

SEQ ID NO: 1906264 - DNA, 13 bp, Homo sapiens
ccctacccccttt

SEQ ID NO: 1906265 - DNA, 22 bp, Homo sapiens
ccctagaagatcacagcagggc

SEQ ID NO: 1906266 - DNA, 11 bp, Homo sapiens
ccctcccaggc

SEQ ID NO: 1906267 - DNA, 12 bp, Homo sapiens
ccctcccctcct

SEQ ID NO: 1906268 - DNA, 17 bp, Homo sapiens
ccctcctttaccgagga

SEQ ID NO: 1906269 - DNA, 13 bp, Homo sapiens
ccctcgcccagtc

SEQ ID NO: 1906270 - DNA, 18 bp, Homo sapiens
ccctcgcccagtcccagc

SEQ ID NO: 1906271 - DNA, 17 bp, Homo sapiens
ccctgacgtctgccacc

SEQ ID NO: 1906272 - DNA, 23 bp, Homo sapiens
ccctgacgtctgccaccagcgcc

SEQ ID NO: 1906273 - DNA, 12 bp, Homo sapiens
ccctgagcccac

SEQ ID NO: 1906274 - DNA, 13 bp, Homo sapiens
ccctgagcccact

SEQ ID NO: 1906275 - DNA, 14 bp, Homo sapiens
ccctgagcccactg

SEQ ID NO: 1906276 - DNA, 16 bp, Homo sapiens
ccctgagcccactgtg

SEQ ID NO: 1906277 - DNA, 17 bp, Homo sapiens
ccctgcagttcccctgg

SEQ ID NO: 1906278 - DNA, 19 bp, Homo sapiens
ccctgccaggcacaggcag

SEQ ID NO: 1906279 - DNA, 21 bp, Homo sapiens
ccctgccaggcacaggcaggg

SEQ ID NO: 1906280 - DNA, 23 bp, Homo sapiens
ccctgccaggcacaggcagggca

SEQ ID NO: 1906281 - DNA, 16 bp, Homo sapiens
ccctgcctctccgccc

SEQ ID NO: 1906282 - DNA, 19 bp, Homo sapiens
ccctgctgtatcttccaga

SEQ ID NO: 1906283 - DNA, 18 bp, Homo sapiens
ccctgcttggcccagggg

SEQ ID NO: 1906284 - DNA, 19 bp, Homo sapiens
ccctggaccccagcctcaa

SEQ ID NO: 1906285 - DNA, 12 bp, Homo sapiens
ccctggccccca

SEQ ID NO: 1906286 - DNA, 15 bp, Homo sapiens
ccctgggccagggcg

SEQ ID NO: 1906287 - DNA, 14 bp, Homo sapiens
ccctgggcctccac

SEQ ID NO: 1906288 - DNA, 17 bp, Homo sapiens
ccctgggcctccacctc

SEQ ID NO: 1906289 - DNA, 19 bp, Homo sapiens
ccctgggcctccacctctg

SEQ ID NO: 1906290 - DNA, 22 bp, Homo sapiens
ccctgggcctccacctctgtgc

SEQ ID NO: 1906291 - DNA, 21 bp, Homo sapiens
ccctgtaaggggccagagcct

SEQ ID NO: 1906292 - DNA, 15 bp, Homo sapiens
ccctgtaggcctcag

SEQ ID NO: 1906293 - DNA, 12 bp, Homo sapiens
ccctgtcccagg

SEQ ID NO: 1906294 - DNA, 14 bp, Homo sapiens
ccctgtcccaggca

SEQ ID NO: 1906295 - DNA, 16 bp, Homo sapiens
ccctgtttcagaggct

SEQ ID NO: 1906296 - DNA, 11 bp, Homo sapiens
cccttatttaa

SEQ ID NO: 1906297 - DNA, 12 bp, Homo sapiens
cccttatttaaa

SEQ ID NO: 1906298 - DNA, 17 bp, Homo sapiens
ctccctgacgtctgcca

SEQ ID NO: 1906299 - DNA, 22 bp, Homo sapiens
ctccctgacgtctgccaccagc

SEQ ID NO: 1906300 - DNA, 14 bp, Homo sapiens
ctccgcccctgagc

SEQ ID NO: 1906301 - DNA, 16 bp, Homo sapiens
ctccgcccctgagccc

SEQ ID NO: 1906302 - DNA, 17 bp, Homo sapiens
ctccgcccctgagccca

SEQ ID NO: 1906303 - DNA, 19 bp, Homo sapiens
ctccgcccctgagcccact

SEQ ID NO: 1906304 - DNA, 20 bp, Homo sapiens
ctccgcccctgagcccactg

SEQ ID NO: 1906305 - DNA, 15 bp, Homo sapiens
ctccgtagcttctag

SEQ ID NO: 1906306 - DNA, 19 bp, Homo sapiens
ctcctaaaaggcccagaga

SEQ ID NO: 1906307 - DNA, 12 bp, Homo sapiens
ctcctcagccct

SEQ ID NO: 1906308 - DNA, 16 bp, Homo sapiens
ctcctcagccctctct

SEQ ID NO: 1906309 - DNA, 21 bp, Homo sapiens
ctcctcagccctctcttgcca

SEQ ID NO: 1906310 - DNA, 12 bp, Homo sapiens
ctcctcctgccc

SEQ ID NO: 1906311 - DNA, 15 bp, Homo sapiens
ctcctcctgccctcc

SEQ ID NO: 1906312 - DNA, 20 bp, Homo sapiens
ctcctgagcccccagcttcc

SEQ ID NO: 1906313 - DNA, 21 bp, Homo sapiens
ctcctgagcccccagcttcca

SEQ ID NO: 1906314 - DNA, 15 bp, Homo sapiens
ctcctgcagcctgag

SEQ ID NO: 1906315 - DNA, 17 bp, Homo sapiens
ctcctgccctccgcccc

SEQ ID NO: 1906316 - DNA, 19 bp, Homo sapiens
ctcctttaccgaggacagc

SEQ ID NO: 1906317 - DNA, 22 bp, Homo sapiens
ctcctttaccgaggacagcctg

SEQ ID NO: 1906318 - DNA, 21 bp, Homo sapiens
ctcctttctttgctgtttgca

SEQ ID NO: 1906319 - DNA, 17 bp, Homo sapiens
ctcgagctcggggctgg

SEQ ID NO: 1906320 - DNA, 23 bp, Homo sapiens
ctcgctctctcgtactctctctc

SEQ ID NO: 1906321 - DNA, 20 bp, Homo sapiens
ctcgctctgttgcccaggct

SEQ ID NO: 1906322 - DNA, 18 bp, Homo sapiens
ctcggatcaggctcccag

SEQ ID NO: 1906323 - DNA, 20 bp, Homo sapiens
ctcgggctgttctggtggcc

SEQ ID NO: 1906324 - DNA, 12 bp, Homo sapiens
ctcggggctggg

SEQ ID NO: 1906325 - DNA, 13 bp, Homo sapiens
ctcggggctgggg

SEQ ID NO: 1906326 - DNA, 22 bp, Homo sapiens
ctcggggctgggggctgcaggg

SEQ ID NO: 1906327 - DNA, 19 bp, Homo sapiens
ctcgtactctctctctttt

SEQ ID NO: 1906328 - DNA, 13 bp, Homo sapiens
ctcgtcctcactg

SEQ ID NO: 1906329 - DNA, 22 bp, Homo sapiens
ctctaaagtctgttgattaaag

SEQ ID NO: 1906330 - DNA, 15 bp, Homo sapiens
ctctaacagtggaca

SEQ ID NO: 1906331 - DNA, 22 bp, Homo sapiens
ctctagaggctggcaagaacca

SEQ ID NO: 1906332 - DNA, 23 bp, Homo sapiens
ctctaggaaaagagaactttttt

SEQ ID NO: 1906333 - DNA, 16 bp, Homo sapiens
ctctaggactgggccc

SEQ ID NO: 1906334 - DNA, 13 bp, Homo sapiens
ctctcaatttttg

SEQ ID NO: 1906335 - DNA, 14 bp, Homo sapiens
ctctcaatttttgg

SEQ ID NO: 1906336 - DNA, 22 bp, Homo sapiens
ctctcaatttttggttgaataa

SEQ ID NO: 1906337 - DNA, 17 bp, Homo sapiens
ctctcacagacaggacc

SEQ ID NO: 1906338 - DNA, 18 bp, Homo sapiens
ctctcaccttggttcctg

SEQ ID NO: 1906339 - DNA, 20 bp, Homo sapiens
ctctcactctcttcctttca

SEQ ID NO: 1906340 - DNA, 20 bp, Homo sapiens
ctctccatccctctcctctg

SEQ ID NO: 1906341 - DNA, 21 bp, Homo sapiens
ctctccatccctctcctctgc

SEQ ID NO: 1906342 - DNA, 23 bp, Homo sapiens
ctctccccacccagacctgcctg

SEQ ID NO: 1906343 - DNA, 23 bp, Homo sapiens
ctctccccaccttcttgggactg

SEQ ID NO: 1906344 - DNA, 18 bp, Homo sapiens
ctctccttaattttatat

SEQ ID NO: 1906345 - DNA, 21 bp, Homo sapiens
ctctctcaatttttggttgaa

SEQ ID NO: 1906346 - DNA, 22 bp, Homo sapiens
ctctctccatccctctcctctg

SEQ ID NO: 1906347 - DNA, 19 bp, Homo sapiens
ctctctgaaggaggccacc

SEQ ID NO: 1906348 - DNA, 21 bp, Homo sapiens
ctctctgaaggaggccacctc

SEQ ID NO: 1906349 - DNA, 14 bp, Homo sapiens
ctctcttcctttca

SEQ ID NO: 1906350 - DNA, 20 bp, Homo sapiens
ctctcttgccaaaaagcaca

SEQ ID NO: 1906351 - DNA, 14 bp, Homo sapiens
ctctgaaggaggcc

SEQ ID NO: 1906352 - DNA, 18 bp, Homo sapiens
ctctgaaggaggccacct

SEQ ID NO: 1906353 - DNA, 17 bp, Homo sapiens
ctctgaattcaggtccc

SEQ ID NO: 1906354 - DNA, 22 bp, Homo sapiens
ctctgaccagaagacaaaggcc

SEQ ID NO: 1906355 - DNA, 22 bp, Homo sapiens
ctctgagtagggcaatggaaat

SEQ ID NO: 1906356 - DNA, 19 bp, Homo sapiens
ctctgagttccggcaccag

SEQ ID NO: 1906357 - DNA, 23 bp, Homo sapiens
ctctgagttccggcaccagtagc

SEQ ID NO: 1906358 - DNA, 17 bp, Homo sapiens
ctctgatctgtgcaggg

SEQ ID NO: 1906359 - DNA, 13 bp, Homo sapiens
ctctgccagggtg

SEQ ID NO: 1906360 - DNA, 22 bp, Homo sapiens
ctctgccccttgggcctcccac

SEQ ID NO: 1906361 - DNA, 22 bp, Homo sapiens
ctctgctgcatccccttccagc

SEQ ID NO: 1906362 - DNA, 14 bp, Homo sapiens
ctctggcacctggg

SEQ ID NO: 1906363 - DNA, 21 bp, Homo sapiens
ctctgggcggtccagaaggag

SEQ ID NO: 1906364 - DNA, 19 bp, Homo sapiens
ctctggggctggcaccagc

SEQ ID NO: 1906365 - DNA, 21 bp, Homo sapiens
ctctgggggactccttccttg

SEQ ID NO: 1906366 - DNA, 22 bp, Homo sapiens
ctctgggggactccttccttga

SEQ ID NO: 1906367 - DNA, 13 bp, Homo sapiens
ctctgtctggcca

SEQ ID NO: 1906368 - DNA, 15 bp, Homo sapiens
ctctgtctggccagg

SEQ ID NO: 1906369 - DNA, 15 bp, Homo sapiens
ctctgtgcagggcac

SEQ ID NO: 1906370 - DNA, 17 bp, Homo sapiens
ctcttctatgtattttg

SEQ ID NO: 1906371 - DNA, 20 bp, Homo sapiens
ctcttgagttgtttttgtat

SEQ ID NO: 1906372 - DNA, 23 bp, Homo sapiens
ctcttgagttgtttttgtatatt

SEQ ID NO: 1906373 - DNA, 19 bp, Homo sapiens
ctcttgcctcagcttcccc

SEQ ID NO: 1906374 - DNA, 21 bp, Homo sapiens
ctcttgcctcagcttccccag

SEQ ID NO: 1906375 - DNA, 12 bp, Homo sapiens
ctcttgggacat

SEQ ID NO: 1906376 - DNA, 16 bp, Homo sapiens
ctcttgggcttggccc

SEQ ID NO: 1906377 - DNA, 20 bp, Homo sapiens
ctcttttccaaacacaggca

SEQ ID NO: 1906378 - DNA, 22 bp, Homo sapiens
ctcttttccctcctttcctttt

SEQ ID NO: 1906379 - DNA, 11 bp, Homo sapiens
ctcttttccta

SEQ ID NO: 1906380 - DNA, 13 bp, Homo sapiens
ctcttttttaagt

SEQ ID NO: 1906381 - DNA, 17 bp, Homo sapiens
ctgaaagatatgtatat

SEQ ID NO: 1906382 - DNA, 15 bp, Homo sapiens
ctgaaataaaagcta

SEQ ID NO: 1906383 - DNA, 17 bp, Homo sapiens
ctgaaatgctttagcat

SEQ ID NO: 1906384 - DNA, 13 bp, Homo sapiens
ctgaaggaggcca

SEQ ID NO: 1906385 - DNA, 15 bp, Homo sapiens
ctgaaggaggccacc

SEQ ID NO: 1906386 - DNA, 16 bp, Homo sapiens
ctgaagtgcatgggtc

SEQ ID NO: 1906387 - DNA, 20 bp, Homo sapiens
ctgaagtgcatgggtcaggg

SEQ ID NO: 1906388 - DNA, 22 bp, Homo sapiens
ctgaagtgcatgggtcagggtg

SEQ ID NO: 1906389 - DNA, 16 bp, Homo sapiens
ctgaataccagtggag

SEQ ID NO: 1906390 - DNA, 14 bp, Homo sapiens
ctgaccagaagaca

SEQ ID NO: 1906391 - DNA, 22 bp, Homo sapiens
ctgaccagaagacaaaggccca

SEQ ID NO: 1906392 - DNA, 23 bp, Homo sapiens
ctgaccagaagacaaaggcccaa

SEQ ID NO: 1906393 - DNA, 19 bp, Homo sapiens
ctgacccatgggcaggaga

SEQ ID NO: 1906394 - DNA, 12 bp, Homo sapiens
ctgacccctgtg

SEQ ID NO: 1906395 - DNA, 15 bp, Homo sapiens
ctgacccctgtgtga

SEQ ID NO: 1906396 - DNA, 12 bp, Homo sapiens
ctgacctcaaat

SEQ ID NO: 1906397 - DNA, 15 bp, Homo sapiens
ctgaccttaaatgca

SEQ ID NO: 1906398 - DNA, 19 bp, Homo sapiens
ctgaccttaaatgcaacca

SEQ ID NO: 1906399 - DNA, 18 bp, Homo sapiens
ctgacgtctgccaccagc

SEQ ID NO: 1906400 - DNA, 22 bp, Homo sapiens
ctgacgtctgccaccagcgccc

SEQ ID NO: 1906401 - DNA, 16 bp, Homo sapiens
ctgactctgccagggt

SEQ ID NO: 1906402 - DNA, 14 bp, Homo sapiens
ctgactgaggcagt

SEQ ID NO: 1906403 - DNA, 18 bp, Homo sapiens
ctgactgtcacaactcct

SEQ ID NO: 1906404 - DNA, 23 bp, Homo sapiens
ctgactttgaatttatataaagt

SEQ ID NO: 1906405 - DNA, 18 bp, Homo sapiens
ctgagaatgaacaaagac

SEQ ID NO: 1906406 - DNA, 18 bp, Homo sapiens
ctgagacccttatttaaa

SEQ ID NO: 1906407 - DNA, 10 bp, Homo sapiens
ctgagcccac

SEQ ID NO: 1906408 - DNA, 12 bp, Homo sapiens
ctgagcccactg

SEQ ID NO: 1906409 - DNA, 13 bp, Homo sapiens
ctgagcccactgt

SEQ ID NO: 1906410 - DNA, 14 bp, Homo sapiens
ctgagcccccagct

SEQ ID NO: 1906411 - DNA, 14 bp, Homo sapiens
ctgagccgcagaga

SEQ ID NO: 1906412 - DNA, 15 bp, Homo sapiens
ctgagccgcagagaa

SEQ ID NO: 1906413 - DNA, 16 bp, Homo sapiens
ctgagccgcagagaag

SEQ ID NO: 1906414 - DNA, 23 bp, Homo sapiens
ctgagctcatttggggaccacag

SEQ ID NO: 1906415 - DNA, 20 bp, Homo sapiens
ctgaggccgttgctgactta

SEQ ID NO: 1906416 - DNA, 18 bp, Homo sapiens
ctgaggggagacagagca

SEQ ID NO: 1906417 - DNA, 20 bp, Homo sapiens
ctgagtctgttctggtaatc

SEQ ID NO: 1906418 - DNA, 15 bp, Homo sapiens
ctgagtgagagggga

SEQ ID NO: 1906419 - DNA, 20 bp, Homo sapiens
ctgagtgagaggggaggcca

SEQ ID NO: 1906420 - DNA, 14 bp, Homo sapiens
ctgagtgcaggccc

SEQ ID NO: 1906421 - DNA, 18 bp, Homo sapiens
ctgataccaaagagacag

SEQ ID NO: 1906422 - DNA, 18 bp, Homo sapiens
ctgatctgtgcagggtat

SEQ ID NO: 1906423 - DNA, 18 bp, Homo sapiens
ctgatggaatttttttgt

SEQ ID NO: 1906424 - DNA, 16 bp, Homo sapiens
ctgatgttccctccgg

SEQ ID NO: 1906425 - DNA, 18 bp, Homo sapiens
ctgatgttcttccagtga

SEQ ID NO: 1906426 - DNA, 20 bp, Homo sapiens
ctgattacgtttacattctt

SEQ ID NO: 1906427 - DNA, 17 bp, Homo sapiens
ctgattcactgcctatg

SEQ ID NO: 1906428 - DNA, 19 bp, Homo sapiens
ctgattctaaaatgtctca

SEQ ID NO: 1906429 - DNA, 15 bp, Homo sapiens
gaacatacaaatgca

SEQ ID NO: 1906430 - DNA, 17 bp, Homo sapiens
gaacatacaaatgcatc

SEQ ID NO: 1906431 - DNA, 22 bp, Homo sapiens
gaacatacaaatgcatctttga

SEQ ID NO: 1906432 - DNA, 16 bp, Homo sapiens
gaacatgcctcctcct

SEQ ID NO: 1906433 - DNA, 22 bp, Homo sapiens
gaacatgcctcctcctgccctc

SEQ ID NO: 1906434 - DNA, 15 bp, Homo sapiens
gaacattaggcccca

SEQ ID NO: 1906435 - DNA, 21 bp, Homo sapiens
gaacatttatccaggaattga

SEQ ID NO: 1906436 - DNA, 21 bp, Homo sapiens
gaaccaaacccaccctttcta

SEQ ID NO: 1906437 - DNA, 14 bp, Homo sapiens
gaaccacttgtaga

SEQ ID NO: 1906438 - DNA, 20 bp, Homo sapiens
gaaccacttgtagatttgat

SEQ ID NO: 1906439 - DNA, 17 bp, Homo sapiens
gaacctgcacacgagca

SEQ ID NO: 1906440 - DNA, 15 bp, Homo sapiens
gaactcttgacagct

SEQ ID NO: 1906441 - DNA, 22 bp, Homo sapiens
gaactgaaaggcttttcaacca

SEQ ID NO: 1906442 - DNA, 15 bp, Homo sapiens
gaactgctgctgacc

SEQ ID NO: 1906443 - DNA, 14 bp, Homo sapiens
gaactggcctctgc

SEQ ID NO: 1906444 - DNA, 13 bp, Homo sapiens
gaactgttgtata

SEQ ID NO: 1906445 - DNA, 20 bp, Homo sapiens
gaactgttgtataaatttat

SEQ ID NO: 1906446 - DNA, 21 bp, Homo sapiens
gaacttacaaagggtctatct

SEQ ID NO: 1906447 - DNA, 13 bp, Homo sapiens
gaacttggaagca

SEQ ID NO: 1906448 - DNA, 15 bp, Homo sapiens
gaacttggaagcaca

SEQ ID NO: 1906449 - DNA, 12 bp, Homo sapiens
gaactttgtata

SEQ ID NO: 1906450 - DNA, 15 bp, Homo sapiens
gaactttgtatagtt

SEQ ID NO: 1906451 - DNA, 21 bp, Homo sapiens
gaacttttttcaaaattcaaa

SEQ ID NO: 1906452 - DNA, 16 bp, Homo sapiens
gaagaactgaaaggct

SEQ ID NO: 1906453 - DNA, 12 bp, Homo sapiens
gaagaataattt

SEQ ID NO: 1906454 - DNA, 10 bp, Homo sapiens
gaagagaaag

SEQ ID NO: 1906455 - DNA, 14 bp, Homo sapiens
gaagagaagagaaa

SEQ ID NO: 1906456 - DNA, 15 bp, Homo sapiens
gaagagaagagaaag

SEQ ID NO: 1906457 - DNA, 23 bp, Homo sapiens
gaagagagtagctcgtcctcact

SEQ ID NO: 1906458 - DNA, 15 bp, Homo sapiens
gaagagccccactct

SEQ ID NO: 1906459 - DNA, 16 bp, Homo sapiens
gaagagccccactctc

SEQ ID NO: 1906460 - DNA, 19 bp, Homo sapiens
gaagagccccactctcaga

SEQ ID NO: 1906461 - DNA, 20 bp, Homo sapiens
gaagagctgttgatgggatg

SEQ ID NO: 1906462 - DNA, 15 bp, Homo sapiens
gaagatactttgtat

SEQ ID NO: 1906463 - DNA, 22 bp, Homo sapiens
gaagcacaccaatcttactttg

SEQ ID NO: 1906464 - DNA, 23 bp, Homo sapiens
gaagcacaccaatcttactttgt

SEQ ID NO: 1906465 - DNA, 15 bp, Homo sapiens
gaagcagtgcccagg

SEQ ID NO: 1906466 - DNA, 18 bp, Homo sapiens
gaagccaagggggacctc

SEQ ID NO: 1906467 - DNA, 21 bp, Homo sapiens
gaagccaagggggacctcggg

SEQ ID NO: 1906468 - DNA, 14 bp, Homo sapiens
gaagccccacacca

SEQ ID NO: 1906469 - DNA, 12 bp, Homo sapiens
gaagctgaggcc

SEQ ID NO: 1906470 - DNA, 14 bp, Homo sapiens
gaagctgaggccca

SEQ ID NO: 1906471 - DNA, 17 bp, Homo sapiens
gaagctgaggctgctgc

SEQ ID NO: 1906472 - DNA, 19 bp, Homo sapiens
gaagctgaggctgctgcca

SEQ ID NO: 1906473 - DNA, 21 bp, Homo sapiens
gaagctgaggctgctgccagg

SEQ ID NO: 1906474 - DNA, 13 bp, Homo sapiens
gaagcttgtatct

SEQ ID NO: 1906475 - DNA, 22 bp, Homo sapiens
gaaggagattgtggggagagaa

SEQ ID NO: 1906476 - DNA, 16 bp, Homo sapiens
gaaggatgccaagaag

SEQ ID NO: 1906477 - DNA, 14 bp, Homo sapiens
gaaggcttttttaa

SEQ ID NO: 1906478 - DNA, 14 bp, Homo sapiens
gaaggtttttgata

SEQ ID NO: 1906479 - DNA, 13 bp, Homo sapiens
gaagtagcacagg

SEQ ID NO: 1906480 - DNA, 17 bp, Homo sapiens
gaagtgcagaactgcag

SEQ ID NO: 1906481 - DNA, 16 bp, Homo sapiens
gaagtgcatgggtcag

SEQ ID NO: 1906482 - DNA, 22 bp, Homo sapiens
gaagtgcatgggtcagggtgtg

SEQ ID NO: 1906483 - DNA, 14 bp, Homo sapiens
gaataaacaccact

SEQ ID NO: 1906484 - DNA, 19 bp, Homo sapiens
gaataaactagattacatt

SEQ ID NO: 1906485 - DNA, 14 bp, Homo sapiens
gaataatgtctaga

SEQ ID NO: 1906486 - DNA, 15 bp, Homo sapiens
gaatactgatggaat

SEQ ID NO: 1906487 - DNA, 15 bp, Homo sapiens
gaatacttgaaccat

SEQ ID NO: 1906488 - DNA, 19 bp, Homo sapiens
gaatatgattaaaaatatc

SEQ ID NO: 1906489 - DNA, 21 bp, Homo sapiens
gaatatgggagaaatagtgtg

SEQ ID NO: 1906490 - DNA, 19 bp, Homo sapiens
gaatatttaagcaataaaa

SEQ ID NO: 1906491 - DNA, 11 bp, Homo sapiens
gaatcacaggc

SEQ ID NO: 1906492 - DNA, 12 bp, Homo sapiens
gaatcacaggct

SEQ ID NO: 1906493 - DNA, 17 bp, Homo sapiens
gaatcacaggctgggct

SEQ ID NO: 1906494 - DNA, 18 bp, Homo sapiens
gaatcacaggctgggctg

SEQ ID NO: 1906495 - DNA, 18 bp, Homo sapiens
gaatcagatacaaaacta

SEQ ID NO: 1906496 - DNA, 13 bp, Homo sapiens
gaatctgctccaa

SEQ ID NO: 1906497 - DNA, 16 bp, Homo sapiens
gaatgaacaaagacca

SEQ ID NO: 1906498 - DNA, 13 bp, Homo sapiens
gaatgactcgttt

SEQ ID NO: 1906499 - DNA, 20 bp, Homo sapiens
gaatgctgggcccctgctca

SEQ ID NO: 1906500 - DNA, 22 bp, Homo sapiens
gaatgctgggcccctgctcaag

SEQ ID NO: 1906501 - DNA, 22 bp, Homo sapiens
gaatgctgtgggaaggcaattt

SEQ ID NO: 1906502 - DNA, 19 bp, Homo sapiens
gaatgtacatactgaaaaa

SEQ ID NO: 1906503 - DNA, 13 bp, Homo sapiens
gaatgtcaataaa

SEQ ID NO: 1906504 - DNA, 15 bp, Homo sapiens
gaatgtcaataaatt

SEQ ID NO: 1906505 - DNA, 20 bp, Homo sapiens
gaatgttttagcacagcgtt

SEQ ID NO: 1906506 - DNA, 17 bp, Homo sapiens
gaattctggttgtaaat

SEQ ID NO: 1906507 - DNA, 11 bp, Homo sapiens
gaattgaaggt

SEQ ID NO: 1906508 - DNA, 18 bp, Homo sapiens
gaattgaaggtttttgat

SEQ ID NO: 1906509 - DNA, 22 bp, Homo sapiens
gaatttaaagaaaaaaatgtca

SEQ ID NO: 1906510 - DNA, 16 bp, Homo sapiens
gaatttatataaagta

SEQ ID NO: 1906511 - DNA, 17 bp, Homo sapiens
gacaaactgccagtttt

SEQ ID NO: 1906512 - DNA, 22 bp, Homo sapiens
gacaaccttggcttggccctgg

SEQ ID NO: 1906513 - DNA, 13 bp, Homo sapiens
gacaatgtttaca

SEQ ID NO: 1906514 - DNA, 23 bp, Homo sapiens
gacacatttaaggtgtagtatta

SEQ ID NO: 1906515 - DNA, 22 bp, Homo sapiens
gacaccacagcctccccttccc

SEQ ID NO: 1906516 - DNA, 23 bp, Homo sapiens
gacaccacagcctccccttccca

SEQ ID NO: 1906517 - DNA, 19 bp, Homo sapiens
gacactaagaggaggcagg

SEQ ID NO: 1906518 - DNA, 14 bp, Homo sapiens
gacactgtggcagc

SEQ ID NO: 1906519 - DNA, 15 bp, Homo sapiens
gacactgtggcagca

SEQ ID NO: 1906520 - DNA, 16 bp, Homo sapiens
gacactgtggcagcag

SEQ ID NO: 1906521 - DNA, 17 bp, Homo sapiens
gacactgtggcagcagg

SEQ ID NO: 1906522 - DNA, 21 bp, Homo sapiens
gacactgtggcagcaggaggg

SEQ ID NO: 1906523 - DNA, 19 bp, Homo sapiens
gacacttgagttaactttt

SEQ ID NO: 1906524 - DNA, 21 bp, Homo sapiens
gacagagagagatactctggg

SEQ ID NO: 1906525 - DNA, 14 bp, Homo sapiens
gacagcctgcctct

SEQ ID NO: 1906526 - DNA, 17 bp, Homo sapiens
gacagcctgcctctgcc

SEQ ID NO: 1906527 - DNA, 19 bp, Homo sapiens
gacagcctgcctctgccac

SEQ ID NO: 1906528 - DNA, 15 bp, Homo sapiens
gacagcgcacagctg

SEQ ID NO: 1906529 - DNA, 21 bp, Homo sapiens
gacagggcccgggcccaggca

SEQ ID NO: 1906530 - DNA, 21 bp, Homo sapiens
gacaggggttccttctgggca

SEQ ID NO: 1906531 - DNA, 14 bp, Homo sapiens
gacagtctcaccat

SEQ ID NO: 1906532 - DNA, 14 bp, Homo sapiens
gacatcaagctcaa

SEQ ID NO: 1906533 - DNA, 19 bp, Homo sapiens
gacatcacagggcctcagt

SEQ ID NO: 1906534 - DNA, 18 bp, Homo sapiens
gacatcccctgctggccg

SEQ ID NO: 1906535 - DNA, 24 bp, Homo sapiens
gacatcctgtcatctgagaatgaa

SEQ ID NO: 1906536 - DNA, 15 bp, Homo sapiens
gacatttcaaataac

SEQ ID NO: 1906537 - DNA, 17 bp, Homo sapiens
gacattttgaaataaaa

SEQ ID NO: 1906538 - DNA, 15 bp, Homo sapiens
gaccaaaagcaacat

SEQ ID NO: 1906539 - DNA, 12 bp, Homo sapiens
gaccacagaggc

SEQ ID NO: 1906540 - DNA, 19 bp, Homo sapiens
gaccacgtctatttcatca

SEQ ID NO: 1906541 - DNA, 21 bp, Homo sapiens
gaccagcaggctcctcagccc

SEQ ID NO: 1906542 - DNA, 22 bp, Homo sapiens
gaccagccccaccatgcaactt

SEQ ID NO: 1906543 - DNA, 14 bp, Homo sapiens
gacccaagtggata

SEQ ID NO: 1906544 - DNA, 12 bp, Homo sapiens
gacccagtggca

SEQ ID NO: 1906545 - DNA, 22 bp, Homo sapiens
gacccagtggcagggcacaggg

SEQ ID NO: 1906546 - DNA, 14 bp, Homo sapiens
gacccatgggcagg

SEQ ID NO: 1906547 - DNA, 18 bp, Homo sapiens
gacccatgggcaggagac

SEQ ID NO: 1906548 - DNA, 19 bp, Homo sapiens
gaccccatctgtgaataag

SEQ ID NO: 1906549 - DNA, 18 bp, Homo sapiens
gaccccgcagcacgcctc

SEQ ID NO: 1906550 - DNA, 21 bp, Homo sapiens
gacccctgtaaggggccagag

SEQ ID NO: 1906551 - DNA, 20 bp, Homo sapiens
gaccctccaaggccaggcct

SEQ ID NO: 1906552 - DNA, 13 bp, Homo sapiens
gaccctgccaggc

SEQ ID NO: 1906553 - DNA, 14 bp, Homo sapiens
gaccctgccaggca

SEQ ID NO: 1906554 - DNA, 15 bp, Homo sapiens
gaccctgccaggcac

SEQ ID NO: 1906555 - DNA, 19 bp, Homo sapiens
gaccctgccaggcacaggc

SEQ ID NO: 1906556 - DNA, 20 bp, Homo sapiens
gaccctgccaggcacaggca

SEQ ID NO: 1906557 - DNA, 22 bp, Homo sapiens
gaccctgccaggcacaggcagg

SEQ ID NO: 1906558 - DNA, 19 bp, Homo sapiens
gaccgaactgttgtataaa

SEQ ID NO: 1906559 - DNA, 18 bp, Homo sapiens
gacctcacacacctctgc

SEQ ID NO: 1906560 - DNA, 19 bp, Homo sapiens
gacctcacacacctctgcc

SEQ ID NO: 1906561 - DNA, 12 bp, Homo sapiens
gacctgactttt

SEQ ID NO: 1906562 - DNA, 18 bp, Homo sapiens
gcttgaagcaaacagttg

SEQ ID NO: 1906563 - DNA, 15 bp, Homo sapiens
gcttggccctggcag

SEQ ID NO: 1906564 - DNA, 20 bp, Homo sapiens
gcttgggctggcgggccctg

SEQ ID NO: 1906565 - DNA, 22 bp, Homo sapiens
gcttgtaactaaaataattttg

SEQ ID NO: 1906566 - DNA, 16 bp, Homo sapiens
gcttgtagttctttaa

SEQ ID NO: 1906567 - DNA, 17 bp, Homo sapiens
gcttgtagttctttaaa

SEQ ID NO: 1906568 - DNA, 17 bp, Homo sapiens
gcttgtgtgcgtgcgtg

SEQ ID NO: 1906569 - DNA, 24 bp, Homo sapiens
gctttagacttgaaaagagacagg

SEQ ID NO: 1906570 - DNA, 16 bp, Homo sapiens
gctttgagttggaagc

SEQ ID NO: 1906571 - DNA, 17 bp, Homo sapiens
gcttttggtgaatttgt

SEQ ID NO: 1906572 - DNA, 21 bp, Homo sapiens
ggaaaggccagcagccttcca

SEQ ID NO: 1906573 - DNA, 23 bp, Homo sapiens
ggaaagtgttcattgcacaatat

SEQ ID NO: 1906574 - DNA, 14 bp, Homo sapiens
ggaaattaagaaga

SEQ ID NO: 1906575 - DNA, 17 bp, Homo sapiens
ggaaatttccattaaag

SEQ ID NO: 1906576 - DNA, 20 bp, Homo sapiens
ggaacccccagcccagcaga

SEQ ID NO: 1906577 - DNA, 12 bp, Homo sapiens
ggaactgctgct

SEQ ID NO: 1906578 - DNA, 13 bp, Homo sapiens
ggaactgctgctg

SEQ ID NO: 1906579 - DNA, 14 bp, Homo sapiens
ggaactgctgctga

SEQ ID NO: 1906580 - DNA, 15 bp, Homo sapiens
ggaagctgaggccca

SEQ ID NO: 1906581 - DNA, 17 bp, Homo sapiens
ggaatatgggagaaata

SEQ ID NO: 1906582 - DNA, 21 bp, Homo sapiens
ggacactaagaggaggcagga

SEQ ID NO: 1906583 - DNA, 21 bp, Homo sapiens
ggacactgtggcagcaggagg

SEQ ID NO: 1906584 - DNA, 18 bp, Homo sapiens
ggacagcctgcctctgcc

SEQ ID NO: 1906585 - DNA, 21 bp, Homo sapiens
ggacagcctgcctctgccaca

SEQ ID NO: 1906586 - DNA, 20 bp, Homo sapiens
ggacatcccctgctggccgg

SEQ ID NO: 1906587 - DNA, 15 bp, Homo sapiens
ggaccagcccacgct

SEQ ID NO: 1906588 - DNA, 19 bp, Homo sapiens
ggaccatgctgtctggcac

SEQ ID NO: 1906589 - DNA, 20 bp, Homo sapiens
ggaccatgctgtctggcaca

SEQ ID NO: 1906590 - DNA, 23 bp, Homo sapiens
ggaccatgctgtctggcacagcc

SEQ ID NO: 1906591 - DNA, 11 bp, Homo sapiens
ggacccagtgg

SEQ ID NO: 1906592 - DNA, 14 bp, Homo sapiens
ggacccagtggcag

SEQ ID NO: 1906593 - DNA, 16 bp, Homo sapiens
ggacccagtggcaggg

SEQ ID NO: 1906594 - DNA, 17 bp, Homo sapiens
ggacccagtggcagggc

SEQ ID NO: 1906595 - DNA, 21 bp, Homo sapiens
ggacccagtggcagggcacag

SEQ ID NO: 1906596 - DNA, 14 bp, Homo sapiens
ggaccccatctgtg

SEQ ID NO: 1906597 - DNA, 17 bp, Homo sapiens
ggaccccatctgtgaat

SEQ ID NO: 1906598 - DNA, 22 bp, Homo sapiens
ggaccctgccaggcacaggcag

SEQ ID NO: 1906599 - DNA, 22 bp, Homo sapiens
ggactccttccttgaaccctaa

SEQ ID NO: 1906600 - DNA, 11 bp, Homo sapiens
ggactgactga

SEQ ID NO: 1906601 - DNA, 17 bp, Homo sapiens
ggactgccacctcccct

SEQ ID NO: 1906602 - DNA, 22 bp, Homo sapiens
ggactggcgagtccagagagga

SEQ ID NO: 1906603 - DNA, 13 bp, Homo sapiens
ggacttgtttccc

SEQ ID NO: 1906604 - DNA, 22 bp, Homo sapiens
ggagaatcacaggctgggctgg

SEQ ID NO: 1906605 - DNA, 17 bp, Homo sapiens
ggagaatgcaccatact

SEQ ID NO: 1906606 - DNA, 21 bp, Homo sapiens
ggagaattaaaactttgtaga

SEQ ID NO: 1906607 - DNA, 18 bp, Homo sapiens
ggagactgctcctgagcc

SEQ ID NO: 1906608 - DNA, 15 bp, Homo sapiens
ggagaggagccctgc

SEQ ID NO: 1906609 - DNA, 16 bp, Homo sapiens
ggagaggagccctgcc

SEQ ID NO: 1906610 - DNA, 23 bp, Homo sapiens
ggagcccatttggagggcctggg

SEQ ID NO: 1906611 - DNA, 15 bp, Homo sapiens
ggagccccagtggtg

SEQ ID NO: 1906612 - DNA, 12 bp, Homo sapiens
ggagccctgcct

SEQ ID NO: 1906613 - DNA, 17 bp, Homo sapiens
ggagccctgggccaggg

SEQ ID NO: 1906614 - DNA, 15 bp, Homo sapiens
ggagcctgcggggca

SEQ ID NO: 1906615 - DNA, 20 bp, Homo sapiens
ggagcctgcggggcagcagg

SEQ ID NO: 1906616 - DNA, 21 bp, Homo sapiens
ggagcctgcggggcagcaggg

SEQ ID NO: 1906617 - DNA, 23 bp, Homo sapiens
ggaggccaagagtggccccacct

SEQ ID NO: 1906618 - DNA, 17 bp, Homo sapiens
ggagggcggagaattct

SEQ ID NO: 1906619 - DNA, 14 bp, Homo sapiens
ggaggggagacttt

SEQ ID NO: 1906620 - DNA, 16 bp, Homo sapiens
ggaggggagactttga

SEQ ID NO: 1906621 - DNA, 14 bp, Homo sapiens
ggaggtgctggttc

SEQ ID NO: 1906622 - DNA, 18 bp, Homo sapiens
ggaggttcaatgagatgg

SEQ ID NO: 1906623 - DNA, 16 bp, Homo sapiens
ggagtcatttctgatt

SEQ ID NO: 1906624 - DNA, 16 bp, Homo sapiens
ggatcagatagcagga

SEQ ID NO: 1906625 - DNA, 18 bp, Homo sapiens
ggatccagctcaagggag

SEQ ID NO: 1906626 - DNA, 15 bp, Homo sapiens
ggatgatatggaggt

SEQ ID NO: 1906627 - DNA, 18 bp, Homo sapiens
ggatggaggaagaactga

SEQ ID NO: 1906628 - DNA, 15 bp, Homo sapiens
ggatggcagtggctg

SEQ ID NO: 1906629 - DNA, 19 bp, Homo sapiens
ggattaaaaccttaagagt

SEQ ID NO: 1906630 - DNA, 14 bp, Homo sapiens
ggattagtttagaa

SEQ ID NO: 1906631 - DNA, 18 bp, Homo sapiens
ggattagtttagaacagg

SEQ ID NO: 1906632 - DNA, 14 bp, Homo sapiens
ggattcctccccac

SEQ ID NO: 1906633 - DNA, 16 bp, Homo sapiens
ggattcctccccaccc

SEQ ID NO: 1906634 - DNA, 23 bp, Homo sapiens
ggatttctctagaggctggcaag

SEQ ID NO: 1906635 - DNA, 18 bp, Homo sapiens
ggatttctctttctctct

SEQ ID NO: 1906636 - DNA, 17 bp, Homo sapiens
ggcaaatccgaaatcag

SEQ ID NO: 1906637 - DNA, 19 bp, Homo sapiens
ggcaagaaaagagttaagg

SEQ ID NO: 1906638 - DNA, 20 bp, Homo sapiens
ggcaataaaagcccaggagc

SEQ ID NO: 1906639 - DNA, 15 bp, Homo sapiens
ggcaataaattttga

SEQ ID NO: 1906640 - DNA, 15 bp, Homo sapiens
ggcacagaaggctgg

SEQ ID NO: 1906641 - DNA, 16 bp, Homo sapiens
ggcacaggcagggcag

SEQ ID NO: 1906642 - DNA, 13 bp, Homo sapiens
ggcacagggcctg

SEQ ID NO: 1906643 - DNA, 14 bp, Homo sapiens
ggcacagggcctgg

SEQ ID NO: 1906644 - DNA, 15 bp, Homo sapiens
ggcacagggcctggc

SEQ ID NO: 1906645 - DNA, 14 bp, Homo sapiens
ggcaccagcaggca

SEQ ID NO: 1906646 - DNA, 23 bp, Homo sapiens
ggcacccacatcctggagtcagg

SEQ ID NO: 1906647 - DNA, 18 bp, Homo sapiens
ggcacgaaatggctgaag

SEQ ID NO: 1906648 - DNA, 19 bp, Homo sapiens
ggcacgtggttgagtgggg

SEQ ID NO: 1906649 - DNA, 21 bp, Homo sapiens
ggcagaagtaggggaagaata

SEQ ID NO: 1906650 - DNA, 24 bp, Homo sapiens
ggcagagagcgaccagcaggctcc

SEQ ID NO: 1906651 - DNA, 23 bp, Homo sapiens
ggcagcatgcaaacttggatcag

SEQ ID NO: 1906652 - DNA, 14 bp, Homo sapiens
ggcagcgccactgt

SEQ ID NO: 1906653 - DNA, 18 bp, Homo sapiens
ggcagcgccactgtccgc

SEQ ID NO: 1906654 - DNA, 16 bp, Homo sapiens
ggcagcttgggctggc

SEQ ID NO: 1906655 - DNA, 23 bp, Homo sapiens
ggcagcttgggctggcgggccct

SEQ ID NO: 1906656 - DNA, 13 bp, Homo sapiens
ggcaggaccagcc

SEQ ID NO: 1906657 - DNA, 12 bp, Homo sapiens
ggcaggccaggg

SEQ ID NO: 1906658 - DNA, 16 bp, Homo sapiens
ggcagggacagggccg

SEQ ID NO: 1906659 - DNA, 12 bp, Homo sapiens
ggcagggcaaga

SEQ ID NO: 1906660 - DNA, 17 bp, Homo sapiens
ggcagggcacagggcct

SEQ ID NO: 1906661 - DNA, 15 bp, Homo sapiens
ggcagggcaggacca

SEQ ID NO: 1906662 - DNA, 14 bp, Homo sapiens
ggcagtggctgtga

SEQ ID NO: 1906663 - DNA, 13 bp, Homo sapiens
ggcatccatgggg

SEQ ID NO: 1906664 - DNA, 21 bp, Homo sapiens
ggcatgaggccccgaggctcg

SEQ ID NO: 1906665 - DNA, 16 bp, Homo sapiens
ggcatgttggactctg

SEQ ID NO: 1906666 - DNA, 17 bp, Homo sapiens
ggcatttgtttctttct

SEQ ID NO: 1906667 - DNA, 22 bp, Homo sapiens
ggcattttcccccttggctctc

SEQ ID NO: 1906668 - DNA, 17 bp, Homo sapiens
ggccaagagtggcccca

SEQ ID NO: 1906669 - DNA, 20 bp, Homo sapiens
ggccaagagtggccccacct

SEQ ID NO: 1906670 - DNA, 21 bp, Homo sapiens
ggccaagagtggccccacctg

SEQ ID NO: 1906671 - DNA, 22 bp, Homo sapiens
ggccaagagtggccccacctgg

SEQ ID NO: 1906672 - DNA, 16 bp, Homo sapiens
ggccaatcagaagcta

SEQ ID NO: 1906673 - DNA, 14 bp, Homo sapiens
ggccaatgggctag

SEQ ID NO: 1906674 - DNA, 21 bp, Homo sapiens
ggccacctcctaaaaggccca

SEQ ID NO: 1906675 - DNA, 23 bp, Homo sapiens
ggccacctcctaaaaggcccaga

SEQ ID NO: 1906676 - DNA, 15 bp, Homo sapiens
ggccacctcttcctg

SEQ ID NO: 1906677 - DNA, 19 bp, Homo sapiens
ggccacctcttcctggccg

SEQ ID NO: 1906678 - DNA, 12 bp, Homo sapiens
ggccagcggccc

SEQ ID NO: 1906679 - DNA, 20 bp, Homo sapiens
ggccagcggccctcccaggc

SEQ ID NO: 1906680 - DNA, 18 bp, Homo sapiens
ggccaggaagtagcacag

SEQ ID NO: 1906681 - DNA, 15 bp, Homo sapiens
ggccagggaggagcc

SEQ ID NO: 1906682 - DNA, 12 bp, Homo sapiens
ggcccaccctgc

SEQ ID NO: 1906683 - DNA, 20 bp, Homo sapiens
ggcccagagagaagagcccc

SEQ ID NO: 1906684 - DNA, 22 bp, Homo sapiens
ggcccagagagaagagccccac

SEQ ID NO: 1906685 - DNA, 17 bp, Homo sapiens
ggcccatgtatggccag

SEQ ID NO: 1906686 - DNA, 19 bp, Homo sapiens
ggcccatgtatggccagga

SEQ ID NO: 1906687 - DNA, 20 bp, Homo sapiens
ggcccatgtatggccaggaa

SEQ ID NO: 1906688 - DNA, 21 bp, Homo sapiens
ggcccatgtatggccaggaag

SEQ ID NO: 1906689 - DNA, 13 bp, Homo sapiens
ggccccacctggc

SEQ ID NO: 1906690 - DNA, 21 bp, Homo sapiens
ggccccttctatgcccagctg

SEQ ID NO: 1906691 - DNA, 18 bp, Homo sapiens
ggcccggcatgaggcccc

SEQ ID NO: 1906692 - DNA, 14 bp, Homo sapiens
ggccctggcagccc

SEQ ID NO: 1906693 - DNA, 13 bp, Homo sapiens
ggccctgggcctc

SEQ ID NO: 1906694 - DNA, 19 bp, Homo sapiens
taatgtctagattttgaaa

SEQ ID NO: 1906695 - DNA, 20 bp, Homo sapiens
taatgtctagattttgaaaa

SEQ ID NO: 1906696 - DNA, 22 bp, Homo sapiens
taattattattcagaaatgact

SEQ ID NO: 1906697 - DNA, 12 bp, Homo sapiens
taattcaaagca

SEQ ID NO: 1906698 - DNA, 21 bp, Homo sapiens
taattcaaagcaccaaaataa

SEQ ID NO: 1906699 - DNA, 21 bp, Homo sapiens
taattcttttttattaatcac

SEQ ID NO: 1906700 - DNA, 19 bp, Homo sapiens
taattgacaggcgaaagaa

SEQ ID NO: 1906701 - DNA, 20 bp, Homo sapiens
taattggctttactattttt

SEQ ID NO: 1906702 - DNA, 15 bp, Homo sapiens
taattgtactttgaa

SEQ ID NO: 1906703 - DNA, 17 bp, Homo sapiens
taattgtactttgaaaa

SEQ ID NO: 1906704 - DNA, 22 bp, Homo sapiens
taattgtgtgaacttggaagca

SEQ ID NO: 1906705 - DNA, 22 bp, Homo sapiens
taattttcctttaatatgaaat

SEQ ID NO: 1906706 - DNA, 13 bp, Homo sapiens
taattttgtgtaa

SEQ ID NO: 1906707 - DNA, 19 bp, Homo sapiens
taattttgtgtaagaaata

SEQ ID NO: 1906708 - DNA, 19 bp, Homo sapiens
tacaaagggtctatcttgt

SEQ ID NO: 1906709 - DNA, 17 bp, Homo sapiens
tacaagtagttctgtat

SEQ ID NO: 1906710 - DNA, 18 bp, Homo sapiens
tacaagtagttctgtatt

SEQ ID NO: 1906711 - DNA, 19 bp, Homo sapiens
tacaagtagttctgtattt

SEQ ID NO: 1906712 - DNA, 15 bp, Homo sapiens
tacacaagtaaacat

SEQ ID NO: 1906713 - DNA, 16 bp, Homo sapiens
tacacaagtaaacatt

SEQ ID NO: 1906714 - DNA, 14 bp, Homo sapiens
tacacaggacaggg

SEQ ID NO: 1906715 - DNA, 21 bp, Homo sapiens
tacacaggacaggggttcctt

SEQ ID NO: 1906716 - DNA, 18 bp, Homo sapiens
tacaccacaagtatctaa

SEQ ID NO: 1906717 - DNA, 17 bp, Homo sapiens
tacactgcctgccttaa

SEQ ID NO: 1906718 - DNA, 23 bp, Homo sapiens
tacactggcaatggtagtttctg

SEQ ID NO: 1906719 - DNA, 16 bp, Homo sapiens
tacacttcagttatct

SEQ ID NO: 1906720 - DNA, 23 bp, Homo sapiens
tacagaccgaactgttgtataaa

SEQ ID NO: 1906721 - DNA, 19 bp, Homo sapiens
tacagactggatgtaccac

SEQ ID NO: 1906722 - DNA, 20 bp, Homo sapiens
tacagatgttttccactgag

SEQ ID NO: 1906723 - DNA, 16 bp, Homo sapiens
tacaggtttttttgac

SEQ ID NO: 1906724 - DNA, 23 bp, Homo sapiens
tacagtaagctggtttacagatg

SEQ ID NO: 1906725 - DNA, 19 bp, Homo sapiens
tacagtgtactttgttaaa

SEQ ID NO: 1906726 - DNA, 15 bp, Homo sapiens
tacatgctttgtgaa

SEQ ID NO: 1906727 - DNA, 16 bp, Homo sapiens
tacatgctttgtgaac

SEQ ID NO: 1906728 - DNA, 15 bp, Homo sapiens
tacatgtttgcagtg

SEQ ID NO: 1906729 - DNA, 16 bp, Homo sapiens
tacatttaaaacatta

SEQ ID NO: 1906730 - DNA, 19 bp, Homo sapiens
taccaaagagacagggccc

SEQ ID NO: 1906731 - DNA, 17 bp, Homo sapiens
taccaactgggcctctg

SEQ ID NO: 1906732 - DNA, 16 bp, Homo sapiens
taccccatggaccatg

SEQ ID NO: 1906733 - DNA, 19 bp, Homo sapiens
taccgaggacagcctgcct

SEQ ID NO: 1906734 - DNA, 14 bp, Homo sapiens
tacctctttggaaa

SEQ ID NO: 1906735 - DNA, 15 bp, Homo sapiens
tacctctttggaaaa

SEQ ID NO: 1906736 - DNA, 18 bp, Homo sapiens
tacctgaaggggttttct

SEQ ID NO: 1906737 - DNA, 19 bp, Homo sapiens
tacctgaaggggttttctt

SEQ ID NO: 1906738 - DNA, 21 bp, Homo sapiens
tacctgaaggggttttcttga

SEQ ID NO: 1906739 - DNA, 11 bp, Homo sapiens
tacctggaaaa

SEQ ID NO: 1906740 - DNA, 20 bp, Homo sapiens
tacctgtataatggagaatt

SEQ ID NO: 1906741 - DNA, 14 bp, Homo sapiens
taccttctgccaga

SEQ ID NO: 1906742 - DNA, 19 bp, Homo sapiens
taccttgtcattttggtct

SEQ ID NO: 1906743 - DNA, 17 bp, Homo sapiens
tacgaagttcaagatca

SEQ ID NO: 1906744 - DNA, 21 bp, Homo sapiens
tacgactcttttccaaacaca

SEQ ID NO: 1906745 - DNA, 12 bp, Homo sapiens
tacgtagttcta

SEQ ID NO: 1906746 - DNA, 13 bp, Homo sapiens
tacgtgtggcttg

SEQ ID NO: 1906747 - DNA, 22 bp, Homo sapiens
tactaaggatacaggctggaaa

SEQ ID NO: 1906748 - DNA, 17 bp, Homo sapiens
tactagaatcagataca

SEQ ID NO: 1906749 - DNA, 20 bp, Homo sapiens
tactcagggtctgatgttgg

SEQ ID NO: 1906750 - DNA, 19 bp, Homo sapiens
tactgaaatgctttagcat

SEQ ID NO: 1906751 - DNA, 19 bp, Homo sapiens
tactgaaccacttgtagat

SEQ ID NO: 1906752 - DNA, 16 bp, Homo sapiens
tactgcaaactattta

SEQ ID NO: 1906753 - DNA, 14 bp, Homo sapiens
tactgcattcttct

SEQ ID NO: 1906754 - DNA, 17 bp, Homo sapiens
tactgctttctgaatgt

SEQ ID NO: 1906755 - DNA, 15 bp, Homo sapiens
tactgtacatgggac

SEQ ID NO: 1906756 - DNA, 17 bp, Homo sapiens
tacttcaaaagtttgtt

SEQ ID NO: 1906757 - DNA, 14 bp, Homo sapiens
tacttgaaaaatgt

SEQ ID NO: 1906758 - DNA, 22 bp, Homo sapiens
tacttgaaaaatgttataactt

SEQ ID NO: 1906759 - DNA, 12 bp, Homo sapiens
tacttgaaccat

SEQ ID NO: 1906760 - DNA, 17 bp, Homo sapiens
tacttgaaccataaaat

SEQ ID NO: 1906761 - DNA, 19 bp, Homo sapiens
tacttgaaccataaaatgt

SEQ ID NO: 1906762 - DNA, 16 bp, Homo sapiens
tacttgagggccagga

SEQ ID NO: 1906763 - DNA, 17 bp, Homo sapiens
tacttgataacaatgtt

SEQ ID NO: 1906764 - DNA, 22 bp, Homo sapiens
tacttgctccattcatacacaa

SEQ ID NO: 1906765 - DNA, 15 bp, Homo sapiens
tacttgctttgagtt

SEQ ID NO: 1906766 - DNA, 18 bp, Homo sapiens
tactttctgaaaatttat

SEQ ID NO: 1906767 - DNA, 12 bp, Homo sapiens
tactttgaaaac

SEQ ID NO: 1906768 - DNA, 19 bp, Homo sapiens
tactttgaaaccagaaaat

SEQ ID NO: 1906769 - DNA, 14 bp, Homo sapiens
tactttgtaaattc

SEQ ID NO: 1906770 - DNA, 17 bp, Homo sapiens
tactttgtaaattctga

SEQ ID NO: 1906771 - DNA, 14 bp, Homo sapiens
tactttgtattgtc

SEQ ID NO: 1906772 - DNA, 18 bp, Homo sapiens
tactttgtattgtcctat

SEQ ID NO: 1906773 - DNA, 15 bp, Homo sapiens
tagaaactcaggaaa

SEQ ID NO: 1906774 - DNA, 12 bp, Homo sapiens
tagaacaggttt

SEQ ID NO: 1906775 - DNA, 20 bp, Homo sapiens
tagaacagtttacttggaaa

SEQ ID NO: 1906776 - DNA, 21 bp, Homo sapiens
tagaacttgttgctgattttg

SEQ ID NO: 1906777 - DNA, 14 bp, Homo sapiens
tagaactttgtata

SEQ ID NO: 1906778 - DNA, 17 bp, Homo sapiens
tagaagtacgtgttact

SEQ ID NO: 1906779 - DNA, 15 bp, Homo sapiens
tagaatccctgtgtt

SEQ ID NO: 1906780 - DNA, 16 bp, Homo sapiens
tagaatccctgtgtta

SEQ ID NO: 1906781 - DNA, 20 bp, Homo sapiens
tagaatccctgtgttaattt

SEQ ID NO: 1906782 - DNA, 19 bp, Homo sapiens
tagaatggcttctctgttt

SEQ ID NO: 1906783 - DNA, 22 bp, Homo sapiens
tagaattacaccacaagtatct

SEQ ID NO: 1906784 - DNA, 19 bp, Homo sapiens
tagacacttgagttaactt

SEQ ID NO: 1906785 - DNA, 21 bp, Homo sapiens
tagacacttgagttaactttt

SEQ ID NO: 1906786 - DNA, 22 bp, Homo sapiens
tagacattttgaaataaaaatg

SEQ ID NO: 1906787 - DNA, 17 bp, Homo sapiens
tagaccaaaagcaacat

SEQ ID NO: 1906788 - DNA, 15 bp, Homo sapiens
tagacggaacagtgt

SEQ ID NO: 1906789 - DNA, 20 bp, Homo sapiens
tagactgccacaaggaagaa

SEQ ID NO: 1906790 - DNA, 16 bp, Homo sapiens
tagactgccagctctt

SEQ ID NO: 1906791 - DNA, 12 bp, Homo sapiens
tagacttgaaaa

SEQ ID NO: 1906792 - DNA, 24 bp, Homo sapiens
tagaggggccagcggccctcccag

SEQ ID NO: 1906793 - DNA, 21 bp, Homo sapiens
tagagggtgatggaacaagag

SEQ ID NO: 1906794 - DNA, 13 bp, Homo sapiens
tagaggtgcatgc

SEQ ID NO: 1906795 - DNA, 21 bp, Homo sapiens
tagagtacactgcctgcctta

SEQ ID NO: 1906796 - DNA, 15 bp, Homo sapiens
tagagtctgagggct

SEQ ID NO: 1906797 - DNA, 19 bp, Homo sapiens
tagatcatagttttattta

SEQ ID NO: 1906798 - DNA, 16 bp, Homo sapiens
tagatgtaattttgtg

SEQ ID NO: 1906799 - DNA, 14 bp, Homo sapiens
tagattttgaaaaa

SEQ ID NO: 1906800 - DNA, 20 bp, Homo sapiens
tagcagctgactttcaaagt

SEQ ID NO: 1906801 - DNA, 18 bp, Homo sapiens
tagcatacattcagacgt

SEQ ID NO: 1906802 - DNA, 17 bp, Homo sapiens
tagcatcacttaaaaca

SEQ ID NO: 1906803 - DNA, 15 bp, Homo sapiens
tagcatttggtgctt

SEQ ID NO: 1906804 - DNA, 15 bp, Homo sapiens
tagccaaaatgtgag

SEQ ID NO: 1906805 - DNA, 14 bp, Homo sapiens
tagccacctgagtt

SEQ ID NO: 1906806 - DNA, 17 bp, Homo sapiens
tagccacctgagttcct

SEQ ID NO: 1906807 - DNA, 15 bp, Homo sapiens
tagccagtgaacata

SEQ ID NO: 1906808 - DNA, 17 bp, Homo sapiens
tagccatgaggaggcag

SEQ ID NO: 1906809 - DNA, 18 bp, Homo sapiens
tagccgtgtcacgggcat

SEQ ID NO: 1906810 - DNA, 20 bp, Homo sapiens
tagcctcacgaaactggaat

SEQ ID NO: 1906811 - DNA, 19 bp, Homo sapiens
tagctaataacatgtgaaa

SEQ ID NO: 1906812 - DNA, 21 bp, Homo sapiens
tagctacgtttactcacagcc

SEQ ID NO: 1906813 - DNA, 12 bp, Homo sapiens
tagctcaataaa

SEQ ID NO: 1906814 - DNA, 17 bp, Homo sapiens
tagctcgtcctcactgg

SEQ ID NO: 1906815 - DNA, 13 bp, Homo sapiens
taggaaaagatat

SEQ ID NO: 1906816 - DNA, 16 bp, Homo sapiens
taggcaaataagcact

SEQ ID NO: 1906817 - DNA, 20 bp, Homo sapiens
taggccccagcaacacgtca

SEQ ID NO: 1906818 - DNA, 19 bp, Homo sapiens
taggcctcaggtgaaactc

SEQ ID NO: 1906819 - DNA, 12 bp, Homo sapiens
taggcttggctc

SEQ ID NO: 1906820 - DNA, 20 bp, Homo sapiens
taggctttatttataaaata

SEQ ID NO: 1906821 - DNA, 21 bp, Homo sapiens
taggctttatttataaaataa

SEQ ID NO: 1906822 - DNA, 15 bp, Homo sapiens
tagggaccagaacca

SEQ ID NO: 1906823 - DNA, 15 bp, Homo sapiens
taggggaagaataat

SEQ ID NO: 1906824 - DNA, 15 bp, Homo sapiens
taggtagagtctgag

SEQ ID NO: 1906825 - DNA, 22 bp, Homo sapiens
taggttattttgatgtaaagat

SEQ ID NO: 1906826 - DNA, 16 bp, Homo sapiens
tctactctaggactgg

SEQ ID NO: 1906827 - DNA, 20 bp, Homo sapiens
tctactctaggactgggccc

SEQ ID NO: 1906828 - DNA, 22 bp, Homo sapiens
tctagaaagagccttaatgtat

SEQ ID NO: 1906829 - DNA, 15 bp, Homo sapiens
tctagattttgaaaa

SEQ ID NO: 1906830 - DNA, 16 bp, Homo sapiens
tctagattttgaaaaa

SEQ ID NO: 1906831 - DNA, 18 bp, Homo sapiens
tctagattttgaaaaatt

SEQ ID NO: 1906832 - DNA, 18 bp, Homo sapiens
tctagggagccctgggcc

SEQ ID NO: 1906833 - DNA, 19 bp, Homo sapiens
tctagtaataaagactcta

SEQ ID NO: 1906834 - DNA, 19 bp, Homo sapiens
tctagtattctttattatt

SEQ ID NO: 1906835 - DNA, 23 bp, Homo sapiens
tctagtctggaactgctgctgac

SEQ ID NO: 1906836 - DNA, 14 bp, Homo sapiens
tctatcttgtaaat

SEQ ID NO: 1906837 - DNA, 15 bp, Homo sapiens
tctatcttgtaaata

SEQ ID NO: 1906838 - DNA, 15 bp, Homo sapiens
tctatttcatcagaa

SEQ ID NO: 1906839 - DNA, 15 bp, Homo sapiens
tctatttctgaaaga

SEQ ID NO: 1906840 - DNA, 13 bp, Homo sapiens
tctatttgtgtaa

SEQ ID NO: 1906841 - DNA, 13 bp, Homo sapiens
tctcaatttttgg

SEQ ID NO: 1906842 - DNA, 22 bp, Homo sapiens
tctcaatttttggttgaataaa

SEQ ID NO: 1906843 - DNA, 22 bp, Homo sapiens
tctcacagacaggacccctgca

SEQ ID NO: 1906844 - DNA, 18 bp, Homo sapiens
tctcacagctatgcaaaa

SEQ ID NO: 1906845 - DNA, 16 bp, Homo sapiens
tctcaccagcccgcca

SEQ ID NO: 1906846 - DNA, 21 bp, Homo sapiens
tctcaccatttccccagggca

SEQ ID NO: 1906847 - DNA, 17 bp, Homo sapiens
tctcactctcttccttt

SEQ ID NO: 1906848 - DNA, 20 bp, Homo sapiens
tctcactctcttcctttcat

SEQ ID NO: 1906849 - DNA, 20 bp, Homo sapiens
tctccatccctctcctctgc

SEQ ID NO: 1906850 - DNA, 17 bp, Homo sapiens
tctccatttcactggct

SEQ ID NO: 1906851 - DNA, 21 bp, Homo sapiens
tctcccaccctttctgccagg

SEQ ID NO: 1906852 - DNA, 22 bp, Homo sapiens
tctcccaccctttctgccaggg

SEQ ID NO: 1906853 - DNA, 15 bp, Homo sapiens
tctcccttttccatg

SEQ ID NO: 1906854 - DNA, 16 bp, Homo sapiens
tctccgcccctgagcc

SEQ ID NO: 1906855 - DNA, 18 bp, Homo sapiens
tctccgcccctgagccca

SEQ ID NO: 1906856 - DNA, 14 bp, Homo sapiens
tctcctgcagcctg

SEQ ID NO: 1906857 - DNA, 13 bp, Homo sapiens
tctcgctaaagag

SEQ ID NO: 1906858 - DNA, 21 bp, Homo sapiens
tctcgctctgttgcccaggct

SEQ ID NO: 1906859 - DNA, 12 bp, Homo sapiens
tctcggcagagg

SEQ ID NO: 1906860 - DNA, 16 bp, Homo sapiens
tctcgtactctctctc

SEQ ID NO: 1906861 - DNA, 21 bp, Homo sapiens
tctcgtactctctctcttttc

SEQ ID NO: 1906862 - DNA, 14 bp, Homo sapiens
tctctaacagtgga

SEQ ID NO: 1906863 - DNA, 14 bp, Homo sapiens
tctctagaggctgg

SEQ ID NO: 1906864 - DNA, 18 bp, Homo sapiens
tctctagaggctggcaag

SEQ ID NO: 1906865 - DNA, 16 bp, Homo sapiens
tctctagtgctgtgaa

SEQ ID NO: 1906866 - DNA, 15 bp, Homo sapiens
tctctcacagacagg

SEQ ID NO: 1906867 - DNA, 17 bp, Homo sapiens
tctctcacagacaggac

SEQ ID NO: 1906868 - DNA, 20 bp, Homo sapiens
tctctcactctcttcctttc

SEQ ID NO: 1906869 - DNA, 14 bp, Homo sapiens
tctctcatttgtgt

SEQ ID NO: 1906870 - DNA, 21 bp, Homo sapiens
tctctccatccctctcctctg

SEQ ID NO: 1906871 - DNA, 22 bp, Homo sapiens
tctctctcactctcttcctttc

SEQ ID NO: 1906872 - DNA, 12 bp, Homo sapiens
tctctctctcca

SEQ ID NO: 1906873 - DNA, 14 bp, Homo sapiens
tctctgaaaacaag

SEQ ID NO: 1906874 - DNA, 13 bp, Homo sapiens
tctcttcctttca

SEQ ID NO: 1906875 - DNA, 18 bp, Homo sapiens
tctcttcctttcattcta

SEQ ID NO: 1906876 - DNA, 22 bp, Homo sapiens
tctcttgcctcagcttccccag

SEQ ID NO: 1906877 - DNA, 23 bp, Homo sapiens
tctctttctaagagacctgaact

SEQ ID NO: 1906878 - DNA, 16 bp, Homo sapiens
tctctttctctctcac

SEQ ID NO: 1906879 - DNA, 16 bp, Homo sapiens
tctcttttccctcctt

SEQ ID NO: 1906880 - DNA, 20 bp, Homo sapiens
tctcttttccctcctttcct

SEQ ID NO: 1906881 - DNA, 13 bp, Homo sapiens
tctgaaaacaaga

SEQ ID NO: 1906882 - DNA, 19 bp, Homo sapiens
tctgaaaagctgtgtactt

SEQ ID NO: 1906883 - DNA, 21 bp, Homo sapiens
tctgaaaatttatataactgt

SEQ ID NO: 1906884 - DNA, 21 bp, Homo sapiens
tctgaaatacaaccagaaaca

SEQ ID NO: 1906885 - DNA, 19 bp, Homo sapiens
tctgactttagcctaccta

SEQ ID NO: 1906886 - DNA, 23 bp, Homo sapiens
tctgactttgaatttatataaag

SEQ ID NO: 1906887 - DNA, 22 bp, Homo sapiens
tctgagcaagaggattttgcgt

SEQ ID NO: 1906888 - DNA, 23 bp, Homo sapiens
tctgagttgttaccccaagcgcc

SEQ ID NO: 1906889 - DNA, 15 bp, Homo sapiens
tctgatatcagcact

SEQ ID NO: 1906890 - DNA, 13 bp, Homo sapiens
tctgatctgtgca

SEQ ID NO: 1906891 - DNA, 20 bp, Homo sapiens
tctgatctgtgcagggtatt

SEQ ID NO: 1906892 - DNA, 22 bp, Homo sapiens
tctgatctgtgcagggtattaa

SEQ ID NO: 1906893 - DNA, 14 bp, Homo sapiens
tctgattccagcac

SEQ ID NO: 1906894 - DNA, 12 bp, Homo sapiens
tctgccacagca

SEQ ID NO: 1906895 - DNA, 15 bp, Homo sapiens
tctgccaccagcgcc

SEQ ID NO: 1906896 - DNA, 21 bp, Homo sapiens
tctgccaccagcgcccccact

SEQ ID NO: 1906897 - DNA, 22 bp, Homo sapiens
tctgccaccagcgcccccactc

SEQ ID NO: 1906898 - DNA, 10 bp, Homo sapiens
tctgccacct

SEQ ID NO: 1906899 - DNA, 12 bp, Homo sapiens
tctgccacctgc

SEQ ID NO: 1906900 - DNA, 15 bp, Homo sapiens
tctgccacctgcaca

SEQ ID NO: 1906901 - DNA, 14 bp, Homo sapiens
tctgccctctgctc

SEQ ID NO: 1906902 - DNA, 15 bp, Homo sapiens
tctgctgcagagcag

SEQ ID NO: 1906903 - DNA, 16 bp, Homo sapiens
tctgctgcagagcagt

SEQ ID NO: 1906904 - DNA, 18 bp, Homo sapiens
tctgctgcatccccttcc

SEQ ID NO: 1906905 - DNA, 12 bp, Homo sapiens
tctgctttagac

SEQ ID NO: 1906906 - DNA, 17 bp, Homo sapiens
tctgctttagacttgaa

SEQ ID NO: 1906907 - DNA, 14 bp, Homo sapiens
tctggaccccatct

SEQ ID NO: 1906908 - DNA, 18 bp, Homo sapiens
tctggaccccatctgtga

SEQ ID NO: 1906909 - DNA, 21 bp, Homo sapiens
tctggaccccatctgtgaata

SEQ ID NO: 1906910 - DNA, 14 bp, Homo sapiens
tctggcacagcctg

SEQ ID NO: 1906911 - DNA, 16 bp, Homo sapiens
tctggcacagcctgca

SEQ ID NO: 1906912 - DNA, 17 bp, Homo sapiens
tctggcacagcctgcac

SEQ ID NO: 1906913 - DNA, 22 bp, Homo sapiens
tctggcccactgtgcagtggag

SEQ ID NO: 1906914 - DNA, 15 bp, Homo sapiens
tctggggaccagctt

SEQ ID NO: 1906915 - DNA, 23 bp, Homo sapiens
tctggggaccagcttggctcagg

SEQ ID NO: 1906916 - DNA, 14 bp, Homo sapiens
tctggtggcccctt

SEQ ID NO: 1906917 - DNA, 13 bp, Homo sapiens
tctgtatttgaaa

SEQ ID NO: 1906918 - DNA, 20 bp, Homo sapiens
tctgtcacttgcattccact

SEQ ID NO: 1906919 - DNA, 11 bp, Homo sapiens
tctgtgaataa

SEQ ID NO: 1906920 - DNA, 16 bp, Homo sapiens
tctgtgaataagccat

SEQ ID NO: 1906921 - DNA, 17 bp, Homo sapiens
tctgtggaaaaataaag

SEQ ID NO: 1906922 - DNA, 21 bp, Homo sapiens
tctgtgtggccagcagcctct

SEQ ID NO: 1906923 - DNA, 18 bp, Homo sapiens
tctgttggcaaatttgtg

SEQ ID NO: 1906924 - DNA, 18 bp, Homo sapiens
tcttaatggatgaaatca

SEQ ID NO: 1906925 - DNA, 17 bp, Homo sapiens
tcttagatcatagtttt

SEQ ID NO: 1906926 - DNA, 22 bp, Homo sapiens
tcttcacatgtaactttcgtaa

SEQ ID NO: 1906927 - DNA, 18 bp, Homo sapiens
tcttcagactgaggcctt

SEQ ID NO: 1906928 - DNA, 20 bp, Homo sapiens
tcttcagactgaggcctttt

SEQ ID NO: 1906929 - DNA, 17 bp, Homo sapiens
tcttccagaacctagga

SEQ ID NO: 1906930 - DNA, 21 bp, Homo sapiens
tcttccagaacctaggaggat

SEQ ID NO: 1906931 - DNA, 12 bp, Homo sapiens
tcttcctggccg

SEQ ID NO: 1906932 - DNA, 11 bp, Homo sapiens
tcttcctttcc

SEQ ID NO: 1906933 - DNA, 13 bp, Homo sapiens
tcttcctttcctt

SEQ ID NO: 1906934 - DNA, 22 bp, Homo sapiens
tcttcctttcctttcctttctt

SEQ ID NO: 1906935 - DNA, 15 bp, Homo sapiens
tcttctcattacttg

SEQ ID NO: 1906936 - DNA, 17 bp, Homo sapiens
tcttctcattacttgtt

SEQ ID NO: 1906937 - DNA, 17 bp, Homo sapiens
tcttctcctgcagcctg

SEQ ID NO: 1906938 - DNA, 19 bp, Homo sapiens
tcttctgatcactgaaata

SEQ ID NO: 1906939 - DNA, 17 bp, Homo sapiens
tcttgcaaaattcctga

SEQ ID NO: 1906940 - DNA, 16 bp, Homo sapiens
tcttgcgggtctgtca

SEQ ID NO: 1906941 - DNA, 20 bp, Homo sapiens
tcttggcaataaattttgaa

SEQ ID NO: 1906942 - DNA, 24 bp, Homo sapiens
tcttggcaataaattttgaaaagt

SEQ ID NO: 1906943 - DNA, 16 bp, Homo sapiens
tcttggccttactgta

SEQ ID NO: 1906944 - DNA, 15 bp, Homo sapiens
tcttgggactgctgt

SEQ ID NO: 1906945 - DNA, 14 bp, Homo sapiens
tctttaagaaagta

SEQ ID NO: 1906946 - DNA, 19 bp, Homo sapiens
tctttattatttttctctc

SEQ ID NO: 1906947 - DNA, 13 bp, Homo sapiens
tctttcccttctt

SEQ ID NO: 1906948 - DNA, 11 bp, Homo sapiens
tctttcctttc

SEQ ID NO: 1906949 - DNA, 16 bp, Homo sapiens
tctttctctctcactc

SEQ ID NO: 1906950 - DNA, 13 bp, Homo sapiens
tctttctttttaa

SEQ ID NO: 1906951 - DNA, 14 bp, Homo sapiens
tctttgcagttccc

SEQ ID NO: 1906952 - DNA, 14 bp, Homo sapiens
tctttgctgtttgc

SEQ ID NO: 1906953 - DNA, 21 bp, Homo sapiens
tctttggaaaaggaaggtagt

SEQ ID NO: 1906954 - DNA, 14 bp, Homo sapiens
tcttttgctttcct

SEQ ID NO: 1906955 - DNA, 15 bp, Homo sapiens
tcttttgctttcctt

SEQ ID NO: 1906956 - DNA, 19 bp, Homo sapiens
tcttttgttactcttggga

SEQ ID NO: 1906957 - DNA, 21 bp, Homo sapiens
tgaaaaaaaaaatgctgaaca

SEQ ID NO: 1906958 - DNA, 21 bp, Homo sapiens
tgaaaacaagagactgcttga

SEQ ID NO: 1906959 - DNA, 21 bp, Homo sapiens
tgatctgtgcagggtattaac

SEQ ID NO: 1906960 - DNA, 18 bp, Homo sapiens
tgatctgtgtaaaatctg

SEQ ID NO: 1906961 - DNA, 16 bp, Homo sapiens
tgatgaagctgaggct

SEQ ID NO: 1906962 - DNA, 23 bp, Homo sapiens
tgatgactgaaaatgaactgtaa

SEQ ID NO: 1906963 - DNA, 23 bp, Homo sapiens
tgatgcagacaaatgaaataata

SEQ ID NO: 1906964 - DNA, 20 bp, Homo sapiens
tgatggaatttttttgtacg

SEQ ID NO: 1906965 - DNA, 17 bp, Homo sapiens
tgatggcttatgatagc

SEQ ID NO: 1906966 - DNA, 18 bp, Homo sapiens
tgatgtcagcagttgctg

SEQ ID NO: 1906967 - DNA, 16 bp, Homo sapiens
tgatgttgtaaaatga

SEQ ID NO: 1906968 - DNA, 15 bp, Homo sapiens
tgattaaaaatatca

SEQ ID NO: 1906969 - DNA, 15 bp, Homo sapiens
tgattaaaatgagtt

SEQ ID NO: 1906970 - DNA, 12 bp, Homo sapiens
tgattaatgcat

SEQ ID NO: 1906971 - DNA, 20 bp, Homo sapiens
tgattattttcagaagctga

SEQ ID NO: 1906972 - DNA, 14 bp, Homo sapiens
tgattgaagaaaca

SEQ ID NO: 1906973 - DNA, 18 bp, Homo sapiens
tgattgaagaaacagcta

SEQ ID NO: 1906974 - DNA, 12 bp, Homo sapiens
tgatttattaac

SEQ ID NO: 1906975 - DNA, 16 bp, Homo sapiens
tgatttattaacttaa

SEQ ID NO: 1906976 - DNA, 22 bp, Homo sapiens
tgatttattaacttaataatca

SEQ ID NO: 1906977 - DNA, 14 bp, Homo sapiens
tgatttgagatttt

SEQ ID NO: 1906978 - DNA, 23 bp, Homo sapiens
tgatttgtacagattctttatta

SEQ ID NO: 1906979 - DNA, 16 bp, Homo sapiens
tgattttgaccttgta

SEQ ID NO: 1906980 - DNA, 20 bp, Homo sapiens
tgatttttttttttaatcta

SEQ ID NO: 1906981 - DNA, 14 bp, Homo sapiens
tgcaaaattcctga

SEQ ID NO: 1906982 - DNA, 18 bp, Homo sapiens
tgcaaacaactgaaatgt

SEQ ID NO: 1906983 - DNA, 16 bp, Homo sapiens
tgcaaacagaagtgca

SEQ ID NO: 1906984 - DNA, 20 bp, Homo sapiens
tgcaaacagaagtgcatcct

SEQ ID NO: 1906985 - DNA, 23 bp, Homo sapiens
tgcaaacagaagtgcatcctgat

SEQ ID NO: 1906986 - DNA, 16 bp, Homo sapiens
tgcaaaggaaatacca

SEQ ID NO: 1906987 - DNA, 18 bp, Homo sapiens
tgcaaattccatagctca

SEQ ID NO: 1906988 - DNA, 16 bp, Homo sapiens
tgcaaccatttgaaac

SEQ ID NO: 1906989 - DNA, 13 bp, Homo sapiens
tgcaatgccccct

SEQ ID NO: 1906990 - DNA, 16 bp, Homo sapiens
tgcaatgccccctccc

SEQ ID NO: 1906991 - DNA, 18 bp, Homo sapiens
tgcaatgccccctcccct

SEQ ID NO: 1906992 - DNA, 21 bp, Homo sapiens
tgcaatgccccctcccctcct

SEQ ID NO: 1906993 - DNA, 22 bp, Homo sapiens
tgcaatttttctttcttttgtt

SEQ ID NO: 1906994 - DNA, 18 bp, Homo sapiens
tgcacacacctcatgcta

SEQ ID NO: 1906995 - DNA, 17 bp, Homo sapiens
tgcaccatactcatgca

SEQ ID NO: 1906996 - DNA, 22 bp, Homo sapiens
tgcacgctgggcaatgagaatc

SEQ ID NO: 1906997 - DNA, 19 bp, Homo sapiens
tgcactccagcctgggcga

SEQ ID NO: 1906998 - DNA, 12 bp, Homo sapiens
tgcactgactct

SEQ ID NO: 1906999 - DNA, 21 bp, Homo sapiens
tgcactgctcacttttttgaa

SEQ ID NO: 1907000 - DNA, 22 bp, Homo sapiens
tgcacttgggggctcagcaagg

SEQ ID NO: 1907001 - DNA, 18 bp, Homo sapiens
tgcagcctccgcttccct

SEQ ID NO: 1907002 - DNA, 18 bp, Homo sapiens
tgcagctcagaaccacag

SEQ ID NO: 1907003 - DNA, 19 bp, Homo sapiens
tgcagctcagaaccacagc

SEQ ID NO: 1907004 - DNA, 20 bp, Homo sapiens
tgcagctcagaaccacagca

SEQ ID NO: 1907005 - DNA, 14 bp, Homo sapiens
tgcagctgtcacca

SEQ ID NO: 1907006 - DNA, 12 bp, Homo sapiens
tgcaggcccacc

SEQ ID NO: 1907007 - DNA, 22 bp, Homo sapiens
tgcagggcacagaaggctgggg

SEQ ID NO: 1907008 - DNA, 16 bp, Homo sapiens
tgcagtatctgtgaac

SEQ ID NO: 1907009 - DNA, 13 bp, Homo sapiens
tgcagtcactgca

SEQ ID NO: 1907010 - DNA, 10 bp, Homo sapiens
tgcagtgtct

SEQ ID NO: 1907011 - DNA, 12 bp, Homo sapiens
tgcagtgtctta

SEQ ID NO: 1907012 - DNA, 15 bp, Homo sapiens
tgcatataacttata

SEQ ID NO: 1907013 - DNA, 16 bp, Homo sapiens
tgcatataacttatat

SEQ ID NO: 1907014 - DNA, 22 bp, Homo sapiens
tgcatataacttatattgtaag

SEQ ID NO: 1907015 - DNA, 12 bp, Homo sapiens
tgcatcagttct

SEQ ID NO: 1907016 - DNA, 12 bp, Homo sapiens
tgcatcttaaaa

SEQ ID NO: 1907017 - DNA, 16 bp, Homo sapiens
tgcatgggtcagggtg

SEQ ID NO: 1907018 - DNA, 15 bp, Homo sapiens
tgcattaaaagaaaa

SEQ ID NO: 1907019 - DNA, 16 bp, Homo sapiens
tgcattaaaagaaaat

SEQ ID NO: 1907020 - DNA, 16 bp, Homo sapiens
tgcattccactttttg

SEQ ID NO: 1907021 - DNA, 23 bp, Homo sapiens
tgcattccactttttgttacata

SEQ ID NO: 1907022 - DNA, 19 bp, Homo sapiens
tgcatttacgcctgtaaat

SEQ ID NO: 1907023 - DNA, 21 bp, Homo sapiens
tgcatttacgcctgtaaatgt

SEQ ID NO: 1907024 - DNA, 22 bp, Homo sapiens
tgcatttacgcctgtaaatgta

SEQ ID NO: 1907025 - DNA, 21 bp, Homo sapiens
tgcatttagggagtattctaa

SEQ ID NO: 1907026 - DNA, 21 bp, Homo sapiens
tgccaatcattgcaaacaact

SEQ ID NO: 1907027 - DNA, 18 bp, Homo sapiens
tgccacaaggaagaaatt

SEQ ID NO: 1907028 - DNA, 15 bp, Homo sapiens
tgccacagcaaggct

SEQ ID NO: 1907029 - DNA, 17 bp, Homo sapiens
tgccaccagcgccccca

SEQ ID NO: 1907030 - DNA, 20 bp, Homo sapiens
tgccaccagcgcccccactc

SEQ ID NO: 1907031 - DNA, 24 bp, Homo sapiens
tgccaccagcgcccccactcctcc

SEQ ID NO: 1907032 - DNA, 18 bp, Homo sapiens
tgccacctccccttgcca

SEQ ID NO: 1907033 - DNA, 18 bp, Homo sapiens
tgccagctcttcctagct

SEQ ID NO: 1907034 - DNA, 17 bp, Homo sapiens
tgccagctgctgagccg

SEQ ID NO: 1907035 - DNA, 19 bp, Homo sapiens
tgccagcttctttgcagct

SEQ ID NO: 1907036 - DNA, 18 bp, Homo sapiens
tgccaggattgtcactcc

SEQ ID NO: 1907037 - DNA, 14 bp, Homo sapiens
tgccaggcacaggc

SEQ ID NO: 1907038 - DNA, 20 bp, Homo sapiens
tgccatgtgcttctgccacc

SEQ ID NO: 1907039 - DNA, 14 bp, Homo sapiens
tgcccagaatactg

SEQ ID NO: 1907040 - DNA, 19 bp, Homo sapiens
tgcccagaatactgatgga

SEQ ID NO: 1907041 - DNA, 15 bp, Homo sapiens
tgcccaggctggagt

SEQ ID NO: 1907042 - DNA, 18 bp, Homo sapiens
tgcccaggctggagtgca

SEQ ID NO: 1907043 - DNA, 20 bp, Homo sapiens
tgccccttgggcctcccact

SEQ ID NO: 1907044 - DNA, 13 bp, Homo sapiens
tgcccgccaccac

SEQ ID NO: 1907045 - DNA, 23 bp, Homo sapiens
tgccctccgccccgtccccccat

SEQ ID NO: 1907046 - DNA, 16 bp, Homo sapiens
tgccgcatctcacagc

SEQ ID NO: 1907047 - DNA, 17 bp, Homo sapiens
tgccggaaagagagctg

SEQ ID NO: 1907048 - DNA, 15 bp, Homo sapiens
tgcctcaataaagct

SEQ ID NO: 1907049 - DNA, 17 bp, Homo sapiens
tgcctcagcttccccag

SEQ ID NO: 1907050 - DNA, 20 bp, Homo sapiens
tgcctcattttcacagcact

SEQ ID NO: 1907051 - DNA, 17 bp, Homo sapiens
tgcctcctcctgccctc

SEQ ID NO: 1907052 - DNA, 20 bp, Homo sapiens
tgcctcctcctgccctccgc

SEQ ID NO: 1907053 - DNA, 20 bp, Homo sapiens
tgcctctccgcccctgagcc

SEQ ID NO: 1907054 - DNA, 16 bp, Homo sapiens
tgcctctgccacagca

SEQ ID NO: 1907055 - DNA, 20 bp, Homo sapiens
tgcctctggctctacacata

SEQ ID NO: 1907056 - DNA, 19 bp, Homo sapiens
tgcctgacagagggatgga

SEQ ID NO: 1907057 - DNA, 11 bp, Homo sapiens
tgcctgcctta

SEQ ID NO: 1907058 - DNA, 21 bp, Homo sapiens
tgccttaagtgaggaaatcaa

SEQ ID NO: 1907059 - DNA, 18 bp, Homo sapiens
tgccttctggttacaatt

SEQ ID NO: 1907060 - DNA, 21 bp, Homo sapiens
tgcctttatctaaggaaacat

SEQ ID NO: 1907061 - DNA, 13 bp, Homo sapiens
tgcgcagttgctg

SEQ ID NO: 1907062 - DNA, 15 bp, Homo sapiens
tgcggccttttcatg

SEQ ID NO: 1907063 - DNA, 15 bp, Homo sapiens
tgcggggcagcaggg

SEQ ID NO: 1907064 - DNA, 14 bp, Homo sapiens
tgcgggtctgtcag

SEQ ID NO: 1907065 - DNA, 15 bp, Homo sapiens
tgcgtagcatttgct

SEQ ID NO: 1907066 - DNA, 15 bp, Homo sapiens
tgcgtcataaggaga

SEQ ID NO: 1907067 - DNA, 23 bp, Homo sapiens
tgctagcctcacgaaactggaat

SEQ ID NO: 1907068 - DNA, 16 bp, Homo sapiens
tgctagtcttaagaac

SEQ ID NO: 1907069 - DNA, 18 bp, Homo sapiens
tgctatcagttttatagc

SEQ ID NO: 1907070 - DNA, 21 bp, Homo sapiens
tgctatgatgttagttttcct

SEQ ID NO: 1907071 - DNA, 23 bp, Homo sapiens
tgctcctagagtatattcctctg

SEQ ID NO: 1907072 - DNA, 18 bp, Homo sapiens
tgctgaaagatatgtata

SEQ ID NO: 1907073 - DNA, 19 bp, Homo sapiens
tgctgaacattgcatataa

SEQ ID NO: 1907074 - DNA, 22 bp, Homo sapiens
tgctgacccaacagcctctgtg

SEQ ID NO: 1907075 - DNA, 23 bp, Homo sapiens
tgctgacccatgggcaggagact

SEQ ID NO: 1907076 - DNA, 15 bp, Homo sapiens
tgctgacccctgtgt

SEQ ID NO: 1907077 - DNA, 16 bp, Homo sapiens
tgctgacccctgtgtg

SEQ ID NO: 1907078 - DNA, 22 bp, Homo sapiens
tgctgacccctgtgtgacatca

SEQ ID NO: 1907079 - DNA, 21 bp, Homo sapiens
tgctgagtctgttctggtaat

SEQ ID NO: 1907080 - DNA, 17 bp, Homo sapiens
tgctgcatccccttcca

SEQ ID NO: 1907081 - DNA, 18 bp, Homo sapiens
tgctgcatccccttccag

SEQ ID NO: 1907082 - DNA, 22 bp, Homo sapiens
tgctgcatccccttccagctcc

SEQ ID NO: 1907083 - DNA, 21 bp, Homo sapiens
tgctgcatgggttaattgaga

SEQ ID NO: 1907084 - DNA, 23 bp, Homo sapiens
tgctgcatgggttaattgagaat

SEQ ID NO: 1907085 - DNA, 17 bp, Homo sapiens
tgctgctgacccctgtg

SEQ ID NO: 1907086 - DNA, 16 bp, Homo sapiens
tgctggccggacaccc

SEQ ID NO: 1907087 - DNA, 14 bp, Homo sapiens
tgctgggaggtccc

SEQ ID NO: 1907088 - DNA, 21 bp, Homo sapiens
tgctgggaggtcccagggccc

SEQ ID NO: 1907089 - DNA, 13 bp, Homo sapiens
tgctgggcccctg

SEQ ID NO: 1907090 - DNA, 17 bp, Homo sapiens
ttcactttcaaaaacat

SEQ ID NO: 1907091 - DNA, 22 bp, Homo sapiens
ttcagaaaactgagctgcaatc

SEQ ID NO: 1907092 - DNA, 19 bp, Homo sapiens
ttcagacatttttggaaat

SEQ ID NO: 1907093 - DNA, 19 bp, Homo sapiens
ttcagcttctataagtgtg

SEQ ID NO: 1907094 - DNA, 23 bp, Homo sapiens
ttcaggggctagctaagccaaga

SEQ ID NO: 1907095 - DNA, 19 bp, Homo sapiens
ttcataagaggttctaact

SEQ ID NO: 1907096 - DNA, 20 bp, Homo sapiens
ttcataagaggttctaactt

SEQ ID NO: 1907097 - DNA, 18 bp, Homo sapiens
ttcataataaatagacac

SEQ ID NO: 1907098 - DNA, 19 bp, Homo sapiens
ttcataataaatagacact

SEQ ID NO: 1907099 - DNA, 17 bp, Homo sapiens
ttcatattttaaacaga

SEQ ID NO: 1907100 - DNA, 21 bp, Homo sapiens
ttcatattttaaacagaggat

SEQ ID NO: 1907101 - DNA, 22 bp, Homo sapiens
ttcatattttaaacagaggata

SEQ ID NO: 1907102 - DNA, 16 bp, Homo sapiens
ttcatcagaacagctg

SEQ ID NO: 1907103 - DNA, 22 bp, Homo sapiens
ttcatcagaacagctgttgact

SEQ ID NO: 1907104 - DNA, 14 bp, Homo sapiens
ttcatctcaatagt

SEQ ID NO: 1907105 - DNA, 16 bp, Homo sapiens
ttcattcttaatttat

SEQ ID NO: 1907106 - DNA, 18 bp, Homo sapiens
ttcattgcacaatatatt

SEQ ID NO: 1907107 - DNA, 16 bp, Homo sapiens
ttcatttgctttggaa

SEQ ID NO: 1907108 - DNA, 23 bp, Homo sapiens
ttccaaataatatgtttccttcc

SEQ ID NO: 1907109 - DNA, 13 bp, Homo sapiens
ttccacagaggac

SEQ ID NO: 1907110 - DNA, 21 bp, Homo sapiens
ttccagatgctggtttttccc

SEQ ID NO: 1907111 - DNA, 12 bp, Homo sapiens
ttccagcaggag

SEQ ID NO: 1907112 - DNA, 20 bp, Homo sapiens
ttccagctccctcccctgct

SEQ ID NO: 1907113 - DNA, 22 bp, Homo sapiens
ttccagctccctcccctgctca

SEQ ID NO: 1907114 - DNA, 14 bp, Homo sapiens
ttccagtggcttct

SEQ ID NO: 1907115 - DNA, 17 bp, Homo sapiens
ttccatagctcaataaa

SEQ ID NO: 1907116 - DNA, 18 bp, Homo sapiens
ttccatagctcaataaaa

SEQ ID NO: 1907117 - DNA, 22 bp, Homo sapiens
ttccatagctcaataaaagaat

SEQ ID NO: 1907118 - DNA, 16 bp, Homo sapiens
ttccatctcttccttt

SEQ ID NO: 1907119 - DNA, 17 bp, Homo sapiens
ttccatctgattccagc

SEQ ID NO: 1907120 - DNA, 13 bp, Homo sapiens
ttcccaacacaaa

SEQ ID NO: 1907121 - DNA, 20 bp, Homo sapiens
ttcccagaccccgcagcacg

SEQ ID NO: 1907122 - DNA, 22 bp, Homo sapiens
ttcccagaccccgcagcacgcc

SEQ ID NO: 1907123 - DNA, 21 bp, Homo sapiens
ttcccatctcctttctctggt

SEQ ID NO: 1907124 - DNA, 14 bp, Homo sapiens
ttccctatctgcaa

SEQ ID NO: 1907125 - DNA, 14 bp, Homo sapiens
ttccctcctttcct

SEQ ID NO: 1907126 - DNA, 17 bp, Homo sapiens
ttccctcctttcctttt

SEQ ID NO: 1907127 - DNA, 15 bp, Homo sapiens
ttcccttcccttcca

SEQ ID NO: 1907128 - DNA, 14 bp, Homo sapiens
ttccctttcctttc

SEQ ID NO: 1907129 - DNA, 16 bp, Homo sapiens
ttccgagtctttctca

SEQ ID NO: 1907130 - DNA, 22 bp, Homo sapiens
ttccgagtctttctcactgcct

SEQ ID NO: 1907131 - DNA, 15 bp, Homo sapiens
ttcctacacaggaca

SEQ ID NO: 1907132 - DNA, 22 bp, Homo sapiens
ttcctagctggagaggagccct

SEQ ID NO: 1907133 - DNA, 15 bp, Homo sapiens
ttcctatgtattctg

SEQ ID NO: 1907134 - DNA, 10 bp, Homo sapiens
ttcctcccca

SEQ ID NO: 1907135 - DNA, 13 bp, Homo sapiens
ttcctccccaccc

SEQ ID NO: 1907136 - DNA, 23 bp, Homo sapiens
ttcctccccaccctgtcccaggc

SEQ ID NO: 1907137 - DNA, 18 bp, Homo sapiens
ttcctctgctgcatcccc

SEQ ID NO: 1907138 - DNA, 17 bp, Homo sapiens
ttcctgttgtcaagaat

SEQ ID NO: 1907139 - DNA, 13 bp, Homo sapiens
ttccttacctgga

SEQ ID NO: 1907140 - DNA, 15 bp, Homo sapiens
ttccttcagatattt

SEQ ID NO: 1907141 - DNA, 14 bp, Homo sapiens
ttccttctgtagcc

SEQ ID NO: 1907142 - DNA, 17 bp, Homo sapiens
ttccttctgtagcctga

SEQ ID NO: 1907143 - DNA, 9 bp, Homo sapiens
ttcctttcc

SEQ ID NO: 1907144 - DNA, 14 bp, Homo sapiens
ttcctttcctttca

SEQ ID NO: 1907145 - DNA, 12 bp, Homo sapiens
ttcctttgactt

SEQ ID NO: 1907146 - DNA, 17 bp, Homo sapiens
ttcctttgactttctgt

SEQ ID NO: 1907147 - DNA, 18 bp, Homo sapiens
ttcctttttatttatatg

SEQ ID NO: 1907148 - DNA, 15 bp, Homo sapiens
ttcgaaaagaaattg

SEQ ID NO: 1907149 - DNA, 17 bp, Homo sapiens
ttcgacttgcatttttg

SEQ ID NO: 1907150 - DNA, 18 bp, Homo sapiens
ttcgtacataatactgaa

SEQ ID NO: 1907151 - DNA, 19 bp, Homo sapiens
ttcgtgacaatgtttacaa

SEQ ID NO: 1907152 - DNA, 13 bp, Homo sapiens
ttctaacttctgt

SEQ ID NO: 1907153 - DNA, 20 bp, Homo sapiens
ttctaccggctttgccatgt

SEQ ID NO: 1907154 - DNA, 16 bp, Homo sapiens
ttctacttccaagact

SEQ ID NO: 1907155 - DNA, 19 bp, Homo sapiens
ttctatacatgtttgcagt

SEQ ID NO: 1907156 - DNA, 19 bp, Homo sapiens
ttctatagcatcacttaaa

SEQ ID NO: 1907157 - DNA, 20 bp, Homo sapiens
ttctatagcatcacttaaaa

SEQ ID NO: 1907158 - DNA, 21 bp, Homo sapiens
ttctatttgtgtaaggacttt

SEQ ID NO: 1907159 - DNA, 13 bp, Homo sapiens
ttctcactgcctt

SEQ ID NO: 1907160 - DNA, 15 bp, Homo sapiens
ttctcactgcctttg

SEQ ID NO: 1907161 - DNA, 15 bp, Homo sapiens
ttctcattacttgtt

SEQ ID NO: 1907162 - DNA, 22 bp, Homo sapiens
ttctcccctctctttctaagag

SEQ ID NO: 1907163 - DNA, 21 bp, Homo sapiens
ttctcgattctttgaagagat

SEQ ID NO: 1907164 - DNA, 19 bp, Homo sapiens
ttctctagaggctggcaag

SEQ ID NO: 1907165 - DNA, 21 bp, Homo sapiens
ttctctccttaattttatatg

SEQ ID NO: 1907166 - DNA, 15 bp, Homo sapiens
ttctctttctctctc

SEQ ID NO: 1907167 - DNA, 17 bp, Homo sapiens
ttctctttctctctcac

SEQ ID NO: 1907168 - DNA, 16 bp, Homo sapiens
ttctgaaatacaacca

SEQ ID NO: 1907169 - DNA, 20 bp, Homo sapiens
ttctgatagtagtctttaaa

SEQ ID NO: 1907170 - DNA, 20 bp, Homo sapiens
ttctgatcactgaaataaaa

SEQ ID NO: 1907171 - DNA, 17 bp, Homo sapiens
ttctgctttagacttga

SEQ ID NO: 1907172 - DNA, 14 bp, Homo sapiens
ttctgtatttgaaa

SEQ ID NO: 1907173 - DNA, 15 bp, Homo sapiens
ttctgtatttgaaag

SEQ ID NO: 1907174 - DNA, 19 bp, Homo sapiens
ttctgtgcccagaatactg

SEQ ID NO: 1907175 - DNA, 20 bp, Homo sapiens
ttctgtgcccagaatactga

SEQ ID NO: 1907176 - DNA, 18 bp, Homo sapiens
ttcttaaaaccaatcaat

SEQ ID NO: 1907177 - DNA, 15 bp, Homo sapiens
ttcttatttatgtaa

SEQ ID NO: 1907178 - DNA, 17 bp, Homo sapiens
ttcttatttatgtaaca

SEQ ID NO: 1907179 - DNA, 18 bp, Homo sapiens
ttcttatttatgtaacaa

SEQ ID NO: 1907180 - DNA, 20 bp, Homo sapiens
ttcttctgatcactgaaata

SEQ ID NO: 1907181 - DNA, 20 bp, Homo sapiens
ttcttgataattttccttta

SEQ ID NO: 1907182 - DNA, 22 bp, Homo sapiens
ttctttattatttttctctctc

SEQ ID NO: 1907183 - DNA, 23 bp, Homo sapiens
ttctttattatttttctctctct

SEQ ID NO: 1907184 - DNA, 14 bp, Homo sapiens
ttctttcctttccc

SEQ ID NO: 1907185 - DNA, 12 bp, Homo sapiens
ttctttcctttt

SEQ ID NO: 1907186 - DNA, 15 bp, Homo sapiens
ttctttgtagcattt

SEQ ID NO: 1907187 - DNA, 16 bp, Homo sapiens
ttctttttccctttcc

SEQ ID NO: 1907188 - DNA, 14 bp, Homo sapiens
ttcttttttattaa

SEQ ID NO: 1907189 - DNA, 20 bp, Homo sapiens
ttcttttttattaatcactg

SEQ ID NO: 1907190 - DNA, 17 bp, Homo sapiens
ttgaaaagtaatattta

SEQ ID NO: 1907191 - DNA, 15 bp, Homo sapiens
ttgaaagagaagcac

SEQ ID NO: 1907192 - DNA, 15 bp, Homo sapiens
ttgaaataaaaatgg

SEQ ID NO: 1907193 - DNA, 16 bp, Homo sapiens
ttgaaccataaaatgt

SEQ ID NO: 1907194 - DNA, 17 bp, Homo sapiens
ttgaaccataaaatgtc

SEQ ID NO: 1907195 - DNA, 11 bp, Homo sapiens
ttgaaccctaa

SEQ ID NO: 1907196 - DNA, 19 bp, Homo sapiens
ttgaactcttctcattact

SEQ ID NO: 1907197 - DNA, 20 bp, Homo sapiens
ttgaactcttctcattactt

SEQ ID NO: 1907198 - DNA, 16 bp, Homo sapiens
ttgaagcaaacagttg

SEQ ID NO: 1907199 - DNA, 15 bp, Homo sapiens
ttgaagcttgtatct

SEQ ID NO: 1907200 - DNA, 15 bp, Homo sapiens
ttgaaggcagaaagc

SEQ ID NO: 1907201 - DNA, 16 bp, Homo sapiens
ttgaaggtttttgata

SEQ ID NO: 1907202 - DNA, 19 bp, Homo sapiens
ttgaataatgtctagattt

SEQ ID NO: 1907203 - DNA, 16 bp, Homo sapiens
ttgaatacttgaacca

SEQ ID NO: 1907204 - DNA, 23 bp, Homo sapiens
ttgaatatgattaaaaatatcaa

SEQ ID NO: 1907205 - DNA, 16 bp, Homo sapiens
ttgaatatttaagcaa

SEQ ID NO: 1907206 - DNA, 23 bp, Homo sapiens
ttgaattcttcacatgtaacttt

SEQ ID NO: 1907207 - DNA, 18 bp, Homo sapiens
ttgaatttatataaagta

SEQ ID NO: 1907208 - DNA, 24 bp, Homo sapiens
ttgaatttatttttaagaaagaaa

SEQ ID NO: 1907209 - DNA, 18 bp, Homo sapiens
ttgacaggttccttttaa

SEQ ID NO: 1907210 - DNA, 14 bp, Homo sapiens
ttgaccaatgaaat

SEQ ID NO: 1907211 - DNA, 15 bp, Homo sapiens
ttgagaatagaaatt

SEQ ID NO: 1907212 - DNA, 19 bp, Homo sapiens
ttgaggattagtttagaac

SEQ ID NO: 1907213 - DNA, 17 bp, Homo sapiens
ttgaggttttggtaatt

SEQ ID NO: 1907214 - DNA, 18 bp, Homo sapiens
ttgagttgtttttgtata

SEQ ID NO: 1907215 - DNA, 19 bp, Homo sapiens
ttgagttgtttttgtatat

SEQ ID NO: 1907216 - DNA, 16 bp, Homo sapiens
ttgataattttccttt

SEQ ID NO: 1907217 - DNA, 16 bp, Homo sapiens
ttgatatatgtatctt

SEQ ID NO: 1907218 - DNA, 16 bp, Homo sapiens
ttgatatttatttatg

SEQ ID NO: 1907219 - DNA, 18 bp, Homo sapiens
ttgatctccctttcctat

SEQ ID NO: 1907220 - DNA, 20 bp, Homo sapiens
ttgatgcattaaaagaaaat

SEQ ID NO: 1907221 - DNA, 22 bp, Homo sapiens
ttgatgggatgattgaagaaac

SEQ ID NO: 1907222 - DNA, 12 bp, Homo sapiens
aaagtgttcatt

SEQ ID NO: 1907223 - DNA, 22 bp, Homo sapiens
aaagttaccagtgccttaaact

SEQ ID NO: 1907224 - DNA, 19 bp, Homo sapiens
aaagttccttctgtagcct

SEQ ID NO: 1907225 - DNA, 22 bp, Homo sapiens
aaagttttgagataagttttgt

SEQ ID NO: 1907226 - DNA, 13 bp, Homo sapiens
aaataaaaaaaag

SEQ ID NO: 1907227 - DNA, 20 bp, Homo sapiens
aaataaaaaaaagaaaaaag

SEQ ID NO: 1907228 - DNA, 17 bp, Homo sapiens
aaataaaagtgctgccg

SEQ ID NO: 1907229 - DNA, 16 bp, Homo sapiens
aaataaacaaagtgaa

SEQ ID NO: 1907230 - DNA, 13 bp, Homo sapiens
aaataaaggaaat

SEQ ID NO: 1907231 - DNA, 13 bp, Homo sapiens
aaataattctttt

SEQ ID NO: 1907232 - DNA, 16 bp, Homo sapiens
aaataatttactgtga

SEQ ID NO: 1907233 - DNA, 20 bp, Homo sapiens
aaatacaaccagaaacaatg

SEQ ID NO: 1907234 - DNA, 14 bp, Homo sapiens
aaatactgtacaat

SEQ ID NO: 1907235 - DNA, 13 bp, Homo sapiens
aaatatcaaatta

SEQ ID NO: 1907236 - DNA, 16 bp, Homo sapiens
aaatatcaaattaatt

SEQ ID NO: 1907237 - DNA, 23 bp, Homo sapiens
aaatatctgtaagagtgtttata

SEQ ID NO: 1907238 - DNA, 19 bp, Homo sapiens
aaatatggtcttttggtta

SEQ ID NO: 1907239 - DNA, 12 bp, Homo sapiens
aaatattgtagt

SEQ ID NO: 1907240 - DNA, 22 bp, Homo sapiens
aaatcaaatgtaaagtttaatt

SEQ ID NO: 1907241 - DNA, 11 bp, Homo sapiens
aaatccaggac

SEQ ID NO: 1907242 - DNA, 23 bp, Homo sapiens
aaatctgacataaaaacagtgct

SEQ ID NO: 1907243 - DNA, 19 bp, Homo sapiens
aaatctggatatagaaagg

SEQ ID NO: 1907244 - DNA, 20 bp, Homo sapiens
aaatcttaagtcataatgaa

SEQ ID NO: 1907245 - DNA, 20 bp, Homo sapiens
aaatgaacacagctctttaa

SEQ ID NO: 1907246 - DNA, 21 bp, Homo sapiens
aaatgaacacagctctttaac

SEQ ID NO: 1907247 - DNA, 19 bp, Homo sapiens
aaatgatgtgcctgcttca

SEQ ID NO: 1907248 - DNA, 15 bp, Homo sapiens
aaatgcatctttgat

SEQ ID NO: 1907249 - DNA, 21 bp, Homo sapiens
aaatgcatctttgatgtgttg

SEQ ID NO: 1907250 - DNA, 21 bp, Homo sapiens
aaatgcctaaaagttttgaga

SEQ ID NO: 1907251 - DNA, 13 bp, Homo sapiens
aaatgctttagca

SEQ ID NO: 1907252 - DNA, 19 bp, Homo sapiens
aaatggaagagaagagaaa

SEQ ID NO: 1907253 - DNA, 21 bp, Homo sapiens
aaatgtaaagttgtcttttaa

SEQ ID NO: 1907254 - DNA, 18 bp, Homo sapiens
aaatgtacagatatgcaa

SEQ ID NO: 1907255 - DNA, 16 bp, Homo sapiens
aaatgtattcattctt

SEQ ID NO: 1907256 - DNA, 20 bp, Homo sapiens
aaatgtgagtggttgaatat

SEQ ID NO: 1907257 - DNA, 15 bp, Homo sapiens
aaatgtgttttggtc

SEQ ID NO: 1907258 - DNA, 16 bp, Homo sapiens
aaatgtgttttggtcc

SEQ ID NO: 1907259 - DNA, 15 bp, Homo sapiens
aaattaaagctgcct

SEQ ID NO: 1907260 - DNA, 13 bp, Homo sapiens
aaattaagaagaa

SEQ ID NO: 1907261 - DNA, 14 bp, Homo sapiens
aaattaagaagaaa

SEQ ID NO: 1907262 - DNA, 15 bp, Homo sapiens
aaattaagaagaaac

SEQ ID NO: 1907263 - DNA, 19 bp, Homo sapiens
aaattccatagctcaataa

SEQ ID NO: 1907264 - DNA, 14 bp, Homo sapiens
aaattctgatttct

SEQ ID NO: 1907265 - DNA, 20 bp, Homo sapiens
aaattctgatttcttttcac

SEQ ID NO: 1907266 - DNA, 14 bp, Homo sapiens
aaatttaactttta

SEQ ID NO: 1907267 - DNA, 13 bp, Homo sapiens
aaatttatataac

SEQ ID NO: 1907268 - DNA, 18 bp, Homo sapiens
aaatttgcccctggcaaa

SEQ ID NO: 1907269 - DNA, 13 bp, Homo sapiens
aaatttgtgaact

SEQ ID NO: 1907270 - DNA, 19 bp, Homo sapiens
aaatttgtttaaagtatac

SEQ ID NO: 1907271 - DNA, 17 bp, Homo sapiens
aaattttgaaaagtaat

SEQ ID NO: 1907272 - DNA, 13 bp, Homo sapiens
aaatttttttgta

SEQ ID NO: 1907273 - DNA, 17 bp, Homo sapiens
aaatttttttgtatgaa

SEQ ID NO: 1907274 - DNA, 18 bp, Homo sapiens
aaatttttttgtatgaaa

SEQ ID NO: 1907275 - DNA, 23 bp, Homo sapiens
aaattttttttcatgctttatca

SEQ ID NO: 1907276 - DNA, 15 bp, Homo sapiens
aacaaaaaagagaaa

SEQ ID NO: 1907277 - DNA, 14 bp, Homo sapiens
aacaaagaccaatt

SEQ ID NO: 1907278 - DNA, 22 bp, Homo sapiens
aacaaatggaagagaagagaaa

SEQ ID NO: 1907279 - DNA, 12 bp, Homo sapiens
aacaacacaatc

SEQ ID NO: 1907280 - DNA, 17 bp, Homo sapiens
aacaagttgagctatga

SEQ ID NO: 1907281 - DNA, 20 bp, Homo sapiens
aacaatgtgtctatttctga

SEQ ID NO: 1907282 - DNA, 23 bp, Homo sapiens
aacaatgtgtctatttctgaaag

SEQ ID NO: 1907283 - DNA, 20 bp, Homo sapiens
aacaattttctagatattat

SEQ ID NO: 1907284 - DNA, 13 bp, Homo sapiens
aacacgttttaag

SEQ ID NO: 1907285 - DNA, 17 bp, Homo sapiens
aacactcttggggacca

SEQ ID NO: 1907286 - DNA, 16 bp, Homo sapiens
aacagagtaatcttgt

SEQ ID NO: 1907287 - DNA, 13 bp, Homo sapiens
aacagatttggaa

SEQ ID NO: 1907288 - DNA, 15 bp, Homo sapiens
aacagatttggaaag

SEQ ID NO: 1907289 - DNA, 18 bp, Homo sapiens
aacagcagtttcaggtag

SEQ ID NO: 1907290 - DNA, 16 bp, Homo sapiens
aacagccatttaggca

SEQ ID NO: 1907291 - DNA, 19 bp, Homo sapiens
aacagccctatttcttgat

SEQ ID NO: 1907292 - DNA, 15 bp, Homo sapiens
aacagcttcatgttc

SEQ ID NO: 1907293 - DNA, 13 bp, Homo sapiens
aacagggtctcta

SEQ ID NO: 1907294 - DNA, 16 bp, Homo sapiens
aacagtgctattctga

SEQ ID NO: 1907295 - DNA, 18 bp, Homo sapiens
aacagtttacttggaaat

SEQ ID NO: 1907296 - DNA, 13 bp, Homo sapiens
aacagttttcctt

SEQ ID NO: 1907297 - DNA, 15 bp, Homo sapiens
aacataattcttatt

SEQ ID NO: 1907298 - DNA, 20 bp, Homo sapiens
aacatacaaatgcatctttg

SEQ ID NO: 1907299 - DNA, 21 bp, Homo sapiens
aacatacaaatgcatctttga

SEQ ID NO: 1907300 - DNA, 17 bp, Homo sapiens
aacatcattccttttta

SEQ ID NO: 1907301 - DNA, 20 bp, Homo sapiens
aacatcattcctttttattt

SEQ ID NO: 1907302 - DNA, 22 bp, Homo sapiens
aacatcattcctttttatttat

SEQ ID NO: 1907303 - DNA, 16 bp, Homo sapiens
aacatctttcttttta

SEQ ID NO: 1907304 - DNA, 17 bp, Homo sapiens
aacatctttctttttaa

SEQ ID NO: 1907305 - DNA, 14 bp, Homo sapiens
aacatgcctcctcc

SEQ ID NO: 1907306 - DNA, 19 bp, Homo sapiens
aacatgcctcctcctgccc

SEQ ID NO: 1907307 - DNA, 22 bp, Homo sapiens
aacatgcctcctcctgccctcc

SEQ ID NO: 1907308 - DNA, 23 bp, Homo sapiens
aacatgcgatgttagttttagaa

SEQ ID NO: 1907309 - DNA, 17 bp, Homo sapiens
aacatgtgaaaagaata

SEQ ID NO: 1907310 - DNA, 17 bp, Homo sapiens
aacattaggccccagca

SEQ ID NO: 1907311 - DNA, 16 bp, Homo sapiens
aacattcctcaaaatg

SEQ ID NO: 1907312 - DNA, 20 bp, Homo sapiens
aacattgcatataacttata

SEQ ID NO: 1907313 - DNA, 21 bp, Homo sapiens
aacattgcatataacttatat

SEQ ID NO: 1907314 - DNA, 21 bp, Homo sapiens
aacatttaaagacaaagacat

SEQ ID NO: 1907315 - DNA, 14 bp, Homo sapiens
aaccaaatgtgcat

SEQ ID NO: 1907316 - DNA, 13 bp, Homo sapiens
aaccaatcaataa

SEQ ID NO: 1907317 - DNA, 20 bp, Homo sapiens
aaccacttgtagatttgatt

SEQ ID NO: 1907318 - DNA, 22 bp, Homo sapiens
aaccacttgtagatttgatttt

SEQ ID NO: 1907319 - DNA, 19 bp, Homo sapiens
aaccatttgaaacccctgt

SEQ ID NO: 1907320 - DNA, 15 bp, Homo sapiens
aacccctcgcccagt

SEQ ID NO: 1907321 - DNA, 23 bp, Homo sapiens
aacccctcgcccagtcccagcag

SEQ ID NO: 1907322 - DNA, 16 bp, Homo sapiens
aacccctggaccccag

SEQ ID NO: 1907323 - DNA, 19 bp, Homo sapiens
aaccttactctgagctcat

SEQ ID NO: 1907324 - DNA, 15 bp, Homo sapiens
aacctttgctgtagt

SEQ ID NO: 1907325 - DNA, 22 bp, Homo sapiens
aacgatcacaaatgactttatt

SEQ ID NO: 1907326 - DNA, 15 bp, Homo sapiens
aacgctgatttaaag

SEQ ID NO: 1907327 - DNA, 20 bp, Homo sapiens
aacgtttggttcaaatgtgt

SEQ ID NO: 1907328 - DNA, 18 bp, Homo sapiens
aacgttttctactttgaa

SEQ ID NO: 1907329 - DNA, 15 bp, Homo sapiens
aactaaaataatttt

SEQ ID NO: 1907330 - DNA, 12 bp, Homo sapiens
aactcacctccc

SEQ ID NO: 1907331 - DNA, 20 bp, Homo sapiens
aactcatctggagttctcaa

SEQ ID NO: 1907332 - DNA, 24 bp, Homo sapiens
aactctatggtcttatatttacaa

SEQ ID NO: 1907333 - DNA, 13 bp, Homo sapiens
aactcttctcatt

SEQ ID NO: 1907334 - DNA, 21 bp, Homo sapiens
aactcttgacagctataatta

SEQ ID NO: 1907335 - DNA, 20 bp, Homo sapiens
aactgaatagcaagtggcat

SEQ ID NO: 1907336 - DNA, 21 bp, Homo sapiens
aactgagatcaaaaaaatata

SEQ ID NO: 1907337 - DNA, 12 bp, Homo sapiens
aactgctgctga

SEQ ID NO: 1907338 - DNA, 22 bp, Homo sapiens
aactgcttcctataattttgat

SEQ ID NO: 1907339 - DNA, 21 bp, Homo sapiens
aactgctttctttcgtttgtt

SEQ ID NO: 1907340 - DNA, 18 bp, Homo sapiens
aactggactgaattcaaa

SEQ ID NO: 1907341 - DNA, 20 bp, Homo sapiens
aactgtcgtgtcatactcga

SEQ ID NO: 1907342 - DNA, 17 bp, Homo sapiens
aactgttccccttggta

SEQ ID NO: 1907343 - DNA, 22 bp, Homo sapiens
aactgttttgtatatgctgcat

SEQ ID NO: 1907344 - DNA, 19 bp, Homo sapiens
aacttatattgtaagaaat

SEQ ID NO: 1907345 - DNA, 23 bp, Homo sapiens
aacttgcaagggcggcctttccc

SEQ ID NO: 1907346 - DNA, 16 bp, Homo sapiens
aacttgttgaatttat

SEQ ID NO: 1907347 - DNA, 20 bp, Homo sapiens
aacttgttgctgattttgac

SEQ ID NO: 1907348 - DNA, 15 bp, Homo sapiens
aactttgtagacatt

SEQ ID NO: 1907349 - DNA, 15 bp, Homo sapiens
aacttttaaagaatt

SEQ ID NO: 1907350 - DNA, 16 bp, Homo sapiens
actgagatcaaaaaaa

SEQ ID NO: 1907351 - DNA, 18 bp, Homo sapiens
actgaggtttacatacgt

SEQ ID NO: 1907352 - DNA, 17 bp, Homo sapiens
actgataattttaaaat

SEQ ID NO: 1907353 - DNA, 22 bp, Homo sapiens
actgatggaatttttttgtacg

SEQ ID NO: 1907354 - DNA, 19 bp, Homo sapiens
actgcactccagcctgggc

SEQ ID NO: 1907355 - DNA, 16 bp, Homo sapiens
actgcagaaaaaatat

SEQ ID NO: 1907356 - DNA, 12 bp, Homo sapiens
actgcagaacag

SEQ ID NO: 1907357 - DNA, 19 bp, Homo sapiens
actgcatttagggagtatt

SEQ ID NO: 1907358 - DNA, 17 bp, Homo sapiens
actgccacaaggaagaa

SEQ ID NO: 1907359 - DNA, 18 bp, Homo sapiens
actgccacaaggaagaaa

SEQ ID NO: 1907360 - DNA, 20 bp, Homo sapiens
actgccacaaggaagaaatt

SEQ ID NO: 1907361 - DNA, 11 bp, Homo sapiens
actgccacctc

SEQ ID NO: 1907362 - DNA, 12 bp, Homo sapiens
actgccagctct

SEQ ID NO: 1907363 - DNA, 17 bp, Homo sapiens
actgctcctgagccccc

SEQ ID NO: 1907364 - DNA, 22 bp, Homo sapiens
actgctgctgacccctgtgtga

SEQ ID NO: 1907365 - DNA, 22 bp, Homo sapiens
actgctgtgaacatgcctcctc

SEQ ID NO: 1907366 - DNA, 23 bp, Homo sapiens
actgctgtgaacatgcctcctcc

SEQ ID NO: 1907367 - DNA, 17 bp, Homo sapiens
actgcttcctttcttga

SEQ ID NO: 1907368 - DNA, 23 bp, Homo sapiens
actgctttctttcgtttgtttgt

SEQ ID NO: 1907369 - DNA, 16 bp, Homo sapiens
actggaataagccttc

SEQ ID NO: 1907370 - DNA, 20 bp, Homo sapiens
actggaataagccttcgaaa

SEQ ID NO: 1907371 - DNA, 12 bp, Homo sapiens
actggagtctct

SEQ ID NO: 1907372 - DNA, 15 bp, Homo sapiens
actggagtctctctc

SEQ ID NO: 1907373 - DNA, 16 bp, Homo sapiens
actggcaatggtagtt

SEQ ID NO: 1907374 - DNA, 21 bp, Homo sapiens
actgggatggaatggcagcat

SEQ ID NO: 1907375 - DNA, 22 bp, Homo sapiens
actgggggacactgtggcagca

SEQ ID NO: 1907376 - DNA, 14 bp, Homo sapiens
actggtctacactg

SEQ ID NO: 1907377 - DNA, 18 bp, Homo sapiens
actgtccgctgtctccct

SEQ ID NO: 1907378 - DNA, 21 bp, Homo sapiens
actgtccgctgtctccctcct

SEQ ID NO: 1907379 - DNA, 14 bp, Homo sapiens
actgtgcagtggag

SEQ ID NO: 1907380 - DNA, 17 bp, Homo sapiens
actgtgcgtggggctcc

SEQ ID NO: 1907381 - DNA, 17 bp, Homo sapiens
actgtggagactgctcc

SEQ ID NO: 1907382 - DNA, 16 bp, Homo sapiens
actgtggcagcaggag

SEQ ID NO: 1907383 - DNA, 17 bp, Homo sapiens
actgtgtatatttgatt

SEQ ID NO: 1907384 - DNA, 18 bp, Homo sapiens
actgtgtatatttgattt

SEQ ID NO: 1907385 - DNA, 19 bp, Homo sapiens
actgtgtatatttgattta

SEQ ID NO: 1907386 - DNA, 20 bp, Homo sapiens
actgtgtgtgtcctacacaa

SEQ ID NO: 1907387 - DNA, 16 bp, Homo sapiens
actgtgttaaaatttt

SEQ ID NO: 1907388 - DNA, 13 bp, Homo sapiens
actgttgtataaa

SEQ ID NO: 1907389 - DNA, 15 bp, Homo sapiens
actgttgtataaatt

SEQ ID NO: 1907390 - DNA, 20 bp, Homo sapiens
actgtttagatttgccatag

SEQ ID NO: 1907391 - DNA, 18 bp, Homo sapiens
acttaaaacacgttttaa

SEQ ID NO: 1907392 - DNA, 22 bp, Homo sapiens
acttaaaagttaagttggtaaa

SEQ ID NO: 1907393 - DNA, 13 bp, Homo sapiens
acttaataatcaa

SEQ ID NO: 1907394 - DNA, 19 bp, Homo sapiens
acttacatatttattttta

SEQ ID NO: 1907395 - DNA, 19 bp, Homo sapiens
acttagaatccctgtgtta

SEQ ID NO: 1907396 - DNA, 20 bp, Homo sapiens
acttagaatccctgtgttaa

SEQ ID NO: 1907397 - DNA, 21 bp, Homo sapiens
acttagaatccctgtgttaat

SEQ ID NO: 1907398 - DNA, 17 bp, Homo sapiens
acttatattgtaagaaa

SEQ ID NO: 1907399 - DNA, 18 bp, Homo sapiens
acttatgactaaaaatat

SEQ ID NO: 1907400 - DNA, 17 bp, Homo sapiens
acttcagccaccctttc

SEQ ID NO: 1907401 - DNA, 15 bp, Homo sapiens
acttccccaagcctg

SEQ ID NO: 1907402 - DNA, 21 bp, Homo sapiens
acttccccaagcctggcaggg

SEQ ID NO: 1907403 - DNA, 13 bp, Homo sapiens
acttctataaagt

SEQ ID NO: 1907404 - DNA, 14 bp, Homo sapiens
acttctttgcagtt

SEQ ID NO: 1907405 - DNA, 21 bp, Homo sapiens
acttctttgcagttcccatct

SEQ ID NO: 1907406 - DNA, 15 bp, Homo sapiens
acttgaaaagagaca

SEQ ID NO: 1907407 - DNA, 20 bp, Homo sapiens
acttgaaaagagacaggcag

SEQ ID NO: 1907408 - DNA, 17 bp, Homo sapiens
acttgaaccataaaatg

SEQ ID NO: 1907409 - DNA, 17 bp, Homo sapiens
acttgcatttttgcagg

SEQ ID NO: 1907410 - DNA, 18 bp, Homo sapiens
acttgcatttttgcagga

SEQ ID NO: 1907411 - DNA, 19 bp, Homo sapiens
acttgcatttttgcaggag

SEQ ID NO: 1907412 - DNA, 19 bp, Homo sapiens
acttgctttggtcactttt

SEQ ID NO: 1907413 - DNA, 20 bp, Homo sapiens
acttgggggctcagcaaggc

SEQ ID NO: 1907414 - DNA, 22 bp, Homo sapiens
acttgggggctcagcaaggcca

SEQ ID NO: 1907415 - DNA, 23 bp, Homo sapiens
acttgggggctcagcaaggccac

SEQ ID NO: 1907416 - DNA, 14 bp, Homo sapiens
acttgtagatttga

SEQ ID NO: 1907417 - DNA, 18 bp, Homo sapiens
acttgtagatttgatttt

SEQ ID NO: 1907418 - DNA, 19 bp, Homo sapiens
acttgtatattctatttta

SEQ ID NO: 1907419 - DNA, 13 bp, Homo sapiens
acttgtcccaagt

SEQ ID NO: 1907420 - DNA, 16 bp, Homo sapiens
acttgttgcctataag

SEQ ID NO: 1907421 - DNA, 21 bp, Homo sapiens
acttgttgctgattttgacct

SEQ ID NO: 1907422 - DNA, 18 bp, Homo sapiens
actttctgaaaatttata

SEQ ID NO: 1907423 - DNA, 19 bp, Homo sapiens
actttctgaaaatttatat

SEQ ID NO: 1907424 - DNA, 21 bp, Homo sapiens
actttctgaaaatttatataa

SEQ ID NO: 1907425 - DNA, 20 bp, Homo sapiens
actttctgtgtaccactggg

SEQ ID NO: 1907426 - DNA, 22 bp, Homo sapiens
actttctgtgtaccactgggat

SEQ ID NO: 1907427 - DNA, 19 bp, Homo sapiens
actttgaatttatataaag

SEQ ID NO: 1907428 - DNA, 23 bp, Homo sapiens
actttgaatttatataaagtatt

SEQ ID NO: 1907429 - DNA, 23 bp, Homo sapiens
actttgaattttagcacattgca

SEQ ID NO: 1907430 - DNA, 19 bp, Homo sapiens
actttgacagcgcacagct

SEQ ID NO: 1907431 - DNA, 10 bp, Homo sapiens
actttgatgt

SEQ ID NO: 1907432 - DNA, 11 bp, Homo sapiens
actttgatgtc

SEQ ID NO: 1907433 - DNA, 19 bp, Homo sapiens
actttggcttacatttgaa

SEQ ID NO: 1907434 - DNA, 21 bp, Homo sapiens
actttggcttacatttgaata

SEQ ID NO: 1907435 - DNA, 14 bp, Homo sapiens
actttgtaaattct

SEQ ID NO: 1907436 - DNA, 18 bp, Homo sapiens
actttgtaaattctgatt

SEQ ID NO: 1907437 - DNA, 19 bp, Homo sapiens
actttgtaaattctgattt

SEQ ID NO: 1907438 - DNA, 19 bp, Homo sapiens
actttgtagacattttgaa

SEQ ID NO: 1907439 - DNA, 12 bp, Homo sapiens
actttgtatagt

SEQ ID NO: 1907440 - DNA, 24 bp, Homo sapiens
actttgtattgtcctattagtgtt

SEQ ID NO: 1907441 - DNA, 14 bp, Homo sapiens
acttttttcaaaat

SEQ ID NO: 1907442 - DNA, 18 bp, Homo sapiens
actttttttttattttat

SEQ ID NO: 1907443 - DNA, 14 bp, Homo sapiens
agaaaaaaaaagaa

SEQ ID NO: 1907444 - DNA, 13 bp, Homo sapiens
agaaaaaaatgtc

SEQ ID NO: 1907445 - DNA, 10 bp, Homo sapiens
agaaaaaaga

SEQ ID NO: 1907446 - DNA, 10 bp, Homo sapiens
agaaaaaagt

SEQ ID NO: 1907447 - DNA, 14 bp, Homo sapiens
agaaaaaagttgta

SEQ ID NO: 1907448 - DNA, 15 bp, Homo sapiens
agaaaaatatctgta

SEQ ID NO: 1907449 - DNA, 22 bp, Homo sapiens
agaaaaccaaacaaaaatgtta

SEQ ID NO: 1907450 - DNA, 17 bp, Homo sapiens
agaaaacttttatgcaa

SEQ ID NO: 1907451 - DNA, 9 bp, Homo sapiens
agaaaagaa

SEQ ID NO: 1907452 - DNA, 12 bp, Homo sapiens
agaaaagaaaaa

SEQ ID NO: 1907453 - DNA, 19 bp, Homo sapiens
agaaaagatgtagatttat

SEQ ID NO: 1907454 - DNA, 19 bp, Homo sapiens
agaaaataaaaaaaagaaa

SEQ ID NO: 1907455 - DNA, 22 bp, Homo sapiens
agaaacttaaatgaacacagct

SEQ ID NO: 1907456 - DNA, 17 bp, Homo sapiens
agaaagagtctgaccct

SEQ ID NO: 1907457 - DNA, 15 bp, Homo sapiens
agaaagcaaaattat

SEQ ID NO: 1907458 - DNA, 17 bp, Homo sapiens
agaaagcaaaattatgt

SEQ ID NO: 1907459 - DNA, 21 bp, Homo sapiens
agaaagcaaaattatgtttgc

SEQ ID NO: 1907460 - DNA, 14 bp, Homo sapiens
agaaatactgtaca

SEQ ID NO: 1907461 - DNA, 16 bp, Homo sapiens
agaaatactgtacaat

SEQ ID NO: 1907462 - DNA, 18 bp, Homo sapiens
agaaatcttaagtcataa

SEQ ID NO: 1907463 - DNA, 22 bp, Homo sapiens
agaaatcttaagtcataatgaa

SEQ ID NO: 1907464 - DNA, 18 bp, Homo sapiens
agaaattgtccttgaagc

SEQ ID NO: 1907465 - DNA, 20 bp, Homo sapiens
agaaatttgcccctggcaaa

SEQ ID NO: 1907466 - DNA, 11 bp, Homo sapiens
agaacacaaga

SEQ ID NO: 1907467 - DNA, 18 bp, Homo sapiens
agaacaggtttttttgtt

SEQ ID NO: 1907468 - DNA, 15 bp, Homo sapiens
agaacattaggcccc

SEQ ID NO: 1907469 - DNA, 17 bp, Homo sapiens
agaacattccatttgct

SEQ ID NO: 1907470 - DNA, 21 bp, Homo sapiens
agaaccagttgttttgtcttg

SEQ ID NO: 1907471 - DNA, 16 bp, Homo sapiens
agaactgcagtcactg

SEQ ID NO: 1907472 - DNA, 20 bp, Homo sapiens
agcaacgatcacaaatgact

SEQ ID NO: 1907473 - DNA, 21 bp, Homo sapiens
agcaagtgtgaatactgcttg

SEQ ID NO: 1907474 - DNA, 23 bp, Homo sapiens
agcaagtgtgaatactgcttgaa

SEQ ID NO: 1907475 - DNA, 16 bp, Homo sapiens
agcaataatttctgta

SEQ ID NO: 1907476 - DNA, 22 bp, Homo sapiens
agcacaccaatcttactttgta

SEQ ID NO: 1907477 - DNA, 13 bp, Homo sapiens
agcacagatttgc

SEQ ID NO: 1907478 - DNA, 20 bp, Homo sapiens
agcaccaaaataagaaaaga

SEQ ID NO: 1907479 - DNA, 21 bp, Homo sapiens
agcaccaaaataagaaaagat

SEQ ID NO: 1907480 - DNA, 14 bp, Homo sapiens
agcaccatcccctc

SEQ ID NO: 1907481 - DNA, 15 bp, Homo sapiens
agcaccatcccctcc

SEQ ID NO: 1907482 - DNA, 17 bp, Homo sapiens
agcacgcctctccccac

SEQ ID NO: 1907483 - DNA, 17 bp, Homo sapiens
agcagacacccttggag

SEQ ID NO: 1907484 - DNA, 21 bp, Homo sapiens
agcagatgcgtagcatttgct

SEQ ID NO: 1907485 - DNA, 13 bp, Homo sapiens
agcagcacccatc

SEQ ID NO: 1907486 - DNA, 12 bp, Homo sapiens
agcagccagcca

SEQ ID NO: 1907487 - DNA, 21 bp, Homo sapiens
agcagcctctgatctgtgcag

SEQ ID NO: 1907488 - DNA, 21 bp, Homo sapiens
agcaggagggactctgtctgg

SEQ ID NO: 1907489 - DNA, 19 bp, Homo sapiens
agcaggccctgggcctcca

SEQ ID NO: 1907490 - DNA, 22 bp, Homo sapiens
agcagggccttctgcctgctga

SEQ ID NO: 1907491 - DNA, 16 bp, Homo sapiens
agcaggggccaagcag

SEQ ID NO: 1907492 - DNA, 20 bp, Homo sapiens
agcaggggccaagcaggcac

SEQ ID NO: 1907493 - DNA, 13 bp, Homo sapiens
agcagtgcccagg

SEQ ID NO: 1907494 - DNA, 20 bp, Homo sapiens
agcagttgctggtaaaatga

SEQ ID NO: 1907495 - DNA, 14 bp, Homo sapiens
agcatacattcaga

SEQ ID NO: 1907496 - DNA, 18 bp, Homo sapiens
agcatcacttaaaacacg

SEQ ID NO: 1907497 - DNA, 19 bp, Homo sapiens
agcattacctctttggaaa

SEQ ID NO: 1907498 - DNA, 16 bp, Homo sapiens
agcattagtgggaaaa

SEQ ID NO: 1907499 - DNA, 14 bp, Homo sapiens
agcatttgctgcat

SEQ ID NO: 1907500 - DNA, 14 bp, Homo sapiens
agcatttggtgctt

SEQ ID NO: 1907501 - DNA, 15 bp, Homo sapiens
agccaaaattaaggt

SEQ ID NO: 1907502 - DNA, 19 bp, Homo sapiens
agccacctgagttcctgag

SEQ ID NO: 1907503 - DNA, 17 bp, Homo sapiens
agccattctgactcata

SEQ ID NO: 1907504 - DNA, 21 bp, Homo sapiens
agcccacgctgactacagggc

SEQ ID NO: 1907505 - DNA, 23 bp, Homo sapiens
agcccacgctgactacagggccg

SEQ ID NO: 1907506 - DNA, 12 bp, Homo sapiens
agcccaggagcc

SEQ ID NO: 1907507 - DNA, 16 bp, Homo sapiens
agcccaggagcccatt

SEQ ID NO: 1907508 - DNA, 18 bp, Homo sapiens
agcccaggatatatttta

SEQ ID NO: 1907509 - DNA, 19 bp, Homo sapiens
agcccatttggagggcctg

SEQ ID NO: 1907510 - DNA, 14 bp, Homo sapiens
agccccactctcag

SEQ ID NO: 1907511 - DNA, 22 bp, Homo sapiens
agccccactctcagaggcccca

SEQ ID NO: 1907512 - DNA, 22 bp, Homo sapiens
agcccccgcagtcgtcagcctc

SEQ ID NO: 1907513 - DNA, 23 bp, Homo sapiens
agcccccgcagtcgtcagcctcc

SEQ ID NO: 1907514 - DNA, 12 bp, Homo sapiens
agccccctggtc

SEQ ID NO: 1907515 - DNA, 16 bp, Homo sapiens
agccctatttcttgat

SEQ ID NO: 1907516 - DNA, 22 bp, Homo sapiens
agccctgaggtttgaatctgac

SEQ ID NO: 1907517 - DNA, 18 bp, Homo sapiens
agccctgcctctccgccc

SEQ ID NO: 1907518 - DNA, 22 bp, Homo sapiens
agccctgcctctccgcccctga

SEQ ID NO: 1907519 - DNA, 15 bp, Homo sapiens
agccctgggccaggg

SEQ ID NO: 1907520 - DNA, 14 bp, Homo sapiens
agccgtaggaccca

SEQ ID NO: 1907521 - DNA, 18 bp, Homo sapiens
agcctcaaaacaaaggcc

SEQ ID NO: 1907522 - DNA, 19 bp, Homo sapiens
agcctcaaatccaggaccc

SEQ ID NO: 1907523 - DNA, 21 bp, Homo sapiens
agcctcacgctcctttctgat

SEQ ID NO: 1907524 - DNA, 14 bp, Homo sapiens
agcctcccacagtg

SEQ ID NO: 1907525 - DNA, 17 bp, Homo sapiens
agcctccgcttccctgg

SEQ ID NO: 1907526 - DNA, 16 bp, Homo sapiens
agcctctgatctgtgc

SEQ ID NO: 1907527 - DNA, 18 bp, Homo sapiens
agcctctgatctgtgcag

SEQ ID NO: 1907528 - DNA, 21 bp, Homo sapiens
agcctgagatggatggacaga

SEQ ID NO: 1907529 - DNA, 12 bp, Homo sapiens
agcctgcccagc

SEQ ID NO: 1907530 - DNA, 14 bp, Homo sapiens
agcctgcctctgcc

SEQ ID NO: 1907531 - DNA, 15 bp, Homo sapiens
agcctgcctctgcca

SEQ ID NO: 1907532 - DNA, 18 bp, Homo sapiens
agcctgcggggcagcagg

SEQ ID NO: 1907533 - DNA, 19 bp, Homo sapiens
agcctgcggggcagcaggg

SEQ ID NO: 1907534 - DNA, 13 bp, Homo sapiens
agcctggcagggg

SEQ ID NO: 1907535 - DNA, 14 bp, Homo sapiens
agcctggcagggga

SEQ ID NO: 1907536 - DNA, 22 bp, Homo sapiens
agccttccagtggcttctccca

SEQ ID NO: 1907537 - DNA, 17 bp, Homo sapiens
agccttcgaaaagaaat

SEQ ID NO: 1907538 - DNA, 15 bp, Homo sapiens
agcctttgaaaatac

SEQ ID NO: 1907539 - DNA, 16 bp, Homo sapiens
agcctttttctaggcc

SEQ ID NO: 1907540 - DNA, 23 bp, Homo sapiens
agcgacagtgtgggacctgcccc

SEQ ID NO: 1907541 - DNA, 13 bp, Homo sapiens
agcgaccagcagg

SEQ ID NO: 1907542 - DNA, 14 bp, Homo sapiens
agcgaccagcaggc

SEQ ID NO: 1907543 - DNA, 17 bp, Homo sapiens
agcgaccagcaggctcc

SEQ ID NO: 1907544 - DNA, 19 bp, Homo sapiens
agcgaccagcaggctcctc

SEQ ID NO: 1907545 - DNA, 15 bp, Homo sapiens
agcgaggctgggctg

SEQ ID NO: 1907546 - DNA, 13 bp, Homo sapiens
agcgcacagctgc

SEQ ID NO: 1907547 - DNA, 14 bp, Homo sapiens
agcgcacagctgct

SEQ ID NO: 1907548 - DNA, 21 bp, Homo sapiens
agcgccactgtccgctgtctc

SEQ ID NO: 1907549 - DNA, 14 bp, Homo sapiens
agcgcccccactcc

SEQ ID NO: 1907550 - DNA, 20 bp, Homo sapiens
agcgcccccactcctcctcc

SEQ ID NO: 1907551 - DNA, 18 bp, Homo sapiens
agctacccctgcagctgg

SEQ ID NO: 1907552 - DNA, 21 bp, Homo sapiens
agctacccctgcagctgggga

SEQ ID NO: 1907553 - DNA, 22 bp, Homo sapiens
agctagaacattccatttgctt

SEQ ID NO: 1907554 - DNA, 19 bp, Homo sapiens
agctagttgaatacttgaa

SEQ ID NO: 1907555 - DNA, 18 bp, Homo sapiens
agctcaagccgtggccgg

SEQ ID NO: 1907556 - DNA, 19 bp, Homo sapiens
agctcaaggcaatgggcta

SEQ ID NO: 1907557 - DNA, 13 bp, Homo sapiens
agctcaataaaag

SEQ ID NO: 1907558 - DNA, 15 bp, Homo sapiens
agctcagaaccacag

SEQ ID NO: 1907559 - DNA, 18 bp, Homo sapiens
agctcatttggggaccac

SEQ ID NO: 1907560 - DNA, 11 bp, Homo sapiens
agctccctccc

SEQ ID NO: 1907561 - DNA, 17 bp, Homo sapiens
agctccctcccctgctc

SEQ ID NO: 1907562 - DNA, 21 bp, Homo sapiens
agctcggggctgggggctgca

SEQ ID NO: 1907563 - DNA, 12 bp, Homo sapiens
agctgaggccca

SEQ ID NO: 1907564 - DNA, 21 bp, Homo sapiens
agctgaggcccatggccacat

SEQ ID NO: 1907565 - DNA, 15 bp, Homo sapiens
agctggagaggagcc

SEQ ID NO: 1907566 - DNA, 13 bp, Homo sapiens
agctggagtctgg

SEQ ID NO: 1907567 - DNA, 18 bp, Homo sapiens
agctggagtctgggctcc

SEQ ID NO: 1907568 - DNA, 20 bp, Homo sapiens
agctggcttacactggcaat

SEQ ID NO: 1907569 - DNA, 19 bp, Homo sapiens
agctgtaaggcatgaagga

SEQ ID NO: 1907570 - DNA, 21 bp, Homo sapiens
agctgtatatatttttcttat

SEQ ID NO: 1907571 - DNA, 24 bp, Homo sapiens
agctgtcaccactacagtaagctg

SEQ ID NO: 1907572 - DNA, 19 bp, Homo sapiens
agctgtgctgggaggtccc

SEQ ID NO: 1907573 - DNA, 20 bp, Homo sapiens
agctgttgactctagtactg

SEQ ID NO: 1907574 - DNA, 23 bp, Homo sapiens
agctgttgatgggatgattgaag

SEQ ID NO: 1907575 - DNA, 19 bp, Homo sapiens
agcttaagggtcatatgtt

SEQ ID NO: 1907576 - DNA, 13 bp, Homo sapiens
agcttacgtagtt

SEQ ID NO: 1907577 - DNA, 17 bp, Homo sapiens
agcttccaattttcctt

SEQ ID NO: 1907578 - DNA, 13 bp, Homo sapiens
agcttccagcagg

SEQ ID NO: 1907579 - DNA, 14 bp, Homo sapiens
agcttccagcagga

SEQ ID NO: 1907580 - DNA, 16 bp, Homo sapiens
agcttccagcaggagg

SEQ ID NO: 1907581 - DNA, 16 bp, Homo sapiens
agcttctagtctggaa

SEQ ID NO: 1907582 - DNA, 14 bp, Homo sapiens
agcttgggctggcg

SEQ ID NO: 1907583 - DNA, 21 bp, Homo sapiens
aggaaatgctgacccatgggc

SEQ ID NO: 1907584 - DNA, 16 bp, Homo sapiens
aggaagaaattaactt

SEQ ID NO: 1907585 - DNA, 19 bp, Homo sapiens
aggaagtagcacaggctga

SEQ ID NO: 1907586 - DNA, 18 bp, Homo sapiens
aggaatatgggagaaata

SEQ ID NO: 1907587 - DNA, 15 bp, Homo sapiens
aggacagcctgcctc

SEQ ID NO: 1907588 - DNA, 18 bp, Homo sapiens
aggacagcctgcctctgc

SEQ ID NO: 1907589 - DNA, 19 bp, Homo sapiens
aggacagcctgcctctgcc

SEQ ID NO: 1907590 - DNA, 22 bp, Homo sapiens
aggaccctgccaggcacaggca

SEQ ID NO: 1907591 - DNA, 22 bp, Homo sapiens
aggactgactgaggcagtttga

SEQ ID NO: 1907592 - DNA, 12 bp, Homo sapiens
aggactgggccc

SEQ ID NO: 1907593 - DNA, 17 bp, Homo sapiens
agtttgaggattagttt

SEQ ID NO: 1907594 - DNA, 18 bp, Homo sapiens
agtttgaggattagttta

SEQ ID NO: 1907595 - DNA, 16 bp, Homo sapiens
agtttgctgaaagata

SEQ ID NO: 1907596 - DNA, 22 bp, Homo sapiens
agtttgctgaaagatatgtata

SEQ ID NO: 1907597 - DNA, 23 bp, Homo sapiens
agtttgctgaaagatatgtatat

SEQ ID NO: 1907598 - DNA, 16 bp, Homo sapiens
agttttaaaaatgcaa

SEQ ID NO: 1907599 - DNA, 15 bp, Homo sapiens
agttttatttatatt

SEQ ID NO: 1907600 - DNA, 20 bp, Homo sapiens
agttttatttatatttattg

SEQ ID NO: 1907601 - DNA, 16 bp, Homo sapiens
agttttccttatcaga

SEQ ID NO: 1907602 - DNA, 18 bp, Homo sapiens
agttttgagataagtttt

SEQ ID NO: 1907603 - DNA, 17 bp, Homo sapiens
ataaaaaaaagaaaaaa

SEQ ID NO: 1907604 - DNA, 15 bp, Homo sapiens
ataaaaaaacagctt

SEQ ID NO: 1907605 - DNA, 21 bp, Homo sapiens
ataaaaaatatatttttatat

SEQ ID NO: 1907606 - DNA, 21 bp, Homo sapiens
ataaaacagagtaatcttgtt

SEQ ID NO: 1907607 - DNA, 21 bp, Homo sapiens
ataaaatgtccagtaagatca

SEQ ID NO: 1907608 - DNA, 23 bp, Homo sapiens
ataaaatgtccagtaagatcact

SEQ ID NO: 1907609 - DNA, 20 bp, Homo sapiens
ataaacaccactggattaat

SEQ ID NO: 1907610 - DNA, 17 bp, Homo sapiens
ataaactagattacatt

SEQ ID NO: 1907611 - DNA, 19 bp, Homo sapiens
ataaactagattacattca

SEQ ID NO: 1907612 - DNA, 17 bp, Homo sapiens
ataaagagaaccatgtg

SEQ ID NO: 1907613 - DNA, 14 bp, Homo sapiens
ataaagataaatgc

SEQ ID NO: 1907614 - DNA, 12 bp, Homo sapiens
ataaaggaaata

SEQ ID NO: 1907615 - DNA, 19 bp, Homo sapiens
ataaaggccccaaatacca

SEQ ID NO: 1907616 - DNA, 19 bp, Homo sapiens
ataaaggtgtgctgtgtcc

SEQ ID NO: 1907617 - DNA, 18 bp, Homo sapiens
ataaagtgcaaacagaag

SEQ ID NO: 1907618 - DNA, 13 bp, Homo sapiens
ataaattatggta

SEQ ID NO: 1907619 - DNA, 21 bp, Homo sapiens
ataaattatggtaaaattttg

SEQ ID NO: 1907620 - DNA, 18 bp, Homo sapiens
ataaattgtcttaatgga

SEQ ID NO: 1907621 - DNA, 14 bp, Homo sapiens
ataaatttatttac

SEQ ID NO: 1907622 - DNA, 15 bp, Homo sapiens
ataaattttgaaaag

SEQ ID NO: 1907623 - DNA, 21 bp, Homo sapiens
ataaattttgaaaagtaatat

SEQ ID NO: 1907624 - DNA, 15 bp, Homo sapiens
ataacaaaaaagaga

SEQ ID NO: 1907625 - DNA, 19 bp, Homo sapiens
ataacatgtgaaaagaata

SEQ ID NO: 1907626 - DNA, 15 bp, Homo sapiens
ataactgcagaaaaa

SEQ ID NO: 1907627 - DNA, 20 bp, Homo sapiens
ataactgttgttgataagga

SEQ ID NO: 1907628 - DNA, 20 bp, Homo sapiens
ataacttatattgtaagaaa

SEQ ID NO: 1907629 - DNA, 21 bp, Homo sapiens
ataagaaaagatgtagattta

SEQ ID NO: 1907630 - DNA, 18 bp, Homo sapiens
ataagaggtactaatagt

SEQ ID NO: 1907631 - DNA, 19 bp, Homo sapiens
ataagaggttctaacttct

SEQ ID NO: 1907632 - DNA, 14 bp, Homo sapiens
ataagcaaaatgaa

SEQ ID NO: 1907633 - DNA, 14 bp, Homo sapiens
ataaggaacattta

SEQ ID NO: 1907634 - DNA, 20 bp, Homo sapiens
ataaggagacttctgtcttc

SEQ ID NO: 1907635 - DNA, 19 bp, Homo sapiens
ataagtccatctgtcactt

SEQ ID NO: 1907636 - DNA, 17 bp, Homo sapiens
ataagtgtgaccagttt

SEQ ID NO: 1907637 - DNA, 21 bp, Homo sapiens
ataagtgtgaccagttttgat

SEQ ID NO: 1907638 - DNA, 15 bp, Homo sapiens
ataagttttgtttca

SEQ ID NO: 1907639 - DNA, 22 bp, Homo sapiens
ataatactgaaatgctttagca

SEQ ID NO: 1907640 - DNA, 14 bp, Homo sapiens
ataatactgaacca

SEQ ID NO: 1907641 - DNA, 20 bp, Homo sapiens
ataatactgaaccacttgta

SEQ ID NO: 1907642 - DNA, 17 bp, Homo sapiens
ataatcaagagccttaa

SEQ ID NO: 1907643 - DNA, 21 bp, Homo sapiens
ataatcaagagccttaaaaca

SEQ ID NO: 1907644 - DNA, 23 bp, Homo sapiens
ataatcatggctcttagaaactc

SEQ ID NO: 1907645 - DNA, 18 bp, Homo sapiens
ataatgtctagattttga

SEQ ID NO: 1907646 - DNA, 18 bp, Homo sapiens
ataatgtggattaaaacc

SEQ ID NO: 1907647 - DNA, 14 bp, Homo sapiens
ataattctttttta

SEQ ID NO: 1907648 - DNA, 19 bp, Homo sapiens
ataattcttttttattaat

SEQ ID NO: 1907649 - DNA, 21 bp, Homo sapiens
ataattcttttttattaatca

SEQ ID NO: 1907650 - DNA, 21 bp, Homo sapiens
ataatttactgtgactttatt

SEQ ID NO: 1907651 - DNA, 19 bp, Homo sapiens
atacaaatgcatctttgat

SEQ ID NO: 1907652 - DNA, 20 bp, Homo sapiens
atacaaatgcatctttgatg

SEQ ID NO: 1907653 - DNA, 21 bp, Homo sapiens
atacaaatgcatctttgatgt

SEQ ID NO: 1907654 - DNA, 16 bp, Homo sapiens
atacaaatttaacttt

SEQ ID NO: 1907655 - DNA, 15 bp, Homo sapiens
atacaatacatagga

SEQ ID NO: 1907656 - DNA, 18 bp, Homo sapiens
atacacagggaggggatg

SEQ ID NO: 1907657 - DNA, 20 bp, Homo sapiens
atacagaccgaactgttgta

SEQ ID NO: 1907658 - DNA, 17 bp, Homo sapiens
atacatgtttgcagtgt

SEQ ID NO: 1907659 - DNA, 18 bp, Homo sapiens
atacatgtttgcagtgtt

SEQ ID NO: 1907660 - DNA, 14 bp, Homo sapiens
atacattcagacgt

SEQ ID NO: 1907661 - DNA, 21 bp, Homo sapiens
atacatttaaaacattaaaat

SEQ ID NO: 1907662 - DNA, 14 bp, Homo sapiens
ataccaacctgaaa

SEQ ID NO: 1907663 - DNA, 15 bp, Homo sapiens
atactgaaaaataca

SEQ ID NO: 1907664 - DNA, 16 bp, Homo sapiens
atactgaaatgcttta

SEQ ID NO: 1907665 - DNA, 17 bp, Homo sapiens
atacttgaaccataaaa

SEQ ID NO: 1907666 - DNA, 20 bp, Homo sapiens
atacttgaaccataaaatgt

SEQ ID NO: 1907667 - DNA, 22 bp, Homo sapiens
atactttgcagcacagctgaga

SEQ ID NO: 1907668 - DNA, 14 bp, Homo sapiens
atactttgtattgt

SEQ ID NO: 1907669 - DNA, 15 bp, Homo sapiens
atagaaagctttgtt

SEQ ID NO: 1907670 - DNA, 21 bp, Homo sapiens
atagaaatttgcccctggcaa

SEQ ID NO: 1907671 - DNA, 22 bp, Homo sapiens
atagacacttgagttaactttt

SEQ ID NO: 1907672 - DNA, 17 bp, Homo sapiens
atagagtacactgcctg

SEQ ID NO: 1907673 - DNA, 15 bp, Homo sapiens
atagcattgtctatt

SEQ ID NO: 1907674 - DNA, 18 bp, Homo sapiens
atagcccaggatatattt

SEQ ID NO: 1907675 - DNA, 19 bp, Homo sapiens
ataggatgggcttctgtgc

SEQ ID NO: 1907676 - DNA, 14 bp, Homo sapiens
ataggtatgatctg

SEQ ID NO: 1907677 - DNA, 12 bp, Homo sapiens
ataggttatttt

SEQ ID NO: 1907678 - DNA, 19 bp, Homo sapiens
atagtttaaaaatctgcca

SEQ ID NO: 1907679 - DNA, 20 bp, Homo sapiens
atagtttaaaaatctgccac

SEQ ID NO: 1907680 - DNA, 24 bp, Homo sapiens
atagttttatttatatttattgac

SEQ ID NO: 1907681 - DNA, 21 bp, Homo sapiens
atataacttatattgtaagaa

SEQ ID NO: 1907682 - DNA, 20 bp, Homo sapiens
atataagacttaatatgttt

SEQ ID NO: 1907683 - DNA, 18 bp, Homo sapiens
atataatattgtctcttt

SEQ ID NO: 1907684 - DNA, 18 bp, Homo sapiens
atatatgtttttgaaggc

SEQ ID NO: 1907685 - DNA, 20 bp, Homo sapiens
atatattcccctaagatttg

SEQ ID NO: 1907686 - DNA, 22 bp, Homo sapiens
atatatttttactgctttctga

SEQ ID NO: 1907687 - DNA, 21 bp, Homo sapiens
atatcaaattaattgtgtgaa

SEQ ID NO: 1907688 - DNA, 13 bp, Homo sapiens
atatcagcactgg

SEQ ID NO: 1907689 - DNA, 22 bp, Homo sapiens
atatcagcactggattgtagaa

SEQ ID NO: 1907690 - DNA, 14 bp, Homo sapiens
atatccacacattt

SEQ ID NO: 1907691 - DNA, 21 bp, Homo sapiens
atatccttttagtctgcatat

SEQ ID NO: 1907692 - DNA, 19 bp, Homo sapiens
atatctttgagttcaacct

SEQ ID NO: 1907693 - DNA, 16 bp, Homo sapiens
atatgaacatacaaat

SEQ ID NO: 1907694 - DNA, 22 bp, Homo sapiens
atatgattaaaaatatcaaatt

SEQ ID NO: 1907695 - DNA, 11 bp, Homo sapiens
atatgctgcat

SEQ ID NO: 1907696 - DNA, 14 bp, Homo sapiens
atatgggagaaata

SEQ ID NO: 1907697 - DNA, 22 bp, Homo sapiens
atatgtaaatggtatgtcattc

SEQ ID NO: 1907698 - DNA, 16 bp, Homo sapiens
atatgtatatttttga

SEQ ID NO: 1907699 - DNA, 17 bp, Homo sapiens
atatgtatgtgtttaga

SEQ ID NO: 1907700 - DNA, 19 bp, Homo sapiens
atatgtggtccatctctga

SEQ ID NO: 1907701 - DNA, 14 bp, Homo sapiens
atatgttttattca

SEQ ID NO: 1907702 - DNA, 17 bp, Homo sapiens
atattgccattatgctt

SEQ ID NO: 1907703 - DNA, 13 bp, Homo sapiens
atattggttttat

SEQ ID NO: 1907704 - DNA, 17 bp, Homo sapiens
atattggttttatgatg

SEQ ID NO: 1907705 - DNA, 14 bp, Homo sapiens
atattgtaagaaat

SEQ ID NO: 1907706 - DNA, 21 bp, Homo sapiens
atattgttttgcattgtctgt

SEQ ID NO: 1907707 - DNA, 17 bp, Homo sapiens
atatttaagcaataaaa

SEQ ID NO: 1907708 - DNA, 22 bp, Homo sapiens
atatttacaacactttaatggg

SEQ ID NO: 1907709 - DNA, 22 bp, Homo sapiens
atatttagatgtaattttgtgt

SEQ ID NO: 1907710 - DNA, 15 bp, Homo sapiens
atatttattaaattt

SEQ ID NO: 1907711 - DNA, 13 bp, Homo sapiens
atatttattgact

SEQ ID NO: 1907712 - DNA, 16 bp, Homo sapiens
atatttattgactctt

SEQ ID NO: 1907713 - DNA, 13 bp, Homo sapiens
atatttattttta

SEQ ID NO: 1907714 - DNA, 23 bp, Homo sapiens
atatttgatttattaacttaata

SEQ ID NO: 1907715 - DNA, 20 bp, Homo sapiens
atattttatttttagaattt

SEQ ID NO: 1907716 - DNA, 12 bp, Homo sapiens
atatttttaaca

SEQ ID NO: 1907717 - DNA, 22 bp, Homo sapiens
atatttttactgctttctgaat

SEQ ID NO: 1907718 - DNA, 17 bp, Homo sapiens
atcaaaaaggcttataa

SEQ ID NO: 1907719 - DNA, 13 bp, Homo sapiens
atcaaactgcttt

SEQ ID NO: 1907720 - DNA, 13 bp, Homo sapiens
atcaaatacattt

SEQ ID NO: 1907721 - DNA, 14 bp, Homo sapiens
atcaaatgtaaagt

SEQ ID NO: 1907722 - DNA, 14 bp, Homo sapiens
atcaagctcaaggc

SEQ ID NO: 1907723 - DNA, 16 bp, Homo sapiens
atcaaggcactaatgt

SEQ ID NO: 1907724 - DNA, 13 bp, Homo sapiens
atcacaaatgact

SEQ ID NO: 1907725 - DNA, 14 bp, Homo sapiens
atcacaaatgactt

SEQ ID NO: 1907726 - DNA, 14 bp, Homo sapiens
atcacaataaagag

SEQ ID NO: 1907727 - DNA, 15 bp, Homo sapiens
atcacagcagggcct

SEQ ID NO: 1907728 - DNA, 14 bp, Homo sapiens
atcacaggctgggc

SEQ ID NO: 1907729 - DNA, 20 bp, Homo sapiens
atcacaggctgggctgggca

SEQ ID NO: 1907730 - DNA, 23 bp, Homo sapiens
atcacaggctgggctgggcactg

SEQ ID NO: 1907731 - DNA, 18 bp, Homo sapiens
atcacagggcctcagttt

SEQ ID NO: 1907732 - DNA, 23 bp, Homo sapiens
atcacggcttttggtgaatttgt

SEQ ID NO: 1907733 - DNA, 12 bp, Homo sapiens
atcactgaaata

SEQ ID NO: 1907734 - DNA, 16 bp, Homo sapiens
atcactggcatggtgg

SEQ ID NO: 1907735 - DNA, 19 bp, Homo sapiens
atcactgtgtatatttgat

SEQ ID NO: 1907736 - DNA, 17 bp, Homo sapiens
atcactgtttagatttg

SEQ ID NO: 1907737 - DNA, 15 bp, Homo sapiens
atcacttaaaacacg

SEQ ID NO: 1907738 - DNA, 14 bp, Homo sapiens
atcagaacagctgt

SEQ ID NO: 1907739 - DNA, 14 bp, Homo sapiens
atcagcactggatt

SEQ ID NO: 1907740 - DNA, 22 bp, Homo sapiens
atcagcactggattgtagaact

SEQ ID NO: 1907741 - DNA, 16 bp, Homo sapiens
atcagctacccctgca

SEQ ID NO: 1907742 - DNA, 13 bp, Homo sapiens
atcaggctcccag

SEQ ID NO: 1907743 - DNA, 23 bp, Homo sapiens
atcatggctcttagaaactcagg

SEQ ID NO: 1907744 - DNA, 14 bp, Homo sapiens
atcattccttttta

SEQ ID NO: 1907745 - DNA, 15 bp, Homo sapiens
atcattcctttttat

SEQ ID NO: 1907746 - DNA, 20 bp, Homo sapiens
atcattcctttttatttata

SEQ ID NO: 1907747 - DNA, 23 bp, Homo sapiens
atcattcctttttatttatatgt

SEQ ID NO: 1907748 - DNA, 12 bp, Homo sapiens
atcattgcaaac

SEQ ID NO: 1907749 - DNA, 21 bp, Homo sapiens
atcattgcaaacaactgaaat

SEQ ID NO: 1907750 - DNA, 22 bp, Homo sapiens
atcattgcaaacaactgaaatg

SEQ ID NO: 1907751 - DNA, 18 bp, Homo sapiens
atcattgttcttttcaat

SEQ ID NO: 1907752 - DNA, 14 bp, Homo sapiens
atcatttgagttca

SEQ ID NO: 1907753 - DNA, 23 bp, Homo sapiens
atccaagcttttttaaagtaaaa

SEQ ID NO: 1907754 - DNA, 17 bp, Homo sapiens
atccagagagtattcta

SEQ ID NO: 1907755 - DNA, 16 bp, Homo sapiens
atccaggaattgatac

SEQ ID NO: 1907756 - DNA, 15 bp, Homo sapiens
atccaggaccctgcc

SEQ ID NO: 1907757 - DNA, 23 bp, Homo sapiens
atccaggaccctgccaggcacag

SEQ ID NO: 1907758 - DNA, 19 bp, Homo sapiens
atccatattaagtaagtct

SEQ ID NO: 1907759 - DNA, 23 bp, Homo sapiens
atccatggggtctctcacagaca

SEQ ID NO: 1907760 - DNA, 22 bp, Homo sapiens
atccattttttatatttcaagt

SEQ ID NO: 1907761 - DNA, 11 bp, Homo sapiens
atccccttcca

SEQ ID NO: 1907762 - DNA, 13 bp, Homo sapiens
atccccttccagc

SEQ ID NO: 1907763 - DNA, 17 bp, Homo sapiens
atcccctttcctgcccc

SEQ ID NO: 1907764 - DNA, 22 bp, Homo sapiens
atcccggcagcgaggctgggct

SEQ ID NO: 1907765 - DNA, 18 bp, Homo sapiens
atcccgtttccctccagg

SEQ ID NO: 1907766 - DNA, 17 bp, Homo sapiens
atccctctcctctgccc

SEQ ID NO: 1907767 - DNA, 19 bp, Homo sapiens
atccctctcctctgccctc

SEQ ID NO: 1907768 - DNA, 21 bp, Homo sapiens
atccctctcctctgccctctg

SEQ ID NO: 1907769 - DNA, 15 bp, Homo sapiens
atccctgctcactgc

SEQ ID NO: 1907770 - DNA, 16 bp, Homo sapiens
atccctgctcactgca

SEQ ID NO: 1907771 - DNA, 23 bp, Homo sapiens
atcctcatggcccatcaggggca

SEQ ID NO: 1907772 - DNA, 22 bp, Homo sapiens
atcctcccctggactcccgtgt

SEQ ID NO: 1907773 - DNA, 21 bp, Homo sapiens
atcctgggcagcttgggctgg

SEQ ID NO: 1907774 - DNA, 16 bp, Homo sapiens
atcctgtcatctgaga

SEQ ID NO: 1907775 - DNA, 23 bp, Homo sapiens
atctagggagccctgggccaggg

SEQ ID NO: 1907776 - DNA, 17 bp, Homo sapiens
atctagttgtcaataaa

SEQ ID NO: 1907777 - DNA, 18 bp, Homo sapiens
atctagttgtcaataaat

SEQ ID NO: 1907778 - DNA, 21 bp, Homo sapiens
atctataggaagattgaacct

SEQ ID NO: 1907779 - DNA, 21 bp, Homo sapiens
atctatttttcttcagactga

SEQ ID NO: 1907780 - DNA, 12 bp, Homo sapiens
atctcacagcta

SEQ ID NO: 1907781 - DNA, 13 bp, Homo sapiens
atctctctgggat

SEQ ID NO: 1907782 - DNA, 10 bp, Homo sapiens
atctcttcct

SEQ ID NO: 1907783 - DNA, 17 bp, Homo sapiens
atctgagaatgaacaaa

SEQ ID NO: 1907784 - DNA, 21 bp, Homo sapiens
atctgatatcagcactggatt

SEQ ID NO: 1907785 - DNA, 14 bp, Homo sapiens
atctgattccagca

SEQ ID NO: 1907786 - DNA, 13 bp, Homo sapiens
atctgccacctgc

SEQ ID NO: 1907787 - DNA, 15 bp, Homo sapiens
atctgggtagctgta

SEQ ID NO: 1907788 - DNA, 13 bp, Homo sapiens
atctggttttctc

SEQ ID NO: 1907789 - DNA, 17 bp, Homo sapiens
atctgtaagagtgttta

SEQ ID NO: 1907790 - DNA, 11 bp, Homo sapiens
atctgtgaata

SEQ ID NO: 1907791 - DNA, 18 bp, Homo sapiens
atcttaagtcataatgaa

SEQ ID NO: 1907792 - DNA, 16 bp, Homo sapiens
atcttactttgtaaat

SEQ ID NO: 1907793 - DNA, 17 bp, Homo sapiens
atcttactttgtaaatt

SEQ ID NO: 1907794 - DNA, 19 bp, Homo sapiens
atcttactttgtaaattct

SEQ ID NO: 1907795 - DNA, 20 bp, Homo sapiens
atcttactttgtaaattctg

SEQ ID NO: 1907796 - DNA, 16 bp, Homo sapiens
atcttggccttactgt

SEQ ID NO: 1907797 - DNA, 17 bp, Homo sapiens
atcttggccttactgta

SEQ ID NO: 1907798 - DNA, 21 bp, Homo sapiens
atcttgtaaatattgttttgc

SEQ ID NO: 1907799 - DNA, 19 bp, Homo sapiens
atctttgatgtgttgttct

SEQ ID NO: 1907800 - DNA, 22 bp, Homo sapiens
atcttttgttactcttgggaca

SEQ ID NO: 1907801 - DNA, 22 bp, Homo sapiens
atgaaaatttcacttgaaatta

SEQ ID NO: 1907802 - DNA, 14 bp, Homo sapiens
atgaaataataaag

SEQ ID NO: 1907803 - DNA, 19 bp, Homo sapiens
atgaaatacacaagtaaac

SEQ ID NO: 1907804 - DNA, 13 bp, Homo sapiens
atgaaatgaattt

SEQ ID NO: 1907805 - DNA, 13 bp, Homo sapiens
atgaacacagctc

SEQ ID NO: 1907806 - DNA, 20 bp, Homo sapiens
atgaacacagctctttaaca

SEQ ID NO: 1907807 - DNA, 14 bp, Homo sapiens
atgaactgtaaatg

SEQ ID NO: 1907808 - DNA, 13 bp, Homo sapiens
atgaagaatttaa

SEQ ID NO: 1907809 - DNA, 19 bp, Homo sapiens
atgaagctgaggctgctgc

SEQ ID NO: 1907810 - DNA, 19 bp, Homo sapiens
atgacaacaaattttggtt

SEQ ID NO: 1907811 - DNA, 15 bp, Homo sapiens
atgacaggcctgtcc

SEQ ID NO: 1907812 - DNA, 19 bp, Homo sapiens
atgacgtacaagtagttct

SEQ ID NO: 1907813 - DNA, 18 bp, Homo sapiens
atgactttattatttatt

SEQ ID NO: 1907814 - DNA, 21 bp, Homo sapiens
atgactttattgcatctgggt

SEQ ID NO: 1907815 - DNA, 13 bp, Homo sapiens
atgaggaggcaga

SEQ ID NO: 1907816 - DNA, 13 bp, Homo sapiens
atgagtttcacag

SEQ ID NO: 1907817 - DNA, 17 bp, Homo sapiens
atgatatgcttgtaact

SEQ ID NO: 1907818 - DNA, 19 bp, Homo sapiens
atgatcacaactgagatca

SEQ ID NO: 1907819 - DNA, 18 bp, Homo sapiens
atgatgtgcctgcttcag

SEQ ID NO: 1907820 - DNA, 19 bp, Homo sapiens
atgatgttagttttcctta

SEQ ID NO: 1907821 - DNA, 14 bp, Homo sapiens
atgatgttgtaaaa

SEQ ID NO: 1907822 - DNA, 13 bp, Homo sapiens
atgattgaagaaa

SEQ ID NO: 1907823 - DNA, 17 bp, Homo sapiens
atgatttaatttgaaat

SEQ ID NO: 1907824 - DNA, 17 bp, Homo sapiens
atgcaatttttctttct

SEQ ID NO: 1907825 - DNA, 21 bp, Homo sapiens
atgcagtcttagatcatagtt

SEQ ID NO: 1907826 - DNA, 22 bp, Homo sapiens
atgcagtcttagatcatagttt

SEQ ID NO: 1907827 - DNA, 14 bp, Homo sapiens
atgcatattactgt

SEQ ID NO: 1907828 - DNA, 12 bp, Homo sapiens
atgcatctttga

SEQ ID NO: 1907829 - DNA, 21 bp, Homo sapiens
atgcatctttgatgtgttgtt

SEQ ID NO: 1907830 - DNA, 18 bp, Homo sapiens
atgcatttatcaataaaa

SEQ ID NO: 1907831 - DNA, 17 bp, Homo sapiens
atgcccagctgtgctgg

SEQ ID NO: 1907832 - DNA, 14 bp, Homo sapiens
atgccccctcccct

SEQ ID NO: 1907833 - DNA, 15 bp, Homo sapiens
atgccccctcccctc

SEQ ID NO: 1907834 - DNA, 18 bp, Homo sapiens
atgccccctcccctcctt

SEQ ID NO: 1907835 - DNA, 15 bp, Homo sapiens
atgcctcctcctgcc

SEQ ID NO: 1907836 - DNA, 19 bp, Homo sapiens
atgcctcctcctgccctcc

SEQ ID NO: 1907837 - DNA, 20 bp, Homo sapiens
atgcctcctcctgccctccg

SEQ ID NO: 1907838 - DNA, 20 bp, Homo sapiens
atgctaatatttttaacaag

SEQ ID NO: 1907839 - DNA, 23 bp, Homo sapiens
atgctgaacattgcatataactt

SEQ ID NO: 1907840 - DNA, 18 bp, Homo sapiens
atgctgacataattctaa

SEQ ID NO: 1907841 - DNA, 16 bp, Homo sapiens
atgctgacccatgggc

SEQ ID NO: 1907842 - DNA, 17 bp, Homo sapiens
atgctgacccatgggca

SEQ ID NO: 1907843 - DNA, 22 bp, Homo sapiens
atgctgactgatggttaaataa

SEQ ID NO: 1907844 - DNA, 18 bp, Homo sapiens
atgctgggcccctgctca

SEQ ID NO: 1907845 - DNA, 17 bp, Homo sapiens
atgctgtctggcacagc

SEQ ID NO: 1907846 - DNA, 19 bp, Homo sapiens
atgctgtctggcacagcct

SEQ ID NO: 1907847 - DNA, 13 bp, Homo sapiens
atggacagacaga

SEQ ID NO: 1907848 - DNA, 18 bp, Homo sapiens
atggaggaagaactgaaa

SEQ ID NO: 1907849 - DNA, 20 bp, Homo sapiens
atggaggaagaactgaaagg

SEQ ID NO: 1907850 - DNA, 20 bp, Homo sapiens
atggatcgatattaatgtat

SEQ ID NO: 1907851 - DNA, 13 bp, Homo sapiens
atggatggacaga

SEQ ID NO: 1907852 - DNA, 23 bp, Homo sapiens
atggcaagttttccatattttta

SEQ ID NO: 1907853 - DNA, 15 bp, Homo sapiens
atggcagtggctgtg

SEQ ID NO: 1907854 - DNA, 16 bp, Homo sapiens
atggcagtggctgtga

SEQ ID NO: 1907855 - DNA, 19 bp, Homo sapiens
atggccacatcctcatggc

SEQ ID NO: 1907856 - DNA, 23 bp, Homo sapiens
atggccacatcctcatggcccat

SEQ ID NO: 1907857 - DNA, 23 bp, Homo sapiens
atggctctgggcggtccagaagg

SEQ ID NO: 1907858 - DNA, 23 bp, Homo sapiens
atggctttatttttttgaactct

SEQ ID NO: 1907859 - DNA, 22 bp, Homo sapiens
atgggagaaatagtgtggaaat

SEQ ID NO: 1907860 - DNA, 17 bp, Homo sapiens
atgggaggggaaatggg

SEQ ID NO: 1907861 - DNA, 13 bp, Homo sapiens
atgggcaggagac

SEQ ID NO: 1907862 - DNA, 15 bp, Homo sapiens
atgggccacacaagt

SEQ ID NO: 1907863 - DNA, 12 bp, Homo sapiens
atgggcctgagt

SEQ ID NO: 1907864 - DNA, 21 bp, Homo sapiens
atggggtctctcacagacagg

SEQ ID NO: 1907865 - DNA, 13 bp, Homo sapiens
gtctccctcctga

SEQ ID NO: 1907866 - DNA, 14 bp, Homo sapiens
gtctccctcctgat

SEQ ID NO: 1907867 - DNA, 12 bp, Homo sapiens
gtctccctggcc

SEQ ID NO: 1907868 - DNA, 21 bp, Homo sapiens
gtctccctggcctcagggctc

SEQ ID NO: 1907869 - DNA, 19 bp, Homo sapiens
gtctcctgtttcagaccag

SEQ ID NO: 1907870 - DNA, 22 bp, Homo sapiens
gtctcgctctgttgcccaggct

SEQ ID NO: 1907871 - DNA, 17 bp, Homo sapiens
gtctctagtgctgtgaa

SEQ ID NO: 1907872 - DNA, 23 bp, Homo sapiens
gtctctcccagctctgggggact

SEQ ID NO: 1907873 - DNA, 18 bp, Homo sapiens
gtctctgtctgatcctgt

SEQ ID NO: 1907874 - DNA, 17 bp, Homo sapiens
gtctgacagccagagcg

SEQ ID NO: 1907875 - DNA, 22 bp, Homo sapiens
gtctgaggccgttgctgactta

SEQ ID NO: 1907876 - DNA, 13 bp, Homo sapiens
gtctgccaccagc

SEQ ID NO: 1907877 - DNA, 15 bp, Homo sapiens
gtctggaactgctgc

SEQ ID NO: 1907878 - DNA, 16 bp, Homo sapiens
gtctggaactgctgct

SEQ ID NO: 1907879 - DNA, 22 bp, Homo sapiens
gtctggaactgctgctgacccc

SEQ ID NO: 1907880 - DNA, 13 bp, Homo sapiens
gtctggcacagcc

SEQ ID NO: 1907881 - DNA, 17 bp, Homo sapiens
gtctggcacagcctgca

SEQ ID NO: 1907882 - DNA, 14 bp, Homo sapiens
gtctggccagggag

SEQ ID NO: 1907883 - DNA, 19 bp, Homo sapiens
gtctggccagggaggagcc

SEQ ID NO: 1907884 - DNA, 18 bp, Homo sapiens
gtctgggctcctcttggg

SEQ ID NO: 1907885 - DNA, 15 bp, Homo sapiens
gtctggggaccagct

SEQ ID NO: 1907886 - DNA, 17 bp, Homo sapiens
gtctgggtttggcaggc

SEQ ID NO: 1907887 - DNA, 22 bp, Homo sapiens
gtctgtgtggccagcagcctct

SEQ ID NO: 1907888 - DNA, 16 bp, Homo sapiens
gtctgtgtttaaagtg

SEQ ID NO: 1907889 - DNA, 16 bp, Homo sapiens
gtctgttgattaaaga

SEQ ID NO: 1907890 - DNA, 13 bp, Homo sapiens
gtctttctcactg

SEQ ID NO: 1907891 - DNA, 18 bp, Homo sapiens
gtctttggccagaacacc

SEQ ID NO: 1907892 - DNA, 16 bp, Homo sapiens
gtctttttacattgtg

SEQ ID NO: 1907893 - DNA, 14 bp, Homo sapiens
gtgaaaaaaaaaat

SEQ ID NO: 1907894 - DNA, 18 bp, Homo sapiens
gtgaaaaaaaaaatgctg

SEQ ID NO: 1907895 - DNA, 13 bp, Homo sapiens
gtgaaaataattg

SEQ ID NO: 1907896 - DNA, 14 bp, Homo sapiens
gtgaaactcccacc

SEQ ID NO: 1907897 - DNA, 16 bp, Homo sapiens
gtgaacatgcctcctc

SEQ ID NO: 1907898 - DNA, 22 bp, Homo sapiens
gtgaacatgcctcctcctgccc

SEQ ID NO: 1907899 - DNA, 20 bp, Homo sapiens
gtgaagatactttgtattgt

SEQ ID NO: 1907900 - DNA, 22 bp, Homo sapiens
gtgaatactgcttgaataaaca

SEQ ID NO: 1907901 - DNA, 18 bp, Homo sapiens
gtgacctcacacacctct

SEQ ID NO: 1907902 - DNA, 22 bp, Homo sapiens
gtgacctcacacacctctgccc

SEQ ID NO: 1907903 - DNA, 17 bp, Homo sapiens
gtgagaggggaggccaa

SEQ ID NO: 1907904 - DNA, 18 bp, Homo sapiens
gtgaggaaatcaaagtgc

SEQ ID NO: 1907905 - DNA, 17 bp, Homo sapiens
gcactggattgtagaac

SEQ ID NO: 1907906 - DNA, 12 bp, Homo sapiens
gcactgggagca

SEQ ID NO: 1907907 - DNA, 18 bp, Homo sapiens
gcacttgggggctcagca

SEQ ID NO: 1907908 - DNA, 20 bp, Homo sapiens
gcagaaagcaaaattatgtt

SEQ ID NO: 1907909 - DNA, 19 bp, Homo sapiens
gcagacatcaagctcaagg

SEQ ID NO: 1907910 - DNA, 19 bp, Homo sapiens
gcagacttttaaagacttg

SEQ ID NO: 1907911 - DNA, 14 bp, Homo sapiens
gcagaggtggtctg

SEQ ID NO: 1907912 - DNA, 23 bp, Homo sapiens
gcagatgcgtagcatttgctgca

SEQ ID NO: 1907913 - DNA, 15 bp, Homo sapiens
gcagcacgcctctcc

SEQ ID NO: 1907914 - DNA, 16 bp, Homo sapiens
gcagcacgcctctccc

SEQ ID NO: 1907915 - DNA, 21 bp, Homo sapiens
gcagcaggggccaagcaggca

SEQ ID NO: 1907916 - DNA, 17 bp, Homo sapiens
gcagcataaagaatttg

SEQ ID NO: 1907917 - DNA, 21 bp, Homo sapiens
gcagccagccaaacacacaga

SEQ ID NO: 1907918 - DNA, 19 bp, Homo sapiens
gcagcccgcatcagctgct

SEQ ID NO: 1907919 - DNA, 19 bp, Homo sapiens
gcagcctccgcttccctgg

SEQ ID NO: 1907920 - DNA, 19 bp, Homo sapiens
gcagcctctgatctgtgca

SEQ ID NO: 1907921 - DNA, 13 bp, Homo sapiens
gcagccttccagt

SEQ ID NO: 1907922 - DNA, 23 bp, Homo sapiens
gcagccttccagtggcttctccc

SEQ ID NO: 1907923 - DNA, 15 bp, Homo sapiens
gcagcgccactgtcc

SEQ ID NO: 1907924 - DNA, 20 bp, Homo sapiens
gcagcgccactgtccgctgt

SEQ ID NO: 1907925 - DNA, 14 bp, Homo sapiens
gcagcttgggctgg

SEQ ID NO: 1907926 - DNA, 16 bp, Homo sapiens
gcaggaccagcccacg

SEQ ID NO: 1907927 - DNA, 13 bp, Homo sapiens
gcaggacgactgt

SEQ ID NO: 1907928 - DNA, 19 bp, Homo sapiens
gcaggcactgaagctgcgg

SEQ ID NO: 1907929 - DNA, 18 bp, Homo sapiens
gcaggccctgggcctcca

SEQ ID NO: 1907930 - DNA, 19 bp, Homo sapiens
gcaggctcctcagccctct

SEQ ID NO: 1907931 - DNA, 15 bp, Homo sapiens
gctgacccctgtgtg

SEQ ID NO: 1907932 - DNA, 19 bp, Homo sapiens
gctgagacccttatttaaa

SEQ ID NO: 1907933 - DNA, 12 bp, Homo sapiens
gctgaggcccat

SEQ ID NO: 1907934 - DNA, 20 bp, Homo sapiens
gctgaggcccatggccacat

SEQ ID NO: 1907935 - DNA, 14 bp, Homo sapiens
gctgaggctgctgc

SEQ ID NO: 1907936 - DNA, 16 bp, Homo sapiens
gctgagtgcaggccca

SEQ ID NO: 1907937 - DNA, 21 bp, Homo sapiens
gctgagtgcaggcccaccctg

SEQ ID NO: 1907938 - DNA, 14 bp, Homo sapiens
gctgatgaggaata

SEQ ID NO: 1907939 - DNA, 17 bp, Homo sapiens
gctgattttgaccttgt

SEQ ID NO: 1907940 - DNA, 20 bp, Homo sapiens
gctgcatccccttccagctc

SEQ ID NO: 1907941 - DNA, 18 bp, Homo sapiens
gctgctgacccctgtgtg

SEQ ID NO: 1907942 - DNA, 12 bp, Homo sapiens
gctgctgtgaag

SEQ ID NO: 1907943 - DNA, 14 bp, Homo sapiens
gctggaactcttga

SEQ ID NO: 1907944 - DNA, 21 bp, Homo sapiens
gctggaactcttgacagctat

SEQ ID NO: 1907945 - DNA, 21 bp, Homo sapiens
gctggagaggagccctgcctc

SEQ ID NO: 1907946 - DNA, 17 bp, Homo sapiens
gctggagtctgggctcc

SEQ ID NO: 1907947 - DNA, 18 bp, Homo sapiens
gctggcaccagcaggcac

SEQ ID NO: 1907948 - DNA, 15 bp, Homo sapiens
gctggccggacaccc

SEQ ID NO: 1907949 - DNA, 18 bp, Homo sapiens
gctgggaggtcccagggc

SEQ ID NO: 1907950 - DNA, 19 bp, Homo sapiens
gctgggaggtcccagggcc

SEQ ID NO: 1907951 - DNA, 15 bp, Homo sapiens
gctgggcactgctct

SEQ ID NO: 1907952 - DNA, 20 bp, Homo sapiens
gctgggcactgctctcacct

SEQ ID NO: 1907953 - DNA, 13 bp, Homo sapiens
gctgggctgggca

SEQ ID NO: 1907954 - DNA, 19 bp, Homo sapiens
gctgggggatgggcctgag

SEQ ID NO: 1907955 - DNA, 12 bp, Homo sapiens
gctgggggctgc

SEQ ID NO: 1907956 - DNA, 16 bp, Homo sapiens
gctgggggctgcaggg

SEQ ID NO: 1907957 - DNA, 17 bp, Homo sapiens
gctgggggctgcagggc

SEQ ID NO: 1907958 - DNA, 19 bp, Homo sapiens
gctgggggctgcagggctg

SEQ ID NO: 1907959 - DNA, 20 bp, Homo sapiens
gctgggggctgcagggctgg

SEQ ID NO: 1907960 - DNA, 16 bp, Homo sapiens
gctggtaaaatgaaga

SEQ ID NO: 1907961 - DNA, 16 bp, Homo sapiens
gctgtctccctcctga

SEQ ID NO: 1907962 - DNA, 19 bp, Homo sapiens
gctgtctggcacagcctgc

SEQ ID NO: 1907963 - DNA, 20 bp, Homo sapiens
gctgtgaacatgcctcctcc

SEQ ID NO: 1907964 - DNA, 17 bp, Homo sapiens
gctgtttgggtttccaa

SEQ ID NO: 1907965 - DNA, 21 bp, Homo sapiens
gcttaactggactgaattcaa

SEQ ID NO: 1907966 - DNA, 15 bp, Homo sapiens
gcttacgtagttcta

SEQ ID NO: 1907967 - DNA, 19 bp, Homo sapiens
gcttcagcctcccacagtg

SEQ ID NO: 1907968 - DNA, 14 bp, Homo sapiens
gcttcagtgaacat

SEQ ID NO: 1907969 - DNA, 16 bp, Homo sapiens
gcttccaattttcctt

SEQ ID NO: 1907970 - DNA, 13 bp, Homo sapiens
gcttccagcagga

SEQ ID NO: 1907971 - DNA, 18 bp, Homo sapiens
gcttcctataattttgat

SEQ ID NO: 1907972 - DNA, 15 bp, Homo sapiens
gcttcctgaggggag

SEQ ID NO: 1907973 - DNA, 21 bp, Homo sapiens
gcttctagtctggaactgctg

SEQ ID NO: 1907974 - DNA, 16 bp, Homo sapiens
gcttctggatgggaca

SEQ ID NO: 1907975 - DNA, 15 bp, Homo sapiens
gcttctgtgcccaga

SEQ ID NO: 1907976 - DNA, 19 bp, Homo sapiens
gcttctgtgcccagaatac

SEQ ID NO: 1907977 - DNA, 21 bp, Homo sapiens
gcttctgtgcccagaatactg

SEQ ID NO: 1907978 - DNA, 15 bp, Homo sapiens
gcttggctcctttca

SEQ ID NO: 1907979 - DNA, 15 bp, Homo sapiens
gcttgggaattttat

SEQ ID NO: 1907980 - DNA, 18 bp, Homo sapiens
gcttggtgagtctgtgtg

SEQ ID NO: 1907981 - DNA, 23 bp, Homo sapiens
gcttgtaactaaaataattttgt

SEQ ID NO: 1907982 - DNA, 13 bp, Homo sapiens
gcttgtagttctt

SEQ ID NO: 1907983 - DNA, 16 bp, Homo sapiens
gcttgtggaagacaag

SEQ ID NO: 1907984 - DNA, 12 bp, Homo sapiens
gctttagacttg

SEQ ID NO: 1907985 - DNA, 17 bp, Homo sapiens
gctttagacttgaaaag

SEQ ID NO: 1907986 - DNA, 21 bp, Homo sapiens
gctttagacttgaaaagagac

SEQ ID NO: 1907987 - DNA, 18 bp, Homo sapiens
gctttatttataaaataa

SEQ ID NO: 1907988 - DNA, 16 bp, Homo sapiens
gctttatttttttgaa

SEQ ID NO: 1907989 - DNA, 11 bp, Homo sapiens
gctttcctttc

SEQ ID NO: 1907990 - DNA, 12 bp, Homo sapiens
gctttcctttcc

SEQ ID NO: 1907991 - DNA, 20 bp, Homo sapiens
gctttctttcgtttgtttgt

SEQ ID NO: 1907992 - DNA, 16 bp, Homo sapiens
gctttgccatgtgctt

SEQ ID NO: 1907993 - DNA, 14 bp, Homo sapiens
gctttggaagtttt

SEQ ID NO: 1907994 - DNA, 18 bp, Homo sapiens
gctttgtctacttcaaaa

SEQ ID NO: 1907995 - DNA, 21 bp, Homo sapiens
gcttttcttggccaacagaac

SEQ ID NO: 1907996 - DNA, 20 bp, Homo sapiens
gcttttggtgaatttgttta

SEQ ID NO: 1907997 - DNA, 17 bp, Homo sapiens
ggaaaagatatttttat

SEQ ID NO: 1907998 - DNA, 11 bp, Homo sapiens
ggaaaaggaag

SEQ ID NO: 1907999 - DNA, 23 bp, Homo sapiens
ggaaaaggaaggtagttcaagaa

SEQ ID NO: 1908000 - DNA, 21 bp, Homo sapiens
ggaaacttgatttgagatttt

SEQ ID NO: 1908001 - DNA, 14 bp, Homo sapiens
ggaaagagagctgg

SEQ ID NO: 1908002 - DNA, 17 bp, Homo sapiens
ggaaagagagctggagt

SEQ ID NO: 1908003 - DNA, 15 bp, Homo sapiens
ggaaagtgttcattg

SEQ ID NO: 1908004 - DNA, 20 bp, Homo sapiens
ggaaagtgttcattgcacaa

SEQ ID NO: 1908005 - DNA, 13 bp, Homo sapiens
ggaacaagttgag

SEQ ID NO: 1908006 - DNA, 16 bp, Homo sapiens
ggaacccccagcccag

SEQ ID NO: 1908007 - DNA, 13 bp, Homo sapiens
ggaacgcccactt

SEQ ID NO: 1908008 - DNA, 19 bp, Homo sapiens
ggaacgcccacttccctgg

SEQ ID NO: 1908009 - DNA, 15 bp, Homo sapiens
ggaactgctgctgac

SEQ ID NO: 1908010 - DNA, 14 bp, Homo sapiens
ggaagacaagtctg

SEQ ID NO: 1908011 - DNA, 14 bp, Homo sapiens
ggaagacagcagga

SEQ ID NO: 1908012 - DNA, 14 bp, Homo sapiens
ggaagcagtgccca

SEQ ID NO: 1908013 - DNA, 12 bp, Homo sapiens
ggaagctgaggc

SEQ ID NO: 1908014 - DNA, 20 bp, Homo sapiens
ggaaggtagttcaagaaatg

SEQ ID NO: 1908015 - DNA, 21 bp, Homo sapiens
ggaaggtagttcaagaaatga

SEQ ID NO: 1908016 - DNA, 15 bp, Homo sapiens
ggaagtagcacaggc

SEQ ID NO: 1908017 - DNA, 22 bp, Homo sapiens
ggaataagccttcgaaaagaaa

SEQ ID NO: 1908018 - DNA, 21 bp, Homo sapiens
ggaatctagccagtgaacata

SEQ ID NO: 1908019 - DNA, 19 bp, Homo sapiens
ggaattgatacgtttatta

SEQ ID NO: 1908020 - DNA, 13 bp, Homo sapiens
ggaatttttttgt

SEQ ID NO: 1908021 - DNA, 17 bp, Homo sapiens
ggacaaccttggcttgg

SEQ ID NO: 1908022 - DNA, 22 bp, Homo sapiens
ggacaaccttggcttggccctg

SEQ ID NO: 1908023 - DNA, 15 bp, Homo sapiens
ggacactgtggcagc

SEQ ID NO: 1908024 - DNA, 17 bp, Homo sapiens
ggacactgtggcagcag

SEQ ID NO: 1908025 - DNA, 14 bp, Homo sapiens
ggacagcctgcctc

SEQ ID NO: 1908026 - DNA, 12 bp, Homo sapiens
ggaccacagagg

SEQ ID NO: 1908027 - DNA, 14 bp, Homo sapiens
ggaccacagaggct

SEQ ID NO: 1908028 - DNA, 15 bp, Homo sapiens
ggaccacagaggctg

SEQ ID NO: 1908029 - DNA, 23 bp, Homo sapiens
ggaccacgtctatttcatcagaa

SEQ ID NO: 1908030 - DNA, 12 bp, Homo sapiens
ggaccagcccac

SEQ ID NO: 1908031 - DNA, 16 bp, Homo sapiens
ggaccatgctgtctgg

SEQ ID NO: 1908032 - DNA, 22 bp, Homo sapiens
ggaccatgctgtctggcacagc

SEQ ID NO: 1908033 - DNA, 17 bp, Homo sapiens
ggacccaagtactttcc

SEQ ID NO: 1908034 - DNA, 19 bp, Homo sapiens
ggacccagtggcagggcac

SEQ ID NO: 1908035 - DNA, 15 bp, Homo sapiens
ggaccccagcctcaa

SEQ ID NO: 1908036 - DNA, 16 bp, Homo sapiens
ggaccctccaaggcca

SEQ ID NO: 1908037 - DNA, 18 bp, Homo sapiens
ggaccctccaaggccagg

SEQ ID NO: 1908038 - DNA, 17 bp, Homo sapiens
ggaccctgccaggcaca

SEQ ID NO: 1908039 - DNA, 18 bp, Homo sapiens
ggaccctgccaggcacag

SEQ ID NO: 1908040 - DNA, 13 bp, Homo sapiens
ggactccttcctt

SEQ ID NO: 1908041 - DNA, 12 bp, Homo sapiens
ggactctctgac

SEQ ID NO: 1908042 - DNA, 17 bp, Homo sapiens
ggactctctgacaaagt

SEQ ID NO: 1908043 - DNA, 18 bp, Homo sapiens
ggactctgtctggccagg

SEQ ID NO: 1908044 - DNA, 23 bp, Homo sapiens
ggactctgtctggccagggagga

SEQ ID NO: 1908045 - DNA, 15 bp, Homo sapiens
ggactgactgaggca

SEQ ID NO: 1908046 - DNA, 16 bp, Homo sapiens
ggactgactgaggcag

SEQ ID NO: 1908047 - DNA, 17 bp, Homo sapiens
ggactgactgaggcagt

SEQ ID NO: 1908048 - DNA, 13 bp, Homo sapiens
ggactgccacctc

SEQ ID NO: 1908049 - DNA, 21 bp, Homo sapiens
ggactgctgtgaacatgcctc

SEQ ID NO: 1908050 - DNA, 19 bp, Homo sapiens
ggactgggcccgagggtgg

SEQ ID NO: 1908051 - DNA, 12 bp, Homo sapiens
ggagaaaaacaa

SEQ ID NO: 1908052 - DNA, 20 bp, Homo sapiens
ggagaagtttgggaaaagcc

SEQ ID NO: 1908053 - DNA, 17 bp, Homo sapiens
ggagaatcacaggctgg

SEQ ID NO: 1908054 - DNA, 22 bp, Homo sapiens
ggagacagagcaacccctggac

SEQ ID NO: 1908055 - DNA, 19 bp, Homo sapiens
ggagactgctcctgagccc

SEQ ID NO: 1908056 - DNA, 12 bp, Homo sapiens
ggagaggagccc

SEQ ID NO: 1908057 - DNA, 12 bp, Homo sapiens
ggagcagaaggc

SEQ ID NO: 1908058 - DNA, 19 bp, Homo sapiens
ggagcagaaggcaggacca

SEQ ID NO: 1908059 - DNA, 21 bp, Homo sapiens
ggagcagcgcggatttctctt

SEQ ID NO: 1908060 - DNA, 18 bp, Homo sapiens
ggagcagtatcatgaagc

SEQ ID NO: 1908061 - DNA, 21 bp, Homo sapiens
ggagcccatttggagggcctg

SEQ ID NO: 1908062 - DNA, 21 bp, Homo sapiens
ggagcccccgcagtcgtcagc

SEQ ID NO: 1908063 - DNA, 20 bp, Homo sapiens
ggagccctgcctctccgccc

SEQ ID NO: 1908064 - DNA, 16 bp, Homo sapiens
ggagccctgggccagg

SEQ ID NO: 1908065 - DNA, 21 bp, Homo sapiens
ggagccctgggccagggcgtg

SEQ ID NO: 1908066 - DNA, 16 bp, Homo sapiens
ggaggaggcaggagtt

SEQ ID NO: 1908067 - DNA, 14 bp, Homo sapiens
ggaggcagagaggg

SEQ ID NO: 1908068 - DNA, 13 bp, Homo sapiens
ggaggcaggagga

SEQ ID NO: 1908069 - DNA, 16 bp, Homo sapiens
cttggttcctggggca

SEQ ID NO: 1908070 - DNA, 18 bp, Homo sapiens
cttggttcctggggcatc

SEQ ID NO: 1908071 - DNA, 16 bp, Homo sapiens
cttgtaactaaaataa

SEQ ID NO: 1908072 - DNA, 21 bp, Homo sapiens
cttgtatctgatatcagcact

SEQ ID NO: 1908073 - DNA, 15 bp, Homo sapiens
cttgtgaaaataatt

SEQ ID NO: 1908074 - DNA, 16 bp, Homo sapiens
cttgtgaaaataattg

SEQ ID NO: 1908075 - DNA, 18 bp, Homo sapiens
cttgtgaaaataattgac

SEQ ID NO: 1908076 - DNA, 21 bp, Homo sapiens
cttgtgggtgtgagcagcacc

SEQ ID NO: 1908077 - DNA, 16 bp, Homo sapiens
cttgttattcaacagc

SEQ ID NO: 1908078 - DNA, 16 bp, Homo sapiens
cttgttgctgattttg

SEQ ID NO: 1908079 - DNA, 21 bp, Homo sapiens
cttgttgtttgtaacaagaaa

SEQ ID NO: 1908080 - DNA, 20 bp, Homo sapiens
ctttaaactgtcgtgtcata

SEQ ID NO: 1908081 - DNA, 16 bp, Homo sapiens
ctttaatgatatgctt

SEQ ID NO: 1908082 - DNA, 12 bp, Homo sapiens
ctttagacttga

SEQ ID NO: 1908083 - DNA, 15 bp, Homo sapiens
ctttagctttctgag

SEQ ID NO: 1908084 - DNA, 21 bp, Homo sapiens
ctttagtacgtgtggcttggt

SEQ ID NO: 1908085 - DNA, 13 bp, Homo sapiens
ctttatatttccc

SEQ ID NO: 1908086 - DNA, 19 bp, Homo sapiens
ctttattatttttctctct

SEQ ID NO: 1908087 - DNA, 17 bp, Homo sapiens
ctttatttataaaataa

SEQ ID NO: 1908088 - DNA, 20 bp, Homo sapiens
ctttatttttttgaactctt

SEQ ID NO: 1908089 - DNA, 15 bp, Homo sapiens
ctttcaccccatcca

SEQ ID NO: 1908090 - DNA, 14 bp, Homo sapiens
ctttcatttgcttt

SEQ ID NO: 1908091 - DNA, 20 bp, Homo sapiens
ctttcattttctttcctttc

SEQ ID NO: 1908092 - DNA, 20 bp, Homo sapiens
ctttcccctttttctttccc

SEQ ID NO: 1908093 - DNA, 13 bp, Homo sapiens
ctttcctttcatt

SEQ ID NO: 1908094 - DNA, 11 bp, Homo sapiens
ctttcctttcc

SEQ ID NO: 1908095 - DNA, 14 bp, Homo sapiens
ctttcctttccttt

SEQ ID NO: 1908096 - DNA, 12 bp, Homo sapiens
ctttcctttctt

SEQ ID NO: 1908097 - DNA, 10 bp, Homo sapiens
ctttcctttt

SEQ ID NO: 1908098 - DNA, 15 bp, Homo sapiens
ctttcctttttcttt

SEQ ID NO: 1908099 - DNA, 17 bp, Homo sapiens
ctttcctttttctttcc

SEQ ID NO: 1908100 - DNA, 20 bp, Homo sapiens
ctttcctttttttccctttt

SEQ ID NO: 1908101 - DNA, 17 bp, Homo sapiens
ctttctataattttaca

SEQ ID NO: 1908102 - DNA, 15 bp, Homo sapiens
ctttctctctcactc

SEQ ID NO: 1908103 - DNA, 12 bp, Homo sapiens
ctttctctgagg

SEQ ID NO: 1908104 - DNA, 17 bp, Homo sapiens
ctttctgaaaatttata

SEQ ID NO: 1908105 - DNA, 20 bp, Homo sapiens
ctttctgaaaatttatataa

SEQ ID NO: 1908106 - DNA, 17 bp, Homo sapiens
ctttctgatcttcacta

SEQ ID NO: 1908107 - DNA, 19 bp, Homo sapiens
ctttgaaatatttaatttc

SEQ ID NO: 1908108 - DNA, 23 bp, Homo sapiens
ctttgaagagatgacaacaaatt

SEQ ID NO: 1908109 - DNA, 13 bp, Homo sapiens
ctttgaatttata

SEQ ID NO: 1908110 - DNA, 17 bp, Homo sapiens
ctttgaatttatataaa

SEQ ID NO: 1908111 - DNA, 20 bp, Homo sapiens
ctttgaatttatataaagta

SEQ ID NO: 1908112 - DNA, 21 bp, Homo sapiens
ctttgaatttatataaagtat

SEQ ID NO: 1908113 - DNA, 22 bp, Homo sapiens
ctttgacagcgcacagctgctc

SEQ ID NO: 1908114 - DNA, 22 bp, Homo sapiens
ctttgaggttttggtaattgta

SEQ ID NO: 1908115 - DNA, 22 bp, Homo sapiens
ctttgatgtcagcagttgctgg

SEQ ID NO: 1908116 - DNA, 12 bp, Homo sapiens
ctttgatgtgtt

SEQ ID NO: 1908117 - DNA, 16 bp, Homo sapiens
ctttgcaaaggagctc

SEQ ID NO: 1908118 - DNA, 19 bp, Homo sapiens
ctttgcagcttcctcttct

SEQ ID NO: 1908119 - DNA, 21 bp, Homo sapiens
ctttgcagttcccatctcctt

SEQ ID NO: 1908120 - DNA, 15 bp, Homo sapiens
ctttgccatgtgctt

SEQ ID NO: 1908121 - DNA, 19 bp, Homo sapiens
ctttggaaagtagaaaagc

SEQ ID NO: 1908122 - DNA, 20 bp, Homo sapiens
ctttgtagacattttgaaat

SEQ ID NO: 1908123 - DNA, 20 bp, Homo sapiens
ctttgtagcatttggtgctt

SEQ ID NO: 1908124 - DNA, 15 bp, Homo sapiens
ctttgtatagttatg

SEQ ID NO: 1908125 - DNA, 22 bp, Homo sapiens
ctttgtattgtcctattagtgt

SEQ ID NO: 1908126 - DNA, 23 bp, Homo sapiens
ctttgtctacttcaaaagtttgt

SEQ ID NO: 1908127 - DNA, 19 bp, Homo sapiens
ctttgtttagtctttatac

SEQ ID NO: 1908128 - DNA, 15 bp, Homo sapiens
cttttaaattataca

SEQ ID NO: 1908129 - DNA, 20 bp, Homo sapiens
cttttaagtggactctctga

SEQ ID NO: 1908130 - DNA, 23 bp, Homo sapiens
cttttaagtggactctctgacaa

SEQ ID NO: 1908131 - DNA, 21 bp, Homo sapiens
cttttattttcacagcccata

SEQ ID NO: 1908132 - DNA, 17 bp, Homo sapiens
cttttccctcctttcct

SEQ ID NO: 1908133 - DNA, 15 bp, Homo sapiens
cttttcttggccaac

SEQ ID NO: 1908134 - DNA, 11 bp, Homo sapiens
cttttctttcc

SEQ ID NO: 1908135 - DNA, 12 bp, Homo sapiens
cttttctttcct

SEQ ID NO: 1908136 - DNA, 14 bp, Homo sapiens
cttttctttccttt

SEQ ID NO: 1908137 - DNA, 16 bp, Homo sapiens
cttttgctttcctttc

SEQ ID NO: 1908138 - DNA, 21 bp, Homo sapiens
cttttggttatgaatactttg

SEQ ID NO: 1908139 - DNA, 18 bp, Homo sapiens
cttttgttactcttggga

SEQ ID NO: 1908140 - DNA, 20 bp, Homo sapiens
cttttgttactcttgggaca

SEQ ID NO: 1908141 - DNA, 16 bp, Homo sapiens
ctttttccctttcctt

SEQ ID NO: 1908142 - DNA, 18 bp, Homo sapiens
ctttttgtaggatacttg

SEQ ID NO: 1908143 - DNA, 13 bp, Homo sapiens
cttttttattaat

SEQ ID NO: 1908144 - DNA, 14 bp, Homo sapiens
cttttttattaatc

SEQ ID NO: 1908145 - DNA, 17 bp, Homo sapiens
cttttttattaatcact

SEQ ID NO: 1908146 - DNA, 21 bp, Homo sapiens
cttttttattaatcactgtgt

SEQ ID NO: 1908147 - DNA, 12 bp, Homo sapiens
cttttttcccct

SEQ ID NO: 1908148 - DNA, 19 bp, Homo sapiens
gaaaaaaaaaatgctgaac

SEQ ID NO: 1908149 - DNA, 22 bp, Homo sapiens
gaaaaaaatgtcaaaagtagaa

SEQ ID NO: 1908150 - DNA, 10 bp, Homo sapiens
gaaaaaagag

SEQ ID NO: 1908151 - DNA, 14 bp, Homo sapiens
gaaaaaagttgtag

SEQ ID NO: 1908152 - DNA, 23 bp, Homo sapiens
gaaaaaagttgtaggcgaatcat

SEQ ID NO: 1908153 - DNA, 14 bp, Homo sapiens
gaaaaataaaagtg

SEQ ID NO: 1908154 - DNA, 20 bp, Homo sapiens
gaaaaatatctgtaagagtg

SEQ ID NO: 1908155 - DNA, 13 bp, Homo sapiens
gaaaactctattt

SEQ ID NO: 1908156 - DNA, 10 bp, Homo sapiens
gaaaagaaaa

SEQ ID NO: 1908157 - DNA, 11 bp, Homo sapiens
gaaaagaaaaa

SEQ ID NO: 1908158 - DNA, 12 bp, Homo sapiens
gaaaagaaaaaa

SEQ ID NO: 1908159 - DNA, 17 bp, Homo sapiens
gaaaagaaaaaaaaaga

SEQ ID NO: 1908160 - DNA, 14 bp, Homo sapiens
gaaaagaatagaag

SEQ ID NO: 1908161 - DNA, 16 bp, Homo sapiens
gaaaagagaacttttt

SEQ ID NO: 1908162 - DNA, 13 bp, Homo sapiens
gaaaagagacagg

SEQ ID NO: 1908163 - DNA, 17 bp, Homo sapiens
gaaaagagacaggcagg

SEQ ID NO: 1908164 - DNA, 14 bp, Homo sapiens
gaaaagatgtagat

SEQ ID NO: 1908165 - DNA, 11 bp, Homo sapiens
gaaaaggaaat

SEQ ID NO: 1908166 - DNA, 19 bp, Homo sapiens
gaaaaggaaggtagttcaa

SEQ ID NO: 1908167 - DNA, 14 bp, Homo sapiens
gaaaagtaatattt

SEQ ID NO: 1908168 - DNA, 17 bp, Homo sapiens
gaaaagtaatatttatt

SEQ ID NO: 1908169 - DNA, 21 bp, Homo sapiens
gaaaataaaaaaaagaaaaaa

SEQ ID NO: 1908170 - DNA, 11 bp, Homo sapiens
gaaaataattg

SEQ ID NO: 1908171 - DNA, 14 bp, Homo sapiens
gaaaatagtttatt

SEQ ID NO: 1908172 - DNA, 18 bp, Homo sapiens
gaaaatgaatgaatacct

SEQ ID NO: 1908173 - DNA, 23 bp, Homo sapiens
gaaaatgtctattcaaaatatca

SEQ ID NO: 1908174 - DNA, 13 bp, Homo sapiens
gaaaatttatata

SEQ ID NO: 1908175 - DNA, 14 bp, Homo sapiens
gaaaatttatataa

SEQ ID NO: 1908176 - DNA, 19 bp, Homo sapiens
gaaaatttatataactgtt

SEQ ID NO: 1908177 - DNA, 22 bp, Homo sapiens
gaaacagacttgtatattctat

SEQ ID NO: 1908178 - DNA, 19 bp, Homo sapiens
gaaacccctgtaggcctca

SEQ ID NO: 1908179 - DNA, 13 bp, Homo sapiens
gaaactaggtctg

SEQ ID NO: 1908180 - DNA, 14 bp, Homo sapiens
gaaactcccaccct

SEQ ID NO: 1908181 - DNA, 13 bp, Homo sapiens
gaaagaaagagga

SEQ ID NO: 1908182 - DNA, 20 bp, Homo sapiens
gaaagaacgctgatttaaag

SEQ ID NO: 1908183 - DNA, 15 bp, Homo sapiens
gaaagaatgtaaagc

SEQ ID NO: 1908184 - DNA, 21 bp, Homo sapiens
gaaagagccttaatgtatttg

SEQ ID NO: 1908185 - DNA, 15 bp, Homo sapiens
gaaagaggaaaagaa

SEQ ID NO: 1908186 - DNA, 13 bp, Homo sapiens
gaaagatatgtat

SEQ ID NO: 1908187 - DNA, 15 bp, Homo sapiens
gaaagcaaaataaca

SEQ ID NO: 1908188 - DNA, 16 bp, Homo sapiens
gaaaggacctgcaaac

SEQ ID NO: 1908189 - DNA, 17 bp, Homo sapiens
gaaaggccagcagcctt

SEQ ID NO: 1908190 - DNA, 17 bp, Homo sapiens
gaaagtgttcattgcac

SEQ ID NO: 1908191 - DNA, 23 bp, Homo sapiens
gaaagtgttcattgcacaatata

SEQ ID NO: 1908192 - DNA, 14 bp, Homo sapiens
gaaataaaaagagt

SEQ ID NO: 1908193 - DNA, 14 bp, Homo sapiens
gaaatcaaagtgct

SEQ ID NO: 1908194 - DNA, 23 bp, Homo sapiens
gaaatcaataatttgtggtgatt

SEQ ID NO: 1908195 - DNA, 22 bp, Homo sapiens
gaaatcatatttggaataaaaa

SEQ ID NO: 1908196 - DNA, 14 bp, Homo sapiens
gaaatgctgaccca

SEQ ID NO: 1908197 - DNA, 22 bp, Homo sapiens
gaaatgctttagcatactagaa

SEQ ID NO: 1908198 - DNA, 22 bp, Homo sapiens
gaaattaaagctgccttttgtt

SEQ ID NO: 1908199 - DNA, 13 bp, Homo sapiens
gaaattaagaaga

SEQ ID NO: 1908200 - DNA, 15 bp, Homo sapiens
gaaattcagattgtt

SEQ ID NO: 1908201 - DNA, 14 bp, Homo sapiens
gaaattgtccttga

SEQ ID NO: 1908202 - DNA, 16 bp, Homo sapiens
gaacaaagaccaattt

SEQ ID NO: 1908203 - DNA, 12 bp, Homo sapiens
gacaatgtttac

SEQ ID NO: 1908204 - DNA, 15 bp, Homo sapiens
gacaccacagcctcc

SEQ ID NO: 1908205 - DNA, 18 bp, Homo sapiens
gacaccacagcctcccct

SEQ ID NO: 1908206 - DNA, 21 bp, Homo sapiens
gacaccacagcctccccttcc

SEQ ID NO: 1908207 - DNA, 23 bp, Homo sapiens
gacaccccacgggaggagtggca

SEQ ID NO: 1908208 - DNA, 13 bp, Homo sapiens
gacactaagagga

SEQ ID NO: 1908209 - DNA, 17 bp, Homo sapiens
gacactaagaggaggca

SEQ ID NO: 1908210 - DNA, 12 bp, Homo sapiens
gacactgtggca

SEQ ID NO: 1908211 - DNA, 13 bp, Homo sapiens
gacactgtggcag

SEQ ID NO: 1908212 - DNA, 19 bp, Homo sapiens
gacactgtggcagcaggag

SEQ ID NO: 1908213 - DNA, 20 bp, Homo sapiens
gacactgtggcagcaggagg

SEQ ID NO: 1908214 - DNA, 19 bp, Homo sapiens
gacagcccgatcctcccct

SEQ ID NO: 1908215 - DNA, 24 bp, Homo sapiens
gacagcccgatcctcccctggact

SEQ ID NO: 1908216 - DNA, 15 bp, Homo sapiens
gacagcctgcctctg

SEQ ID NO: 1908217 - DNA, 16 bp, Homo sapiens
gacagcctgcctctgc

SEQ ID NO: 1908218 - DNA, 18 bp, Homo sapiens
gacagcctgcctctgcca

SEQ ID NO: 1908219 - DNA, 21 bp, Homo sapiens
gacaggacccctgcagttccc

SEQ ID NO: 1908220 - DNA, 16 bp, Homo sapiens
gacaggcgaaagaaaa

SEQ ID NO: 1908221 - DNA, 17 bp, Homo sapiens
gacaggcgaaagaaaac

SEQ ID NO: 1908222 - DNA, 13 bp, Homo sapiens
gacagtctcacca

SEQ ID NO: 1908223 - DNA, 23 bp, Homo sapiens
gacagtctcaccatttccccagg

SEQ ID NO: 1908224 - DNA, 17 bp, Homo sapiens
gacatcacagggcctca

SEQ ID NO: 1908225 - DNA, 13 bp, Homo sapiens
gaccacagaggct

SEQ ID NO: 1908226 - DNA, 22 bp, Homo sapiens
gaccacagaggctgtggtcaga

SEQ ID NO: 1908227 - DNA, 23 bp, Homo sapiens
gaccacaggtgcccgccaccaca

SEQ ID NO: 1908228 - DNA, 11 bp, Homo sapiens
gaccagcccac

SEQ ID NO: 1908229 - DNA, 16 bp, Homo sapiens
gaccagcccacgctga

SEQ ID NO: 1908230 - DNA, 18 bp, Homo sapiens
gaccataacagtgccagc

SEQ ID NO: 1908231 - DNA, 19 bp, Homo sapiens
gaccatgctgtctggcaca

SEQ ID NO: 1908232 - DNA, 22 bp, Homo sapiens
gaccatgctgtctggcacagcc

SEQ ID NO: 1908233 - DNA, 23 bp, Homo sapiens
gaccatgctgtctggcacagcct

SEQ ID NO: 1908234 - DNA, 18 bp, Homo sapiens
gacccaagtactttccaa

SEQ ID NO: 1908235 - DNA, 14 bp, Homo sapiens
gacccagtggcagg

SEQ ID NO: 1908236 - DNA, 18 bp, Homo sapiens
gacccagtggcagggcac

SEQ ID NO: 1908237 - DNA, 19 bp, Homo sapiens
gacccagtggcagggcaca

SEQ ID NO: 1908238 - DNA, 16 bp, Homo sapiens
gacccatgggcaggag

SEQ ID NO: 1908239 - DNA, 16 bp, Homo sapiens
gaccccatctgtgaat

SEQ ID NO: 1908240 - DNA, 22 bp, Homo sapiens
gaccccgcagcacgcctctccc

SEQ ID NO: 1908241 - DNA, 22 bp, Homo sapiens
gaccctccaaggccaggccttg

SEQ ID NO: 1908242 - DNA, 12 bp, Homo sapiens
gaccctgccagg

SEQ ID NO: 1908243 - DNA, 17 bp, Homo sapiens
gagtggccccacctggc

SEQ ID NO: 1908244 - DNA, 19 bp, Homo sapiens
gagttaactttttgtagga

SEQ ID NO: 1908245 - DNA, 14 bp, Homo sapiens
gagttgtttttgta

SEQ ID NO: 1908246 - DNA, 16 bp, Homo sapiens
gagttgtttttgtata

SEQ ID NO: 1908247 - DNA, 16 bp, Homo sapiens
gataaaaaaacagctt

SEQ ID NO: 1908248 - DNA, 15 bp, Homo sapiens
gataaagatatcaat

SEQ ID NO: 1908249 - DNA, 21 bp, Homo sapiens
gataaatattgagcagatcta

SEQ ID NO: 1908250 - DNA, 22 bp, Homo sapiens
gataacaagtttaatataaagt

SEQ ID NO: 1908251 - DNA, 22 bp, Homo sapiens
gataacaatgttttaacaagaa

SEQ ID NO: 1908252 - DNA, 20 bp, Homo sapiens
gataagcagttatgtgacct

SEQ ID NO: 1908253 - DNA, 22 bp, Homo sapiens
gatacgcttaaggtggaaagtg

SEQ ID NO: 1908254 - DNA, 16 bp, Homo sapiens
gatactttgtattgtc

SEQ ID NO: 1908255 - DNA, 19 bp, Homo sapiens
gatactttgtattgtccta

SEQ ID NO: 1908256 - DNA, 23 bp, Homo sapiens
gatactttgtattgtcctattag

SEQ ID NO: 1908257 - DNA, 14 bp, Homo sapiens
gatataaacagctt

SEQ ID NO: 1908258 - DNA, 12 bp, Homo sapiens
gatatatgtatc

SEQ ID NO: 1908259 - DNA, 19 bp, Homo sapiens
gatatatgtttttgaaggc

SEQ ID NO: 1908260 - DNA, 13 bp, Homo sapiens
gatatcaaaggca

SEQ ID NO: 1908261 - DNA, 21 bp, Homo sapiens
gatatccatgagctgcactga

SEQ ID NO: 1908262 - DNA, 21 bp, Homo sapiens
gatatggggttacttcagcca

SEQ ID NO: 1908263 - DNA, 13 bp, Homo sapiens
gatatttttaata

SEQ ID NO: 1908264 - DNA, 13 bp, Homo sapiens
gatcacaaatgac

SEQ ID NO: 1908265 - DNA, 18 bp, Homo sapiens
gatcactgtttagatttg

SEQ ID NO: 1908266 - DNA, 21 bp, Homo sapiens
gatcactgtttagatttgcca

SEQ ID NO: 1908267 - DNA, 14 bp, Homo sapiens
gatcaggctcccag

SEQ ID NO: 1908268 - DNA, 22 bp, Homo sapiens
gatcatagttttatttatattt

SEQ ID NO: 1908269 - DNA, 15 bp, Homo sapiens
gatcatttgagttca

SEQ ID NO: 1908270 - DNA, 16 bp, Homo sapiens
gatccattttttatat

SEQ ID NO: 1908271 - DNA, 18 bp, Homo sapiens
gatccattttttatattt

SEQ ID NO: 1908272 - DNA, 17 bp, Homo sapiens
gatcctcccctggactc

SEQ ID NO: 1908273 - DNA, 18 bp, Homo sapiens
gatcctgcactgactctg

SEQ ID NO: 1908274 - DNA, 21 bp, Homo sapiens
gatcctgcactgactctggaa

SEQ ID NO: 1908275 - DNA, 22 bp, Homo sapiens
gatctcgccaacccctctctca

SEQ ID NO: 1908276 - DNA, 21 bp, Homo sapiens
gatctctttgatcctggaaat

SEQ ID NO: 1908277 - DNA, 16 bp, Homo sapiens
gatgaagctgaggctg

SEQ ID NO: 1908278 - DNA, 13 bp, Homo sapiens
gatgaggcaaccc

SEQ ID NO: 1908279 - DNA, 14 bp, Homo sapiens
gatgatatggaggt

SEQ ID NO: 1908280 - DNA, 21 bp, Homo sapiens
gatgccaagaagtttaaggaa

SEQ ID NO: 1908281 - DNA, 14 bp, Homo sapiens
gatgctcacagggc

SEQ ID NO: 1908282 - DNA, 14 bp, Homo sapiens
gatggacagacaga

SEQ ID NO: 1908283 - DNA, 16 bp, Homo sapiens
gatggcagtggctgtg

SEQ ID NO: 1908284 - DNA, 10 bp, Homo sapiens
gatgggcctg

SEQ ID NO: 1908285 - DNA, 12 bp, Homo sapiens
gatggggctggg

SEQ ID NO: 1908286 - DNA, 23 bp, Homo sapiens
gatggtatctatagtcaagacga

SEQ ID NO: 1908287 - DNA, 12 bp, Homo sapiens
gatgtaaagatg

SEQ ID NO: 1908288 - DNA, 19 bp, Homo sapiens
gatgtaattttgtgtaaga

SEQ ID NO: 1908289 - DNA, 14 bp, Homo sapiens
gatgtagatttatt

SEQ ID NO: 1908290 - DNA, 15 bp, Homo sapiens
gatgtagatttattt

SEQ ID NO: 1908291 - DNA, 17 bp, Homo sapiens
gatgtagatttatttca

SEQ ID NO: 1908292 - DNA, 12 bp, Homo sapiens
gatgtgcctaaa

SEQ ID NO: 1908293 - DNA, 22 bp, Homo sapiens
gatgtgtctcctgtttcagacc

SEQ ID NO: 1908294 - DNA, 18 bp, Homo sapiens
gatgttctggataccatt

SEQ ID NO: 1908295 - DNA, 22 bp, Homo sapiens
gatgtttaaaacaccttctata

SEQ ID NO: 1908296 - DNA, 23 bp, Homo sapiens
gatgtttaaaacaccttctatag

SEQ ID NO: 1908297 - DNA, 14 bp, Homo sapiens
gatgttttccactg

SEQ ID NO: 1908298 - DNA, 13 bp, Homo sapiens
gattagtttagaa

SEQ ID NO: 1908299 - DNA, 20 bp, Homo sapiens
gattcaggcattttccccct

SEQ ID NO: 1908300 - DNA, 15 bp, Homo sapiens
gattccagcacaacc

SEQ ID NO: 1908301 - DNA, 16 bp, Homo sapiens
gattcccttgttattc

SEQ ID NO: 1908302 - DNA, 12 bp, Homo sapiens
gattcctcccca

SEQ ID NO: 1908303 - DNA, 16 bp, Homo sapiens
gattgtggggagagaa

SEQ ID NO: 1908304 - DNA, 20 bp, Homo sapiens
gattgtggggagagaaatct

SEQ ID NO: 1908305 - DNA, 16 bp, Homo sapiens
gatttaatttgaaata

SEQ ID NO: 1908306 - DNA, 21 bp, Homo sapiens
gatttctctagaggctggcaa

SEQ ID NO: 1908307 - DNA, 16 bp, Homo sapiens
gatttctctttctctc

SEQ ID NO: 1908308 - DNA, 12 bp, Homo sapiens
gatttctggtct

SEQ ID NO: 1908309 - DNA, 17 bp, Homo sapiens
gatttgataacaagttt

SEQ ID NO: 1908310 - DNA, 13 bp, Homo sapiens
gattttgaaaaat

SEQ ID NO: 1908311 - DNA, 21 bp, Homo sapiens
gattttgaaaaattacctgta

SEQ ID NO: 1908312 - DNA, 14 bp, Homo sapiens
gattttgaccttgt

SEQ ID NO: 1908313 - DNA, 23 bp, Homo sapiens
gcaaatgcacacacctcatgcta

SEQ ID NO: 1908314 - DNA, 14 bp, Homo sapiens
gcaaatggcctcat

SEQ ID NO: 1908315 - DNA, 23 bp, Homo sapiens
gcaacaattctcccgggactctg

SEQ ID NO: 1908316 - DNA, 17 bp, Homo sapiens
gcaacacgtcattgtgt

SEQ ID NO: 1908317 - DNA, 21 bp, Homo sapiens
gcaacccctggaccccagcct

SEQ ID NO: 1908318 - DNA, 19 bp, Homo sapiens
gcaacttcctttgactttc

SEQ ID NO: 1908319 - DNA, 15 bp, Homo sapiens
gcaagcaccatcccc

SEQ ID NO: 1908320 - DNA, 12 bp, Homo sapiens
gcaaggctgtcg

SEQ ID NO: 1908321 - DNA, 14 bp, Homo sapiens
gcaagggaggccca

SEQ ID NO: 1908322 - DNA, 17 bp, Homo sapiens
gcaagggaggcccagcg

SEQ ID NO: 1908323 - DNA, 19 bp, Homo sapiens
gcaagtgtgaatactgctt

SEQ ID NO: 1908324 - DNA, 18 bp, Homo sapiens
gcaataaaaaatatattt

SEQ ID NO: 1908325 - DNA, 16 bp, Homo sapiens
gcaataaaagcccagg

SEQ ID NO: 1908326 - DNA, 18 bp, Homo sapiens
gcaataaaagcccaggag

SEQ ID NO: 1908327 - DNA, 17 bp, Homo sapiens
gcaatggtagtttctgt

SEQ ID NO: 1908328 - DNA, 23 bp, Homo sapiens
gcaattctcgattctttgaagag

SEQ ID NO: 1908329 - DNA, 17 bp, Homo sapiens
gcacaatatatttttac

SEQ ID NO: 1908330 - DNA, 16 bp, Homo sapiens
gcacacatttaaaaat

SEQ ID NO: 1908331 - DNA, 16 bp, Homo sapiens
gcacaccaatcttact

SEQ ID NO: 1908332 - DNA, 21 bp, Homo sapiens
gcacaccaatcttactttgta

SEQ ID NO: 1908333 - DNA, 14 bp, Homo sapiens
gcacagctgctctg

SEQ ID NO: 1908334 - DNA, 14 bp, Homo sapiens
gcacaggcagggca

SEQ ID NO: 1908335 - DNA, 14 bp, Homo sapiens
gcacagggcctggc

SEQ ID NO: 1908336 - DNA, 16 bp, Homo sapiens
gcacagggcctggccc

SEQ ID NO: 1908337 - DNA, 19 bp, Homo sapiens
gcacagggcctggcccatg

SEQ ID NO: 1908338 - DNA, 20 bp, Homo sapiens
gcaccaaaataagaaaagat

SEQ ID NO: 1908339 - DNA, 13 bp, Homo sapiens
gcaccagcaggca

SEQ ID NO: 1908340 - DNA, 14 bp, Homo sapiens
gcaccagcaggcac

SEQ ID NO: 1908341 - DNA, 19 bp, Homo sapiens
gcaccagcccagaagtgca

SEQ ID NO: 1908342 - DNA, 20 bp, Homo sapiens
gcacccacatcctggagtca

SEQ ID NO: 1908343 - DNA, 17 bp, Homo sapiens
gcacgaaatggctgaag

SEQ ID NO: 1908344 - DNA, 21 bp, Homo sapiens
gcacgcctctccccaccttct

SEQ ID NO: 1908345 - DNA, 15 bp, Homo sapiens
gcactcctttaaagc

SEQ ID NO: 1908346 - DNA, 20 bp, Homo sapiens
gcactctggggctggcacca

SEQ ID NO: 1908347 - DNA, 13 bp, Homo sapiens
ctctttctctctc

SEQ ID NO: 1908348 - DNA, 13 bp, Homo sapiens
ctctttggaaaag

SEQ ID NO: 1908349 - DNA, 17 bp, Homo sapiens
ctgaaaatttatataac

SEQ ID NO: 1908350 - DNA, 18 bp, Homo sapiens
ctgaaagaataggattaa

SEQ ID NO: 1908351 - DNA, 18 bp, Homo sapiens
ctgaaagaggccaaacag

SEQ ID NO: 1908352 - DNA, 20 bp, Homo sapiens
ctgaaagatatgtatatttt

SEQ ID NO: 1908353 - DNA, 23 bp, Homo sapiens
ctgaaagatatgtatatttttga

SEQ ID NO: 1908354 - DNA, 10 bp, Homo sapiens
ctgaaataca

SEQ ID NO: 1908355 - DNA, 14 bp, Homo sapiens
ctgaaatataaagt

SEQ ID NO: 1908356 - DNA, 15 bp, Homo sapiens
ctgaaccacttgtag

SEQ ID NO: 1908357 - DNA, 18 bp, Homo sapiens
ctgaacgtttggttcaaa

SEQ ID NO: 1908358 - DNA, 16 bp, Homo sapiens
ctgaaggaggccacct

SEQ ID NO: 1908359 - DNA, 19 bp, Homo sapiens
ctgaaggaggccacctcct

SEQ ID NO: 1908360 - DNA, 16 bp, Homo sapiens
ctgaaggggttttctt

SEQ ID NO: 1908361 - DNA, 19 bp, Homo sapiens
ctgaaggggttttcttgat

SEQ ID NO: 1908362 - DNA, 19 bp, Homo sapiens
ctgaagtgcatgggtcagg

SEQ ID NO: 1908363 - DNA, 21 bp, Homo sapiens
ctgaatattgccattatgctt

SEQ ID NO: 1908364 - DNA, 21 bp, Homo sapiens
ctgaattggaatgcactcaga

SEQ ID NO: 1908365 - DNA, 17 bp, Homo sapiens
ctgacccaacagcctct

SEQ ID NO: 1908366 - DNA, 15 bp, Homo sapiens
ctgacgtctgccacc

SEQ ID NO: 1908367 - DNA, 15 bp, Homo sapiens
ctgactacagggccg

SEQ ID NO: 1908368 - DNA, 12 bp, Homo sapiens
ctgacttagaat

SEQ ID NO: 1908369 - DNA, 22 bp, Homo sapiens
ctgacttagaatccctgtgtta

SEQ ID NO: 1908370 - DNA, 16 bp, Homo sapiens
ctgactttgaatttat

SEQ ID NO: 1908371 - DNA, 20 bp, Homo sapiens
ctgactttgaatttatataa

SEQ ID NO: 1908372 - DNA, 17 bp, Homo sapiens
ctgagaatgaacaaaga

SEQ ID NO: 1908373 - DNA, 16 bp, Homo sapiens
ctgagacccttattta

SEQ ID NO: 1908374 - DNA, 14 bp, Homo sapiens
ctgagaggctgtct

SEQ ID NO: 1908375 - DNA, 22 bp, Homo sapiens
ctgagatggatggacagacaga

SEQ ID NO: 1908376 - DNA, 15 bp, Homo sapiens
ctgagcccccagctt

SEQ ID NO: 1908377 - DNA, 18 bp, Homo sapiens
ctgagctcattaataaaa

SEQ ID NO: 1908378 - DNA, 20 bp, Homo sapiens
ctgagctcatttggggacca

SEQ ID NO: 1908379 - DNA, 17 bp, Homo sapiens
ctgaggcagtttgagga

SEQ ID NO: 1908380 - DNA, 17 bp, Homo sapiens
ctgaggcccatggccac

SEQ ID NO: 1908381 - DNA, 21 bp, Homo sapiens
ctgaggctgctgccaggcccg

SEQ ID NO: 1908382 - DNA, 18 bp, Homo sapiens
ctgagggaggaggcagga

SEQ ID NO: 1908383 - DNA, 17 bp, Homo sapiens
ctgagggcttgtagttc

SEQ ID NO: 1908384 - DNA, 15 bp, Homo sapiens
ctgaggggagacaga

SEQ ID NO: 1908385 - DNA, 17 bp, Homo sapiens
ctgaggggagacagagc

SEQ ID NO: 1908386 - DNA, 20 bp, Homo sapiens
ctgagtagctgggattacag

SEQ ID NO: 1908387 - DNA, 16 bp, Homo sapiens
ctgagtgagaggggag

SEQ ID NO: 1908388 - DNA, 19 bp, Homo sapiens
ctgagttccggcaccagta

SEQ ID NO: 1908389 - DNA, 17 bp, Homo sapiens
ctgagttgttaccccaa

SEQ ID NO: 1908390 - DNA, 14 bp, Homo sapiens
ctgataaagaaaga

SEQ ID NO: 1908391 - DNA, 23 bp, Homo sapiens
ctgataccaaagagacagggccc

SEQ ID NO: 1908392 - DNA, 17 bp, Homo sapiens
ctgatacttagaccaaa

SEQ ID NO: 1908393 - DNA, 20 bp, Homo sapiens
ctgatattcaaatggacaaa

SEQ ID NO: 1908394 - DNA, 13 bp, Homo sapiens
ctgatctgtgcag

SEQ ID NO: 1908395 - DNA, 14 bp, Homo sapiens
ctgatgtctttggc

SEQ ID NO: 1908396 - DNA, 17 bp, Homo sapiens
ctgatgtttctcatcct

SEQ ID NO: 1908397 - DNA, 15 bp, Homo sapiens
ctgattttgaccttg

SEQ ID NO: 1908398 - DNA, 21 bp, Homo sapiens
ctgattttgaccttgtattga

SEQ ID NO: 1908399 - DNA, 16 bp, Homo sapiens
ctgcactgactctgga

SEQ ID NO: 1908400 - DNA, 19 bp, Homo sapiens
ctgcagcctccgcttccct

SEQ ID NO: 1908401 - DNA, 13 bp, Homo sapiens
ctgcagggctggg

SEQ ID NO: 1908402 - DNA, 21 bp, Homo sapiens
ctgcagttcccctggaagcag

SEQ ID NO: 1908403 - DNA, 16 bp, Homo sapiens
ctgcatccccttccag

SEQ ID NO: 1908404 - DNA, 19 bp, Homo sapiens
ctgcatccccttccagctc

SEQ ID NO: 1908405 - DNA, 21 bp, Homo sapiens
ctgcatccccttccagctccc

SEQ ID NO: 1908406 - DNA, 23 bp, Homo sapiens
ctgcatccccttccagctccctc

SEQ ID NO: 1908407 - DNA, 20 bp, Homo sapiens
ctgcatgggttaattgagaa

SEQ ID NO: 1908408 - DNA, 22 bp, Homo sapiens
ctgcatgggttaattgagaata

SEQ ID NO: 1908409 - DNA, 23 bp, Homo sapiens
ctgcatttagggagtattctaat

SEQ ID NO: 1908410 - DNA, 15 bp, Homo sapiens
ctgccaccagcgccc

SEQ ID NO: 1908411 - DNA, 18 bp, Homo sapiens
ctgccacctccccttgcc

SEQ ID NO: 1908412 - DNA, 19 bp, Homo sapiens
ctgccacctccccttgcca

SEQ ID NO: 1908413 - DNA, 20 bp, Homo sapiens
ctgccacctccccttgccag

SEQ ID NO: 1908414 - DNA, 22 bp, Homo sapiens
ctgccacctccccttgccagct

SEQ ID NO: 1908415 - DNA, 14 bp, Homo sapiens
ctgccacctgcaca

SEQ ID NO: 1908416 - DNA, 16 bp, Homo sapiens
ctgccacctgcacagg

SEQ ID NO: 1908417 - DNA, 12 bp, Homo sapiens
ctgccagctctt

SEQ ID NO: 1908418 - DNA, 14 bp, Homo sapiens
ctgccagctcttcc

SEQ ID NO: 1908419 - DNA, 15 bp, Homo sapiens
ctgccagctcttcct

SEQ ID NO: 1908420 - DNA, 20 bp, Homo sapiens
ctgccaggcacaggcagggc

SEQ ID NO: 1908421 - DNA, 21 bp, Homo sapiens
ctgccaggcacaggcagggca

SEQ ID NO: 1908422 - DNA, 22 bp, Homo sapiens
ctgccaggcacaggcagggcag

SEQ ID NO: 1908423 - DNA, 14 bp, Homo sapiens
ctgccagggatggc

SEQ ID NO: 1908424 - DNA, 17 bp, Homo sapiens
ctgccccccagcctagg

SEQ ID NO: 1908425 - DNA, 14 bp, Homo sapiens
ctgccccttgggcc

SEQ ID NO: 1908426 - DNA, 17 bp, Homo sapiens
ctgccccttgggcctcc

SEQ ID NO: 1908427 - DNA, 19 bp, Homo sapiens
ctgccctccgccccgtccc

SEQ ID NO: 1908428 - DNA, 21 bp, Homo sapiens
ctgccctccgccccgtccccc

SEQ ID NO: 1908429 - DNA, 23 bp, Homo sapiens
ctgccctccgccccgtcccccca

SEQ ID NO: 1908430 - DNA, 15 bp, Homo sapiens
ctgccctctgctcta

SEQ ID NO: 1908431 - DNA, 22 bp, Homo sapiens
ctgcctctccgcccctgagccc

SEQ ID NO: 1908432 - DNA, 16 bp, Homo sapiens
ctgcctctgccacagc

SEQ ID NO: 1908433 - DNA, 20 bp, Homo sapiens
ctgcctgacagagggatgga

SEQ ID NO: 1908434 - DNA, 13 bp, Homo sapiens
ctgccttaagtga

SEQ ID NO: 1908435 - DNA, 16 bp, Homo sapiens
ctgccttaagtgagga

SEQ ID NO: 1908436 - DNA, 12 bp, Homo sapiens
ctgctcagatcc

SEQ ID NO: 1908437 - DNA, 15 bp, Homo sapiens
ctgctccaactccac

SEQ ID NO: 1908438 - DNA, 19 bp, Homo sapiens
ctgctcccctaaagcctca

SEQ ID NO: 1908439 - DNA, 13 bp, Homo sapiens
ctgctcctgagcc

SEQ ID NO: 1908440 - DNA, 14 bp, Homo sapiens
ctgctcctgagccc

SEQ ID NO: 1908441 - DNA, 16 bp, Homo sapiens
ctgctcctgagccccc

SEQ ID NO: 1908442 - DNA, 22 bp, Homo sapiens
ctgctctcaccttggttcctgg

SEQ ID NO: 1908443 - DNA, 17 bp, Homo sapiens
ctgctctccccacccag

SEQ ID NO: 1908444 - DNA, 18 bp, Homo sapiens
ctgctctcgaggcagcag

SEQ ID NO: 1908445 - DNA, 14 bp, Homo sapiens
ctgctgacccctgt

SEQ ID NO: 1908446 - DNA, 15 bp, Homo sapiens
ctgctgcagagcagt

SEQ ID NO: 1908447 - DNA, 20 bp, Homo sapiens
ctgctgctgacccctgtgtg

SEQ ID NO: 1908448 - DNA, 23 bp, Homo sapiens
ctgctgctgacccctgtgtgaca

SEQ ID NO: 1908449 - DNA, 20 bp, Homo sapiens
ctgctgggctccacttggct

SEQ ID NO: 1908450 - DNA, 17 bp, Homo sapiens
ctgctgtatcttccaga

SEQ ID NO: 1908451 - DNA, 17 bp, Homo sapiens
ctgctgtgaacatgcct

SEQ ID NO: 1908452 - DNA, 19 bp, Homo sapiens
ctgctgtgaagctggaact

SEQ ID NO: 1908453 - DNA, 21 bp, Homo sapiens
ctgcttataaacatttaaaga

SEQ ID NO: 1908454 - DNA, 23 bp, Homo sapiens
ctgcttataaacatttaaagaca

SEQ ID NO: 1908455 - DNA, 16 bp, Homo sapiens
ctgcttggcccagggg

SEQ ID NO: 1908456 - DNA, 18 bp, Homo sapiens
ctgcttggcccagggggc

SEQ ID NO: 1908457 - DNA, 20 bp, Homo sapiens
ctgctttagacttgaaaaga

SEQ ID NO: 1908458 - DNA, 17 bp, Homo sapiens
ctggaaaggccagcagc

SEQ ID NO: 1908459 - DNA, 22 bp, Homo sapiens
ctggaaaggccagcagccttcc

SEQ ID NO: 1908460 - DNA, 20 bp, Homo sapiens
ctggaaattgaaataaagat

SEQ ID NO: 1908461 - DNA, 21 bp, Homo sapiens
ctggaactgctgctgacccct

SEQ ID NO: 1908462 - DNA, 22 bp, Homo sapiens
ctggaactgctgctgacccctg

SEQ ID NO: 1908463 - DNA, 17 bp, Homo sapiens
ctggaagcagtgcccag

SEQ ID NO: 1908464 - DNA, 18 bp, Homo sapiens
ctggaagcagtgcccagg

SEQ ID NO: 1908465 - DNA, 13 bp, Homo sapiens
ctggaataagcct

SEQ ID NO: 1908466 - DNA, 15 bp, Homo sapiens
ctggaataagccttc

SEQ ID NO: 1908467 - DNA, 14 bp, Homo sapiens
ctggaccccagcct

SEQ ID NO: 1908468 - DNA, 18 bp, Homo sapiens
ctggaccccatctgtgaa

SEQ ID NO: 1908469 - DNA, 19 bp, Homo sapiens
ctggaccccatctgtgaat

SEQ ID NO: 1908470 - DNA, 12 bp, Homo sapiens
ctggactgaatt

SEQ ID NO: 1908471 - DNA, 17 bp, Homo sapiens
ctggagaggagccctgc

SEQ ID NO: 1908472 - DNA, 23 bp, Homo sapiens
ctggagaggagccctgcctctcc

SEQ ID NO: 1908473 - DNA, 23 bp, Homo sapiens
ctggagcctgcggggcagcaggg

SEQ ID NO: 1908474 - DNA, 15 bp, Homo sapiens
ctggaggctcaaatt

SEQ ID NO: 1908475 - DNA, 18 bp, Homo sapiens
ctggaggctcaaattttg

SEQ ID NO: 1908476 - DNA, 12 bp, Homo sapiens
ctggagtctggg

SEQ ID NO: 1908477 - DNA, 13 bp, Homo sapiens
ctggatagtgaag

SEQ ID NO: 1908478 - DNA, 18 bp, Homo sapiens
ctggatatagaaaggaga

SEQ ID NO: 1908479 - DNA, 20 bp, Homo sapiens
ctggatatccatgagctgca

SEQ ID NO: 1908480 - DNA, 15 bp, Homo sapiens
ctggatgtaccacca

SEQ ID NO: 1908481 - DNA, 23 bp, Homo sapiens
ctggcaagaaaagagttaaggca

SEQ ID NO: 1908482 - DNA, 12 bp, Homo sapiens
ctggcacagcct

SEQ ID NO: 1908483 - DNA, 13 bp, Homo sapiens
ctggcacagcctg

SEQ ID NO: 1908484 - DNA, 14 bp, Homo sapiens
ctggcacagcctgc

SEQ ID NO: 1908485 - DNA, 15 bp, Homo sapiens
ctggcaccagcaggc

SEQ ID NO: 1908486 - DNA, 17 bp, Homo sapiens
ctggcacgaaatggctg

SEQ ID NO: 1908487 - DNA, 20 bp, Homo sapiens
ctggcacgaaatggctgaag

SEQ ID NO: 1908488 - DNA, 13 bp, Homo sapiens
ctggcagcccgca

SEQ ID NO: 1908489 - DNA, 18 bp, Homo sapiens
ctggcagcccgcatcagc

SEQ ID NO: 1908490 - DNA, 18 bp, Homo sapiens
ctggccagggaggagccc

SEQ ID NO: 1908491 - DNA, 19 bp, Homo sapiens
ctggcccatgtatggccag

SEQ ID NO: 1908492 - DNA, 14 bp, Homo sapiens
ctggcccccacatg

SEQ ID NO: 1908493 - DNA, 15 bp, Homo sapiens
ctggcccccacatgg

SEQ ID NO: 1908494 - DNA, 22 bp, Homo sapiens
ctggccctctctgaaggaggcc

SEQ ID NO: 1908495 - DNA, 23 bp, Homo sapiens
ctggccctctctgaaggaggcca

SEQ ID NO: 1908496 - DNA, 18 bp, Homo sapiens
ctggcgggccctggagct

SEQ ID NO: 1908497 - DNA, 18 bp, Homo sapiens
ctggctccctcactctca

SEQ ID NO: 1908498 - DNA, 20 bp, Homo sapiens
ctggctccctcactctcagg

SEQ ID NO: 1908499 - DNA, 13 bp, Homo sapiens
ctggctctacaca

SEQ ID NO: 1908500 - DNA, 14 bp, Homo sapiens
ctggcttacactgg

SEQ ID NO: 1908501 - DNA, 21 bp, Homo sapiens
ctgggaccacaggtgcccgcc

SEQ ID NO: 1908502 - DNA, 14 bp, Homo sapiens
ctgggaggtcccag

SEQ ID NO: 1908503 - DNA, 18 bp, Homo sapiens
ctgggaggtcccagggcc

SEQ ID NO: 1908504 - DNA, 19 bp, Homo sapiens
ctgggaggtcccagggccc

SEQ ID NO: 1908505 - DNA, 21 bp, Homo sapiens
ctgggatctcgccaacccctc

SEQ ID NO: 1908506 - DNA, 18 bp, Homo sapiens
ctgggcagcttgggctgg

SEQ ID NO: 1908507 - DNA, 21 bp, Homo sapiens
ctgggcagcttgggctggcgg

SEQ ID NO: 1908508 - DNA, 13 bp, Homo sapiens
ctgggccagggcg

SEQ ID NO: 1908509 - DNA, 15 bp, Homo sapiens
ctgggcccctgctca

SEQ ID NO: 1908510 - DNA, 16 bp, Homo sapiens
ctgggcccgagggtgg

SEQ ID NO: 1908511 - DNA, 11 bp, Homo sapiens
ctgggcctcca

SEQ ID NO: 1908512 - DNA, 15 bp, Homo sapiens
ctgggcctctgatgt

SEQ ID NO: 1908513 - DNA, 20 bp, Homo sapiens
ctgggcctggctccctcact

SEQ ID NO: 1908514 - DNA, 11 bp, Homo sapiens
ctgggctcctc

SEQ ID NO: 1908515 - DNA, 15 bp, Homo sapiens
ctgggctcctcttgg

SEQ ID NO: 1908516 - DNA, 12 bp, Homo sapiens
ctgggctgggca

SEQ ID NO: 1908517 - DNA, 22 bp, Homo sapiens
ctggggaccagcttggctcagg

SEQ ID NO: 1908518 - DNA, 19 bp, Homo sapiens
ctggggcatccatggggtc

SEQ ID NO: 1908519 - DNA, 16 bp, Homo sapiens
ctgggggatgggcctg

SEQ ID NO: 1908520 - DNA, 18 bp, Homo sapiens
ctgggggatgggcctgag

SEQ ID NO: 1908521 - DNA, 15 bp, Homo sapiens
ctgggggctgcaggg

SEQ ID NO: 1908522 - DNA, 18 bp, Homo sapiens
ctgggggctgcagggctg

SEQ ID NO: 1908523 - DNA, 20 bp, Homo sapiens
ctgggggctgcagggctggg

SEQ ID NO: 1908524 - DNA, 21 bp, Homo sapiens
ctgggggctgcagggctgggt

SEQ ID NO: 1908525 - DNA, 13 bp, Homo sapiens
ctgggtagctgta

SEQ ID NO: 1908526 - DNA, 16 bp, Homo sapiens
ctgggtcaggggtaca

SEQ ID NO: 1908527 - DNA, 18 bp, Homo sapiens
ctgggtttggcaggcact

SEQ ID NO: 1908528 - DNA, 13 bp, Homo sapiens
ctggtaaaatgaa

SEQ ID NO: 1908529 - DNA, 16 bp, Homo sapiens
ctggtaaaatgaagaa

SEQ ID NO: 1908530 - DNA, 17 bp, Homo sapiens
ctggtccatctggtttt

SEQ ID NO: 1908531 - DNA, 21 bp, Homo sapiens
ctggtgatgcgcagttgctgt

SEQ ID NO: 1908532 - DNA, 19 bp, Homo sapiens
ctggttcaagcgattctct

SEQ ID NO: 1908533 - DNA, 19 bp, Homo sapiens
ctgtaaggggccagagcct

SEQ ID NO: 1908534 - DNA, 20 bp, Homo sapiens
ctgtagcctgaagagtttgt

SEQ ID NO: 1908535 - DNA, 22 bp, Homo sapiens
ctgtaggcctcaggtgaaactc

SEQ ID NO: 1908536 - DNA, 21 bp, Homo sapiens
ctgtataaaggtgtgctgtgt

SEQ ID NO: 1908537 - DNA, 13 bp, Homo sapiens
ctgtatatatttt

SEQ ID NO: 1908538 - DNA, 20 bp, Homo sapiens
ctgtattgattatataagca

SEQ ID NO: 1908539 - DNA, 13 bp, Homo sapiens
ctgtatttgaaag

SEQ ID NO: 1908540 - DNA, 16 bp, Homo sapiens
ctgtatttgaaagtgc

SEQ ID NO: 1908541 - DNA, 14 bp, Homo sapiens
ctgtcaaggctcag

SEQ ID NO: 1908542 - DNA, 22 bp, Homo sapiens
ctgtcaccactacagtaagctg

SEQ ID NO: 1908543 - DNA, 19 bp, Homo sapiens
ctgtcatctgagaatgaac

SEQ ID NO: 1908544 - DNA, 22 bp, Homo sapiens
ctgtcatctgagaatgaacaaa

SEQ ID NO: 1908545 - DNA, 18 bp, Homo sapiens
ctgtcccaggcagcgcca

SEQ ID NO: 1908546 - DNA, 20 bp, Homo sapiens
ctgtccgctgtctccctcct

SEQ ID NO: 1908547 - DNA, 14 bp, Homo sapiens
ctgtctcggcagag

SEQ ID NO: 1908548 - DNA, 19 bp, Homo sapiens
ctgtctgttgtattcattg

SEQ ID NO: 1908549 - DNA, 15 bp, Homo sapiens
ctgtgaacatgcctc

SEQ ID NO: 1908550 - DNA, 16 bp, Homo sapiens
ctgtgaacatgcctcc

SEQ ID NO: 1908551 - DNA, 18 bp, Homo sapiens
ctgtgaaggagtaatggg

SEQ ID NO: 1908552 - DNA, 19 bp, Homo sapiens
ctgtgcagggcacagaagg

SEQ ID NO: 1908553 - DNA, 14 bp, Homo sapiens
ctgtgcgtggggct

SEQ ID NO: 1908554 - DNA, 14 bp, Homo sapiens
ctgtggagactgct

SEQ ID NO: 1908555 - DNA, 15 bp, Homo sapiens
ctgtggcagcaggag

SEQ ID NO: 1908556 - DNA, 20 bp, Homo sapiens
ctgtggtcagagagggaagc

SEQ ID NO: 1908557 - DNA, 20 bp, Homo sapiens
ctgtgtatatttgatttatt

SEQ ID NO: 1908558 - DNA, 22 bp, Homo sapiens
ctgtgtatatttgatttattaa

SEQ ID NO: 1908559 - DNA, 21 bp, Homo sapiens
ctgtgtgacatcacagggcct

SEQ ID NO: 1908560 - DNA, 23 bp, Homo sapiens
ctgtgtgacatcacagggcctca

SEQ ID NO: 1908561 - DNA, 17 bp, Homo sapiens
ctgtgtggccagcagcc

SEQ ID NO: 1908562 - DNA, 19 bp, Homo sapiens
ctgttacactttttggaag

SEQ ID NO: 1908563 - DNA, 19 bp, Homo sapiens
ctgttagtattgattcaaa

SEQ ID NO: 1908564 - DNA, 17 bp, Homo sapiens
ctgttatgtgagaacat

SEQ ID NO: 1908565 - DNA, 23 bp, Homo sapiens
ctgttcagttagagtgagtgctg

SEQ ID NO: 1908566 - DNA, 14 bp, Homo sapiens
ctgttccccttggt

SEQ ID NO: 1908567 - DNA, 13 bp, Homo sapiens
ctgttctggtaat

SEQ ID NO: 1908568 - DNA, 23 bp, Homo sapiens
ctgttgatgggatgattgaagaa

SEQ ID NO: 1908569 - DNA, 19 bp, Homo sapiens
ctgtttagatttgccatag

SEQ ID NO: 1908570 - DNA, 21 bp, Homo sapiens
ctgtttagatttgccatagag

SEQ ID NO: 1908571 - DNA, 22 bp, Homo sapiens
ctgtttcataagctttgtaatt

SEQ ID NO: 1908572 - DNA, 21 bp, Homo sapiens
ctgtttgcaatcacacgtggt

SEQ ID NO: 1908573 - DNA, 17 bp, Homo sapiens
ctgtttttcttctgaaa

SEQ ID NO: 1908574 - DNA, 21 bp, Homo sapiens
ctgtttttcttctgaaataca

SEQ ID NO: 1908575 - DNA, 18 bp, Homo sapiens
cttaaaacatcattcctt

SEQ ID NO: 1908576 - DNA, 20 bp, Homo sapiens
cttaaaacatcattcctttt

SEQ ID NO: 1908577 - DNA, 15 bp, Homo sapiens
cttaaatatagcagt

SEQ ID NO: 1908578 - DNA, 17 bp, Homo sapiens
cttaaatgaacacagct

SEQ ID NO: 1908579 - DNA, 17 bp, Homo sapiens
cttaactgtatagctct

SEQ ID NO: 1908580 - DNA, 19 bp, Homo sapiens
cttaaggtggaaagtgttc

SEQ ID NO: 1908581 - DNA, 23 bp, Homo sapiens
cttaaggtggaaagtgttcattg

SEQ ID NO: 1908582 - DNA, 20 bp, Homo sapiens
cttaagtgaggaaatcaaag

SEQ ID NO: 1908583 - DNA, 14 bp, Homo sapiens
cttaataatcaaga

SEQ ID NO: 1908584 - DNA, 15 bp, Homo sapiens
cttaataatcaagag

SEQ ID NO: 1908585 - DNA, 20 bp, Homo sapiens
cttaataatcaagagcctta

SEQ ID NO: 1908586 - DNA, 13 bp, Homo sapiens
cttaatatgtttt

SEQ ID NO: 1908587 - DNA, 19 bp, Homo sapiens
cttaatggatgaaatcata

SEQ ID NO: 1908588 - DNA, 18 bp, Homo sapiens
cttacatttgaataatgt

SEQ ID NO: 1908589 - DNA, 13 bp, Homo sapiens
cttacctggaaaa

SEQ ID NO: 1908590 - DNA, 17 bp, Homo sapiens
cttactttgtaaattct

SEQ ID NO: 1908591 - DNA, 19 bp, Homo sapiens
cttactttgtaaattctga

SEQ ID NO: 1908592 - DNA, 15 bp, Homo sapiens
cttagaatccctgtg

SEQ ID NO: 1908593 - DNA, 19 bp, Homo sapiens
cttagaatccctgtgttaa

SEQ ID NO: 1908594 - DNA, 19 bp, Homo sapiens
cttagatcatagttttatt

SEQ ID NO: 1908595 - DNA, 21 bp, Homo sapiens
cttagatcatagttttattta

SEQ ID NO: 1908596 - DNA, 22 bp, Homo sapiens
cttagatcatagttttatttat

SEQ ID NO: 1908597 - DNA, 21 bp, Homo sapiens
cttagatgtgtctcctgtttc

SEQ ID NO: 1908598 - DNA, 12 bp, Homo sapiens
cttataaaacag

SEQ ID NO: 1908599 - DNA, 21 bp, Homo sapiens
cttataaaacagagtaatctt

SEQ ID NO: 1908600 - DNA, 15 bp, Homo sapiens
cttatacaaatttaa

SEQ ID NO: 1908601 - DNA, 17 bp, Homo sapiens
cttatacaaatttaact

SEQ ID NO: 1908602 - DNA, 21 bp, Homo sapiens
cttatacaaatttaactttta

SEQ ID NO: 1908603 - DNA, 17 bp, Homo sapiens
cttatgactaaaaatat

SEQ ID NO: 1908604 - DNA, 23 bp, Homo sapiens
cttcactaagaacaaaagaagca

SEQ ID NO: 1908605 - DNA, 15 bp, Homo sapiens
cttcagcctcccaca

SEQ ID NO: 1908606 - DNA, 20 bp, Homo sapiens
cttcatctcaatagtgattt

SEQ ID NO: 1908607 - DNA, 11 bp, Homo sapiens
cttccagcagg

SEQ ID NO: 1908608 - DNA, 23 bp, Homo sapiens
cttccagcaggagggacagtctc

SEQ ID NO: 1908609 - DNA, 16 bp, Homo sapiens
cttccagtggcttctc

SEQ ID NO: 1908610 - DNA, 16 bp, Homo sapiens
cttccatctcttcctt

SEQ ID NO: 1908611 - DNA, 17 bp, Homo sapiens
cttccatctcttccttt

SEQ ID NO: 1908612 - DNA, 18 bp, Homo sapiens
cttccatctcttcctttc

SEQ ID NO: 1908613 - DNA, 19 bp, Homo sapiens
cttccatctcttcctttcc

SEQ ID NO: 1908614 - DNA, 23 bp, Homo sapiens
cttcccagaccccgcagcacgcc

SEQ ID NO: 1908615 - DNA, 19 bp, Homo sapiens
cttcccggttgtgagagcc

SEQ ID NO: 1908616 - DNA, 15 bp, Homo sapiens
cttccctccatccac

SEQ ID NO: 1908617 - DNA, 13 bp, Homo sapiens
cttccctggttca

SEQ ID NO: 1908618 - DNA, 21 bp, Homo sapiens
cttcctataattttgatagtg

SEQ ID NO: 1908619 - DNA, 11 bp, Homo sapiens
cctattagtgt

SEQ ID NO: 1908620 - DNA, 19 bp, Homo sapiens
cctattagtgttatatgaa

SEQ ID NO: 1908621 - DNA, 15 bp, Homo sapiens
cctatttcttgataa

SEQ ID NO: 1908622 - DNA, 18 bp, Homo sapiens
cctcaaatccaggaccct

SEQ ID NO: 1908623 - DNA, 23 bp, Homo sapiens
cctcaaatgatgtgcctgcttca

SEQ ID NO: 1908624 - DNA, 14 bp, Homo sapiens
cctcaataaagctc

SEQ ID NO: 1908625 - DNA, 20 bp, Homo sapiens
cctcacacacctctgcccct

SEQ ID NO: 1908626 - DNA, 13 bp, Homo sapiens
cctcactctcagg

SEQ ID NO: 1908627 - DNA, 14 bp, Homo sapiens
cctcactctcagga

SEQ ID NO: 1908628 - DNA, 13 bp, Homo sapiens
cctcagcttcccc

SEQ ID NO: 1908629 - DNA, 21 bp, Homo sapiens
cctcagcttccccagtagctg

SEQ ID NO: 1908630 - DNA, 23 bp, Homo sapiens
cctcagtcggggcaggccagggg

SEQ ID NO: 1908631 - DNA, 13 bp, Homo sapiens
cctccaaggccag

SEQ ID NO: 1908632 - DNA, 19 bp, Homo sapiens
cctccatccacccctctgg

SEQ ID NO: 1908633 - DNA, 12 bp, Homo sapiens
cctcccactccc

SEQ ID NO: 1908634 - DNA, 20 bp, Homo sapiens
cctcccactcccatggctct

SEQ ID NO: 1908635 - DNA, 10 bp, Homo sapiens
cctcccaggc

SEQ ID NO: 1908636 - DNA, 22 bp, Homo sapiens
cctccccaccctgtcccaggca

SEQ ID NO: 1908637 - DNA, 16 bp, Homo sapiens
cctcccctcctttacc

SEQ ID NO: 1908638 - DNA, 13 bp, Homo sapiens
cctcccctgctca

SEQ ID NO: 1908639 - DNA, 16 bp, Homo sapiens
cctcccctgctcagaa

SEQ ID NO: 1908640 - DNA, 13 bp, Homo sapiens
cctccccttccca

SEQ ID NO: 1908641 - DNA, 17 bp, Homo sapiens
cctccccttcccagacc

SEQ ID NO: 1908642 - DNA, 14 bp, Homo sapiens
cctccccttgccag

SEQ ID NO: 1908643 - DNA, 22 bp, Homo sapiens
cctccccttgccagctgctgag

SEQ ID NO: 1908644 - DNA, 16 bp, Homo sapiens
cctccctgacgtctgc

SEQ ID NO: 1908645 - DNA, 20 bp, Homo sapiens
cctccctgacgtctgccacc

SEQ ID NO: 1908646 - DNA, 17 bp, Homo sapiens
cctccgccccgtccccc

SEQ ID NO: 1908647 - DNA, 14 bp, Homo sapiens
cctccggctaagca

SEQ ID NO: 1908648 - DNA, 18 bp, Homo sapiens
cctcctaaaaggcccaga

SEQ ID NO: 1908649 - DNA, 13 bp, Homo sapiens
cctcctcctgccc

SEQ ID NO: 1908650 - DNA, 22 bp, Homo sapiens
cctcctttaccgaggacagcct

SEQ ID NO: 1908651 - DNA, 10 bp, Homo sapiens
cctcctttcc

SEQ ID NO: 1908652 - DNA, 14 bp, Homo sapiens
cctcctttcctttt

SEQ ID NO: 1908653 - DNA, 21 bp, Homo sapiens
cctcctttctttgctgtttgc

SEQ ID NO: 1908654 - DNA, 20 bp, Homo sapiens
cctcgcccagtcccagcagc

SEQ ID NO: 1908655 - DNA, 21 bp, Homo sapiens
cctctccccaccttcttggga

SEQ ID NO: 1908656 - DNA, 14 bp, Homo sapiens
cctctcctctgccc

SEQ ID NO: 1908657 - DNA, 22 bp, Homo sapiens
cctctcctctgccctctgctct

SEQ ID NO: 1908658 - DNA, 18 bp, Homo sapiens
cctctctgaaggaggcca

SEQ ID NO: 1908659 - DNA, 14 bp, Homo sapiens
cctctcttgccaaa

SEQ ID NO: 1908660 - DNA, 23 bp, Homo sapiens
cctctcttgccaaaaagcacaag

SEQ ID NO: 1908661 - DNA, 13 bp, Homo sapiens
cctctctttctaa

SEQ ID NO: 1908662 - DNA, 23 bp, Homo sapiens
cctctgccccttgggcctcccac

SEQ ID NO: 1908663 - DNA, 14 bp, Homo sapiens
cctctgccctctgc

SEQ ID NO: 1908664 - DNA, 21 bp, Homo sapiens
cctctgctgcatccccttcca

SEQ ID NO: 1908665 - DNA, 23 bp, Homo sapiens
cctctgctgcatccccttccagc

SEQ ID NO: 1908666 - DNA, 16 bp, Homo sapiens
cctctggctctacaca

SEQ ID NO: 1908667 - DNA, 21 bp, Homo sapiens
cctcttaatgtatgattacat

SEQ ID NO: 1908668 - DNA, 22 bp, Homo sapiens
cctcttctcctgcagcctgaga

SEQ ID NO: 1908669 - DNA, 16 bp, Homo sapiens
cctgaaggggttttct

SEQ ID NO: 1908670 - DNA, 14 bp, Homo sapiens
cctgacgtctgcca

SEQ ID NO: 1908671 - DNA, 16 bp, Homo sapiens
cctgacgtctgccacc

SEQ ID NO: 1908672 - DNA, 23 bp, Homo sapiens
cctgacgtctgccaccagcgccc

SEQ ID NO: 1908673 - DNA, 21 bp, Homo sapiens
cctgagatggatggacagaca

SEQ ID NO: 1908674 - DNA, 15 bp, Homo sapiens
cctgagcccccagct

SEQ ID NO: 1908675 - DNA, 18 bp, Homo sapiens
cctgagcccccagcttcc

SEQ ID NO: 1908676 - DNA, 19 bp, Homo sapiens
cctgaggggagacagagca

SEQ ID NO: 1908677 - DNA, 22 bp, Homo sapiens
cctgaggggagacagagcaacc

SEQ ID NO: 1908678 - DNA, 13 bp, Homo sapiens
cctgagttcctga

SEQ ID NO: 1908679 - DNA, 22 bp, Homo sapiens
cctgagttcctgaggtgatgaa

SEQ ID NO: 1908680 - DNA, 21 bp, Homo sapiens
cctgattattttcagaagctg

SEQ ID NO: 1908681 - DNA, 19 bp, Homo sapiens
cctgattcactgcctatga

SEQ ID NO: 1908682 - DNA, 15 bp, Homo sapiens
cctgcacttgggggc

SEQ ID NO: 1908683 - DNA, 14 bp, Homo sapiens
cctgcagcctgaga

SEQ ID NO: 1908684 - DNA, 12 bp, Homo sapiens
cctgcagctggg

SEQ ID NO: 1908685 - DNA, 13 bp, Homo sapiens
cctgcagttcccc

SEQ ID NO: 1908686 - DNA, 13 bp, Homo sapiens
cctgccaggcaca

SEQ ID NO: 1908687 - DNA, 18 bp, Homo sapiens
cctgccaggcacaggcag

SEQ ID NO: 1908688 - DNA, 23 bp, Homo sapiens
cctgccaggcacaggcagggcag

SEQ ID NO: 1908689 - DNA, 13 bp, Homo sapiens
cctgccctccgcc

SEQ ID NO: 1908690 - DNA, 18 bp, Homo sapiens
cctgccctccgccccgtc

SEQ ID NO: 1908691 - DNA, 12 bp, Homo sapiens
cctgcctctgcc

SEQ ID NO: 1908692 - DNA, 12 bp, Homo sapiens
cctgctgaccat

SEQ ID NO: 1908693 - DNA, 20 bp, Homo sapiens
cctgctgtatcttccagaac

SEQ ID NO: 1908694 - DNA, 22 bp, Homo sapiens
cctgctgtatcttccagaacct

SEQ ID NO: 1908695 - DNA, 17 bp, Homo sapiens
cctgcttcagcctccca

SEQ ID NO: 1908696 - DNA, 21 bp, Homo sapiens
cctgcttctcccctgggctgc

SEQ ID NO: 1908697 - DNA, 15 bp, Homo sapiens
cctgcttggcccagg

SEQ ID NO: 1908698 - DNA, 17 bp, Homo sapiens
cctggaagcagtgccca

SEQ ID NO: 1908699 - DNA, 18 bp, Homo sapiens
cctggaagcagtgcccag

SEQ ID NO: 1908700 - DNA, 12 bp, Homo sapiens
cctggaccccag

SEQ ID NO: 1908701 - DNA, 17 bp, Homo sapiens
cctggaccccagcctca

SEQ ID NO: 1908702 - DNA, 17 bp, Homo sapiens
cctggactcccgtgtag

SEQ ID NO: 1908703 - DNA, 17 bp, Homo sapiens
cctggcatatctctgtt

SEQ ID NO: 1908704 - DNA, 15 bp, Homo sapiens
cctggcccatgtatg

SEQ ID NO: 1908705 - DNA, 18 bp, Homo sapiens
cctggccggtgtgggggc

SEQ ID NO: 1908706 - DNA, 22 bp, Homo sapiens
cctggccggtgtgggggccccg

SEQ ID NO: 1908707 - DNA, 22 bp, Homo sapiens
cctggctccctcactctcagga

SEQ ID NO: 1908708 - DNA, 17 bp, Homo sapiens
cctgggcctccacctct

SEQ ID NO: 1908709 - DNA, 18 bp, Homo sapiens
cctgggcctccacctctg

SEQ ID NO: 1908710 - DNA, 22 bp, Homo sapiens
cctgggcctccacctctgtgca

SEQ ID NO: 1908711 - DNA, 12 bp, Homo sapiens
cctgggcctggc

SEQ ID NO: 1908712 - DNA, 20 bp, Homo sapiens
cctgggttagactgccagct

SEQ ID NO: 1908713 - DNA, 15 bp, Homo sapiens
cctgtaaatgtattc

SEQ ID NO: 1908714 - DNA, 21 bp, Homo sapiens
cctgtacatatctttgagttc

SEQ ID NO: 1908715 - DNA, 12 bp, Homo sapiens
cctgtcccaggc

SEQ ID NO: 1908716 - DNA, 15 bp, Homo sapiens
cctgtcccaggcagc

SEQ ID NO: 1908717 - DNA, 18 bp, Homo sapiens
cctgtcccaggcagcgcc

SEQ ID NO: 1908718 - DNA, 19 bp, Homo sapiens
cctgtccctcccctgggca

SEQ ID NO: 1908719 - DNA, 20 bp, Homo sapiens
cctgtctcccaccctttctg

SEQ ID NO: 1908720 - DNA, 18 bp, Homo sapiens
cctgtttcagaggctcag

SEQ ID NO: 1908721 - DNA, 20 bp, Homo sapiens
ccttaaaacatcattccttt

SEQ ID NO: 1908722 - DNA, 15 bp, Homo sapiens
ccttcaagctgcttt

SEQ ID NO: 1908723 - DNA, 15 bp, Homo sapiens
ccttccagctccctc

SEQ ID NO: 1908724 - DNA, 17 bp, Homo sapiens
ccttccagctccctccc

SEQ ID NO: 1908725 - DNA, 20 bp, Homo sapiens
ccttccagctccctcccctg

SEQ ID NO: 1908726 - DNA, 18 bp, Homo sapiens
ccttccatctcttccttt

SEQ ID NO: 1908727 - DNA, 16 bp, Homo sapiens
ccttccatctgattcc

SEQ ID NO: 1908728 - DNA, 24 bp, Homo sapiens
ccttcccagaccccgcagcacgcc

SEQ ID NO: 1908729 - DNA, 17 bp, Homo sapiens
ccttcgaaaagaaattg

SEQ ID NO: 1908730 - DNA, 17 bp, Homo sapiens
ccttctatgcccagctg

SEQ ID NO: 1908731 - DNA, 13 bp, Homo sapiens
ccttctgtagcct

SEQ ID NO: 1908732 - DNA, 18 bp, Homo sapiens
ccttcttgggactgctgt

SEQ ID NO: 1908733 - DNA, 16 bp, Homo sapiens
ccttgaaccctaataa

SEQ ID NO: 1908734 - DNA, 16 bp, Homo sapiens
ccttgaagcttgtatc

SEQ ID NO: 1908735 - DNA, 19 bp, Homo sapiens
ccttgaagcttgtatctga

SEQ ID NO: 1908736 - DNA, 22 bp, Homo sapiens
ccttgatgaaataacacagcag

SEQ ID NO: 1908737 - DNA, 15 bp, Homo sapiens
ccttgccagctgctg

SEQ ID NO: 1908738 - DNA, 19 bp, Homo sapiens
ccttgccagctgctgagcc

SEQ ID NO: 1908739 - DNA, 20 bp, Homo sapiens
ccttggaaatcaaatgtaaa

SEQ ID NO: 1908740 - DNA, 22 bp, Homo sapiens
ccttggaaatcaaatgtaaagt

SEQ ID NO: 1908741 - DNA, 19 bp, Homo sapiens
ccttggcttggccctggca

SEQ ID NO: 1908742 - DNA, 22 bp, Homo sapiens
ccttggcttggccctggcagcc

SEQ ID NO: 1908743 - DNA, 18 bp, Homo sapiens
ccttgggcctcccactcc

SEQ ID NO: 1908744 - DNA, 19 bp, Homo sapiens
ccttggggacaaccttggc

SEQ ID NO: 1908745 - DNA, 15 bp, Homo sapiens
cctttagttataaag

SEQ ID NO: 1908746 - DNA, 22 bp, Homo sapiens
cctttcattctagtattcttta

SEQ ID NO: 1908747 - DNA, 21 bp, Homo sapiens
cctttcattttctttcctttc

SEQ ID NO: 1908748 - DNA, 13 bp, Homo sapiens
cctttcctttctt

SEQ ID NO: 1908749 - DNA, 22 bp, Homo sapiens
cctttcctttttctttcctttc

SEQ ID NO: 1908750 - DNA, 15 bp, Homo sapiens
cctttctgatcttca

SEQ ID NO: 1908751 - DNA, 13 bp, Homo sapiens
cctttctgccagg

SEQ ID NO: 1908752 - DNA, 21 bp, Homo sapiens
cctttctgccagggatggcag

SEQ ID NO: 1908753 - DNA, 17 bp, Homo sapiens
cctttgactttctgtgt

SEQ ID NO: 1908754 - DNA, 14 bp, Homo sapiens
ccttttctttcctt

SEQ ID NO: 1908755 - DNA, 17 bp, Homo sapiens
ctcacgctcctttctga

SEQ ID NO: 1908756 - DNA, 10 bp, Homo sapiens
ctcactctca

SEQ ID NO: 1908757 - DNA, 14 bp, Homo sapiens
ctcactctcaggaa

SEQ ID NO: 1908758 - DNA, 14 bp, Homo sapiens
ctcactctcttcct

SEQ ID NO: 1908759 - DNA, 12 bp, Homo sapiens
ctcactgccttt

SEQ ID NO: 1908760 - DNA, 13 bp, Homo sapiens
ctcactgcctttg

SEQ ID NO: 1908761 - DNA, 20 bp, Homo sapiens
ctcactgcctttgtttagaa

SEQ ID NO: 1908762 - DNA, 20 bp, Homo sapiens
ctcactgtggtgtctgtgtt

SEQ ID NO: 1908763 - DNA, 13 bp, Homo sapiens
ctcactttttcat

SEQ ID NO: 1908764 - DNA, 22 bp, Homo sapiens
ctcagaaaagacgcaccagccc

SEQ ID NO: 1908765 - DNA, 14 bp, Homo sapiens
ctcagaaccacagc

SEQ ID NO: 1908766 - DNA, 13 bp, Homo sapiens
ctcagaagaaaga

SEQ ID NO: 1908767 - DNA, 12 bp, Homo sapiens
ctcagaggcccc

SEQ ID NO: 1908768 - DNA, 13 bp, Homo sapiens
ctcagaggcccca

SEQ ID NO: 1908769 - DNA, 21 bp, Homo sapiens
ctcagaggccccaatacccca

SEQ ID NO: 1908770 - DNA, 23 bp, Homo sapiens
ctcagaggccccaataccccatg

SEQ ID NO: 1908771 - DNA, 20 bp, Homo sapiens
ctcagatcccacttttgcca

SEQ ID NO: 1908772 - DNA, 15 bp, Homo sapiens
ctcagattgtaatat

SEQ ID NO: 1908773 - DNA, 17 bp, Homo sapiens
ctcagccctctcttgcc

SEQ ID NO: 1908774 - DNA, 15 bp, Homo sapiens
ctcaggaaatgctga

SEQ ID NO: 1908775 - DNA, 22 bp, Homo sapiens
ctcaggaaatgctgacccatgg

SEQ ID NO: 1908776 - DNA, 22 bp, Homo sapiens
ctcaggcatggatgaataaatg

SEQ ID NO: 1908777 - DNA, 17 bp, Homo sapiens
ctcagtcggggcaggcc

SEQ ID NO: 1908778 - DNA, 19 bp, Homo sapiens
ctcagtttccctatctgca

SEQ ID NO: 1908779 - DNA, 20 bp, Homo sapiens
ctcagtttccctatctgcaa

SEQ ID NO: 1908780 - DNA, 17 bp, Homo sapiens
ctcatctggagttctca

SEQ ID NO: 1908781 - DNA, 21 bp, Homo sapiens
ctcatctggagttctcaaaga

SEQ ID NO: 1908782 - DNA, 21 bp, Homo sapiens
ctcatgtacttttaaattata

SEQ ID NO: 1908783 - DNA, 14 bp, Homo sapiens
ctcattcagcatct

SEQ ID NO: 1908784 - DNA, 16 bp, Homo sapiens
ctcattcagcatctga

SEQ ID NO: 1908785 - DNA, 19 bp, Homo sapiens
ctccaaaccttactctgag

SEQ ID NO: 1908786 - DNA, 22 bp, Homo sapiens
ctccaaagtattgtacaaataa

SEQ ID NO: 1908787 - DNA, 15 bp, Homo sapiens
ctccaacccctcgcc

SEQ ID NO: 1908788 - DNA, 19 bp, Homo sapiens
ctccaacccctcgcccagt

SEQ ID NO: 1908789 - DNA, 12 bp, Homo sapiens
ctccacctctgt

SEQ ID NO: 1908790 - DNA, 20 bp, Homo sapiens
ctccacctctgtgcagggca

SEQ ID NO: 1908791 - DNA, 21 bp, Homo sapiens
ctccacctctgtgcagggcac

SEQ ID NO: 1908792 - DNA, 19 bp, Homo sapiens
ctccatccacccctctggc

SEQ ID NO: 1908793 - DNA, 22 bp, Homo sapiens
ctccatccctctcctctgccct

SEQ ID NO: 1908794 - DNA, 14 bp, Homo sapiens
ctcccaccctttct

SEQ ID NO: 1908795 - DNA, 20 bp, Homo sapiens
ctcccaccctttctgccagg

SEQ ID NO: 1908796 - DNA, 13 bp, Homo sapiens
ctcccactcccat

SEQ ID NO: 1908797 - DNA, 16 bp, Homo sapiens
ctcccacttctgccag

SEQ ID NO: 1908798 - DNA, 18 bp, Homo sapiens
ctcccagctccaccccgc

SEQ ID NO: 1908799 - DNA, 20 bp, Homo sapiens
ctcccaggagcctgcccagc

SEQ ID NO: 1908800 - DNA, 22 bp, Homo sapiens
ctcccagggagcaagggcaggg

SEQ ID NO: 1908801 - DNA, 13 bp, Homo sapiens
ctcccatggctct

SEQ ID NO: 1908802 - DNA, 21 bp, Homo sapiens
ctccccacccagacctgcctg

SEQ ID NO: 1908803 - DNA, 16 bp, Homo sapiens
ctcccctaaagcctca

SEQ ID NO: 1908804 - DNA, 23 bp, Homo sapiens
ctcccctaaagcctcaaaacaaa

SEQ ID NO: 1908805 - DNA, 11 bp, Homo sapiens
ctcccctcctt

SEQ ID NO: 1908806 - DNA, 12 bp, Homo sapiens
ctcccctggact

SEQ ID NO: 1908807 - DNA, 11 bp, Homo sapiens
ctccccttccc

SEQ ID NO: 1908808 - DNA, 12 bp, Homo sapiens
ctccccttccca

SEQ ID NO: 1908809 - DNA, 14 bp, Homo sapiens
ctccccttgccagc

SEQ ID NO: 1908810 - DNA, 16 bp, Homo sapiens
ctccccttgccagctg

SEQ ID NO: 1908811 - DNA, 16 bp, Homo sapiens
ctcccgcctccaaccc

SEQ ID NO: 1908812 - DNA, 15 bp, Homo sapiens
ctcccgggactctgc

SEQ ID NO: 1908813 - DNA, 14 bp, Homo sapiens
ctccctcactctca

SEQ ID NO: 1908814 - DNA, 12 bp, Homo sapiens
ctccctcccctg

SEQ ID NO: 1908815 - DNA, 16 bp, Homo sapiens
ctccctgacgtctgcc

SEQ ID NO: 1908816 - DNA, 18 bp, Homo sapiens
ctccctgacgtctgccac

SEQ ID NO: 1908817 - DNA, 17 bp, Homo sapiens
ctccgccccgtcccccc

SEQ ID NO: 1908818 - DNA, 19 bp, Homo sapiens
ctccgccccgtccccccat

SEQ ID NO: 1908819 - DNA, 18 bp, Homo sapiens
ctccgcccctgagcccac

SEQ ID NO: 1908820 - DNA, 16 bp, Homo sapiens
ctcctaaaaggcccag

SEQ ID NO: 1908821 - DNA, 17 bp, Homo sapiens
ctcctaaaaggcccaga

SEQ ID NO: 1908822 - DNA, 18 bp, Homo sapiens
ctcctaaaaggcccagag

SEQ ID NO: 1908823 - DNA, 18 bp, Homo sapiens
ctcctaaataaattattt

SEQ ID NO: 1908824 - DNA, 21 bp, Homo sapiens
ctcctaaataaattatttgtt

SEQ ID NO: 1908825 - DNA, 15 bp, Homo sapiens
ctcctcagccctctc

SEQ ID NO: 1908826 - DNA, 22 bp, Homo sapiens
ctcctcagccctctcttgccaa

SEQ ID NO: 1908827 - DNA, 13 bp, Homo sapiens
ctcctcctgccct

SEQ ID NO: 1908828 - DNA, 16 bp, Homo sapiens
ctcctcctgccctccg

SEQ ID NO: 1908829 - DNA, 11 bp, Homo sapiens
ctcctgccctc

SEQ ID NO: 1908830 - DNA, 15 bp, Homo sapiens
ctcctgtgctggtga

SEQ ID NO: 1908831 - DNA, 15 bp, Homo sapiens
ctcctgtttcagacc

SEQ ID NO: 1908832 - DNA, 16 bp, Homo sapiens
ctcctgtttcagacca

SEQ ID NO: 1908833 - DNA, 22 bp, Homo sapiens
ctcctttcctttttctttcctt

SEQ ID NO: 1908834 - DNA, 20 bp, Homo sapiens
ctcctttctttgctgtttgc

SEQ ID NO: 1908835 - DNA, 14 bp, Homo sapiens
ctcgattctttgaa

SEQ ID NO: 1908836 - DNA, 20 bp, Homo sapiens
ctcgcccagtcccagcagcc

SEQ ID NO: 1908837 - DNA, 19 bp, Homo sapiens
ctcggccctcaagtgcccg

SEQ ID NO: 1908838 - DNA, 15 bp, Homo sapiens
ctcgtccccattgct

SEQ ID NO: 1908839 - DNA, 15 bp, Homo sapiens
ctctaattgctgcca

SEQ ID NO: 1908840 - DNA, 16 bp, Homo sapiens
ctctagaggctggcaa

SEQ ID NO: 1908841 - DNA, 21 bp, Homo sapiens
ctctaggactgggcccgaggg

SEQ ID NO: 1908842 - DNA, 14 bp, Homo sapiens
ctctagtactgtga

SEQ ID NO: 1908843 - DNA, 17 bp, Homo sapiens
ctctagtgctgtgaaaa

SEQ ID NO: 1908844 - DNA, 20 bp, Homo sapiens
ctctagtgctgtgaaaaaaa

SEQ ID NO: 1908845 - DNA, 22 bp, Homo sapiens
ctctatggtcttatatttacaa

SEQ ID NO: 1908846 - DNA, 18 bp, Homo sapiens
ctctcacagacaggaccc

SEQ ID NO: 1908847 - DNA, 20 bp, Homo sapiens
ctctcacagacaggacccct

SEQ ID NO: 1908848 - DNA, 23 bp, Homo sapiens
ctctcaccttggttcctggggca

SEQ ID NO: 1908849 - DNA, 21 bp, Homo sapiens
ctctcaggaaatgctgaccca

SEQ ID NO: 1908850 - DNA, 14 bp, Homo sapiens
ctctcatttgtgtg

SEQ ID NO: 1908851 - DNA, 13 bp, Homo sapiens
ctctcccagctct

SEQ ID NO: 1908852 - DNA, 14 bp, Homo sapiens
ctctcccagctctg

SEQ ID NO: 1908853 - DNA, 13 bp, Homo sapiens
ctctccccacctt

SEQ ID NO: 1908854 - DNA, 15 bp, Homo sapiens
ctctccccaccttct

SEQ ID NO: 1908855 - DNA, 18 bp, Homo sapiens
ctctccgcccctgagccc

SEQ ID NO: 1908856 - DNA, 20 bp, Homo sapiens
ctctccgcccctgagcccac

SEQ ID NO: 1908857 - DNA, 17 bp, Homo sapiens
ctctcgtactctctctc

SEQ ID NO: 1908858 - DNA, 15 bp, Homo sapiens
ctctctccatccctc

SEQ ID NO: 1908859 - DNA, 23 bp, Homo sapiens
ctctctccatccctctcctctgc

SEQ ID NO: 1908860 - DNA, 14 bp, Homo sapiens
ctctctctccatcc

SEQ ID NO: 1908861 - DNA, 22 bp, Homo sapiens
ctctctcttttccctcctttcc

SEQ ID NO: 1908862 - DNA, 12 bp, Homo sapiens
ctctcttccttt

SEQ ID NO: 1908863 - DNA, 13 bp, Homo sapiens
ctctcttcctttc

SEQ ID NO: 1908864 - DNA, 16 bp, Homo sapiens
ctctcttcctttcatt

SEQ ID NO: 1908865 - DNA, 24 bp, Homo sapiens
ctctgaaaacaagagactgcttga

SEQ ID NO: 1908866 - DNA, 17 bp, Homo sapiens
ctctgaaggaggccacc

SEQ ID NO: 1908867 - DNA, 14 bp, Homo sapiens
ctctgacaaagtgg

SEQ ID NO: 1908868 - DNA, 20 bp, Homo sapiens
ctctgagttccggcaccagt

SEQ ID NO: 1908869 - DNA, 21 bp, Homo sapiens
ctctgagttccggcaccagta

SEQ ID NO: 1908870 - DNA, 14 bp, Homo sapiens
ctctgatctgtgca

SEQ ID NO: 1908871 - DNA, 15 bp, Homo sapiens
ctctgatctgtgcag

SEQ ID NO: 1908872 - DNA, 22 bp, Homo sapiens
ctctgatgttcttccagtgagg

SEQ ID NO: 1908873 - DNA, 19 bp, Homo sapiens
ctctgcacacaagaggcta

SEQ ID NO: 1908874 - DNA, 17 bp, Homo sapiens
ctctgccctctgctcta

SEQ ID NO: 1908875 - DNA, 16 bp, Homo sapiens
ctctgctgcatcccct

SEQ ID NO: 1908876 - DNA, 20 bp, Homo sapiens
ctctgctgcatccccttcca

SEQ ID NO: 1908877 - DNA, 21 bp, Homo sapiens
ctctgctgcatccccttccag

SEQ ID NO: 1908878 - DNA, 15 bp, Homo sapiens
ctctggctctacaca

SEQ ID NO: 1908879 - DNA, 14 bp, Homo sapiens
ctctgggaacttct

SEQ ID NO: 1908880 - DNA, 16 bp, Homo sapiens
ctctgggcggtccaga

SEQ ID NO: 1908881 - DNA, 19 bp, Homo sapiens
ctctgggcggtccagaagg

SEQ ID NO: 1908882 - DNA, 23 bp, Homo sapiens
ctctggggctggcaccagcaggc

SEQ ID NO: 1908883 - DNA, 22 bp, Homo sapiens
ctctggtacaatttcttttggt

SEQ ID NO: 1908884 - DNA, 16 bp, Homo sapiens
ctctgtctggccaggg

SEQ ID NO: 1908885 - DNA, 19 bp, Homo sapiens
ctctgtctggccagggagg

SEQ ID NO: 1908886 - DNA, 21 bp, Homo sapiens
ctctgtgcagggcacagaagg

SEQ ID NO: 1908887 - DNA, 20 bp, Homo sapiens
ctctgtttttcttctgaaat

SEQ ID NO: 1908888 - DNA, 14 bp, Homo sapiens
ctcttcctagctgg

SEQ ID NO: 1908889 - DNA, 11 bp, Homo sapiens
ctcttcctttc

SEQ ID NO: 1908890 - DNA, 22 bp, Homo sapiens
ctcttgcctcagcttccccagt

SEQ ID NO: 1908891 - DNA, 12 bp, Homo sapiens
ctctttctctct

SEQ ID NO: 1908892 - DNA, 13 bp, Homo sapiens
cccagtcccagca

SEQ ID NO: 1908893 - DNA, 17 bp, Homo sapiens
cccagtcccagcagcca

SEQ ID NO: 1908894 - DNA, 16 bp, Homo sapiens
cccatcagctacccct

SEQ ID NO: 1908895 - DNA, 16 bp, Homo sapiens
cccatcaggggcagga

SEQ ID NO: 1908896 - DNA, 20 bp, Homo sapiens
cccatcccgtttccctccag

SEQ ID NO: 1908897 - DNA, 13 bp, Homo sapiens
cccatggctctgg

SEQ ID NO: 1908898 - DNA, 17 bp, Homo sapiens
ccccaagcgccctggcc

SEQ ID NO: 1908899 - DNA, 13 bp, Homo sapiens
ccccaccctgtcc

SEQ ID NO: 1908900 - DNA, 21 bp, Homo sapiens
ccccaccctgtcccaggcagc

SEQ ID NO: 1908901 - DNA, 22 bp, Homo sapiens
ccccaccttcttgggactgctg

SEQ ID NO: 1908902 - DNA, 15 bp, Homo sapiens
ccccactcctcctcc

SEQ ID NO: 1908903 - DNA, 21 bp, Homo sapiens
ccccactcctcctcctttctt

SEQ ID NO: 1908904 - DNA, 14 bp, Homo sapiens
ccccactctcagag

SEQ ID NO: 1908905 - DNA, 16 bp, Homo sapiens
ccccactctcagaggc

SEQ ID NO: 1908906 - DNA, 23 bp, Homo sapiens
ccccagcaacacgtcattgtgta

SEQ ID NO: 1908907 - DNA, 20 bp, Homo sapiens
ccccagccctccagtacctt

SEQ ID NO: 1908908 - DNA, 22 bp, Homo sapiens
ccccagcctcaaatccaggacc

SEQ ID NO: 1908909 - DNA, 11 bp, Homo sapiens
ccccagggcac

SEQ ID NO: 1908910 - DNA, 23 bp, Homo sapiens
ccccatcccgtttccctccaggt

SEQ ID NO: 1908911 - DNA, 14 bp, Homo sapiens
ccccatctgtgaat

SEQ ID NO: 1908912 - DNA, 16 bp, Homo sapiens
cccccacatggtgatg

SEQ ID NO: 1908913 - DNA, 12 bp, Homo sapiens
cccccactcctc

SEQ ID NO: 1908914 - DNA, 14 bp, Homo sapiens
cccccactcctcct

SEQ ID NO: 1908915 - DNA, 21 bp, Homo sapiens
cccccactcctcctcctttct

SEQ ID NO: 1908916 - DNA, 14 bp, Homo sapiens
cccccagcttccag

SEQ ID NO: 1908917 - DNA, 11 bp, Homo sapiens
cccccatcccg

SEQ ID NO: 1908918 - DNA, 21 bp, Homo sapiens
cccccgcagtcgtcagcctcc

SEQ ID NO: 1908919 - DNA, 24 bp, Homo sapiens
cccccgcagtcgtcagcctccctg

SEQ ID NO: 1908920 - DNA, 19 bp, Homo sapiens
ccccgcagcacgcctctcc

SEQ ID NO: 1908921 - DNA, 22 bp, Homo sapiens
ccccgcagtcgtcagcctccct

SEQ ID NO: 1908922 - DNA, 23 bp, Homo sapiens
ccccgcagtcgtcagcctccctg

SEQ ID NO: 1908923 - DNA, 22 bp, Homo sapiens
cccctcgcccagtcccagcagc

SEQ ID NO: 1908924 - DNA, 21 bp, Homo sapiens
cccctggaagcagtgcccagg

SEQ ID NO: 1908925 - DNA, 11 bp, Homo sapiens
cccctggaccc

SEQ ID NO: 1908926 - DNA, 18 bp, Homo sapiens
cccctggaccccagcctc

SEQ ID NO: 1908927 - DNA, 15 bp, Homo sapiens
cccctggtctttgag

SEQ ID NO: 1908928 - DNA, 18 bp, Homo sapiens
ccccttccagctccctcc

SEQ ID NO: 1908929 - DNA, 13 bp, Homo sapiens
ccccttcccagac

SEQ ID NO: 1908930 - DNA, 15 bp, Homo sapiens
ccccttgggcctccc

SEQ ID NO: 1908931 - DNA, 16 bp, Homo sapiens
ccccttgggcctccca

SEQ ID NO: 1908932 - DNA, 17 bp, Homo sapiens
ccccttgggcctcccac

SEQ ID NO: 1908933 - DNA, 20 bp, Homo sapiens
ccccttgggcctcccactcc

SEQ ID NO: 1908934 - DNA, 17 bp, Homo sapiens
cccgacgctctctctcg

SEQ ID NO: 1908935 - DNA, 21 bp, Homo sapiens
cccgaggctcgagctcggggc

SEQ ID NO: 1908936 - DNA, 16 bp, Homo sapiens
cccgagggtggtttac

SEQ ID NO: 1908937 - DNA, 23 bp, Homo sapiens
cccgagggtggtttacctgcacc

SEQ ID NO: 1908938 - DNA, 21 bp, Homo sapiens
cccgcagatggctggaatatt

SEQ ID NO: 1908939 - DNA, 23 bp, Homo sapiens
cccgcagcacgcctctccccacc

SEQ ID NO: 1908940 - DNA, 14 bp, Homo sapiens
cccgggcccaggca

SEQ ID NO: 1908941 - DNA, 17 bp, Homo sapiens
cccggggaggggccaga

SEQ ID NO: 1908942 - DNA, 17 bp, Homo sapiens
cccgtccccccatcccg

SEQ ID NO: 1908943 - DNA, 12 bp, Homo sapiens
cccgtctcaggt

SEQ ID NO: 1908944 - DNA, 17 bp, Homo sapiens
cccgtttccctccaggt

SEQ ID NO: 1908945 - DNA, 19 bp, Homo sapiens
ccctaactcctgcctatga

SEQ ID NO: 1908946 - DNA, 21 bp, Homo sapiens
ccctagaagatcacagcaggg

SEQ ID NO: 1908947 - DNA, 21 bp, Homo sapiens
ccctatttaacagggtctcta

SEQ ID NO: 1908948 - DNA, 16 bp, Homo sapiens
ccctccaaggccaggc

SEQ ID NO: 1908949 - DNA, 9 bp, Homo sapiens
ccctcccag

SEQ ID NO: 1908950 - DNA, 12 bp, Homo sapiens
ccctcccaggcg

SEQ ID NO: 1908951 - DNA, 13 bp, Homo sapiens
ccctcccagggag

SEQ ID NO: 1908952 - DNA, 14 bp, Homo sapiens
ccctcccctccttt

SEQ ID NO: 1908953 - DNA, 19 bp, Homo sapiens
ccctccttgtgctgccagt

SEQ ID NO: 1908954 - DNA, 16 bp, Homo sapiens
ccctcgcccagtccca

SEQ ID NO: 1908955 - DNA, 22 bp, Homo sapiens
ccctcgcccagtcccagcagcc

SEQ ID NO: 1908956 - DNA, 13 bp, Homo sapiens
ccctctcctctgc

SEQ ID NO: 1908957 - DNA, 14 bp, Homo sapiens
ccctctctttctaa

SEQ ID NO: 1908958 - DNA, 17 bp, Homo sapiens
ccctgagcccactgtgc

SEQ ID NO: 1908959 - DNA, 12 bp, Homo sapiens
ccctgatctccg

SEQ ID NO: 1908960 - DNA, 21 bp, Homo sapiens
ccctgcagttcccctggaagc

SEQ ID NO: 1908961 - DNA, 22 bp, Homo sapiens
ccctgcagttcccctggaagca

SEQ ID NO: 1908962 - DNA, 22 bp, Homo sapiens
ccctgccaggcacaggcagggc

SEQ ID NO: 1908963 - DNA, 14 bp, Homo sapiens
ccctgcctctccgc

SEQ ID NO: 1908964 - DNA, 23 bp, Homo sapiens
ccctgcctctccgcccctgagcc

SEQ ID NO: 1908965 - DNA, 14 bp, Homo sapiens
ccctgcttggccca

SEQ ID NO: 1908966 - DNA, 13 bp, Homo sapiens
ccctgcttgggac

SEQ ID NO: 1908967 - DNA, 16 bp, Homo sapiens
ccctggaagcagtgcc

SEQ ID NO: 1908968 - DNA, 18 bp, Homo sapiens
ccctggaagcagtgccca

SEQ ID NO: 1908969 - DNA, 21 bp, Homo sapiens
ccctggaagcagtgcccaggt

SEQ ID NO: 1908970 - DNA, 15 bp, Homo sapiens
ccctggcagcccgca

SEQ ID NO: 1908971 - DNA, 18 bp, Homo sapiens
ccctggcatatctctgtt

SEQ ID NO: 1908972 - DNA, 11 bp, Homo sapiens
ccctgggcctc

SEQ ID NO: 1908973 - DNA, 19 bp, Homo sapiens
ccctgggttagactgccag

SEQ ID NO: 1908974 - DNA, 21 bp, Homo sapiens
ccctgggttagactgccagct

SEQ ID NO: 1908975 - DNA, 23 bp, Homo sapiens
ccctgggttagactgccagctct

SEQ ID NO: 1908976 - DNA, 13 bp, Homo sapiens
ccctgtcccaggc

SEQ ID NO: 1908977 - DNA, 15 bp, Homo sapiens
ccctgtcccaggcag

SEQ ID NO: 1908978 - DNA, 20 bp, Homo sapiens
ccctgtcccaggcagcgcca

SEQ ID NO: 1908979 - DNA, 22 bp, Homo sapiens
ccctgtcccaggcagcgccact

SEQ ID NO: 1908980 - DNA, 22 bp, Homo sapiens
cccttatttaaaactcacctcc

SEQ ID NO: 1908981 - DNA, 15 bp, Homo sapiens
cccttccagctccct

SEQ ID NO: 1908982 - DNA, 17 bp, Homo sapiens
cccttccatctcttcct

SEQ ID NO: 1908983 - DNA, 20 bp, Homo sapiens
cccttccatctcttcctttc

SEQ ID NO: 1908984 - DNA, 14 bp, Homo sapiens
cccttcccagaccc

SEQ ID NO: 1908985 - DNA, 21 bp, Homo sapiens
cccttctttttccctttcctt

SEQ ID NO: 1908986 - DNA, 14 bp, Homo sapiens
cccttgccagctgc

SEQ ID NO: 1908987 - DNA, 18 bp, Homo sapiens
cccttgccagctgctgag

SEQ ID NO: 1908988 - DNA, 15 bp, Homo sapiens
cccttgggcctccca

SEQ ID NO: 1908989 - DNA, 23 bp, Homo sapiens
cccttgggcctcccactcccatg

SEQ ID NO: 1908990 - DNA, 18 bp, Homo sapiens
ccgaactgggcatatttc

SEQ ID NO: 1908991 - DNA, 13 bp, Homo sapiens
ccgcagcacgcct

SEQ ID NO: 1908992 - DNA, 18 bp, Homo sapiens
ccgcagcacgcctctccc

SEQ ID NO: 1908993 - DNA, 17 bp, Homo sapiens
ccgcagtcgtcagcctc

SEQ ID NO: 1908994 - DNA, 18 bp, Homo sapiens
ccgcagtcgtcagcctcc

SEQ ID NO: 1908995 - DNA, 19 bp, Homo sapiens
ccgcagtcgtcagcctccc

SEQ ID NO: 1908996 - DNA, 19 bp, Homo sapiens
ccgcatcagctgctcagat

SEQ ID NO: 1908997 - DNA, 14 bp, Homo sapiens
ccgccacatccctc

SEQ ID NO: 1908998 - DNA, 14 bp, Homo sapiens
ccgcccctgagccc

SEQ ID NO: 1908999 - DNA, 22 bp, Homo sapiens
ccgccggcaataaaagcccagg

SEQ ID NO: 1909000 - DNA, 15 bp, Homo sapiens
ccgctgtctccctcc

SEQ ID NO: 1909001 - DNA, 16 bp, Homo sapiens
ccgctgtctccctcct

SEQ ID NO: 1909002 - DNA, 18 bp, Homo sapiens
ccgctgtctccctcctga

SEQ ID NO: 1909003 - DNA, 20 bp, Homo sapiens
ccggcagcgaggctgggctg

SEQ ID NO: 1909004 - DNA, 16 bp, Homo sapiens
ccggcatgaggccccg

SEQ ID NO: 1909005 - DNA, 18 bp, Homo sapiens
ccggccgcactgggagca

SEQ ID NO: 1909006 - DNA, 13 bp, Homo sapiens
ccgggcccaggca

SEQ ID NO: 1909007 - DNA, 15 bp, Homo sapiens
ccgggcccaggcaga

SEQ ID NO: 1909008 - DNA, 17 bp, Homo sapiens
ccggggaggggccagag

SEQ ID NO: 1909009 - DNA, 15 bp, Homo sapiens
ccggggtccaggcat

SEQ ID NO: 1909010 - DNA, 21 bp, Homo sapiens
ccggtcgggggggaccctcca

SEQ ID NO: 1909011 - DNA, 17 bp, Homo sapiens
ccgtccccccatcccgt

SEQ ID NO: 1909012 - DNA, 14 bp, Homo sapiens
ccgtcccctcccag

SEQ ID NO: 1909013 - DNA, 16 bp, Homo sapiens
ccgtcccctcccaggg

SEQ ID NO: 1909014 - DNA, 20 bp, Homo sapiens
ccgtgaagatactttgtatt

SEQ ID NO: 1909015 - DNA, 14 bp, Homo sapiens
ccgtttccctccag

SEQ ID NO: 1909016 - DNA, 15 bp, Homo sapiens
cctaaaaggcccaga

SEQ ID NO: 1909017 - DNA, 17 bp, Homo sapiens
cctaaaaggcccagaga

SEQ ID NO: 1909018 - DNA, 19 bp, Homo sapiens
cctaacccagaaaatctga

SEQ ID NO: 1909019 - DNA, 14 bp, Homo sapiens
cctaagtacttaaa

SEQ ID NO: 1909020 - DNA, 14 bp, Homo sapiens
cctacaaagctctg

SEQ ID NO: 1909021 - DNA, 23 bp, Homo sapiens
cctacacaggacaggggttcctt

SEQ ID NO: 1909022 - DNA, 12 bp, Homo sapiens
cctagctggaga

SEQ ID NO: 1909023 - DNA, 16 bp, Homo sapiens
cctagctggagaggag

SEQ ID NO: 1909024 - DNA, 13 bp, Homo sapiens
cctagtttgctgt

SEQ ID NO: 1909025 - DNA, 16 bp, Homo sapiens
cctatcaaaaagatat

SEQ ID NO: 1909026 - DNA, 15 bp, Homo sapiens
cctatgaacagacca

SEQ ID NO: 1909027 - DNA, 16 bp, Homo sapiens
cctatgaacagaccat

SEQ ID NO: 1909028 - DNA, 19 bp, Homo sapiens
cctatgtagacaatataag

SEQ ID NO: 1909029 - DNA, 18 bp, Homo sapiens
aattggtatcaagaaagt

SEQ ID NO: 1909030 - DNA, 13 bp, Homo sapiens
aattgtactttga

SEQ ID NO: 1909031 - DNA, 19 bp, Homo sapiens
aattgtattaattatttaa

SEQ ID NO: 1909032 - DNA, 13 bp, Homo sapiens
aattgtccttgaa

SEQ ID NO: 1909033 - DNA, 19 bp, Homo sapiens
aattgtcttaatggatgaa

SEQ ID NO: 1909034 - DNA, 16 bp, Homo sapiens
aattgttactccatat

SEQ ID NO: 1909035 - DNA, 21 bp, Homo sapiens
aattgttgtttgtatgtataa

SEQ ID NO: 1909036 - DNA, 24 bp, Homo sapiens
aatttaagttttgacaagctggct

SEQ ID NO: 1909037 - DNA, 12 bp, Homo sapiens
aatttatataaa

SEQ ID NO: 1909038 - DNA, 19 bp, Homo sapiens
aatttatataaagtatttt

SEQ ID NO: 1909039 - DNA, 11 bp, Homo sapiens
aatttcttttg

SEQ ID NO: 1909040 - DNA, 17 bp, Homo sapiens
aatttgcccctggcaaa

SEQ ID NO: 1909041 - DNA, 22 bp, Homo sapiens
aatttgcccctggcaaatgcac

SEQ ID NO: 1909042 - DNA, 19 bp, Homo sapiens
aatttgtgtaaattattga

SEQ ID NO: 1909043 - DNA, 11 bp, Homo sapiens
aattttccttt

SEQ ID NO: 1909044 - DNA, 12 bp, Homo sapiens
aattttctttca

SEQ ID NO: 1909045 - DNA, 13 bp, Homo sapiens
aattttgaaaagt

SEQ ID NO: 1909046 - DNA, 21 bp, Homo sapiens
aattttgaaaagtaatattta

SEQ ID NO: 1909047 - DNA, 22 bp, Homo sapiens
aattttgaaaagtaatatttat

SEQ ID NO: 1909048 - DNA, 16 bp, Homo sapiens
aattttgatagtggga

SEQ ID NO: 1909049 - DNA, 19 bp, Homo sapiens
aattttggacctaaacatt

SEQ ID NO: 1909050 - DNA, 14 bp, Homo sapiens
aattttggttttct

SEQ ID NO: 1909051 - DNA, 20 bp, Homo sapiens
aattttggttttctactgtt

SEQ ID NO: 1909052 - DNA, 14 bp, Homo sapiens
aattttgtgtaaga

SEQ ID NO: 1909053 - DNA, 17 bp, Homo sapiens
aattttgtgtaagaaat

SEQ ID NO: 1909054 - DNA, 18 bp, Homo sapiens
aattttgtgtaagaaata

SEQ ID NO: 1909055 - DNA, 14 bp, Homo sapiens
aatttttatgtgtg

SEQ ID NO: 1909056 - DNA, 16 bp, Homo sapiens
aatttttggttgaata

SEQ ID NO: 1909057 - DNA, 18 bp, Homo sapiens
aatttttggttgaataaa

SEQ ID NO: 1909058 - DNA, 21 bp, Homo sapiens
aattttttaagtgaaaatata

SEQ ID NO: 1909059 - DNA, 17 bp, Homo sapiens
aatttttttgtatgaaa

SEQ ID NO: 1909060 - DNA, 13 bp, Homo sapiens
acaaaaaagagaa

SEQ ID NO: 1909061 - DNA, 22 bp, Homo sapiens
acaaagctctgaattcaggtcc

SEQ ID NO: 1909062 - DNA, 12 bp, Homo sapiens
acaaatgaaata

SEQ ID NO: 1909063 - DNA, 18 bp, Homo sapiens
acaaatgactttattatt

SEQ ID NO: 1909064 - DNA, 16 bp, Homo sapiens
acaaatgcatctttga

SEQ ID NO: 1909065 - DNA, 22 bp, Homo sapiens
acaaatggaagagaagagaaag

SEQ ID NO: 1909066 - DNA, 19 bp, Homo sapiens
acaaatgggttaatcctga

SEQ ID NO: 1909067 - DNA, 17 bp, Homo sapiens
acaactgaaagaaaaag

SEQ ID NO: 1909068 - DNA, 19 bp, Homo sapiens
acaactgaaagaaaaagta

SEQ ID NO: 1909069 - DNA, 20 bp, Homo sapiens
acaacttatgactaaaaata

SEQ ID NO: 1909070 - DNA, 10 bp, Homo sapiens
acaagaaaat

SEQ ID NO: 1909071 - DNA, 14 bp, Homo sapiens
acaagagactgctt

SEQ ID NO: 1909072 - DNA, 19 bp, Homo sapiens
acaaggaagaaattaactt

SEQ ID NO: 1909073 - DNA, 18 bp, Homo sapiens
acaagtagttctgtattt

SEQ ID NO: 1909074 - DNA, 20 bp, Homo sapiens
acaagtagttctgtatttga

SEQ ID NO: 1909075 - DNA, 20 bp, Homo sapiens
acaagttgagctatgactta

SEQ ID NO: 1909076 - DNA, 22 bp, Homo sapiens
acaataataagtccatctgtca

SEQ ID NO: 1909077 - DNA, 20 bp, Homo sapiens
acaatctcgtaggtgtcctg

SEQ ID NO: 1909078 - DNA, 21 bp, Homo sapiens
acaatgtgtctatttctgaaa

SEQ ID NO: 1909079 - DNA, 15 bp, Homo sapiens
acaatgtgtgttgct

SEQ ID NO: 1909080 - DNA, 22 bp, Homo sapiens
acaatgtgtgttgctgtcagaa

SEQ ID NO: 1909081 - DNA, 21 bp, Homo sapiens
acacaacgtaatcaaatatgt

SEQ ID NO: 1909082 - DNA, 23 bp, Homo sapiens
acacatttgttgccagatttcag

SEQ ID NO: 1909083 - DNA, 23 bp, Homo sapiens
acaccaatcttactttgtaaatt

SEQ ID NO: 1909084 - DNA, 15 bp, Homo sapiens
acaccacaagtatct

SEQ ID NO: 1909085 - DNA, 14 bp, Homo sapiens
acaccacagcctcc

SEQ ID NO: 1909086 - DNA, 18 bp, Homo sapiens
acacctaccaaaaaataa

SEQ ID NO: 1909087 - DNA, 18 bp, Homo sapiens
acacctcatgctagcctc

SEQ ID NO: 1909088 - DNA, 12 bp, Homo sapiens
acaccttctata

SEQ ID NO: 1909089 - DNA, 12 bp, Homo sapiens
acacgtcattgt

SEQ ID NO: 1909090 - DNA, 13 bp, Homo sapiens
acacgtcattgtg

SEQ ID NO: 1909091 - DNA, 15 bp, Homo sapiens
acactgcctgcctta

SEQ ID NO: 1909092 - DNA, 19 bp, Homo sapiens
acactgtggcagcaggagg

SEQ ID NO: 1909093 - DNA, 23 bp, Homo sapiens
acagaaggggactgccacctccc

SEQ ID NO: 1909094 - DNA, 19 bp, Homo sapiens
acagacaccacagcctccc

SEQ ID NO: 1909095 - DNA, 20 bp, Homo sapiens
acagactggatgtaccacca

SEQ ID NO: 1909096 - DNA, 12 bp, Homo sapiens
acagacttgtat

SEQ ID NO: 1909097 - DNA, 16 bp, Homo sapiens
acagactttagctttc

SEQ ID NO: 1909098 - DNA, 17 bp, Homo sapiens
acagactttagctttct

SEQ ID NO: 1909099 - DNA, 19 bp, Homo sapiens
acagagagagatactctgg

SEQ ID NO: 1909100 - DNA, 20 bp, Homo sapiens
acagagagagatactctggg

SEQ ID NO: 1909101 - DNA, 16 bp, Homo sapiens
acagagcaacccctgg

SEQ ID NO: 1909102 - DNA, 16 bp, Homo sapiens
acagagctaaggccaa

SEQ ID NO: 1909103 - DNA, 16 bp, Homo sapiens
acagaggacacagaga

SEQ ID NO: 1909104 - DNA, 22 bp, Homo sapiens
acagagtgccaacttctttcat

SEQ ID NO: 1909105 - DNA, 20 bp, Homo sapiens
acagatgccatatagtgtta

SEQ ID NO: 1909106 - DNA, 21 bp, Homo sapiens
acagatttgcttttctttgct

SEQ ID NO: 1909107 - DNA, 21 bp, Homo sapiens
acagcaacgatcacaaatgac

SEQ ID NO: 1909108 - DNA, 13 bp, Homo sapiens
acagcaaggctgt

SEQ ID NO: 1909109 - DNA, 16 bp, Homo sapiens
acagcaagtgtgaata

SEQ ID NO: 1909110 - DNA, 21 bp, Homo sapiens
acagcaggataaacattccag

SEQ ID NO: 1909111 - DNA, 22 bp, Homo sapiens
acagcaggataaacattccaga

SEQ ID NO: 1909112 - DNA, 12 bp, Homo sapiens
acagcagggcct

SEQ ID NO: 1909113 - DNA, 23 bp, Homo sapiens
acagcccgatcctcccctggact

SEQ ID NO: 1909114 - DNA, 18 bp, Homo sapiens
acagcctccccttcccag

SEQ ID NO: 1909115 - DNA, 18 bp, Homo sapiens
acagcctgcctctgccac

SEQ ID NO: 1909116 - DNA, 21 bp, Homo sapiens
acagcctgcctctgccacagc

SEQ ID NO: 1909117 - DNA, 14 bp, Homo sapiens
acagctatgcaaaa

SEQ ID NO: 1909118 - DNA, 14 bp, Homo sapiens
acagctctttaaca

SEQ ID NO: 1909119 - DNA, 14 bp, Homo sapiens
acagctgttgactc

SEQ ID NO: 1909120 - DNA, 11 bp, Homo sapiens
catccctctcc

SEQ ID NO: 1909121 - DNA, 20 bp, Homo sapiens
catcctcatggcccatcagg

SEQ ID NO: 1909122 - DNA, 16 bp, Homo sapiens
catcctgtcatctgag

SEQ ID NO: 1909123 - DNA, 18 bp, Homo sapiens
catctaggggagccttga

SEQ ID NO: 1909124 - DNA, 19 bp, Homo sapiens
catctaggggagccttgat

SEQ ID NO: 1909125 - DNA, 12 bp, Homo sapiens
catctctgaaaa

SEQ ID NO: 1909126 - DNA, 13 bp, Homo sapiens
catctctgaaaac

SEQ ID NO: 1909127 - DNA, 21 bp, Homo sapiens
catctctgaaaacaagagact

SEQ ID NO: 1909128 - DNA, 13 bp, Homo sapiens
catctcttccttt

SEQ ID NO: 1909129 - DNA, 14 bp, Homo sapiens
catctgagaatgaa

SEQ ID NO: 1909130 - DNA, 16 bp, Homo sapiens
catctgggtagctgta

SEQ ID NO: 1909131 - DNA, 14 bp, Homo sapiens
catctggttttctc

SEQ ID NO: 1909132 - DNA, 15 bp, Homo sapiens
catctggttttctct

SEQ ID NO: 1909133 - DNA, 15 bp, Homo sapiens
catctttgatgtgtt

SEQ ID NO: 1909134 - DNA, 15 bp, Homo sapiens
catgaaaatagcaat

SEQ ID NO: 1909135 - DNA, 18 bp, Homo sapiens
catgaggaggcagagagg

SEQ ID NO: 1909136 - DNA, 19 bp, Homo sapiens
catgaggaggcagagaggg

SEQ ID NO: 1909137 - DNA, 13 bp, Homo sapiens
catgaggccccga

SEQ ID NO: 1909138 - DNA, 21 bp, Homo sapiens
catgaggccccgaggctcgag

SEQ ID NO: 1909139 - DNA, 13 bp, Homo sapiens
catgatacgctta

SEQ ID NO: 1909140 - DNA, 22 bp, Homo sapiens
catgcctactaaatgtacagat

SEQ ID NO: 1909141 - DNA, 16 bp, Homo sapiens
catgcctcctcctgcc

SEQ ID NO: 1909142 - DNA, 17 bp, Homo sapiens
catgcctcctcctgccc

SEQ ID NO: 1909143 - DNA, 21 bp, Homo sapiens
catgcctcctcctgccctccg

SEQ ID NO: 1909144 - DNA, 18 bp, Homo sapiens
catgcgatgttagtttta

SEQ ID NO: 1909145 - DNA, 22 bp, Homo sapiens
catgctagcctcacgaaactgg

SEQ ID NO: 1909146 - DNA, 17 bp, Homo sapiens
catgctgtctggcacag

SEQ ID NO: 1909147 - DNA, 19 bp, Homo sapiens
catgctgtctggcacagcc

SEQ ID NO: 1909148 - DNA, 17 bp, Homo sapiens
catgctttgtgaacaag

SEQ ID NO: 1909149 - DNA, 13 bp, Homo sapiens
catggaccatgct

SEQ ID NO: 1909150 - DNA, 21 bp, Homo sapiens
catggccacatcctcatggcc

SEQ ID NO: 1909151 - DNA, 16 bp, Homo sapiens
catggcccatcagggg

SEQ ID NO: 1909152 - DNA, 15 bp, Homo sapiens
catggccctgagcca

SEQ ID NO: 1909153 - DNA, 14 bp, Homo sapiens
catggctcttagaa

SEQ ID NO: 1909154 - DNA, 14 bp, Homo sapiens
catgggccaccacg

SEQ ID NO: 1909155 - DNA, 23 bp, Homo sapiens
catggggtctctcacagacagga

SEQ ID NO: 1909156 - DNA, 15 bp, Homo sapiens
catgggtcagggtgt

SEQ ID NO: 1909157 - DNA, 22 bp, Homo sapiens
catgggtcagggtgtgaggcca

SEQ ID NO: 1909158 - DNA, 18 bp, Homo sapiens
catgtaatttgtgtaaat

SEQ ID NO: 1909159 - DNA, 14 bp, Homo sapiens
catgtatggccagg

SEQ ID NO: 1909160 - DNA, 15 bp, Homo sapiens
catgtgcccactgtc

SEQ ID NO: 1909161 - DNA, 13 bp, Homo sapiens
cattaactgcttc

SEQ ID NO: 1909162 - DNA, 15 bp, Homo sapiens
cattaactgcttcct

SEQ ID NO: 1909163 - DNA, 15 bp, Homo sapiens
cattacctctttgga

SEQ ID NO: 1909164 - DNA, 15 bp, Homo sapiens
cattaggccccagca

SEQ ID NO: 1909165 - DNA, 20 bp, Homo sapiens
cattaggccccagcaacacg

SEQ ID NO: 1909166 - DNA, 16 bp, Homo sapiens
cattcacatatctgct

SEQ ID NO: 1909167 - DNA, 17 bp, Homo sapiens
cattcatacacaacgta

SEQ ID NO: 1909168 - DNA, 22 bp, Homo sapiens
cattcgctactatgatttaatt

SEQ ID NO: 1909169 - DNA, 20 bp, Homo sapiens
cattctctaatatccacttg

SEQ ID NO: 1909170 - DNA, 22 bp, Homo sapiens
cattctctccatttcactggct

SEQ ID NO: 1909171 - DNA, 20 bp, Homo sapiens
cattgatacaatcatagcat

SEQ ID NO: 1909172 - DNA, 16 bp, Homo sapiens
cattgcaaacaactga

SEQ ID NO: 1909173 - DNA, 13 bp, Homo sapiens
cattgcagaccct

SEQ ID NO: 1909174 - DNA, 16 bp, Homo sapiens
cattgcatataactta

SEQ ID NO: 1909175 - DNA, 22 bp, Homo sapiens
cattgtaaaagcattttgtaat

SEQ ID NO: 1909176 - DNA, 11 bp, Homo sapiens
cattgtgaatg

SEQ ID NO: 1909177 - DNA, 19 bp, Homo sapiens
cattgtgaatgctgtggga

SEQ ID NO: 1909178 - DNA, 21 bp, Homo sapiens
catttaaaacattaaaatata

SEQ ID NO: 1909179 - DNA, 19 bp, Homo sapiens
catttaaagacaaagacat

SEQ ID NO: 1909180 - DNA, 15 bp, Homo sapiens
catttacgcctgtaa

SEQ ID NO: 1909181 - DNA, 20 bp, Homo sapiens
catttaggcaaataagcact

SEQ ID NO: 1909182 - DNA, 20 bp, Homo sapiens
catttagggagtattctaat

SEQ ID NO: 1909183 - DNA, 21 bp, Homo sapiens
catttagtaaatgctgaaata

SEQ ID NO: 1909184 - DNA, 18 bp, Homo sapiens
catttatccaggaattga

SEQ ID NO: 1909185 - DNA, 16 bp, Homo sapiens
catttccccagggcac

SEQ ID NO: 1909186 - DNA, 15 bp, Homo sapiens
catttgctttggaag

SEQ ID NO: 1909187 - DNA, 12 bp, Homo sapiens
catttggcttcc

SEQ ID NO: 1909188 - DNA, 13 bp, Homo sapiens
catttggcttcct

SEQ ID NO: 1909189 - DNA, 14 bp, Homo sapiens
catttggcttcctc

SEQ ID NO: 1909190 - DNA, 15 bp, Homo sapiens
catttggcttcctct

SEQ ID NO: 1909191 - DNA, 20 bp, Homo sapiens
catttggcttcctctgctgc

SEQ ID NO: 1909192 - DNA, 20 bp, Homo sapiens
catttggggaccacagaggc

SEQ ID NO: 1909193 - DNA, 23 bp, Homo sapiens
catttgtaatctagttgtcaata

SEQ ID NO: 1909194 - DNA, 22 bp, Homo sapiens
catttgtttctttctctgagga

SEQ ID NO: 1909195 - DNA, 23 bp, Homo sapiens
catttgtttctttctctgaggac

SEQ ID NO: 1909196 - DNA, 12 bp, Homo sapiens
cattttctttcc

SEQ ID NO: 1909197 - DNA, 21 bp, Homo sapiens
cattttgacaactgaaagaaa

SEQ ID NO: 1909198 - DNA, 12 bp, Homo sapiens
cattttgtaata

SEQ ID NO: 1909199 - DNA, 16 bp, Homo sapiens
cattttgtaataataa

SEQ ID NO: 1909200 - DNA, 14 bp, Homo sapiens
ccaaaattaaggtg

SEQ ID NO: 1909201 - DNA, 17 bp, Homo sapiens
ccaaagagacagggccc

SEQ ID NO: 1909202 - DNA, 14 bp, Homo sapiens
ccaaagtattgtac

SEQ ID NO: 1909203 - DNA, 23 bp, Homo sapiens
ccaaataatatgtttccttccct

SEQ ID NO: 1909204 - DNA, 15 bp, Homo sapiens
ccaaccccagacccc

SEQ ID NO: 1909205 - DNA, 21 bp, Homo sapiens
ccaagacttattttcacatgt

SEQ ID NO: 1909206 - DNA, 18 bp, Homo sapiens
ccaagagtggccccacct

SEQ ID NO: 1909207 - DNA, 19 bp, Homo sapiens
ccaagagtggccccacctg

SEQ ID NO: 1909208 - DNA, 13 bp, Homo sapiens
ccaagcaggcact

SEQ ID NO: 1909209 - DNA, 13 bp, Homo sapiens
ccaagcctggcag

SEQ ID NO: 1909210 - DNA, 15 bp, Homo sapiens
ccaagcctggcaggg

SEQ ID NO: 1909211 - DNA, 18 bp, Homo sapiens
ccaagcctggcaggggat

SEQ ID NO: 1909212 - DNA, 16 bp, Homo sapiens
ccaagcgccctggccc

SEQ ID NO: 1909213 - DNA, 18 bp, Homo sapiens
ccaagggggacctcgggc

SEQ ID NO: 1909214 - DNA, 20 bp, Homo sapiens
ccaagggggacctcgggctg

SEQ ID NO: 1909215 - DNA, 15 bp, Homo sapiens
ccaagtctgacagcc

SEQ ID NO: 1909216 - DNA, 20 bp, Homo sapiens
ccaagtggatattttcttaa

SEQ ID NO: 1909217 - DNA, 23 bp, Homo sapiens
ccaagtggatattttcttaaaac

SEQ ID NO: 1909218 - DNA, 16 bp, Homo sapiens
ccaatcttactttgta

SEQ ID NO: 1909219 - DNA, 21 bp, Homo sapiens
ccaatcttactttgtaaattc

SEQ ID NO: 1909220 - DNA, 23 bp, Homo sapiens
ccaatgaaatacacaagtaaaca

SEQ ID NO: 1909221 - DNA, 19 bp, Homo sapiens
ccacaagtatctaaatttg

SEQ ID NO: 1909222 - DNA, 13 bp, Homo sapiens
ccacagaggctgt

SEQ ID NO: 1909223 - DNA, 15 bp, Homo sapiens
ccacagaggctgtgg

SEQ ID NO: 1909224 - DNA, 12 bp, Homo sapiens
ccacagcctccc

SEQ ID NO: 1909225 - DNA, 13 bp, Homo sapiens
ccacagcctcccc

SEQ ID NO: 1909226 - DNA, 19 bp, Homo sapiens
ccacagcctccccttccca

SEQ ID NO: 1909227 - DNA, 20 bp, Homo sapiens
ccacagcctccccttcccag

SEQ ID NO: 1909228 - DNA, 19 bp, Homo sapiens
ccacatgggtactgtctcg

SEQ ID NO: 1909229 - DNA, 23 bp, Homo sapiens
ccacatgggtactgtctcggcag

SEQ ID NO: 1909230 - DNA, 19 bp, Homo sapiens
ccaccactgactataccaa

SEQ ID NO: 1909231 - DNA, 17 bp, Homo sapiens
ccaccagcgcccccact

SEQ ID NO: 1909232 - DNA, 22 bp, Homo sapiens
ccacccagacctgcctgtctcc

SEQ ID NO: 1909233 - DNA, 12 bp, Homo sapiens
ccaccctacccc

SEQ ID NO: 1909234 - DNA, 17 bp, Homo sapiens
ccaccctgcttggccca

SEQ ID NO: 1909235 - DNA, 15 bp, Homo sapiens
ccaccctgtcccagg

SEQ ID NO: 1909236 - DNA, 12 bp, Homo sapiens
ccaccctttctg

SEQ ID NO: 1909237 - DNA, 18 bp, Homo sapiens
ccaccgtccctctgcaga

SEQ ID NO: 1909238 - DNA, 11 bp, Homo sapiens
ccacctctgtg

SEQ ID NO: 1909239 - DNA, 19 bp, Homo sapiens
ccacctctgtgcagggcac

SEQ ID NO: 1909240 - DNA, 13 bp, Homo sapiens
ccacctcttcctg

SEQ ID NO: 1909241 - DNA, 14 bp, Homo sapiens
ccacctgagttcct

SEQ ID NO: 1909242 - DNA, 15 bp, Homo sapiens
ccacctgagttcctg

SEQ ID NO: 1909243 - DNA, 17 bp, Homo sapiens
ccaccttcttgggactg

SEQ ID NO: 1909244 - DNA, 20 bp, Homo sapiens
ccactcccatggctctgggc

SEQ ID NO: 1909245 - DNA, 21 bp, Homo sapiens
ccactcccatggctctgggcg

SEQ ID NO: 1909246 - DNA, 16 bp, Homo sapiens
ccactcctcctccttt

SEQ ID NO: 1909247 - DNA, 16 bp, Homo sapiens
ccactctcagaggccc

SEQ ID NO: 1909248 - DNA, 17 bp, Homo sapiens
ccactctcagaggcccc

SEQ ID NO: 1909249 - DNA, 19 bp, Homo sapiens
ccactgggatagaggaatc

SEQ ID NO: 1909250 - DNA, 21 bp, Homo sapiens
ccactgtccgctgtctccctc

SEQ ID NO: 1909251 - DNA, 17 bp, Homo sapiens
ccactgtctcttccact

SEQ ID NO: 1909252 - DNA, 20 bp, Homo sapiens
ccactgtgcagtggagcaga

SEQ ID NO: 1909253 - DNA, 14 bp, Homo sapiens
ccacttctgccaga

SEQ ID NO: 1909254 - DNA, 19 bp, Homo sapiens
ccacttctgccagatgtcc

SEQ ID NO: 1909255 - DNA, 17 bp, Homo sapiens
ccacttgtagatttgat

SEQ ID NO: 1909256 - DNA, 23 bp, Homo sapiens
ccagaagacctcccttcaggtgc

SEQ ID NO: 1909257 - DNA, 17 bp, Homo sapiens
ccagaaggagcaggccc

SEQ ID NO: 1909258 - DNA, 18 bp, Homo sapiens
ccagaaggagcaggccct

SEQ ID NO: 1909259 - DNA, 22 bp, Homo sapiens
ccagaaggagcaggccctgggc

SEQ ID NO: 1909260 - DNA, 11 bp, Homo sapiens
ccagaatgaag

SEQ ID NO: 1909261 - DNA, 22 bp, Homo sapiens
ccagacaatctcgtaggtgtcc

SEQ ID NO: 1909262 - DNA, 18 bp, Homo sapiens
ccagacctgcctgtctcc

SEQ ID NO: 1909263 - DNA, 19 bp, Homo sapiens
ccagacgctcattcagcat

SEQ ID NO: 1909264 - DNA, 17 bp, Homo sapiens
ccagagagaagagcccc

SEQ ID NO: 1909265 - DNA, 19 bp, Homo sapiens
ccagagagaagagccccac

SEQ ID NO: 1909266 - DNA, 14 bp, Homo sapiens
ccagagtagccatg

SEQ ID NO: 1909267 - DNA, 13 bp, Homo sapiens
ccagcagccagcc

SEQ ID NO: 1909268 - DNA, 15 bp, Homo sapiens
ccagcagccagccaa

SEQ ID NO: 1909269 - DNA, 19 bp, Homo sapiens
ccagcagcctctgatctgt

SEQ ID NO: 1909270 - DNA, 20 bp, Homo sapiens
ccagcagcctctgatctgtg

SEQ ID NO: 1909271 - DNA, 15 bp, Homo sapiens
ccagcagccttccag

SEQ ID NO: 1909272 - DNA, 13 bp, Homo sapiens
ccagcaggaggga

SEQ ID NO: 1909273 - DNA, 16 bp, Homo sapiens
ccagcaggagggacag

SEQ ID NO: 1909274 - DNA, 20 bp, Homo sapiens
ccagcaggagggacagtctc

SEQ ID NO: 1909275 - DNA, 15 bp, Homo sapiens
ccagcaggctcctca

SEQ ID NO: 1909276 - DNA, 21 bp, Homo sapiens
ccagcaggctcctcagccctc

SEQ ID NO: 1909277 - DNA, 11 bp, Homo sapiens
ccagcccagca

SEQ ID NO: 1909278 - DNA, 13 bp, Homo sapiens
ccagcccagcaga

SEQ ID NO: 1909279 - DNA, 12 bp, Homo sapiens
ccagccctccag

SEQ ID NO: 1909280 - DNA, 19 bp, Homo sapiens
ccagcctcaaatccaggac

SEQ ID NO: 1909281 - DNA, 18 bp, Homo sapiens
ccagcgcccccactcctc

SEQ ID NO: 1909282 - DNA, 21 bp, Homo sapiens
ccagcgcccccactcctcctc

SEQ ID NO: 1909283 - DNA, 21 bp, Homo sapiens
ccagcgcggacatcccctgct

SEQ ID NO: 1909284 - DNA, 15 bp, Homo sapiens
ccagcggccctccca

SEQ ID NO: 1909285 - DNA, 15 bp, Homo sapiens
ccagctccaccccgc

SEQ ID NO: 1909286 - DNA, 17 bp, Homo sapiens
ccagctgctgagccgca

SEQ ID NO: 1909287 - DNA, 23 bp, Homo sapiens
ccagctgctgagccgcagagaag

SEQ ID NO: 1909288 - DNA, 17 bp, Homo sapiens
ccagctgtgctgggagg

SEQ ID NO: 1909289 - DNA, 14 bp, Homo sapiens
ccagcttggctcag

SEQ ID NO: 1909290 - DNA, 18 bp, Homo sapiens
ccaggaagtagcacaggc

SEQ ID NO: 1909291 - DNA, 14 bp, Homo sapiens
ccaggaccctgcca

SEQ ID NO: 1909292 - DNA, 15 bp, Homo sapiens
ccaggaccctgccag

SEQ ID NO: 1909293 - DNA, 18 bp, Homo sapiens
ccaggaccctgccaggca

SEQ ID NO: 1909294 - DNA, 22 bp, Homo sapiens
ccaggaccctgccaggcacagg

SEQ ID NO: 1909295 - DNA, 16 bp, Homo sapiens
ccaggagcctgcccag

SEQ ID NO: 1909296 - DNA, 23 bp, Homo sapiens
ccaggatatattttatttttaga

SEQ ID NO: 1909297 - DNA, 12 bp, Homo sapiens
ccaggcacaggc

SEQ ID NO: 1909298 - DNA, 16 bp, Homo sapiens
ccaggcccggcatgag

SEQ ID NO: 1909299 - DNA, 21 bp, Homo sapiens
ccaggcccggcatgaggcccc

SEQ ID NO: 1909300 - DNA, 12 bp, Homo sapiens
ccagggaggagc

SEQ ID NO: 1909301 - DNA, 17 bp, Homo sapiens
ccagggatggcagtggc

SEQ ID NO: 1909302 - DNA, 15 bp, Homo sapiens
ccaggttccacagag

SEQ ID NO: 1909303 - DNA, 21 bp, Homo sapiens
ccagtaagatcactgtttaga

SEQ ID NO: 1909304 - DNA, 23 bp, Homo sapiens
ccagtagctgggaccacaggtgc

SEQ ID NO: 1909305 - DNA, 15 bp, Homo sapiens
ccagtcccagcagcc

SEQ ID NO: 1909306 - DNA, 23 bp, Homo sapiens
ccagtgaggcatctctctgggat

SEQ ID NO: 1909307 - DNA, 16 bp, Homo sapiens
ccagtggcagggcaca

SEQ ID NO: 1909308 - DNA, 19 bp, Homo sapiens
ccagtggcagggcacaggg

SEQ ID NO: 1909309 - DNA, 21 bp, Homo sapiens
ccagtgtgtaaattgtattct

SEQ ID NO: 1909310 - DNA, 14 bp, Homo sapiens
ccagttgctgtcac

SEQ ID NO: 1909311 - DNA, 18 bp, Homo sapiens
ccagttgctgtcacaaag

SEQ ID NO: 1909312 - DNA, 21 bp, Homo sapiens
ccagttgttagattaagaaat

SEQ ID NO: 1909313 - DNA, 14 bp, Homo sapiens
ccatagctcaataa

SEQ ID NO: 1909314 - DNA, 13 bp, Homo sapiens
ccatatagaaagc

SEQ ID NO: 1909315 - DNA, 15 bp, Homo sapiens
ccatcaggggcagga

SEQ ID NO: 1909316 - DNA, 16 bp, Homo sapiens
ccatccacatgggtac

SEQ ID NO: 1909317 - DNA, 23 bp, Homo sapiens
ccatcccggcagcgaggctgggc

SEQ ID NO: 1909318 - DNA, 17 bp, Homo sapiens
ccatcccgtttccctcc

SEQ ID NO: 1909319 - DNA, 17 bp, Homo sapiens
ccatccctctcctctgc

SEQ ID NO: 1909320 - DNA, 12 bp, Homo sapiens
ccatctcttcct

SEQ ID NO: 1909321 - DNA, 14 bp, Homo sapiens
ccatctcttccttt

SEQ ID NO: 1909322 - DNA, 16 bp, Homo sapiens
ccatctggttttctct

SEQ ID NO: 1909323 - DNA, 14 bp, Homo sapiens
ccatctgtgaataa

SEQ ID NO: 1909324 - DNA, 22 bp, Homo sapiens
ccatgagaatgttttagcacag

SEQ ID NO: 1909325 - DNA, 21 bp, Homo sapiens
ccatgagctgcactgatcacc

SEQ ID NO: 1909326 - DNA, 20 bp, Homo sapiens
ccatggccacatcctcatgg

SEQ ID NO: 1909327 - DNA, 22 bp, Homo sapiens
ccatggccacatcctcatggcc

SEQ ID NO: 1909328 - DNA, 12 bp, Homo sapiens
ccatgggcagga

SEQ ID NO: 1909329 - DNA, 22 bp, Homo sapiens
ccatgtacccattgcagaccct

SEQ ID NO: 1909330 - DNA, 14 bp, Homo sapiens
ccatgtatggccag

SEQ ID NO: 1909331 - DNA, 18 bp, Homo sapiens
ccatgtatggccaggaag

SEQ ID NO: 1909332 - DNA, 20 bp, Homo sapiens
ccatgttggccaggctgctc

SEQ ID NO: 1909333 - DNA, 15 bp, Homo sapiens
ccattcatacacaac

SEQ ID NO: 1909334 - DNA, 18 bp, Homo sapiens
ccattcatacacaacgta

SEQ ID NO: 1909335 - DNA, 22 bp, Homo sapiens
ccattgagaccgtgaagatact

SEQ ID NO: 1909336 - DNA, 16 bp, Homo sapiens
ccatttactgcattct

SEQ ID NO: 1909337 - DNA, 16 bp, Homo sapiens
ccattttttatatttc

SEQ ID NO: 1909338 - DNA, 22 bp, Homo sapiens
cccaaacaaatggaagagaaga

SEQ ID NO: 1909339 - DNA, 13 bp, Homo sapiens
cccaacacaaaga

SEQ ID NO: 1909340 - DNA, 13 bp, Homo sapiens
cccaacacgggta

SEQ ID NO: 1909341 - DNA, 13 bp, Homo sapiens
cccaagcctggca

SEQ ID NO: 1909342 - DNA, 16 bp, Homo sapiens
cccaagcctggcaggg

SEQ ID NO: 1909343 - DNA, 15 bp, Homo sapiens
cccaagtctgacagc

SEQ ID NO: 1909344 - DNA, 16 bp, Homo sapiens
cccaagtctgacagcc

SEQ ID NO: 1909345 - DNA, 19 bp, Homo sapiens
cccacatggtgatgttgac

SEQ ID NO: 1909346 - DNA, 20 bp, Homo sapiens
cccaccctgcttggcccagg

SEQ ID NO: 1909347 - DNA, 17 bp, Homo sapiens
cccaccctttctgccag

SEQ ID NO: 1909348 - DNA, 23 bp, Homo sapiens
cccaccctttctgccagggatgg

SEQ ID NO: 1909349 - DNA, 18 bp, Homo sapiens
cccacctggccctctctg

SEQ ID NO: 1909350 - DNA, 15 bp, Homo sapiens
cccaccttcttggga

SEQ ID NO: 1909351 - DNA, 14 bp, Homo sapiens
cccactcccatggc

SEQ ID NO: 1909352 - DNA, 20 bp, Homo sapiens
cccactcctcctcctttctt

SEQ ID NO: 1909353 - DNA, 15 bp, Homo sapiens
cccactctcagaggc

SEQ ID NO: 1909354 - DNA, 14 bp, Homo sapiens
cccagaatactgat

SEQ ID NO: 1909355 - DNA, 17 bp, Homo sapiens
cccagagagaagagccc

SEQ ID NO: 1909356 - DNA, 18 bp, Homo sapiens
cccagagagaagagcccc

SEQ ID NO: 1909357 - DNA, 21 bp, Homo sapiens
cccagagagaagagccccact

SEQ ID NO: 1909358 - DNA, 14 bp, Homo sapiens
cccagcagccagcc

SEQ ID NO: 1909359 - DNA, 19 bp, Homo sapiens
cccagcctaggcttggctc

SEQ ID NO: 1909360 - DNA, 23 bp, Homo sapiens
cccagcctcaaatccaggaccct

SEQ ID NO: 1909361 - DNA, 16 bp, Homo sapiens
cccagcttccagcagg

SEQ ID NO: 1909362 - DNA, 19 bp, Homo sapiens
cccagcttccagcaggagg

SEQ ID NO: 1909363 - DNA, 22 bp, Homo sapiens
cccaggagcccatttggagggc

SEQ ID NO: 1909364 - DNA, 20 bp, Homo sapiens
cccaggcagcgccactgtcc

SEQ ID NO: 1909365 - DNA, 19 bp, Homo sapiens
cccaggctggagtgcagtg

SEQ ID NO: 1909366 - DNA, 22 bp, Homo sapiens
cccagggggcttcctgagggga

SEQ ID NO: 1909367 - DNA, 16 bp, Homo sapiens
ccttttctttcctttt

SEQ ID NO: 1909368 - DNA, 18 bp, Homo sapiens
cctttttatttatatgta

SEQ ID NO: 1909369 - DNA, 22 bp, Homo sapiens
cctttttatttatatgtatgtg

SEQ ID NO: 1909370 - DNA, 13 bp, Homo sapiens
cctttttctttcc

SEQ ID NO: 1909371 - DNA, 19 bp, Homo sapiens
cgaaagaggcacccttcca

SEQ ID NO: 1909372 - DNA, 20 bp, Homo sapiens
cgaaagaggcacccttccat

SEQ ID NO: 1909373 - DNA, 16 bp, Homo sapiens
cgaagttcaagatcaa

SEQ ID NO: 1909374 - DNA, 18 bp, Homo sapiens
cgacacggtctcggatca

SEQ ID NO: 1909375 - DNA, 17 bp, Homo sapiens
cgagcagggcaggcccc

SEQ ID NO: 1909376 - DNA, 23 bp, Homo sapiens
cgaggctcgagctcggggctggg

SEQ ID NO: 1909377 - DNA, 14 bp, Homo sapiens
cgatcacaaatgac

SEQ ID NO: 1909378 - DNA, 18 bp, Homo sapiens
cgatcacaaatgacttta

SEQ ID NO: 1909379 - DNA, 11 bp, Homo sapiens
cgcactgggag

SEQ ID NO: 1909380 - DNA, 13 bp, Homo sapiens
cgcactgggagca

SEQ ID NO: 1909381 - DNA, 21 bp, Homo sapiens
cgcagagaagtgacggttcct

SEQ ID NO: 1909382 - DNA, 13 bp, Homo sapiens
cgcagcacgcctc

SEQ ID NO: 1909383 - DNA, 16 bp, Homo sapiens
cgcagcacgcctctcc

SEQ ID NO: 1909384 - DNA, 19 bp, Homo sapiens
cgcagcacgcctctcccca

SEQ ID NO: 1909385 - DNA, 19 bp, Homo sapiens
cgcagtcgtcagcctccct

SEQ ID NO: 1909386 - DNA, 20 bp, Homo sapiens
cgcagtcgtcagcctccctg

SEQ ID NO: 1909387 - DNA, 22 bp, Homo sapiens
cgcagtcgtcagcctccctgac

SEQ ID NO: 1909388 - DNA, 17 bp, Homo sapiens
cgcccagtcccagcagc

SEQ ID NO: 1909389 - DNA, 21 bp, Homo sapiens
cgcccagtcccagcagccagc

SEQ ID NO: 1909390 - DNA, 14 bp, Homo sapiens
cgcccctgagccca

SEQ ID NO: 1909391 - DNA, 15 bp, Homo sapiens
cgccctggcccccac

SEQ ID NO: 1909392 - DNA, 20 bp, Homo sapiens
cgccggcaataaaagcccag

SEQ ID NO: 1909393 - DNA, 17 bp, Homo sapiens
cgcctctccccaccttc

SEQ ID NO: 1909394 - DNA, 23 bp, Homo sapiens
cgcctggtgatgcgcagttgctg

SEQ ID NO: 1909395 - DNA, 14 bp, Homo sapiens
cgcctgtaaatgta

SEQ ID NO: 1909396 - DNA, 16 bp, Homo sapiens
cgctcattcagcatct

SEQ ID NO: 1909397 - DNA, 16 bp, Homo sapiens
cgctgactacagggcc

SEQ ID NO: 1909398 - DNA, 15 bp, Homo sapiens
cgctgtctccctcct

SEQ ID NO: 1909399 - DNA, 22 bp, Homo sapiens
cgcttccctggttcaagcgatt

SEQ ID NO: 1909400 - DNA, 15 bp, Homo sapiens
cggaaagagagctgg

SEQ ID NO: 1909401 - DNA, 21 bp, Homo sapiens
cggatcctgcactgactctgg

SEQ ID NO: 1909402 - DNA, 22 bp, Homo sapiens
cggatcctgcactgactctgga

SEQ ID NO: 1909403 - DNA, 16 bp, Homo sapiens
cggcaataaaagccca

SEQ ID NO: 1909404 - DNA, 18 bp, Homo sapiens
cggcaataaaagcccagg

SEQ ID NO: 1909405 - DNA, 12 bp, Homo sapiens
cggcagaggtgg

SEQ ID NO: 1909406 - DNA, 15 bp, Homo sapiens
cggcagaggtggtct

SEQ ID NO: 1909407 - DNA, 18 bp, Homo sapiens
cggcagcgaggctgggct

SEQ ID NO: 1909408 - DNA, 13 bp, Homo sapiens
cggcatttgtttc

SEQ ID NO: 1909409 - DNA, 10 bp, Homo sapiens
cggccctccc

SEQ ID NO: 1909410 - DNA, 22 bp, Homo sapiens
cggccctgatctccgcagaggc

SEQ ID NO: 1909411 - DNA, 16 bp, Homo sapiens
cggccgcactgggagc

SEQ ID NO: 1909412 - DNA, 22 bp, Homo sapiens
cggccgcactgggagcagcgcg

SEQ ID NO: 1909413 - DNA, 21 bp, Homo sapiens
cgggctgttctggtggcccct

SEQ ID NO: 1909414 - DNA, 14 bp, Homo sapiens
cggggcagcagggg

SEQ ID NO: 1909415 - DNA, 15 bp, Homo sapiens
cggggcaggccaggg

SEQ ID NO: 1909416 - DNA, 18 bp, Homo sapiens
cggggctgggggctgcag

SEQ ID NO: 1909417 - DNA, 23 bp, Homo sapiens
cggtcgggggggaccctccaagg

SEQ ID NO: 1909418 - DNA, 20 bp, Homo sapiens
cggtggctcatgcctgtaat

SEQ ID NO: 1909419 - DNA, 13 bp, Homo sapiens
cggtgtgggggcc

SEQ ID NO: 1909420 - DNA, 18 bp, Homo sapiens
cggttcaaacctgtgaag

SEQ ID NO: 1909421 - DNA, 16 bp, Homo sapiens
cggttcctacacagga

SEQ ID NO: 1909422 - DNA, 17 bp, Homo sapiens
cggttcctacacaggac

SEQ ID NO: 1909423 - DNA, 18 bp, Homo sapiens
cgtacaagtagttctgta

SEQ ID NO: 1909424 - DNA, 19 bp, Homo sapiens
cgtacaagtagttctgtat

SEQ ID NO: 1909425 - DNA, 12 bp, Homo sapiens
cgtagcttctag

SEQ ID NO: 1909426 - DNA, 17 bp, Homo sapiens
cgtagcttctagtctgg

SEQ ID NO: 1909427 - DNA, 15 bp, Homo sapiens
cgtatggctttattt

SEQ ID NO: 1909428 - DNA, 17 bp, Homo sapiens
cgtattttgtatttaaa

SEQ ID NO: 1909429 - DNA, 13 bp, Homo sapiens
cgtcagcctccct

SEQ ID NO: 1909430 - DNA, 10 bp, Homo sapiens
cgtcccctcc

SEQ ID NO: 1909431 - DNA, 18 bp, Homo sapiens
cgtgaagatactttgtat

SEQ ID NO: 1909432 - DNA, 21 bp, Homo sapiens
cgtgaagatactttgtattgt

SEQ ID NO: 1909433 - DNA, 22 bp, Homo sapiens
cgtggtgacctcacacacctct

SEQ ID NO: 1909434 - DNA, 23 bp, Homo sapiens
cgttttaaggactgactgaggca

SEQ ID NO: 1909435 - DNA, 18 bp, Homo sapiens
cgttttggaagtgatgta

SEQ ID NO: 1909436 - DNA, 22 bp, Homo sapiens
ctaaaagaagcatctctgacca

SEQ ID NO: 1909437 - DNA, 18 bp, Homo sapiens
ctaaaaggcccagagaga

SEQ ID NO: 1909438 - DNA, 17 bp, Homo sapiens
ctaaaataattttgtaa

SEQ ID NO: 1909439 - DNA, 14 bp, Homo sapiens
ctaaagagtgaatg

SEQ ID NO: 1909440 - DNA, 23 bp, Homo sapiens
ctaacaaacagattcttttatgt

SEQ ID NO: 1909441 - DNA, 23 bp, Homo sapiens
ctaactgttttgtatatgctgca

SEQ ID NO: 1909442 - DNA, 12 bp, Homo sapiens
ctaagactgctt

SEQ ID NO: 1909443 - DNA, 15 bp, Homo sapiens
ctaagactgcttcta

SEQ ID NO: 1909444 - DNA, 11 bp, Homo sapiens
ctaagagacct

SEQ ID NO: 1909445 - DNA, 15 bp, Homo sapiens
ctaaggagttttgtt

SEQ ID NO: 1909446 - DNA, 22 bp, Homo sapiens
ctaaggccaatgggctagaggg

SEQ ID NO: 1909447 - DNA, 14 bp, Homo sapiens
ctaagtacttaaaa

SEQ ID NO: 1909448 - DNA, 22 bp, Homo sapiens
ctaataagaccccactggagtc

SEQ ID NO: 1909449 - DNA, 17 bp, Homo sapiens
ctaataagctagttgaa

SEQ ID NO: 1909450 - DNA, 16 bp, Homo sapiens
ctaatatccacttgtc

SEQ ID NO: 1909451 - DNA, 19 bp, Homo sapiens
ctaatcttgtgaaaataat

SEQ ID NO: 1909452 - DNA, 21 bp, Homo sapiens
ctaatcttgtgaaaataattg

SEQ ID NO: 1909453 - DNA, 15 bp, Homo sapiens
ctacacaggacaggg

SEQ ID NO: 1909454 - DNA, 11 bp, Homo sapiens
ctacagggccg

SEQ ID NO: 1909455 - DNA, 14 bp, Homo sapiens
ctacatttccgcca

SEQ ID NO: 1909456 - DNA, 19 bp, Homo sapiens
ctaccctgatcacctcagg

SEQ ID NO: 1909457 - DNA, 14 bp, Homo sapiens
ctacctaacccaga

SEQ ID NO: 1909458 - DNA, 17 bp, Homo sapiens
ctactacctgtaatgac

SEQ ID NO: 1909459 - DNA, 15 bp, Homo sapiens
ctactctaggactgg

SEQ ID NO: 1909460 - DNA, 17 bp, Homo sapiens
ctactgcatttagggag

SEQ ID NO: 1909461 - DNA, 21 bp, Homo sapiens
ctactgttatgtgagaacatt

SEQ ID NO: 1909462 - DNA, 20 bp, Homo sapiens
ctactttgaaatatttaatt

SEQ ID NO: 1909463 - DNA, 19 bp, Homo sapiens
ctagaacattccatttgct

SEQ ID NO: 1909464 - DNA, 19 bp, Homo sapiens
ctagaagatcacagcaggg

SEQ ID NO: 1909465 - DNA, 15 bp, Homo sapiens
ctagattttgaaaaa

SEQ ID NO: 1909466 - DNA, 22 bp, Homo sapiens
ctagcctcacgctcctttctga

SEQ ID NO: 1909467 - DNA, 18 bp, Homo sapiens
ctagctggagaggagccc

SEQ ID NO: 1909468 - DNA, 22 bp, Homo sapiens
ctagctggagaggagccctgcc

SEQ ID NO: 1909469 - DNA, 21 bp, Homo sapiens
ctaggaaaagagaactttttt

SEQ ID NO: 1909470 - DNA, 21 bp, Homo sapiens
ctagggagccctgggccaggg

SEQ ID NO: 1909471 - DNA, 17 bp, Homo sapiens
ctaggtagagtctgagg

SEQ ID NO: 1909472 - DNA, 18 bp, Homo sapiens
ctagtctggaactgctgc

SEQ ID NO: 1909473 - DNA, 20 bp, Homo sapiens
ctagtctggaactgctgctg

SEQ ID NO: 1909474 - DNA, 23 bp, Homo sapiens
ctagtctggaactgctgctgacc

SEQ ID NO: 1909475 - DNA, 16 bp, Homo sapiens
ctataaaatgtatcaa

SEQ ID NO: 1909476 - DNA, 18 bp, Homo sapiens
ctataattattattcaga

SEQ ID NO: 1909477 - DNA, 20 bp, Homo sapiens
ctataattttgatagtggga

SEQ ID NO: 1909478 - DNA, 16 bp, Homo sapiens
ctataccaactgggcc

SEQ ID NO: 1909479 - DNA, 20 bp, Homo sapiens
ctatagcatcacttaaaaca

SEQ ID NO: 1909480 - DNA, 23 bp, Homo sapiens
ctatcagttttatagctttattt

SEQ ID NO: 1909481 - DNA, 13 bp, Homo sapiens
ctatgaaaggcag

SEQ ID NO: 1909482 - DNA, 15 bp, Homo sapiens
ctatgaacagaccat

SEQ ID NO: 1909483 - DNA, 20 bp, Homo sapiens
ctatgatgttagttttcctt

SEQ ID NO: 1909484 - DNA, 15 bp, Homo sapiens
ctatgtattttgtga

SEQ ID NO: 1909485 - DNA, 16 bp, Homo sapiens
ctattagtgttatatg

SEQ ID NO: 1909486 - DNA, 23 bp, Homo sapiens
ctatttctgaaagaataggatta

SEQ ID NO: 1909487 - DNA, 11 bp, Homo sapiens
ctatttcttga

SEQ ID NO: 1909488 - DNA, 20 bp, Homo sapiens
ctatttttttcctcctttgc

SEQ ID NO: 1909489 - DNA, 13 bp, Homo sapiens
ctcaaatccagga

SEQ ID NO: 1909490 - DNA, 16 bp, Homo sapiens
ctcaaatccaggaccc

SEQ ID NO: 1909491 - DNA, 17 bp, Homo sapiens
ctcaagccgtggccggg

SEQ ID NO: 1909492 - DNA, 13 bp, Homo sapiens
ctcaataaaagaa

SEQ ID NO: 1909493 - DNA, 17 bp, Homo sapiens
ctcaataaaagaatctg

SEQ ID NO: 1909494 - DNA, 19 bp, Homo sapiens
ctcaataaaagaatctgat

SEQ ID NO: 1909495 - DNA, 14 bp, Homo sapiens
ctcaatgctgtttg

SEQ ID NO: 1909496 - DNA, 17 bp, Homo sapiens
ctcaatgctgtttgggt

SEQ ID NO: 1909497 - DNA, 16 bp, Homo sapiens
ctcacacacctctgcc

SEQ ID NO: 1909498 - DNA, 12 bp, Homo sapiens
ctcacagacagg

SEQ ID NO: 1909499 - DNA, 15 bp, Homo sapiens
ctcacagctatgcaa

SEQ ID NO: 1909500 - DNA, 21 bp, Homo sapiens
ctcaccatttccccagggcac

SEQ ID NO: 1909501 - DNA, 16 bp, Homo sapiens
ctcaccttggttcctg

SEQ ID NO: 1909502 - DNA, 16 bp, Homo sapiens
ctcacgaaactggaat

SEQ ID NO: 1909503 - DNA, 19 bp, Homo sapiens
aaggccagcagccttccag

SEQ ID NO: 1909504 - DNA, 23 bp, Homo sapiens
aaggctgtcggggtcaagctgga

SEQ ID NO: 1909505 - DNA, 18 bp, Homo sapiens
aaggctgtctcagataaa

SEQ ID NO: 1909506 - DNA, 16 bp, Homo sapiens
aaggcttataaaacag

SEQ ID NO: 1909507 - DNA, 14 bp, Homo sapiens
aagggcagggacag

SEQ ID NO: 1909508 - DNA, 17 bp, Homo sapiens
aaggggactgccacctc

SEQ ID NO: 1909509 - DNA, 12 bp, Homo sapiens
aaggggttttct

SEQ ID NO: 1909510 - DNA, 18 bp, Homo sapiens
aagggtctatcttgtaaa

SEQ ID NO: 1909511 - DNA, 15 bp, Homo sapiens
aaggtagttcaagaa

SEQ ID NO: 1909512 - DNA, 22 bp, Homo sapiens
aaggtggaaagtgttcattgca

SEQ ID NO: 1909513 - DNA, 13 bp, Homo sapiens
aaggtgtttgaaa

SEQ ID NO: 1909514 - DNA, 20 bp, Homo sapiens
aaggtgtttgaaaatagttt

SEQ ID NO: 1909515 - DNA, 14 bp, Homo sapiens
aagtaaagtttctg

SEQ ID NO: 1909516 - DNA, 15 bp, Homo sapiens
aagtagaactttgta

SEQ ID NO: 1909517 - DNA, 16 bp, Homo sapiens
aagtagaactttgtat

SEQ ID NO: 1909518 - DNA, 17 bp, Homo sapiens
aagtagaactttgtata

SEQ ID NO: 1909519 - DNA, 13 bp, Homo sapiens
aagtagaggtggc

SEQ ID NO: 1909520 - DNA, 17 bp, Homo sapiens
aagtagaggtggcttca

SEQ ID NO: 1909521 - DNA, 14 bp, Homo sapiens
aagtagcacaggct

SEQ ID NO: 1909522 - DNA, 16 bp, Homo sapiens
aagtagcacaggctga

SEQ ID NO: 1909523 - DNA, 17 bp, Homo sapiens
aagtaggggaagaataa

SEQ ID NO: 1909524 - DNA, 21 bp, Homo sapiens
aagtagttctgtatttgaaag

SEQ ID NO: 1909525 - DNA, 22 bp, Homo sapiens
aagtagttctgtatttgaaagt

SEQ ID NO: 1909526 - DNA, 17 bp, Homo sapiens
aagtattgtacaaataa

SEQ ID NO: 1909527 - DNA, 13 bp, Homo sapiens
aagtctcaaggta

SEQ ID NO: 1909528 - DNA, 20 bp, Homo sapiens
aagtctgttgattaaagatg

SEQ ID NO: 1909529 - DNA, 23 bp, Homo sapiens
aagtgacatgcattcacatatct

SEQ ID NO: 1909530 - DNA, 21 bp, Homo sapiens
aagtgaggaaatcaaagtgct

SEQ ID NO: 1909531 - DNA, 20 bp, Homo sapiens
aagtgcaaacagaagtgcat

SEQ ID NO: 1909532 - DNA, 18 bp, Homo sapiens
aagtgcaatgccccctcc

SEQ ID NO: 1909533 - DNA, 21 bp, Homo sapiens
aagtgcaatgccccctcccct

SEQ ID NO: 1909534 - DNA, 16 bp, Homo sapiens
aagtgcctttgcagct

SEQ ID NO: 1909535 - DNA, 18 bp, Homo sapiens
aagtggactctctgacaa

SEQ ID NO: 1909536 - DNA, 19 bp, Homo sapiens
aagtgggtactttctgaaa

SEQ ID NO: 1909537 - DNA, 15 bp, Homo sapiens
aagtgtattgtaatg

SEQ ID NO: 1909538 - DNA, 14 bp, Homo sapiens
aagtgtgaatactg

SEQ ID NO: 1909539 - DNA, 15 bp, Homo sapiens
aagtgtgaatactgc

SEQ ID NO: 1909540 - DNA, 20 bp, Homo sapiens
aagtgtgaatactgcttgaa

SEQ ID NO: 1909541 - DNA, 11 bp, Homo sapiens
aagtgttcatt

SEQ ID NO: 1909542 - DNA, 20 bp, Homo sapiens
aagttaactgttccccttgg

SEQ ID NO: 1909543 - DNA, 19 bp, Homo sapiens
aagttagttccactgagac

SEQ ID NO: 1909544 - DNA, 13 bp, Homo sapiens
aagttccttctgt

SEQ ID NO: 1909545 - DNA, 14 bp, Homo sapiens
aagttccttctgta

SEQ ID NO: 1909546 - DNA, 16 bp, Homo sapiens
aagttgagctatgact

SEQ ID NO: 1909547 - DNA, 18 bp, Homo sapiens
aagttgtttcattgattt

SEQ ID NO: 1909548 - DNA, 15 bp, Homo sapiens
aagtttaaggaatat

SEQ ID NO: 1909549 - DNA, 19 bp, Homo sapiens
aagttttgacaagctggct

SEQ ID NO: 1909550 - DNA, 14 bp, Homo sapiens
aataaaaaaaagaa

SEQ ID NO: 1909551 - DNA, 18 bp, Homo sapiens
aataaaaaaaagaaaaaa

SEQ ID NO: 1909552 - DNA, 16 bp, Homo sapiens
aataaaaaatatattt

SEQ ID NO: 1909553 - DNA, 13 bp, Homo sapiens
aataaaactgcta

SEQ ID NO: 1909554 - DNA, 13 bp, Homo sapiens
aataaaagcccag

SEQ ID NO: 1909555 - DNA, 17 bp, Homo sapiens
aataaaagcccaggagc

SEQ ID NO: 1909556 - DNA, 14 bp, Homo sapiens
aataaagagatttt

SEQ ID NO: 1909557 - DNA, 11 bp, Homo sapiens
aataaaggaaa

SEQ ID NO: 1909558 - DNA, 23 bp, Homo sapiens
aataaatggcccggacatgtctt

SEQ ID NO: 1909559 - DNA, 20 bp, Homo sapiens
aataaattggagttttaaaa

SEQ ID NO: 1909560 - DNA, 15 bp, Homo sapiens
ggttcctacacagga

SEQ ID NO: 1909561 - DNA, 22 bp, Homo sapiens
ggttcctggggcatccatgggg

SEQ ID NO: 1909562 - DNA, 18 bp, Homo sapiens
ggttctttcatttgcttt

SEQ ID NO: 1909563 - DNA, 11 bp, Homo sapiens
ggttgaataaa

SEQ ID NO: 1909564 - DNA, 21 bp, Homo sapiens
ggttgggacccagtggcaggg

SEQ ID NO: 1909565 - DNA, 22 bp, Homo sapiens
ggttgggacccagtggcagggc

SEQ ID NO: 1909566 - DNA, 23 bp, Homo sapiens
ggttgggacccagtggcagggca

SEQ ID NO: 1909567 - DNA, 15 bp, Homo sapiens
ggtttacctgcaccg

SEQ ID NO: 1909568 - DNA, 14 bp, Homo sapiens
ggtttcagggctga

SEQ ID NO: 1909569 - DNA, 17 bp, Homo sapiens
ggttttatttatttctt

SEQ ID NO: 1909570 - DNA, 22 bp, Homo sapiens
ggttttccgcattctttgtaca

SEQ ID NO: 1909571 - DNA, 19 bp, Homo sapiens
ggttttctactgttatgtg

SEQ ID NO: 1909572 - DNA, 15 bp, Homo sapiens
ggttttggtaattgt

SEQ ID NO: 1909573 - DNA, 16 bp, Homo sapiens
gtaaaagcattttgta

SEQ ID NO: 1909574 - DNA, 14 bp, Homo sapiens
gtaaaagttaagat

SEQ ID NO: 1909575 - DNA, 21 bp, Homo sapiens
gtaaaatctgacataaaaaca

SEQ ID NO: 1909576 - DNA, 16 bp, Homo sapiens
gtaaaatgaagaattt

SEQ ID NO: 1909577 - DNA, 21 bp, Homo sapiens
gtaaagaaatacacagggagg

SEQ ID NO: 1909578 - DNA, 20 bp, Homo sapiens
gtaaatgactttcataataa

SEQ ID NO: 1909579 - DNA, 16 bp, Homo sapiens
gtaaatggtatgtcat

SEQ ID NO: 1909580 - DNA, 14 bp, Homo sapiens
gtaaatgtattcat

SEQ ID NO: 1909581 - DNA, 15 bp, Homo sapiens
gtaaatgtattcatt

SEQ ID NO: 1909582 - DNA, 16 bp, Homo sapiens
gtaaattgtattctca

SEQ ID NO: 1909583 - DNA, 15 bp, Homo sapiens
gtaactaaaataatt

SEQ ID NO: 1909584 - DNA, 12 bp, Homo sapiens
gtaagaaatact

SEQ ID NO: 1909585 - DNA, 17 bp, Homo sapiens
gtaagaaatactgtaca

SEQ ID NO: 1909586 - DNA, 21 bp, Homo sapiens
gtaagaacgtgcttgtggaag

SEQ ID NO: 1909587 - DNA, 20 bp, Homo sapiens
gtaagatcactgtttagatt

SEQ ID NO: 1909588 - DNA, 20 bp, Homo sapiens
gtaagcgtatggctttattt

SEQ ID NO: 1909589 - DNA, 16 bp, Homo sapiens
gtaaggaaaaataaaa

SEQ ID NO: 1909590 - DNA, 16 bp, Homo sapiens
gtaataataaagaata

SEQ ID NO: 1909591 - DNA, 22 bp, Homo sapiens
gtaatctagttgtcaataaatg

SEQ ID NO: 1909592 - DNA, 11 bp, Homo sapiens
ggaggccaaga

SEQ ID NO: 1909593 - DNA, 14 bp, Homo sapiens
ggaggccacctcct

SEQ ID NO: 1909594 - DNA, 22 bp, Homo sapiens
ggaggcccagcgcggacatccc

SEQ ID NO: 1909595 - DNA, 16 bp, Homo sapiens
ggagggactctgtctg

SEQ ID NO: 1909596 - DNA, 22 bp, Homo sapiens
ggagggactctgtctggccagg

SEQ ID NO: 1909597 - DNA, 16 bp, Homo sapiens
ggagggcctgggcctg

SEQ ID NO: 1909598 - DNA, 14 bp, Homo sapiens
ggaggtggcatccc

SEQ ID NO: 1909599 - DNA, 17 bp, Homo sapiens
ggagtaagtagaggtgg

SEQ ID NO: 1909600 - DNA, 20 bp, Homo sapiens
ggagtgagtgaaactcccac

SEQ ID NO: 1909601 - DNA, 16 bp, Homo sapiens
ggatattttcttaaaa

SEQ ID NO: 1909602 - DNA, 16 bp, Homo sapiens
ggatcaggctcccagg

SEQ ID NO: 1909603 - DNA, 14 bp, Homo sapiens
ggatgattgaagaa

SEQ ID NO: 1909604 - DNA, 16 bp, Homo sapiens
ggatgattgaagaaac

SEQ ID NO: 1909605 - DNA, 16 bp, Homo sapiens
ggatgtgctgcagtgc

SEQ ID NO: 1909606 - DNA, 21 bp, Homo sapiens
ggatgtttttagttctgactt

SEQ ID NO: 1909607 - DNA, 15 bp, Homo sapiens
ggattaatgatcata

SEQ ID NO: 1909608 - DNA, 17 bp, Homo sapiens
ggattagtttagaacag

SEQ ID NO: 1909609 - DNA, 13 bp, Homo sapiens
ggattcctcccca

SEQ ID NO: 1909610 - DNA, 13 bp, Homo sapiens
ggattgtcactcc

SEQ ID NO: 1909611 - DNA, 14 bp, Homo sapiens
ggatttctctttct

SEQ ID NO: 1909612 - DNA, 20 bp, Homo sapiens
ggcaaatccgaaatcagcag

SEQ ID NO: 1909613 - DNA, 23 bp, Homo sapiens
ggcaagaaccagttgttttgtct

SEQ ID NO: 1909614 - DNA, 17 bp, Homo sapiens
ggcaataaaagcccagg

SEQ ID NO: 1909615 - DNA, 16 bp, Homo sapiens
ggcaataaattttgaa

SEQ ID NO: 1909616 - DNA, 18 bp, Homo sapiens
ggcaatggtagtttctgt

SEQ ID NO: 1909617 - DNA, 14 bp, Homo sapiens
ggcacagcctgcac

SEQ ID NO: 1909618 - DNA, 15 bp, Homo sapiens
ggcacagcctgcact

SEQ ID NO: 1909619 - DNA, 21 bp, Homo sapiens
ggcacaggcagggcaggacca

SEQ ID NO: 1909620 - DNA, 17 bp, Homo sapiens
ggcacagggcctggccc

SEQ ID NO: 1909621 - DNA, 20 bp, Homo sapiens
ggcacagggcctggcccatg

SEQ ID NO: 1909622 - DNA, 13 bp, Homo sapiens
ggcagagagggtc

SEQ ID NO: 1909623 - DNA, 16 bp, Homo sapiens
ggcagaggtggtctgg

SEQ ID NO: 1909624 - DNA, 17 bp, Homo sapiens
ggcagcgaggctgggct

SEQ ID NO: 1909625 - DNA, 14 bp, Homo sapiens
ggcagcttgggctg

SEQ ID NO: 1909626 - DNA, 15 bp, Homo sapiens
ggcagcttgggctgg

SEQ ID NO: 1909627 - DNA, 16 bp, Homo sapiens
ggcaggaccagcccac

SEQ ID NO: 1909628 - DNA, 17 bp, Homo sapiens
ggcaggaccagcccacg

SEQ ID NO: 1909629 - DNA, 19 bp, Homo sapiens
ggcaggaccagcccacgct

SEQ ID NO: 1909630 - DNA, 14 bp, Homo sapiens
ggcagggcacaggg

SEQ ID NO: 1909631 - DNA, 18 bp, Homo sapiens
ggcagggcacagggcctg

SEQ ID NO: 1909632 - DNA, 23 bp, Homo sapiens
ggcagggcacagggcctggccca

SEQ ID NO: 1909633 - DNA, 16 bp, Homo sapiens
ggcagggcaggaccag

SEQ ID NO: 1909634 - DNA, 13 bp, Homo sapiens
ggcagtggctgtg

SEQ ID NO: 1909635 - DNA, 15 bp, Homo sapiens
ggcagtggctgtgaa

SEQ ID NO: 1909636 - DNA, 23 bp, Homo sapiens
ggcatatatgtactagtggcatg

SEQ ID NO: 1909637 - DNA, 18 bp, Homo sapiens
ggcatttggcttcctctg

SEQ ID NO: 1909638 - DNA, 15 bp, Homo sapiens
ggccaaacaggccct

SEQ ID NO: 1909639 - DNA, 19 bp, Homo sapiens
ggccaagagtggccccacc

SEQ ID NO: 1909640 - DNA, 13 bp, Homo sapiens
ggccaagcaggca

SEQ ID NO: 1909641 - DNA, 20 bp, Homo sapiens
ggccaccacgcctagcctca

SEQ ID NO: 1909642 - DNA, 12 bp, Homo sapiens
ggccagagcctt

SEQ ID NO: 1909643 - DNA, 11 bp, Homo sapiens
ggccagcagcc

SEQ ID NO: 1909644 - DNA, 14 bp, Homo sapiens
ggccagcagccttc

SEQ ID NO: 1909645 - DNA, 16 bp, Homo sapiens
ggccagcagccttcca

SEQ ID NO: 1909646 - DNA, 18 bp, Homo sapiens
ggccagcggccctcccag

SEQ ID NO: 1909647 - DNA, 20 bp, Homo sapiens
ggccaggaagtagcacaggc

SEQ ID NO: 1909648 - DNA, 22 bp, Homo sapiens
ggccagggaggagccccagtgg

SEQ ID NO: 1909649 - DNA, 22 bp, Homo sapiens
ggcccaccctgcttggcccagg

SEQ ID NO: 1909650 - DNA, 23 bp, Homo sapiens
ggcccaccctgcttggcccaggg

SEQ ID NO: 1909651 - DNA, 22 bp, Homo sapiens
ggcccagcgcggacatcccctg

SEQ ID NO: 1909652 - DNA, 22 bp, Homo sapiens
ggcccagggggcttcctgaggg

SEQ ID NO: 1909653 - DNA, 18 bp, Homo sapiens
ggcccatcaggggcagga

SEQ ID NO: 1909654 - DNA, 13 bp, Homo sapiens
ggcccatggccac

SEQ ID NO: 1909655 - DNA, 22 bp, Homo sapiens
ggccccacctggccctctctga

SEQ ID NO: 1909656 - DNA, 17 bp, Homo sapiens
ggccccagcaacacgtc

SEQ ID NO: 1909657 - DNA, 21 bp, Homo sapiens
ggccccagcaacacgtcattg

SEQ ID NO: 1909658 - DNA, 15 bp, Homo sapiens
ggccccgtctcaggt

SEQ ID NO: 1909659 - DNA, 16 bp, Homo sapiens
ggcccggcatgaggcc

SEQ ID NO: 1909660 - DNA, 15 bp, Homo sapiens
ggcccgggcccaggc

SEQ ID NO: 1909661 - DNA, 20 bp, Homo sapiens
ggccctctctgaaggaggcc

SEQ ID NO: 1909662 - DNA, 13 bp, Homo sapiens
ggccctggcagcc

SEQ ID NO: 1909663 - DNA, 12 bp, Homo sapiens
ggccctgggcct

SEQ ID NO: 1909664 - DNA, 17 bp, Homo sapiens
ggccctgggcctccacc

SEQ ID NO: 1909665 - DNA, 19 bp, Homo sapiens
ggccctgggcctccacctc

SEQ ID NO: 1909666 - DNA, 15 bp, Homo sapiens
ggccgcactgggagc

SEQ ID NO: 1909667 - DNA, 22 bp, Homo sapiens
ggccgccggcaataaaagccca

SEQ ID NO: 1909668 - DNA, 13 bp, Homo sapiens
ggcctcagggctc

SEQ ID NO: 1909669 - DNA, 14 bp, Homo sapiens
ggcctccacctctg

SEQ ID NO: 1909670 - DNA, 13 bp, Homo sapiens
ggcctcccactcc

SEQ ID NO: 1909671 - DNA, 14 bp, Homo sapiens
ggcctcccactccc

SEQ ID NO: 1909672 - DNA, 20 bp, Homo sapiens
ggcctcccactcccatggct

SEQ ID NO: 1909673 - DNA, 22 bp, Homo sapiens
ggcctgagtgagaggggaggcc

SEQ ID NO: 1909674 - DNA, 18 bp, Homo sapiens
ggcctgggcctggctccc

SEQ ID NO: 1909675 - DNA, 16 bp, Homo sapiens
ggccttctgcctgctg

SEQ ID NO: 1909676 - DNA, 13 bp, Homo sapiens
ggcctttcccact

SEQ ID NO: 1909677 - DNA, 22 bp, Homo sapiens
ggcgaaatccctgctcactgca

SEQ ID NO: 1909678 - DNA, 13 bp, Homo sapiens
ggcgagcagggca

SEQ ID NO: 1909679 - DNA, 19 bp, Homo sapiens
ggcgagcagggcaggcccc

SEQ ID NO: 1909680 - DNA, 20 bp, Homo sapiens
ggcggagcttgcagtgagcc

SEQ ID NO: 1909681 - DNA, 21 bp, Homo sapiens
ggcggagcttgcagtgagccg

SEQ ID NO: 1909682 - DNA, 20 bp, Homo sapiens
ggcgtattttgtatttaaaa

SEQ ID NO: 1909683 - DNA, 15 bp, Homo sapiens
ggctagctaagccaa

SEQ ID NO: 1909684 - DNA, 15 bp, Homo sapiens
ggctcagcaaggcca

SEQ ID NO: 1909685 - DNA, 19 bp, Homo sapiens
ggctcagcaaggccacctc

SEQ ID NO: 1909686 - DNA, 15 bp, Homo sapiens
ggctcaggctgagct

SEQ ID NO: 1909687 - DNA, 16 bp, Homo sapiens
ggctccctcactctca

SEQ ID NO: 1909688 - DNA, 17 bp, Homo sapiens
ggctcctcagccctctc

SEQ ID NO: 1909689 - DNA, 18 bp, Homo sapiens
ggctcctcagccctctct

SEQ ID NO: 1909690 - DNA, 13 bp, Homo sapiens
ggctcgagctcgg

SEQ ID NO: 1909691 - DNA, 21 bp, Homo sapiens
ggctcgagctcggggctgggg

SEQ ID NO: 1909692 - DNA, 14 bp, Homo sapiens
ggctctacacatat

SEQ ID NO: 1909693 - DNA, 20 bp, Homo sapiens
ggctctcctcagaagaaaga

SEQ ID NO: 1909694 - DNA, 13 bp, Homo sapiens
ggctgaagtgcat

SEQ ID NO: 1909695 - DNA, 20 bp, Homo sapiens
ggctgaagtgcatgggtcag

SEQ ID NO: 1909696 - DNA, 16 bp, Homo sapiens
ggctgagtgcaggccc

SEQ ID NO: 1909697 - DNA, 14 bp, Homo sapiens
ggctgcagggctgg

SEQ ID NO: 1909698 - DNA, 15 bp, Homo sapiens
ggctgcagggctggg

SEQ ID NO: 1909699 - DNA, 16 bp, Homo sapiens
ggctgcagggctgggt

SEQ ID NO: 1909700 - DNA, 15 bp, Homo sapiens
ggctgctgccaggcc

SEQ ID NO: 1909701 - DNA, 14 bp, Homo sapiens
ggctgctgtgaagc

SEQ ID NO: 1909702 - DNA, 13 bp, Homo sapiens
ggctggcaccagc

SEQ ID NO: 1909703 - DNA, 17 bp, Homo sapiens
ggctggcaccagcaggc

SEQ ID NO: 1909704 - DNA, 20 bp, Homo sapiens
ggctggcaccagcaggcact

SEQ ID NO: 1909705 - DNA, 14 bp, Homo sapiens
ggctggcgggccct

SEQ ID NO: 1909706 - DNA, 14 bp, Homo sapiens
ggctgggctggcca

SEQ ID NO: 1909707 - DNA, 15 bp, Homo sapiens
ggctgggctgggcac

SEQ ID NO: 1909708 - DNA, 18 bp, Homo sapiens
ggctgggctgggcactgc

SEQ ID NO: 1909709 - DNA, 12 bp, Homo sapiens
ggctgggtcagg

SEQ ID NO: 1909710 - DNA, 17 bp, Homo sapiens
ggctgtctgttgtattc

SEQ ID NO: 1909711 - DNA, 18 bp, Homo sapiens
gtgaggcatctctctggg

SEQ ID NO: 1909712 - DNA, 19 bp, Homo sapiens
gtgatctgctgcagagcag

SEQ ID NO: 1909713 - DNA, 16 bp, Homo sapiens
gtgatgaagctgaggc

SEQ ID NO: 1909714 - DNA, 17 bp, Homo sapiens
gtgatgaagctgaggct

SEQ ID NO: 1909715 - DNA, 13 bp, Homo sapiens
gtgatttggatct

SEQ ID NO: 1909716 - DNA, 22 bp, Homo sapiens
gtgcaaacaaaaggtgtgcctg

SEQ ID NO: 1909717 - DNA, 17 bp, Homo sapiens
gtgcaaacagaagtgca

SEQ ID NO: 1909718 - DNA, 17 bp, Homo sapiens
gtgcaatgccccctccc

SEQ ID NO: 1909719 - DNA, 22 bp, Homo sapiens
gtgcagaactgcagtcactgca

SEQ ID NO: 1909720 - DNA, 19 bp, Homo sapiens
gtgcaggcccaccctgctt

SEQ ID NO: 1909721 - DNA, 11 bp, Homo sapiens
gtgcagggcac

SEQ ID NO: 1909722 - DNA, 17 bp, Homo sapiens
gtgcagggcacagaagg

SEQ ID NO: 1909723 - DNA, 12 bp, Homo sapiens
gtgcagggctgc

SEQ ID NO: 1909724 - DNA, 18 bp, Homo sapiens
gtgcagtgatgtttgcca

SEQ ID NO: 1909725 - DNA, 20 bp, Homo sapiens
gtgccaccgtccctctgcag

SEQ ID NO: 1909726 - DNA, 21 bp, Homo sapiens
gtgccaccgtccctctgcaga

SEQ ID NO: 1909727 - DNA, 20 bp, Homo sapiens
gtgccggaaagagagctgga

SEQ ID NO: 1909728 - DNA, 16 bp, Homo sapiens
gtgcctaaataagtta

SEQ ID NO: 1909729 - DNA, 23 bp, Homo sapiens
gtgcctgcttcagcctcccacag

SEQ ID NO: 1909730 - DNA, 24 bp, Homo sapiens
gtgctattacgaagttcaagatca

SEQ ID NO: 1909731 - DNA, 13 bp, Homo sapiens
gtgctgagctgac

SEQ ID NO: 1909732 - DNA, 22 bp, Homo sapiens
gtgctgggaggtcccagggccc

SEQ ID NO: 1909733 - DNA, 13 bp, Homo sapiens
gtgctggtgaccc

SEQ ID NO: 1909734 - DNA, 12 bp, Homo sapiens
gtgctgtgaaaa

SEQ ID NO: 1909735 - DNA, 22 bp, Homo sapiens
gtgcttctgccaccctgctgag

SEQ ID NO: 1909736 - DNA, 22 bp, Homo sapiens
gtggaaagtgttcattgcacaa

SEQ ID NO: 1909737 - DNA, 18 bp, Homo sapiens
gtggaaattaagaagaaa

SEQ ID NO: 1909738 - DNA, 13 bp, Homo sapiens
gtggactctctga

SEQ ID NO: 1909739 - DNA, 16 bp, Homo sapiens
gtggactctctgacaa

SEQ ID NO: 1909740 - DNA, 17 bp, Homo sapiens
gtggagaatcacaggct

SEQ ID NO: 1909741 - DNA, 22 bp, Homo sapiens
gtggagactgctcctgagcccc

SEQ ID NO: 1909742 - DNA, 17 bp, Homo sapiens
gtggattcctccccacc

SEQ ID NO: 1909743 - DNA, 18 bp, Homo sapiens
gtggattcctccccaccc

SEQ ID NO: 1909744 - DNA, 20 bp, Homo sapiens
gtggattcctccccaccctg

SEQ ID NO: 1909745 - DNA, 18 bp, Homo sapiens
gtggcagcaggagggact

SEQ ID NO: 1909746 - DNA, 15 bp, Homo sapiens
gtggcagggcacagg

SEQ ID NO: 1909747 - DNA, 20 bp, Homo sapiens
gtggcagggcacagggcctg

SEQ ID NO: 1909748 - DNA, 16 bp, Homo sapiens
gtggccagcagcctct

SEQ ID NO: 1909749 - DNA, 18 bp, Homo sapiens
gtggccagcagcctctga

SEQ ID NO: 1909750 - DNA, 22 bp, Homo sapiens
gtggccccacctggccctctct

SEQ ID NO: 1909751 - DNA, 20 bp, Homo sapiens
gtggccggggtccaggcatg

SEQ ID NO: 1909752 - DNA, 16 bp, Homo sapiens
gtggcctggcttgtct

SEQ ID NO: 1909753 - DNA, 14 bp, Homo sapiens
gtggcttctcccaa

SEQ ID NO: 1909754 - DNA, 19 bp, Homo sapiens
gtgggggccccgtctcagg

SEQ ID NO: 1909755 - DNA, 18 bp, Homo sapiens
gtggtcagagagggaagc

SEQ ID NO: 1909756 - DNA, 13 bp, Homo sapiens
gtgtatatttgat

SEQ ID NO: 1909757 - DNA, 14 bp, Homo sapiens
gtgtatatttgatt

SEQ ID NO: 1909758 - DNA, 13 bp, Homo sapiens
gtgtattgtaatg

SEQ ID NO: 1909759 - DNA, 18 bp, Homo sapiens
gtgtcatggatagatttt

SEQ ID NO: 1909760 - DNA, 14 bp, Homo sapiens
gtgtcctttctgaa

SEQ ID NO: 1909761 - DNA, 19 bp, Homo sapiens
gtgtctcctgtttcagacc

SEQ ID NO: 1909762 - DNA, 22 bp, Homo sapiens
gtgtctcctgtttcagaccagc

SEQ ID NO: 1909763 - DNA, 15 bp, Homo sapiens
gtgtgaacttggaag

SEQ ID NO: 1909764 - DNA, 12 bp, Homo sapiens
gtgtgaccagtt

SEQ ID NO: 1909765 - DNA, 18 bp, Homo sapiens
gtgtgcccagcttataaa

SEQ ID NO: 1909766 - DNA, 16 bp, Homo sapiens
gtgtgcctggcagcca

SEQ ID NO: 1909767 - DNA, 15 bp, Homo sapiens
gtgtggccagcagcc

SEQ ID NO: 1909768 - DNA, 21 bp, Homo sapiens
gtgtggccagcagcctctgat

SEQ ID NO: 1909769 - DNA, 21 bp, Homo sapiens
gtgtgggggccccgtctcagg

SEQ ID NO: 1909770 - DNA, 13 bp, Homo sapiens
gtgtggtgacatt

SEQ ID NO: 1909771 - DNA, 13 bp, Homo sapiens
gtgtgttacaatg

SEQ ID NO: 1909772 - DNA, 13 bp, Homo sapiens
gtgttaatttaag

SEQ ID NO: 1909773 - DNA, 13 bp, Homo sapiens
gtgttacatgtat

SEQ ID NO: 1909774 - DNA, 17 bp, Homo sapiens
gtgttatatgaacatac

SEQ ID NO: 1909775 - DNA, 15 bp, Homo sapiens
gtgttatgagccagg

SEQ ID NO: 1909776 - DNA, 20 bp, Homo sapiens
gttaactgttccccttggta

SEQ ID NO: 1909777 - DNA, 12 bp, Homo sapiens
gttaagcatcta

SEQ ID NO: 1909778 - DNA, 21 bp, Homo sapiens
gttaagggacttgtcccaagt

SEQ ID NO: 1909779 - DNA, 12 bp, Homo sapiens
gttacagcctgg

SEQ ID NO: 1909780 - DNA, 20 bp, Homo sapiens
gttactggccaaggctattt

SEQ ID NO: 1909781 - DNA, 17 bp, Homo sapiens
gttagactgccagctct

SEQ ID NO: 1909782 - DNA, 16 bp, Homo sapiens
gttagattaagaaata

SEQ ID NO: 1909783 - DNA, 14 bp, Homo sapiens
gttagtattgattc

SEQ ID NO: 1909784 - DNA, 15 bp, Homo sapiens
gttagtattgattca

SEQ ID NO: 1909785 - DNA, 16 bp, Homo sapiens
gttagttccactgaga

SEQ ID NO: 1909786 - DNA, 16 bp, Homo sapiens
gttatgtgagaacatt

SEQ ID NO: 1909787 - DNA, 11 bp, Homo sapiens
gttatgtgtct

SEQ ID NO: 1909788 - DNA, 20 bp, Homo sapiens
gttcaagatcaaaaaggctt

SEQ ID NO: 1909789 - DNA, 15 bp, Homo sapiens
gttcctacacaggac

SEQ ID NO: 1909790 - DNA, 22 bp, Homo sapiens
gttcctggggcatccatggggt

SEQ ID NO: 1909791 - DNA, 11 bp, Homo sapiens
gttctaacttc

SEQ ID NO: 1909792 - DNA, 13 bp, Homo sapiens
gttctgactttga

SEQ ID NO: 1909793 - DNA, 20 bp, Homo sapiens
gttcttggcaataaattttg

SEQ ID NO: 1909794 - DNA, 21 bp, Homo sapiens
gttcttggcaataaattttga

SEQ ID NO: 1909795 - DNA, 22 bp, Homo sapiens
gttcttggcaataaattttgaa

SEQ ID NO: 1909796 - DNA, 23 bp, Homo sapiens
gttcttggcaataaattttgaaa

SEQ ID NO: 1909797 - DNA, 20 bp, Homo sapiens
gttctttcatttgctttgga

SEQ ID NO: 1909798 - DNA, 19 bp, Homo sapiens
gttcttttcaatatatttg

SEQ ID NO: 1909799 - DNA, 20 bp, Homo sapiens
gttgagggcatttggcttcc

SEQ ID NO: 1909800 - DNA, 12 bp, Homo sapiens
ctttgtatagtt

SEQ ID NO: 1909801 - DNA, 18 bp, Homo sapiens
ctttgtatagttatgtaa

SEQ ID NO: 1909802 - DNA, 19 bp, Homo sapiens
ctttgtatagttatgtaaa

SEQ ID NO: 1909803 - DNA, 12 bp, Homo sapiens
ctttgtattgtc

SEQ ID NO: 1909804 - DNA, 15 bp, Homo sapiens
ctttgtattgtccta

SEQ ID NO: 1909805 - DNA, 15 bp, Homo sapiens
ctttgttaaaaacac

SEQ ID NO: 1909806 - DNA, 16 bp, Homo sapiens
ctttgttgaaagaaag

SEQ ID NO: 1909807 - DNA, 18 bp, Homo sapiens
cttttccctcctttcctt

SEQ ID NO: 1909808 - DNA, 17 bp, Homo sapiens
cttttctttccttttca

SEQ ID NO: 1909809 - DNA, 18 bp, Homo sapiens
cttttctttccttttcat

SEQ ID NO: 1909810 - DNA, 18 bp, Homo sapiens
cttttcttttgctttcct

SEQ ID NO: 1909811 - DNA, 21 bp, Homo sapiens
cttttcttttgctttcctttc

SEQ ID NO: 1909812 - DNA, 14 bp, Homo sapiens
cttttgataagaaa

SEQ ID NO: 1909813 - DNA, 19 bp, Homo sapiens
cttttggttcattttcaga

SEQ ID NO: 1909814 - DNA, 18 bp, Homo sapiens
ctttttatttatatgtat

SEQ ID NO: 1909815 - DNA, 15 bp, Homo sapiens
cttttttatataata

SEQ ID NO: 1909816 - DNA, 19 bp, Homo sapiens
cttttttatataataaaag

SEQ ID NO: 1909817 - DNA, 15 bp, Homo sapiens
cttttttattaatca

SEQ ID NO: 1909818 - DNA, 14 bp, Homo sapiens
cttttttcaaaatt

SEQ ID NO: 1909819 - DNA, 18 bp, Homo sapiens
gaaaaaaaaaatgctgaa

SEQ ID NO: 1909820 - DNA, 15 bp, Homo sapiens
gaaaaaaaaagaaaa

SEQ ID NO: 1909821 - DNA, 17 bp, Homo sapiens
gaaaaaagagaaaagaa

SEQ ID NO: 1909822 - DNA, 22 bp, Homo sapiens
gaaaaaagttgtaggcgaatca

SEQ ID NO: 1909823 - DNA, 17 bp, Homo sapiens
gaaaaatgttataactt

SEQ ID NO: 1909824 - DNA, 9 bp, Homo sapiens
gaaaagaaa

SEQ ID NO: 1909825 - DNA, 12 bp, Homo sapiens
gaaaagaaattg

SEQ ID NO: 1909826 - DNA, 18 bp, Homo sapiens
gaaaagaaattgtccttg

SEQ ID NO: 1909827 - DNA, 18 bp, Homo sapiens
gaaaagatgtagatttat

SEQ ID NO: 1909828 - DNA, 18 bp, Homo sapiens
gaaaagctgtgtacttta

SEQ ID NO: 1909829 - DNA, 16 bp, Homo sapiens
gaaaataaaaaaaaga

SEQ ID NO: 1909830 - DNA, 17 bp, Homo sapiens
gaaaataaaaaaaagaa

SEQ ID NO: 1909831 - DNA, 18 bp, Homo sapiens
gaaaataaaaaaaagaaa

SEQ ID NO: 1909832 - DNA, 15 bp, Homo sapiens
gaaaatagtttattt

SEQ ID NO: 1909833 - DNA, 19 bp, Homo sapiens
gaaaatagtttattttaaa

SEQ ID NO: 1909834 - DNA, 22 bp, Homo sapiens
gaaaatatttgcacacatttaa

SEQ ID NO: 1909835 - DNA, 23 bp, Homo sapiens
gaaacatgttgccaaaatggtgg

SEQ ID NO: 1909836 - DNA, 19 bp, Homo sapiens
gaaacattggcataatttt

SEQ ID NO: 1909837 - DNA, 20 bp, Homo sapiens
gaaacattggcataattttt

SEQ ID NO: 1909838 - DNA, 17 bp, Homo sapiens
gaaaccgaagggactgg

SEQ ID NO: 1909839 - DNA, 15 bp, Homo sapiens
gaaactcaggaaaga

SEQ ID NO: 1909840 - DNA, 15 bp, Homo sapiens
gaaactccagatgcc

SEQ ID NO: 1909841 - DNA, 16 bp, Homo sapiens
gaaactcccaccctac

SEQ ID NO: 1909842 - DNA, 17 bp, Homo sapiens
gaaactctatggtctta

SEQ ID NO: 1909843 - DNA, 22 bp, Homo sapiens
gaaactggaataagccttcgaa

SEQ ID NO: 1909844 - DNA, 14 bp, Homo sapiens
gaaagagagctgga

SEQ ID NO: 1909845 - DNA, 19 bp, Homo sapiens
gaaagatatgtatattttt

SEQ ID NO: 1909846 - DNA, 22 bp, Homo sapiens
gaaagatatgtatatttttgat

SEQ ID NO: 1909847 - DNA, 21 bp, Homo sapiens
gaaagctttgttgaaagaaag

SEQ ID NO: 1909848 - DNA, 15 bp, Homo sapiens
gaaagtgcctttgca

SEQ ID NO: 1909849 - DNA, 15 bp, Homo sapiens
gaaagtgttcattgc

SEQ ID NO: 1909850 - DNA, 18 bp, Homo sapiens
gaaatacacaagtaaaca

SEQ ID NO: 1909851 - DNA, 19 bp, Homo sapiens
gaaatagtcatttgtgaat

SEQ ID NO: 1909852 - DNA, 20 bp, Homo sapiens
gaaatatgtattctgtaaaa

SEQ ID NO: 1909853 - DNA, 12 bp, Homo sapiens
gaaatcaaagtg

SEQ ID NO: 1909854 - DNA, 17 bp, Homo sapiens
gaaatcaaatgtaaagt

SEQ ID NO: 1909855 - DNA, 14 bp, Homo sapiens
gaaatcttaagtca

SEQ ID NO: 1909856 - DNA, 13 bp, Homo sapiens
gaaatgaagagct

SEQ ID NO: 1909857 - DNA, 23 bp, Homo sapiens
gaaattaacttaccctgtatatc

SEQ ID NO: 1909858 - DNA, 17 bp, Homo sapiens
gaaattcagattgttta

SEQ ID NO: 1909859 - DNA, 12 bp, Homo sapiens
gaaattgtcctt

SEQ ID NO: 1909860 - DNA, 20 bp, Homo sapiens
gaaattgtccttgaagcttg

SEQ ID NO: 1909861 - DNA, 18 bp, Homo sapiens
gaaatttgcccctggcaa

SEQ ID NO: 1909862 - DNA, 22 bp, Homo sapiens
gaacaagttgagctatgactta

SEQ ID NO: 1909863 - DNA, 14 bp, Homo sapiens
gaacagattttatt

SEQ ID NO: 1909864 - DNA, 12 bp, Homo sapiens
gaacagctgttg

SEQ ID NO: 1909865 - DNA, 17 bp, Homo sapiens
gaacagctgttgactct

SEQ ID NO: 1909866 - DNA, 13 bp, Homo sapiens
gaacagtaaacat

SEQ ID NO: 1909867 - DNA, 16 bp, Homo sapiens
gaacataattcttatt

SEQ ID NO: 1909868 - DNA, 15 bp, Homo sapiens
gaacatgcctcctcc

SEQ ID NO: 1909869 - DNA, 18 bp, Homo sapiens
gaacatgcctcctcctgc

SEQ ID NO: 1909870 - DNA, 20 bp, Homo sapiens
gaacatgcctcctcctgccc

SEQ ID NO: 1909871 - DNA, 21 bp, Homo sapiens
gaacatgcctcctcctgccct

SEQ ID NO: 1909872 - DNA, 16 bp, Homo sapiens
gaacattaggccccag

SEQ ID NO: 1909873 - DNA, 21 bp, Homo sapiens
gaacattaggccccagcaaca

SEQ ID NO: 1909874 - DNA, 17 bp, Homo sapiens
gaacattccatttgctt

SEQ ID NO: 1909875 - DNA, 23 bp, Homo sapiens
gaacattgcatataacttatatt

SEQ ID NO: 1909876 - DNA, 13 bp, Homo sapiens
gaaccacttgtag

SEQ ID NO: 1909877 - DNA, 18 bp, Homo sapiens
gaaccataaaatgtccag

SEQ ID NO: 1909878 - DNA, 13 bp, Homo sapiens
gaacctaggagga

SEQ ID NO: 1909879 - DNA, 23 bp, Homo sapiens
gaacctctcaggatcaatgaccc

SEQ ID NO: 1909880 - DNA, 12 bp, Homo sapiens
gaacgcccactt

SEQ ID NO: 1909881 - DNA, 18 bp, Homo sapiens
gaacgtttggttcaaatg

SEQ ID NO: 1909882 - DNA, 12 bp, Homo sapiens
gaactgctgctg

SEQ ID NO: 1909883 - DNA, 13 bp, Homo sapiens
gaactgctgctga

SEQ ID NO: 1909884 - DNA, 16 bp, Homo sapiens
gaactgctgctgaccc

SEQ ID NO: 1909885 - DNA, 19 bp, Homo sapiens
gaactgggcatatttctaa

SEQ ID NO: 1909886 - DNA, 15 bp, Homo sapiens
gaactgttgtataaa

SEQ ID NO: 1909887 - DNA, 16 bp, Homo sapiens
gaactgttgtataaat

SEQ ID NO: 1909888 - DNA, 21 bp, Homo sapiens
gaactttgtatagttatgtaa

SEQ ID NO: 1909889 - DNA, 13 bp, Homo sapiens
gaagaatttaaag

SEQ ID NO: 1909890 - DNA, 16 bp, Homo sapiens
gaagacaaaggcccaa

SEQ ID NO: 1909891 - DNA, 17 bp, Homo sapiens
gaagacaagtctgtggc

SEQ ID NO: 1909892 - DNA, 21 bp, Homo sapiens
gaagacttccccaagcctggc

SEQ ID NO: 1909893 - DNA, 22 bp, Homo sapiens
gaagacttccccaagcctggca

SEQ ID NO: 1909894 - DNA, 23 bp, Homo sapiens
gaagacttccccaagcctggcag

SEQ ID NO: 1909895 - DNA, 14 bp, Homo sapiens
gaagagaaaggaca

SEQ ID NO: 1909896 - DNA, 21 bp, Homo sapiens
gaagagagtagctcgtcctca

SEQ ID NO: 1909897 - DNA, 13 bp, Homo sapiens
gaagagtttgtaa

SEQ ID NO: 1909898 - DNA, 12 bp, Homo sapiens
gaagatactttg

SEQ ID NO: 1909899 - DNA, 16 bp, Homo sapiens
gaagatcacagcaggg

SEQ ID NO: 1909900 - DNA, 12 bp, Homo sapiens
gaagcagtgccc

SEQ ID NO: 1909901 - DNA, 18 bp, Homo sapiens
gaagcagtgcccaggtgg

SEQ ID NO: 1909902 - DNA, 13 bp, Homo sapiens
gaagcatctctga

SEQ ID NO: 1909903 - DNA, 14 bp, Homo sapiens
gaagcatctctgac

SEQ ID NO: 1909904 - DNA, 15 bp, Homo sapiens
gaagctgaggctgct

SEQ ID NO: 1909905 - DNA, 16 bp, Homo sapiens
gaagctgaggctgctg

SEQ ID NO: 1909906 - DNA, 14 bp, Homo sapiens
gaagctgatgagga

SEQ ID NO: 1909907 - DNA, 22 bp, Homo sapiens
gaagcttgtatctgatatcagc

SEQ ID NO: 1909908 - DNA, 15 bp, Homo sapiens
gaaggagattgtggg

SEQ ID NO: 1909909 - DNA, 20 bp, Homo sapiens
gaaggcaataccaacctgaa

SEQ ID NO: 1909910 - DNA, 22 bp, Homo sapiens
gaaggcaataccaacctgaaag

SEQ ID NO: 1909911 - DNA, 21 bp, Homo sapiens
gaaggcaatttctctgcacac

SEQ ID NO: 1909912 - DNA, 18 bp, Homo sapiens
gaagtaaaagttaagatc

SEQ ID NO: 1909913 - DNA, 12 bp, Homo sapiens
gaagtagcacag

SEQ ID NO: 1909914 - DNA, 16 bp, Homo sapiens
gaagtgacggttccta

SEQ ID NO: 1909915 - DNA, 23 bp, Homo sapiens
gaagtgcatcctgattattttca

SEQ ID NO: 1909916 - DNA, 15 bp, Homo sapiens
gaagtgcatgggtca

SEQ ID NO: 1909917 - DNA, 21 bp, Homo sapiens
gaagtggtgacattttgcatg

SEQ ID NO: 1909918 - DNA, 20 bp, Homo sapiens
gaagttaaaagcacaaagga

SEQ ID NO: 1909919 - DNA, 15 bp, Homo sapiens
gaagttcaagatcaa

SEQ ID NO: 1909920 - DNA, 16 bp, Homo sapiens
gaataaaaattccaga

SEQ ID NO: 1909921 - DNA, 22 bp, Homo sapiens
gaataagccattctgactcata

SEQ ID NO: 1909922 - DNA, 17 bp, Homo sapiens
gaatactgcttgaataa

SEQ ID NO: 1909923 - DNA, 22 bp, Homo sapiens
gaatacttgaaccataaaatgt

SEQ ID NO: 1909924 - DNA, 24 bp, Homo sapiens
gaatactttgcagcacagctgaga

SEQ ID NO: 1909925 - DNA, 21 bp, Homo sapiens
gaatagaaatttgcccctggc

SEQ ID NO: 1909926 - DNA, 18 bp, Homo sapiens
gaatagaagctaaggttt

SEQ ID NO: 1909927 - DNA, 18 bp, Homo sapiens
gaatatgggagaaatagt

SEQ ID NO: 1909928 - DNA, 14 bp, Homo sapiens
gaatcacaggctgg

SEQ ID NO: 1909929 - DNA, 15 bp, Homo sapiens
gaatcacaggctggg

SEQ ID NO: 1909930 - DNA, 23 bp, Homo sapiens
gaatcatttgttcaaagctgttg

SEQ ID NO: 1909931 - DNA, 17 bp, Homo sapiens
gaatccctgtgttaatt

SEQ ID NO: 1909932 - DNA, 18 bp, Homo sapiens
gaatctagccagtgaaca

SEQ ID NO: 1909933 - DNA, 12 bp, Homo sapiens
gaatctattttt

SEQ ID NO: 1909934 - DNA, 23 bp, Homo sapiens
gaatctgataccaaagagacagg

SEQ ID NO: 1909935 - DNA, 16 bp, Homo sapiens
gaatctgatacttaga

SEQ ID NO: 1909936 - DNA, 22 bp, Homo sapiens
gaatctggaccccatctgtgaa

SEQ ID NO: 1909937 - DNA, 21 bp, Homo sapiens
aatcatgtacatttgaaaata

SEQ ID NO: 1909938 - DNA, 19 bp, Homo sapiens
aatccaggaccctgccagg

SEQ ID NO: 1909939 - DNA, 20 bp, Homo sapiens
aatccctgtgttaatttaag

SEQ ID NO: 1909940 - DNA, 21 bp, Homo sapiens
aatcctagtttgctgtggcct

SEQ ID NO: 1909941 - DNA, 21 bp, Homo sapiens
aatcgctttcctaaaacagta

SEQ ID NO: 1909942 - DNA, 18 bp, Homo sapiens
aatctgaattggaatgca

SEQ ID NO: 1909943 - DNA, 16 bp, Homo sapiens
aatctgataccaaaga

SEQ ID NO: 1909944 - DNA, 18 bp, Homo sapiens
aatctgccacctgcacag

SEQ ID NO: 1909945 - DNA, 16 bp, Homo sapiens
aatcttactttgtaaa

SEQ ID NO: 1909946 - DNA, 17 bp, Homo sapiens
aatcttactttgtaaat

SEQ ID NO: 1909947 - DNA, 18 bp, Homo sapiens
aatcttactttgtaaatt

SEQ ID NO: 1909948 - DNA, 20 bp, Homo sapiens
aatcttactttgtaaattct

SEQ ID NO: 1909949 - DNA, 14 bp, Homo sapiens
aatcttgtgaaaat

SEQ ID NO: 1909950 - DNA, 18 bp, Homo sapiens
acaggacaggggttcctt

SEQ ID NO: 1909951 - DNA, 15 bp, Homo sapiens
acaggacccctgcag

SEQ ID NO: 1909952 - DNA, 20 bp, Homo sapiens
acaggacccctgcagttccc

SEQ ID NO: 1909953 - DNA, 19 bp, Homo sapiens
acaggataaagatatcaat

SEQ ID NO: 1909954 - DNA, 23 bp, Homo sapiens
acaggcagggcaggaccagccca

SEQ ID NO: 1909955 - DNA, 22 bp, Homo sapiens
acaggccctcctccctcccagc

SEQ ID NO: 1909956 - DNA, 15 bp, Homo sapiens
acaggctgagtgcag

SEQ ID NO: 1909957 - DNA, 20 bp, Homo sapiens
acaggctgagtgcaggccca

SEQ ID NO: 1909958 - DNA, 19 bp, Homo sapiens
acagggcctggcccatgta

SEQ ID NO: 1909959 - DNA, 12 bp, Homo sapiens
acaggggttcct

SEQ ID NO: 1909960 - DNA, 19 bp, Homo sapiens
acagggtctctagtgctgt

SEQ ID NO: 1909961 - DNA, 15 bp, Homo sapiens
acaggttccttttaa

SEQ ID NO: 1909962 - DNA, 22 bp, Homo sapiens
acaggttccttttaagtggact

SEQ ID NO: 1909963 - DNA, 12 bp, Homo sapiens
acagtaaacatt

SEQ ID NO: 1909964 - DNA, 22 bp, Homo sapiens
acagtacccctctagctttgtt

SEQ ID NO: 1909965 - DNA, 15 bp, Homo sapiens
acagtcaccaagtgt

SEQ ID NO: 1909966 - DNA, 20 bp, Homo sapiens
acagtgtactttgttaaaaa

SEQ ID NO: 1909967 - DNA, 12 bp, Homo sapiens
acagttgtttga

SEQ ID NO: 1909968 - DNA, 15 bp, Homo sapiens
acagttgtttgatgc

SEQ ID NO: 1909969 - DNA, 14 bp, Homo sapiens
acagttttcttcat

SEQ ID NO: 1909970 - DNA, 13 bp, Homo sapiens
acataactgataa

SEQ ID NO: 1909971 - DNA, 14 bp, Homo sapiens
acataatactgaac

SEQ ID NO: 1909972 - DNA, 16 bp, Homo sapiens
acataatactgaacca

SEQ ID NO: 1909973 - DNA, 13 bp, Homo sapiens
acataattcttat

SEQ ID NO: 1909974 - DNA, 12 bp, Homo sapiens
acatagaaagtt

SEQ ID NO: 1909975 - DNA, 21 bp, Homo sapiens
acataggcttatacaaattta

SEQ ID NO: 1909976 - DNA, 16 bp, Homo sapiens
acatataaattgtctt

SEQ ID NO: 1909977 - DNA, 23 bp, Homo sapiens
acatcaaataattgaagagacaa

SEQ ID NO: 1909978 - DNA, 21 bp, Homo sapiens
acatcacagggcctcagtttc

SEQ ID NO: 1909979 - DNA, 14 bp, Homo sapiens
acatcactggcatg

SEQ ID NO: 1909980 - DNA, 19 bp, Homo sapiens
acatccatcgtaattgttc

SEQ ID NO: 1909981 - DNA, 12 bp, Homo sapiens
acatcccctgct

SEQ ID NO: 1909982 - DNA, 16 bp, Homo sapiens
acatctttctttttaa

SEQ ID NO: 1909983 - DNA, 18 bp, Homo sapiens
acatgagcttacattctt

SEQ ID NO: 1909984 - DNA, 18 bp, Homo sapiens
acatgcattcacatatct

SEQ ID NO: 1909985 - DNA, 17 bp, Homo sapiens
acatgcctcctcctgcc

SEQ ID NO: 1909986 - DNA, 19 bp, Homo sapiens
acatgcctcctcctgccct

SEQ ID NO: 1909987 - DNA, 17 bp, Homo sapiens
acatgggactatgcttt

SEQ ID NO: 1909988 - DNA, 20 bp, Homo sapiens
acatgggactatgcttttct

SEQ ID NO: 1909989 - DNA, 15 bp, Homo sapiens
acatgtaatttgtgt

SEQ ID NO: 1909990 - DNA, 21 bp, Homo sapiens
acattcgttctctaaccattc

SEQ ID NO: 1909991 - DNA, 14 bp, Homo sapiens
acattggcataatt

SEQ ID NO: 1909992 - DNA, 16 bp, Homo sapiens
acattggtaagaatga

SEQ ID NO: 1909993 - DNA, 22 bp, Homo sapiens
acattggttctttcatttgctt

SEQ ID NO: 1909994 - DNA, 11 bp, Homo sapiens
acattgtgaat

SEQ ID NO: 1909995 - DNA, 13 bp, Homo sapiens
acatttaaagaca

SEQ ID NO: 1909996 - DNA, 22 bp, Homo sapiens
acattttagaatgtcaataaat

SEQ ID NO: 1909997 - DNA, 13 bp, Homo sapiens
accaaaataagaa

SEQ ID NO: 1909998 - DNA, 18 bp, Homo sapiens
accaaaataagaaaagat

SEQ ID NO: 1909999 - DNA, 19 bp, Homo sapiens
accaaacccaccctttcta

SEQ ID NO: 1910000 - DNA, 14 bp, Homo sapiens
accaaaccttctga

SEQ ID NO: 1910001 - DNA, 15 bp, Homo sapiens
accaagtgtattgta

SEQ ID NO: 1910002 - DNA, 13 bp, Homo sapiens
accaatcaataat

SEQ ID NO: 1910003 - DNA, 15 bp, Homo sapiens
accaatcttactttg

SEQ ID NO: 1910004 - DNA, 19 bp, Homo sapiens
accaatcttactttgtaaa

SEQ ID NO: 1910005 - DNA, 23 bp, Homo sapiens
accaatcttactttgtaaattct

SEQ ID NO: 1910006 - DNA, 16 bp, Homo sapiens
accacaagtatctaaa

SEQ ID NO: 1910007 - DNA, 21 bp, Homo sapiens
accacaagtatctaaatttgg

SEQ ID NO: 1910008 - DNA, 17 bp, Homo sapiens
accacagcctccccttc

SEQ ID NO: 1910009 - DNA, 22 bp, Homo sapiens
accacagcctccccttcccaga

SEQ ID NO: 1910010 - DNA, 15 bp, Homo sapiens
accacgaatgaggta

SEQ ID NO: 1910011 - DNA, 18 bp, Homo sapiens
accactacagtaagctgg

SEQ ID NO: 1910012 - DNA, 16 bp, Homo sapiens
accacttgtagatttg

SEQ ID NO: 1910013 - DNA, 20 bp, Homo sapiens
accagaagacaaaggcccaa

SEQ ID NO: 1910014 - DNA, 18 bp, Homo sapiens
accagacttttttaaaca

SEQ ID NO: 1910015 - DNA, 11 bp, Homo sapiens
accagcaggca

SEQ ID NO: 1910016 - DNA, 13 bp, Homo sapiens
accagcaggctcc

SEQ ID NO: 1910017 - DNA, 15 bp, Homo sapiens
accagcaggctcctc

SEQ ID NO: 1910018 - DNA, 18 bp, Homo sapiens
accagcaggctcctcagc

SEQ ID NO: 1910019 - DNA, 21 bp, Homo sapiens
accagcaggctcctcagccct

SEQ ID NO: 1910020 - DNA, 19 bp, Homo sapiens
accagccagggaaagactg

SEQ ID NO: 1910021 - DNA, 11 bp, Homo sapiens
accagcccacg

SEQ ID NO: 1910022 - DNA, 14 bp, Homo sapiens
accagcgcccccac

SEQ ID NO: 1910023 - DNA, 19 bp, Homo sapiens
accagcgcccccactcctc

SEQ ID NO: 1910024 - DNA, 19 bp, Homo sapiens
accaggaagaaggacttgt

SEQ ID NO: 1910025 - DNA, 11 bp, Homo sapiens
accagttttga

SEQ ID NO: 1910026 - DNA, 20 bp, Homo sapiens
accatgctgtctggcacagc

SEQ ID NO: 1910027 - DNA, 22 bp, Homo sapiens
accatgctgtctggcacagcct

SEQ ID NO: 1910028 - DNA, 23 bp, Homo sapiens
accatgctgtctggcacagcctg

SEQ ID NO: 1910029 - DNA, 20 bp, Homo sapiens
accatgttggccaggctgct

SEQ ID NO: 1910030 - DNA, 16 bp, Homo sapiens
accatttccccagggc

SEQ ID NO: 1910031 - DNA, 17 bp, Homo sapiens
acccaacagcctctgtg

SEQ ID NO: 1910032 - DNA, 19 bp, Homo sapiens
acccaagtggatattttct

SEQ ID NO: 1910033 - DNA, 21 bp, Homo sapiens
acccaccctttctacttccaa

SEQ ID NO: 1910034 - DNA, 18 bp, Homo sapiens
acccagacctgcctgtct

SEQ ID NO: 1910035 - DNA, 13 bp, Homo sapiens
acccagtggcagg

SEQ ID NO: 1910036 - DNA, 14 bp, Homo sapiens
acccagtggcaggg

SEQ ID NO: 1910037 - DNA, 16 bp, Homo sapiens
acccagtggcagggca

SEQ ID NO: 1910038 - DNA, 18 bp, Homo sapiens
acccagtggcagggcaca

SEQ ID NO: 1910039 - DNA, 20 bp, Homo sapiens
acccagtggcagggcacagg

SEQ ID NO: 1910040 - DNA, 20 bp, Homo sapiens
acccagtttcctttcttagc

SEQ ID NO: 1910041 - DNA, 22 bp, Homo sapiens
acccatgaaagaaaacttttat

SEQ ID NO: 1910042 - DNA, 18 bp, Homo sapiens
acccatgggcaggagact

SEQ ID NO: 1910043 - DNA, 14 bp, Homo sapiens
acccattgcagacc

SEQ ID NO: 1910044 - DNA, 16 bp, Homo sapiens
acccattgcagaccct

SEQ ID NO: 1910045 - DNA, 20 bp, Homo sapiens
accccaaacaaatggaagag

SEQ ID NO: 1910046 - DNA, 19 bp, Homo sapiens
accccaagcgccctggccc

SEQ ID NO: 1910047 - DNA, 21 bp, Homo sapiens
accccagcctcaaatccagga

SEQ ID NO: 1910048 - DNA, 15 bp, Homo sapiens
accccatctgtgaat

SEQ ID NO: 1910049 - DNA, 18 bp, Homo sapiens
acccccttttttatataa

SEQ ID NO: 1910050 - DNA, 22 bp, Homo sapiens
accccgcaagcaccatcccctc

SEQ ID NO: 1910051 - DNA, 15 bp, Homo sapiens
acccctcactttccc

SEQ ID NO: 1910052 - DNA, 14 bp, Homo sapiens
acccctcgcccagt

SEQ ID NO: 1910053 - DNA, 18 bp, Homo sapiens
acccctcgcccagtccca

SEQ ID NO: 1910054 - DNA, 19 bp, Homo sapiens
accctgatcacctcagggc

SEQ ID NO: 1910055 - DNA, 14 bp, Homo sapiens
accctgccaggcac

SEQ ID NO: 1910056 - DNA, 16 bp, Homo sapiens
accctgccaggcacag

SEQ ID NO: 1910057 - DNA, 18 bp, Homo sapiens
accctgccaggcacaggc

SEQ ID NO: 1910058 - DNA, 23 bp, Homo sapiens
accctgccaggcacaggcagggc

SEQ ID NO: 1910059 - DNA, 23 bp, Homo sapiens
accctgtacatatctttgagttc

SEQ ID NO: 1910060 - DNA, 23 bp, Homo sapiens
acttggaagcacaccaatcttac

SEQ ID NO: 1910061 - DNA, 21 bp, Homo sapiens
acttggatcagatagcaggag

SEQ ID NO: 1910062 - DNA, 17 bp, Homo sapiens
acttgggggctcagcaa

SEQ ID NO: 1910063 - DNA, 15 bp, Homo sapiens
acttgtagatttgat

SEQ ID NO: 1910064 - DNA, 16 bp, Homo sapiens
acttgtagatttgatt

SEQ ID NO: 1910065 - DNA, 22 bp, Homo sapiens
acttgtatattctattttacaa

SEQ ID NO: 1910066 - DNA, 17 bp, Homo sapiens
acttgtcccaagtctga

SEQ ID NO: 1910067 - DNA, 16 bp, Homo sapiens
actttattagcagctg

SEQ ID NO: 1910068 - DNA, 21 bp, Homo sapiens
actttcaaagtggatgcaatt

SEQ ID NO: 1910069 - DNA, 22 bp, Homo sapiens
actttcatattttaaacagagg

SEQ ID NO: 1910070 - DNA, 22 bp, Homo sapiens
actttctgaaaatttatataac

SEQ ID NO: 1910071 - DNA, 11 bp, Homo sapiens
actttgaaaac

SEQ ID NO: 1910072 - DNA, 14 bp, Homo sapiens
actttgaaatattt

SEQ ID NO: 1910073 - DNA, 16 bp, Homo sapiens
actttgaatttatata

SEQ ID NO: 1910074 - DNA, 21 bp, Homo sapiens
actttgaatttatataaagta

SEQ ID NO: 1910075 - DNA, 20 bp, Homo sapiens
actttgacaggttcctttta

SEQ ID NO: 1910076 - DNA, 21 bp, Homo sapiens
actttgacaggttccttttaa

SEQ ID NO: 1910077 - DNA, 16 bp, Homo sapiens
actttgatgtcagcag

SEQ ID NO: 1910078 - DNA, 17 bp, Homo sapiens
actttgatgtcagcagt

SEQ ID NO: 1910079 - DNA, 14 bp, Homo sapiens
actttgtagacatt

SEQ ID NO: 1910080 - DNA, 15 bp, Homo sapiens
actttgtagacattt

SEQ ID NO: 1910081 - DNA, 14 bp, Homo sapiens
actttgtatagtta

SEQ ID NO: 1910082 - DNA, 21 bp, Homo sapiens
actttgtatagttatgtaaat

SEQ ID NO: 1910083 - DNA, 15 bp, Homo sapiens
actttgtattgtcct

SEQ ID NO: 1910084 - DNA, 22 bp, Homo sapiens
acttttagatgtggttaatttt

SEQ ID NO: 1910085 - DNA, 13 bp, Homo sapiens
acttttttcaaaa

SEQ ID NO: 1910086 - DNA, 16 bp, Homo sapiens
agaaaaaaaaagaaaa

SEQ ID NO: 1910087 - DNA, 20 bp, Homo sapiens
agaaaaaaatgtcaaaagta

SEQ ID NO: 1910088 - DNA, 14 bp, Homo sapiens
agaaaaaatattgt

SEQ ID NO: 1910089 - DNA, 18 bp, Homo sapiens
agaaaaatatctgtaaga

SEQ ID NO: 1910090 - DNA, 17 bp, Homo sapiens
agaaaagaaaaaaaaag

SEQ ID NO: 1910091 - DNA, 18 bp, Homo sapiens
agaaaataaaaaaaagaa

SEQ ID NO: 1910092 - DNA, 20 bp, Homo sapiens
agaaaataaaaaaaagaaaa

SEQ ID NO: 1910093 - DNA, 23 bp, Homo sapiens
agaaaatctgaattggaatgcac

SEQ ID NO: 1910094 - DNA, 16 bp, Homo sapiens
agaaacagctatgaga

SEQ ID NO: 1910095 - DNA, 19 bp, Homo sapiens
agaaactctatggtcttat

SEQ ID NO: 1910096 - DNA, 13 bp, Homo sapiens
agaaatactgtac

SEQ ID NO: 1910097 - DNA, 17 bp, Homo sapiens
agaaatcttaagtcata

SEQ ID NO: 1910098 - DNA, 19 bp, Homo sapiens
agaaattgtccttgaagct

SEQ ID NO: 1910099 - DNA, 22 bp, Homo sapiens
agaaattgtccttgaagcttgt

SEQ ID NO: 1910100 - DNA, 23 bp, Homo sapiens
agaaattgtccttgaagcttgta

SEQ ID NO: 1910101 - DNA, 12 bp, Homo sapiens
agaaatttgccc

SEQ ID NO: 1910102 - DNA, 14 bp, Homo sapiens
agaacattaggccc

SEQ ID NO: 1910103 - DNA, 16 bp, Homo sapiens
agaacattaggcccca

SEQ ID NO: 1910104 - DNA, 18 bp, Homo sapiens
agaacattaggccccagc

SEQ ID NO: 1910105 - DNA, 20 bp, Homo sapiens
agaactgaaaggcttttcaa

SEQ ID NO: 1910106 - DNA, 15 bp, Homo sapiens
agaactttgtatagt

SEQ ID NO: 1910107 - DNA, 16 bp, Homo sapiens
agaagacaaaggccca

SEQ ID NO: 1910108 - DNA, 12 bp, Homo sapiens
agaagagaaagg

SEQ ID NO: 1910109 - DNA, 21 bp, Homo sapiens
agaagagagtagctcgtcctc

SEQ ID NO: 1910110 - DNA, 13 bp, Homo sapiens
agaagagccccac

SEQ ID NO: 1910111 - DNA, 22 bp, Homo sapiens
agaagagccccactctcagagg

SEQ ID NO: 1910112 - DNA, 15 bp, Homo sapiens
agaagcatctctgac

SEQ ID NO: 1910113 - DNA, 24 bp, Homo sapiens
agaagccaagggggacctcgggct

SEQ ID NO: 1910114 - DNA, 13 bp, Homo sapiens
agaagctgatgag

SEQ ID NO: 1910115 - DNA, 17 bp, Homo sapiens
agaagctgatgaggaat

SEQ ID NO: 1910116 - DNA, 20 bp, Homo sapiens
agaaggggactgccacctcc

SEQ ID NO: 1910117 - DNA, 18 bp, Homo sapiens
agaagtaggggaagaata

SEQ ID NO: 1910118 - DNA, 23 bp, Homo sapiens
agaagtgacggttcctacacagg

SEQ ID NO: 1910119 - DNA, 15 bp, Homo sapiens
agaataatttggtat

SEQ ID NO: 1910120 - DNA, 14 bp, Homo sapiens
agaatactgatgga

SEQ ID NO: 1910121 - DNA, 15 bp, Homo sapiens
agaatactgatggaa

SEQ ID NO: 1910122 - DNA, 16 bp, Homo sapiens
agaatagaaatttgcc

SEQ ID NO: 1910123 - DNA, 13 bp, Homo sapiens
agaatcacaggct

SEQ ID NO: 1910124 - DNA, 17 bp, Homo sapiens
agaatccctgtgttaat

SEQ ID NO: 1910125 - DNA, 18 bp, Homo sapiens
agaatccctgtgttaatt

SEQ ID NO: 1910126 - DNA, 22 bp, Homo sapiens
agaatgaacaaagaccaatttt

SEQ ID NO: 1910127 - DNA, 18 bp, Homo sapiens
agaatgcaccatactcat

SEQ ID NO: 1910128 - DNA, 20 bp, Homo sapiens
agaatgtcaataaatttgct

SEQ ID NO: 1910129 - DNA, 12 bp, Homo sapiens
agaattgaaggt

SEQ ID NO: 1910130 - DNA, 15 bp, Homo sapiens
agaattgaaggtttt

SEQ ID NO: 1910131 - DNA, 18 bp, Homo sapiens
agaattgaaggtttttga

SEQ ID NO: 1910132 - DNA, 21 bp, Homo sapiens
agaatttaaagaaaaaaatgt

SEQ ID NO: 1910133 - DNA, 17 bp, Homo sapiens
agacaccacagcctccc

SEQ ID NO: 1910134 - DNA, 19 bp, Homo sapiens
agacaccacagcctcccct

SEQ ID NO: 1910135 - DNA, 21 bp, Homo sapiens
agacagacaccacagcctccc

SEQ ID NO: 1910136 - DNA, 11 bp, Homo sapiens
agacagaccac

SEQ ID NO: 1910137 - DNA, 20 bp, Homo sapiens
agacagagcaacccctggac

SEQ ID NO: 1910138 - DNA, 20 bp, Homo sapiens
agacaggcaggtgatctgct

SEQ ID NO: 1910139 - DNA, 23 bp, Homo sapiens
agacagggcccgggcccaggcag

SEQ ID NO: 1910140 - DNA, 22 bp, Homo sapiens
agacaggggtctcgggggtggg

SEQ ID NO: 1910141 - DNA, 18 bp, Homo sapiens
agacatcaagctcaaggc

SEQ ID NO: 1910142 - DNA, 17 bp, Homo sapiens
agacatgtaatttgtgt

SEQ ID NO: 1910143 - DNA, 16 bp, Homo sapiens
agacatttcaaataac

SEQ ID NO: 1910144 - DNA, 20 bp, Homo sapiens
agacattttcagacattttt

SEQ ID NO: 1910145 - DNA, 14 bp, Homo sapiens
agacattttgaaat

SEQ ID NO: 1910146 - DNA, 14 bp, Homo sapiens
agaccatcctggct

SEQ ID NO: 1910147 - DNA, 19 bp, Homo sapiens
agaccccgcagcacgcctc

SEQ ID NO: 1910148 - DNA, 21 bp, Homo sapiens
agaccccgcagcacgcctctc

SEQ ID NO: 1910149 - DNA, 17 bp, Homo sapiens
agaccgaactgttgtat

SEQ ID NO: 1910150 - DNA, 20 bp, Homo sapiens
agaccgaactgttgtataaa

SEQ ID NO: 1910151 - DNA, 19 bp, Homo sapiens
agaccgtgaagatactttg

SEQ ID NO: 1910152 - DNA, 20 bp, Homo sapiens
agaccgtgaagatactttgt

SEQ ID NO: 1910153 - DNA, 12 bp, Homo sapiens
agacctgcctgt

SEQ ID NO: 1910154 - DNA, 14 bp, Homo sapiens
agacggaacagtgt

SEQ ID NO: 1910155 - DNA, 14 bp, Homo sapiens
agactcaaaacact

SEQ ID NO: 1910156 - DNA, 17 bp, Homo sapiens
acacttcagttatcttg

SEQ ID NO: 1910157 - DNA, 22 bp, Homo sapiens
acagacaccacagcctcccctt

SEQ ID NO: 1910158 - DNA, 13 bp, Homo sapiens
acagacaggaccc

SEQ ID NO: 1910159 - DNA, 18 bp, Homo sapiens
acagacaggacccctgca

SEQ ID NO: 1910160 - DNA, 15 bp, Homo sapiens
acagagctaaggcca

SEQ ID NO: 1910161 - DNA, 12 bp, Homo sapiens
acagaggctgtg

SEQ ID NO: 1910162 - DNA, 17 bp, Homo sapiens
acagaggctgtggtcag

SEQ ID NO: 1910163 - DNA, 19 bp, Homo sapiens
acagaggctgtggtcagag

SEQ ID NO: 1910164 - DNA, 14 bp, Homo sapiens
acagatatgcaaat

SEQ ID NO: 1910165 - DNA, 18 bp, Homo sapiens
acagatgttttccactga

SEQ ID NO: 1910166 - DNA, 16 bp, Homo sapiens
acagcagtttcaggta

SEQ ID NO: 1910167 - DNA, 17 bp, Homo sapiens
acagcatttgtgtgtta

SEQ ID NO: 1910168 - DNA, 23 bp, Homo sapiens
acagcatttgtgtgttacaatgt

SEQ ID NO: 1910169 - DNA, 13 bp, Homo sapiens
acagcctcccctt

SEQ ID NO: 1910170 - DNA, 15 bp, Homo sapiens
acagcctccccttcc

SEQ ID NO: 1910171 - DNA, 16 bp, Homo sapiens
acagcctccccttccc

SEQ ID NO: 1910172 - DNA, 17 bp, Homo sapiens
acagcctccccttccca

SEQ ID NO: 1910173 - DNA, 19 bp, Homo sapiens
acagcctccccttcccaga

SEQ ID NO: 1910174 - DNA, 12 bp, Homo sapiens
acagcctgcctc

SEQ ID NO: 1910175 - DNA, 15 bp, Homo sapiens
acagcctgcctctgc

SEQ ID NO: 1910176 - DNA, 18 bp, Homo sapiens
acctgtatcaaactgctt

SEQ ID NO: 1910177 - DNA, 12 bp, Homo sapiens
accttcaagctg

SEQ ID NO: 1910178 - DNA, 17 bp, Homo sapiens
accttctatagcatcac

SEQ ID NO: 1910179 - DNA, 13 bp, Homo sapiens
accttctgacttt

SEQ ID NO: 1910180 - DNA, 15 bp, Homo sapiens
accttcttgggactg

SEQ ID NO: 1910181 - DNA, 17 bp, Homo sapiens
accttggcttggccctg

SEQ ID NO: 1910182 - DNA, 11 bp, Homo sapiens
accttgtattg

SEQ ID NO: 1910183 - DNA, 17 bp, Homo sapiens
acctttgctgtagtgtt

SEQ ID NO: 1910184 - DNA, 18 bp, Homo sapiens
acgatcacaaatgacttt

SEQ ID NO: 1910185 - DNA, 11 bp, Homo sapiens
acgcaattctc

SEQ ID NO: 1910186 - DNA, 15 bp, Homo sapiens
acgcaccagcccaga

SEQ ID NO: 1910187 - DNA, 15 bp, Homo sapiens
acgcccacttccctg

SEQ ID NO: 1910188 - DNA, 17 bp, Homo sapiens
acgcctagcctcacgct

SEQ ID NO: 1910189 - DNA, 11 bp, Homo sapiens
acgcctctccc

SEQ ID NO: 1910190 - DNA, 14 bp, Homo sapiens
acgcctctccccac

SEQ ID NO: 1910191 - DNA, 19 bp, Homo sapiens
acgcctctccccaccttct

SEQ ID NO: 1910192 - DNA, 16 bp, Homo sapiens
acgcctgtaaatgtat

SEQ ID NO: 1910193 - DNA, 14 bp, Homo sapiens
acgctcctttctga

SEQ ID NO: 1910194 - DNA, 13 bp, Homo sapiens
acgcttaaggtgg

SEQ ID NO: 1910195 - DNA, 23 bp, Homo sapiens
acggatcctgcactgactctgga

SEQ ID NO: 1910196 - DNA, 14 bp, Homo sapiens
acggcaagaaggca

SEQ ID NO: 1910197 - DNA, 12 bp, Homo sapiens
acgtaatcaaat

SEQ ID NO: 1910198 - DNA, 15 bp, Homo sapiens
acgtacaagtagttc

SEQ ID NO: 1910199 - DNA, 19 bp, Homo sapiens
acgtacaagtagttctgta

SEQ ID NO: 1910200 - DNA, 22 bp, Homo sapiens
acgtctatttcatcagaacagc

SEQ ID NO: 1910201 - DNA, 23 bp, Homo sapiens
acgtctgccaccagcgcccccac

SEQ ID NO: 1910202 - DNA, 22 bp, Homo sapiens
acgtggtgacctcacacacctc

SEQ ID NO: 1910203 - DNA, 18 bp, Homo sapiens
acgtgtcagggctgagtg

SEQ ID NO: 1910204 - DNA, 22 bp, Homo sapiens
acgtttattaggaaaagatatt

SEQ ID NO: 1910205 - DNA, 18 bp, Homo sapiens
acgttttctactttgaaa

SEQ ID NO: 1910206 - DNA, 20 bp, Homo sapiens
actaaaataattttgtaatg

SEQ ID NO: 1910207 - DNA, 20 bp, Homo sapiens
actaacaaagttttcatgtg

SEQ ID NO: 1910208 - DNA, 21 bp, Homo sapiens
actaatgttttggtctgaaaa

SEQ ID NO: 1910209 - DNA, 18 bp, Homo sapiens
actacagggccgccggca

SEQ ID NO: 1910210 - DNA, 22 bp, Homo sapiens
actacctgtaatgacaggcctg

SEQ ID NO: 1910211 - DNA, 18 bp, Homo sapiens
actaggattataatgctg

SEQ ID NO: 1910212 - DNA, 13 bp, Homo sapiens
actataaaatctg

SEQ ID NO: 1910213 - DNA, 19 bp, Homo sapiens
actatgatttaatttgaaa

SEQ ID NO: 1910214 - DNA, 22 bp, Homo sapiens
actcacagccagcgaactgaca

SEQ ID NO: 1910215 - DNA, 19 bp, Homo sapiens
actcccaggaccctgtgcc

SEQ ID NO: 1910216 - DNA, 12 bp, Homo sapiens
actcccatggct

SEQ ID NO: 1910217 - DNA, 14 bp, Homo sapiens
actcccatggctct

SEQ ID NO: 1910218 - DNA, 22 bp, Homo sapiens
actcccgtgtaggaacctgcac

SEQ ID NO: 1910219 - DNA, 14 bp, Homo sapiens
actcgagtctgagg

SEQ ID NO: 1910220 - DNA, 15 bp, Homo sapiens
actcgagtctgaggc

SEQ ID NO: 1910221 - DNA, 22 bp, Homo sapiens
actcggatgtgtcctttctgaa

SEQ ID NO: 1910222 - DNA, 16 bp, Homo sapiens
actctacatgcttgtt

SEQ ID NO: 1910223 - DNA, 14 bp, Homo sapiens
actctcagaggccc

SEQ ID NO: 1910224 - DNA, 17 bp, Homo sapiens
actctcagaggccccaa

SEQ ID NO: 1910225 - DNA, 21 bp, Homo sapiens
actctctctcttttccctcct

SEQ ID NO: 1910226 - DNA, 14 bp, Homo sapiens
actctctgacaaag

SEQ ID NO: 1910227 - DNA, 12 bp, Homo sapiens
actctcttcctt

SEQ ID NO: 1910228 - DNA, 23 bp, Homo sapiens
actctgcactgaatggctgacct

SEQ ID NO: 1910229 - DNA, 14 bp, Homo sapiens
actctgccagggtg

SEQ ID NO: 1910230 - DNA, 12 bp, Homo sapiens
actctggaaaag

SEQ ID NO: 1910231 - DNA, 17 bp, Homo sapiens
actctggaaaaggcata

SEQ ID NO: 1910232 - DNA, 22 bp, Homo sapiens
actctggggctggcaccagcag

SEQ ID NO: 1910233 - DNA, 23 bp, Homo sapiens
actctggggctggcaccagcagg

SEQ ID NO: 1910234 - DNA, 14 bp, Homo sapiens
actctgtctggcca

SEQ ID NO: 1910235 - DNA, 16 bp, Homo sapiens
actctgtctggccagg

SEQ ID NO: 1910236 - DNA, 17 bp, Homo sapiens
actctgtctggccaggg

SEQ ID NO: 1910237 - DNA, 20 bp, Homo sapiens
actcttgagttgtttttgta

SEQ ID NO: 1910238 - DNA, 21 bp, Homo sapiens
actcttgagttgtttttgtat

SEQ ID NO: 1910239 - DNA, 18 bp, Homo sapiens
actgaaccacttgtagat

SEQ ID NO: 1910240 - DNA, 20 bp, Homo sapiens
actgaaccacttgtagattt

SEQ ID NO: 1910241 - DNA, 21 bp, Homo sapiens
actgaaccacttgtagatttg

SEQ ID NO: 1910242 - DNA, 15 bp, Homo sapiens
actgactgaggcagt

SEQ ID NO: 1910243 - DNA, 21 bp, Homo sapiens
actgactgaggcagtttgagg

SEQ ID NO: 1910244 - DNA, 15 bp, Homo sapiens
actgactgcttataa

SEQ ID NO: 1910245 - DNA, 20 bp, Homo sapiens
actgaggcagtttgaggatt

SEQ ID NO: 1910246 - DNA, 21 bp, Homo sapiens
actgaggcctaaaagtaaaca

SEQ ID NO: 1910247 - DNA, 15 bp, Homo sapiens
actgataattttaaa

SEQ ID NO: 1910248 - DNA, 19 bp, Homo sapiens
actgataattttaaaatgt

SEQ ID NO: 1910249 - DNA, 12 bp, Homo sapiens
actgatggaatt

SEQ ID NO: 1910250 - DNA, 23 bp, Homo sapiens
actgatggaatttttttgtacga

SEQ ID NO: 1910251 - DNA, 23 bp, Homo sapiens
actgattacgtttacattcttct

SEQ ID NO: 1910252 - DNA, 14 bp, Homo sapiens
actgcacgttttca

SEQ ID NO: 1910253 - DNA, 22 bp, Homo sapiens
actgcagcctccgcttccctgg

SEQ ID NO: 1910254 - DNA, 14 bp, Homo sapiens
actgcatttaggga

SEQ ID NO: 1910255 - DNA, 12 bp, Homo sapiens
actgccacctcc

SEQ ID NO: 1910256 - DNA, 17 bp, Homo sapiens
actgccagctcttccta

SEQ ID NO: 1910257 - DNA, 13 bp, Homo sapiens
actgcctgcctta

SEQ ID NO: 1910258 - DNA, 15 bp, Homo sapiens
actgcctgccttaag

SEQ ID NO: 1910259 - DNA, 18 bp, Homo sapiens
actgcctgccttaagtga

SEQ ID NO: 1910260 - DNA, 19 bp, Homo sapiens
actgctagtcttaagaact

SEQ ID NO: 1910261 - DNA, 13 bp, Homo sapiens
actgctcctgagc

SEQ ID NO: 1910262 - DNA, 19 bp, Homo sapiens
actgctcctgagcccccag

SEQ ID NO: 1910263 - DNA, 20 bp, Homo sapiens
actgctcctgagcccccagc

SEQ ID NO: 1910264 - DNA, 21 bp, Homo sapiens
actgctcctgagcccccagct

SEQ ID NO: 1910265 - DNA, 22 bp, Homo sapiens
actgctcctgagcccccagctt

SEQ ID NO: 1910266 - DNA, 21 bp, Homo sapiens
actgctctcaccttggttcct

SEQ ID NO: 1910267 - DNA, 13 bp, Homo sapiens
actgctgctgacc

SEQ ID NO: 1910268 - DNA, 18 bp, Homo sapiens
actgcttcctataatttt

SEQ ID NO: 1910269 - DNA, 21 bp, Homo sapiens
actgcttcctataattttgat

SEQ ID NO: 1910270 - DNA, 22 bp, Homo sapiens
actgcttcctataattttgata

SEQ ID NO: 1910271 - DNA, 15 bp, Homo sapiens
actgcttgacaaagg

SEQ ID NO: 1910272 - DNA, 16 bp, Homo sapiens
actgcttgacaaagga

SEQ ID NO: 1910273 - DNA, 12 bp, Homo sapiens
actgctttctga

SEQ ID NO: 1910274 - DNA, 14 bp, Homo sapiens
actggcaagaaaag

SEQ ID NO: 1910275 - DNA, 13 bp, Homo sapiens
actggccaaggct

SEQ ID NO: 1910276 - DNA, 16 bp, Homo sapiens
actggccacagttgtt

SEQ ID NO: 1910277 - DNA, 20 bp, Homo sapiens
actgggggacactgtggcag

SEQ ID NO: 1910278 - DNA, 20 bp, Homo sapiens
actgtatagctcttttccta

SEQ ID NO: 1910279 - DNA, 17 bp, Homo sapiens
agtgtgaccagttttga

SEQ ID NO: 1910280 - DNA, 13 bp, Homo sapiens
agtgtggaaagca

SEQ ID NO: 1910281 - DNA, 19 bp, Homo sapiens
agtgtggaaattaagaaga

SEQ ID NO: 1910282 - DNA, 23 bp, Homo sapiens
agtgtggggtgtgtgcagggctg

SEQ ID NO: 1910283 - DNA, 12 bp, Homo sapiens
agtgttaagata

SEQ ID NO: 1910284 - DNA, 12 bp, Homo sapiens
agtgttcattgc

SEQ ID NO: 1910285 - DNA, 16 bp, Homo sapiens
agtgttcattgcacaa

SEQ ID NO: 1910286 - DNA, 12 bp, Homo sapiens
agtgtttaaatg

SEQ ID NO: 1910287 - DNA, 21 bp, Homo sapiens
agttaagttggtaaagtattt

SEQ ID NO: 1910288 - DNA, 16 bp, Homo sapiens
agttaccagtgcctta

SEQ ID NO: 1910289 - DNA, 19 bp, Homo sapiens
agttagttccactgagacc

SEQ ID NO: 1910290 - DNA, 14 bp, Homo sapiens
agttatgtaaataa

SEQ ID NO: 1910291 - DNA, 14 bp, Homo sapiens
agttcaagaaatga

SEQ ID NO: 1910292 - DNA, 17 bp, Homo sapiens
agttcaagaaatgaaga

SEQ ID NO: 1910293 - DNA, 18 bp, Homo sapiens
agttcaagaaatgaagag

SEQ ID NO: 1910294 - DNA, 14 bp, Homo sapiens
agttccttctatac

SEQ ID NO: 1910295 - DNA, 15 bp, Homo sapiens
agttctgactttgaa

SEQ ID NO: 1910296 - DNA, 16 bp, Homo sapiens
agttctgactttgaat

SEQ ID NO: 1910297 - DNA, 18 bp, Homo sapiens
agttctgactttgaattt

SEQ ID NO: 1910298 - DNA, 15 bp, Homo sapiens
agttctgtatttgaa

SEQ ID NO: 1910299 - DNA, 18 bp, Homo sapiens
agttctgtatttgaaagt

SEQ ID NO: 1910300 - DNA, 21 bp, Homo sapiens
agttctgtatttgaaagtgcc

SEQ ID NO: 1910301 - DNA, 23 bp, Homo sapiens
agttctgtatttgaaagtgcctt

SEQ ID NO: 1910302 - DNA, 15 bp, Homo sapiens
agttgaatacttgaa

SEQ ID NO: 1910303 - DNA, 19 bp, Homo sapiens
agttgaatacttgaaccat

SEQ ID NO: 1910304 - DNA, 18 bp, Homo sapiens
agttgactagaatcgaca

SEQ ID NO: 1910305 - DNA, 15 bp, Homo sapiens
agttgagctatgact

SEQ ID NO: 1910306 - DNA, 15 bp, Homo sapiens
agttgctggtaaaat

SEQ ID NO: 1910307 - DNA, 15 bp, Homo sapiens
agttgctgtcacaaa

SEQ ID NO: 1910308 - DNA, 18 bp, Homo sapiens
agttggaagcggtttgca

SEQ ID NO: 1910309 - DNA, 21 bp, Homo sapiens
agttgtaggcgaatcatttgt

SEQ ID NO: 1910310 - DNA, 22 bp, Homo sapiens
agttgtaggcgaatcatttgtt

SEQ ID NO: 1910311 - DNA, 14 bp, Homo sapiens
agttgtcaataaat

SEQ ID NO: 1910312 - DNA, 15 bp, Homo sapiens
agttgttagattaag

SEQ ID NO: 1910313 - DNA, 15 bp, Homo sapiens
agttgttttgtcttg

SEQ ID NO: 1910314 - DNA, 17 bp, Homo sapiens
agttgtttttgtatatt

SEQ ID NO: 1910315 - DNA, 18 bp, Homo sapiens
agttgtttttgtatattg

SEQ ID NO: 1910316 - DNA, 19 bp, Homo sapiens
agttgtttttgtatattgg

SEQ ID NO: 1910317 - DNA, 20 bp, Homo sapiens
agttgtttttgtatattggt

SEQ ID NO: 1910318 - DNA, 22 bp, Homo sapiens
agtttaaaaatctgccacctgc

SEQ ID NO: 1910319 - DNA, 14 bp, Homo sapiens
agtttaaggaatat

SEQ ID NO: 1910320 - DNA, 17 bp, Homo sapiens
agtttagaacaggtttt

SEQ ID NO: 1910321 - DNA, 17 bp, Homo sapiens
agtttctgtggttggct

SEQ ID NO: 1910322 - DNA, 14 bp, Homo sapiens
agtttgtaaatgac

SEQ ID NO: 1910323 - DNA, 17 bp, Homo sapiens
agtttgtaaatgacttt

SEQ ID NO: 1910324 - DNA, 14 bp, Homo sapiens
agttttatttatat

SEQ ID NO: 1910325 - DNA, 17 bp, Homo sapiens
agttttatttatattta

SEQ ID NO: 1910326 - DNA, 18 bp, Homo sapiens
agttttatttatatttat

SEQ ID NO: 1910327 - DNA, 19 bp, Homo sapiens
agttttatttatatttatt

SEQ ID NO: 1910328 - DNA, 22 bp, Homo sapiens
agttttatttatatttattgac

SEQ ID NO: 1910329 - DNA, 14 bp, Homo sapiens
agttttcatgtgct

SEQ ID NO: 1910330 - DNA, 14 bp, Homo sapiens
agttttgacaagct

SEQ ID NO: 1910331 - DNA, 16 bp, Homo sapiens
ataaaacagagtaatc

SEQ ID NO: 1910332 - DNA, 19 bp, Homo sapiens
ataaaacagagtaatcttg

SEQ ID NO: 1910333 - DNA, 14 bp, Homo sapiens
ataaaactgctagt

SEQ ID NO: 1910334 - DNA, 13 bp, Homo sapiens
ataaaagaatctg

SEQ ID NO: 1910335 - DNA, 20 bp, Homo sapiens
ataaaagacaaatgcaacat

SEQ ID NO: 1910336 - DNA, 16 bp, Homo sapiens
ataaaagcccaggagc

SEQ ID NO: 1910337 - DNA, 22 bp, Homo sapiens
ataaacgtggagaatcacaggc

SEQ ID NO: 1910338 - DNA, 19 bp, Homo sapiens
ataaagcaataagaacaaa

SEQ ID NO: 1910339 - DNA, 23 bp, Homo sapiens
ataaagtatttttataatgactg

SEQ ID NO: 1910340 - DNA, 16 bp, Homo sapiens
ataaagtgcaaacaga

SEQ ID NO: 1910341 - DNA, 15 bp, Homo sapiens
ataaatttatttact

SEQ ID NO: 1910342 - DNA, 19 bp, Homo sapiens
ataaatttatttactgcta

SEQ ID NO: 1910343 - DNA, 16 bp, Homo sapiens
ataaattttgaaaagt

SEQ ID NO: 1910344 - DNA, 17 bp, Homo sapiens
ataacaaaaaagagaaa

SEQ ID NO: 1910345 - DNA, 19 bp, Homo sapiens
ataacaaaaaagagaaacg

SEQ ID NO: 1910346 - DNA, 22 bp, Homo sapiens
ataaccatggtgattaaaatga

SEQ ID NO: 1910347 - DNA, 22 bp, Homo sapiens
ataactgcagaaaaaatattgt

SEQ ID NO: 1910348 - DNA, 15 bp, Homo sapiens
ataactgttgttgat

SEQ ID NO: 1910349 - DNA, 15 bp, Homo sapiens
ataacttatattgta

SEQ ID NO: 1910350 - DNA, 21 bp, Homo sapiens
ataacttatattgtaagaaat

SEQ ID NO: 1910351 - DNA, 22 bp, Homo sapiens
ataacttatattgtaagaaata

SEQ ID NO: 1910352 - DNA, 23 bp, Homo sapiens
ataacttatattgtaagaaatac

SEQ ID NO: 1910353 - DNA, 18 bp, Homo sapiens
ataagaaaagatgtagat

SEQ ID NO: 1910354 - DNA, 15 bp, Homo sapiens
ataagatattttatt

SEQ ID NO: 1910355 - DNA, 15 bp, Homo sapiens
ataagcaaaatgaaa

SEQ ID NO: 1910356 - DNA, 19 bp, Homo sapiens
ataagcaaaatgaaaagag

SEQ ID NO: 1910357 - DNA, 16 bp, Homo sapiens
ataagccatgagaatg

SEQ ID NO: 1910358 - DNA, 14 bp, Homo sapiens
ataagctagttgaa

SEQ ID NO: 1910359 - DNA, 17 bp, Homo sapiens
ataagctagttgaatac

SEQ ID NO: 1910360 - DNA, 11 bp, Homo sapiens
ataagttttgt

SEQ ID NO: 1910361 - DNA, 23 bp, Homo sapiens
ataataaaagtgccttagcatgt

SEQ ID NO: 1910362 - DNA, 14 bp, Homo sapiens
ataataaagaatag

SEQ ID NO: 1910363 - DNA, 21 bp, Homo sapiens
ataataagtccatctgtcact

SEQ ID NO: 1910364 - DNA, 17 bp, Homo sapiens
ataatactgaaatgctt

SEQ ID NO: 1910365 - DNA, 16 bp, Homo sapiens
ataatactgaaccact

SEQ ID NO: 1910366 - DNA, 18 bp, Homo sapiens
ataatatgtttccttccc

SEQ ID NO: 1910367 - DNA, 20 bp, Homo sapiens
ataatcaagagccttaaaac

SEQ ID NO: 1910368 - DNA, 23 bp, Homo sapiens
ataatcatgttagagttacttct

SEQ ID NO: 1910369 - DNA, 17 bp, Homo sapiens
ataattcttttttatta

SEQ ID NO: 1910370 - DNA, 22 bp, Homo sapiens
ataattcttttttattaatcac

SEQ ID NO: 1910371 - DNA, 13 bp, Homo sapiens
ataattttgatag

SEQ ID NO: 1910372 - DNA, 23 bp, Homo sapiens
ataattttgtaatgtatcaaata

SEQ ID NO: 1910373 - DNA, 17 bp, Homo sapiens
atacaaatgcatctttg

SEQ ID NO: 1910374 - DNA, 18 bp, Homo sapiens
atacaaatgcatctttga

SEQ ID NO: 1910375 - DNA, 19 bp, Homo sapiens
atacaaatttaacttttaa

SEQ ID NO: 1910376 - DNA, 14 bp, Homo sapiens
atacacagggaggg

SEQ ID NO: 1910377 - DNA, 18 bp, Homo sapiens
atacagaccgaactgttg

SEQ ID NO: 1910378 - DNA, 23 bp, Homo sapiens
atacagcaaacctaattgcacaa

SEQ ID NO: 1910379 - DNA, 20 bp, Homo sapiens
atacaggctggaaagtaagg

SEQ ID NO: 1910380 - DNA, 12 bp, Homo sapiens
atacatgtttgc

SEQ ID NO: 1910381 - DNA, 21 bp, Homo sapiens
atacatgtttgcagtgttaag

SEQ ID NO: 1910382 - DNA, 16 bp, Homo sapiens
atacatttaaaacatt

SEQ ID NO: 1910383 - DNA, 17 bp, Homo sapiens
ataccaactgggcctct

SEQ ID NO: 1910384 - DNA, 17 bp, Homo sapiens
ataccaagcatgtggat

SEQ ID NO: 1910385 - DNA, 23 bp, Homo sapiens
ataccattatatgttccccctgt

SEQ ID NO: 1910386 - DNA, 17 bp, Homo sapiens
atactgaaatgctttag

SEQ ID NO: 1910387 - DNA, 12 bp, Homo sapiens
atactgaaccac

SEQ ID NO: 1910388 - DNA, 23 bp, Homo sapiens
atactgaaccacttgtagatttg

SEQ ID NO: 1910389 - DNA, 13 bp, Homo sapiens
atactgatggaat

SEQ ID NO: 1910390 - DNA, 15 bp, Homo sapiens
atacttgaaaaatgt

SEQ ID NO: 1910391 - DNA, 13 bp, Homo sapiens
atacttgaaccat

SEQ ID NO: 1910392 - DNA, 16 bp, Homo sapiens
atacttgaaccataaa

SEQ ID NO: 1910393 - DNA, 10 bp, Homo sapiens
atactttgta

SEQ ID NO: 1910394 - DNA, 18 bp, Homo sapiens
atactttgtattgtccta

SEQ ID NO: 1910395 - DNA, 18 bp, Homo sapiens
atagaaaaaaagaaatta

SEQ ID NO: 1910396 - DNA, 22 bp, Homo sapiens
atagaaatttgcccctggcaaa

SEQ ID NO: 1910397 - DNA, 14 bp, Homo sapiens
atagagtacactgc

SEQ ID NO: 1910398 - DNA, 15 bp, Homo sapiens
atagcatcacttaaa

SEQ ID NO: 1910399 - DNA, 16 bp, Homo sapiens
atagcatcacttaaaa

SEQ ID NO: 1910400 - DNA, 18 bp, Homo sapiens
atagcatcacttaaaaca

SEQ ID NO: 1910401 - DNA, 20 bp, Homo sapiens
atagcatcacttaaaacacg

SEQ ID NO: 1910402 - DNA, 17 bp, Homo sapiens
atagcattgtctatttt

SEQ ID NO: 1910403 - DNA, 14 bp, Homo sapiens
atagctcaataaaa

SEQ ID NO: 1910404 - DNA, 17 bp, Homo sapiens
atagctcaataaaagaa

SEQ ID NO: 1910405 - DNA, 14 bp, Homo sapiens
ataggaactgaggt

SEQ ID NO: 1910406 - DNA, 17 bp, Homo sapiens
ataggcttatacaaatt

SEQ ID NO: 1910407 - DNA, 18 bp, Homo sapiens
atagtatccagcacagat

SEQ ID NO: 1910408 - DNA, 21 bp, Homo sapiens
atagtcaagacgaacatgtag

SEQ ID NO: 1910409 - DNA, 16 bp, Homo sapiens
atagttatgtaaataa

SEQ ID NO: 1910410 - DNA, 22 bp, Homo sapiens
atagtttaaaaatctgccacct

SEQ ID NO: 1910411 - DNA, 16 bp, Homo sapiens
atagttttatttatat

SEQ ID NO: 1910412 - DNA, 13 bp, Homo sapiens
atataaagtattt

SEQ ID NO: 1910413 - DNA, 19 bp, Homo sapiens
atataactgttgttgataa

SEQ ID NO: 1910414 - DNA, 16 bp, Homo sapiens
atataacttatattgt

SEQ ID NO: 1910415 - DNA, 22 bp, Homo sapiens
atataacttatattgtaagaaa

SEQ ID NO: 1910416 - DNA, 13 bp, Homo sapiens
agaggctggcaag

SEQ ID NO: 1910417 - DNA, 17 bp, Homo sapiens
agaggctgtggtcagag

SEQ ID NO: 1910418 - DNA, 23 bp, Homo sapiens
agaggggccagcggccctcccag

SEQ ID NO: 1910419 - DNA, 16 bp, Homo sapiens
agagggtcactggggg

SEQ ID NO: 1910420 - DNA, 21 bp, Homo sapiens
agagggtgatggaacaagaga

SEQ ID NO: 1910421 - DNA, 12 bp, Homo sapiens
agaggtggtctg

SEQ ID NO: 1910422 - DNA, 17 bp, Homo sapiens
agaggttctaacttctg

SEQ ID NO: 1910423 - DNA, 13 bp, Homo sapiens
agagtacactgcc

SEQ ID NO: 1910424 - DNA, 17 bp, Homo sapiens
agagtagccatgaggag

SEQ ID NO: 1910425 - DNA, 21 bp, Homo sapiens
agagtctgagggcttgtagtt

SEQ ID NO: 1910426 - DNA, 22 bp, Homo sapiens
agagtctgagggcttgtagttc

SEQ ID NO: 1910427 - DNA, 23 bp, Homo sapiens
agagtctgagggcttgtagttct

SEQ ID NO: 1910428 - DNA, 21 bp, Homo sapiens
agagtctggggaccagcttgg

SEQ ID NO: 1910429 - DNA, 17 bp, Homo sapiens
agagtttgtaaatgact

SEQ ID NO: 1910430 - DNA, 15 bp, Homo sapiens
agagttttctatgaa

SEQ ID NO: 1910431 - DNA, 18 bp, Homo sapiens
agataaaaaaacagcttt

SEQ ID NO: 1910432 - DNA, 19 bp, Homo sapiens
agataattgtactttgaaa

SEQ ID NO: 1910433 - DNA, 15 bp, Homo sapiens
agataccaagcatgt

SEQ ID NO: 1910434 - DNA, 12 bp, Homo sapiens
agatactttgta

SEQ ID NO: 1910435 - DNA, 17 bp, Homo sapiens
agatcactgtttagatt

SEQ ID NO: 1910436 - DNA, 18 bp, Homo sapiens
agatcactgtttagattt

SEQ ID NO: 1910437 - DNA, 19 bp, Homo sapiens
agatcactgtttagatttg

SEQ ID NO: 1910438 - DNA, 20 bp, Homo sapiens
agatcactgtttagatttgc

SEQ ID NO: 1910439 - DNA, 17 bp, Homo sapiens
agatcatttgagttcag

SEQ ID NO: 1910440 - DNA, 16 bp, Homo sapiens
agatgacaacaaattt

SEQ ID NO: 1910441 - DNA, 20 bp, Homo sapiens
agatggtggcattttgagaa

SEQ ID NO: 1910442 - DNA, 14 bp, Homo sapiens
agatgtaattttgt

SEQ ID NO: 1910443 - DNA, 15 bp, Homo sapiens
agatgtaattttgtg

SEQ ID NO: 1910444 - DNA, 19 bp, Homo sapiens
agatgtaattttgtgtaag

SEQ ID NO: 1910445 - DNA, 23 bp, Homo sapiens
agatgtgtctcctgtttcagacc

SEQ ID NO: 1910446 - DNA, 22 bp, Homo sapiens
agatgttgaggcgagcagggca

SEQ ID NO: 1910447 - DNA, 14 bp, Homo sapiens
agatgtttaaaaca

SEQ ID NO: 1910448 - DNA, 15 bp, Homo sapiens
agatgtttaaaacac

SEQ ID NO: 1910449 - DNA, 15 bp, Homo sapiens
agatgttttccactg

SEQ ID NO: 1910450 - DNA, 14 bp, Homo sapiens
agattaagaaatag

SEQ ID NO: 1910451 - DNA, 20 bp, Homo sapiens
agattgaacctgaatattgc

SEQ ID NO: 1910452 - DNA, 21 bp, Homo sapiens
agatttgatatatgtatcttt

SEQ ID NO: 1910453 - DNA, 18 bp, Homo sapiens
agatttgccatagagtac

SEQ ID NO: 1910454 - DNA, 13 bp, Homo sapiens
agattttgaaaaa

SEQ ID NO: 1910455 - DNA, 15 bp, Homo sapiens
agattttgaaaaatt

SEQ ID NO: 1910456 - DNA, 15 bp, Homo sapiens
agcaaaatcagaagt

SEQ ID NO: 1910457 - DNA, 15 bp, Homo sapiens
agcaaattttggacc

SEQ ID NO: 1910458 - DNA, 18 bp, Homo sapiens
agcaacccctggacccca

SEQ ID NO: 1910459 - DNA, 24 bp, Homo sapiens
agcaacccctggaccccagcctca

SEQ ID NO: 1910460 - DNA, 18 bp, Homo sapiens
agcaacgatcacaaatga

SEQ ID NO: 1910461 - DNA, 15 bp, Homo sapiens
agcaaggaatacaag

SEQ ID NO: 1910462 - DNA, 12 bp, Homo sapiens
agcaaggccacc

SEQ ID NO: 1910463 - DNA, 14 bp, Homo sapiens
agcaaggccacctc

SEQ ID NO: 1910464 - DNA, 15 bp, Homo sapiens
agcaaggccacctct

SEQ ID NO: 1910465 - DNA, 19 bp, Homo sapiens
agcaaggccacctcttcct

SEQ ID NO: 1910466 - DNA, 15 bp, Homo sapiens
agcaagtgtgaatac

SEQ ID NO: 1910467 - DNA, 14 bp, Homo sapiens
agcaataaaactgc

SEQ ID NO: 1910468 - DNA, 15 bp, Homo sapiens
agcaataaaactgct

SEQ ID NO: 1910469 - DNA, 18 bp, Homo sapiens
agcaataaaactgctagt

SEQ ID NO: 1910470 - DNA, 22 bp, Homo sapiens
agcacaaccttcaagctgcttt

SEQ ID NO: 1910471 - DNA, 19 bp, Homo sapiens
agcacaccaatcttacttt

SEQ ID NO: 1910472 - DNA, 12 bp, Homo sapiens
agcacaggctga

SEQ ID NO: 1910473 - DNA, 18 bp, Homo sapiens
agcacaggctgagtgcag

SEQ ID NO: 1910474 - DNA, 21 bp, Homo sapiens
agcacaggctgagtgcaggcc

SEQ ID NO: 1910475 - DNA, 17 bp, Homo sapiens
agcaccaaaataagaaa

SEQ ID NO: 1910476 - DNA, 19 bp, Homo sapiens
agcaccaaaataagaaaag

SEQ ID NO: 1910477 - DNA, 16 bp, Homo sapiens
agcacgcctctcccca

SEQ ID NO: 1910478 - DNA, 19 bp, Homo sapiens
agcactggattgtagaact

SEQ ID NO: 1910479 - DNA, 23 bp, Homo sapiens
agcactggattgtagaacttgtt

SEQ ID NO: 1910480 - DNA, 13 bp, Homo sapiens
agcagaaggaagg

SEQ ID NO: 1910481 - DNA, 21 bp, Homo sapiens
agcagccagccaaacacacag

SEQ ID NO: 1910482 - DNA, 16 bp, Homo sapiens
agcagcctctgatctg

SEQ ID NO: 1910483 - DNA, 19 bp, Homo sapiens
agcagcctctgatctgtgc

SEQ ID NO: 1910484 - DNA, 13 bp, Homo sapiens
agcagccttccag

SEQ ID NO: 1910485 - DNA, 20 bp, Homo sapiens
agcagccttccagtggcttc

SEQ ID NO: 1910486 - DNA, 21 bp, Homo sapiens
agcagccttccagtggcttct

SEQ ID NO: 1910487 - DNA, 12 bp, Homo sapiens
agcaggaggaac

SEQ ID NO: 1910488 - DNA, 14 bp, Homo sapiens
agcaggagggacag

SEQ ID NO: 1910489 - DNA, 19 bp, Homo sapiens
agcaggagggacagtctca

SEQ ID NO: 1910490 - DNA, 13 bp, Homo sapiens
agcaggagggact

SEQ ID NO: 1910491 - DNA, 20 bp, Homo sapiens
agcaggagggactctgtctg

SEQ ID NO: 1910492 - DNA, 23 bp, Homo sapiens
agcaggagggactctgtctggcc

SEQ ID NO: 1910493 - DNA, 15 bp, Homo sapiens
agcaggccctgggcc

SEQ ID NO: 1910494 - DNA, 16 bp, Homo sapiens
agcaggccctgggcct

SEQ ID NO: 1910495 - DNA, 22 bp, Homo sapiens
agcaggccctgggcctccacct

SEQ ID NO: 1910496 - DNA, 13 bp, Homo sapiens
agcaggctcctca

SEQ ID NO: 1910497 - DNA, 15 bp, Homo sapiens
agcaggctcctcagc

SEQ ID NO: 1910498 - DNA, 16 bp, Homo sapiens
agcaggctcctcagcc

SEQ ID NO: 1910499 - DNA, 21 bp, Homo sapiens
agcaggctcctcagccctctc

SEQ ID NO: 1910500 - DNA, 14 bp, Homo sapiens
agcagggcaggccc

SEQ ID NO: 1910501 - DNA, 23 bp, Homo sapiens
agcagtgcccaggtggctgtgga

SEQ ID NO: 1910502 - DNA, 16 bp, Homo sapiens
agcagttgctggtaaa

SEQ ID NO: 1910503 - DNA, 22 bp, Homo sapiens
agcagttgctggtaaaatgaag

SEQ ID NO: 1910504 - DNA, 23 bp, Homo sapiens
agcagttgctggtaaaatgaaga

SEQ ID NO: 1910505 - DNA, 16 bp, Homo sapiens
agcataactaggatta

SEQ ID NO: 1910506 - DNA, 17 bp, Homo sapiens
agcataactaggattat

SEQ ID NO: 1910507 - DNA, 14 bp, Homo sapiens
agcatctctgacca

SEQ ID NO: 1910508 - DNA, 19 bp, Homo sapiens
agcatgtaaagagctggga

SEQ ID NO: 1910509 - DNA, 14 bp, Homo sapiens
agcatgtgttgcag

SEQ ID NO: 1910510 - DNA, 19 bp, Homo sapiens
agcatgtgttgcagctgtc

SEQ ID NO: 1910511 - DNA, 22 bp, Homo sapiens
agcatgtgttgcagctgtcacc

SEQ ID NO: 1910512 - DNA, 17 bp, Homo sapiens
agcattacctctttgga

SEQ ID NO: 1910513 - DNA, 14 bp, Homo sapiens
agcattctaaatga

SEQ ID NO: 1910514 - DNA, 20 bp, Homo sapiens
agcattgcagtcactttgac

SEQ ID NO: 1910515 - DNA, 15 bp, Homo sapiens
agcattgtctatttt

SEQ ID NO: 1910516 - DNA, 22 bp, Homo sapiens
agcattgtctatttttctcttc

SEQ ID NO: 1910517 - DNA, 15 bp, Homo sapiens
agcatttgctgcatg

SEQ ID NO: 1910518 - DNA, 15 bp, Homo sapiens
agcatttggtgcttg

SEQ ID NO: 1910519 - DNA, 18 bp, Homo sapiens
agccaaaattaaggtgtt

SEQ ID NO: 1910520 - DNA, 18 bp, Homo sapiens
agccaaacacacagaagg

SEQ ID NO: 1910521 - DNA, 14 bp, Homo sapiens
agccagcatcggaa

SEQ ID NO: 1910522 - DNA, 16 bp, Homo sapiens
agccagggaaagactg

SEQ ID NO: 1910523 - DNA, 18 bp, Homo sapiens
agccaggttccacagagg

SEQ ID NO: 1910524 - DNA, 14 bp, Homo sapiens
agccagtgaacata

SEQ ID NO: 1910525 - DNA, 14 bp, Homo sapiens
agccatgaggaggc

SEQ ID NO: 1910526 - DNA, 18 bp, Homo sapiens
agccatgaggaggcagag

SEQ ID NO: 1910527 - DNA, 18 bp, Homo sapiens
agccatttaggcaaataa

SEQ ID NO: 1910528 - DNA, 21 bp, Homo sapiens
agcccacctgggttggaggaa

SEQ ID NO: 1910529 - DNA, 20 bp, Homo sapiens
agcccacgctgactacaggg

SEQ ID NO: 1910530 - DNA, 21 bp, Homo sapiens
agcccagcttttcctgggaca

SEQ ID NO: 1910531 - DNA, 21 bp, Homo sapiens
agcccatttggagggcctggg

SEQ ID NO: 1910532 - DNA, 16 bp, Homo sapiens
agccccactctcagag

SEQ ID NO: 1910533 - DNA, 16 bp, Homo sapiens
agccccatctagggga

SEQ ID NO: 1910534 - DNA, 20 bp, Homo sapiens
agcccccagcttccagcagg

SEQ ID NO: 1910535 - DNA, 21 bp, Homo sapiens
agcccccagcttccagcagga

SEQ ID NO: 1910536 - DNA, 21 bp, Homo sapiens
agcccgatcctcccctggact

SEQ ID NO: 1910537 - DNA, 16 bp, Homo sapiens
agcctcacgaaactgg

SEQ ID NO: 1910538 - DNA, 18 bp, Homo sapiens
agcctcacgaaactggaa

SEQ ID NO: 1910539 - DNA, 23 bp, Homo sapiens
agcctcacgctcctttctgatct

SEQ ID NO: 1910540 - DNA, 14 bp, Homo sapiens
agcctccaattttt

SEQ ID NO: 1910541 - DNA, 10 bp, Homo sapiens
agcctcccct

SEQ ID NO: 1910542 - DNA, 15 bp, Homo sapiens
agcctccccttccca

SEQ ID NO: 1910543 - DNA, 20 bp, Homo sapiens
agcctccctgacgtctgcca

SEQ ID NO: 1910544 - DNA, 18 bp, Homo sapiens
agcctccgcttccctggt

SEQ ID NO: 1910545 - DNA, 18 bp, Homo sapiens
agcctgaagagtttgtaa

SEQ ID NO: 1910546 - DNA, 13 bp, Homo sapiens
agcctgagagtct

SEQ ID NO: 1910547 - DNA, 20 bp, Homo sapiens
agcctgcacttgggggctca

SEQ ID NO: 1910548 - DNA, 11 bp, Homo sapiens
agcctggcagg

SEQ ID NO: 1910549 - DNA, 12 bp, Homo sapiens
agcctggcaggg

SEQ ID NO: 1910550 - DNA, 15 bp, Homo sapiens
agccttccagtggct

SEQ ID NO: 1910551 - DNA, 18 bp, Homo sapiens
agccttccagtggcttct

SEQ ID NO: 1910552 - DNA, 15 bp, Homo sapiens
agcgaccagcaggct

SEQ ID NO: 1910553 - DNA, 19 bp, Homo sapiens
agggactctgtctggccag

SEQ ID NO: 1910554 - DNA, 20 bp, Homo sapiens
agggactctgtctggccagg

SEQ ID NO: 1910555 - DNA, 21 bp, Homo sapiens
agggactctgtctggccaggg

SEQ ID NO: 1910556 - DNA, 23 bp, Homo sapiens
agggactctgtctggccagggag

SEQ ID NO: 1910557 - DNA, 15 bp, Homo sapiens
agggagacagaccac

SEQ ID NO: 1910558 - DNA, 15 bp, Homo sapiens
agggagtattctaat

SEQ ID NO: 1910559 - DNA, 16 bp, Homo sapiens
agggatggcagtggct

SEQ ID NO: 1910560 - DNA, 18 bp, Homo sapiens
agggattcagccctccct

SEQ ID NO: 1910561 - DNA, 18 bp, Homo sapiens
agggcacagaaggctggg

SEQ ID NO: 1910562 - DNA, 13 bp, Homo sapiens
agggcacagggcc

SEQ ID NO: 1910563 - DNA, 14 bp, Homo sapiens
agggcacagggcct

SEQ ID NO: 1910564 - DNA, 17 bp, Homo sapiens
agggcacagggcctggc

SEQ ID NO: 1910565 - DNA, 19 bp, Homo sapiens
agggcacagggcctggccc

SEQ ID NO: 1910566 - DNA, 19 bp, Homo sapiens
agggcaggaccagcccacg

SEQ ID NO: 1910567 - DNA, 15 bp, Homo sapiens
agggcatttggcttc

SEQ ID NO: 1910568 - DNA, 21 bp, Homo sapiens
agggcatttggcttcctctgc

SEQ ID NO: 1910569 - DNA, 18 bp, Homo sapiens
agggcccgggcccaggca

SEQ ID NO: 1910570 - DNA, 13 bp, Homo sapiens
agggcctgggcct

SEQ ID NO: 1910571 - DNA, 19 bp, Homo sapiens
agggcctgggcctggctcc

SEQ ID NO: 1910572 - DNA, 17 bp, Homo sapiens
agggctgagtgttctgg

SEQ ID NO: 1910573 - DNA, 17 bp, Homo sapiens
agggctgggtcaggggt

SEQ ID NO: 1910574 - DNA, 19 bp, Homo sapiens
agggcttgtagttctttaa

SEQ ID NO: 1910575 - DNA, 16 bp, Homo sapiens
aggggaagaataattt

SEQ ID NO: 1910576 - DNA, 13 bp, Homo sapiens
aggggactgccac

SEQ ID NO: 1910577 - DNA, 13 bp, Homo sapiens
aggggagactttg

SEQ ID NO: 1910578 - DNA, 16 bp, Homo sapiens
aggggccaagcaggca

SEQ ID NO: 1910579 - DNA, 13 bp, Homo sapiens
aggggccagagcc

SEQ ID NO: 1910580 - DNA, 22 bp, Homo sapiens
aggggccagagccttggaggac

SEQ ID NO: 1910581 - DNA, 14 bp, Homo sapiens
aggggccagcggcc

SEQ ID NO: 1910582 - DNA, 17 bp, Homo sapiens
aggggccagcggccctc

SEQ ID NO: 1910583 - DNA, 18 bp, Homo sapiens
aggggccagcggccctcc

SEQ ID NO: 1910584 - DNA, 19 bp, Homo sapiens
aggggccagcggccctccc

SEQ ID NO: 1910585 - DNA, 23 bp, Homo sapiens
aggggccagcggccctcccaggc

SEQ ID NO: 1910586 - DNA, 18 bp, Homo sapiens
agggggacctcgggctgt

SEQ ID NO: 1910587 - DNA, 16 bp, Homo sapiens
aggggtacacagagct

SEQ ID NO: 1910588 - DNA, 21 bp, Homo sapiens
aggggttttcttgataatttt

SEQ ID NO: 1910589 - DNA, 19 bp, Homo sapiens
agggtcactggggcccaag

SEQ ID NO: 1910590 - DNA, 19 bp, Homo sapiens
agggtctatcttgtaaata

SEQ ID NO: 1910591 - DNA, 18 bp, Homo sapiens
agggtctctagtgctgtg

SEQ ID NO: 1910592 - DNA, 20 bp, Homo sapiens
agggtctctagtgctgtgaa

SEQ ID NO: 1910593 - DNA, 20 bp, Homo sapiens
agggtgccggaaagagagct

SEQ ID NO: 1910594 - DNA, 22 bp, Homo sapiens
agggtgccggaaagagagctgg

SEQ ID NO: 1910595 - DNA, 13 bp, Homo sapiens
agggtgtgaggcc

SEQ ID NO: 1910596 - DNA, 22 bp, Homo sapiens
agggtgtgtgcccccagattta

SEQ ID NO: 1910597 - DNA, 17 bp, Homo sapiens
agggtttcagagagcct

SEQ ID NO: 1910598 - DNA, 14 bp, Homo sapiens
aggtaaaatgtagc

SEQ ID NO: 1910599 - DNA, 15 bp, Homo sapiens
aggtaaaatgtagct

SEQ ID NO: 1910600 - DNA, 17 bp, Homo sapiens
aggtagttcaagaaatg

SEQ ID NO: 1910601 - DNA, 23 bp, Homo sapiens
aggtagttcaagaaatgaagagc

SEQ ID NO: 1910602 - DNA, 20 bp, Homo sapiens
aggtgaaactccagatgcca

SEQ ID NO: 1910603 - DNA, 21 bp, Homo sapiens
aggtgaaactccagatgccac

SEQ ID NO: 1910604 - DNA, 16 bp, Homo sapiens
aggtgatgaagacagc

SEQ ID NO: 1910605 - DNA, 20 bp, Homo sapiens
aggttcaatgagatggtggc

SEQ ID NO: 1910606 - DNA, 18 bp, Homo sapiens
aggttccacagaggacac

SEQ ID NO: 1910607 - DNA, 15 bp, Homo sapiens
aggttccttttaagt

SEQ ID NO: 1910608 - DNA, 13 bp, Homo sapiens
aggttctaacttc

SEQ ID NO: 1910609 - DNA, 12 bp, Homo sapiens
aggtttgaatct

SEQ ID NO: 1910610 - DNA, 15 bp, Homo sapiens
aggttttttttgtac

SEQ ID NO: 1910611 - DNA, 14 bp, Homo sapiens
agtaagatcactgt

SEQ ID NO: 1910612 - DNA, 15 bp, Homo sapiens
agtaagatcactgtt

SEQ ID NO: 1910613 - DNA, 20 bp, Homo sapiens
agtaagatcactgtttagat

SEQ ID NO: 1910614 - DNA, 15 bp, Homo sapiens
agtaagctggtttac

SEQ ID NO: 1910615 - DNA, 15 bp, Homo sapiens
agtaagggaagcaga

SEQ ID NO: 1910616 - DNA, 19 bp, Homo sapiens
agtaagggaagcagaagga

SEQ ID NO: 1910617 - DNA, 22 bp, Homo sapiens
agtaatatttattaaatttttt

SEQ ID NO: 1910618 - DNA, 23 bp, Homo sapiens
agtaattgtattaattatttaaa

SEQ ID NO: 1910619 - DNA, 23 bp, Homo sapiens
agtaccatttaatggggaggaca

SEQ ID NO: 1910620 - DNA, 19 bp, Homo sapiens
agtaccctggttgtgtgtc

SEQ ID NO: 1910621 - DNA, 15 bp, Homo sapiens
agtagaactttgtat

SEQ ID NO: 1910622 - DNA, 13 bp, Homo sapiens
agtagaggtggct

SEQ ID NO: 1910623 - DNA, 16 bp, Homo sapiens
agtagcacaggctgag

SEQ ID NO: 1910624 - DNA, 13 bp, Homo sapiens
agtagcaggcccg

SEQ ID NO: 1910625 - DNA, 20 bp, Homo sapiens
agtagccatgaggaggcaga

SEQ ID NO: 1910626 - DNA, 19 bp, Homo sapiens
agtagtctgtgtttaaagt

SEQ ID NO: 1910627 - DNA, 23 bp, Homo sapiens
agtatatttaagaagccaagggg

SEQ ID NO: 1910628 - DNA, 20 bp, Homo sapiens
agtatcctgagagcccagaa

SEQ ID NO: 1910629 - DNA, 12 bp, Homo sapiens
agtatctaaatt

SEQ ID NO: 1910630 - DNA, 19 bp, Homo sapiens
agtatctaaatttggaact

SEQ ID NO: 1910631 - DNA, 15 bp, Homo sapiens
agtattgattcaaat

SEQ ID NO: 1910632 - DNA, 19 bp, Homo sapiens
agtatttttataatgactg

SEQ ID NO: 1910633 - DNA, 23 bp, Homo sapiens
agtatttttataatgactggtct

SEQ ID NO: 1910634 - DNA, 19 bp, Homo sapiens
agtcaacagtaccctggtt

SEQ ID NO: 1910635 - DNA, 21 bp, Homo sapiens
agtcacccctgcctaaagata

SEQ ID NO: 1910636 - DNA, 22 bp, Homo sapiens
agtcactctaggactctgcact

SEQ ID NO: 1910637 - DNA, 21 bp, Homo sapiens
agtcactgcacgttttcatct

SEQ ID NO: 1910638 - DNA, 14 bp, Homo sapiens
agtcactttgacag

SEQ ID NO: 1910639 - DNA, 21 bp, Homo sapiens
agtccaagccgtaggacccag

SEQ ID NO: 1910640 - DNA, 12 bp, Homo sapiens
agtcccagcagc

SEQ ID NO: 1910641 - DNA, 16 bp, Homo sapiens
agtcccagcagccagc

SEQ ID NO: 1910642 - DNA, 14 bp, Homo sapiens
agtcggggcaggcc

SEQ ID NO: 1910643 - DNA, 16 bp, Homo sapiens
agtcgtcagcctccct

SEQ ID NO: 1910644 - DNA, 14 bp, Homo sapiens
agtctatagaaatg

SEQ ID NO: 1910645 - DNA, 18 bp, Homo sapiens
agtctatatgaaaaacaa

SEQ ID NO: 1910646 - DNA, 23 bp, Homo sapiens
agtctcgctctgttgcccaggct

SEQ ID NO: 1910647 - DNA, 22 bp, Homo sapiens
agtctctctctctccatccctc

SEQ ID NO: 1910648 - DNA, 17 bp, Homo sapiens
agtctgagggcttgtag

SEQ ID NO: 1910649 - DNA, 17 bp, Homo sapiens
agtctggaactgctgct

SEQ ID NO: 1910650 - DNA, 20 bp, Homo sapiens
agtctggaactgctgctgac

SEQ ID NO: 1910651 - DNA, 21 bp, Homo sapiens
agtctggaactgctgctgacc

SEQ ID NO: 1910652 - DNA, 20 bp, Homo sapiens
agtctggcccactgtgcagt

SEQ ID NO: 1910653 - DNA, 11 bp, Homo sapiens
agtctgtggct

SEQ ID NO: 1910654 - DNA, 22 bp, Homo sapiens
agtctgtggcttggtgagtctg

SEQ ID NO: 1910655 - DNA, 16 bp, Homo sapiens
agtctgttctggtaat

SEQ ID NO: 1910656 - DNA, 16 bp, Homo sapiens
agtctgttgattaaag

SEQ ID NO: 1910657 - DNA, 13 bp, Homo sapiens
agtcttaagaact

SEQ ID NO: 1910658 - DNA, 18 bp, Homo sapiens
agtcttagatcatagttt

SEQ ID NO: 1910659 - DNA, 19 bp, Homo sapiens
agtcttagatcatagtttt

SEQ ID NO: 1910660 - DNA, 20 bp, Homo sapiens
agtcttagatcatagtttta

SEQ ID NO: 1910661 - DNA, 21 bp, Homo sapiens
agtcttagatcatagttttat

SEQ ID NO: 1910662 - DNA, 14 bp, Homo sapiens
agtctttctcactg

SEQ ID NO: 1910663 - DNA, 16 bp, Homo sapiens
agtctttctcactgcc

SEQ ID NO: 1910664 - DNA, 15 bp, Homo sapiens
agtgaaaactttgta

SEQ ID NO: 1910665 - DNA, 14 bp, Homo sapiens
agtgaaactcccac

SEQ ID NO: 1910666 - DNA, 17 bp, Homo sapiens
agtgaacagattttatt

SEQ ID NO: 1910667 - DNA, 20 bp, Homo sapiens
agtgaacataattcttatta

SEQ ID NO: 1910668 - DNA, 15 bp, Homo sapiens
agtgaggaaatcaaa

SEQ ID NO: 1910669 - DNA, 20 bp, Homo sapiens
agtgatataaaagctgcata

SEQ ID NO: 1910670 - DNA, 19 bp, Homo sapiens
agtgcaaacagaagtgcat

SEQ ID NO: 1910671 - DNA, 13 bp, Homo sapiens
agtgcaggcccac

SEQ ID NO: 1910672 - DNA, 22 bp, Homo sapiens
agtgcagtggcgaaatccctgc

SEQ ID NO: 1910673 - DNA, 16 bp, Homo sapiens
agtgccgcatctcaca

SEQ ID NO: 1910674 - DNA, 18 bp, Homo sapiens
agtgccgcatctcacagc

SEQ ID NO: 1910675 - DNA, 20 bp, Homo sapiens
agtgcctttgcagctcagaa

SEQ ID NO: 1910676 - DNA, 14 bp, Homo sapiens
agtgctgtgaaaaa

SEQ ID NO: 1910677 - DNA, 16 bp, Homo sapiens
agtggactctctgaca

SEQ ID NO: 1910678 - DNA, 18 bp, Homo sapiens
agtggactctctgacaaa

SEQ ID NO: 1910679 - DNA, 22 bp, Homo sapiens
agtggactctctgacaaagtgg

SEQ ID NO: 1910680 - DNA, 20 bp, Homo sapiens
agtggatattttcttaaaac

SEQ ID NO: 1910681 - DNA, 21 bp, Homo sapiens
agtggatattttcttaaaacc

SEQ ID NO: 1910682 - DNA, 15 bp, Homo sapiens
agtggcagggcacag

SEQ ID NO: 1910683 - DNA, 11 bp, Homo sapiens
agtggctgtga

SEQ ID NO: 1910684 - DNA, 22 bp, Homo sapiens
agtggggggaacgcccacttcc

SEQ ID NO: 1910685 - DNA, 18 bp, Homo sapiens
agtgggtactttctgaaa

SEQ ID NO: 1910686 - DNA, 15 bp, Homo sapiens
agtgtactttgttaa

SEQ ID NO: 1910687 - DNA, 18 bp, Homo sapiens
agtgtattctatttgtgt

SEQ ID NO: 1910688 - DNA, 13 bp, Homo sapiens
agtgtgaatactg

SEQ ID NO: 1910689 - DNA, 17 bp, Homo sapiens
caggaaccagacaatct

SEQ ID NO: 1910690 - DNA, 15 bp, Homo sapiens
caggaagtagcacag

SEQ ID NO: 1910691 - DNA, 18 bp, Homo sapiens
caggaagtagcacaggct

SEQ ID NO: 1910692 - DNA, 14 bp, Homo sapiens
caggaccagcccac

SEQ ID NO: 1910693 - DNA, 15 bp, Homo sapiens
caggaccagcccacg

SEQ ID NO: 1910694 - DNA, 16 bp, Homo sapiens
caggaccagcccacgc

SEQ ID NO: 1910695 - DNA, 21 bp, Homo sapiens
caggaccagcccacgctgact

SEQ ID NO: 1910696 - DNA, 12 bp, Homo sapiens
caggacccctgc

SEQ ID NO: 1910697 - DNA, 12 bp, Homo sapiens
caggaccctgcc

SEQ ID NO: 1910698 - DNA, 17 bp, Homo sapiens
caggaccctgccaggca

SEQ ID NO: 1910699 - DNA, 19 bp, Homo sapiens
caggaccctgccaggcaca

SEQ ID NO: 1910700 - DNA, 22 bp, Homo sapiens
caggaccctgccaggcacaggc

SEQ ID NO: 1910701 - DNA, 16 bp, Homo sapiens
caggagcagtatcatg

SEQ ID NO: 1910702 - DNA, 17 bp, Homo sapiens
caggaggccaaggtggg

SEQ ID NO: 1910703 - DNA, 16 bp, Homo sapiens
caggagggacagtctc

SEQ ID NO: 1910704 - DNA, 17 bp, Homo sapiens
caggagggacagtctca

SEQ ID NO: 1910705 - DNA, 17 bp, Homo sapiens
caggagggactctgtct

SEQ ID NO: 1910706 - DNA, 15 bp, Homo sapiens
caggagttggagtta

SEQ ID NO: 1910707 - DNA, 12 bp, Homo sapiens
caggcacaggca

SEQ ID NO: 1910708 - DNA, 18 bp, Homo sapiens
caggcacaggcagggcag

SEQ ID NO: 1910709 - DNA, 21 bp, Homo sapiens
caggcagagagcgaccagcag

SEQ ID NO: 1910710 - DNA, 23 bp, Homo sapiens
caggcagagagcgaccagcaggc

SEQ ID NO: 1910711 - DNA, 20 bp, Homo sapiens
caggcagcgccactgtccgc

SEQ ID NO: 1910712 - DNA, 16 bp, Homo sapiens
caggcagggcaggacc

SEQ ID NO: 1910713 - DNA, 17 bp, Homo sapiens
caggcagggcaggacca

SEQ ID NO: 1910714 - DNA, 15 bp, Homo sapiens
caggcatgggccacc

SEQ ID NO: 1910715 - DNA, 24 bp, Homo sapiens
caggcatgttggactctgagctca

SEQ ID NO: 1910716 - DNA, 13 bp, Homo sapiens
caggccaggggag

SEQ ID NO: 1910717 - DNA, 23 bp, Homo sapiens
caggcccaccctgcttggcccag

SEQ ID NO: 1910718 - DNA, 24 bp, Homo sapiens
caggcccaccctgcttggcccagg

SEQ ID NO: 1910719 - DNA, 20 bp, Homo sapiens
caggccctcctccctcccag

SEQ ID NO: 1910720 - DNA, 14 bp, Homo sapiens
caggccctgggcct

SEQ ID NO: 1910721 - DNA, 16 bp, Homo sapiens
caggccctgggcctcc

SEQ ID NO: 1910722 - DNA, 23 bp, Homo sapiens
caggcgcaagggaggcccagcgc

SEQ ID NO: 1910723 - DNA, 16 bp, Homo sapiens
caggctcctcagccct

SEQ ID NO: 1910724 - DNA, 14 bp, Homo sapiens
caggctgagtgcag

SEQ ID NO: 1910725 - DNA, 15 bp, Homo sapiens
caggctgagtgcagg

SEQ ID NO: 1910726 - DNA, 16 bp, Homo sapiens
caggctgagtgcaggc

SEQ ID NO: 1910727 - DNA, 21 bp, Homo sapiens
caggctgagtgcaggcccacc

SEQ ID NO: 1910728 - DNA, 23 bp, Homo sapiens
caggctgagtgcaggcccaccct

SEQ ID NO: 1910729 - DNA, 22 bp, Homo sapiens
caggctgctctcaaacccctga

SEQ ID NO: 1910730 - DNA, 21 bp, Homo sapiens
caggctgggctgggcactgct

SEQ ID NO: 1910731 - DNA, 18 bp, Homo sapiens
caggctttctagaaagaa

SEQ ID NO: 1910732 - DNA, 13 bp, Homo sapiens
cagggaaagactg

SEQ ID NO: 1910733 - DNA, 18 bp, Homo sapiens
cagggcacagaaggctgg

SEQ ID NO: 1910734 - DNA, 15 bp, Homo sapiens
cagggcacagggcct

SEQ ID NO: 1910735 - DNA, 19 bp, Homo sapiens
cagggcacagggcctggcc

SEQ ID NO: 1910736 - DNA, 17 bp, Homo sapiens
cagggcaggaccagccc

SEQ ID NO: 1910737 - DNA, 19 bp, Homo sapiens
cagggcaggaccagcccac

SEQ ID NO: 1910738 - DNA, 21 bp, Homo sapiens
cagggcccccagcgagagtcc

SEQ ID NO: 1910739 - DNA, 18 bp, Homo sapiens
cagggcccgggcccaggc

SEQ ID NO: 1910740 - DNA, 23 bp, Homo sapiens
cagggcccgggcccaggcagaga

SEQ ID NO: 1910741 - DNA, 12 bp, Homo sapiens
cagggcctggcc

SEQ ID NO: 1910742 - DNA, 21 bp, Homo sapiens
cagggctctgactctgccagg

SEQ ID NO: 1910743 - DNA, 23 bp, Homo sapiens
cagggctctgactctgccagggt

SEQ ID NO: 1910744 - DNA, 15 bp, Homo sapiens
cagggctgggtcagg

SEQ ID NO: 1910745 - DNA, 16 bp, Homo sapiens
caggggagatccttgt

SEQ ID NO: 1910746 - DNA, 19 bp, Homo sapiens
caggggatccagctcaagg

SEQ ID NO: 1910747 - DNA, 14 bp, Homo sapiens
caggggcaggaacc

SEQ ID NO: 1910748 - DNA, 12 bp, Homo sapiens
cagggggcttcc

SEQ ID NO: 1910749 - DNA, 13 bp, Homo sapiens
cagggggcttcct

SEQ ID NO: 1910750 - DNA, 22 bp, Homo sapiens
cagggggcttcctgaggggaga

SEQ ID NO: 1910751 - DNA, 22 bp, Homo sapiens
caggggtacacagagctaaggc

SEQ ID NO: 1910752 - DNA, 17 bp, Homo sapiens
caggggtctcgggggtg

SEQ ID NO: 1910753 - DNA, 12 bp, Homo sapiens
caggggttcctt

SEQ ID NO: 1910754 - DNA, 19 bp, Homo sapiens
caggggttccttctgggca

SEQ ID NO: 1910755 - DNA, 20 bp, Homo sapiens
caggggttccttctgggcat

SEQ ID NO: 1910756 - DNA, 22 bp, Homo sapiens
cagggtaagctggtgttataat

SEQ ID NO: 1910757 - DNA, 15 bp, Homo sapiens
cagggtacaaaaaat

SEQ ID NO: 1910758 - DNA, 17 bp, Homo sapiens
cagggtattaacgtgtc

SEQ ID NO: 1910759 - DNA, 21 bp, Homo sapiens
cagggtctctagtgctgtgaa

SEQ ID NO: 1910760 - DNA, 16 bp, Homo sapiens
caggtacacatatttt

SEQ ID NO: 1910761 - DNA, 20 bp, Homo sapiens
caggtccccaattgagaatg

SEQ ID NO: 1910762 - DNA, 20 bp, Homo sapiens
caggttccttttaagtggac

SEQ ID NO: 1910763 - DNA, 19 bp, Homo sapiens
cagtaagatcactgtttag

SEQ ID NO: 1910764 - DNA, 20 bp, Homo sapiens
cagtaagatcactgtttaga

SEQ ID NO: 1910765 - DNA, 21 bp, Homo sapiens
cagtaagatcactgtttagat

SEQ ID NO: 1910766 - DNA, 23 bp, Homo sapiens
cagtaccatttaatggggaggac

SEQ ID NO: 1910767 - DNA, 23 bp, Homo sapiens
cagtatagtttaaaaatctgcca

SEQ ID NO: 1910768 - DNA, 19 bp, Homo sapiens
cagtcccagcagccagcca

SEQ ID NO: 1910769 - DNA, 15 bp, Homo sapiens
cagtcgtcagcctcc

SEQ ID NO: 1910770 - DNA, 22 bp, Homo sapiens
cagtcttagatcatagttttat

SEQ ID NO: 1910771 - DNA, 19 bp, Homo sapiens
cagtgaggcatctctctgg

SEQ ID NO: 1910772 - DNA, 23 bp, Homo sapiens
cagtgagggtaagtattttcctg

SEQ ID NO: 1910773 - DNA, 11 bp, Homo sapiens
cagtgcccagg

SEQ ID NO: 1910774 - DNA, 14 bp, Homo sapiens
cagtgcccaggtgg

SEQ ID NO: 1910775 - DNA, 22 bp, Homo sapiens
cagtgcccaggtggctgtggaa

SEQ ID NO: 1910776 - DNA, 22 bp, Homo sapiens
cagtgctattctgagtgaaaat

SEQ ID NO: 1910777 - DNA, 13 bp, Homo sapiens
cagtggcagggca

SEQ ID NO: 1910778 - DNA, 20 bp, Homo sapiens
cagtggcagggcacagggcc

SEQ ID NO: 1910779 - DNA, 19 bp, Homo sapiens
cagtgtggcctcttctgag

SEQ ID NO: 1910780 - DNA, 13 bp, Homo sapiens
cagtgttaagata

SEQ ID NO: 1910781 - DNA, 13 bp, Homo sapiens
cagttatgtgacc

SEQ ID NO: 1910782 - DNA, 17 bp, Homo sapiens
cagttcccctggaagca

SEQ ID NO: 1910783 - DNA, 14 bp, Homo sapiens
cagttgctggtaaa

SEQ ID NO: 1910784 - DNA, 18 bp, Homo sapiens
cagttgctggtaaaatga

SEQ ID NO: 1910785 - DNA, 13 bp, Homo sapiens
cagttgctgtcac

SEQ ID NO: 1910786 - DNA, 21 bp, Homo sapiens
cagttgctgtcacaaaggagt

SEQ ID NO: 1910787 - DNA, 13 bp, Homo sapiens
cagttgtttgatg

SEQ ID NO: 1910788 - DNA, 15 bp, Homo sapiens
cagtttactggttta

SEQ ID NO: 1910789 - DNA, 19 bp, Homo sapiens
cagtttccctatctgcaaa

SEQ ID NO: 1910790 - DNA, 18 bp, Homo sapiens
cagttttatagctttatt

SEQ ID NO: 1910791 - DNA, 23 bp, Homo sapiens
cagttttgatatttatttatgct

SEQ ID NO: 1910792 - DNA, 21 bp, Homo sapiens
cagtttttcataagatatttt

SEQ ID NO: 1910793 - DNA, 13 bp, Homo sapiens
cataaagaatttg

SEQ ID NO: 1910794 - DNA, 22 bp, Homo sapiens
cataaagaatttgtcacaggaa

SEQ ID NO: 1910795 - DNA, 22 bp, Homo sapiens
atccaggaccctgccaggcaca

SEQ ID NO: 1910796 - DNA, 21 bp, Homo sapiens
atccatactaacccttttcca

SEQ ID NO: 1910797 - DNA, 21 bp, Homo sapiens
atccatattaagtaagtctca

SEQ ID NO: 1910798 - DNA, 17 bp, Homo sapiens
atccccttccagctccc

SEQ ID NO: 1910799 - DNA, 22 bp, Homo sapiens
atcccgcagatggctggaatat

SEQ ID NO: 1910800 - DNA, 16 bp, Homo sapiens
atcccgtttccctcca

SEQ ID NO: 1910801 - DNA, 14 bp, Homo sapiens
atccctctcctctg

SEQ ID NO: 1910802 - DNA, 13 bp, Homo sapiens
atccctgctcact

SEQ ID NO: 1910803 - DNA, 15 bp, Homo sapiens
atccctgtgttaatt

SEQ ID NO: 1910804 - DNA, 21 bp, Homo sapiens
atcctaatgacttctaaaaat

SEQ ID NO: 1910805 - DNA, 16 bp, Homo sapiens
atcctagtttgctgtg

SEQ ID NO: 1910806 - DNA, 16 bp, Homo sapiens
atcctgcactgactct

SEQ ID NO: 1910807 - DNA, 17 bp, Homo sapiens
atcctgcactgactctg

SEQ ID NO: 1910808 - DNA, 22 bp, Homo sapiens
atcctgggcagcttgggctggc

SEQ ID NO: 1910809 - DNA, 17 bp, Homo sapiens
atcctgtcatctgagaa

SEQ ID NO: 1910810 - DNA, 17 bp, Homo sapiens
atccttttagtctgcat

SEQ ID NO: 1910811 - DNA, 17 bp, Homo sapiens
atcgacttgttcttgat

SEQ ID NO: 1910812 - DNA, 21 bp, Homo sapiens
atcgagtgccgcatctcacag

SEQ ID NO: 1910813 - DNA, 16 bp, Homo sapiens
atctaaatttggaact

SEQ ID NO: 1910814 - DNA, 12 bp, Homo sapiens
atctaataatga

SEQ ID NO: 1910815 - DNA, 12 bp, Homo sapiens
atctactgcatt

SEQ ID NO: 1910816 - DNA, 19 bp, Homo sapiens
atctagccagtgaacataa

SEQ ID NO: 1910817 - DNA, 21 bp, Homo sapiens
atctagctctccatactttga

SEQ ID NO: 1910818 - DNA, 19 bp, Homo sapiens
atctaggggagccttgatt

SEQ ID NO: 1910819 - DNA, 17 bp, Homo sapiens
atctcgccaacccctct

SEQ ID NO: 1910820 - DNA, 12 bp, Homo sapiens
atctctgaaaac

SEQ ID NO: 1910821 - DNA, 13 bp, Homo sapiens
atctgagaatgaa

SEQ ID NO: 1910822 - DNA, 16 bp, Homo sapiens
atctgataccaaagag

SEQ ID NO: 1910823 - DNA, 17 bp, Homo sapiens
atctgccacctgcacag

SEQ ID NO: 1910824 - DNA, 18 bp, Homo sapiens
atctggagttctcaaaga

SEQ ID NO: 1910825 - DNA, 18 bp, Homo sapiens
atctgggtagctgtaagg

SEQ ID NO: 1910826 - DNA, 12 bp, Homo sapiens
atctggttacag

SEQ ID NO: 1910827 - DNA, 18 bp, Homo sapiens
atctgtcacttgcattcc

SEQ ID NO: 1910828 - DNA, 18 bp, Homo sapiens
atctgtgcagggtattaa

SEQ ID NO: 1910829 - DNA, 13 bp, Homo sapiens
atcttactttgta

SEQ ID NO: 1910830 - DNA, 14 bp, Homo sapiens
atcttactttgtaa

SEQ ID NO: 1910831 - DNA, 21 bp, Homo sapiens
atcttactttgtaaattctga

SEQ ID NO: 1910832 - DNA, 22 bp, Homo sapiens
atcttactttgtaaattctgat

SEQ ID NO: 1910833 - DNA, 20 bp, Homo sapiens
atcttgtccaagttgtttca

SEQ ID NO: 1910834 - DNA, 14 bp, Homo sapiens
atcttgtgaaaata

SEQ ID NO: 1910835 - DNA, 18 bp, Homo sapiens
atcttgtgaaaataattg

SEQ ID NO: 1910836 - DNA, 19 bp, Homo sapiens
atctttaactgaactctga

SEQ ID NO: 1910837 - DNA, 14 bp, Homo sapiens
atctttgagtgtat

SEQ ID NO: 1910838 - DNA, 14 bp, Homo sapiens
atctttgatgtgtt

SEQ ID NO: 1910839 - DNA, 15 bp, Homo sapiens
atctttgatgtgttg

SEQ ID NO: 1910840 - DNA, 16 bp, Homo sapiens
atctttgatgtgttgt

SEQ ID NO: 1910841 - DNA, 20 bp, Homo sapiens
atgaaaacatggaacagtgt

SEQ ID NO: 1910842 - DNA, 18 bp, Homo sapiens
atgaaagaaaacttttat

SEQ ID NO: 1910843 - DNA, 18 bp, Homo sapiens
atgaactcaatataaaaa

SEQ ID NO: 1910844 - DNA, 14 bp, Homo sapiens
atgaagctgaggct

SEQ ID NO: 1910845 - DNA, 17 bp, Homo sapiens
atgaagtaaagtttctg

SEQ ID NO: 1910846 - DNA, 15 bp, Homo sapiens
atgaataaagtgcaa

SEQ ID NO: 1910847 - DNA, 18 bp, Homo sapiens
atgaataaagtgcaaaca

SEQ ID NO: 1910848 - DNA, 13 bp, Homo sapiens
atgacaacaaatt

SEQ ID NO: 1910849 - DNA, 16 bp, Homo sapiens
atgacaacaaattttg

SEQ ID NO: 1910850 - DNA, 20 bp, Homo sapiens
atgacccctgtaaggggcca

SEQ ID NO: 1910851 - DNA, 20 bp, Homo sapiens
atgacgtacaagtagttctg

SEQ ID NO: 1910852 - DNA, 23 bp, Homo sapiens
atgacgtacaagtagttctgtat

SEQ ID NO: 1910853 - DNA, 16 bp, Homo sapiens
atgactgaaaatgaac

SEQ ID NO: 1910854 - DNA, 16 bp, Homo sapiens
atgactttattgcatc

SEQ ID NO: 1910855 - DNA, 18 bp, Homo sapiens
atgactttcataataaat

SEQ ID NO: 1910856 - DNA, 11 bp, Homo sapiens
atgagaatgtt

SEQ ID NO: 1910857 - DNA, 20 bp, Homo sapiens
atgaggcagcacgtgcacaa

SEQ ID NO: 1910858 - DNA, 18 bp, Homo sapiens
atgagggagacagaccac

SEQ ID NO: 1910859 - DNA, 16 bp, Homo sapiens
atgagtccaaactgga

SEQ ID NO: 1910860 - DNA, 14 bp, Homo sapiens
atgatgtgcctgct

SEQ ID NO: 1910861 - DNA, 17 bp, Homo sapiens
atgatgttagttttcct

SEQ ID NO: 1910862 - DNA, 14 bp, Homo sapiens
atgattaaaaatat

SEQ ID NO: 1910863 - DNA, 14 bp, Homo sapiens
atgattaatgcatt

SEQ ID NO: 1910864 - DNA, 23 bp, Homo sapiens
atgcaaaaagctagtcaacagta

SEQ ID NO: 1910865 - DNA, 16 bp, Homo sapiens
atgcacacacctcatg

SEQ ID NO: 1910866 - DNA, 18 bp, Homo sapiens
atgcagaacttccctcca

SEQ ID NO: 1910867 - DNA, 13 bp, Homo sapiens
atgcatctttgat

SEQ ID NO: 1910868 - DNA, 16 bp, Homo sapiens
atgcatctttgatgtg

SEQ ID NO: 1910869 - DNA, 13 bp, Homo sapiens
cataagaggttct

SEQ ID NO: 1910870 - DNA, 17 bp, Homo sapiens
cataagaggttctaact

SEQ ID NO: 1910871 - DNA, 17 bp, Homo sapiens
cataagctttgtaattc

SEQ ID NO: 1910872 - DNA, 19 bp, Homo sapiens
cataaggagacttctgtct

SEQ ID NO: 1910873 - DNA, 18 bp, Homo sapiens
cataatactgaaatgctt

SEQ ID NO: 1910874 - DNA, 18 bp, Homo sapiens
cataatactgaaccactt

SEQ ID NO: 1910875 - DNA, 19 bp, Homo sapiens
cataatgaataaagtgcaa

SEQ ID NO: 1910876 - DNA, 22 bp, Homo sapiens
catacacaagcgtgtcaggctg

SEQ ID NO: 1910877 - DNA, 15 bp, Homo sapiens
catacgtaaaaatct

SEQ ID NO: 1910878 - DNA, 14 bp, Homo sapiens
catactcatgcatg

SEQ ID NO: 1910879 - DNA, 17 bp, Homo sapiens
catactcgagtctgagg

SEQ ID NO: 1910880 - DNA, 14 bp, Homo sapiens
catagagtacactg

SEQ ID NO: 1910881 - DNA, 18 bp, Homo sapiens
catagagtacactgcctg

SEQ ID NO: 1910882 - DNA, 19 bp, Homo sapiens
catagtggcttaactggac

SEQ ID NO: 1910883 - DNA, 16 bp, Homo sapiens
catagttttatttata

SEQ ID NO: 1910884 - DNA, 19 bp, Homo sapiens
catagttttatttatattt

SEQ ID NO: 1910885 - DNA, 17 bp, Homo sapiens
catataaattgtcttaa

SEQ ID NO: 1910886 - DNA, 15 bp, Homo sapiens
catatagaaagcttt

SEQ ID NO: 1910887 - DNA, 21 bp, Homo sapiens
catatatttcacactggagtg

SEQ ID NO: 1910888 - DNA, 21 bp, Homo sapiens
catatccttttagtctgcata

SEQ ID NO: 1910889 - DNA, 14 bp, Homo sapiens
catatctttgagtt

SEQ ID NO: 1910890 - DNA, 18 bp, Homo sapiens
catattttaaacagagga

SEQ ID NO: 1910891 - DNA, 13 bp, Homo sapiens
catatttttacaa

SEQ ID NO: 1910892 - DNA, 14 bp, Homo sapiens
catcactggcatgg

SEQ ID NO: 1910893 - DNA, 13 bp, Homo sapiens
catcacttaaaac

SEQ ID NO: 1910894 - DNA, 15 bp, Homo sapiens
catcacttaaaacac

SEQ ID NO: 1910895 - DNA, 17 bp, Homo sapiens
catcagaacagctgttg

SEQ ID NO: 1910896 - DNA, 15 bp, Homo sapiens
catcagctgctcaga

SEQ ID NO: 1910897 - DNA, 16 bp, Homo sapiens
catcagctgctcagat

SEQ ID NO: 1910898 - DNA, 19 bp, Homo sapiens
catcagctgctcagatccc

SEQ ID NO: 1910899 - DNA, 19 bp, Homo sapiens
catccatggggtctctcac

SEQ ID NO: 1910900 - DNA, 12 bp, Homo sapiens
catccccttcca

SEQ ID NO: 1910901 - DNA, 15 bp, Homo sapiens
catccctctcctctg

SEQ ID NO: 1910902 - DNA, 18 bp, Homo sapiens
catccgtttgccaatcat

SEQ ID NO: 1910903 - DNA, 12 bp, Homo sapiens
catcctcatggc

SEQ ID NO: 1910904 - DNA, 19 bp, Homo sapiens
catcgaggagctagaacat

SEQ ID NO: 1910905 - DNA, 17 bp, Homo sapiens
catctcccttttccatg

SEQ ID NO: 1910906 - DNA, 12 bp, Homo sapiens
catctcttcctt

SEQ ID NO: 1910907 - DNA, 14 bp, Homo sapiens
catctcttcctttc

SEQ ID NO: 1910908 - DNA, 15 bp, Homo sapiens
catctcttcctttcc

SEQ ID NO: 1910909 - DNA, 18 bp, Homo sapiens
catctcttcctttccttt

SEQ ID NO: 1910910 - DNA, 17 bp, Homo sapiens
catctgacctctacctt

SEQ ID NO: 1910911 - DNA, 13 bp, Homo sapiens
catctgtgaataa

SEQ ID NO: 1910912 - DNA, 23 bp, Homo sapiens
catcttttgttactcttgggaca

SEQ ID NO: 1910913 - DNA, 13 bp, Homo sapiens
catgaggaggcag

SEQ ID NO: 1910914 - DNA, 15 bp, Homo sapiens
catgaggaggcagag

SEQ ID NO: 1910915 - DNA, 17 bp, Homo sapiens
catgaggcctcctgcca

SEQ ID NO: 1910916 - DNA, 21 bp, Homo sapiens
catgatacgcttaaggtggaa

SEQ ID NO: 1910917 - DNA, 20 bp, Homo sapiens
catgcattcacatatctgct

SEQ ID NO: 1910918 - DNA, 12 bp, Homo sapiens
catgcctcctcc

SEQ ID NO: 1910919 - DNA, 14 bp, Homo sapiens
catgcctcctcctg

SEQ ID NO: 1910920 - DNA, 18 bp, Homo sapiens
catgctgtctggcacagc

SEQ ID NO: 1910921 - DNA, 21 bp, Homo sapiens
catgctgtctggcacagcctg

SEQ ID NO: 1910922 - DNA, 20 bp, Homo sapiens
catggaccatgctgtctggc

SEQ ID NO: 1910923 - DNA, 20 bp, Homo sapiens
catggcccatcaggggcagg

SEQ ID NO: 1910924 - DNA, 21 bp, Homo sapiens
catggcccatcaggggcagga

SEQ ID NO: 1910925 - DNA, 19 bp, Homo sapiens
catgggttaattgagaata

SEQ ID NO: 1910926 - DNA, 14 bp, Homo sapiens
catgtaatttgtgt

SEQ ID NO: 1910927 - DNA, 18 bp, Homo sapiens
catgtacatttgaaaata

SEQ ID NO: 1910928 - DNA, 22 bp, Homo sapiens
catgtataggtatgatctgtgt

SEQ ID NO: 1910929 - DNA, 12 bp, Homo sapiens
catgtatggcca

SEQ ID NO: 1910930 - DNA, 15 bp, Homo sapiens
catgtatggccagga

SEQ ID NO: 1910931 - DNA, 19 bp, Homo sapiens
catgtgttgcagctgtcac

SEQ ID NO: 1910932 - DNA, 21 bp, Homo sapiens
catgtgttgcagctgtcacca

SEQ ID NO: 1910933 - DNA, 15 bp, Homo sapiens
catgttggccaggct

SEQ ID NO: 1910934 - DNA, 14 bp, Homo sapiens
catgtttgcagtgt

SEQ ID NO: 1910935 - DNA, 13 bp, Homo sapiens
cattaaaagaaaa

SEQ ID NO: 1910936 - DNA, 14 bp, Homo sapiens
cattaaaagaaaat

SEQ ID NO: 1910937 - DNA, 17 bp, Homo sapiens
cattacttgttgcctat

SEQ ID NO: 1910938 - DNA, 14 bp, Homo sapiens
cattaggccccagc

SEQ ID NO: 1910939 - DNA, 13 bp, Homo sapiens
cattagtgggaaa

SEQ ID NO: 1910940 - DNA, 17 bp, Homo sapiens
cattatctacttgtgta

SEQ ID NO: 1910941 - DNA, 21 bp, Homo sapiens
cattccactttttgttacata

SEQ ID NO: 1910942 - DNA, 13 bp, Homo sapiens
cattccatttgct

SEQ ID NO: 1910943 - DNA, 17 bp, Homo sapiens
cattcgtacataatact

SEQ ID NO: 1910944 - DNA, 19 bp, Homo sapiens
cattcgtacataatactga

SEQ ID NO: 1910945 - DNA, 15 bp, Homo sapiens
cattctgactcatat

SEQ ID NO: 1910946 - DNA, 17 bp, Homo sapiens
cattcttaatttatgta

SEQ ID NO: 1910947 - DNA, 18 bp, Homo sapiens
cattcttaatttatgtaa

SEQ ID NO: 1910948 - DNA, 19 bp, Homo sapiens
cattcttctgatcactgaa

SEQ ID NO: 1910949 - DNA, 22 bp, Homo sapiens
cattcttctgatcactgaaata

SEQ ID NO: 1910950 - DNA, 19 bp, Homo sapiens
cattgcaaacaactgaaat

SEQ ID NO: 1910951 - DNA, 21 bp, Homo sapiens
cattgcaaacaactgaaatgt

SEQ ID NO: 1910952 - DNA, 14 bp, Homo sapiens
cattgcacaatata

SEQ ID NO: 1910953 - DNA, 20 bp, Homo sapiens
cattgtaaaagcattttgta

SEQ ID NO: 1910954 - DNA, 21 bp, Homo sapiens
cattgtaaaagcattttgtaa

SEQ ID NO: 1910955 - DNA, 21 bp, Homo sapiens
cattgtaagcgtatggcttta

SEQ ID NO: 1910956 - DNA, 12 bp, Homo sapiens
cattgtgaatgc

SEQ ID NO: 1910957 - DNA, 22 bp, Homo sapiens
catttaaaaataaatgtaaagt

SEQ ID NO: 1910958 - DNA, 19 bp, Homo sapiens
catttaaaacattaaaata

SEQ ID NO: 1910959 - DNA, 20 bp, Homo sapiens
catttaaaacattaaaatat

SEQ ID NO: 1910960 - DNA, 19 bp, Homo sapiens
catttacgcctgtaaatgt

SEQ ID NO: 1910961 - DNA, 18 bp, Homo sapiens
catttcaaaatatgtgta

SEQ ID NO: 1910962 - DNA, 12 bp, Homo sapiens
catttcaaataa

SEQ ID NO: 1910963 - DNA, 17 bp, Homo sapiens
catttcaaataactgca

SEQ ID NO: 1910964 - DNA, 19 bp, Homo sapiens
catttcaaggtaaaatgta

SEQ ID NO: 1910965 - DNA, 18 bp, Homo sapiens
catttcccaacacaaaga

SEQ ID NO: 1910966 - DNA, 12 bp, Homo sapiens
catttgaaaata

SEQ ID NO: 1910967 - DNA, 18 bp, Homo sapiens
catttggcttcctctgct

SEQ ID NO: 1910968 - DNA, 21 bp, Homo sapiens
catttggcttcctctgctgca

SEQ ID NO: 1910969 - DNA, 19 bp, Homo sapiens
catttgttgccagatttca

SEQ ID NO: 1910970 - DNA, 21 bp, Homo sapiens
cattttcagattcaggcattt

SEQ ID NO: 1910971 - DNA, 11 bp, Homo sapiens
cattttgaaat

SEQ ID NO: 1910972 - DNA, 17 bp, Homo sapiens
cattttgaaataaaaat

SEQ ID NO: 1910973 - DNA, 17 bp, Homo sapiens
ccaaaataagaaaagat

SEQ ID NO: 1910974 - DNA, 16 bp, Homo sapiens
ccaaacccaccctttc

SEQ ID NO: 1910975 - DNA, 18 bp, Homo sapiens
ccaaatatatttaatggt

SEQ ID NO: 1910976 - DNA, 19 bp, Homo sapiens
ccaaatgtgtgcccagctt

SEQ ID NO: 1910977 - DNA, 18 bp, Homo sapiens
ccaacccctcgcccagtc

SEQ ID NO: 1910978 - DNA, 15 bp, Homo sapiens
ccaactccacaccct

SEQ ID NO: 1910979 - DNA, 14 bp, Homo sapiens
ccaactgggcctct

SEQ ID NO: 1910980 - DNA, 16 bp, Homo sapiens
ccaagagtggccccac

SEQ ID NO: 1910981 - DNA, 21 bp, Homo sapiens
ccaagagtggccccacctggc

SEQ ID NO: 1910982 - DNA, 19 bp, Homo sapiens
ccaagccgtaggacccagt

SEQ ID NO: 1910983 - DNA, 16 bp, Homo sapiens
ccaagtctgacagcca

SEQ ID NO: 1910984 - DNA, 22 bp, Homo sapiens
ccaagtggatattttcttaaaa

SEQ ID NO: 1910985 - DNA, 16 bp, Homo sapiens
ccaagtgtattgtaat

SEQ ID NO: 1910986 - DNA, 14 bp, Homo sapiens
ccaataccccatgg

SEQ ID NO: 1910987 - DNA, 17 bp, Homo sapiens
ccaataccccatggacc

SEQ ID NO: 1910988 - DNA, 17 bp, Homo sapiens
ccaatcttactttgtaa

SEQ ID NO: 1910989 - DNA, 19 bp, Homo sapiens
ccaattctttagtgctgat

SEQ ID NO: 1910990 - DNA, 12 bp, Homo sapiens
ccacagaggctg

SEQ ID NO: 1910991 - DNA, 16 bp, Homo sapiens
ccacagcaaggctgtc

SEQ ID NO: 1910992 - DNA, 15 bp, Homo sapiens
ccacagcctcccctt

SEQ ID NO: 1910993 - DNA, 22 bp, Homo sapiens
ccacagcctccccttcccagac

SEQ ID NO: 1910994 - DNA, 14 bp, Homo sapiens
ccacaggtgcccgc

SEQ ID NO: 1910995 - DNA, 14 bp, Homo sapiens
ccacatccctctct

SEQ ID NO: 1910996 - DNA, 21 bp, Homo sapiens
ccacatccctctctgctggac

SEQ ID NO: 1910997 - DNA, 16 bp, Homo sapiens
ccacatcctcatggcc

SEQ ID NO: 1910998 - DNA, 21 bp, Homo sapiens
ccaccagcgcccccactcctc

SEQ ID NO: 1910999 - DNA, 22 bp, Homo sapiens
ccacccctctggcacctgggtt

SEQ ID NO: 1911000 - DNA, 16 bp, Homo sapiens
ccaccctgtcccaggc

SEQ ID NO: 1911001 - DNA, 19 bp, Homo sapiens
ccaccctgtcccaggcagc

SEQ ID NO: 1911002 - DNA, 15 bp, Homo sapiens
ccacctccccttgcc

SEQ ID NO: 1911003 - DNA, 17 bp, Homo sapiens
ccacctccccttgccag

SEQ ID NO: 1911004 - DNA, 20 bp, Homo sapiens
ccacctcctaaaaggcccag

SEQ ID NO: 1911005 - DNA, 17 bp, Homo sapiens
ccacctctgtgcagggc

SEQ ID NO: 1911006 - DNA, 17 bp, Homo sapiens
ccacctcttcctggccg

SEQ ID NO: 1911007 - DNA, 12 bp, Homo sapiens
ccacctggccct

SEQ ID NO: 1911008 - DNA, 18 bp, Homo sapiens
ccacctggccctctctga

SEQ ID NO: 1911009 - DNA, 19 bp, Homo sapiens
ccaccttcttgggactgct

SEQ ID NO: 1911010 - DNA, 22 bp, Homo sapiens
ccaccttcttgggactgctgtg

SEQ ID NO: 1911011 - DNA, 15 bp, Homo sapiens
ccacgcctagcctca

SEQ ID NO: 1911012 - DNA, 13 bp, Homo sapiens
ccacgctgactac

SEQ ID NO: 1911013 - DNA, 12 bp, Homo sapiens
ccactacagtaa

SEQ ID NO: 1911014 - DNA, 15 bp, Homo sapiens
ccactcctcctcctt

SEQ ID NO: 1911015 - DNA, 15 bp, Homo sapiens
ccactctcagaggcc

SEQ ID NO: 1911016 - DNA, 18 bp, Homo sapiens
ccactctcagaggcccca

SEQ ID NO: 1911017 - DNA, 19 bp, Homo sapiens
ccactgagcatcacaataa

SEQ ID NO: 1911018 - DNA, 23 bp, Homo sapiens
ccactggagtctctctctctcca

SEQ ID NO: 1911019 - DNA, 17 bp, Homo sapiens
ccactgtccgctgtctc

SEQ ID NO: 1911020 - DNA, 19 bp, Homo sapiens
ccactgtgcgtggggctcc

SEQ ID NO: 1911021 - DNA, 13 bp, Homo sapiens
ccacttccctggg

SEQ ID NO: 1911022 - DNA, 23 bp, Homo sapiens
ccacttccctgggttagactgcc

SEQ ID NO: 1911023 - DNA, 13 bp, Homo sapiens
ccacttctgccag

SEQ ID NO: 1911024 - DNA, 18 bp, Homo sapiens
ccacttgtagatttgatt

SEQ ID NO: 1911025 - DNA, 20 bp, Homo sapiens
ccacttgtagatttgatttt

SEQ ID NO: 1911026 - DNA, 17 bp, Homo sapiens
ccacttgtccatgtgaa

SEQ ID NO: 1911027 - DNA, 12 bp, Homo sapiens
ccagaaacaaca

SEQ ID NO: 1911028 - DNA, 18 bp, Homo sapiens
ccagaagacaaaggccca

SEQ ID NO: 1911029 - DNA, 15 bp, Homo sapiens
ccagaatactgatgg

SEQ ID NO: 1911030 - DNA, 20 bp, Homo sapiens
ccagacgctcattcagcatc

SEQ ID NO: 1911031 - DNA, 20 bp, Homo sapiens
ccagagagaagagccccact

SEQ ID NO: 1911032 - DNA, 17 bp, Homo sapiens
ccagagtagccatgagg

SEQ ID NO: 1911033 - DNA, 17 bp, Homo sapiens
ccagcacttcaggaggc

SEQ ID NO: 1911034 - DNA, 12 bp, Homo sapiens
ccagcagccagc

SEQ ID NO: 1911035 - DNA, 14 bp, Homo sapiens
ccagcagccagcca

SEQ ID NO: 1911036 - DNA, 12 bp, Homo sapiens
ccagcagccttc

SEQ ID NO: 1911037 - DNA, 16 bp, Homo sapiens
ccagcagccttccagt

SEQ ID NO: 1911038 - DNA, 17 bp, Homo sapiens
ccagcagccttccagtg

SEQ ID NO: 1911039 - DNA, 14 bp, Homo sapiens
ccagcaggctcctc

SEQ ID NO: 1911040 - DNA, 16 bp, Homo sapiens
ccagcaggctcctcag

SEQ ID NO: 1911041 - DNA, 19 bp, Homo sapiens
ccagcaggctcctcagccc

SEQ ID NO: 1911042 - DNA, 19 bp, Homo sapiens
ccagcatgtaaagagctgg

SEQ ID NO: 1911043 - DNA, 16 bp, Homo sapiens
ccagccaaacacacag

SEQ ID NO: 1911044 - DNA, 20 bp, Homo sapiens
ccagccaaacacacagaagg

SEQ ID NO: 1911045 - DNA, 18 bp, Homo sapiens
ccagcctcaaatccagga

SEQ ID NO: 1911046 - DNA, 23 bp, Homo sapiens
ccagcctcaaatccaggaccctg

SEQ ID NO: 1911047 - DNA, 22 bp, Homo sapiens
ccagcgcccccactcctcctcc

SEQ ID NO: 1911048 - DNA, 24 bp, Homo sapiens
ccagcgcccccactcctcctcctt

SEQ ID NO: 1911049 - DNA, 14 bp, Homo sapiens
ccagcggccctccc

SEQ ID NO: 1911050 - DNA, 19 bp, Homo sapiens
ccagcggccctcccaggcg

SEQ ID NO: 1911051 - DNA, 18 bp, Homo sapiens
ccagctccctcccctgct

SEQ ID NO: 1911052 - DNA, 16 bp, Homo sapiens
ccagctcttcctagct

SEQ ID NO: 1911053 - DNA, 20 bp, Homo sapiens
ccagctcttcctagctggag

SEQ ID NO: 1911054 - DNA, 14 bp, Homo sapiens
ccagctgtgctggg

SEQ ID NO: 1911055 - DNA, 16 bp, Homo sapiens
ccagctgtgctgggag

SEQ ID NO: 1911056 - DNA, 18 bp, Homo sapiens
ccagctgtgctgggaggt

SEQ ID NO: 1911057 - DNA, 21 bp, Homo sapiens
ccagctgtgctgggaggtccc

SEQ ID NO: 1911058 - DNA, 15 bp, Homo sapiens
ccagcttccagcagg

SEQ ID NO: 1911059 - DNA, 16 bp, Homo sapiens
ccagcttccagcagga

SEQ ID NO: 1911060 - DNA, 17 bp, Homo sapiens
ccagcttccagcaggag

SEQ ID NO: 1911061 - DNA, 14 bp, Homo sapiens
ccagcttctttgca

SEQ ID NO: 1911062 - DNA, 22 bp, Homo sapiens
ccaggaagtagcacaggctgag

SEQ ID NO: 1911063 - DNA, 22 bp, Homo sapiens
ccaggaattgatacgtttatta

SEQ ID NO: 1911064 - DNA, 13 bp, Homo sapiens
ccaggaccctgcc

SEQ ID NO: 1911065 - DNA, 11 bp, Homo sapiens
ccaggagccca

SEQ ID NO: 1911066 - DNA, 12 bp, Homo sapiens
ccaggagcccat

SEQ ID NO: 1911067 - DNA, 22 bp, Homo sapiens
ccaggatgctcccccagggaag

SEQ ID NO: 1911068 - DNA, 15 bp, Homo sapiens
ccaggcacaggcagg

SEQ ID NO: 1911069 - DNA, 19 bp, Homo sapiens
ccaggcagcgccactgtcc

SEQ ID NO: 1911070 - DNA, 19 bp, Homo sapiens
ccaggcatgttggactctg

SEQ ID NO: 1911071 - DNA, 23 bp, Homo sapiens
ccaggctgctctcaaacccctga

SEQ ID NO: 1911072 - DNA, 13 bp, Homo sapiens
ccagggaagaaac

SEQ ID NO: 1911073 - DNA, 19 bp, Homo sapiens
ccagggacagatccagcag

SEQ ID NO: 1911074 - DNA, 19 bp, Homo sapiens
ccagggatggcagtggctg

SEQ ID NO: 1911075 - DNA, 22 bp, Homo sapiens
ccagggatggcagtggctgtga

SEQ ID NO: 1911076 - DNA, 11 bp, Homo sapiens
ccagggcccta

SEQ ID NO: 1911077 - DNA, 13 bp, Homo sapiens
ccagggggcttcc

SEQ ID NO: 1911078 - DNA, 22 bp, Homo sapiens
ccagggggcttcctgaggggag

SEQ ID NO: 1911079 - DNA, 23 bp, Homo sapiens
ccagggggcttcctgaggggaga

SEQ ID NO: 1911080 - DNA, 20 bp, Homo sapiens
ccaggtgttgttgagggcat

SEQ ID NO: 1911081 - DNA, 16 bp, Homo sapiens
ccagtaagatcactgt

SEQ ID NO: 1911082 - DNA, 17 bp, Homo sapiens
ccagtaagatcactgtt

SEQ ID NO: 1911083 - DNA, 18 bp, Homo sapiens
ccagtaccttctgccaga

SEQ ID NO: 1911084 - DNA, 14 bp, Homo sapiens
ccagtcccagcagc

SEQ ID NO: 1911085 - DNA, 14 bp, Homo sapiens
ccagtgaggcatct

SEQ ID NO: 1911086 - DNA, 22 bp, Homo sapiens
ccagtgaggcatctctctggga

SEQ ID NO: 1911087 - DNA, 21 bp, Homo sapiens
ccagtggcagggcacagggcc

SEQ ID NO: 1911088 - DNA, 15 bp, Homo sapiens
ccagttgctgtcaca

SEQ ID NO: 1911089 - DNA, 17 bp, Homo sapiens
ccagttgttttgtcttg

SEQ ID NO: 1911090 - DNA, 16 bp, Homo sapiens
ccatagagtacactgc

SEQ ID NO: 1911091 - DNA, 20 bp, Homo sapiens
ccatagagtacactgcctgc

SEQ ID NO: 1911092 - DNA, 22 bp, Homo sapiens
ccatagagtacactgcctgcct

SEQ ID NO: 1911093 - DNA, 13 bp, Homo sapiens
ccatcaggggcag

SEQ ID NO: 1911094 - DNA, 17 bp, Homo sapiens
ccatccacccctctggc

SEQ ID NO: 1911095 - DNA, 21 bp, Homo sapiens
ccatccaccgtcccctcccag

SEQ ID NO: 1911096 - DNA, 14 bp, Homo sapiens
ccatcctgaactgg

SEQ ID NO: 1911097 - DNA, 13 bp, Homo sapiens
ccatctcttcctt

SEQ ID NO: 1911098 - DNA, 12 bp, Homo sapiens
ccatctgtgaat

SEQ ID NO: 1911099 - DNA, 22 bp, Homo sapiens
ccatcttttgttactcttggga

SEQ ID NO: 1911100 - DNA, 14 bp, Homo sapiens
ccatgaaagaaaac

SEQ ID NO: 1911101 - DNA, 19 bp, Homo sapiens
ccatgaggaggcagagagg

SEQ ID NO: 1911102 - DNA, 19 bp, Homo sapiens
ccatgaggcctcctgccat

SEQ ID NO: 1911103 - DNA, 20 bp, Homo sapiens
ccatgaggcctcctgccatg

SEQ ID NO: 1911104 - DNA, 16 bp, Homo sapiens
ccatgctgtctggcac

SEQ ID NO: 1911105 - DNA, 22 bp, Homo sapiens
ccatgctgtctggcacagcctg

SEQ ID NO: 1911106 - DNA, 19 bp, Homo sapiens
ccatgcttcagtgaacata

SEQ ID NO: 1911107 - DNA, 13 bp, Homo sapiens
ccatgggcaggag

SEQ ID NO: 1911108 - DNA, 15 bp, Homo sapiens
ccatgtatggccagg

SEQ ID NO: 1911109 - DNA, 21 bp, Homo sapiens
ccatgtatggccaggaagtag

SEQ ID NO: 1911110 - DNA, 23 bp, Homo sapiens
ccatgttggccaggctgctctca

SEQ ID NO: 1911111 - DNA, 14 bp, Homo sapiens
ccattgcagaccct

SEQ ID NO: 1911112 - DNA, 20 bp, Homo sapiens
ccatttaatggggaggacaa

SEQ ID NO: 1911113 - DNA, 15 bp, Homo sapiens
ccatttccccagggc

SEQ ID NO: 1911114 - DNA, 16 bp, Homo sapiens
ccatttccccagggca

SEQ ID NO: 1911115 - DNA, 18 bp, Homo sapiens
ccatttggagggcctggg

SEQ ID NO: 1911116 - DNA, 21 bp, Homo sapiens
ccatttggagggcctgggcct

SEQ ID NO: 1911117 - DNA, 18 bp, Homo sapiens
cccaaatgtgtgcccagc

SEQ ID NO: 1911118 - DNA, 19 bp, Homo sapiens
cccaaatgtgtgcccagct

SEQ ID NO: 1911119 - DNA, 22 bp, Homo sapiens
cccaagtctgacagccagagcg

SEQ ID NO: 1911120 - DNA, 16 bp, Homo sapiens
cccaataccccatgga

SEQ ID NO: 1911121 - DNA, 17 bp, Homo sapiens
cccaataccccatggac

SEQ ID NO: 1911122 - DNA, 12 bp, Homo sapiens
cccaatcacccc

SEQ ID NO: 1911123 - DNA, 12 bp, Homo sapiens
cccacctggccc

SEQ ID NO: 1911124 - DNA, 13 bp, Homo sapiens
cccacctggccct

SEQ ID NO: 1911125 - DNA, 14 bp, Homo sapiens
cccaccttcttggg

SEQ ID NO: 1911126 - DNA, 22 bp, Homo sapiens
cccaccttcttgggactgctgt

SEQ ID NO: 1911127 - DNA, 20 bp, Homo sapiens
cccacgctgactacagggcc

SEQ ID NO: 1911128 - DNA, 15 bp, Homo sapiens
cccactacgggcacc

SEQ ID NO: 1911129 - DNA, 22 bp, Homo sapiens
cccactcccatggctctgggcg

SEQ ID NO: 1911130 - DNA, 12 bp, Homo sapiens
cccactctcaga

SEQ ID NO: 1911131 - DNA, 13 bp, Homo sapiens
cccactctcagag

SEQ ID NO: 1911132 - DNA, 22 bp, Homo sapiens
cccagaccccgcagcacgcctc

SEQ ID NO: 1911133 - DNA, 19 bp, Homo sapiens
cccagagagaagagcccca

SEQ ID NO: 1911134 - DNA, 15 bp, Homo sapiens
cccagccctccagta

SEQ ID NO: 1911135 - DNA, 18 bp, Homo sapiens
cccagccctccagtacct

SEQ ID NO: 1911136 - DNA, 18 bp, Homo sapiens
cccagctgtgctgggagg

SEQ ID NO: 1911137 - DNA, 15 bp, Homo sapiens
cccagcttccagcag

SEQ ID NO: 1911138 - DNA, 13 bp, Homo sapiens
cccaggagcccat

SEQ ID NO: 1911139 - DNA, 14 bp, Homo sapiens
cccaggcagagagc

SEQ ID NO: 1911140 - DNA, 12 bp, Homo sapiens
cccagttgctgt

SEQ ID NO: 1911141 - DNA, 21 bp, Homo sapiens
cccatccaccgtcccctccca

SEQ ID NO: 1911142 - DNA, 22 bp, Homo sapiens
cccatccaccgtcccctcccag

SEQ ID NO: 1911143 - DNA, 17 bp, Homo sapiens
cccatcccgtttccctc

SEQ ID NO: 1911144 - DNA, 18 bp, Homo sapiens
cccatcccgtttccctcc

SEQ ID NO: 1911145 - DNA, 19 bp, Homo sapiens
cccatcccgtttccctcca

SEQ ID NO: 1911146 - DNA, 14 bp, Homo sapiens
cccatgggcaggag

SEQ ID NO: 1911147 - DNA, 19 bp, Homo sapiens
ccccaataccccatggacc

SEQ ID NO: 1911148 - DNA, 15 bp, Homo sapiens
ccccaccctgtccca

SEQ ID NO: 1911149 - DNA, 20 bp, Homo sapiens
ccccacctggccctctctga

SEQ ID NO: 1911150 - DNA, 18 bp, Homo sapiens
ccccactcctcctccttt

SEQ ID NO: 1911151 - DNA, 11 bp, Homo sapiens
ccccactctca

SEQ ID NO: 1911152 - DNA, 12 bp, Homo sapiens
ccccactctcag

SEQ ID NO: 1911153 - DNA, 19 bp, Homo sapiens
ccccagcgagagtccctgc

SEQ ID NO: 1911154 - DNA, 18 bp, Homo sapiens
ccccagcttccagcagga

SEQ ID NO: 1911155 - DNA, 12 bp, Homo sapiens
ccccagggcacg

SEQ ID NO: 1911156 - DNA, 12 bp, Homo sapiens
ccccatctgtga

SEQ ID NO: 1911157 - DNA, 17 bp, Homo sapiens
cccccatcccgtttccc

SEQ ID NO: 1911158 - DNA, 20 bp, Homo sapiens
cccccatcccgtttccctcc

SEQ ID NO: 1911159 - DNA, 22 bp, Homo sapiens
cccccatcccgtttccctccag

SEQ ID NO: 1911160 - DNA, 24 bp, Homo sapiens
ccccgcagtcgtcagcctccctga

SEQ ID NO: 1911161 - DNA, 13 bp, Homo sapiens
cccctcccaggga

SEQ ID NO: 1911162 - DNA, 14 bp, Homo sapiens
cccctcccctcctt

SEQ ID NO: 1911163 - DNA, 12 bp, Homo sapiens
cccctgcagctg

SEQ ID NO: 1911164 - DNA, 20 bp, Homo sapiens
cccctgcagttcccctggaa

SEQ ID NO: 1911165 - DNA, 23 bp, Homo sapiens
cccctggaagcagtgcccaggtg

SEQ ID NO: 1911166 - DNA, 16 bp, Homo sapiens
cccctggaccccagcc

SEQ ID NO: 1911167 - DNA, 16 bp, Homo sapiens
cccctggcaaatgcac

SEQ ID NO: 1911168 - DNA, 14 bp, Homo sapiens
cccctgtgtgacat

SEQ ID NO: 1911169 - DNA, 15 bp, Homo sapiens
ccccttccagctccc

SEQ ID NO: 1911170 - DNA, 23 bp, Homo sapiens
ccccttccagctccctcccctgc

SEQ ID NO: 1911171 - DNA, 16 bp, Homo sapiens
ccccttgccagctgct

SEQ ID NO: 1911172 - DNA, 21 bp, Homo sapiens
ccccttgccagctgctgagcc

SEQ ID NO: 1911173 - DNA, 10 bp, Homo sapiens
cccctttctt

SEQ ID NO: 1911174 - DNA, 22 bp, Homo sapiens
cccctttttctttcccttcttt

SEQ ID NO: 1911175 - DNA, 12 bp, Homo sapiens
cccgactccagt

SEQ ID NO: 1911176 - DNA, 19 bp, Homo sapiens
cccgatcctcccctggact

SEQ ID NO: 1911177 - DNA, 16 bp, Homo sapiens
cccgcaagcaccatcc

SEQ ID NO: 1911178 - DNA, 18 bp, Homo sapiens
cccgcagtcgtcagcctc

SEQ ID NO: 1911179 - DNA, 19 bp, Homo sapiens
cccggcagcgaggctgggc

SEQ ID NO: 1911180 - DNA, 15 bp, Homo sapiens
cccgggcccaggcag

SEQ ID NO: 1911181 - DNA, 14 bp, Homo sapiens
cccgtttccctcca

SEQ ID NO: 1911182 - DNA, 14 bp, Homo sapiens
ccctaataagaccc

SEQ ID NO: 1911183 - DNA, 13 bp, Homo sapiens
ccctcactctcag

SEQ ID NO: 1911184 - DNA, 14 bp, Homo sapiens
ccctcactctcagg

SEQ ID NO: 1911185 - DNA, 15 bp, Homo sapiens
ccctcactctcagga

SEQ ID NO: 1911186 - DNA, 10 bp, Homo sapiens
ccctccaagg

SEQ ID NO: 1911187 - DNA, 13 bp, Homo sapiens
ccctccagtacct

SEQ ID NO: 1911188 - DNA, 14 bp, Homo sapiens
ccctcccagggagc

SEQ ID NO: 1911189 - DNA, 14 bp, Homo sapiens
ccctcccctgctca

SEQ ID NO: 1911190 - DNA, 22 bp, Homo sapiens
ccctccgccccgtccccccatc

SEQ ID NO: 1911191 - DNA, 16 bp, Homo sapiens
ccctcctccctcccag

SEQ ID NO: 1911192 - DNA, 23 bp, Homo sapiens
ccctcctttaccgaggacagcct

SEQ ID NO: 1911193 - DNA, 11 bp, Homo sapiens
ccctcctttcc

SEQ ID NO: 1911194 - DNA, 18 bp, Homo sapiens
ccctctcctctgccctct

SEQ ID NO: 1911195 - DNA, 22 bp, Homo sapiens
ccctctcctctgccctctgctc

SEQ ID NO: 1911196 - DNA, 23 bp, Homo sapiens
ccctctctgaaggaggccacctc

SEQ ID NO: 1911197 - DNA, 16 bp, Homo sapiens
ccctgacgtctgccac

SEQ ID NO: 1911198 - DNA, 13 bp, Homo sapiens
ccctgccaggcac

SEQ ID NO: 1911199 - DNA, 15 bp, Homo sapiens
ccctgccaggcacag

SEQ ID NO: 1911200 - DNA, 20 bp, Homo sapiens
ccctgccaggcacaggcagg

SEQ ID NO: 1911201 - DNA, 21 bp, Homo sapiens
ccctgcctctccgcccctgag

SEQ ID NO: 1911202 - DNA, 23 bp, Homo sapiens
ccctgctgtatcttccagaacct

SEQ ID NO: 1911203 - DNA, 16 bp, Homo sapiens
ccctgcttggcccagg

SEQ ID NO: 1911204 - DNA, 17 bp, Homo sapiens
ccctggaagcagtgccc

SEQ ID NO: 1911205 - DNA, 14 bp, Homo sapiens
ccctggaccccagc

SEQ ID NO: 1911206 - DNA, 18 bp, Homo sapiens
ccctggaccccagcctca

SEQ ID NO: 1911207 - DNA, 14 bp, Homo sapiens
ccctggagctcaag

SEQ ID NO: 1911208 - DNA, 23 bp, Homo sapiens
ccctggcaaatgcacacacctca

SEQ ID NO: 1911209 - DNA, 17 bp, Homo sapiens
ccctggcccccacatgg

SEQ ID NO: 1911210 - DNA, 10 bp, Homo sapiens
ccctgggcct

SEQ ID NO: 1911211 - DNA, 12 bp, Homo sapiens
ccctgggcctcc

SEQ ID NO: 1911212 - DNA, 15 bp, Homo sapiens
ccctgggcctccacc

SEQ ID NO: 1911213 - DNA, 16 bp, Homo sapiens
ccctgggcctccacct

SEQ ID NO: 1911214 - DNA, 18 bp, Homo sapiens
ccctgggcctccacctct

SEQ ID NO: 1911215 - DNA, 18 bp, Homo sapiens
ccctgggttagactgcca

SEQ ID NO: 1911216 - DNA, 20 bp, Homo sapiens
ccctgggttagactgccagc

SEQ ID NO: 1911217 - DNA, 22 bp, Homo sapiens
ccctgggttagactgccagctc

SEQ ID NO: 1911218 - DNA, 12 bp, Homo sapiens
ccctgtccctcc

SEQ ID NO: 1911219 - DNA, 13 bp, Homo sapiens
ccctgtgttaatt

SEQ ID NO: 1911220 - DNA, 21 bp, Homo sapiens
cccttatttaaaactcacctc

SEQ ID NO: 1911221 - DNA, 14 bp, Homo sapiens
cccttccagctccc

SEQ ID NO: 1911222 - DNA, 17 bp, Homo sapiens
cccttccagctccctcc

SEQ ID NO: 1911223 - DNA, 18 bp, Homo sapiens
cccttccagctccctccc

SEQ ID NO: 1911224 - DNA, 21 bp, Homo sapiens
cccttccagctccctcccctg

SEQ ID NO: 1911225 - DNA, 17 bp, Homo sapiens
cccttccatctgattcc

SEQ ID NO: 1911226 - DNA, 12 bp, Homo sapiens
cccttgcagccg

SEQ ID NO: 1911227 - DNA, 13 bp, Homo sapiens
ccctttctggcac

SEQ ID NO: 1911228 - DNA, 21 bp, Homo sapiens
ccctttctggcacgaaatggc

SEQ ID NO: 1911229 - DNA, 14 bp, Homo sapiens
ccctttttctttcc

SEQ ID NO: 1911230 - DNA, 19 bp, Homo sapiens
ccgaaagaggcacccttcc

SEQ ID NO: 1911231 - DNA, 22 bp, Homo sapiens
ccgaggacagcctgcctctgcc

SEQ ID NO: 1911232 - DNA, 23 bp, Homo sapiens
ccgaggacagcctgcctctgcca

SEQ ID NO: 1911233 - DNA, 20 bp, Homo sapiens
ccgaggcgggtggatcacga

SEQ ID NO: 1911234 - DNA, 22 bp, Homo sapiens
ccgaggctcgagctcggggctg

SEQ ID NO: 1911235 - DNA, 22 bp, Homo sapiens
ccgagggtggtttacctgcacc

SEQ ID NO: 1911236 - DNA, 19 bp, Homo sapiens
ccgagtctttctcactgcc

SEQ ID NO: 1911237 - DNA, 20 bp, Homo sapiens
ccgagtctttctcactgcct

SEQ ID NO: 1911238 - DNA, 14 bp, Homo sapiens
ccgcaagcaccatc

SEQ ID NO: 1911239 - DNA, 11 bp, Homo sapiens
ccgcactggga

SEQ ID NO: 1911240 - DNA, 15 bp, Homo sapiens
ccgcactgggagcag

SEQ ID NO: 1911241 - DNA, 23 bp, Homo sapiens
ccgcagagaagtgacggttccta

SEQ ID NO: 1911242 - DNA, 16 bp, Homo sapiens
ccgcagatggctggaa

SEQ ID NO: 1911243 - DNA, 15 bp, Homo sapiens
ccgcccctgagccca

SEQ ID NO: 1911244 - DNA, 15 bp, Homo sapiens
ccggaaagagagctg

SEQ ID NO: 1911245 - DNA, 16 bp, Homo sapiens
ccggcaataaaagccc

SEQ ID NO: 1911246 - DNA, 18 bp, Homo sapiens
ccggcaataaaagcccag

SEQ ID NO: 1911247 - DNA, 19 bp, Homo sapiens
ccggcaataaaagcccagg

SEQ ID NO: 1911248 - DNA, 15 bp, Homo sapiens
ccggcatgaggcccc

SEQ ID NO: 1911249 - DNA, 13 bp, Homo sapiens
ccggcgggactgt

SEQ ID NO: 1911250 - DNA, 16 bp, Homo sapiens
ccggctaagcaggcgc

SEQ ID NO: 1911251 - DNA, 12 bp, Homo sapiens
ccgggactctgc

SEQ ID NO: 1911252 - DNA, 16 bp, Homo sapiens
ccggggtccaggcatg

SEQ ID NO: 1911253 - DNA, 17 bp, Homo sapiens
ccggtgtgggggccccg

SEQ ID NO: 1911254 - DNA, 23 bp, Homo sapiens
ccgtacgactcttttccaaacac

SEQ ID NO: 1911255 - DNA, 14 bp, Homo sapiens
ccgtccccccatcc

SEQ ID NO: 1911256 - DNA, 15 bp, Homo sapiens
ccgtcccctcccagg

SEQ ID NO: 1911257 - DNA, 17 bp, Homo sapiens
ccgtgaagatactttgt

SEQ ID NO: 1911258 - DNA, 18 bp, Homo sapiens
ccgtgaagatactttgta

SEQ ID NO: 1911259 - DNA, 14 bp, Homo sapiens
ccgttgctgactta

SEQ ID NO: 1911260 - DNA, 15 bp, Homo sapiens
ccgttgctgacttag

SEQ ID NO: 1911261 - DNA, 17 bp, Homo sapiens
ccgttgctgacttagaa

SEQ ID NO: 1911262 - DNA, 15 bp, Homo sapiens
ccgtttccctccagg

SEQ ID NO: 1911263 - DNA, 16 bp, Homo sapiens
ccgtttccctccaggt

SEQ ID NO: 1911264 - DNA, 19 bp, Homo sapiens
cctaaagcctcaaaacaaa

SEQ ID NO: 1911265 - DNA, 23 bp, Homo sapiens
cctaacgttttctactttgaaat

SEQ ID NO: 1911266 - DNA, 19 bp, Homo sapiens
cctagaagatcacagcagg

SEQ ID NO: 1911267 - DNA, 20 bp, Homo sapiens
cctagaagatcacagcaggg

SEQ ID NO: 1911268 - DNA, 19 bp, Homo sapiens
cctagctggagaggagccc

SEQ ID NO: 1911269 - DNA, 12 bp, Homo sapiens
ctctgaggacaa

SEQ ID NO: 1911270 - DNA, 19 bp, Homo sapiens
ctctgccacagcaaggctg

SEQ ID NO: 1911271 - DNA, 17 bp, Homo sapiens
ctctgccccttgggcct

SEQ ID NO: 1911272 - DNA, 19 bp, Homo sapiens
ctctgccccttgggcctcc

SEQ ID NO: 1911273 - DNA, 20 bp, Homo sapiens
ctctgccccttgggcctccc

SEQ ID NO: 1911274 - DNA, 23 bp, Homo sapiens
ctctgccccttgggcctcccact

SEQ ID NO: 1911275 - DNA, 24 bp, Homo sapiens
ctctgccccttgggcctcccactc

SEQ ID NO: 1911276 - DNA, 15 bp, Homo sapiens
ctctgccctctgctc

SEQ ID NO: 1911277 - DNA, 23 bp, Homo sapiens
ctctgctctaattgctgccagga

SEQ ID NO: 1911278 - DNA, 13 bp, Homo sapiens
ctctgctgcatcc

SEQ ID NO: 1911279 - DNA, 19 bp, Homo sapiens
ctctgctgcatccccttcc

SEQ ID NO: 1911280 - DNA, 18 bp, Homo sapiens
ctctgctggacgtccagg

SEQ ID NO: 1911281 - DNA, 13 bp, Homo sapiens
ctctggcacctgg

SEQ ID NO: 1911282 - DNA, 23 bp, Homo sapiens
ctctgggcggtccagaaggagca

SEQ ID NO: 1911283 - DNA, 17 bp, Homo sapiens
ctctggtacaatttctt

SEQ ID NO: 1911284 - DNA, 22 bp, Homo sapiens
ctctgttacactttttggaagt

SEQ ID NO: 1911285 - DNA, 22 bp, Homo sapiens
ctctgttgcccaggctggagtg

SEQ ID NO: 1911286 - DNA, 15 bp, Homo sapiens
ctcttacacactgga

SEQ ID NO: 1911287 - DNA, 13 bp, Homo sapiens
ctcttcctttcct

SEQ ID NO: 1911288 - DNA, 18 bp, Homo sapiens
ctcttctcattacttgtt

SEQ ID NO: 1911289 - DNA, 16 bp, Homo sapiens
ctcttctcctgcagcc

SEQ ID NO: 1911290 - DNA, 13 bp, Homo sapiens
ctcttgagttgtt

SEQ ID NO: 1911291 - DNA, 16 bp, Homo sapiens
ctcttgagttgttttt

SEQ ID NO: 1911292 - DNA, 18 bp, Homo sapiens
ctcttgagttgtttttgt

SEQ ID NO: 1911293 - DNA, 22 bp, Homo sapiens
ctcttgagttgtttttgtatat

SEQ ID NO: 1911294 - DNA, 22 bp, Homo sapiens
ctctttctaagagacctgaact

SEQ ID NO: 1911295 - DNA, 23 bp, Homo sapiens
ctctttctaagagacctgaactg

SEQ ID NO: 1911296 - DNA, 14 bp, Homo sapiens
ctctttctctctca

SEQ ID NO: 1911297 - DNA, 12 bp, Homo sapiens
ctctttggaaaa

SEQ ID NO: 1911298 - DNA, 18 bp, Homo sapiens
ctcttttccctcctttcc

SEQ ID NO: 1911299 - DNA, 18 bp, Homo sapiens
ctgaaaagctgtgtactt

SEQ ID NO: 1911300 - DNA, 18 bp, Homo sapiens
ctgaaaatttatataact

SEQ ID NO: 1911301 - DNA, 19 bp, Homo sapiens
ctgaaaatttatataactg

SEQ ID NO: 1911302 - DNA, 18 bp, Homo sapiens
ctgaaagatatgtatatt

SEQ ID NO: 1911303 - DNA, 13 bp, Homo sapiens
ctgaaataaaagc

SEQ ID NO: 1911304 - DNA, 21 bp, Homo sapiens
ctgaaatgctttagcatacta

SEQ ID NO: 1911305 - DNA, 14 bp, Homo sapiens
ctgaacattgcata

SEQ ID NO: 1911306 - DNA, 14 bp, Homo sapiens
ctgaaccacttgta

SEQ ID NO: 1911307 - DNA, 17 bp, Homo sapiens
ctgaaccacttgtagat

SEQ ID NO: 1911308 - DNA, 18 bp, Homo sapiens
ctgaaccacttgtagatt

SEQ ID NO: 1911309 - DNA, 23 bp, Homo sapiens
ctgaacgtttggttcaaatgtgt

SEQ ID NO: 1911310 - DNA, 18 bp, Homo sapiens
ctgaagagtttgtaaatg

SEQ ID NO: 1911311 - DNA, 20 bp, Homo sapiens
ctgaagagtttgtaaatgac

SEQ ID NO: 1911312 - DNA, 18 bp, Homo sapiens
ctgaaggggttttcttga

SEQ ID NO: 1911313 - DNA, 20 bp, Homo sapiens
ctgaaggggttttcttgata

SEQ ID NO: 1911314 - DNA, 14 bp, Homo sapiens
ctgaagtgcatggg

SEQ ID NO: 1911315 - DNA, 18 bp, Homo sapiens
ctgaatttttatgtgtga

SEQ ID NO: 1911316 - DNA, 20 bp, Homo sapiens
ctgaatttttatgtgtgatt

SEQ ID NO: 1911317 - DNA, 13 bp, Homo sapiens
ctgacaaagtggg

SEQ ID NO: 1911318 - DNA, 16 bp, Homo sapiens
ctgacagagggatgga

SEQ ID NO: 1911319 - DNA, 12 bp, Homo sapiens
ctgacagccaga

SEQ ID NO: 1911320 - DNA, 15 bp, Homo sapiens
ctgacagccagagcg

SEQ ID NO: 1911321 - DNA, 17 bp, Homo sapiens
ctgacccatgggcagga

SEQ ID NO: 1911322 - DNA, 23 bp, Homo sapiens
ctgacccctgtgtgacatcacag

SEQ ID NO: 1911323 - DNA, 18 bp, Homo sapiens
ctgacctggatatccatg

SEQ ID NO: 1911324 - DNA, 14 bp, Homo sapiens
ctgactacagggcc

SEQ ID NO: 1911325 - DNA, 21 bp, Homo sapiens
ctgactataccaactgggcct

SEQ ID NO: 1911326 - DNA, 22 bp, Homo sapiens
ctgactataccaactgggcctc

SEQ ID NO: 1911327 - DNA, 11 bp, Homo sapiens
ctgactgaggc

SEQ ID NO: 1911328 - DNA, 17 bp, Homo sapiens
ctgactgaggcagtttg

SEQ ID NO: 1911329 - DNA, 12 bp, Homo sapiens
ctgactttgaat

SEQ ID NO: 1911330 - DNA, 18 bp, Homo sapiens
ctgactttgaatttatat

SEQ ID NO: 1911331 - DNA, 22 bp, Homo sapiens
ctgactttgaatttatataaag

SEQ ID NO: 1911332 - DNA, 17 bp, Homo sapiens
ctgagagcccagaaaag

SEQ ID NO: 1911333 - DNA, 17 bp, Homo sapiens
ctgagatggatggacag

SEQ ID NO: 1911334 - DNA, 21 bp, Homo sapiens
ctgagatggatggacagacag

SEQ ID NO: 1911335 - DNA, 17 bp, Homo sapiens
ctgagcatcacaataaa

SEQ ID NO: 1911336 - DNA, 11 bp, Homo sapiens
ctgagcccact

SEQ ID NO: 1911337 - DNA, 17 bp, Homo sapiens
ctgagcccccagcttcc

SEQ ID NO: 1911338 - DNA, 22 bp, Homo sapiens
ctgagcccccagcttccagcag

SEQ ID NO: 1911339 - DNA, 23 bp, Homo sapiens
ctgagcccccagcttccagcagg

SEQ ID NO: 1911340 - DNA, 19 bp, Homo sapiens
ctgagctcatttggggacc

SEQ ID NO: 1911341 - DNA, 11 bp, Homo sapiens
ctgaggcccat

SEQ ID NO: 1911342 - DNA, 13 bp, Homo sapiens
ctgaggcccatgg

SEQ ID NO: 1911343 - DNA, 19 bp, Homo sapiens
ctgaggcccatggccacat

SEQ ID NO: 1911344 - DNA, 23 bp, Homo sapiens
ctgaggcctaaaagtaaacatta

SEQ ID NO: 1911345 - DNA, 16 bp, Homo sapiens
ctgaggctgctgccag

SEQ ID NO: 1911346 - DNA, 17 bp, Homo sapiens
ctgaggctgctgccagg

SEQ ID NO: 1911347 - DNA, 18 bp, Homo sapiens
ctgaggctgctgccaggc

SEQ ID NO: 1911348 - DNA, 20 bp, Homo sapiens
ctgagggcttgtagttcttt

SEQ ID NO: 1911349 - DNA, 19 bp, Homo sapiens
ctgaggggagacagagcaa

SEQ ID NO: 1911350 - DNA, 22 bp, Homo sapiens
ctgaggtgatgaagacagcccg

SEQ ID NO: 1911351 - DNA, 15 bp, Homo sapiens
ctgagtgcaggccca

SEQ ID NO: 1911352 - DNA, 17 bp, Homo sapiens
ctgagtgcaggcccacc

SEQ ID NO: 1911353 - DNA, 21 bp, Homo sapiens
ctgagtgcaggcccaccctgc

SEQ ID NO: 1911354 - DNA, 16 bp, Homo sapiens
ctgagttgttacccca

SEQ ID NO: 1911355 - DNA, 17 bp, Homo sapiens
ctgataccaaagagaca

SEQ ID NO: 1911356 - DNA, 14 bp, Homo sapiens
ctgatatcagcact

SEQ ID NO: 1911357 - DNA, 17 bp, Homo sapiens
ctgatgttccctccggt

SEQ ID NO: 1911358 - DNA, 20 bp, Homo sapiens
ctgattttgaccttgtattg

SEQ ID NO: 1911359 - DNA, 17 bp, Homo sapiens
ctgcacacaagaggcta

SEQ ID NO: 1911360 - DNA, 14 bp, Homo sapiens
ctgcactgactctg

SEQ ID NO: 1911361 - DNA, 15 bp, Homo sapiens
ctgcactgactctgg

SEQ ID NO: 1911362 - DNA, 19 bp, Homo sapiens
ctgcacttgggggctcagc

SEQ ID NO: 1911363 - DNA, 23 bp, Homo sapiens
ctgcacttgggggctcagcaagg

SEQ ID NO: 1911364 - DNA, 15 bp, Homo sapiens
ctgcagaaaaaatat

SEQ ID NO: 1911365 - DNA, 20 bp, Homo sapiens
ctgcagaacagcttcatgtt

SEQ ID NO: 1911366 - DNA, 21 bp, Homo sapiens
ctgcagagcagtaagggaaca

SEQ ID NO: 1911367 - DNA, 10 bp, Homo sapiens
ctgcagggct

SEQ ID NO: 1911368 - DNA, 12 bp, Homo sapiens
ctgcatcccctt

SEQ ID NO: 1911369 - DNA, 20 bp, Homo sapiens
ctgcatccccttccagctcc

SEQ ID NO: 1911370 - DNA, 20 bp, Homo sapiens
cttatatttacaacacttta

SEQ ID NO: 1911371 - DNA, 13 bp, Homo sapiens
cttatgagatggg

SEQ ID NO: 1911372 - DNA, 15 bp, Homo sapiens
cttatgccatcccgg

SEQ ID NO: 1911373 - DNA, 21 bp, Homo sapiens
cttcaaaagtttgtttgctta

SEQ ID NO: 1911374 - DNA, 17 bp, Homo sapiens
cttcagccaccctttct

SEQ ID NO: 1911375 - DNA, 21 bp, Homo sapiens
cttcagccaccctttctggca

SEQ ID NO: 1911376 - DNA, 24 bp, Homo sapiens
cttcagccaccctttctggcacga

SEQ ID NO: 1911377 - DNA, 13 bp, Homo sapiens
cttcagcctccca

SEQ ID NO: 1911378 - DNA, 14 bp, Homo sapiens
cttcagcctcccac

SEQ ID NO: 1911379 - DNA, 17 bp, Homo sapiens
cttcagcctcccacagt

SEQ ID NO: 1911380 - DNA, 13 bp, Homo sapiens
cttccagcaggag

SEQ ID NO: 1911381 - DNA, 15 bp, Homo sapiens
cttccagctccctcc

SEQ ID NO: 1911382 - DNA, 23 bp, Homo sapiens
cttccagtgaggcatctctctgg

SEQ ID NO: 1911383 - DNA, 15 bp, Homo sapiens
cttccagtggcttct

SEQ ID NO: 1911384 - DNA, 19 bp, Homo sapiens
cttccagtggcttctccca

SEQ ID NO: 1911385 - DNA, 21 bp, Homo sapiens
cttccatctgattccagcaca

SEQ ID NO: 1911386 - DNA, 20 bp, Homo sapiens
cttcccaaatgtgtgcccag

SEQ ID NO: 1911387 - DNA, 23 bp, Homo sapiens
cttcccaaatgtgtgcccagctt

SEQ ID NO: 1911388 - DNA, 19 bp, Homo sapiens
cttccccaagcctggcagg

SEQ ID NO: 1911389 - DNA, 20 bp, Homo sapiens
cttccccaagcctggcaggg

SEQ ID NO: 1911390 - DNA, 22 bp, Homo sapiens
cttccctgggttagactgccag

SEQ ID NO: 1911391 - DNA, 23 bp, Homo sapiens
cttccctgggttagactgccagc

SEQ ID NO: 1911392 - DNA, 12 bp, Homo sapiens
cttccctggttc

SEQ ID NO: 1911393 - DNA, 20 bp, Homo sapiens
cttccctggttcaagcgatt

SEQ ID NO: 1911394 - DNA, 19 bp, Homo sapiens
cttcccttccatctcttcc

SEQ ID NO: 1911395 - DNA, 16 bp, Homo sapiens
cttcccttcccttccc

SEQ ID NO: 1911396 - DNA, 18 bp, Homo sapiens
cttcctataattttgata

SEQ ID NO: 1911397 - DNA, 20 bp, Homo sapiens
cttcctataattttgatagt

SEQ ID NO: 1911398 - DNA, 15 bp, Homo sapiens
cttcctcaatgcatt

SEQ ID NO: 1911399 - DNA, 17 bp, Homo sapiens
cttcctctgctgcatcc

SEQ ID NO: 1911400 - DNA, 19 bp, Homo sapiens
cttcctctgctgcatcccc

SEQ ID NO: 1911401 - DNA, 22 bp, Homo sapiens
cttcctctgctgcatccccttc

SEQ ID NO: 1911402 - DNA, 21 bp, Homo sapiens
cttcctgaggggagacagagc

SEQ ID NO: 1911403 - DNA, 17 bp, Homo sapiens
cttccttacctggaaaa

SEQ ID NO: 1911404 - DNA, 14 bp, Homo sapiens
cttccttgaaccct

SEQ ID NO: 1911405 - DNA, 23 bp, Homo sapiens
cttctagtctggaactgctgctg

SEQ ID NO: 1911406 - DNA, 22 bp, Homo sapiens
cttctatacatgtttgcagtgt

SEQ ID NO: 1911407 - DNA, 16 bp, Homo sapiens
cttctcctgcagcctg

SEQ ID NO: 1911408 - DNA, 23 bp, Homo sapiens
cttctcctgcagcctgagatgga

SEQ ID NO: 1911409 - DNA, 23 bp, Homo sapiens
cttctctgtttttcttctgaaat

SEQ ID NO: 1911410 - DNA, 11 bp, Homo sapiens
cttctgaaata

SEQ ID NO: 1911411 - DNA, 17 bp, Homo sapiens
cttctgtagcctgaaga

SEQ ID NO: 1911412 - DNA, 21 bp, Homo sapiens
cttctgtagcctgaagagttt

SEQ ID NO: 1911413 - DNA, 23 bp, Homo sapiens
cttctgtagcctgaagagtttgt

SEQ ID NO: 1911414 - DNA, 20 bp, Homo sapiens
cttctgtgcccagaatactg

SEQ ID NO: 1911415 - DNA, 17 bp, Homo sapiens
cttcttgggactgctgt

SEQ ID NO: 1911416 - DNA, 20 bp, Homo sapiens
cttgaaaattttattaaaaa

SEQ ID NO: 1911417 - DNA, 17 bp, Homo sapiens
cttgaaccataaaatgt

SEQ ID NO: 1911418 - DNA, 14 bp, Homo sapiens
cttgagggccagga

SEQ ID NO: 1911419 - DNA, 22 bp, Homo sapiens
cttgagttgtttttgtatattg

SEQ ID NO: 1911420 - DNA, 16 bp, Homo sapiens
cttgataattttcctt

SEQ ID NO: 1911421 - DNA, 22 bp, Homo sapiens
cttgataattttcctttaatat

SEQ ID NO: 1911422 - DNA, 21 bp, Homo sapiens
cttgatgaaataacacagcag

SEQ ID NO: 1911423 - DNA, 22 bp, Homo sapiens
cttgatgaaataacacagcagt

SEQ ID NO: 1911424 - DNA, 15 bp, Homo sapiens
cttgatggattttca

SEQ ID NO: 1911425 - DNA, 22 bp, Homo sapiens
cttgattcgtagatttaataac

SEQ ID NO: 1911426 - DNA, 16 bp, Homo sapiens
cttgatttgagatttt

SEQ ID NO: 1911427 - DNA, 17 bp, Homo sapiens
cttgcaaaattcctgac

SEQ ID NO: 1911428 - DNA, 22 bp, Homo sapiens
cttgcaagggcggcctttccca

SEQ ID NO: 1911429 - DNA, 14 bp, Homo sapiens
cttgcatttttgca

SEQ ID NO: 1911430 - DNA, 21 bp, Homo sapiens
cttgcatttttgcaggagcag

SEQ ID NO: 1911431 - DNA, 14 bp, Homo sapiens
cttgctttgagttg

SEQ ID NO: 1911432 - DNA, 17 bp, Homo sapiens
cttggatgtttttagtt

SEQ ID NO: 1911433 - DNA, 23 bp, Homo sapiens
cttggatgtttttagttctgact

SEQ ID NO: 1911434 - DNA, 20 bp, Homo sapiens
cttggcaataaattttgaaa

SEQ ID NO: 1911435 - DNA, 11 bp, Homo sapiens
cttggcccagg

SEQ ID NO: 1911436 - DNA, 21 bp, Homo sapiens
cttggcccagggggcttcctg

SEQ ID NO: 1911437 - DNA, 23 bp, Homo sapiens
cttggcccagggggcttcctgag

SEQ ID NO: 1911438 - DNA, 15 bp, Homo sapiens
cttggccctcccacc

SEQ ID NO: 1911439 - DNA, 13 bp, Homo sapiens
cttggccctggca

SEQ ID NO: 1911440 - DNA, 18 bp, Homo sapiens
cttggcttggccctggca

SEQ ID NO: 1911441 - DNA, 14 bp, Homo sapiens
cttgggcctcccac

SEQ ID NO: 1911442 - DNA, 15 bp, Homo sapiens
cttgggcctcccact

SEQ ID NO: 1911443 - DNA, 22 bp, Homo sapiens
cttggggacaaccttggcttgg

SEQ ID NO: 1911444 - DNA, 22 bp, Homo sapiens
cttggtctgggtttggcaggca

SEQ ID NO: 1911445 - DNA, 13 bp, Homo sapiens
cttggttcctggg

SEQ ID NO: 1911446 - DNA, 15 bp, Homo sapiens
cttggttcctggggc

SEQ ID NO: 1911447 - DNA, 15 bp, Homo sapiens
cttgtaaatattgtt

SEQ ID NO: 1911448 - DNA, 14 bp, Homo sapiens
cttgtagatttgat

SEQ ID NO: 1911449 - DNA, 17 bp, Homo sapiens
cttgtagatttgatttt

SEQ ID NO: 1911450 - DNA, 15 bp, Homo sapiens
cttgtagttctttaa

SEQ ID NO: 1911451 - DNA, 15 bp, Homo sapiens
cttgtatattctatt

SEQ ID NO: 1911452 - DNA, 16 bp, Homo sapiens
cttgtattcctaactg

SEQ ID NO: 1911453 - DNA, 19 bp, Homo sapiens
cttgtattgaagttaactg

SEQ ID NO: 1911454 - DNA, 16 bp, Homo sapiens
cttgtattttttaatg

SEQ ID NO: 1911455 - DNA, 18 bp, Homo sapiens
cttgtccaagttgtttca

SEQ ID NO: 1911456 - DNA, 10 bp, Homo sapiens
cttgtcccaa

SEQ ID NO: 1911457 - DNA, 18 bp, Homo sapiens
cttgtcccaagtctgaca

SEQ ID NO: 1911458 - DNA, 15 bp, Homo sapiens
cttgtggaagacaag

SEQ ID NO: 1911459 - DNA, 23 bp, Homo sapiens
cttgtggaagacaagtctgtggc

SEQ ID NO: 1911460 - DNA, 15 bp, Homo sapiens
cttgttgaatttatt

SEQ ID NO: 1911461 - DNA, 13 bp, Homo sapiens
cttgttgctgatt

SEQ ID NO: 1911462 - DNA, 22 bp, Homo sapiens
cttgttggttcaccattgagac

SEQ ID NO: 1911463 - DNA, 20 bp, Homo sapiens
cttgttttacataactgata

SEQ ID NO: 1911464 - DNA, 15 bp, Homo sapiens
ctttaccgaggacag

SEQ ID NO: 1911465 - DNA, 14 bp, Homo sapiens
ctttagacttgaaa

SEQ ID NO: 1911466 - DNA, 21 bp, Homo sapiens
ctttagacttgaaaagagaca

SEQ ID NO: 1911467 - DNA, 16 bp, Homo sapiens
ctttagcaaagaactc

SEQ ID NO: 1911468 - DNA, 19 bp, Homo sapiens
ctttatctaaggaaacatt

SEQ ID NO: 1911469 - DNA, 12 bp, Homo sapiens
ctttattattta

SEQ ID NO: 1911470 - DNA, 21 bp, Homo sapiens
ctttcacatttggaatttaaa

SEQ ID NO: 1911471 - DNA, 12 bp, Homo sapiens
ctttcataataa

SEQ ID NO: 1911472 - DNA, 19 bp, Homo sapiens
ctttcatattttaaacaga

SEQ ID NO: 1911473 - DNA, 23 bp, Homo sapiens
ctttcatattttaaacagaggat

SEQ ID NO: 1911474 - DNA, 16 bp, Homo sapiens
ctttcattttctttcc

SEQ ID NO: 1911475 - DNA, 17 bp, Homo sapiens
ctttcattttctttcct

SEQ ID NO: 1911476 - DNA, 12 bp, Homo sapiens
ctttcctttcat

SEQ ID NO: 1911477 - DNA, 16 bp, Homo sapiens
ctttcctttcctttca

SEQ ID NO: 1911478 - DNA, 16 bp, Homo sapiens
ctttcctttcctttct

SEQ ID NO: 1911479 - DNA, 18 bp, Homo sapiens
ctttctagaaagaataaa

SEQ ID NO: 1911480 - DNA, 13 bp, Homo sapiens
ctttctcactgcc

SEQ ID NO: 1911481 - DNA, 17 bp, Homo sapiens
ctttctcactgcctttg

SEQ ID NO: 1911482 - DNA, 18 bp, Homo sapiens
ctttctgaaaatttatat

SEQ ID NO: 1911483 - DNA, 14 bp, Homo sapiens
ctttctgccaggga

SEQ ID NO: 1911484 - DNA, 20 bp, Homo sapiens
ctttctgccagggatggcag

SEQ ID NO: 1911485 - DNA, 23 bp, Homo sapiens
ctttgaaaacaccagctgtatat

SEQ ID NO: 1911486 - DNA, 12 bp, Homo sapiens
ctttgaaaatac

SEQ ID NO: 1911487 - DNA, 20 bp, Homo sapiens
ctttgacagcgcacagctgc

SEQ ID NO: 1911488 - DNA, 21 bp, Homo sapiens
ctttgacaggttccttttaag

SEQ ID NO: 1911489 - DNA, 16 bp, Homo sapiens
ctttgactttctgtgt

SEQ ID NO: 1911490 - DNA, 14 bp, Homo sapiens
ctttgagctcccac

SEQ ID NO: 1911491 - DNA, 23 bp, Homo sapiens
ctttgagctcccacttctgccag

SEQ ID NO: 1911492 - DNA, 12 bp, Homo sapiens
ctttgaggtttt

SEQ ID NO: 1911493 - DNA, 23 bp, Homo sapiens
ctttgagtgtattctatttgtgt

SEQ ID NO: 1911494 - DNA, 11 bp, Homo sapiens
ctttgatgtca

SEQ ID NO: 1911495 - DNA, 16 bp, Homo sapiens
ctttgatgtgttgttc

SEQ ID NO: 1911496 - DNA, 15 bp, Homo sapiens
ctttgcaaaggagct

SEQ ID NO: 1911497 - DNA, 17 bp, Homo sapiens
ctttgccaaaaagcata

SEQ ID NO: 1911498 - DNA, 14 bp, Homo sapiens
ctttgctgtttgca

SEQ ID NO: 1911499 - DNA, 22 bp, Homo sapiens
ctttggccagaacaccgtgggc

SEQ ID NO: 1911500 - DNA, 15 bp, Homo sapiens
ctttggtcactttta

SEQ ID NO: 1911501 - DNA, 16 bp, Homo sapiens
ctttgtaaattctgat

SEQ ID NO: 1911502 - DNA, 17 bp, Homo sapiens
ctttgtaaattctgatt

SEQ ID NO: 1911503 - DNA, 16 bp, Homo sapiens
ctttgtaattcagaaa

SEQ ID NO: 1911504 - DNA, 18 bp, Homo sapiens
ctttgtaattcagaaatc

SEQ ID NO: 1911505 - DNA, 20 bp, Homo sapiens
ctttgtacacccatgaaaga

SEQ ID NO: 1911506 - DNA, 21 bp, Homo sapiens
gaatgattaatcataaagaaa

SEQ ID NO: 1911507 - DNA, 20 bp, Homo sapiens
gaatgcactcagactgtata

SEQ ID NO: 1911508 - DNA, 23 bp, Homo sapiens
gaatgtacatactgaaaaataca

SEQ ID NO: 1911509 - DNA, 22 bp, Homo sapiens
gaattaaaactttgtagacatt

SEQ ID NO: 1911510 - DNA, 20 bp, Homo sapiens
gaattacaccacaagtatct

SEQ ID NO: 1911511 - DNA, 18 bp, Homo sapiens
gaattcaccacagacttt

SEQ ID NO: 1911512 - DNA, 19 bp, Homo sapiens
gaattcaccacagacttta

SEQ ID NO: 1911513 - DNA, 18 bp, Homo sapiens
gaattcttcacatgtaac

SEQ ID NO: 1911514 - DNA, 19 bp, Homo sapiens
gaattggaatgcactcaga

SEQ ID NO: 1911515 - DNA, 20 bp, Homo sapiens
gaatttaaagaaaaaaatgt

SEQ ID NO: 1911516 - DNA, 18 bp, Homo sapiens
gaatttatataaagtatt

SEQ ID NO: 1911517 - DNA, 20 bp, Homo sapiens
gaatttatataaagtatttt

SEQ ID NO: 1911518 - DNA, 18 bp, Homo sapiens
gaattttattgacacagt

SEQ ID NO: 1911519 - DNA, 22 bp, Homo sapiens
gacaaagtgggtactttctgaa

SEQ ID NO: 1911520 - DNA, 14 bp, Homo sapiens
gacaacaaattttg

SEQ ID NO: 1911521 - DNA, 22 bp, Homo sapiens
gacaacaaattttggttttcta

SEQ ID NO: 1911522 - DNA, 14 bp, Homo sapiens
gacaagctggctta

SEQ ID NO: 1911523 - DNA, 20 bp, Homo sapiens
gacaagctggcttacactgg

SEQ ID NO: 1911524 - DNA, 14 bp, Homo sapiens
gacacagaagcccc

SEQ ID NO: 1911525 - DNA, 17 bp, Homo sapiens
gacaccacagcctcccc

SEQ ID NO: 1911526 - DNA, 18 bp, Homo sapiens
gacactgtggcagcagga

SEQ ID NO: 1911527 - DNA, 18 bp, Homo sapiens
gacagacaccacagcctc

SEQ ID NO: 1911528 - DNA, 19 bp, Homo sapiens
gacagacaccacagcctcc

SEQ ID NO: 1911529 - DNA, 22 bp, Homo sapiens
gacagacaccacagcctcccct

SEQ ID NO: 1911530 - DNA, 20 bp, Homo sapiens
gacagcctgcctctgccaca

SEQ ID NO: 1911531 - DNA, 18 bp, Homo sapiens
gacagcgcacagctgctc

SEQ ID NO: 1911532 - DNA, 14 bp, Homo sapiens
gacaggacccctgc

SEQ ID NO: 1911533 - DNA, 17 bp, Homo sapiens
gacaggacccctgcagt

SEQ ID NO: 1911534 - DNA, 17 bp, Homo sapiens
gacagggtttcaccatg

SEQ ID NO: 1911535 - DNA, 18 bp, Homo sapiens
gacatcacagggcctcag

SEQ ID NO: 1911536 - DNA, 21 bp, Homo sapiens
gacatcctgtcatctgagaat

SEQ ID NO: 1911537 - DNA, 21 bp, Homo sapiens
gacatggcgtattttgtattt

SEQ ID NO: 1911538 - DNA, 19 bp, Homo sapiens
gacatttcaaataactgca

SEQ ID NO: 1911539 - DNA, 19 bp, Homo sapiens
gaccaatgaaatgaattta

SEQ ID NO: 1911540 - DNA, 11 bp, Homo sapiens
gaccacagagg

SEQ ID NO: 1911541 - DNA, 19 bp, Homo sapiens
gaccacaggtgcccgccac

SEQ ID NO: 1911542 - DNA, 21 bp, Homo sapiens
gaccagaagacaaaggcccaa

SEQ ID NO: 1911543 - DNA, 14 bp, Homo sapiens
gaccagcaggctcc

SEQ ID NO: 1911544 - DNA, 15 bp, Homo sapiens
gaccagcaggctcct

SEQ ID NO: 1911545 - DNA, 20 bp, Homo sapiens
gaccagcaggctcctcagcc

SEQ ID NO: 1911546 - DNA, 23 bp, Homo sapiens
gaccagcaggctcctcagccctc

SEQ ID NO: 1911547 - DNA, 11 bp, Homo sapiens
gaccagccagg

SEQ ID NO: 1911548 - DNA, 12 bp, Homo sapiens
gaccagcccacg

SEQ ID NO: 1911549 - DNA, 17 bp, Homo sapiens
gaccagcttggctcagg

SEQ ID NO: 1911550 - DNA, 23 bp, Homo sapiens
gaccagggacagatccagcaggc

SEQ ID NO: 1911551 - DNA, 15 bp, Homo sapiens
gaccatgctgtctgg

SEQ ID NO: 1911552 - DNA, 22 bp, Homo sapiens
gacccaagtggatattttctta

SEQ ID NO: 1911553 - DNA, 15 bp, Homo sapiens
gacccagtggcaggg

SEQ ID NO: 1911554 - DNA, 16 bp, Homo sapiens
gacccagtggcagggc

SEQ ID NO: 1911555 - DNA, 23 bp, Homo sapiens
gacccagtggcagggcacagggc

SEQ ID NO: 1911556 - DNA, 15 bp, Homo sapiens
gacccatgggcagga

SEQ ID NO: 1911557 - DNA, 20 bp, Homo sapiens
gacccatgggcaggagactg

SEQ ID NO: 1911558 - DNA, 15 bp, Homo sapiens
gaccccactggagtc

SEQ ID NO: 1911559 - DNA, 14 bp, Homo sapiens
gaccccagcctcaa

SEQ ID NO: 1911560 - DNA, 13 bp, Homo sapiens
gacccccatcact

SEQ ID NO: 1911561 - DNA, 18 bp, Homo sapiens
gacccctgtaaggggcca

SEQ ID NO: 1911562 - DNA, 11 bp, Homo sapiens
gaccctccaag

SEQ ID NO: 1911563 - DNA, 15 bp, Homo sapiens
gaccctccaaggcca

SEQ ID NO: 1911564 - DNA, 16 bp, Homo sapiens
gacctcaaatgatgtg

SEQ ID NO: 1911565 - DNA, 21 bp, Homo sapiens
gacctcacacacctctgcccc

SEQ ID NO: 1911566 - DNA, 18 bp, Homo sapiens
gacctgtatcaaactgct

SEQ ID NO: 1911567 - DNA, 14 bp, Homo sapiens
gaccttaaatgcaa

SEQ ID NO: 1911568 - DNA, 20 bp, Homo sapiens
gacgactgttttcccaacac

SEQ ID NO: 1911569 - DNA, 12 bp, Homo sapiens
gacgctctctct

SEQ ID NO: 1911570 - DNA, 11 bp, Homo sapiens
gacggttccta

SEQ ID NO: 1911571 - DNA, 18 bp, Homo sapiens
gacggttcctacacagga

SEQ ID NO: 1911572 - DNA, 19 bp, Homo sapiens
gacggttcctacacaggac

SEQ ID NO: 1911573 - DNA, 22 bp, Homo sapiens
gacgtacaagtagttctgtatt

SEQ ID NO: 1911574 - DNA, 21 bp, Homo sapiens
gacgtcagatgtttaaaacac

SEQ ID NO: 1911575 - DNA, 13 bp, Homo sapiens
gacgtctgccacc

SEQ ID NO: 1911576 - DNA, 18 bp, Homo sapiens
gacgttttttctgcacaa

SEQ ID NO: 1911577 - DNA, 13 bp, Homo sapiens
gactacagggccg

SEQ ID NO: 1911578 - DNA, 21 bp, Homo sapiens
gactcatatcccctatttaac

SEQ ID NO: 1911579 - DNA, 17 bp, Homo sapiens
gactctctgacaaagtg

SEQ ID NO: 1911580 - DNA, 17 bp, Homo sapiens
gactctgccagggtggg

SEQ ID NO: 1911581 - DNA, 19 bp, Homo sapiens
gactgccacaaggaagaaa

SEQ ID NO: 1911582 - DNA, 17 bp, Homo sapiens
gactgctcctgagcccc

SEQ ID NO: 1911583 - DNA, 15 bp, Homo sapiens
gactggatctgcagg

SEQ ID NO: 1911584 - DNA, 23 bp, Homo sapiens
gactggtcttccttacctggaaa

SEQ ID NO: 1911585 - DNA, 16 bp, Homo sapiens
gactgtggagactgct

SEQ ID NO: 1911586 - DNA, 21 bp, Homo sapiens
gacttaacatagccaaaatgt

SEQ ID NO: 1911587 - DNA, 22 bp, Homo sapiens
gacttatgccatcccggcagcg

SEQ ID NO: 1911588 - DNA, 21 bp, Homo sapiens
gacttccccaagcctggcagg

SEQ ID NO: 1911589 - DNA, 11 bp, Homo sapiens
gacttgaaaag

SEQ ID NO: 1911590 - DNA, 17 bp, Homo sapiens
gacttgaaaagagacag

SEQ ID NO: 1911591 - DNA, 18 bp, Homo sapiens
gacttgtatattctattt

SEQ ID NO: 1911592 - DNA, 22 bp, Homo sapiens
gactttagcctacctaacccag

SEQ ID NO: 1911593 - DNA, 17 bp, Homo sapiens
gactttgaatttatata

SEQ ID NO: 1911594 - DNA, 21 bp, Homo sapiens
gactttgaatttatataaagt

SEQ ID NO: 1911595 - DNA, 23 bp, Homo sapiens
gactttgaatttatataaagtat

SEQ ID NO: 1911596 - DNA, 13 bp, Homo sapiens
gagaaaagaaaaa

SEQ ID NO: 1911597 - DNA, 19 bp, Homo sapiens
gagaaaagaaaaaaaaaga

SEQ ID NO: 1911598 - DNA, 17 bp, Homo sapiens
gagaacattaggcccca

SEQ ID NO: 1911599 - DNA, 14 bp, Homo sapiens
gagaaccatgtgct

SEQ ID NO: 1911600 - DNA, 19 bp, Homo sapiens
gagaagacttccccaagcc

SEQ ID NO: 1911601 - DNA, 14 bp, Homo sapiens
gagaatagaaattt

SEQ ID NO: 1911602 - DNA, 23 bp, Homo sapiens
gagaatagaaatttgcccctggc

SEQ ID NO: 1911603 - DNA, 15 bp, Homo sapiens
gagaatcacaggctg

SEQ ID NO: 1911604 - DNA, 16 bp, Homo sapiens
gagaatcacaggctgg

SEQ ID NO: 1911605 - DNA, 13 bp, Homo sapiens
gagaatgaacaaa

SEQ ID NO: 1911606 - DNA, 20 bp, Homo sapiens
gagaatggcgtgaacccggg

SEQ ID NO: 1911607 - DNA, 15 bp, Homo sapiens
gagaattaaaacttt

SEQ ID NO: 1911608 - DNA, 17 bp, Homo sapiens
gagaattgggattacat

SEQ ID NO: 1911609 - DNA, 17 bp, Homo sapiens
gagacagactagaagtt

SEQ ID NO: 1911610 - DNA, 18 bp, Homo sapiens
gagacagggcccgggccc

SEQ ID NO: 1911611 - DNA, 22 bp, Homo sapiens
gagacagggcccgggcccaggc

SEQ ID NO: 1911612 - DNA, 23 bp, Homo sapiens
gagacagggcccgggcccaggca

SEQ ID NO: 1911613 - DNA, 20 bp, Homo sapiens
gagaccgtgaagatactttg

SEQ ID NO: 1911614 - DNA, 22 bp, Homo sapiens
gagaccgtgaagatactttgta

SEQ ID NO: 1911615 - DNA, 19 bp, Homo sapiens
gagactgctcctgagcccc

SEQ ID NO: 1911616 - DNA, 20 bp, Homo sapiens
gagactgtggagactgctcc

SEQ ID NO: 1911617 - DNA, 14 bp, Homo sapiens
gagactttgatgtc

SEQ ID NO: 1911618 - DNA, 14 bp, Homo sapiens
gagagaagagcccc

SEQ ID NO: 1911619 - DNA, 12 bp, Homo sapiens
gagagctggagt

SEQ ID NO: 1911620 - DNA, 15 bp, Homo sapiens
gagaggagccctgcc

SEQ ID NO: 1911621 - DNA, 17 bp, Homo sapiens
gagagggaagctgaggc

SEQ ID NO: 1911622 - DNA, 18 bp, Homo sapiens
gagagggaagctgaggcc

SEQ ID NO: 1911623 - DNA, 16 bp, Homo sapiens
gagaggggaggccaag

SEQ ID NO: 1911624 - DNA, 20 bp, Homo sapiens
gagatgacaacaaattttgg

SEQ ID NO: 1911625 - DNA, 19 bp, Homo sapiens
gagatggatggacagacag

SEQ ID NO: 1911626 - DNA, 20 bp, Homo sapiens
gagatttacccagactggtt

SEQ ID NO: 1911627 - DNA, 22 bp, Homo sapiens
gagcaacccctggaccccagcc

SEQ ID NO: 1911628 - DNA, 18 bp, Homo sapiens
gagcaagggcagggacag

SEQ ID NO: 1911629 - DNA, 20 bp, Homo sapiens
gagcaggccctgggcctcca

SEQ ID NO: 1911630 - DNA, 15 bp, Homo sapiens
gagcagggcaggccc

SEQ ID NO: 1911631 - DNA, 17 bp, Homo sapiens
gagcagtatcatgaagc

SEQ ID NO: 1911632 - DNA, 19 bp, Homo sapiens
gagcattgcagtcactttg

SEQ ID NO: 1911633 - DNA, 14 bp, Homo sapiens
gagccccactctca

SEQ ID NO: 1911634 - DNA, 16 bp, Homo sapiens
gagccccactctcaga

SEQ ID NO: 1911635 - DNA, 17 bp, Homo sapiens
gagccccactctcagag

SEQ ID NO: 1911636 - DNA, 23 bp, Homo sapiens
gagccccactctcagaggcccca

SEQ ID NO: 1911637 - DNA, 18 bp, Homo sapiens
gagccctgcctctccgcc

SEQ ID NO: 1911638 - DNA, 14 bp, Homo sapiens
gagccttaaaacat

SEQ ID NO: 1911639 - DNA, 17 bp, Homo sapiens
gagccttggaggacact

SEQ ID NO: 1911640 - DNA, 15 bp, Homo sapiens
gagcgaccagcaggc

SEQ ID NO: 1911641 - DNA, 17 bp, Homo sapiens
gagcgaccagcaggctc

SEQ ID NO: 1911642 - DNA, 21 bp, Homo sapiens
gagcgaccagcaggctcctca

SEQ ID NO: 1911643 - DNA, 16 bp, Homo sapiens
gagctcaagccgtggc

SEQ ID NO: 1911644 - DNA, 19 bp, Homo sapiens
gagctcaagccgtggccgg

SEQ ID NO: 1911645 - DNA, 13 bp, Homo sapiens
gagctcggggctg

SEQ ID NO: 1911646 - DNA, 16 bp, Homo sapiens
gagctcggggctgggg

SEQ ID NO: 1911647 - DNA, 21 bp, Homo sapiens
gagctcggggctgggggctgc

SEQ ID NO: 1911648 - DNA, 17 bp, Homo sapiens
gagctggagtctgggct

SEQ ID NO: 1911649 - DNA, 20 bp, Homo sapiens
gaggaaatcaaagtgctatt

SEQ ID NO: 1911650 - DNA, 18 bp, Homo sapiens
gaggacaagagaaaaaag

SEQ ID NO: 1911651 - DNA, 17 bp, Homo sapiens
gaggacaatctagctct

SEQ ID NO: 1911652 - DNA, 22 bp, Homo sapiens
gaggacaatctagctctccata

SEQ ID NO: 1911653 - DNA, 15 bp, Homo sapiens
gaggacagcctgcct

SEQ ID NO: 1911654 - DNA, 16 bp, Homo sapiens
gaggacagcctgcctc

SEQ ID NO: 1911655 - DNA, 18 bp, Homo sapiens
gaggacagcctgcctctg

SEQ ID NO: 1911656 - DNA, 19 bp, Homo sapiens
gaggacagcctgcctctgc

SEQ ID NO: 1911657 - DNA, 20 bp, Homo sapiens
gaggacagcctgcctctgcc

SEQ ID NO: 1911658 - DNA, 19 bp, Homo sapiens
gaggagccccagtggtgag

SEQ ID NO: 1911659 - DNA, 16 bp, Homo sapiens
gaggaggcaggaggag

SEQ ID NO: 1911660 - DNA, 21 bp, Homo sapiens
gaggagtggattcctccccac

SEQ ID NO: 1911661 - DNA, 15 bp, Homo sapiens
gaggcaggaggagca

SEQ ID NO: 1911662 - DNA, 17 bp, Homo sapiens
gaggccaaacaggccct

SEQ ID NO: 1911663 - DNA, 13 bp, Homo sapiens
gaggccacctcct

SEQ ID NO: 1911664 - DNA, 13 bp, Homo sapiens
gaggcccatggcc

SEQ ID NO: 1911665 - DNA, 19 bp, Homo sapiens
gaggccccaataccccatg

SEQ ID NO: 1911666 - DNA, 17 bp, Homo sapiens
gaggccccgaggctcga

SEQ ID NO: 1911667 - DNA, 19 bp, Homo sapiens
gaggcctaaaagtaaacat

SEQ ID NO: 1911668 - DNA, 14 bp, Homo sapiens
gaggcgagcagggc

SEQ ID NO: 1911669 - DNA, 15 bp, Homo sapiens
gaggcgagcagggca

SEQ ID NO: 1911670 - DNA, 16 bp, Homo sapiens
gaggcgagcagggcag

SEQ ID NO: 1911671 - DNA, 15 bp, Homo sapiens
gaggctcaaattttg

SEQ ID NO: 1911672 - DNA, 15 bp, Homo sapiens
gaggctgctgccagg

SEQ ID NO: 1911673 - DNA, 18 bp, Homo sapiens
gaggctgctgccaggccc

SEQ ID NO: 1911674 - DNA, 14 bp, Homo sapiens
gaggctgtggtcag

SEQ ID NO: 1911675 - DNA, 16 bp, Homo sapiens
gaggctgtggtcagag

SEQ ID NO: 1911676 - DNA, 15 bp, Homo sapiens
gagggaagctgaggc

SEQ ID NO: 1911677 - DNA, 19 bp, Homo sapiens
gagggaagctgaggcccat

SEQ ID NO: 1911678 - DNA, 21 bp, Homo sapiens
gagggactctgtctggccagg

SEQ ID NO: 1911679 - DNA, 13 bp, Homo sapiens
gagggcctgggcc

SEQ ID NO: 1911680 - DNA, 17 bp, Homo sapiens
gaggggatggggctggg

SEQ ID NO: 1911681 - DNA, 18 bp, Homo sapiens
gaggggccagcggccctc

SEQ ID NO: 1911682 - DNA, 21 bp, Homo sapiens
gaggggccagcggccctccca

SEQ ID NO: 1911683 - DNA, 24 bp, Homo sapiens
gagggtgccggaaagagagctgga

SEQ ID NO: 1911684 - DNA, 16 bp, Homo sapiens
gagggttcagagagga

SEQ ID NO: 1911685 - DNA, 13 bp, Homo sapiens
gaggtcccagggc

SEQ ID NO: 1911686 - DNA, 21 bp, Homo sapiens
gaggtgtgtgacgtttttcca

SEQ ID NO: 1911687 - DNA, 12 bp, Homo sapiens
gagtagccatga

SEQ ID NO: 1911688 - DNA, 20 bp, Homo sapiens
gagtattctaataagctagt

SEQ ID NO: 1911689 - DNA, 15 bp, Homo sapiens
gagtcatttctgatt

SEQ ID NO: 1911690 - DNA, 16 bp, Homo sapiens
gagtccaaactggaat

SEQ ID NO: 1911691 - DNA, 23 bp, Homo sapiens
gagtctctctctctccatccctc

SEQ ID NO: 1911692 - DNA, 15 bp, Homo sapiens
gagtgagaggggagg

SEQ ID NO: 1911693 - DNA, 15 bp, Homo sapiens
gagtggattcctccc

SEQ ID NO: 1911694 - DNA, 13 bp, Homo sapiens
gagtggccccacc

SEQ ID NO: 1911695 - DNA, 19 bp, Homo sapiens
gagtggccccacctggccc

SEQ ID NO: 1911696 - DNA, 21 bp, Homo sapiens
gagtggccccacctggccctc

SEQ ID NO: 1911697 - DNA, 15 bp, Homo sapiens
gagttacagcctggg

SEQ ID NO: 1911698 - DNA, 13 bp, Homo sapiens
gagttgtttttgt

SEQ ID NO: 1911699 - DNA, 18 bp, Homo sapiens
gagttgtttttgtatatt

SEQ ID NO: 1911700 - DNA, 17 bp, Homo sapiens
gagtttgtaaatgactt

SEQ ID NO: 1911701 - DNA, 18 bp, Homo sapiens
gagtttgtaaatgacttt

SEQ ID NO: 1911702 - DNA, 18 bp, Homo sapiens
gagttttctatgaatcta

SEQ ID NO: 1911703 - DNA, 19 bp, Homo sapiens
gataatgtggattaaaacc

SEQ ID NO: 1911704 - DNA, 22 bp, Homo sapiens
gataattttcctttaatatgaa

SEQ ID NO: 1911705 - DNA, 20 bp, Homo sapiens
gataccaaagagacagggcc

SEQ ID NO: 1911706 - DNA, 15 bp, Homo sapiens
gatagcattgtaagc

SEQ ID NO: 1911707 - DNA, 18 bp, Homo sapiens
gatatatgtatctttata

SEQ ID NO: 1911708 - DNA, 16 bp, Homo sapiens
gatatcagcactggat

SEQ ID NO: 1911709 - DNA, 12 bp, Homo sapiens
gatatgcttgta

SEQ ID NO: 1911710 - DNA, 15 bp, Homo sapiens
gatcaaaaaaatata

SEQ ID NO: 1911711 - DNA, 14 bp, Homo sapiens
gatcaaaaaggctt

SEQ ID NO: 1911712 - DNA, 20 bp, Homo sapiens
gatcacaaatgactttatta

SEQ ID NO: 1911713 - DNA, 14 bp, Homo sapiens
gatcacagcagggc

SEQ ID NO: 1911714 - DNA, 14 bp, Homo sapiens
gatcactgaaataa

SEQ ID NO: 1911715 - DNA, 18 bp, Homo sapiens
gatcactgaaataaaagc

SEQ ID NO: 1911716 - DNA, 16 bp, Homo sapiens
gatcagatagcaggag

SEQ ID NO: 1911717 - DNA, 15 bp, Homo sapiens
gatcaggctcccagg

SEQ ID NO: 1911718 - DNA, 15 bp, Homo sapiens
gatccagtgtgtaaa

SEQ ID NO: 1911719 - DNA, 15 bp, Homo sapiens
gatcctcccctggac

SEQ ID NO: 1911720 - DNA, 18 bp, Homo sapiens
gatcctcccctggactcc

SEQ ID NO: 1911721 - DNA, 20 bp, Homo sapiens
gatcgtctggttagaaaaca

SEQ ID NO: 1911722 - DNA, 17 bp, Homo sapiens
gatctccctttcctata

SEQ ID NO: 1911723 - DNA, 12 bp, Homo sapiens
gatctgctgcag

SEQ ID NO: 1911724 - DNA, 22 bp, Homo sapiens
gatgaataaatgttatagctgc

SEQ ID NO: 1911725 - DNA, 15 bp, Homo sapiens
gatgattgaagaaac

SEQ ID NO: 1911726 - DNA, 19 bp, Homo sapiens
gatgattgaagaaacagct

SEQ ID NO: 1911727 - DNA, 20 bp, Homo sapiens
gatggaatttttttgtacga

SEQ ID NO: 1911728 - DNA, 19 bp, Homo sapiens
gatggatatatgtttttga

SEQ ID NO: 1911729 - DNA, 15 bp, Homo sapiens
gatggcagtggctgt

SEQ ID NO: 1911730 - DNA, 17 bp, Homo sapiens
gatggcagtggctgtga

SEQ ID NO: 1911731 - DNA, 12 bp, Homo sapiens
gatgggcctgag

SEQ ID NO: 1911732 - DNA, 13 bp, Homo sapiens
gatgggcctgagt

SEQ ID NO: 1911733 - DNA, 18 bp, Homo sapiens
gatgggcctgagtgagag

SEQ ID NO: 1911734 - DNA, 17 bp, Homo sapiens
gatgtcagcagttgctg

SEQ ID NO: 1911735 - DNA, 18 bp, Homo sapiens
gatgttagttttagaatt

SEQ ID NO: 1911736 - DNA, 16 bp, Homo sapiens
gatgttagttttcctt

SEQ ID NO: 1911737 - DNA, 19 bp, Homo sapiens
gatgttgacatcactggca

SEQ ID NO: 1911738 - DNA, 17 bp, Homo sapiens
gatgtttttagttctga

SEQ ID NO: 1911739 - DNA, 20 bp, Homo sapiens
gatgtttttagttctgactt

SEQ ID NO: 1911740 - DNA, 20 bp, Homo sapiens
gattaaagatgagctttgtc

SEQ ID NO: 1911741 - DNA, 23 bp, Homo sapiens
gattacaggcatgggccaccacg

SEQ ID NO: 1911742 - DNA, 15 bp, Homo sapiens
gattacattcagttg

SEQ ID NO: 1911743 - DNA, 13 bp, Homo sapiens
gattagagaccag

SEQ ID NO: 1911744 - DNA, 15 bp, Homo sapiens
gattagtttagaaca

SEQ ID NO: 1911745 - DNA, 16 bp, Homo sapiens
gattatataagcaaaa

SEQ ID NO: 1911746 - DNA, 18 bp, Homo sapiens
gattcaatgcctctggct

SEQ ID NO: 1911747 - DNA, 17 bp, Homo sapiens
gattcaggcattttccc

SEQ ID NO: 1911748 - DNA, 17 bp, Homo sapiens
gattccatttactgcat

SEQ ID NO: 1911749 - DNA, 16 bp, Homo sapiens
gattcctccccaccct

SEQ ID NO: 1911750 - DNA, 18 bp, Homo sapiens
gattcctccccaccctgt

SEQ ID NO: 1911751 - DNA, 20 bp, Homo sapiens
gattcctccccaccctgtcc

SEQ ID NO: 1911752 - DNA, 21 bp, Homo sapiens
gattctgaccttaaatgcaac

SEQ ID NO: 1911753 - DNA, 16 bp, Homo sapiens
gattgcctcaataaag

SEQ ID NO: 1911754 - DNA, 19 bp, Homo sapiens
gattgcctcaataaagctc

SEQ ID NO: 1911755 - DNA, 23 bp, Homo sapiens
gattgtaatatgtaaatggtatg

SEQ ID NO: 1911756 - DNA, 20 bp, Homo sapiens
gattgtagaacttgttgctg

SEQ ID NO: 1911757 - DNA, 20 bp, Homo sapiens
gattgtcaatgctggagaaa

SEQ ID NO: 1911758 - DNA, 21 bp, Homo sapiens
gattgtcaatgctggagaaaa

SEQ ID NO: 1911759 - DNA, 15 bp, Homo sapiens
gatttaaccattcca

SEQ ID NO: 1911760 - DNA, 16 bp, Homo sapiens
gatttagtaagtgttc

SEQ ID NO: 1911761 - DNA, 22 bp, Homo sapiens
gatttatttcatcatattatac

SEQ ID NO: 1911762 - DNA, 17 bp, Homo sapiens
gatttgatatatgtatc

SEQ ID NO: 1911763 - DNA, 17 bp, Homo sapiens
gatttgccatagagtac

SEQ ID NO: 1911764 - DNA, 21 bp, Homo sapiens
gatttgctaataatgttcacg

SEQ ID NO: 1911765 - DNA, 12 bp, Homo sapiens
gattttgaaaaa

SEQ ID NO: 1911766 - DNA, 15 bp, Homo sapiens
gattttgaccttgta

SEQ ID NO: 1911767 - DNA, 20 bp, Homo sapiens
gattttgaccttgtattgaa

SEQ ID NO: 1911768 - DNA, 13 bp, Homo sapiens
gatttttgtatca

SEQ ID NO: 1911769 - DNA, 22 bp, Homo sapiens
gcaaaataacaaaaaagagaaa

SEQ ID NO: 1911770 - DNA, 21 bp, Homo sapiens
gcaaaatgaaaagagaaactt

SEQ ID NO: 1911771 - DNA, 20 bp, Homo sapiens
gcaaaatgggatgatatgga

SEQ ID NO: 1911772 - DNA, 14 bp, Homo sapiens
gcaaacagaagtgc

SEQ ID NO: 1911773 - DNA, 17 bp, Homo sapiens
gcaaacagaagtgcatc

SEQ ID NO: 1911774 - DNA, 19 bp, Homo sapiens
gcaaacctaattgcacaac

SEQ ID NO: 1911775 - DNA, 14 bp, Homo sapiens
gcaaaggaaatacc

SEQ ID NO: 1911776 - DNA, 16 bp, Homo sapiens
gcaaatccgaaatcag

SEQ ID NO: 1911777 - DNA, 22 bp, Homo sapiens
gcaaatgcacacacctcatgct

SEQ ID NO: 1911778 - DNA, 19 bp, Homo sapiens
attatggtaaaattttgta

SEQ ID NO: 1911779 - DNA, 12 bp, Homo sapiens
attattccctct

SEQ ID NO: 1911780 - DNA, 16 bp, Homo sapiens
attatttttctctctc

SEQ ID NO: 1911781 - DNA, 14 bp, Homo sapiens
attatttttctgta

SEQ ID NO: 1911782 - DNA, 18 bp, Homo sapiens
attcaacagcaagtgtga

SEQ ID NO: 1911783 - DNA, 21 bp, Homo sapiens
attcaacagcaagtgtgaata

SEQ ID NO: 1911784 - DNA, 20 bp, Homo sapiens
attcagaaatgactttttga

SEQ ID NO: 1911785 - DNA, 22 bp, Homo sapiens
attcaggtcccagttgctgtca

SEQ ID NO: 1911786 - DNA, 13 bp, Homo sapiens
attcatacacaac

SEQ ID NO: 1911787 - DNA, 19 bp, Homo sapiens
attcattcttaatttatgt

SEQ ID NO: 1911788 - DNA, 23 bp, Homo sapiens
attccaagtcagaaactgtttct

SEQ ID NO: 1911789 - DNA, 18 bp, Homo sapiens
attccagaatgaagaatt

SEQ ID NO: 1911790 - DNA, 20 bp, Homo sapiens
attccatttactgcattctt

SEQ ID NO: 1911791 - DNA, 15 bp, Homo sapiens
attccatttgcttgt

SEQ ID NO: 1911792 - DNA, 12 bp, Homo sapiens
attcctccccac

SEQ ID NO: 1911793 - DNA, 13 bp, Homo sapiens
attcctccccacc

SEQ ID NO: 1911794 - DNA, 16 bp, Homo sapiens
attcctccccaccctg

SEQ ID NO: 1911795 - DNA, 17 bp, Homo sapiens
attcctccccaccctgt

SEQ ID NO: 1911796 - DNA, 22 bp, Homo sapiens
attcctccccaccctgtcccag

SEQ ID NO: 1911797 - DNA, 16 bp, Homo sapiens
attcctttttatttat

SEQ ID NO: 1911798 - DNA, 21 bp, Homo sapiens
attcgctactatgatttaatt

SEQ ID NO: 1911799 - DNA, 22 bp, Homo sapiens
attcgtacataatactgaacca

SEQ ID NO: 1911800 - DNA, 23 bp, Homo sapiens
attcgtacataatactgaaccac

SEQ ID NO: 1911801 - DNA, 16 bp, Homo sapiens
attctaaaatgtctca

SEQ ID NO: 1911802 - DNA, 16 bp, Homo sapiens
attctaaatgaactca

SEQ ID NO: 1911803 - DNA, 14 bp, Homo sapiens
attctaataagcta

SEQ ID NO: 1911804 - DNA, 16 bp, Homo sapiens
attctagaaagagcct

SEQ ID NO: 1911805 - DNA, 15 bp, Homo sapiens
attctatttgtgtaa

SEQ ID NO: 1911806 - DNA, 13 bp, Homo sapiens
attctattttaca

SEQ ID NO: 1911807 - DNA, 15 bp, Homo sapiens
attctcgattctttg

SEQ ID NO: 1911808 - DNA, 17 bp, Homo sapiens
attctcttgcctcagct

SEQ ID NO: 1911809 - DNA, 12 bp, Homo sapiens
attcttctgatc

SEQ ID NO: 1911810 - DNA, 15 bp, Homo sapiens
attcttctgatcact

SEQ ID NO: 1911811 - DNA, 21 bp, Homo sapiens
attctttattatttttctctc

SEQ ID NO: 1911812 - DNA, 23 bp, Homo sapiens
attctttattatttttctctctc

SEQ ID NO: 1911813 - DNA, 15 bp, Homo sapiens
attcttttttattaa

SEQ ID NO: 1911814 - DNA, 20 bp, Homo sapiens
attgaaagaatgtaaagcaa

SEQ ID NO: 1911815 - DNA, 13 bp, Homo sapiens
attgaaggttttt

SEQ ID NO: 1911816 - DNA, 15 bp, Homo sapiens
attgactcttgagtt

SEQ ID NO: 1911817 - DNA, 17 bp, Homo sapiens
attgagaatagaaattt

SEQ ID NO: 1911818 - DNA, 18 bp, Homo sapiens
attgagaatagaaatttg

SEQ ID NO: 1911819 - DNA, 20 bp, Homo sapiens
attgagaccgtgaagatact

SEQ ID NO: 1911820 - DNA, 12 bp, Homo sapiens
attgatgatgtt

SEQ ID NO: 1911821 - DNA, 14 bp, Homo sapiens
attgattcaaatgt

SEQ ID NO: 1911822 - DNA, 13 bp, Homo sapiens
attgatttagtaa

SEQ ID NO: 1911823 - DNA, 19 bp, Homo sapiens
attgcacaatatattttta

SEQ ID NO: 1911824 - DNA, 16 bp, Homo sapiens
attgcagtcactttga

SEQ ID NO: 1911825 - DNA, 22 bp, Homo sapiens
attgcagtgtgaatgctgggcc

SEQ ID NO: 1911826 - DNA, 13 bp, Homo sapiens
attgcctcaataa

SEQ ID NO: 1911827 - DNA, 21 bp, Homo sapiens
attgctgaatggagttaaact

SEQ ID NO: 1911828 - DNA, 14 bp, Homo sapiens
attggttttatgat

SEQ ID NO: 1911829 - DNA, 21 bp, Homo sapiens
attgtaagaaatactgtacaa

SEQ ID NO: 1911830 - DNA, 18 bp, Homo sapiens
attgtaagcgtatggctt

SEQ ID NO: 1911831 - DNA, 19 bp, Homo sapiens
attgtaagcgtatggcttt

SEQ ID NO: 1911832 - DNA, 16 bp, Homo sapiens
attgtaatgtatactt

SEQ ID NO: 1911833 - DNA, 23 bp, Homo sapiens
tactttctgaaaatttatataac

SEQ ID NO: 1911834 - DNA, 11 bp, Homo sapiens
tactttgaaat

SEQ ID NO: 1911835 - DNA, 18 bp, Homo sapiens
tactttgtaaattctgat

SEQ ID NO: 1911836 - DNA, 22 bp, Homo sapiens
tactttgtaaattctgatttct

SEQ ID NO: 1911837 - DNA, 12 bp, Homo sapiens
tactttgtattg

SEQ ID NO: 1911838 - DNA, 16 bp, Homo sapiens
tactttgtattgtcct

SEQ ID NO: 1911839 - DNA, 17 bp, Homo sapiens
tagaaactcaggaaaga

SEQ ID NO: 1911840 - DNA, 12 bp, Homo sapiens
tagaaagagtct

SEQ ID NO: 1911841 - DNA, 13 bp, Homo sapiens
tagaacaggtttt

SEQ ID NO: 1911842 - DNA, 20 bp, Homo sapiens
tagaagatcacagcagggcc

SEQ ID NO: 1911843 - DNA, 18 bp, Homo sapiens
tagaaggagattgtgggg

SEQ ID NO: 1911844 - DNA, 20 bp, Homo sapiens
tagaatcagatacaaaacta

SEQ ID NO: 1911845 - DNA, 13 bp, Homo sapiens
tagaatgtcaata

SEQ ID NO: 1911846 - DNA, 22 bp, Homo sapiens
tagaatgtcaataaatttgctt

SEQ ID NO: 1911847 - DNA, 16 bp, Homo sapiens
tagaattgaaggtttt

SEQ ID NO: 1911848 - DNA, 18 bp, Homo sapiens
tagacaatataagagctt

SEQ ID NO: 1911849 - DNA, 14 bp, Homo sapiens
tagacattttgaaa

SEQ ID NO: 1911850 - DNA, 15 bp, Homo sapiens
tagacattttgaaat

SEQ ID NO: 1911851 - DNA, 11 bp, Homo sapiens
tagactgccag

SEQ ID NO: 1911852 - DNA, 12 bp, Homo sapiens
tagactgccagc

SEQ ID NO: 1911853 - DNA, 10 bp, Homo sapiens
tagacttgaa

SEQ ID NO: 1911854 - DNA, 14 bp, Homo sapiens
tagacttgaaaaga

SEQ ID NO: 1911855 - DNA, 21 bp, Homo sapiens
tagaggggccagcggccctcc

SEQ ID NO: 1911856 - DNA, 23 bp, Homo sapiens
tagaggggccagcggccctccca

SEQ ID NO: 1911857 - DNA, 13 bp, Homo sapiens
tagagtacactgc

SEQ ID NO: 1911858 - DNA, 22 bp, Homo sapiens
tagagtacactgcctgccttaa

SEQ ID NO: 1911859 - DNA, 17 bp, Homo sapiens
tagatcatagttttatt

SEQ ID NO: 1911860 - DNA, 16 bp, Homo sapiens
tagattccatttactg

SEQ ID NO: 1911861 - DNA, 21 bp, Homo sapiens
tagatttgccatagagtacac

SEQ ID NO: 1911862 - DNA, 13 bp, Homo sapiens
tagattttgaaaa

SEQ ID NO: 1911863 - DNA, 17 bp, Homo sapiens
tagattttgaaaaatta

SEQ ID NO: 1911864 - DNA, 12 bp, Homo sapiens
tagcacaggctg

SEQ ID NO: 1911865 - DNA, 20 bp, Homo sapiens
tagcacaggctgagtgcagg

SEQ ID NO: 1911866 - DNA, 18 bp, Homo sapiens
tagcatgtgttgcagctg

SEQ ID NO: 1911867 - DNA, 19 bp, Homo sapiens
tagcatgtgttgcagctgt

SEQ ID NO: 1911868 - DNA, 21 bp, Homo sapiens
tagcatgtgttgcagctgtca

SEQ ID NO: 1911869 - DNA, 13 bp, Homo sapiens
tagccaaaatgtg

SEQ ID NO: 1911870 - DNA, 23 bp, Homo sapiens
tagccaaaatgtgagtggttgaa

SEQ ID NO: 1911871 - DNA, 20 bp, Homo sapiens
tagccatgaggaggcagaga

SEQ ID NO: 1911872 - DNA, 21 bp, Homo sapiens
tagcccaggatatattttatt

SEQ ID NO: 1911873 - DNA, 17 bp, Homo sapiens
tagcctcacgaaactgg

SEQ ID NO: 1911874 - DNA, 19 bp, Homo sapiens
tagcctgaagagtttgtaa

SEQ ID NO: 1911875 - DNA, 23 bp, Homo sapiens
tagctatatgcattttatgtgac

SEQ ID NO: 1911876 - DNA, 24 bp, Homo sapiens
tagctattactgcagactataaaa

SEQ ID NO: 1911877 - DNA, 14 bp, Homo sapiens
tagctcgtcctcac

SEQ ID NO: 1911878 - DNA, 20 bp, Homo sapiens
tagctgcatttgtctggcct

SEQ ID NO: 1911879 - DNA, 19 bp, Homo sapiens
tagcttctagtctggaact

SEQ ID NO: 1911880 - DNA, 12 bp, Homo sapiens
taggcaaataag

SEQ ID NO: 1911881 - DNA, 16 bp, Homo sapiens
taggcagcctgagagt

SEQ ID NO: 1911882 - DNA, 23 bp, Homo sapiens
taggcccctgattcactgcctat

SEQ ID NO: 1911883 - DNA, 14 bp, Homo sapiens
tagggaccagaacc

SEQ ID NO: 1911884 - DNA, 16 bp, Homo sapiens
tagtacgtgtggcttg

SEQ ID NO: 1911885 - DNA, 15 bp, Homo sapiens
tagtatctaataatg

SEQ ID NO: 1911886 - DNA, 19 bp, Homo sapiens
tagtcaagacgaacatgta

SEQ ID NO: 1911887 - DNA, 14 bp, Homo sapiens
tagtcggagccccc

SEQ ID NO: 1911888 - DNA, 18 bp, Homo sapiens
tagtgtggaaattaagaa

SEQ ID NO: 1911889 - DNA, 22 bp, Homo sapiens
tagtgttatatgaacatacaaa

SEQ ID NO: 1911890 - DNA, 15 bp, Homo sapiens
tagttatgtaaataa

SEQ ID NO: 1911891 - DNA, 15 bp, Homo sapiens
tcaatatatttgtat

SEQ ID NO: 1911892 - DNA, 17 bp, Homo sapiens
tcaatgaacaagcattc

SEQ ID NO: 1911893 - DNA, 22 bp, Homo sapiens
tcacaataaagagaaccatgtg

SEQ ID NO: 1911894 - DNA, 12 bp, Homo sapiens
tcacacacctct

SEQ ID NO: 1911895 - DNA, 17 bp, Homo sapiens
tcacacacctctgcccc

SEQ ID NO: 1911896 - DNA, 14 bp, Homo sapiens
tcacagacaggacc

SEQ ID NO: 1911897 - DNA, 15 bp, Homo sapiens
tcacagacaggaccc

SEQ ID NO: 1911898 - DNA, 13 bp, Homo sapiens
tcacagcagggcc

SEQ ID NO: 1911899 - DNA, 18 bp, Homo sapiens
tcacaggctgggctgggc

SEQ ID NO: 1911900 - DNA, 20 bp, Homo sapiens
tcacaggctgggctgggcac

SEQ ID NO: 1911901 - DNA, 23 bp, Homo sapiens
tcacatgtggggaggttaatcta

SEQ ID NO: 1911902 - DNA, 14 bp, Homo sapiens
tcaccacagacttt

SEQ ID NO: 1911903 - DNA, 19 bp, Homo sapiens
tcaccatgttggccaggct

SEQ ID NO: 1911904 - DNA, 21 bp, Homo sapiens
tcaccattcgtacataatact

SEQ ID NO: 1911905 - DNA, 17 bp, Homo sapiens
tcaccatttccccaggg

SEQ ID NO: 1911906 - DNA, 18 bp, Homo sapiens
tcaccccatccacatggg

SEQ ID NO: 1911907 - DNA, 19 bp, Homo sapiens
tcacctatccagagagtat

SEQ ID NO: 1911908 - DNA, 13 bp, Homo sapiens
tcactctcttcct

SEQ ID NO: 1911909 - DNA, 23 bp, Homo sapiens
tcactgcagcctccgcttccctg

SEQ ID NO: 1911910 - DNA, 13 bp, Homo sapiens
tcactggcatggt

SEQ ID NO: 1911911 - DNA, 21 bp, Homo sapiens
tcactggccacagttgtttga

SEQ ID NO: 1911912 - DNA, 14 bp, Homo sapiens
tcactgtgtatatt

SEQ ID NO: 1911913 - DNA, 19 bp, Homo sapiens
tcactgtgtatatttgatt

SEQ ID NO: 1911914 - DNA, 12 bp, Homo sapiens
tcactgtttaga

SEQ ID NO: 1911915 - DNA, 16 bp, Homo sapiens
tcactgtttagatttg

SEQ ID NO: 1911916 - DNA, 22 bp, Homo sapiens
tcacttaagttagttccactga

SEQ ID NO: 1911917 - DNA, 16 bp, Homo sapiens
tcacttttttgaagga

SEQ ID NO: 1911918 - DNA, 19 bp, Homo sapiens
tcagaaatccttgtattta

SEQ ID NO: 1911919 - DNA, 17 bp, Homo sapiens
tcagaaatgactttttg

SEQ ID NO: 1911920 - DNA, 14 bp, Homo sapiens
tcagaacagctgtt

SEQ ID NO: 1911921 - DNA, 19 bp, Homo sapiens
tcagaagctgatgaggaat

SEQ ID NO: 1911922 - DNA, 22 bp, Homo sapiens
tcagaggccccaataccccatg

SEQ ID NO: 1911923 - DNA, 13 bp, Homo sapiens
tcagattcaggca

SEQ ID NO: 1911924 - DNA, 16 bp, Homo sapiens
tcagattcaggcattt

SEQ ID NO: 1911925 - DNA, 12 bp, Homo sapiens
tcagcaaggcca

SEQ ID NO: 1911926 - DNA, 13 bp, Homo sapiens
tcagcaaggccac

SEQ ID NO: 1911927 - DNA, 15 bp, Homo sapiens
tcagcaaggccacct

SEQ ID NO: 1911928 - DNA, 14 bp, Homo sapiens
tcagcactggattg

SEQ ID NO: 1911929 - DNA, 18 bp, Homo sapiens
tcagccctctcttgccaa

SEQ ID NO: 1911930 - DNA, 17 bp, Homo sapiens
tcagcttccccagtagc

SEQ ID NO: 1911931 - DNA, 19 bp, Homo sapiens
tcagcttccccagtagctg

SEQ ID NO: 1911932 - DNA, 13 bp, Homo sapiens
tcaggctcccagg

SEQ ID NO: 1911933 - DNA, 18 bp, Homo sapiens
tcagggctgagtgttctg

SEQ ID NO: 1911934 - DNA, 17 bp, Homo sapiens
tcaggggtacacagagc

SEQ ID NO: 1911935 - DNA, 23 bp, Homo sapiens
tcaggggtacacagagctaaggc

SEQ ID NO: 1911936 - DNA, 19 bp, Homo sapiens
tcagggtgtgaggccacac

SEQ ID NO: 1911937 - DNA, 12 bp, Homo sapiens
tcaggtcccagt

SEQ ID NO: 1911938 - DNA, 22 bp, Homo sapiens
tcaggtcccagttgctgtcaca

SEQ ID NO: 1911939 - DNA, 19 bp, Homo sapiens
tcagtcggggcaggccagg

SEQ ID NO: 1911940 - DNA, 15 bp, Homo sapiens
tcagtgtttggtgca

SEQ ID NO: 1911941 - DNA, 19 bp, Homo sapiens
tcataagaggttctaactt

SEQ ID NO: 1911942 - DNA, 16 bp, Homo sapiens
tcataagctttgtaat

SEQ ID NO: 1911943 - DNA, 14 bp, Homo sapiens
tcatacacaacgta

SEQ ID NO: 1911944 - DNA, 16 bp, Homo sapiens
tcatactcgagtctga

SEQ ID NO: 1911945 - DNA, 20 bp, Homo sapiens
tcatagcattgtctattttt

SEQ ID NO: 1911946 - DNA, 16 bp, Homo sapiens
tcatagttttatttat

SEQ ID NO: 1911947 - DNA, 17 bp, Homo sapiens
tcatatgcacgttaaaa

SEQ ID NO: 1911948 - DNA, 12 bp, Homo sapiens
tcatattataca

SEQ ID NO: 1911949 - DNA, 13 bp, Homo sapiens
tcatcagaacagc

SEQ ID NO: 1911950 - DNA, 21 bp, Homo sapiens
tcatcagaacagctgttgact

SEQ ID NO: 1911951 - DNA, 14 bp, Homo sapiens
tcatcatattatac

SEQ ID NO: 1911952 - DNA, 21 bp, Homo sapiens
tcatcgaggagctagaacatt

SEQ ID NO: 1911953 - DNA, 21 bp, Homo sapiens
tcatctctagggaccagaacc

SEQ ID NO: 1911954 - DNA, 14 bp, Homo sapiens
tcatctgagaatga

SEQ ID NO: 1911955 - DNA, 15 bp, Homo sapiens
tcatctgagaatgaa

SEQ ID NO: 1911956 - DNA, 20 bp, Homo sapiens
tcatctggagttctcaaaga

SEQ ID NO: 1911957 - DNA, 18 bp, Homo sapiens
tcatggcccatcaggggc

SEQ ID NO: 1911958 - DNA, 19 bp, Homo sapiens
tcatggcccatcaggggca

SEQ ID NO: 1911959 - DNA, 16 bp, Homo sapiens
tcatggctcttagaaa

SEQ ID NO: 1911960 - DNA, 12 bp, Homo sapiens
tcattacttgtt

SEQ ID NO: 1911961 - DNA, 22 bp, Homo sapiens
tcattcttaatttatgtaaggt

SEQ ID NO: 1911962 - DNA, 16 bp, Homo sapiens
tcatttcaaaatatgt

SEQ ID NO: 1911963 - DNA, 15 bp, Homo sapiens
tcatttgctttggaa

SEQ ID NO: 1911964 - DNA, 22 bp, Homo sapiens
tcatttggggaccacagaggct

SEQ ID NO: 1911965 - DNA, 15 bp, Homo sapiens
tcattttctttcctt

SEQ ID NO: 1911966 - DNA, 13 bp, Homo sapiens
tccaacccctcgc

SEQ ID NO: 1911967 - DNA, 14 bp, Homo sapiens
tccaacccctcgcc

SEQ ID NO: 1911968 - DNA, 21 bp, Homo sapiens
tccaactggattataaataaa

SEQ ID NO: 1911969 - DNA, 15 bp, Homo sapiens
tccacagaggacaca

SEQ ID NO: 1911970 - DNA, 19 bp, Homo sapiens
tccacagaggacacagaga

SEQ ID NO: 1911971 - DNA, 14 bp, Homo sapiens
tccacccctctggc

SEQ ID NO: 1911972 - DNA, 14 bp, Homo sapiens
tccaccgtcccctc

SEQ ID NO: 1911973 - DNA, 20 bp, Homo sapiens
tccacctctgtgcagggcac

SEQ ID NO: 1911974 - DNA, 14 bp, Homo sapiens
tccactttttgtta

SEQ ID NO: 1911975 - DNA, 18 bp, Homo sapiens
tccactttttgttacata

SEQ ID NO: 1911976 - DNA, 19 bp, Homo sapiens
tccagaaggagcaggccct

SEQ ID NO: 1911977 - DNA, 12 bp, Homo sapiens
tccagaatgaag

SEQ ID NO: 1911978 - DNA, 15 bp, Homo sapiens
tccagatgccacaat

SEQ ID NO: 1911979 - DNA, 17 bp, Homo sapiens
tccagctccctcccctg

SEQ ID NO: 1911980 - DNA, 14 bp, Homo sapiens
tccaggaccctgcc

SEQ ID NO: 1911981 - DNA, 15 bp, Homo sapiens
tccaggaccctgcca

SEQ ID NO: 1911982 - DNA, 22 bp, Homo sapiens
tccaggaccctgccaggcacag

SEQ ID NO: 1911983 - DNA, 15 bp, Homo sapiens
tccagtaagatcact

SEQ ID NO: 1911984 - DNA, 21 bp, Homo sapiens
tccagtaagatcactgtttag

SEQ ID NO: 1911985 - DNA, 23 bp, Homo sapiens
tccagtaagatcactgtttagat

SEQ ID NO: 1911986 - DNA, 21 bp, Homo sapiens
tccagtgaggcatctctctgg

SEQ ID NO: 1911987 - DNA, 18 bp, Homo sapiens
tccagtggcttctcccaa

SEQ ID NO: 1911988 - DNA, 14 bp, Homo sapiens
tccagtttttcata

SEQ ID NO: 1911989 - DNA, 17 bp, Homo sapiens
tccatagctcaataaaa

SEQ ID NO: 1911990 - DNA, 12 bp, Homo sapiens
tccatctctgaa

SEQ ID NO: 1911991 - DNA, 17 bp, Homo sapiens
tccatctcttcctttcc

SEQ ID NO: 1911992 - DNA, 16 bp, Homo sapiens
tccatctgattccagc

SEQ ID NO: 1911993 - DNA, 22 bp, Homo sapiens
tccatggggtctctcacagaca

SEQ ID NO: 1911994 - DNA, 15 bp, Homo sapiens
tccattttttatatt

SEQ ID NO: 1911995 - DNA, 16 bp, Homo sapiens
tcccaagtctgacagc

SEQ ID NO: 1911996 - DNA, 12 bp, Homo sapiens
tcccactcccat

SEQ ID NO: 1911997 - DNA, 18 bp, Homo sapiens
tcccactcccatggctct

SEQ ID NO: 1911998 - DNA, 16 bp, Homo sapiens
tcccacttctgccaga

SEQ ID NO: 1911999 - DNA, 19 bp, Homo sapiens
tcccagaccccgcagcacg

SEQ ID NO: 1912000 - DNA, 21 bp, Homo sapiens
tcccagaccccgcagcacgcc

SEQ ID NO: 1912001 - DNA, 15 bp, Homo sapiens
tcccagctccacccc

SEQ ID NO: 1912002 - DNA, 11 bp, Homo sapiens
tcccagctctg

SEQ ID NO: 1912003 - DNA, 14 bp, Homo sapiens
tcccaggcagcgcc

SEQ ID NO: 1912004 - DNA, 16 bp, Homo sapiens
tcccaggcagcgccac

SEQ ID NO: 1912005 - DNA, 21 bp, Homo sapiens
tcccaggcagcgccactgtcc

SEQ ID NO: 1912006 - DNA, 16 bp, Homo sapiens
tccccaccctgtccca

SEQ ID NO: 1912007 - DNA, 19 bp, Homo sapiens
tccccaccctgtcccaggc

SEQ ID NO: 1912008 - DNA, 23 bp, Homo sapiens
tccccaccttcttgggactgctg

SEQ ID NO: 1912009 - DNA, 21 bp, Homo sapiens
tccccagggcacgtggttgag

SEQ ID NO: 1912010 - DNA, 17 bp, Homo sapiens
tcccctcccagggagca

SEQ ID NO: 1912011 - DNA, 17 bp, Homo sapiens
tcccctggaagcagtgc

SEQ ID NO: 1912012 - DNA, 19 bp, Homo sapiens
tccccttccagctccctcc

SEQ ID NO: 1912013 - DNA, 15 bp, Homo sapiens
tccccttcccagacc

SEQ ID NO: 1912014 - DNA, 14 bp, Homo sapiens
tccccttgcagccg

SEQ ID NO: 1912015 - DNA, 13 bp, Homo sapiens
tccctaaagtgtt

SEQ ID NO: 1912016 - DNA, 15 bp, Homo sapiens
tccctcactctcagg

SEQ ID NO: 1912017 - DNA, 15 bp, Homo sapiens
tccctcccctgctca

SEQ ID NO: 1912018 - DNA, 17 bp, Homo sapiens
tccctcccctgctcaga

SEQ ID NO: 1912019 - DNA, 14 bp, Homo sapiens
tccctctcctctgc

SEQ ID NO: 1912020 - DNA, 19 bp, Homo sapiens
tccctctcctctgccctct

SEQ ID NO: 1912021 - DNA, 17 bp, Homo sapiens
tccctgacgtctgccac

SEQ ID NO: 1912022 - DNA, 21 bp, Homo sapiens
tccctgacgtctgccaccagc

SEQ ID NO: 1912023 - DNA, 20 bp, Homo sapiens
tccctgctgtatcttccaga

SEQ ID NO: 1912024 - DNA, 20 bp, Homo sapiens
tccctgtgttaatttaagtt

SEQ ID NO: 1912025 - DNA, 14 bp, Homo sapiens
tccctttcctttcc

SEQ ID NO: 1912026 - DNA, 19 bp, Homo sapiens
tccctttcctttcctttca

SEQ ID NO: 1912027 - DNA, 17 bp, Homo sapiens
tcccttttctttccttt

SEQ ID NO: 1912028 - DNA, 18 bp, Homo sapiens
tcccttttctttcctttt

SEQ ID NO: 1912029 - DNA, 15 bp, Homo sapiens
tccgcccctgagccc

SEQ ID NO: 1912030 - DNA, 17 bp, Homo sapiens
tccgcccctgagcccac

SEQ ID NO: 1912031 - DNA, 18 bp, Homo sapiens
tccgcccctgagcccact

SEQ ID NO: 1912032 - DNA, 16 bp, Homo sapiens
tccgctgtctccctcc

SEQ ID NO: 1912033 - DNA, 17 bp, Homo sapiens
tccggctaagcaggcgc

SEQ ID NO: 1912034 - DNA, 13 bp, Homo sapiens
tcctaaaaggccc

SEQ ID NO: 1912035 - DNA, 16 bp, Homo sapiens
tcctaaaaggcccaga

SEQ ID NO: 1912036 - DNA, 16 bp, Homo sapiens
tcctaaataaattatt

SEQ ID NO: 1912037 - DNA, 23 bp, Homo sapiens
tcctaactgttttgtatatgctg

SEQ ID NO: 1912038 - DNA, 17 bp, Homo sapiens
tcctaatggtgatgcag

SEQ ID NO: 1912039 - DNA, 21 bp, Homo sapiens
tcctagctggagaggagccct

SEQ ID NO: 1912040 - DNA, 14 bp, Homo sapiens
tcctagtttgctgt

SEQ ID NO: 1912041 - DNA, 23 bp, Homo sapiens
tcctataattttgatagtgggac

SEQ ID NO: 1912042 - DNA, 18 bp, Homo sapiens
tcctatgtattctgggta

SEQ ID NO: 1912043 - DNA, 14 bp, Homo sapiens
tcctattagtgtta

SEQ ID NO: 1912044 - DNA, 12 bp, Homo sapiens
tcctcagccctc

SEQ ID NO: 1912045 - DNA, 15 bp, Homo sapiens
tcctcagccctctct

SEQ ID NO: 1912046 - DNA, 19 bp, Homo sapiens
tcctcatggcccatcaggg

SEQ ID NO: 1912047 - DNA, 16 bp, Homo sapiens
tcctccccaccctgtc

SEQ ID NO: 1912048 - DNA, 18 bp, Homo sapiens
tcctccccaccctgtccc

SEQ ID NO: 1912049 - DNA, 14 bp, Homo sapiens
tcctcccctggact

SEQ ID NO: 1912050 - DNA, 13 bp, Homo sapiens
tcctcctcctttc

SEQ ID NO: 1912051 - DNA, 12 bp, Homo sapiens
tcctcctgccct

SEQ ID NO: 1912052 - DNA, 22 bp, Homo sapiens
tcctctgctgcatccccttcca

SEQ ID NO: 1912053 - DNA, 17 bp, Homo sapiens
tcctgagcccccagctt

SEQ ID NO: 1912054 - DNA, 18 bp, Homo sapiens
tcctgagcccccagcttc

SEQ ID NO: 1912055 - DNA, 12 bp, Homo sapiens
tcctgccctccg

SEQ ID NO: 1912056 - DNA, 20 bp, Homo sapiens
tcctgccctccgccccgtcc

SEQ ID NO: 1912057 - DNA, 16 bp, Homo sapiens
tccttaattttatatg

SEQ ID NO: 1912058 - DNA, 15 bp, Homo sapiens
tccttacctggaaaa

SEQ ID NO: 1912059 - DNA, 15 bp, Homo sapiens
tccttatcagaggcc

SEQ ID NO: 1912060 - DNA, 13 bp, Homo sapiens
tccttctgggcat

SEQ ID NO: 1912061 - DNA, 14 bp, Homo sapiens
tccttgaagcttgt

SEQ ID NO: 1912062 - DNA, 22 bp, Homo sapiens
tccttggaaatcaaatgtaaag

SEQ ID NO: 1912063 - DNA, 16 bp, Homo sapiens
tccttgtatttagtaa

SEQ ID NO: 1912064 - DNA, 15 bp, Homo sapiens
tcctttaatatgaaa

SEQ ID NO: 1912065 - DNA, 21 bp, Homo sapiens
tcctttaccgaggacagcctg

SEQ ID NO: 1912066 - DNA, 22 bp, Homo sapiens
tcctttaccgaggacagcctgc

SEQ ID NO: 1912067 - DNA, 23 bp, Homo sapiens
tcctttaccgaggacagcctgcc

SEQ ID NO: 1912068 - DNA, 20 bp, Homo sapiens
tcctttcagtggcttggact

SEQ ID NO: 1912069 - DNA, 18 bp, Homo sapiens
tcctttcattttctttcc

SEQ ID NO: 1912070 - DNA, 16 bp, Homo sapiens
tcctttcctttttctt

SEQ ID NO: 1912071 - DNA, 12 bp, Homo sapiens
tcctttcttgat

SEQ ID NO: 1912072 - DNA, 22 bp, Homo sapiens
tcctttttatttatatgtatgt

SEQ ID NO: 1912073 - DNA, 20 bp, Homo sapiens
tcctttttttcccttttctt

SEQ ID NO: 1912074 - DNA, 13 bp, Homo sapiens
tcgaaaagaaatt

SEQ ID NO: 1912075 - DNA, 15 bp, Homo sapiens
tcgagctcggggctg

SEQ ID NO: 1912076 - DNA, 13 bp, Homo sapiens
tcgagtctgaggc

SEQ ID NO: 1912077 - DNA, 14 bp, Homo sapiens
tcgagtctgaggcc

SEQ ID NO: 1912078 - DNA, 20 bp, Homo sapiens
tcgagtgccgcatctcacag

SEQ ID NO: 1912079 - DNA, 22 bp, Homo sapiens
tcgagtgccgcatctcacagct

SEQ ID NO: 1912080 - DNA, 23 bp, Homo sapiens
tcgagtgccgcatctcacagcta

SEQ ID NO: 1912081 - DNA, 13 bp, Homo sapiens
tcgattctttgaa

SEQ ID NO: 1912082 - DNA, 22 bp, Homo sapiens
tcgcatagaaatcaataatttg

SEQ ID NO: 1912083 - DNA, 16 bp, Homo sapiens
tcggatcaggctccca

SEQ ID NO: 1912084 - DNA, 13 bp, Homo sapiens
tcgggaaacctcc

SEQ ID NO: 1912085 - DNA, 20 bp, Homo sapiens
tcgggctgttctggtggccc

SEQ ID NO: 1912086 - DNA, 15 bp, Homo sapiens
tcggggcaggccagg

SEQ ID NO: 1912087 - DNA, 16 bp, Homo sapiens
tcggggcaggccaggg

SEQ ID NO: 1912088 - DNA, 21 bp, Homo sapiens
tcggggctgggggctgcaggg

SEQ ID NO: 1912089 - DNA, 14 bp, Homo sapiens
tcgtacataatact

SEQ ID NO: 1912090 - DNA, 22 bp, Homo sapiens
tcgtacataatactgaaccact

SEQ ID NO: 1912091 - DNA, 14 bp, Homo sapiens
tcgtactctctctc

SEQ ID NO: 1912092 - DNA, 13 bp, Homo sapiens
tcgtcagcctccc

SEQ ID NO: 1912093 - DNA, 14 bp, Homo sapiens
tcgtcagcctccct

SEQ ID NO: 1912094 - DNA, 16 bp, Homo sapiens
tcgtcagcctccctga

SEQ ID NO: 1912095 - DNA, 21 bp, Homo sapiens
tcgtgatgctatgatgttagt

SEQ ID NO: 1912096 - DNA, 14 bp, Homo sapiens
tcgttcgctcgctc

SEQ ID NO: 1912097 - DNA, 16 bp, Homo sapiens
tctaatatatccacac

SEQ ID NO: 1912098 - DNA, 17 bp, Homo sapiens
tctaccctgatcacctc

SEQ ID NO: 1912099 - DNA, 12 bp, Homo sapiens
tctactttgaaa

SEQ ID NO: 1912100 - DNA, 14 bp, Homo sapiens
tctactttgaaata

SEQ ID NO: 1912101 - DNA, 21 bp, Homo sapiens
tctactttgaaatatttaatt

SEQ ID NO: 1912102 - DNA, 12 bp, Homo sapiens
tctagcacatgt

SEQ ID NO: 1912103 - DNA, 17 bp, Homo sapiens
tctaggactctgcactg

SEQ ID NO: 1912104 - DNA, 15 bp, Homo sapiens
tctaggactgggccc

SEQ ID NO: 1912105 - DNA, 13 bp, Homo sapiens
tctagtactgtga

SEQ ID NO: 1912106 - DNA, 14 bp, Homo sapiens
tctagtactgtgaa

SEQ ID NO: 1912107 - DNA, 15 bp, Homo sapiens
tctagtactgtgaat

SEQ ID NO: 1912108 - DNA, 14 bp, Homo sapiens
tctagtattcttta

SEQ ID NO: 1912109 - DNA, 19 bp, Homo sapiens
tctagtctggaactgctgc

SEQ ID NO: 1912110 - DNA, 20 bp, Homo sapiens
tctagtctggaactgctgct

SEQ ID NO: 1912111 - DNA, 22 bp, Homo sapiens
tctagtctggaactgctgctga

SEQ ID NO: 1912112 - DNA, 14 bp, Homo sapiens
tctagtgctgtgaa

SEQ ID NO: 1912113 - DNA, 19 bp, Homo sapiens
tctagtgctgtgaaaaaaa

SEQ ID NO: 1912114 - DNA, 15 bp, Homo sapiens
tctataattttacaa

SEQ ID NO: 1912115 - DNA, 18 bp, Homo sapiens
tctatacatgtttgcagt

SEQ ID NO: 1912116 - DNA, 15 bp, Homo sapiens
tctatagcatcactt

SEQ ID NO: 1912117 - DNA, 17 bp, Homo sapiens
tctatagcatcacttaa

SEQ ID NO: 1912118 - DNA, 19 bp, Homo sapiens
tctatagcatcacttaaaa

SEQ ID NO: 1912119 - DNA, 17 bp, Homo sapiens
tctatcttgtaaatatt

SEQ ID NO: 1912120 - DNA, 21 bp, Homo sapiens
tctatttcatcagaacagctg

SEQ ID NO: 1912121 - DNA, 17 bp, Homo sapiens
tctatttctctccttaa

SEQ ID NO: 1912122 - DNA, 12 bp, Homo sapiens
tctatttctgaa

SEQ ID NO: 1912123 - DNA, 16 bp, Homo sapiens
tctatttttctcttca

SEQ ID NO: 1912124 - DNA, 19 bp, Homo sapiens
tctatttttcttcagactg

SEQ ID NO: 1912125 - DNA, 17 bp, Homo sapiens
tctcaaagacctggggc

SEQ ID NO: 1912126 - DNA, 21 bp, Homo sapiens
tctcaaagccccattaactgc

SEQ ID NO: 1912127 - DNA, 19 bp, Homo sapiens
tctcacagacaggacccct

SEQ ID NO: 1912128 - DNA, 20 bp, Homo sapiens
tctcacagacaggacccctg

SEQ ID NO: 1912129 - DNA, 17 bp, Homo sapiens
tctcacagctatgcaaa

SEQ ID NO: 1912130 - DNA, 20 bp, Homo sapiens
tctcaccatttccccagggc

SEQ ID NO: 1912131 - DNA, 17 bp, Homo sapiens
tctcaccttggttcctg

SEQ ID NO: 1912132 - DNA, 12 bp, Homo sapiens
tctcactctctt

SEQ ID NO: 1912133 - DNA, 15 bp, Homo sapiens
tctcactctcttcct

SEQ ID NO: 1912134 - DNA, 16 bp, Homo sapiens
tctcactctcttcctt

SEQ ID NO: 1912135 - DNA, 18 bp, Homo sapiens
tctcactctcttcctttc

SEQ ID NO: 1912136 - DNA, 15 bp, Homo sapiens
tctcactgcctttgt

SEQ ID NO: 1912137 - DNA, 14 bp, Homo sapiens
tctcattacttgtt

SEQ ID NO: 1912138 - DNA, 12 bp, Homo sapiens
tctcccagctct

SEQ ID NO: 1912139 - DNA, 14 bp, Homo sapiens
tctccctaaagtgt

SEQ ID NO: 1912140 - DNA, 17 bp, Homo sapiens
tctccgcccctgagccc

SEQ ID NO: 1912141 - DNA, 19 bp, Homo sapiens
tctccgcccctgagcccac

SEQ ID NO: 1912142 - DNA, 20 bp, Homo sapiens
tctccgcccctgagcccact

SEQ ID NO: 1912143 - DNA, 21 bp, Homo sapiens
tctccgcccctgagcccactg

SEQ ID NO: 1912144 - DNA, 17 bp, Homo sapiens
tctcctctgccctctgc

SEQ ID NO: 1912145 - DNA, 18 bp, Homo sapiens
tctcctctgccctctgct

SEQ ID NO: 1912146 - DNA, 18 bp, Homo sapiens
tctccttaagagacaatt

SEQ ID NO: 1912147 - DNA, 14 bp, Homo sapiens
tctcgattctttga

SEQ ID NO: 1912148 - DNA, 19 bp, Homo sapiens
tctcgctctgttgcccagg

SEQ ID NO: 1912149 - DNA, 20 bp, Homo sapiens
tctctaacagtggacaaagt

SEQ ID NO: 1912150 - DNA, 23 bp, Homo sapiens
tctctaatatccacttgtccatg

SEQ ID NO: 1912151 - DNA, 15 bp, Homo sapiens
tctctactaaaaata

SEQ ID NO: 1912152 - DNA, 14 bp, Homo sapiens
tctctagtgctgtg

SEQ ID NO: 1912153 - DNA, 17 bp, Homo sapiens
tctctagtgctgtgaaa

SEQ ID NO: 1912154 - DNA, 19 bp, Homo sapiens
tctctagtgctgtgaaaaa

SEQ ID NO: 1912155 - DNA, 19 bp, Homo sapiens
tctctcacagacaggaccc

SEQ ID NO: 1912156 - DNA, 23 bp, Homo sapiens
tctctcacagacaggacccctgc

SEQ ID NO: 1912157 - DNA, 19 bp, Homo sapiens
tctctccatttcactggct

SEQ ID NO: 1912158 - DNA, 15 bp, Homo sapiens
tctctcccagctctg

SEQ ID NO: 1912159 - DNA, 16 bp, Homo sapiens
tctctcccagctctgg

SEQ ID NO: 1912160 - DNA, 18 bp, Homo sapiens
tctctcgtactctctctc

SEQ ID NO: 1912161 - DNA, 13 bp, Homo sapiens
tctctctctccat

SEQ ID NO: 1912162 - DNA, 15 bp, Homo sapiens
tctctgaaggaggcc

SEQ ID NO: 1912163 - DNA, 21 bp, Homo sapiens
tctctgaaggaggccacctcc

SEQ ID NO: 1912164 - DNA, 11 bp, Homo sapiens
tctcttccttt

SEQ ID NO: 1912165 - DNA, 14 bp, Homo sapiens
tctcttctctgcca

SEQ ID NO: 1912166 - DNA, 13 bp, Homo sapiens
tctcttgcctcag

SEQ ID NO: 1912167 - DNA, 13 bp, Homo sapiens
tctctttctctct

SEQ ID NO: 1912168 - DNA, 14 bp, Homo sapiens
tctctttctctctc

SEQ ID NO: 1912169 - DNA, 17 bp, Homo sapiens
tctgaaatataaagtct

SEQ ID NO: 1912170 - DNA, 17 bp, Homo sapiens
tctgaaggaggccacct

SEQ ID NO: 1912171 - DNA, 19 bp, Homo sapiens
tctgaaggaggccacctcc

SEQ ID NO: 1912172 - DNA, 20 bp, Homo sapiens
tctgaaggaggccacctcct

SEQ ID NO: 1912173 - DNA, 20 bp, Homo sapiens
tctgaattggaatgcactca

SEQ ID NO: 1912174 - DNA, 21 bp, Homo sapiens
tctgactttgaatttatataa

SEQ ID NO: 1912175 - DNA, 14 bp, Homo sapiens
tctgagaatgaaca

SEQ ID NO: 1912176 - DNA, 19 bp, Homo sapiens
tctgagcttacgtagttct

SEQ ID NO: 1912177 - DNA, 17 bp, Homo sapiens
tctgaggccgttgctga

SEQ ID NO: 1912178 - DNA, 22 bp, Homo sapiens
tctgaggccgttgctgacttag

SEQ ID NO: 1912179 - DNA, 22 bp, Homo sapiens
tctgagttaggttccagcatgt

SEQ ID NO: 1912180 - DNA, 23 bp, Homo sapiens
tctgagttccggcaccagtagca

SEQ ID NO: 1912181 - DNA, 22 bp, Homo sapiens
tctgatagtagtctttaaaaga

SEQ ID NO: 1912182 - DNA, 17 bp, Homo sapiens
tctgatatcagcactgg

SEQ ID NO: 1912183 - DNA, 18 bp, Homo sapiens
tctgatatcagcactgga

SEQ ID NO: 1912184 - DNA, 22 bp, Homo sapiens
tctgatcactgaaataaaagct

SEQ ID NO: 1912185 - DNA, 20 bp, Homo sapiens
tctgatttcttttcaccatt

SEQ ID NO: 1912186 - DNA, 21 bp, Homo sapiens
tctgccacagcaaggctgtcg

SEQ ID NO: 1912187 - DNA, 13 bp, Homo sapiens
tctgccaccagcg

SEQ ID NO: 1912188 - DNA, 23 bp, Homo sapiens
tctgccaccagcgcccccactcc

SEQ ID NO: 1912189 - DNA, 11 bp, Homo sapiens
tctgccacctg

SEQ ID NO: 1912190 - DNA, 16 bp, Homo sapiens
tctgccacctgcacag

SEQ ID NO: 1912191 - DNA, 22 bp, Homo sapiens
tctgccagatgtcctaatggtg

SEQ ID NO: 1912192 - DNA, 23 bp, Homo sapiens
tctgccagatgtcctaatggtga

SEQ ID NO: 1912193 - DNA, 18 bp, Homo sapiens
tctgccagggatggcagt

SEQ ID NO: 1912194 - DNA, 18 bp, Homo sapiens
tctgccccttgggcctcc

SEQ ID NO: 1912195 - DNA, 23 bp, Homo sapiens
tctgccccttgggcctcccactc

SEQ ID NO: 1912196 - DNA, 16 bp, Homo sapiens
tctgccctctgctcta

SEQ ID NO: 1912197 - DNA, 16 bp, Homo sapiens
tctgctccaactccac

SEQ ID NO: 1912198 - DNA, 21 bp, Homo sapiens
tctgctctaattgctgccagg

SEQ ID NO: 1912199 - DNA, 18 bp, Homo sapiens
tctgctttagacttgaaa

SEQ ID NO: 1912200 - DNA, 18 bp, Homo sapiens
tctggaactgctgctgac

SEQ ID NO: 1912201 - DNA, 21 bp, Homo sapiens
tctggaactgctgctgacccc

SEQ ID NO: 1912202 - DNA, 23 bp, Homo sapiens
tctggaactgctgctgacccctg

SEQ ID NO: 1912203 - DNA, 15 bp, Homo sapiens
tctggcacagcctgc

SEQ ID NO: 1912204 - DNA, 13 bp, Homo sapiens
tctggggaccagc

SEQ ID NO: 1912205 - DNA, 18 bp, Homo sapiens
tctgggtagctgtaaggc

SEQ ID NO: 1912206 - DNA, 16 bp, Homo sapiens
tctgggtttggcaggc

SEQ ID NO: 1912207 - DNA, 12 bp, Homo sapiens
tctggtggcccc

SEQ ID NO: 1912208 - DNA, 14 bp, Homo sapiens
tctgtagcctgaag

SEQ ID NO: 1912209 - DNA, 21 bp, Homo sapiens
tctgtcacttgcattccactt

SEQ ID NO: 1912210 - DNA, 18 bp, Homo sapiens
tctgtcagggttggaaag

SEQ ID NO: 1912211 - DNA, 19 bp, Homo sapiens
tctgtcagggttggaaagt

SEQ ID NO: 1912212 - DNA, 13 bp, Homo sapiens
tctgtgaataagc

SEQ ID NO: 1912213 - DNA, 14 bp, Homo sapiens
tctgtgcagggcac

SEQ ID NO: 1912214 - DNA, 12 bp, Homo sapiens
tctgtggttggc

SEQ ID NO: 1912215 - DNA, 19 bp, Homo sapiens
tctgtggttggctgggaaa

SEQ ID NO: 1912216 - DNA, 19 bp, Homo sapiens
tctgttacactttttggaa

SEQ ID NO: 1912217 - DNA, 21 bp, Homo sapiens
tctgttggcaaatttgtgaac

SEQ ID NO: 1912218 - DNA, 21 bp, Homo sapiens
tctgtttttcttctgaaatac

SEQ ID NO: 1912219 - DNA, 19 bp, Homo sapiens
tcttaatggatgaaatcat

SEQ ID NO: 1912220 - DNA, 15 bp, Homo sapiens
tcttaatttatgtaa

SEQ ID NO: 1912221 - DNA, 11 bp, Homo sapiens
tcttactttgt

SEQ ID NO: 1912222 - DNA, 16 bp, Homo sapiens
tcttactttgtaaatt

SEQ ID NO: 1912223 - DNA, 17 bp, Homo sapiens
tcttactttgtaaattc

SEQ ID NO: 1912224 - DNA, 12 bp, Homo sapiens
tcttagaaactc

SEQ ID NO: 1912225 - DNA, 16 bp, Homo sapiens
tcttagctgatgtctt

SEQ ID NO: 1912226 - DNA, 17 bp, Homo sapiens
tcttagctgatgtcttt

SEQ ID NO: 1912227 - DNA, 17 bp, Homo sapiens
tcttaggccaggcgtgg

SEQ ID NO: 1912228 - DNA, 13 bp, Homo sapiens
tcttagtttgaat

SEQ ID NO: 1912229 - DNA, 14 bp, Homo sapiens
tcttatttatgtaa

SEQ ID NO: 1912230 - DNA, 15 bp, Homo sapiens
tcttatttatgtaac

SEQ ID NO: 1912231 - DNA, 23 bp, Homo sapiens
tcttccttacctggaaaaacatg

SEQ ID NO: 1912232 - DNA, 13 bp, Homo sapiens
tcttcctttcatt

SEQ ID NO: 1912233 - DNA, 15 bp, Homo sapiens
tcttctcctgcagcc

SEQ ID NO: 1912234 - DNA, 15 bp, Homo sapiens
tcttgacctctgcct

SEQ ID NO: 1912235 - DNA, 20 bp, Homo sapiens
tcttgagttgtttttgtata

SEQ ID NO: 1912236 - DNA, 19 bp, Homo sapiens
tcttgcctcagcttcccca

SEQ ID NO: 1912237 - DNA, 15 bp, Homo sapiens
tcttgctctctttta

SEQ ID NO: 1912238 - DNA, 14 bp, Homo sapiens
tcttgttctctcct

SEQ ID NO: 1912239 - DNA, 11 bp, Homo sapiens
tcttgttggtt

SEQ ID NO: 1912240 - DNA, 21 bp, Homo sapiens
tctttaaaagatataagactt

SEQ ID NO: 1912241 - DNA, 17 bp, Homo sapiens
tctttcccttctttttc

SEQ ID NO: 1912242 - DNA, 11 bp, Homo sapiens
tctttcctttt

SEQ ID NO: 1912243 - DNA, 18 bp, Homo sapiens
tctttctaagagacctga

SEQ ID NO: 1912244 - DNA, 13 bp, Homo sapiens
tctttctctgagg

SEQ ID NO: 1912245 - DNA, 19 bp, Homo sapiens
tctttgaagagatgacaac

SEQ ID NO: 1912246 - DNA, 13 bp, Homo sapiens
tctttgatgtgtt

SEQ ID NO: 1912247 - DNA, 16 bp, Homo sapiens
tctttgatgtgttgtt

SEQ ID NO: 1912248 - DNA, 18 bp, Homo sapiens
tctttgcagttcccatct

SEQ ID NO: 1912249 - DNA, 16 bp, Homo sapiens
tcttttgctttccttt

SEQ ID NO: 1912250 - DNA, 13 bp, Homo sapiens
tctttttcccttt

SEQ ID NO: 1912251 - DNA, 17 bp, Homo sapiens
tctttttccctttcctt

SEQ ID NO: 1912252 - DNA, 16 bp, Homo sapiens
tcttttttattaatca

SEQ ID NO: 1912253 - DNA, 24 bp, Homo sapiens
tcttttttattaatcactgtgtat

SEQ ID NO: 1912254 - DNA, 20 bp, Homo sapiens
tcttttttgatatgataata

SEQ ID NO: 1912255 - DNA, 20 bp, Homo sapiens
tgaaaaaaaaaatgctgaac

SEQ ID NO: 1912256 - DNA, 20 bp, Homo sapiens
tgaaaacaagagactgcttg

SEQ ID NO: 1912257 - DNA, 14 bp, Homo sapiens
tgaaaagagaaact

SEQ ID NO: 1912258 - DNA, 15 bp, Homo sapiens
tgaaaagagaaactt

SEQ ID NO: 1912259 - DNA, 18 bp, Homo sapiens
tgaaaagtaatatttatt

SEQ ID NO: 1912260 - DNA, 20 bp, Homo sapiens
tgaaaagtaatatttattaa

SEQ ID NO: 1912261 - DNA, 21 bp, Homo sapiens
tgaaaagtaatatttattaaa

SEQ ID NO: 1912262 - DNA, 14 bp, Homo sapiens
tgaaaataagccat

SEQ ID NO: 1912263 - DNA, 18 bp, Homo sapiens
tgaaaataagccatgaga

SEQ ID NO: 1912264 - DNA, 18 bp, Homo sapiens
tgaaaatagtttatttta

SEQ ID NO: 1912265 - DNA, 12 bp, Homo sapiens
tgaaaatttata

SEQ ID NO: 1912266 - DNA, 21 bp, Homo sapiens
tgaaaatttcacttgaaatta

SEQ ID NO: 1912267 - DNA, 13 bp, Homo sapiens
tgaaacagacttg

SEQ ID NO: 1912268 - DNA, 14 bp, Homo sapiens
tgaaacagacttgt

SEQ ID NO: 1912269 - DNA, 24 bp, Homo sapiens
tgaaacatgttgccaaaatggtgg

SEQ ID NO: 1912270 - DNA, 14 bp, Homo sapiens
tgaaactcccaccc

SEQ ID NO: 1912271 - DNA, 15 bp, Homo sapiens
tgaaactcccaccct

SEQ ID NO: 1912272 - DNA, 15 bp, Homo sapiens
tgaaagaaaactttt

SEQ ID NO: 1912273 - DNA, 16 bp, Homo sapiens
tgaaagaataggatta

SEQ ID NO: 1912274 - DNA, 23 bp, Homo sapiens
tgaaagaataggattaatgatca

SEQ ID NO: 1912275 - DNA, 14 bp, Homo sapiens
tgaaagaatgtaaa

SEQ ID NO: 1912276 - DNA, 16 bp, Homo sapiens
tgaaagaatgtaaagc

SEQ ID NO: 1912277 - DNA, 21 bp, Homo sapiens
tgaaaggcttttcaaccacaa

SEQ ID NO: 1912278 - DNA, 21 bp, Homo sapiens
tgaaagtgcctttgcagctca

SEQ ID NO: 1912279 - DNA, 20 bp, Homo sapiens
tgaaatacaaccagaaacaa

SEQ ID NO: 1912280 - DNA, 23 bp, Homo sapiens
tgaaattttttttcatgctttat

SEQ ID NO: 1912281 - DNA, 15 bp, Homo sapiens
tgaacaaagaccaat

SEQ ID NO: 1912282 - DNA, 15 bp, Homo sapiens
tgaacaagtccctgt

SEQ ID NO: 1912283 - DNA, 16 bp, Homo sapiens
tgaacatacaaatgca

SEQ ID NO: 1912284 - DNA, 23 bp, Homo sapiens
tgaacatacaaatgcatctttga

SEQ ID NO: 1912285 - DNA, 18 bp, Homo sapiens
tgaacatgcctcctcctg

SEQ ID NO: 1912286 - DNA, 16 bp, Homo sapiens
tgaaccataaaatgtc

SEQ ID NO: 1912287 - DNA, 14 bp, Homo sapiens
tgaaccctaataag

SEQ ID NO: 1912288 - DNA, 12 bp, Homo sapiens
tgaacctgaata

SEQ ID NO: 1912289 - DNA, 17 bp, Homo sapiens
tgaacgtttggttcaaa

SEQ ID NO: 1912290 - DNA, 18 bp, Homo sapiens
tgaactcttctcattact

SEQ ID NO: 1912291 - DNA, 16 bp, Homo sapiens
tgaacttggaagcaca

SEQ ID NO: 1912292 - DNA, 11 bp, Homo sapiens
tgaagaattta

SEQ ID NO: 1912293 - DNA, 15 bp, Homo sapiens
tgaagaatttaaaga

SEQ ID NO: 1912294 - DNA, 16 bp, Homo sapiens
tgaagagatgacaaca

SEQ ID NO: 1912295 - DNA, 13 bp, Homo sapiens
tgaagagtttgta

SEQ ID NO: 1912296 - DNA, 19 bp, Homo sapiens
tgaagagtttgtaaatgac

SEQ ID NO: 1912297 - DNA, 22 bp, Homo sapiens
tgaagagtttgtaaatgacttt

SEQ ID NO: 1912298 - DNA, 12 bp, Homo sapiens
tgaagatacttt

SEQ ID NO: 1912299 - DNA, 19 bp, Homo sapiens
tgaagatactttgtattgt

SEQ ID NO: 1912300 - DNA, 20 bp, Homo sapiens
tgaagcaaacagttgacaat

SEQ ID NO: 1912301 - DNA, 13 bp, Homo sapiens
tgaagctgaggct

SEQ ID NO: 1912302 - DNA, 14 bp, Homo sapiens
tgaagcttgtatct

SEQ ID NO: 1912303 - DNA, 18 bp, Homo sapiens
tgaaggaggccacctcct

SEQ ID NO: 1912304 - DNA, 13 bp, Homo sapiens
tgaaggtttttga

SEQ ID NO: 1912305 - DNA, 14 bp, Homo sapiens
tgaaggtttttgat

SEQ ID NO: 1912306 - DNA, 17 bp, Homo sapiens
tgaagtgcatgggtcag

SEQ ID NO: 1912307 - DNA, 13 bp, Homo sapiens
tgaagtgccttaa

SEQ ID NO: 1912308 - DNA, 18 bp, Homo sapiens
tgaataatgtctagattt

SEQ ID NO: 1912309 - DNA, 21 bp, Homo sapiens
tgaataatgtctagattttga

SEQ ID NO: 1912310 - DNA, 13 bp, Homo sapiens
tgaatactgcttg

SEQ ID NO: 1912311 - DNA, 14 bp, Homo sapiens
tgaatatgattaaa

SEQ ID NO: 1912312 - DNA, 19 bp, Homo sapiens
tgaatatttaagcaataaa

SEQ ID NO: 1912313 - DNA, 20 bp, Homo sapiens
tgaatatttaagcaataaaa

SEQ ID NO: 1912314 - DNA, 22 bp, Homo sapiens
tgaatatttaagcaataaaact

SEQ ID NO: 1912315 - DNA, 13 bp, Homo sapiens
tgaatgctgggcc

SEQ ID NO: 1912316 - DNA, 22 bp, Homo sapiens
tgaatgctgtgggaaggcaatt

SEQ ID NO: 1912317 - DNA, 11 bp, Homo sapiens
tgaattaaaac

SEQ ID NO: 1912318 - DNA, 13 bp, Homo sapiens
tgaatttatataa

SEQ ID NO: 1912319 - DNA, 14 bp, Homo sapiens
tgaatttatataaa

SEQ ID NO: 1912320 - DNA, 16 bp, Homo sapiens
tgaatttatataaagt

SEQ ID NO: 1912321 - DNA, 16 bp, Homo sapiens
tgaatttttaaagaca

SEQ ID NO: 1912322 - DNA, 18 bp, Homo sapiens
tgacaaaggaaacacata

SEQ ID NO: 1912323 - DNA, 22 bp, Homo sapiens
tgacaaagtgggtactttctga

SEQ ID NO: 1912324 - DNA, 21 bp, Homo sapiens
tgacagagagagatactctgg

SEQ ID NO: 1912325 - DNA, 16 bp, Homo sapiens
tgacagcgcacagctg

SEQ ID NO: 1912326 - DNA, 14 bp, Homo sapiens
tgacaggcctgtcc

SEQ ID NO: 1912327 - DNA, 18 bp, Homo sapiens
tgacaggcgaaagaaaac

SEQ ID NO: 1912328 - DNA, 17 bp, Homo sapiens
tgacatcactggcatgg

SEQ ID NO: 1912329 - DNA, 17 bp, Homo sapiens
tgacattttagaatgtc

SEQ ID NO: 1912330 - DNA, 19 bp, Homo sapiens
tgaccagaagacaaaggcc

SEQ ID NO: 1912331 - DNA, 12 bp, Homo sapiens
tgaccagttttg

SEQ ID NO: 1912332 - DNA, 19 bp, Homo sapiens
tgacctcacacacctctgc

SEQ ID NO: 1912333 - DNA, 20 bp, Homo sapiens
tgacctcacacacctctgcc

SEQ ID NO: 1912334 - DNA, 12 bp, Homo sapiens
tgacggttccta

SEQ ID NO: 1912335 - DNA, 22 bp, Homo sapiens
tgacgtacaagtagttctgtat

SEQ ID NO: 1912336 - DNA, 17 bp, Homo sapiens
tgacgtctgccaccagc

SEQ ID NO: 1912337 - DNA, 13 bp, Homo sapiens
tgactacagggcc

SEQ ID NO: 1912338 - DNA, 22 bp, Homo sapiens
tgactctgccagggtggggctc

SEQ ID NO: 1912339 - DNA, 14 bp, Homo sapiens
tgactcttgagttg

SEQ ID NO: 1912340 - DNA, 19 bp, Homo sapiens
tgactcttgagttgttttt

SEQ ID NO: 1912341 - DNA, 14 bp, Homo sapiens
tgactgaactgtaa

SEQ ID NO: 1912342 - DNA, 13 bp, Homo sapiens
tgactgaggcagt

SEQ ID NO: 1912343 - DNA, 18 bp, Homo sapiens
tgactgaggcagtttgag

SEQ ID NO: 1912344 - DNA, 13 bp, Homo sapiens
tgactgcttataa

SEQ ID NO: 1912345 - DNA, 20 bp, Homo sapiens
tgacttaacatagccaaaat

SEQ ID NO: 1912346 - DNA, 20 bp, Homo sapiens
tgacttagaatccctgtgtt

SEQ ID NO: 1912347 - DNA, 21 bp, Homo sapiens
tgacttagaatccctgtgtta

SEQ ID NO: 1912348 - DNA, 23 bp, Homo sapiens
tgacttagaatccctgtgttaat

SEQ ID NO: 1912349 - DNA, 16 bp, Homo sapiens
tgactttattatttat

SEQ ID NO: 1912350 - DNA, 17 bp, Homo sapiens
tgactttattatttatt

SEQ ID NO: 1912351 - DNA, 17 bp, Homo sapiens
tgactttcacatttgga

SEQ ID NO: 1912352 - DNA, 22 bp, Homo sapiens
tgactttgaatttatataaagt

SEQ ID NO: 1912353 - DNA, 12 bp, Homo sapiens
tgagaatagaaa

SEQ ID NO: 1912354 - DNA, 23 bp, Homo sapiens
tgagaatagaaatttgcccctgg

SEQ ID NO: 1912355 - DNA, 17 bp, Homo sapiens
tgagaatgaacaaagac

SEQ ID NO: 1912356 - DNA, 17 bp, Homo sapiens
tgagaggggaggccaag

SEQ ID NO: 1912357 - DNA, 21 bp, Homo sapiens
tgagagtggtacaagggagaa

SEQ ID NO: 1912358 - DNA, 17 bp, Homo sapiens
tgagatggatggacaga

SEQ ID NO: 1912359 - DNA, 14 bp, Homo sapiens
tgagcaagcccagg

SEQ ID NO: 1912360 - DNA, 15 bp, Homo sapiens
tgagcaagcccagga

SEQ ID NO: 1912361 - DNA, 22 bp, Homo sapiens
tgagcccccagcttccagcagg

SEQ ID NO: 1912362 - DNA, 15 bp, Homo sapiens
tgagctatgacttaa

SEQ ID NO: 1912363 - DNA, 17 bp, Homo sapiens
tgagcttacgtagttct

SEQ ID NO: 1912364 - DNA, 18 bp, Homo sapiens
tgagcttacgtagttcta

SEQ ID NO: 1912365 - DNA, 14 bp, Homo sapiens
tgaggaggcagaga

SEQ ID NO: 1912366 - DNA, 16 bp, Homo sapiens
tgaggaggcagagagg

SEQ ID NO: 1912367 - DNA, 17 bp, Homo sapiens
tgaggattagtttagaa

SEQ ID NO: 1912368 - DNA, 19 bp, Homo sapiens
tgaggattagtttagaaca

SEQ ID NO: 1912369 - DNA, 20 bp, Homo sapiens
tgaggcagcacgtgcacaaa

SEQ ID NO: 1912370 - DNA, 15 bp, Homo sapiens
tgaggccccgaggct

SEQ ID NO: 1912371 - DNA, 17 bp, Homo sapiens
tgaggccgttgctgact

SEQ ID NO: 1912372 - DNA, 20 bp, Homo sapiens
tgaggccgttgctgacttag

SEQ ID NO: 1912373 - DNA, 16 bp, Homo sapiens
tgaggcgagcagggca

SEQ ID NO: 1912374 - DNA, 15 bp, Homo sapiens
tgaggctgctgccag

SEQ ID NO: 1912375 - DNA, 20 bp, Homo sapiens
tgaggctgctgccaggcccg

SEQ ID NO: 1912376 - DNA, 21 bp, Homo sapiens
tgagggcatttggcttcctct

SEQ ID NO: 1912377 - DNA, 21 bp, Homo sapiens
tgaggtaggcacaaatacatt

SEQ ID NO: 1912378 - DNA, 21 bp, Homo sapiens
tgagtctgtgtggccagcagc

SEQ ID NO: 1912379 - DNA, 13 bp, Homo sapiens
tgagtgcaggccc

SEQ ID NO: 1912380 - DNA, 21 bp, Homo sapiens
tgagtggggggaacgcccact

SEQ ID NO: 1912381 - DNA, 21 bp, Homo sapiens
tgagtgtgatccagtttttca

SEQ ID NO: 1912382 - DNA, 17 bp, Homo sapiens
tgagttccggcaccagt

SEQ ID NO: 1912383 - DNA, 18 bp, Homo sapiens
tgagttgtttttgtatat

SEQ ID NO: 1912384 - DNA, 20 bp, Homo sapiens
tgataaccatagcattaata

SEQ ID NO: 1912385 - DNA, 13 bp, Homo sapiens
tgataaggaacat

SEQ ID NO: 1912386 - DNA, 15 bp, Homo sapiens
tgataaggaacattt

SEQ ID NO: 1912387 - DNA, 22 bp, Homo sapiens
tgataccaaagagacagggccc

SEQ ID NO: 1912388 - DNA, 16 bp, Homo sapiens
tgatagcattgtaagc

SEQ ID NO: 1912389 - DNA, 22 bp, Homo sapiens
tgataggttattttgatgtaaa

SEQ ID NO: 1912390 - DNA, 15 bp, Homo sapiens
tgatataaacagctt

SEQ ID NO: 1912391 - DNA, 12 bp, Homo sapiens
tgatatggaggt

SEQ ID NO: 1912392 - DNA, 17 bp, Homo sapiens
tgatctccgcagaggct

SEQ ID NO: 1912393 - DNA, 13 bp, Homo sapiens
tgatctgtgcagg

SEQ ID NO: 1912394 - DNA, 20 bp, Homo sapiens
tgatctgtgcagggtattaa

SEQ ID NO: 1912395 - DNA, 12 bp, Homo sapiens
tgatcttcacta

SEQ ID NO: 1912396 - DNA, 11 bp, Homo sapiens
tgatctttgag

SEQ ID NO: 1912397 - DNA, 14 bp, Homo sapiens
tgatctttgagtgt

SEQ ID NO: 1912398 - DNA, 15 bp, Homo sapiens
tgatgaagctgaggc

SEQ ID NO: 1912399 - DNA, 21 bp, Homo sapiens
tgatgaagctgaggctgctgc

SEQ ID NO: 1912400 - DNA, 23 bp, Homo sapiens
tgatgaagctgaggctgctgcca

SEQ ID NO: 1912401 - DNA, 22 bp, Homo sapiens
tgatgacgtacaagtagttctg

SEQ ID NO: 1912402 - DNA, 18 bp, Homo sapiens
tgatgcattaaaagaaaa

SEQ ID NO: 1912403 - DNA, 18 bp, Homo sapiens
tgatgctggaactcttga

SEQ ID NO: 1912404 - DNA, 22 bp, Homo sapiens
tgatgctggaactcttgacagc

SEQ ID NO: 1912405 - DNA, 19 bp, Homo sapiens
tgatgggatgattgaagaa

SEQ ID NO: 1912406 - DNA, 21 bp, Homo sapiens
tgatgggatgattgaagaaac

SEQ ID NO: 1912407 - DNA, 12 bp, Homo sapiens
tgatgtactgta

SEQ ID NO: 1912408 - DNA, 22 bp, Homo sapiens
tgatgtcagcagttgctggtaa

SEQ ID NO: 1912409 - DNA, 12 bp, Homo sapiens
tgatgtttctca

SEQ ID NO: 1912410 - DNA, 19 bp, Homo sapiens
tgatgtttgccatttgctg

SEQ ID NO: 1912411 - DNA, 19 bp, Homo sapiens
tgattaaaaatatcaaatt

SEQ ID NO: 1912412 - DNA, 20 bp, Homo sapiens
tgattaaaaatatcaaatta

SEQ ID NO: 1912413 - DNA, 22 bp, Homo sapiens
tgattaaaaatatcaaattaat

SEQ ID NO: 1912414 - DNA, 14 bp, Homo sapiens
tgattaaaatgagt

SEQ ID NO: 1912415 - DNA, 18 bp, Homo sapiens
tgattattttcagaagct

SEQ ID NO: 1912416 - DNA, 18 bp, Homo sapiens
tgattcccttgttattca

SEQ ID NO: 1912417 - DNA, 19 bp, Homo sapiens
tgattcccttgttattcaa

SEQ ID NO: 1912418 - DNA, 18 bp, Homo sapiens
tgattcgtagatttaata

SEQ ID NO: 1912419 - DNA, 18 bp, Homo sapiens
tgattctaaaatgtctca

SEQ ID NO: 1912420 - DNA, 15 bp, Homo sapiens
tgatttattaactta

SEQ ID NO: 1912421 - DNA, 23 bp, Homo sapiens
tgatttcttttcaccattcgtac

SEQ ID NO: 1912422 - DNA, 13 bp, Homo sapiens
tgatttgagattt

SEQ ID NO: 1912423 - DNA, 20 bp, Homo sapiens
tgattttgaccttgtattga

SEQ ID NO: 1912424 - DNA, 16 bp, Homo sapiens
tgcaaacaactgaaat

SEQ ID NO: 1912425 - DNA, 17 bp, Homo sapiens
tgcaaacagaagtgcat

SEQ ID NO: 1912426 - DNA, 15 bp, Homo sapiens
tgcaacttcctttga

SEQ ID NO: 1912427 - DNA, 14 bp, Homo sapiens
tgcaatgccccctc

SEQ ID NO: 1912428 - DNA, 23 bp, Homo sapiens
tgcacacgagcagacacccttgg

SEQ ID NO: 1912429 - DNA, 13 bp, Homo sapiens
tgcaccatactca

SEQ ID NO: 1912430 - DNA, 15 bp, Homo sapiens
tgcactcagactgta

SEQ ID NO: 1912431 - DNA, 23 bp, Homo sapiens
tgcactgaatggctgacctgacc

SEQ ID NO: 1912432 - DNA, 13 bp, Homo sapiens
tgcactgactctg

SEQ ID NO: 1912433 - DNA, 17 bp, Homo sapiens
tgcactgactctggaaa

SEQ ID NO: 1912434 - DNA, 21 bp, Homo sapiens
tgcacttgggggctcagcaag

SEQ ID NO: 1912435 - DNA, 22 bp, Homo sapiens
tgcagaacttccctccatccac

SEQ ID NO: 1912436 - DNA, 18 bp, Homo sapiens
tgcagagcagtaagggaa

SEQ ID NO: 1912437 - DNA, 20 bp, Homo sapiens
tgcagcctccgcttccctgg

SEQ ID NO: 1912438 - DNA, 12 bp, Homo sapiens
tgcagcctgaga

SEQ ID NO: 1912439 - DNA, 15 bp, Homo sapiens
tgcagctcagaacca

SEQ ID NO: 1912440 - DNA, 19 bp, Homo sapiens
tagttctgactttgaattt

SEQ ID NO: 1912441 - DNA, 21 bp, Homo sapiens
tagttctgactttgaatttat

SEQ ID NO: 1912442 - DNA, 17 bp, Homo sapiens
tagttctgtatttgaaa

SEQ ID NO: 1912443 - DNA, 19 bp, Homo sapiens
tagttctgtatttgaaagt

SEQ ID NO: 1912444 - DNA, 13 bp, Homo sapiens
tagttgaatactt

SEQ ID NO: 1912445 - DNA, 16 bp, Homo sapiens
tagttgaatacttgaa

SEQ ID NO: 1912446 - DNA, 19 bp, Homo sapiens
tagtttaaaaatctgccac

SEQ ID NO: 1912447 - DNA, 23 bp, Homo sapiens
tataaaacagccctatttcttga

SEQ ID NO: 1912448 - DNA, 17 bp, Homo sapiens
tataaagtatttttata

SEQ ID NO: 1912449 - DNA, 16 bp, Homo sapiens
tataaatttatttact

SEQ ID NO: 1912450 - DNA, 19 bp, Homo sapiens
tataacttatattgtaaga

SEQ ID NO: 1912451 - DNA, 24 bp, Homo sapiens
tataacttatattgtaagaaatac

SEQ ID NO: 1912452 - DNA, 19 bp, Homo sapiens
tataagcaaaatcagaagt

SEQ ID NO: 1912453 - DNA, 21 bp, Homo sapiens
tataagccaaaattaaggtgt

SEQ ID NO: 1912454 - DNA, 13 bp, Homo sapiens
tataatgactggt

SEQ ID NO: 1912455 - DNA, 22 bp, Homo sapiens
tataattgatgatgttgtaaaa

SEQ ID NO: 1912456 - DNA, 15 bp, Homo sapiens
tataattttgatagt

SEQ ID NO: 1912457 - DNA, 22 bp, Homo sapiens
tatacatgtttgcagtgttaag

SEQ ID NO: 1912458 - DNA, 14 bp, Homo sapiens
tatagaaaggagac

SEQ ID NO: 1912459 - DNA, 15 bp, Homo sapiens
tatagcatcacttaa

SEQ ID NO: 1912460 - DNA, 17 bp, Homo sapiens
tatagcatcacttaaaa

SEQ ID NO: 1912461 - DNA, 18 bp, Homo sapiens
tatagcatcacttaaaac

SEQ ID NO: 1912462 - DNA, 22 bp, Homo sapiens
tatagttatgtaaataattctt

SEQ ID NO: 1912463 - DNA, 20 bp, Homo sapiens
tatagtttaaaaatctgcca

SEQ ID NO: 1912464 - DNA, 18 bp, Homo sapiens
tatataagcaaaatgaaa

SEQ ID NO: 1912465 - DNA, 16 bp, Homo sapiens
tatatgtatgtgttta

SEQ ID NO: 1912466 - DNA, 18 bp, Homo sapiens
tatatgtatgtgtttaga

SEQ ID NO: 1912467 - DNA, 19 bp, Homo sapiens
tatatgtttttgaaggcag

SEQ ID NO: 1912468 - DNA, 17 bp, Homo sapiens
tatattctattttacaa

SEQ ID NO: 1912469 - DNA, 15 bp, Homo sapiens
tatattggttttatg

SEQ ID NO: 1912470 - DNA, 16 bp, Homo sapiens
tatattggttttatga

SEQ ID NO: 1912471 - DNA, 19 bp, Homo sapiens
tatattggttttatgatga

SEQ ID NO: 1912472 - DNA, 23 bp, Homo sapiens
tatattggttttatgatgacgta

SEQ ID NO: 1912473 - DNA, 15 bp, Homo sapiens
tatattgtaagaaat

SEQ ID NO: 1912474 - DNA, 20 bp, Homo sapiens
tatattgtaagaaatactgt

SEQ ID NO: 1912475 - DNA, 21 bp, Homo sapiens
tatatttattgactcttgagt

SEQ ID NO: 1912476 - DNA, 20 bp, Homo sapiens
tatatttgatttattaactt

SEQ ID NO: 1912477 - DNA, 18 bp, Homo sapiens
tatattttatttttagaa

SEQ ID NO: 1912478 - DNA, 15 bp, Homo sapiens
tatattttgaaatat

SEQ ID NO: 1912479 - DNA, 18 bp, Homo sapiens
tatatttttactgctttc

SEQ ID NO: 1912480 - DNA, 21 bp, Homo sapiens
tatatttttactgctttctga

SEQ ID NO: 1912481 - DNA, 16 bp, Homo sapiens
tatcaaattaattgtg

SEQ ID NO: 1912482 - DNA, 17 bp, Homo sapiens
tatcaaattaattgtgt

SEQ ID NO: 1912483 - DNA, 22 bp, Homo sapiens
tatcaagcctagatgttttata

SEQ ID NO: 1912484 - DNA, 14 bp, Homo sapiens
tatcagcactggat

SEQ ID NO: 1912485 - DNA, 16 bp, Homo sapiens
tatcagcactggattg

SEQ ID NO: 1912486 - DNA, 18 bp, Homo sapiens
tatcctgagagcccagaa

SEQ ID NO: 1912487 - DNA, 15 bp, Homo sapiens
tatctaaatttggaa

SEQ ID NO: 1912488 - DNA, 19 bp, Homo sapiens
tatctaaatttggaactta

SEQ ID NO: 1912489 - DNA, 20 bp, Homo sapiens
tatctactgataaagaaaga

SEQ ID NO: 1912490 - DNA, 18 bp, Homo sapiens
tatctttgagttcaacct

SEQ ID NO: 1912491 - DNA, 18 bp, Homo sapiens
tatgaaaaacaaaaataa

SEQ ID NO: 1912492 - DNA, 13 bp, Homo sapiens
tatgaaaacatgg

SEQ ID NO: 1912493 - DNA, 17 bp, Homo sapiens
tatgaacatacaaatgc

SEQ ID NO: 1912494 - DNA, 15 bp, Homo sapiens
tatgaatactttgca

SEQ ID NO: 1912495 - DNA, 14 bp, Homo sapiens
tatgattaaaaata

SEQ ID NO: 1912496 - DNA, 13 bp, Homo sapiens
tatgcccagctgt

SEQ ID NO: 1912497 - DNA, 21 bp, Homo sapiens
tatgtaaggttttttttgtac

SEQ ID NO: 1912498 - DNA, 15 bp, Homo sapiens
tatgtataattcaaa

SEQ ID NO: 1912499 - DNA, 13 bp, Homo sapiens
tatgtatgtgttt

SEQ ID NO: 1912500 - DNA, 17 bp, Homo sapiens
tatgtatgtgtttagaa

SEQ ID NO: 1912501 - DNA, 20 bp, Homo sapiens
tatgtatgtgtttagaattg

SEQ ID NO: 1912502 - DNA, 22 bp, Homo sapiens
tatgtatgtgtttagaattgaa

SEQ ID NO: 1912503 - DNA, 19 bp, Homo sapiens
tatgtctagcacatgttga

SEQ ID NO: 1912504 - DNA, 13 bp, Homo sapiens
tatgtgtttagaa

SEQ ID NO: 1912505 - DNA, 22 bp, Homo sapiens
tatgtttgccactttgcaaagg

SEQ ID NO: 1912506 - DNA, 18 bp, Homo sapiens
tattaaatttttttgtat

SEQ ID NO: 1912507 - DNA, 21 bp, Homo sapiens
tattaaatttttttgtatgaa

SEQ ID NO: 1912508 - DNA, 15 bp, Homo sapiens
tattaacttaataat

SEQ ID NO: 1912509 - DNA, 20 bp, Homo sapiens
tattaacttaataatcaaga

SEQ ID NO: 1912510 - DNA, 12 bp, Homo sapiens
tattaatcactg

SEQ ID NO: 1912511 - DNA, 14 bp, Homo sapiens
tattaatcactgtg

SEQ ID NO: 1912512 - DNA, 15 bp, Homo sapiens
tattaatcactgtgt

SEQ ID NO: 1912513 - DNA, 17 bp, Homo sapiens
tattaatcactgtgtat

SEQ ID NO: 1912514 - DNA, 13 bp, Homo sapiens
tattaattattta

SEQ ID NO: 1912515 - DNA, 16 bp, Homo sapiens
tattaggaaaagatat

SEQ ID NO: 1912516 - DNA, 18 bp, Homo sapiens
tattaggaaaagatattt

SEQ ID NO: 1912517 - DNA, 16 bp, Homo sapiens
tattatttttctctct

SEQ ID NO: 1912518 - DNA, 17 bp, Homo sapiens
tattatttttctctctc

SEQ ID NO: 1912519 - DNA, 19 bp, Homo sapiens
tattcaggggaaacttgat

SEQ ID NO: 1912520 - DNA, 13 bp, Homo sapiens
tattctaataagc

SEQ ID NO: 1912521 - DNA, 14 bp, Homo sapiens
tattctatttgtgt

SEQ ID NO: 1912522 - DNA, 17 bp, Homo sapiens
tattctattttacaact

SEQ ID NO: 1912523 - DNA, 13 bp, Homo sapiens
tattctcataata

SEQ ID NO: 1912524 - DNA, 22 bp, Homo sapiens
tattgcagtgtgaatgctgggc

SEQ ID NO: 1912525 - DNA, 23 bp, Homo sapiens
tattgcagtgtgaatgctgggcc

SEQ ID NO: 1912526 - DNA, 17 bp, Homo sapiens
tattggtgtaaggtact

SEQ ID NO: 1912527 - DNA, 22 bp, Homo sapiens
tattgtcctattagtgttatat

SEQ ID NO: 1912528 - DNA, 13 bp, Homo sapiens
tatttaaagaaat

SEQ ID NO: 1912529 - DNA, 20 bp, Homo sapiens
tatttacaacactttaatgg

SEQ ID NO: 1912530 - DNA, 16 bp, Homo sapiens
tatttatatgtatgtg

SEQ ID NO: 1912531 - DNA, 18 bp, Homo sapiens
tatttatatgtatgtgtt

SEQ ID NO: 1912532 - DNA, 16 bp, Homo sapiens
tatttatatttattga

SEQ ID NO: 1912533 - DNA, 16 bp, Homo sapiens
tatttatgctaatatt

SEQ ID NO: 1912534 - DNA, 15 bp, Homo sapiens
tatttatgtaacaaa

SEQ ID NO: 1912535 - DNA, 16 bp, Homo sapiens
tatttatgttttcaca

SEQ ID NO: 1912536 - DNA, 24 bp, Homo sapiens
tatttattaaatttttttgtatga

SEQ ID NO: 1912537 - DNA, 21 bp, Homo sapiens
tatttattgactcttgagttg

SEQ ID NO: 1912538 - DNA, 20 bp, Homo sapiens
tatttattttttttaattgt

SEQ ID NO: 1912539 - DNA, 20 bp, Homo sapiens
tatttcatcatattatacag

SEQ ID NO: 1912540 - DNA, 21 bp, Homo sapiens
tatttcatcatattatacaga

SEQ ID NO: 1912541 - DNA, 20 bp, Homo sapiens
tatttgaaagtgcctttgca

SEQ ID NO: 1912542 - DNA, 15 bp, Homo sapiens
tatttgatgactgaa

SEQ ID NO: 1912543 - DNA, 13 bp, Homo sapiens
tatttgatttatt

SEQ ID NO: 1912544 - DNA, 23 bp, Homo sapiens
tatttgatttattaacttaataa

SEQ ID NO: 1912545 - DNA, 13 bp, Homo sapiens
tattttattaata

SEQ ID NO: 1912546 - DNA, 20 bp, Homo sapiens
tattttatttttagaatttt

SEQ ID NO: 1912547 - DNA, 22 bp, Homo sapiens
tattttcagaagctgatgagga

SEQ ID NO: 1912548 - DNA, 17 bp, Homo sapiens
tattttgatgtaaagat

SEQ ID NO: 1912549 - DNA, 13 bp, Homo sapiens
tattttgtgaata

SEQ ID NO: 1912550 - DNA, 18 bp, Homo sapiens
tatttttaagaaagaaat

SEQ ID NO: 1912551 - DNA, 20 bp, Homo sapiens
tatttttactgctttctgaa

SEQ ID NO: 1912552 - DNA, 18 bp, Homo sapiens
tattttttttaattgtat

SEQ ID NO: 1912553 - DNA, 14 bp, Homo sapiens
tcaaaaaaatctaa

SEQ ID NO: 1912554 - DNA, 16 bp, Homo sapiens
tcaaaacaaaggccta

SEQ ID NO: 1912555 - DNA, 18 bp, Homo sapiens
tcaaaagtagaactttgt

SEQ ID NO: 1912556 - DNA, 14 bp, Homo sapiens
tcaaacccctgacc

SEQ ID NO: 1912557 - DNA, 23 bp, Homo sapiens
tcaaagacctggggctgctgtga

SEQ ID NO: 1912558 - DNA, 20 bp, Homo sapiens
tcaaagccccattaactgct

SEQ ID NO: 1912559 - DNA, 19 bp, Homo sapiens
tcaaataactgcagaaaaa

SEQ ID NO: 1912560 - DNA, 14 bp, Homo sapiens
tcaaatccaggacc

SEQ ID NO: 1912561 - DNA, 19 bp, Homo sapiens
tcaaatccaggaccctgcc

SEQ ID NO: 1912562 - DNA, 18 bp, Homo sapiens
tcaaatgatgtgcctgct

SEQ ID NO: 1912563 - DNA, 19 bp, Homo sapiens
tcaaatgatgtgcctgctt

SEQ ID NO: 1912564 - DNA, 16 bp, Homo sapiens
tcaaatgtgttttggt

SEQ ID NO: 1912565 - DNA, 21 bp, Homo sapiens
tcaaattctccctaaagtgtt

SEQ ID NO: 1912566 - DNA, 21 bp, Homo sapiens
tcaacaacattcctcaaaatg

SEQ ID NO: 1912567 - DNA, 15 bp, Homo sapiens
tcaacagcaagtgtg

SEQ ID NO: 1912568 - DNA, 10 bp, Homo sapiens
tcaagaaatg

SEQ ID NO: 1912569 - DNA, 17 bp, Homo sapiens
tcaagagccttaaaaca

SEQ ID NO: 1912570 - DNA, 21 bp, Homo sapiens
tcaagaggacaatctagctct

SEQ ID NO: 1912571 - DNA, 17 bp, Homo sapiens
tcaagatcaaaaaggct

SEQ ID NO: 1912572 - DNA, 24 bp, Homo sapiens
tcaagatcaaaaaggcttataaaa

SEQ ID NO: 1912573 - DNA, 11 bp, Homo sapiens
tcaaggctcag

SEQ ID NO: 1912574 - DNA, 21 bp, Homo sapiens
tcaataaaagcctttgaaaat

SEQ ID NO: 1912575 - DNA, 22 bp, Homo sapiens
tcaataaaagcctttgaaaata

SEQ ID NO: 1912576 - DNA, 12 bp, Homo sapiens
tgcagctgtcac

SEQ ID NO: 1912577 - DNA, 13 bp, Homo sapiens
tgcagctgtcacc

SEQ ID NO: 1912578 - DNA, 21 bp, Homo sapiens
tgcagcttcctcttctaccat

SEQ ID NO: 1912579 - DNA, 14 bp, Homo sapiens
tgcaggcccaccct

SEQ ID NO: 1912580 - DNA, 15 bp, Homo sapiens
tgcaggcccaccctg

SEQ ID NO: 1912581 - DNA, 13 bp, Homo sapiens
tgcagggctgggt

SEQ ID NO: 1912582 - DNA, 14 bp, Homo sapiens
tgcagggctgggtc

SEQ ID NO: 1912583 - DNA, 16 bp, Homo sapiens
tgcagggctgggtcag

SEQ ID NO: 1912584 - DNA, 17 bp, Homo sapiens
tgcagggctgggtcagg

SEQ ID NO: 1912585 - DNA, 20 bp, Homo sapiens
tgcagtgtgaatgctgggcc

SEQ ID NO: 1912586 - DNA, 12 bp, Homo sapiens
tgcagtgttaag

SEQ ID NO: 1912587 - DNA, 23 bp, Homo sapiens
tgcagttcccctggaagcagtgc

SEQ ID NO: 1912588 - DNA, 13 bp, Homo sapiens
tgcatattactgt

SEQ ID NO: 1912589 - DNA, 22 bp, Homo sapiens
tgcatattactgtacatgggac

SEQ ID NO: 1912590 - DNA, 16 bp, Homo sapiens
tgcatccccttccagc

SEQ ID NO: 1912591 - DNA, 22 bp, Homo sapiens
tgcatccccttccagctccctc

SEQ ID NO: 1912592 - DNA, 24 bp, Homo sapiens
tgcatccccttccagctccctccc

SEQ ID NO: 1912593 - DNA, 18 bp, Homo sapiens
tgcatctgggtagctgta

SEQ ID NO: 1912594 - DNA, 12 bp, Homo sapiens
tgcatctttgat

SEQ ID NO: 1912595 - DNA, 14 bp, Homo sapiens
tgcattaaaagaaa

SEQ ID NO: 1912596 - DNA, 17 bp, Homo sapiens
tgcattaaaagaaaata

SEQ ID NO: 1912597 - DNA, 19 bp, Homo sapiens
tgcatttagggagtattct

SEQ ID NO: 1912598 - DNA, 17 bp, Homo sapiens
tgccacaaggaagaaat

SEQ ID NO: 1912599 - DNA, 13 bp, Homo sapiens
tgccaccagcgcc

SEQ ID NO: 1912600 - DNA, 13 bp, Homo sapiens
tgccacctcccct

SEQ ID NO: 1912601 - DNA, 19 bp, Homo sapiens
tgccactttgcaaaggagc

SEQ ID NO: 1912602 - DNA, 23 bp, Homo sapiens
tgccagacgctcattcagcatct

SEQ ID NO: 1912603 - DNA, 16 bp, Homo sapiens
tgccagctgctgagcc

SEQ ID NO: 1912604 - DNA, 20 bp, Homo sapiens
tgccagctgctgagccgcag

SEQ ID NO: 1912605 - DNA, 15 bp, Homo sapiens
tgccaggcacaggca

SEQ ID NO: 1912606 - DNA, 19 bp, Homo sapiens
tgccaggcacaggcagggc

SEQ ID NO: 1912607 - DNA, 20 bp, Homo sapiens
tgccaggcacaggcagggca

SEQ ID NO: 1912608 - DNA, 21 bp, Homo sapiens
tgccaggcccggcatgaggcc

SEQ ID NO: 1912609 - DNA, 23 bp, Homo sapiens
tgccaggcccggcatgaggcccc

SEQ ID NO: 1912610 - DNA, 21 bp, Homo sapiens
tgccagggatggcagtggctg

SEQ ID NO: 1912611 - DNA, 19 bp, Homo sapiens
tgccagttttgtttccttt

SEQ ID NO: 1912612 - DNA, 18 bp, Homo sapiens
tgccatagagtacactgc

SEQ ID NO: 1912613 - DNA, 16 bp, Homo sapiens
tgcccagaatactgat

SEQ ID NO: 1912614 - DNA, 13 bp, Homo sapiens
tgcccagctgtgc

SEQ ID NO: 1912615 - DNA, 20 bp, Homo sapiens
tgcccagctgtgctgggagg

SEQ ID NO: 1912616 - DNA, 20 bp, Homo sapiens
tgcccaggctggagtgcagt

SEQ ID NO: 1912617 - DNA, 19 bp, Homo sapiens
tgcccaggtggctgtggaa

SEQ ID NO: 1912618 - DNA, 13 bp, Homo sapiens
tgccccctcccct

SEQ ID NO: 1912619 - DNA, 14 bp, Homo sapiens
tgccccctcccctc

SEQ ID NO: 1912620 - DNA, 13 bp, Homo sapiens
tgcccctggcaaa

SEQ ID NO: 1912621 - DNA, 15 bp, Homo sapiens
tgcccctggcaaatg

SEQ ID NO: 1912622 - DNA, 15 bp, Homo sapiens
tgccccttgggcctc

SEQ ID NO: 1912623 - DNA, 18 bp, Homo sapiens
tgccccttgggcctccca

SEQ ID NO: 1912624 - DNA, 19 bp, Homo sapiens
tgccccttgggcctcccac

SEQ ID NO: 1912625 - DNA, 22 bp, Homo sapiens
tgccccttgggcctcccactcc

SEQ ID NO: 1912626 - DNA, 18 bp, Homo sapiens
tgccgccgctaggtagag

SEQ ID NO: 1912627 - DNA, 22 bp, Homo sapiens
tgccgccgctaggtagagtctg

SEQ ID NO: 1912628 - DNA, 19 bp, Homo sapiens
tgccggaaagagagctgga

SEQ ID NO: 1912629 - DNA, 15 bp, Homo sapiens
tgcctacaaagctct

SEQ ID NO: 1912630 - DNA, 16 bp, Homo sapiens
tgcctataagccaaaa

SEQ ID NO: 1912631 - DNA, 18 bp, Homo sapiens
tgcctatgaacagaccat

SEQ ID NO: 1912632 - DNA, 14 bp, Homo sapiens
tgcctcctcctgcc

SEQ ID NO: 1912633 - DNA, 19 bp, Homo sapiens
tgcctcctcctgccctccg

SEQ ID NO: 1912634 - DNA, 15 bp, Homo sapiens
tgcctctccgcccct

SEQ ID NO: 1912635 - DNA, 11 bp, Homo sapiens
tgcctctgcca

SEQ ID NO: 1912636 - DNA, 13 bp, Homo sapiens
tgcctctgccaca

SEQ ID NO: 1912637 - DNA, 19 bp, Homo sapiens
tgcctgccttaagtgagga

SEQ ID NO: 1912638 - DNA, 21 bp, Homo sapiens
tgcctgctctcgaggcagcag

SEQ ID NO: 1912639 - DNA, 11 bp, Homo sapiens
tgcctgctgac

SEQ ID NO: 1912640 - DNA, 21 bp, Homo sapiens
tgcctgcttcagcctcccaca

SEQ ID NO: 1912641 - DNA, 19 bp, Homo sapiens
tgctaatcttgtgaaaata

SEQ ID NO: 1912642 - DNA, 23 bp, Homo sapiens
tgctaatcttgtgaaaataattg

SEQ ID NO: 1912643 - DNA, 18 bp, Homo sapiens
tgctacagaaaagaaact

SEQ ID NO: 1912644 - DNA, 17 bp, Homo sapiens
tgctacttgagggccag

SEQ ID NO: 1912645 - DNA, 15 bp, Homo sapiens
tgctatcagttttat

SEQ ID NO: 1912646 - DNA, 18 bp, Homo sapiens
tgctattacgaagttcaa

SEQ ID NO: 1912647 - DNA, 19 bp, Homo sapiens
tgctccattcatacacaac

SEQ ID NO: 1912648 - DNA, 22 bp, Homo sapiens
tgctccattcatacacaacgta

SEQ ID NO: 1912649 - DNA, 13 bp, Homo sapiens
tgctcctgagccc

SEQ ID NO: 1912650 - DNA, 14 bp, Homo sapiens
tgctcctgagcccc

SEQ ID NO: 1912651 - DNA, 18 bp, Homo sapiens
tgctctcaaacccctgac

SEQ ID NO: 1912652 - DNA, 22 bp, Homo sapiens
tgctctcaccttggttcctggg

SEQ ID NO: 1912653 - DNA, 19 bp, Homo sapiens
tgctgaaagatatgtatat

SEQ ID NO: 1912654 - DNA, 22 bp, Homo sapiens
tgctgaccataacagtgccagc

SEQ ID NO: 1912655 - DNA, 17 bp, Homo sapiens
tgctgacccaacagcct

SEQ ID NO: 1912656 - DNA, 15 bp, Homo sapiens
tgctgacccatgggc

SEQ ID NO: 1912657 - DNA, 16 bp, Homo sapiens
tgctgacccatgggca

SEQ ID NO: 1912658 - DNA, 18 bp, Homo sapiens
tgctgacccatgggcagg

SEQ ID NO: 1912659 - DNA, 19 bp, Homo sapiens
tgctgagtctgttctggta

SEQ ID NO: 1912660 - DNA, 13 bp, Homo sapiens
tgctgattttgac

SEQ ID NO: 1912661 - DNA, 20 bp, Homo sapiens
tgctgattttgaccttgtat

SEQ ID NO: 1912662 - DNA, 24 bp, Homo sapiens
tgctgccaggcccggcatgaggcc

SEQ ID NO: 1912663 - DNA, 22 bp, Homo sapiens
tgctgggaggtcccagggccct

SEQ ID NO: 1912664 - DNA, 16 bp, Homo sapiens
tgctggtaaaatgaag

SEQ ID NO: 1912665 - DNA, 22 bp, Homo sapiens
tgctggttccatgcctgctctc

SEQ ID NO: 1912666 - DNA, 23 bp, Homo sapiens
tgctgtcagaatattctttttat

SEQ ID NO: 1912667 - DNA, 15 bp, Homo sapiens
tgctgtctggcacag

SEQ ID NO: 1912668 - DNA, 13 bp, Homo sapiens
tgctgtgaaaaaa

SEQ ID NO: 1912669 - DNA, 22 bp, Homo sapiens
tgctgtgaacatgcctcctcct

SEQ ID NO: 1912670 - DNA, 17 bp, Homo sapiens
tgctgtgaagctggaac

SEQ ID NO: 1912671 - DNA, 23 bp, Homo sapiens
tgctgtgggaaggcaatttctct

SEQ ID NO: 1912672 - DNA, 18 bp, Homo sapiens
tgctgttacagttttctt

SEQ ID NO: 1912673 - DNA, 14 bp, Homo sapiens
tgcttataaacatt

SEQ ID NO: 1912674 - DNA, 15 bp, Homo sapiens
tgcttataaacattt

SEQ ID NO: 1912675 - DNA, 19 bp, Homo sapiens
tgcttatcagtgtgcaata

SEQ ID NO: 1912676 - DNA, 18 bp, Homo sapiens
tgcttcctataattttga

SEQ ID NO: 1912677 - DNA, 19 bp, Homo sapiens
tgcttcctataattttgat

SEQ ID NO: 1912678 - DNA, 12 bp, Homo sapiens
tgcttctgccac

SEQ ID NO: 1912679 - DNA, 13 bp, Homo sapiens
tgcttctgccacc

SEQ ID NO: 1912680 - DNA, 16 bp, Homo sapiens
tgcttgacaaaggagc

SEQ ID NO: 1912681 - DNA, 22 bp, Homo sapiens
tgcttgacaaaggagcattgca

SEQ ID NO: 1912682 - DNA, 14 bp, Homo sapiens
tgcttggcccaggg

SEQ ID NO: 1912683 - DNA, 14 bp, Homo sapiens
tgcttgttgacaga

SEQ ID NO: 1912684 - DNA, 12 bp, Homo sapiens
tgctttctgaat

SEQ ID NO: 1912685 - DNA, 15 bp, Homo sapiens
tgctttctttcgttt

SEQ ID NO: 1912686 - DNA, 14 bp, Homo sapiens
tgctttggcaatgc

SEQ ID NO: 1912687 - DNA, 14 bp, Homo sapiens
tgctttgtgaacaa

SEQ ID NO: 1912688 - DNA, 18 bp, Homo sapiens
tggaaaaataaaggaaat

SEQ ID NO: 1912689 - DNA, 14 bp, Homo sapiens
tggaaaaggcatat

SEQ ID NO: 1912690 - DNA, 18 bp, Homo sapiens
tggaaattaagaagaaac

SEQ ID NO: 1912691 - DNA, 15 bp, Homo sapiens
tggaaattgaaataa

SEQ ID NO: 1912692 - DNA, 23 bp, Homo sapiens
tggaactcttgacagctataatt

SEQ ID NO: 1912693 - DNA, 13 bp, Homo sapiens
tggaactgctgct

SEQ ID NO: 1912694 - DNA, 18 bp, Homo sapiens
tggaactgctgctgaccc

SEQ ID NO: 1912695 - DNA, 21 bp, Homo sapiens
tggaagcacaccaatcttact

SEQ ID NO: 1912696 - DNA, 22 bp, Homo sapiens
tggaagcacaccaatcttactt

SEQ ID NO: 1912697 - DNA, 16 bp, Homo sapiens
tggaagcagtgcccag

SEQ ID NO: 1912698 - DNA, 17 bp, Homo sapiens
tggaagcagtgcccagg

SEQ ID NO: 1912699 - DNA, 12 bp, Homo sapiens
tggaatattaaa

SEQ ID NO: 1912700 - DNA, 13 bp, Homo sapiens
tggaatctgctcc

SEQ ID NO: 1912701 - DNA, 15 bp, Homo sapiens
tggaatgcactcaga

SEQ ID NO: 1912702 - DNA, 13 bp, Homo sapiens
tggacaagaaagt

SEQ ID NO: 1912703 - DNA, 22 bp, Homo sapiens
tggacagacagacaccacagcc

SEQ ID NO: 1912704 - DNA, 23 bp, Homo sapiens
tggacagacagacaccacagcct

SEQ ID NO: 1912705 - DNA, 13 bp, Homo sapiens
tggaccccagcct

SEQ ID NO: 1912706 - DNA, 15 bp, Homo sapiens
tggactctctgacaa

SEQ ID NO: 1912707 - DNA, 16 bp, Homo sapiens
tggactctctgacaaa

SEQ ID NO: 1912708 - DNA, 17 bp, Homo sapiens
tggagaaaaatatctgt

SEQ ID NO: 1912709 - DNA, 16 bp, Homo sapiens
tggagaatcacaggct

SEQ ID NO: 1912710 - DNA, 17 bp, Homo sapiens
tggagaatcacaggctg

SEQ ID NO: 1912711 - DNA, 20 bp, Homo sapiens
tggagactgctcctgagccc

SEQ ID NO: 1912712 - DNA, 16 bp, Homo sapiens
tggagaggagccctgc

SEQ ID NO: 1912713 - DNA, 22 bp, Homo sapiens
tggagcctgcggggcagcaggg

SEQ ID NO: 1912714 - DNA, 15 bp, Homo sapiens
tggaggaagaactga

SEQ ID NO: 1912715 - DNA, 14 bp, Homo sapiens
tggaggctcaaatt

SEQ ID NO: 1912716 - DNA, 14 bp, Homo sapiens
tggagtctctctct

SEQ ID NO: 1912717 - DNA, 18 bp, Homo sapiens
tggatatatgtttttgaa

SEQ ID NO: 1912718 - DNA, 16 bp, Homo sapiens
tggattgtagaacttg

SEQ ID NO: 1912719 - DNA, 21 bp, Homo sapiens
tggattgtagaacttgttgct

SEQ ID NO: 1912720 - DNA, 17 bp, Homo sapiens
tggcaaatttgtgaact

SEQ ID NO: 1912721 - DNA, 21 bp, Homo sapiens
tggcaataaattttgaaaagt

SEQ ID NO: 1912722 - DNA, 21 bp, Homo sapiens
tggcaatggtagtttctgtgg

SEQ ID NO: 1912723 - DNA, 15 bp, Homo sapiens
tggcaccagcaggca

SEQ ID NO: 1912724 - DNA, 13 bp, Homo sapiens
tggcacctgggtt

SEQ ID NO: 1912725 - DNA, 14 bp, Homo sapiens
tggcagcaggaggg

SEQ ID NO: 1912726 - DNA, 20 bp, Homo sapiens
tggcagcaggagggactctg

SEQ ID NO: 1912727 - DNA, 21 bp, Homo sapiens
tggcagcaggagggactctgt

SEQ ID NO: 1912728 - DNA, 17 bp, Homo sapiens
tggcagggcacagggcc

SEQ ID NO: 1912729 - DNA, 20 bp, Homo sapiens
tggcaggggatccagctcaa

SEQ ID NO: 1912730 - DNA, 14 bp, Homo sapiens
tggcaggtgagcaa

SEQ ID NO: 1912731 - DNA, 15 bp, Homo sapiens
tggcagtggctgtga

SEQ ID NO: 1912732 - DNA, 17 bp, Homo sapiens
tggcagtggctgtgaag

SEQ ID NO: 1912733 - DNA, 18 bp, Homo sapiens
tggcagtggctgtgaagg

SEQ ID NO: 1912734 - DNA, 17 bp, Homo sapiens
tggccaggctgctctca

SEQ ID NO: 1912735 - DNA, 15 bp, Homo sapiens
tggcccactgtgcag

SEQ ID NO: 1912736 - DNA, 19 bp, Homo sapiens
tggcccatcaggggcagga

SEQ ID NO: 1912737 - DNA, 21 bp, Homo sapiens
tggcccatcaggggcaggaac

SEQ ID NO: 1912738 - DNA, 18 bp, Homo sapiens
tggcccatgtatggccag

SEQ ID NO: 1912739 - DNA, 21 bp, Homo sapiens
tggcccatgtatggccaggaa

SEQ ID NO: 1912740 - DNA, 13 bp, Homo sapiens
tggccccacctgg

SEQ ID NO: 1912741 - DNA, 17 bp, Homo sapiens
tggccccacctggccct

SEQ ID NO: 1912742 - DNA, 23 bp, Homo sapiens
tggccccacctggccctctctga

SEQ ID NO: 1912743 - DNA, 22 bp, Homo sapiens
tggccccttctatgcccagctg

SEQ ID NO: 1912744 - DNA, 15 bp, Homo sapiens
tggcctcagggctct

SEQ ID NO: 1912745 - DNA, 14 bp, Homo sapiens
tggctccctcactc

SEQ ID NO: 1912746 - DNA, 16 bp, Homo sapiens
tggctccctcactctc

SEQ ID NO: 1912747 - DNA, 17 bp, Homo sapiens
tggctccctcactctca

SEQ ID NO: 1912748 - DNA, 15 bp, Homo sapiens
tggctctacacatat

SEQ ID NO: 1912749 - DNA, 21 bp, Homo sapiens
tggctgtggaataggaacgct

SEQ ID NO: 1912750 - DNA, 23 bp, Homo sapiens
tggcttaactggactgaattcaa

SEQ ID NO: 1912751 - DNA, 16 bp, Homo sapiens
tggcttcagaaatgga

SEQ ID NO: 1912752 - DNA, 23 bp, Homo sapiens
tggcttcccaaatgtgtgcccag

SEQ ID NO: 1912753 - DNA, 16 bp, Homo sapiens
tggcttcctctgctgc

SEQ ID NO: 1912754 - DNA, 19 bp, Homo sapiens
tggcttctcccaacactct

SEQ ID NO: 1912755 - DNA, 16 bp, Homo sapiens
tggcttggccctggca

SEQ ID NO: 1912756 - DNA, 18 bp, Homo sapiens
tggcttggtgagtctgtg

SEQ ID NO: 1912757 - DNA, 20 bp, Homo sapiens
tgggaccacaggtgcccgcc

SEQ ID NO: 1912758 - DNA, 14 bp, Homo sapiens
tgggacccagtggc

SEQ ID NO: 1912759 - DNA, 19 bp, Homo sapiens
tgggacccagtggcagggc

SEQ ID NO: 1912760 - DNA, 22 bp, Homo sapiens
tgggacccagtggcagggcaca

SEQ ID NO: 1912761 - DNA, 19 bp, Homo sapiens
tgggactatgcttttctca

SEQ ID NO: 1912762 - DNA, 13 bp, Homo sapiens
tgggactgctgtg

SEQ ID NO: 1912763 - DNA, 21 bp, Homo sapiens
tgggactgctgtgaacatgcc

SEQ ID NO: 1912764 - DNA, 16 bp, Homo sapiens
tgggatagaggaatca

SEQ ID NO: 1912765 - DNA, 20 bp, Homo sapiens
tgggatctcgccaacccctc

SEQ ID NO: 1912766 - DNA, 17 bp, Homo sapiens
tgggatgattgaagaaa

SEQ ID NO: 1912767 - DNA, 23 bp, Homo sapiens
tgggatgattgaagaaacagcta

SEQ ID NO: 1912768 - DNA, 14 bp, Homo sapiens
tgggcctcccactc

SEQ ID NO: 1912769 - DNA, 15 bp, Homo sapiens
tgggcctcccactcc

SEQ ID NO: 1912770 - DNA, 16 bp, Homo sapiens
tgggcctcccactccc

SEQ ID NO: 1912771 - DNA, 20 bp, Homo sapiens
tgggcctcccactcccatgg

SEQ ID NO: 1912772 - DNA, 17 bp, Homo sapiens
tgggctggcgggccctg

SEQ ID NO: 1912773 - DNA, 18 bp, Homo sapiens
tgggctggcgggccctgg

SEQ ID NO: 1912774 - DNA, 23 bp, Homo sapiens
tgggctggcgggccctggagctc

SEQ ID NO: 1912775 - DNA, 14 bp, Homo sapiens
tgggctgggcactg

SEQ ID NO: 1912776 - DNA, 16 bp, Homo sapiens
tgggcttctgtgccca

SEQ ID NO: 1912777 - DNA, 17 bp, Homo sapiens
tggggaccacagaggct

SEQ ID NO: 1912778 - DNA, 15 bp, Homo sapiens
tggggctcccgcctc

SEQ ID NO: 1912779 - DNA, 16 bp, Homo sapiens
tggggctcccgcctcc

SEQ ID NO: 1912780 - DNA, 15 bp, Homo sapiens
tggggctggcaccag

SEQ ID NO: 1912781 - DNA, 18 bp, Homo sapiens
tggggctgggggatgggc

SEQ ID NO: 1912782 - DNA, 22 bp, Homo sapiens
tggggctgggggatgggcctga

SEQ ID NO: 1912783 - DNA, 19 bp, Homo sapiens
tgggggactccttccttga

SEQ ID NO: 1912784 - DNA, 18 bp, Homo sapiens
tgggggccccgtctcagg

SEQ ID NO: 1912785 - DNA, 18 bp, Homo sapiens
tgggggctcagcaaggcc

SEQ ID NO: 1912786 - DNA, 13 bp, Homo sapiens
tgggggctgcagg

SEQ ID NO: 1912787 - DNA, 16 bp, Homo sapiens
tgggggctgcagggct

SEQ ID NO: 1912788 - DNA, 17 bp, Homo sapiens
tgggggctgcagggctg

SEQ ID NO: 1912789 - DNA, 19 bp, Homo sapiens
tgggtactgtctcggcaga

SEQ ID NO: 1912790 - DNA, 16 bp, Homo sapiens
tgggtactttctgaaa

SEQ ID NO: 1912791 - DNA, 17 bp, Homo sapiens
tgggtactttctgaaaa

SEQ ID NO: 1912792 - DNA, 18 bp, Homo sapiens
tgggtactttctgaaaat

SEQ ID NO: 1912793 - DNA, 21 bp, Homo sapiens
tgggtcagggtgtgaggccac

SEQ ID NO: 1912794 - DNA, 23 bp, Homo sapiens
tgggtcagggtgtgaggccacac

SEQ ID NO: 1912795 - DNA, 14 bp, Homo sapiens
tgggttagactgcc

SEQ ID NO: 1912796 - DNA, 16 bp, Homo sapiens
tgggttagactgccag

SEQ ID NO: 1912797 - DNA, 19 bp, Homo sapiens
tgggttagactgccagctc

SEQ ID NO: 1912798 - DNA, 13 bp, Homo sapiens
tgggttcaggccc

SEQ ID NO: 1912799 - DNA, 17 bp, Homo sapiens
tgggtttggcaggcact

SEQ ID NO: 1912800 - DNA, 15 bp, Homo sapiens
tggtagtttctgtgg

SEQ ID NO: 1912801 - DNA, 15 bp, Homo sapiens
tggtatcaagaaagt

SEQ ID NO: 1912802 - DNA, 15 bp, Homo sapiens
tggtccatctctgaa

SEQ ID NO: 1912803 - DNA, 22 bp, Homo sapiens
tggtccatctctgaaaacaaga

SEQ ID NO: 1912804 - DNA, 20 bp, Homo sapiens
tggtctgggtttggcaggca

SEQ ID NO: 1912805 - DNA, 23 bp, Homo sapiens
tggtgccaccgtccctctgcaga

SEQ ID NO: 1912806 - DNA, 20 bp, Homo sapiens
tggtggttgggacccagtgg

SEQ ID NO: 1912807 - DNA, 23 bp, Homo sapiens
tggtggttgggacccagtggcag

SEQ ID NO: 1912808 - DNA, 18 bp, Homo sapiens
tggtgtaaggtactttca

SEQ ID NO: 1912809 - DNA, 13 bp, Homo sapiens
tggttagaaaaca

SEQ ID NO: 1912810 - DNA, 17 bp, Homo sapiens
tggttatgaatactttg

SEQ ID NO: 1912811 - DNA, 19 bp, Homo sapiens
tggttccatgcctgctctc

SEQ ID NO: 1912812 - DNA, 12 bp, Homo sapiens
tggttgaataaa

SEQ ID NO: 1912813 - DNA, 18 bp, Homo sapiens
tggttgaataaactagat

SEQ ID NO: 1912814 - DNA, 20 bp, Homo sapiens
tggtttgggcaagcagactg

SEQ ID NO: 1912815 - DNA, 12 bp, Homo sapiens
tggttttatgat

SEQ ID NO: 1912816 - DNA, 19 bp, Homo sapiens
tgtaaaagcattttgtaat

SEQ ID NO: 1912817 - DNA, 19 bp, Homo sapiens
tgtaaagtaggaaaaataa

SEQ ID NO: 1912818 - DNA, 22 bp, Homo sapiens
tgtaaataattcttttttatta

SEQ ID NO: 1912819 - DNA, 14 bp, Homo sapiens
tgtaaatgactttc

SEQ ID NO: 1912820 - DNA, 15 bp, Homo sapiens
tgtaaatgtattcat

SEQ ID NO: 1912821 - DNA, 14 bp, Homo sapiens
tgtaaattctgatt

SEQ ID NO: 1912822 - DNA, 19 bp, Homo sapiens
tgtaaattctgatttcttt

SEQ ID NO: 1912823 - DNA, 14 bp, Homo sapiens
tgtaactaaaataa

SEQ ID NO: 1912824 - DNA, 18 bp, Homo sapiens
tgtaagaaatactgtaca

SEQ ID NO: 1912825 - DNA, 14 bp, Homo sapiens
tgtaaggcatgaag

SEQ ID NO: 1912826 - DNA, 22 bp, Homo sapiens
tgtaaggttttttttgtacgca

SEQ ID NO: 1912827 - DNA, 12 bp, Homo sapiens
tgtaatccagca

SEQ ID NO: 1912828 - DNA, 15 bp, Homo sapiens
tgtaattttgtgtaa

SEQ ID NO: 1912829 - DNA, 16 bp, Homo sapiens
tgtaattttgtgtaag

SEQ ID NO: 1912830 - DNA, 19 bp, Homo sapiens
tgtacatatctttgagttc

SEQ ID NO: 1912831 - DNA, 19 bp, Homo sapiens
tgtacatgggactatgctt

SEQ ID NO: 1912832 - DNA, 20 bp, Homo sapiens
tgtacatgggactatgcttt

SEQ ID NO: 1912833 - DNA, 23 bp, Homo sapiens
tgtacgacgtcagatgtttaaaa

SEQ ID NO: 1912834 - DNA, 18 bp, Homo sapiens
tgtactttgttaaaaaca

SEQ ID NO: 1912835 - DNA, 14 bp, Homo sapiens
tgtagacattttga

SEQ ID NO: 1912836 - DNA, 16 bp, Homo sapiens
tgtagatttatttcat

SEQ ID NO: 1912837 - DNA, 12 bp, Homo sapiens
tgtagatttgat

SEQ ID NO: 1912838 - DNA, 16 bp, Homo sapiens
tgtagatttgattttt

SEQ ID NO: 1912839 - DNA, 15 bp, Homo sapiens
tgtagttctttaaac

SEQ ID NO: 1912840 - DNA, 14 bp, Homo sapiens
tgtataaggacagt

SEQ ID NO: 1912841 - DNA, 20 bp, Homo sapiens
tgtataattcaaagcaccaa

SEQ ID NO: 1912842 - DNA, 18 bp, Homo sapiens
tgtatagctcttttccta

SEQ ID NO: 1912843 - DNA, 21 bp, Homo sapiens
tgtataggtatgatctgtgta

SEQ ID NO: 1912844 - DNA, 14 bp, Homo sapiens
tgtatagttatgta

SEQ ID NO: 1912845 - DNA, 16 bp, Homo sapiens
tgtatagttatgtaaa

SEQ ID NO: 1912846 - DNA, 14 bp, Homo sapiens
tgtatatgctgcat

SEQ ID NO: 1912847 - DNA, 18 bp, Homo sapiens
tgtatattctattttaca

SEQ ID NO: 1912848 - DNA, 17 bp, Homo sapiens
tgtatatttgatttatt

SEQ ID NO: 1912849 - DNA, 19 bp, Homo sapiens
tgtatatttgatttattaa

SEQ ID NO: 1912850 - DNA, 13 bp, Homo sapiens
tgtatcaaactgc

SEQ ID NO: 1912851 - DNA, 23 bp, Homo sapiens
tgtatcaaatacatttaaaacat

SEQ ID NO: 1912852 - DNA, 17 bp, Homo sapiens
tgtatctttataattga

SEQ ID NO: 1912853 - DNA, 13 bp, Homo sapiens
tgtatgaaaacat

SEQ ID NO: 1912854 - DNA, 22 bp, Homo sapiens
tgtatggtccatagcactgtat

SEQ ID NO: 1912855 - DNA, 12 bp, Homo sapiens
tgtatgtataat

SEQ ID NO: 1912856 - DNA, 13 bp, Homo sapiens
tgtatgtataatt

SEQ ID NO: 1912857 - DNA, 20 bp, Homo sapiens
tgtatgtgtttagaattgaa

SEQ ID NO: 1912858 - DNA, 13 bp, Homo sapiens
tgtattctgtaaa

SEQ ID NO: 1912859 - DNA, 20 bp, Homo sapiens
tgtattgaagttaactgttc

SEQ ID NO: 1912860 - DNA, 12 bp, Homo sapiens
tgtattgtaatg

SEQ ID NO: 1912861 - DNA, 19 bp, Homo sapiens
tgtattgtcctattagtgt

SEQ ID NO: 1912862 - DNA, 17 bp, Homo sapiens
tgtattttttaatgcta

SEQ ID NO: 1912863 - DNA, 19 bp, Homo sapiens
tgtattttttaatgctaat

SEQ ID NO: 1912864 - DNA, 14 bp, Homo sapiens
tgtcaccactacag

SEQ ID NO: 1912865 - DNA, 18 bp, Homo sapiens
tgtcacttgcattccact

SEQ ID NO: 1912866 - DNA, 15 bp, Homo sapiens
tgtcagaatattctt

SEQ ID NO: 1912867 - DNA, 20 bp, Homo sapiens
tgtcagcagttgctggtaaa

SEQ ID NO: 1912868 - DNA, 16 bp, Homo sapiens
tgtcatcaccatggaa

SEQ ID NO: 1912869 - DNA, 23 bp, Homo sapiens
tgtcccaggcagcgccactgtcc

SEQ ID NO: 1912870 - DNA, 12 bp, Homo sapiens
tgtccgctgtct

SEQ ID NO: 1912871 - DNA, 14 bp, Homo sapiens
tgtccgctgtctcc

SEQ ID NO: 1912872 - DNA, 19 bp, Homo sapiens
tgtccttgaagcttgtatc

SEQ ID NO: 1912873 - DNA, 14 bp, Homo sapiens
tgtctagattttga

SEQ ID NO: 1912874 - DNA, 17 bp, Homo sapiens
tgtctagcacatgttga

SEQ ID NO: 1912875 - DNA, 12 bp, Homo sapiens
tgtctccctcct

SEQ ID NO: 1912876 - DNA, 20 bp, Homo sapiens
tgtctcctgtttcagaccag

SEQ ID NO: 1912877 - DNA, 15 bp, Homo sapiens
tgtctcttctatgta

SEQ ID NO: 1912878 - DNA, 17 bp, Homo sapiens
tgtctcttttttaagtt

SEQ ID NO: 1912879 - DNA, 18 bp, Homo sapiens
tgtctgccacattaacta

SEQ ID NO: 1912880 - DNA, 12 bp, Homo sapiens
tgtctggccagg

SEQ ID NO: 1912881 - DNA, 18 bp, Homo sapiens
tgtctgttggcaaatttg

SEQ ID NO: 1912882 - DNA, 16 bp, Homo sapiens
tgtcttaatggatgaa

SEQ ID NO: 1912883 - DNA, 18 bp, Homo sapiens
tgtcttaatggatgaaat

SEQ ID NO: 1912884 - DNA, 21 bp, Homo sapiens
tgtcttgcgggtctgtcaggg

SEQ ID NO: 1912885 - DNA, 21 bp, Homo sapiens
tgtgaagctggaactgcggga

SEQ ID NO: 1912886 - DNA, 19 bp, Homo sapiens
tgtgaatgctgggcccctg

SEQ ID NO: 1912887 - DNA, 19 bp, Homo sapiens
tgtgacatcacagggcctc

SEQ ID NO: 1912888 - DNA, 21 bp, Homo sapiens
tgtgacatcacagggcctcag

SEQ ID NO: 1912889 - DNA, 21 bp, Homo sapiens
tgtgacgtttttccagttcac

SEQ ID NO: 1912890 - DNA, 15 bp, Homo sapiens
tgtgagcagcaccca

SEQ ID NO: 1912891 - DNA, 21 bp, Homo sapiens
tgtgatgaagctgaggctgct

SEQ ID NO: 1912892 - DNA, 16 bp, Homo sapiens
tgtgattcaatgcctc

SEQ ID NO: 1912893 - DNA, 22 bp, Homo sapiens
tgtgattgcctcaataaagctc

SEQ ID NO: 1912894 - DNA, 12 bp, Homo sapiens
tgtgcagggcac

SEQ ID NO: 1912895 - DNA, 14 bp, Homo sapiens
tgtgcagggcacag

SEQ ID NO: 1912896 - DNA, 23 bp, Homo sapiens
tgtgcctgcttcagcctcccaca

SEQ ID NO: 1912897 - DNA, 21 bp, Homo sapiens
tgtgcgtggggctcccgcctc

SEQ ID NO: 1912898 - DNA, 14 bp, Homo sapiens
tgtgctcagaatta

SEQ ID NO: 1912899 - DNA, 21 bp, Homo sapiens
tgtgctcagaattattaatta

SEQ ID NO: 1912900 - DNA, 12 bp, Homo sapiens
tgtgctgccagt

SEQ ID NO: 1912901 - DNA, 21 bp, Homo sapiens
tgtggaaaaataaaggaaatt

SEQ ID NO: 1912902 - DNA, 13 bp, Homo sapiens
tgtggagactgct

SEQ ID NO: 1912903 - DNA, 18 bp, Homo sapiens
tgtggagtcatttctgat

SEQ ID NO: 1912904 - DNA, 11 bp, Homo sapiens
tgtggcagcag

SEQ ID NO: 1912905 - DNA, 18 bp, Homo sapiens
tgtggcttggtgagtctg

SEQ ID NO: 1912906 - DNA, 13 bp, Homo sapiens
tgtggtcagagag

SEQ ID NO: 1912907 - DNA, 19 bp, Homo sapiens
tgtggtccatctctgaaaa

SEQ ID NO: 1912908 - DNA, 15 bp, Homo sapiens
tgtgtaaattattga

SEQ ID NO: 1912909 - DNA, 17 bp, Homo sapiens
tgtgtaagaaatacaga

SEQ ID NO: 1912910 - DNA, 21 bp, Homo sapiens
tgtgtatatttgatttattaa

SEQ ID NO: 1912911 - DNA, 15 bp, Homo sapiens
tgtgtccaccgttgt

SEQ ID NO: 1912912 - DNA, 14 bp, Homo sapiens
tgtgtctatttctg

SEQ ID NO: 1912913 - DNA, 17 bp, Homo sapiens
tgtgtctatttctgaaa

SEQ ID NO: 1912914 - DNA, 23 bp, Homo sapiens
tgtgtgacatcacagggcctcag

SEQ ID NO: 1912915 - DNA, 14 bp, Homo sapiens
tgtgtgttacaatg

SEQ ID NO: 1912916 - DNA, 18 bp, Homo sapiens
tgtgttaatttaagtttt

SEQ ID NO: 1912917 - DNA, 22 bp, Homo sapiens
tgtgtttagaattgaaggtttt

SEQ ID NO: 1912918 - DNA, 13 bp, Homo sapiens
tgtgttttcataa

SEQ ID NO: 1912919 - DNA, 20 bp, Homo sapiens
tgttaagataattgtacttt

SEQ ID NO: 1912920 - DNA, 17 bp, Homo sapiens
tgttactcttgggacat

SEQ ID NO: 1912921 - DNA, 17 bp, Homo sapiens
tgttacttgctttgagt

SEQ ID NO: 1912922 - DNA, 14 bp, Homo sapiens
tgttagttttcctt

SEQ ID NO: 1912923 - DNA, 13 bp, Homo sapiens
tgttatgagccag

SEQ ID NO: 1912924 - DNA, 18 bp, Homo sapiens
tgttatgtgagaacatta

SEQ ID NO: 1912925 - DNA, 16 bp, Homo sapiens
tgttattcaacagcaa

SEQ ID NO: 1912926 - DNA, 20 bp, Homo sapiens
tgttcattgcacaatatatt

SEQ ID NO: 1912927 - DNA, 15 bp, Homo sapiens
tgttctggtggcccc

SEQ ID NO: 1912928 - DNA, 23 bp, Homo sapiens
tgttcttggcaataaattttgaa

SEQ ID NO: 1912929 - DNA, 20 bp, Homo sapiens
tgttgacatcactggcatgg

SEQ ID NO: 1912930 - DNA, 19 bp, Homo sapiens
tgttgactctagtactgtg

SEQ ID NO: 1912931 - DNA, 15 bp, Homo sapiens
tgttgaggcgagcag

SEQ ID NO: 1912932 - DNA, 21 bp, Homo sapiens
tgttgagggcatttggcttcc

SEQ ID NO: 1912933 - DNA, 21 bp, Homo sapiens
tgttgccaaaatggtggcctg

SEQ ID NO: 1912934 - DNA, 20 bp, Homo sapiens
tgttgcccaggctggagtgc

SEQ ID NO: 1912935 - DNA, 17 bp, Homo sapiens
tgttgcctataagccaa

SEQ ID NO: 1912936 - DNA, 18 bp, Homo sapiens
tgttgcctataagccaaa

SEQ ID NO: 1912937 - DNA, 14 bp, Homo sapiens
tgttggactctgag

SEQ ID NO: 1912938 - DNA, 16 bp, Homo sapiens
tgttggactctgagct

SEQ ID NO: 1912939 - DNA, 18 bp, Homo sapiens
tgttggactctgagctca

SEQ ID NO: 1912940 - DNA, 14 bp, Homo sapiens
tgttgtataaattt

SEQ ID NO: 1912941 - DNA, 19 bp, Homo sapiens
tgttgttcttggcaataaa

SEQ ID NO: 1912942 - DNA, 12 bp, Homo sapiens
tgtttaaaacac

SEQ ID NO: 1912943 - DNA, 15 bp, Homo sapiens
tgtttagtctttata

SEQ ID NO: 1912944 - DNA, 23 bp, Homo sapiens
tgtttcaattagaaaaggaaata

SEQ ID NO: 1912945 - DNA, 18 bp, Homo sapiens
tgtttgaaaatagtttat

SEQ ID NO: 1912946 - DNA, 21 bp, Homo sapiens
tgtttgatgcattaaaagaaa

SEQ ID NO: 1912947 - DNA, 12 bp, Homo sapiens
tgtttgcagtgt

SEQ ID NO: 1912948 - DNA, 15 bp, Homo sapiens
tgtttttagttctga

SEQ ID NO: 1912949 - DNA, 15 bp, Homo sapiens
tgtttttctgcttta

SEQ ID NO: 1912950 - DNA, 19 bp, Homo sapiens
tgtttttctgctttagact

SEQ ID NO: 1912951 - DNA, 17 bp, Homo sapiens
tgtttttcttctgaaat

SEQ ID NO: 1912952 - DNA, 16 bp, Homo sapiens
tgtttttgaaggcaga

SEQ ID NO: 1912953 - DNA, 18 bp, Homo sapiens
tgtttttgaaggcagaaa

SEQ ID NO: 1912954 - DNA, 20 bp, Homo sapiens
tgtttttgaaggcagaaagc

SEQ ID NO: 1912955 - DNA, 12 bp, Homo sapiens
tgtttttgtata

SEQ ID NO: 1912956 - DNA, 13 bp, Homo sapiens
tgtttttgtatat

SEQ ID NO: 1912957 - DNA, 18 bp, Homo sapiens
tgttttttgtttttctgc

SEQ ID NO: 1912958 - DNA, 16 bp, Homo sapiens
ttaaaaatctgccacc

SEQ ID NO: 1912959 - DNA, 19 bp, Homo sapiens
ttaaaacacgttttaagga

SEQ ID NO: 1912960 - DNA, 22 bp, Homo sapiens
ttaaaacacgttttaaggactg

SEQ ID NO: 1912961 - DNA, 16 bp, Homo sapiens
ttaaaacatcattcct

SEQ ID NO: 1912962 - DNA, 18 bp, Homo sapiens
ttaaaacatcattccttt

SEQ ID NO: 1912963 - DNA, 19 bp, Homo sapiens
ttaaaactgctcatttcat

SEQ ID NO: 1912964 - DNA, 20 bp, Homo sapiens
ttaaaactttgtagacattt

SEQ ID NO: 1912965 - DNA, 21 bp, Homo sapiens
ttaaactttagtgctacagaa

SEQ ID NO: 1912966 - DNA, 16 bp, Homo sapiens
ttaaagaaaaaaatgt

SEQ ID NO: 1912967 - DNA, 20 bp, Homo sapiens
ttaaagaaatatgtattctg

SEQ ID NO: 1912968 - DNA, 14 bp, Homo sapiens
ttaaagacaaagca

SEQ ID NO: 1912969 - DNA, 16 bp, Homo sapiens
ttaaagtgtggaaagc

SEQ ID NO: 1912970 - DNA, 22 bp, Homo sapiens
ttaaatgaacacagctctttaa

SEQ ID NO: 1912971 - DNA, 23 bp, Homo sapiens
ttaaatttttttgtatgaaaaca

SEQ ID NO: 1912972 - DNA, 11 bp, Homo sapiens
ttaacaagtca

SEQ ID NO: 1912973 - DNA, 22 bp, Homo sapiens
ttaacagggtctctagtgctgt

SEQ ID NO: 1912974 - DNA, 24 bp, Homo sapiens
ttaactgcttcctataattttgat

SEQ ID NO: 1912975 - DNA, 16 bp, Homo sapiens
ttaactgttcagtatt

SEQ ID NO: 1912976 - DNA, 17 bp, Homo sapiens
ttaacttaataatcaag

SEQ ID NO: 1912977 - DNA, 20 bp, Homo sapiens
ttaagaaagaaatactgtat

SEQ ID NO: 1912978 - DNA, 13 bp, Homo sapiens
ttaagaaattcct

SEQ ID NO: 1912979 - DNA, 20 bp, Homo sapiens
ttaagataattgtactttga

SEQ ID NO: 1912980 - DNA, 23 bp, Homo sapiens
ttaagataattgtactttgaaaa

SEQ ID NO: 1912981 - DNA, 22 bp, Homo sapiens
ttaagatcccagtgtgaagtat

SEQ ID NO: 1912982 - DNA, 16 bp, Homo sapiens
ttaaggactgactgag

SEQ ID NO: 1912983 - DNA, 17 bp, Homo sapiens
ttaagtgaaaatatagc

SEQ ID NO: 1912984 - DNA, 19 bp, Homo sapiens
ttaagtgaggaaatcaaag

SEQ ID NO: 1912985 - DNA, 21 bp, Homo sapiens
ttctgactttgaatttatata

SEQ ID NO: 1912986 - DNA, 17 bp, Homo sapiens
ttctgatagtagtcttt

SEQ ID NO: 1912987 - DNA, 15 bp, Homo sapiens
ttctgatcactgaaa

SEQ ID NO: 1912988 - DNA, 14 bp, Homo sapiens
ttctgatcttcact

SEQ ID NO: 1912989 - DNA, 20 bp, Homo sapiens
ttctgatttcttttcaccat

SEQ ID NO: 1912990 - DNA, 13 bp, Homo sapiens
ttctgctttagac

SEQ ID NO: 1912991 - DNA, 14 bp, Homo sapiens
ttctggatgggaca

SEQ ID NO: 1912992 - DNA, 16 bp, Homo sapiens
ttctggttacaattta

SEQ ID NO: 1912993 - DNA, 11 bp, Homo sapiens
ttctgtatttg

SEQ ID NO: 1912994 - DNA, 16 bp, Homo sapiens
ttctgtatttgaaagt

SEQ ID NO: 1912995 - DNA, 17 bp, Homo sapiens
ttctgtatttgaaagtg

SEQ ID NO: 1912996 - DNA, 23 bp, Homo sapiens
ttctgtgcccagaatactgatgg

SEQ ID NO: 1912997 - DNA, 24 bp, Homo sapiens
ttctgtgcccagaatactgatgga

SEQ ID NO: 1912998 - DNA, 23 bp, Homo sapiens
ttctgtgctgttacagttttctt

SEQ ID NO: 1912999 - DNA, 23 bp, Homo sapiens
ttctgtggaaaaataaaggaaat

SEQ ID NO: 1913000 - DNA, 20 bp, Homo sapiens
ttcttaaaaccaatcaataa

SEQ ID NO: 1913001 - DNA, 18 bp, Homo sapiens
ttcttaatttatgtaagg

SEQ ID NO: 1913002 - DNA, 22 bp, Homo sapiens
ttcttagcatacattcagacgt

SEQ ID NO: 1913003 - DNA, 21 bp, Homo sapiens
ttcttggcaataaattttgaa

SEQ ID NO: 1913004 - DNA, 22 bp, Homo sapiens
ttcttggcaataaattttgaaa

SEQ ID NO: 1913005 - DNA, 16 bp, Homo sapiens
ttcttgggactgctgt

SEQ ID NO: 1913006 - DNA, 18 bp, Homo sapiens
ttctttattgcttactgt

SEQ ID NO: 1913007 - DNA, 13 bp, Homo sapiens
ttctttccttttc

SEQ ID NO: 1913008 - DNA, 16 bp, Homo sapiens
ttctttttattttagt

SEQ ID NO: 1913009 - DNA, 16 bp, Homo sapiens
ttcttttttattaatc

SEQ ID NO: 1913010 - DNA, 22 bp, Homo sapiens
ttcttttttattaatcactgtg

SEQ ID NO: 1913011 - DNA, 14 bp, Homo sapiens
ttcttttttcccct

SEQ ID NO: 1913012 - DNA, 20 bp, Homo sapiens
ttgaaaaatgttataactta

SEQ ID NO: 1913013 - DNA, 14 bp, Homo sapiens
ttgaaaatagttta

SEQ ID NO: 1913014 - DNA, 16 bp, Homo sapiens
ttgaaagaatgtaaag

SEQ ID NO: 1913015 - DNA, 17 bp, Homo sapiens
ttgaaataaaaagagta

SEQ ID NO: 1913016 - DNA, 21 bp, Homo sapiens
ttgaaatatggtcttttggtt

SEQ ID NO: 1913017 - DNA, 15 bp, Homo sapiens
ttgaaatggaaatta

SEQ ID NO: 1913018 - DNA, 14 bp, Homo sapiens
ttgaaccataaaat

SEQ ID NO: 1913019 - DNA, 21 bp, Homo sapiens
ttgaactcttctcattacttg

SEQ ID NO: 1913020 - DNA, 14 bp, Homo sapiens
ttgaaggtttttga

SEQ ID NO: 1913021 - DNA, 13 bp, Homo sapiens
ttgaagttaactg

SEQ ID NO: 1913022 - DNA, 21 bp, Homo sapiens
ttgaataaacaccactggatt

SEQ ID NO: 1913023 - DNA, 22 bp, Homo sapiens
ttgaataaacaccactggatta

SEQ ID NO: 1913024 - DNA, 15 bp, Homo sapiens
ttgaataatgtctag

SEQ ID NO: 1913025 - DNA, 21 bp, Homo sapiens
ttgaataatgtctagattttg

SEQ ID NO: 1913026 - DNA, 22 bp, Homo sapiens
ttgaataatgtctagattttga

SEQ ID NO: 1913027 - DNA, 14 bp, Homo sapiens
ttgaatatgattaa

SEQ ID NO: 1913028 - DNA, 17 bp, Homo sapiens
ttgaatatttaagcaat

SEQ ID NO: 1913029 - DNA, 14 bp, Homo sapiens
ttgaccttgtattg

SEQ ID NO: 1913030 - DNA, 16 bp, Homo sapiens
ttgagaatagaaattt

SEQ ID NO: 1913031 - DNA, 21 bp, Homo sapiens
ttgagaccgtgaagatacttt

SEQ ID NO: 1913032 - DNA, 21 bp, Homo sapiens
ttgagataagttttgtttcaa

SEQ ID NO: 1913033 - DNA, 15 bp, Homo sapiens
ttgagctatgactta

SEQ ID NO: 1913034 - DNA, 14 bp, Homo sapiens
ttgaggattagttt

SEQ ID NO: 1913035 - DNA, 17 bp, Homo sapiens
ttgaggattagtttaga

SEQ ID NO: 1913036 - DNA, 18 bp, Homo sapiens
ttgaggcgagcagggcag

SEQ ID NO: 1913037 - DNA, 12 bp, Homo sapiens
ttgagggccagg

SEQ ID NO: 1913038 - DNA, 22 bp, Homo sapiens
ttgagtggggggaacgcccact

SEQ ID NO: 1913039 - DNA, 20 bp, Homo sapiens
ttgagttcaacctttagtac

SEQ ID NO: 1913040 - DNA, 17 bp, Homo sapiens
ttgagttgtttttgtat

SEQ ID NO: 1913041 - DNA, 18 bp, Homo sapiens
ttgataaggaacatttat

SEQ ID NO: 1913042 - DNA, 22 bp, Homo sapiens
ttgataaggaacatttatccag

SEQ ID NO: 1913043 - DNA, 16 bp, Homo sapiens
ttgatacgtttattag

SEQ ID NO: 1913044 - DNA, 12 bp, Homo sapiens
ttgatagtggga

SEQ ID NO: 1913045 - DNA, 13 bp, Homo sapiens
ttgatatatgtat

SEQ ID NO: 1913046 - DNA, 17 bp, Homo sapiens
ttgatctttgagtgtat

SEQ ID NO: 1913047 - DNA, 14 bp, Homo sapiens
ttgatgtaaagatg

SEQ ID NO: 1913048 - DNA, 23 bp, Homo sapiens
ttgatgtaaagatgttctggata

SEQ ID NO: 1913049 - DNA, 12 bp, Homo sapiens
ttgatgtcagca

SEQ ID NO: 1913050 - DNA, 11 bp, Homo sapiens
ttgatgtgctt

SEQ ID NO: 1913051 - DNA, 20 bp, Homo sapiens
ttgatgtgcttacataacca

SEQ ID NO: 1913052 - DNA, 14 bp, Homo sapiens
ttgatgtgttgttc

SEQ ID NO: 1913053 - DNA, 14 bp, Homo sapiens
ttgattaaagatga

SEQ ID NO: 1913054 - DNA, 20 bp, Homo sapiens
ttgatttattaacttaataa

SEQ ID NO: 1913055 - DNA, 23 bp, Homo sapiens
ttgcaagggcggcctttcccact

SEQ ID NO: 1913056 - DNA, 17 bp, Homo sapiens
ttgcagcacagctgaga

SEQ ID NO: 1913057 - DNA, 18 bp, Homo sapiens
ttgcagctcagaaccaca

SEQ ID NO: 1913058 - DNA, 13 bp, Homo sapiens
ttgcagctgtcac

SEQ ID NO: 1913059 - DNA, 13 bp, Homo sapiens
ttgcagtgttaag

SEQ ID NO: 1913060 - DNA, 16 bp, Homo sapiens
ttgcagtgttaagata

SEQ ID NO: 1913061 - DNA, 17 bp, Homo sapiens
ttgcatataacttatat

SEQ ID NO: 1913062 - DNA, 23 bp, Homo sapiens
ttgcatataacttatattgtaag

SEQ ID NO: 1913063 - DNA, 11 bp, Homo sapiens
ttgcattccac

SEQ ID NO: 1913064 - DNA, 17 bp, Homo sapiens
ttgcatttacgcctgta

SEQ ID NO: 1913065 - DNA, 21 bp, Homo sapiens
ttgcatttacgcctgtaaatg

SEQ ID NO: 1913066 - DNA, 13 bp, Homo sapiens
ttgccaaaatggt

SEQ ID NO: 1913067 - DNA, 13 bp, Homo sapiens
ttgcccctggcaa

SEQ ID NO: 1913068 - DNA, 15 bp, Homo sapiens
ttgctaacaggatat

SEQ ID NO: 1913069 - DNA, 16 bp, Homo sapiens
ttgctccattcataca

SEQ ID NO: 1913070 - DNA, 21 bp, Homo sapiens
ttgctgaaagatatgtatatt

SEQ ID NO: 1913071 - DNA, 15 bp, Homo sapiens
ttgctgacttagaat

SEQ ID NO: 1913072 - DNA, 14 bp, Homo sapiens
ttgctgattttgac

SEQ ID NO: 1913073 - DNA, 18 bp, Homo sapiens
ttgctgattttgaccttg

SEQ ID NO: 1913074 - DNA, 22 bp, Homo sapiens
ttgctgcatgggttaattgaga

SEQ ID NO: 1913075 - DNA, 23 bp, Homo sapiens
ttgctggtaaaatgaagaattta

SEQ ID NO: 1913076 - DNA, 21 bp, Homo sapiens
ttgcttgaagcaaacagttga

SEQ ID NO: 1913077 - DNA, 14 bp, Homo sapiens
ttgctttcctttcc

SEQ ID NO: 1913078 - DNA, 16 bp, Homo sapiens
ttggaaatcaaatgta

SEQ ID NO: 1913079 - DNA, 21 bp, Homo sapiens
ttggaaatcaaatgtaaagtt

SEQ ID NO: 1913080 - DNA, 14 bp, Homo sapiens
ttggaacttacaaa

SEQ ID NO: 1913081 - DNA, 14 bp, Homo sapiens
ttggactctgagct

SEQ ID NO: 1913082 - DNA, 18 bp, Homo sapiens
ttggatgtttttagttct

SEQ ID NO: 1913083 - DNA, 23 bp, Homo sapiens
ttggatgtttttagttctgactt

SEQ ID NO: 1913084 - DNA, 17 bp, Homo sapiens
ttggcaaatttgtgaac

SEQ ID NO: 1913085 - DNA, 22 bp, Homo sapiens
ttggcctctgcaaaggaaatac

SEQ ID NO: 1913086 - DNA, 14 bp, Homo sapiens
ttgggaattttatt

SEQ ID NO: 1913087 - DNA, 19 bp, Homo sapiens
ttgggcctcccactcccat

SEQ ID NO: 1913088 - DNA, 21 bp, Homo sapiens
ttggtcctggaggctcaaatt

SEQ ID NO: 1913089 - DNA, 19 bp, Homo sapiens
ttggtctctcccagctctg

SEQ ID NO: 1913090 - DNA, 13 bp, Homo sapiens
ttggttcctgggg

SEQ ID NO: 1913091 - DNA, 19 bp, Homo sapiens
ttggttttatgatgacgta

SEQ ID NO: 1913092 - DNA, 19 bp, Homo sapiens
ttgtaaaaatgtctttcat

SEQ ID NO: 1913093 - DNA, 17 bp, Homo sapiens
ttgtaaaagcattttgt

SEQ ID NO: 1913094 - DNA, 12 bp, Homo sapiens
ttgtaaattctg

SEQ ID NO: 1913095 - DNA, 14 bp, Homo sapiens
ttgtaaattctgat

SEQ ID NO: 1913096 - DNA, 15 bp, Homo sapiens
ttgtaaattctgatt

SEQ ID NO: 1913097 - DNA, 15 bp, Homo sapiens
ttgtaacaagaaaat

SEQ ID NO: 1913098 - DNA, 18 bp, Homo sapiens
ttgtaactaaaataattt

SEQ ID NO: 1913099 - DNA, 21 bp, Homo sapiens
ttgtaactaaaataattttgt

SEQ ID NO: 1913100 - DNA, 16 bp, Homo sapiens
ttgtaagcgtatggct

SEQ ID NO: 1913101 - DNA, 18 bp, Homo sapiens
ttgtaagcgtatggcttt

SEQ ID NO: 1913102 - DNA, 17 bp, Homo sapiens
ttgtaatctagttgtca

SEQ ID NO: 1913103 - DNA, 14 bp, Homo sapiens
ttgtagatttgatt

SEQ ID NO: 1913104 - DNA, 15 bp, Homo sapiens
ttgtagttctttaaa

SEQ ID NO: 1913105 - DNA, 21 bp, Homo sapiens
ttgtatagttatgtaaataat

SEQ ID NO: 1913106 - DNA, 16 bp, Homo sapiens
ttgtatatgctgcatt

SEQ ID NO: 1913107 - DNA, 14 bp, Homo sapiens
ttgtatattctatt

SEQ ID NO: 1913108 - DNA, 22 bp, Homo sapiens
ttgtatattctattttacaact

SEQ ID NO: 1913109 - DNA, 14 bp, Homo sapiens
ttgtatattggttt

SEQ ID NO: 1913110 - DNA, 22 bp, Homo sapiens
ttgtatattggttttatgatga

SEQ ID NO: 1913111 - DNA, 15 bp, Homo sapiens
ttgtatctgatatca

SEQ ID NO: 1913112 - DNA, 14 bp, Homo sapiens
ttgtcattttggtc

SEQ ID NO: 1913113 - DNA, 20 bp, Homo sapiens
ttgtcccaagtctgacagcc

SEQ ID NO: 1913114 - DNA, 16 bp, Homo sapiens
ttgtcctattagtgtt

SEQ ID NO: 1913115 - DNA, 16 bp, Homo sapiens
ttgtccttgaagcttg

SEQ ID NO: 1913116 - DNA, 23 bp, Homo sapiens
ttgtctatttttctcttcatatt

SEQ ID NO: 1913117 - DNA, 15 bp, Homo sapiens
ttgtctcctcccagg

SEQ ID NO: 1913118 - DNA, 16 bp, Homo sapiens
ttgtgaaaataattga

SEQ ID NO: 1913119 - DNA, 19 bp, Homo sapiens
ttgtgaaacagacttgtat

SEQ ID NO: 1913120 - DNA, 19 bp, Homo sapiens
ttgtgagagcctgtgatcc

SEQ ID NO: 1913121 - DNA, 12 bp, Homo sapiens
ttgtgagatggg

SEQ ID NO: 1913122 - DNA, 19 bp, Homo sapiens
ttaatactataaataatat

SEQ ID NO: 1913123 - DNA, 11 bp, Homo sapiens
ttaatcactgt

SEQ ID NO: 1913124 - DNA, 17 bp, Homo sapiens
ttaatcactgtgtatat

SEQ ID NO: 1913125 - DNA, 21 bp, Homo sapiens
ttaatgatatgcttgtaacta

SEQ ID NO: 1913126 - DNA, 22 bp, Homo sapiens
ttaatgcatttatcaataaaag

SEQ ID NO: 1913127 - DNA, 17 bp, Homo sapiens
ttaatgctaatcttgtg

SEQ ID NO: 1913128 - DNA, 18 bp, Homo sapiens
ttaatggatgaaatcata

SEQ ID NO: 1913129 - DNA, 20 bp, Homo sapiens
ttaattgaaagaatgtaaag

SEQ ID NO: 1913130 - DNA, 16 bp, Homo sapiens
ttaatttatgtaaggt

SEQ ID NO: 1913131 - DNA, 22 bp, Homo sapiens
ttacaaagggtctatcttgtaa

SEQ ID NO: 1913132 - DNA, 15 bp, Homo sapiens
ttacaatgtaacttt

SEQ ID NO: 1913133 - DNA, 20 bp, Homo sapiens
ttacaccacaagtatctaaa

SEQ ID NO: 1913134 - DNA, 12 bp, Homo sapiens
ttacagaacagt

SEQ ID NO: 1913135 - DNA, 20 bp, Homo sapiens
ttacagcctgggcaataaag

SEQ ID NO: 1913136 - DNA, 21 bp, Homo sapiens
ttaccgaggacagcctgcctc

SEQ ID NO: 1913137 - DNA, 23 bp, Homo sapiens
ttaccgaggacagcctgcctctg

SEQ ID NO: 1913138 - DNA, 11 bp, Homo sapiens
ttacctggaaa

SEQ ID NO: 1913139 - DNA, 13 bp, Homo sapiens
ttacctggaaaaa

SEQ ID NO: 1913140 - DNA, 20 bp, Homo sapiens
ttaccttgtcattttggtct

SEQ ID NO: 1913141 - DNA, 19 bp, Homo sapiens
ttacgaagttcaagatcaa

SEQ ID NO: 1913142 - DNA, 20 bp, Homo sapiens
ttacgaagttcaagatcaaa

SEQ ID NO: 1913143 - DNA, 13 bp, Homo sapiens
ttactctgagctc

SEQ ID NO: 1913144 - DNA, 13 bp, Homo sapiens
ttactttgtaaat

SEQ ID NO: 1913145 - DNA, 18 bp, Homo sapiens
ttactttgtaaattctga

SEQ ID NO: 1913146 - DNA, 20 bp, Homo sapiens
ttactttgtaaattctgatt

SEQ ID NO: 1913147 - DNA, 13 bp, Homo sapiens
ttagaaaaggaaa

SEQ ID NO: 1913148 - DNA, 13 bp, Homo sapiens
ttagaattgaagg

SEQ ID NO: 1913149 - DNA, 14 bp, Homo sapiens
ttagaattgaaggt

SEQ ID NO: 1913150 - DNA, 18 bp, Homo sapiens
ttagaattgaaggttttt

SEQ ID NO: 1913151 - DNA, 13 bp, Homo sapiens
ttagactgccagc

SEQ ID NO: 1913152 - DNA, 19 bp, Homo sapiens
ttagacttgaaaagagaca

SEQ ID NO: 1913153 - DNA, 15 bp, Homo sapiens
ttagataaatattga

SEQ ID NO: 1913154 - DNA, 16 bp, Homo sapiens
ttagatttgccataga

SEQ ID NO: 1913155 - DNA, 21 bp, Homo sapiens
ttagatttgccatagagtaca

SEQ ID NO: 1913156 - DNA, 11 bp, Homo sapiens
ttagcacagcg

SEQ ID NO: 1913157 - DNA, 15 bp, Homo sapiens
ttagcatacattcag

SEQ ID NO: 1913158 - DNA, 23 bp, Homo sapiens
ttagcatactagaatcagataca

SEQ ID NO: 1913159 - DNA, 22 bp, Homo sapiens
ttagcatgtgttgcagctgtca

SEQ ID NO: 1913160 - DNA, 20 bp, Homo sapiens
ttagtctcagttctcttaat

SEQ ID NO: 1913161 - DNA, 16 bp, Homo sapiens
ttagtttagaacaggt

SEQ ID NO: 1913162 - DNA, 17 bp, Homo sapiens
ttagttttagaattaca

SEQ ID NO: 1913163 - DNA, 17 bp, Homo sapiens
ttataaaataaacacct

SEQ ID NO: 1913164 - DNA, 18 bp, Homo sapiens
ttatacaaatttaacttt

SEQ ID NO: 1913165 - DNA, 14 bp, Homo sapiens
ttatataaagtatt

SEQ ID NO: 1913166 - DNA, 12 bp, Homo sapiens
ttatataactgt

SEQ ID NO: 1913167 - DNA, 14 bp, Homo sapiens
ttatataagcaaaa

SEQ ID NO: 1913168 - DNA, 19 bp, Homo sapiens
ttatataagcaaaatgaaa

SEQ ID NO: 1913169 - DNA, 14 bp, Homo sapiens
ttatatgtatgtgt

SEQ ID NO: 1913170 - DNA, 14 bp, Homo sapiens
ttatattgtaagaa

SEQ ID NO: 1913171 - DNA, 24 bp, Homo sapiens
ttatattgtaagaaatactgtaca

SEQ ID NO: 1913172 - DNA, 19 bp, Homo sapiens
ttatatttcaagtacactg

SEQ ID NO: 1913173 - DNA, 16 bp, Homo sapiens
ttatcaataaaagcct

SEQ ID NO: 1913174 - DNA, 17 bp, Homo sapiens
ttatcaatagcccagga

SEQ ID NO: 1913175 - DNA, 19 bp, Homo sapiens
ttatcttagtctatagaaa

SEQ ID NO: 1913176 - DNA, 22 bp, Homo sapiens
ttatgatgacgtacaagtagtt

SEQ ID NO: 1913177 - DNA, 22 bp, Homo sapiens
ttatgcaaggtcttgcatttaa

SEQ ID NO: 1913178 - DNA, 12 bp, Homo sapiens
ttatgtaaataa

SEQ ID NO: 1913179 - DNA, 13 bp, Homo sapiens
ttatgtaaataat

SEQ ID NO: 1913180 - DNA, 17 bp, Homo sapiens
ttatgtttttgtactct

SEQ ID NO: 1913181 - DNA, 21 bp, Homo sapiens
ttattaaatttttttgtatga

SEQ ID NO: 1913182 - DNA, 13 bp, Homo sapiens
ttattaatcactg

SEQ ID NO: 1913183 - DNA, 18 bp, Homo sapiens
ttattaatcactgtgtat

SEQ ID NO: 1913184 - DNA, 21 bp, Homo sapiens
ttattagcagctgactttcaa

SEQ ID NO: 1913185 - DNA, 12 bp, Homo sapiens
ttattatttatt

SEQ ID NO: 1913186 - DNA, 18 bp, Homo sapiens
ttattatttttctctctc

SEQ ID NO: 1913187 - DNA, 13 bp, Homo sapiens
ttattcaacagca

SEQ ID NO: 1913188 - DNA, 14 bp, Homo sapiens
ttattgatgaaaat

SEQ ID NO: 1913189 - DNA, 20 bp, Homo sapiens
ttattgtcttcctgtaagac

SEQ ID NO: 1913190 - DNA, 14 bp, Homo sapiens
ttatttatatgtat

SEQ ID NO: 1913191 - DNA, 15 bp, Homo sapiens
ttatttatatgtatg

SEQ ID NO: 1913192 - DNA, 16 bp, Homo sapiens
ttatttatatgtatgt

SEQ ID NO: 1913193 - DNA, 20 bp, Homo sapiens
ttatttcatcatattataca

SEQ ID NO: 1913194 - DNA, 19 bp, Homo sapiens
ttatttgtgatgtactgta

SEQ ID NO: 1913195 - DNA, 18 bp, Homo sapiens
ttattttcacagcccata

SEQ ID NO: 1913196 - DNA, 15 bp, Homo sapiens
ttattttcagaagct

SEQ ID NO: 1913197 - DNA, 16 bp, Homo sapiens
ttattttcagaagctg

SEQ ID NO: 1913198 - DNA, 13 bp, Homo sapiens
ttattttgatgta

SEQ ID NO: 1913199 - DNA, 16 bp, Homo sapiens
ttatttttaagaaaga

SEQ ID NO: 1913200 - DNA, 14 bp, Homo sapiens
ttatttttagaatt

SEQ ID NO: 1913201 - DNA, 22 bp, Homo sapiens
ttatttttagaattttgtgaaa

SEQ ID NO: 1913202 - DNA, 15 bp, Homo sapiens
ttatttttctctctc

SEQ ID NO: 1913203 - DNA, 12 bp, Homo sapiens
ttatttttgctt

SEQ ID NO: 1913204 - DNA, 19 bp, Homo sapiens
ttcaaaatactttttaagg

SEQ ID NO: 1913205 - DNA, 14 bp, Homo sapiens
ttcaaaattcaaaa

SEQ ID NO: 1913206 - DNA, 21 bp, Homo sapiens
ttcaaagcaccaaaataagaa

SEQ ID NO: 1913207 - DNA, 20 bp, Homo sapiens
ttcaacagcaagtgtgaata

SEQ ID NO: 1913208 - DNA, 20 bp, Homo sapiens
ttcaacccccttaactgtat

SEQ ID NO: 1913209 - DNA, 15 bp, Homo sapiens
ttcaagaaatgaaga

SEQ ID NO: 1913210 - DNA, 17 bp, Homo sapiens
ttcaagaaatgaagagc

SEQ ID NO: 1913211 - DNA, 19 bp, Homo sapiens
ttcaagaaatgaagagctg

SEQ ID NO: 1913212 - DNA, 17 bp, Homo sapiens
ttcaagtacactgaatt

SEQ ID NO: 1913213 - DNA, 19 bp, Homo sapiens
ttcacttgaaattaaagct

SEQ ID NO: 1913214 - DNA, 21 bp, Homo sapiens
ttcagattcaggcattttccc

SEQ ID NO: 1913215 - DNA, 12 bp, Homo sapiens
ttcagcatctga

SEQ ID NO: 1913216 - DNA, 21 bp, Homo sapiens
ttcagcatctgacctctacct

SEQ ID NO: 1913217 - DNA, 17 bp, Homo sapiens
ttcaggcattttccccc

SEQ ID NO: 1913218 - DNA, 19 bp, Homo sapiens
ttcaggcccatcagctacc

SEQ ID NO: 1913219 - DNA, 14 bp, Homo sapiens
ttcaggtagaggtg

SEQ ID NO: 1913220 - DNA, 22 bp, Homo sapiens
ttcaggtcccagttgctgtcac

SEQ ID NO: 1913221 - DNA, 21 bp, Homo sapiens
ttcattgatttagtaagtgtt

SEQ ID NO: 1913222 - DNA, 16 bp, Homo sapiens
ttcattgcacaatata

SEQ ID NO: 1913223 - DNA, 17 bp, Homo sapiens
ttcattttgaaaaacac

SEQ ID NO: 1913224 - DNA, 20 bp, Homo sapiens
ttccaaataatatgtttcct

SEQ ID NO: 1913225 - DNA, 14 bp, Homo sapiens
ttccaattttcctt

SEQ ID NO: 1913226 - DNA, 14 bp, Homo sapiens
ttccacagaggaca

SEQ ID NO: 1913227 - DNA, 22 bp, Homo sapiens
ttccacagaggacacagagaag

SEQ ID NO: 1913228 - DNA, 13 bp, Homo sapiens
ttccactgagacc

SEQ ID NO: 1913229 - DNA, 20 bp, Homo sapiens
ttccagcacaaccttcaagc

SEQ ID NO: 1913230 - DNA, 15 bp, Homo sapiens
ttccagctccctccc

SEQ ID NO: 1913231 - DNA, 19 bp, Homo sapiens
ttccagctccctcccctgc

SEQ ID NO: 1913232 - DNA, 18 bp, Homo sapiens
ttccagtggcttctccca

SEQ ID NO: 1913233 - DNA, 19 bp, Homo sapiens
ttccagtggcttctcccaa

SEQ ID NO: 1913234 - DNA, 14 bp, Homo sapiens
ttccatctcttcct

SEQ ID NO: 1913235 - DNA, 22 bp, Homo sapiens
ttcccaaatgtgtgcccagctt

SEQ ID NO: 1913236 - DNA, 17 bp, Homo sapiens
ttccccaagcctggcag

SEQ ID NO: 1913237 - DNA, 19 bp, Homo sapiens
ttccccaagcctggcaggg

SEQ ID NO: 1913238 - DNA, 17 bp, Homo sapiens
ttcccttccatctcttc

SEQ ID NO: 1913239 - DNA, 18 bp, Homo sapiens
ttccgcattctttgtaca

SEQ ID NO: 1913240 - DNA, 14 bp, Homo sapiens
ttcctccccaccct

SEQ ID NO: 1913241 - DNA, 19 bp, Homo sapiens
ttcctccccaccctgtccc

SEQ ID NO: 1913242 - DNA, 19 bp, Homo sapiens
ttcctctgctgcatcccct

SEQ ID NO: 1913243 - DNA, 23 bp, Homo sapiens
ttcctctgctgcatccccttcca

SEQ ID NO: 1913244 - DNA, 19 bp, Homo sapiens
ttcctgacgagataagcag

SEQ ID NO: 1913245 - DNA, 19 bp, Homo sapiens
ttcctggggcatccatggg

SEQ ID NO: 1913246 - DNA, 14 bp, Homo sapiens
ttcgttctctgcca

SEQ ID NO: 1913247 - DNA, 12 bp, Homo sapiens
ttctactttgaa

SEQ ID NO: 1913248 - DNA, 21 bp, Homo sapiens
ttctactttgaaatatttaat

SEQ ID NO: 1913249 - DNA, 21 bp, Homo sapiens
ttctcattacttgttgcctat

SEQ ID NO: 1913250 - DNA, 17 bp, Homo sapiens
ttctcccgggactctgc

SEQ ID NO: 1913251 - DNA, 15 bp, Homo sapiens
ttctctagaggctgg

SEQ ID NO: 1913252 - DNA, 13 bp, Homo sapiens
ttctctgaggaca

SEQ ID NO: 1913253 - DNA, 23 bp, Homo sapiens
ttctctgtttttcttctgaaata

SEQ ID NO: 1913254 - DNA, 14 bp, Homo sapiens
ttctcttgcctcag

SEQ ID NO: 1913255 - DNA, 18 bp, Homo sapiens
ttctctttctctctcact

SEQ ID NO: 1913256 - DNA, 14 bp, Homo sapiens
ttctgaaaatttat

SEQ ID NO: 1913257 - DNA, 16 bp, Homo sapiens
ttctgactttgaattt

SEQ ID NO: 1913258 - DNA, 20 bp, Homo sapiens
ttctgactttgaatttatat

SEQ ID NO: 1913259 - DNA, 16 bp, Homo sapiens
ttgtgtgaacttggaa

SEQ ID NO: 1913260 - DNA, 15 bp, Homo sapiens
ttgttactcttggga

SEQ ID NO: 1913261 - DNA, 19 bp, Homo sapiens
ttgttcttggcaataaatt

SEQ ID NO: 1913262 - DNA, 17 bp, Homo sapiens
ttgttgctgattttgac

SEQ ID NO: 1913263 - DNA, 15 bp, Homo sapiens
ttgttgtttgtatgt

SEQ ID NO: 1913264 - DNA, 23 bp, Homo sapiens
ttgtttagtctttatactgcaaa

SEQ ID NO: 1913265 - DNA, 12 bp, Homo sapiens
ttgtttgtttca

SEQ ID NO: 1913266 - DNA, 13 bp, Homo sapiens
ttgtttttgtata

SEQ ID NO: 1913267 - DNA, 15 bp, Homo sapiens
ttgtttttgtatatt

SEQ ID NO: 1913268 - DNA, 16 bp, Homo sapiens
tttaaaaagtgtttaa

SEQ ID NO: 1913269 - DNA, 20 bp, Homo sapiens
tttaaaaagtgtttaaatgt

SEQ ID NO: 1913270 - DNA, 15 bp, Homo sapiens
tttaaaaatctgcca

SEQ ID NO: 1913271 - DNA, 16 bp, Homo sapiens
tttaaaaatctgccac

SEQ ID NO: 1913272 - DNA, 20 bp, Homo sapiens
tttaaaagatataagactta

SEQ ID NO: 1913273 - DNA, 16 bp, Homo sapiens
tttaaacatagaaagt

SEQ ID NO: 1913274 - DNA, 18 bp, Homo sapiens
tttaaagaaaaaaatgtc

SEQ ID NO: 1913275 - DNA, 13 bp, Homo sapiens
tttaacttttaaa

SEQ ID NO: 1913276 - DNA, 15 bp, Homo sapiens
tttaagcaataaaac

SEQ ID NO: 1913277 - DNA, 13 bp, Homo sapiens
tttaagttttgac

SEQ ID NO: 1913278 - DNA, 16 bp, Homo sapiens
tttaatctactgcatt

SEQ ID NO: 1913279 - DNA, 18 bp, Homo sapiens
tttaatctactgcattta

SEQ ID NO: 1913280 - DNA, 20 bp, Homo sapiens
tttaattgaaagaatgtaaa

SEQ ID NO: 1913281 - DNA, 21 bp, Homo sapiens
tttaattgaaagaatgtaaag

SEQ ID NO: 1913282 - DNA, 14 bp, Homo sapiens
tttaattgtatttt

SEQ ID NO: 1913283 - DNA, 16 bp, Homo sapiens
tttaatttgaaatatg

SEQ ID NO: 1913284 - DNA, 20 bp, Homo sapiens
tttacaacactttaatgggt

SEQ ID NO: 1913285 - DNA, 16 bp, Homo sapiens
tttacctgcaaaaaat

SEQ ID NO: 1913286 - DNA, 17 bp, Homo sapiens
tttactgtgactttatt

SEQ ID NO: 1913287 - DNA, 15 bp, Homo sapiens
tttagaacaggtttt

SEQ ID NO: 1913288 - DNA, 11 bp, Homo sapiens
tttagaattga

SEQ ID NO: 1913289 - DNA, 15 bp, Homo sapiens
tttagaattgaaggt

SEQ ID NO: 1913290 - DNA, 17 bp, Homo sapiens
tttagaattgaaggttt

SEQ ID NO: 1913291 - DNA, 14 bp, Homo sapiens
tttagacttgaaaa

SEQ ID NO: 1913292 - DNA, 19 bp, Homo sapiens
tttagacttgaaaagagac

SEQ ID NO: 1913293 - DNA, 23 bp, Homo sapiens
tttagacttgaaaagagacaggc

SEQ ID NO: 1913294 - DNA, 19 bp, Homo sapiens
tttaggccaatcagaagct

SEQ ID NO: 1913295 - DNA, 14 bp, Homo sapiens
tttaggtgaaaata

SEQ ID NO: 1913296 - DNA, 14 bp, Homo sapiens
tttataatgaataa

SEQ ID NO: 1913297 - DNA, 17 bp, Homo sapiens
tttatataaagtatttt

SEQ ID NO: 1913298 - DNA, 17 bp, Homo sapiens
tttatatgtatatagat

SEQ ID NO: 1913299 - DNA, 21 bp, Homo sapiens
tttatatgtatgtgtttagaa

SEQ ID NO: 1913300 - DNA, 13 bp, Homo sapiens
tttatatttcaag

SEQ ID NO: 1913301 - DNA, 18 bp, Homo sapiens
tttatatttcaagtacac

SEQ ID NO: 1913302 - DNA, 21 bp, Homo sapiens
tttatccattcaactgaaaat

SEQ ID NO: 1913303 - DNA, 20 bp, Homo sapiens
tttattaacttaataatcaa

SEQ ID NO: 1913304 - DNA, 15 bp, Homo sapiens
tttattaatcactgt

SEQ ID NO: 1913305 - DNA, 20 bp, Homo sapiens
tttattaggaaaagatattt

SEQ ID NO: 1913306 - DNA, 23 bp, Homo sapiens
tttattatttattttttttaatt

SEQ ID NO: 1913307 - DNA, 15 bp, Homo sapiens
tttatttatatgtat

SEQ ID NO: 1913308 - DNA, 16 bp, Homo sapiens
tttatttttaagaaag

SEQ ID NO: 1913309 - DNA, 23 bp, Homo sapiens
tttatttttagaattttgtgaaa

SEQ ID NO: 1913310 - DNA, 21 bp, Homo sapiens
tttattttttttaattgtatt

SEQ ID NO: 1913311 - DNA, 16 bp, Homo sapiens
tttcaaaatatgtgta

SEQ ID NO: 1913312 - DNA, 20 bp, Homo sapiens
tttcaaataactgcagaaaa

SEQ ID NO: 1913313 - DNA, 18 bp, Homo sapiens
tttcaagtacactgaatt

SEQ ID NO: 1913314 - DNA, 14 bp, Homo sapiens
tttcagaagctgat

SEQ ID NO: 1913315 - DNA, 11 bp, Homo sapiens
tttcagtgagg

SEQ ID NO: 1913316 - DNA, 18 bp, Homo sapiens
tttcataagatattttat

SEQ ID NO: 1913317 - DNA, 16 bp, Homo sapiens
tttcataataaataga

SEQ ID NO: 1913318 - DNA, 17 bp, Homo sapiens
tttcatcatattataca

SEQ ID NO: 1913319 - DNA, 13 bp, Homo sapiens
tttcatgctttat

SEQ ID NO: 1913320 - DNA, 12 bp, Homo sapiens
tttcatgtgctc

SEQ ID NO: 1913321 - DNA, 17 bp, Homo sapiens
tttcattttctttcctt

SEQ ID NO: 1913322 - DNA, 21 bp, Homo sapiens
tttccactgagcatcacaata

SEQ ID NO: 1913323 - DNA, 17 bp, Homo sapiens
tttccatatttttacaa

SEQ ID NO: 1913324 - DNA, 13 bp, Homo sapiens
tttccattttata

SEQ ID NO: 1913325 - DNA, 18 bp, Homo sapiens
tttccattttataaatgt

SEQ ID NO: 1913326 - DNA, 17 bp, Homo sapiens
tttcccccttggctctc

SEQ ID NO: 1913327 - DNA, 13 bp, Homo sapiens
tttccctatctgc

SEQ ID NO: 1913328 - DNA, 14 bp, Homo sapiens
tttccctttccttt

SEQ ID NO: 1913329 - DNA, 17 bp, Homo sapiens
tttcctttaatatgaaa

SEQ ID NO: 1913330 - DNA, 19 bp, Homo sapiens
tttctaattggctttacta

SEQ ID NO: 1913331 - DNA, 22 bp, Homo sapiens
tttctcaaagccccattaactg

SEQ ID NO: 1913332 - DNA, 17 bp, Homo sapiens
tttctctctcactctct

SEQ ID NO: 1913333 - DNA, 22 bp, Homo sapiens
tttctctctcactctcttcctt

SEQ ID NO: 1913334 - DNA, 21 bp, Homo sapiens
tttctgaaaatttatataact

SEQ ID NO: 1913335 - DNA, 23 bp, Homo sapiens
tttctgaatgtagacggaacagt

SEQ ID NO: 1913336 - DNA, 17 bp, Homo sapiens
tttctgctttagacttg

SEQ ID NO: 1913337 - DNA, 20 bp, Homo sapiens
tttctgctttagacttgaaa

SEQ ID NO: 1913338 - DNA, 14 bp, Homo sapiens
tttcttgataattt

SEQ ID NO: 1913339 - DNA, 19 bp, Homo sapiens
tttcttgataattttcctt

SEQ ID NO: 1913340 - DNA, 15 bp, Homo sapiens
tttctttaagaaagt

SEQ ID NO: 1913341 - DNA, 16 bp, Homo sapiens
tttctttaagaaagta

SEQ ID NO: 1913342 - DNA, 20 bp, Homo sapiens
tttctttattgcttactgtg

SEQ ID NO: 1913343 - DNA, 17 bp, Homo sapiens
tttctttttaagaaatt

SEQ ID NO: 1913344 - DNA, 22 bp, Homo sapiens
tttgaaaaattacctgtataat

SEQ ID NO: 1913345 - DNA, 23 bp, Homo sapiens
tttgaaaacaccagctgtatata

SEQ ID NO: 1913346 - DNA, 14 bp, Homo sapiens
tttgaaaagtaata

SEQ ID NO: 1913347 - DNA, 22 bp, Homo sapiens
tttgaaaagtaatatttattaa

SEQ ID NO: 1913348 - DNA, 22 bp, Homo sapiens
tttgaaacccctgtaggcctca

SEQ ID NO: 1913349 - DNA, 18 bp, Homo sapiens
tttgaaagtgcctttgca

SEQ ID NO: 1913350 - DNA, 21 bp, Homo sapiens
tttgaaagtgcctttgcagct

SEQ ID NO: 1913351 - DNA, 23 bp, Homo sapiens
tttgaaagtgcctttgcagctca

SEQ ID NO: 1913352 - DNA, 16 bp, Homo sapiens
tttgaaatatggtctt

SEQ ID NO: 1913353 - DNA, 17 bp, Homo sapiens
tttgaactcttctcatt

SEQ ID NO: 1913354 - DNA, 15 bp, Homo sapiens
tttgaatttatataa

SEQ ID NO: 1913355 - DNA, 19 bp, Homo sapiens
tttgaatttatataaagta

SEQ ID NO: 1913356 - DNA, 19 bp, Homo sapiens
tttgacagcgcacagctgc

SEQ ID NO: 1913357 - DNA, 13 bp, Homo sapiens
tttgaccttgtat

SEQ ID NO: 1913358 - DNA, 14 bp, Homo sapiens
tttgaccttgtatt

SEQ ID NO: 1913359 - DNA, 22 bp, Homo sapiens
tttgaggattagtttagaacag

SEQ ID NO: 1913360 - DNA, 14 bp, Homo sapiens
tttgatgtcagcag

SEQ ID NO: 1913361 - DNA, 20 bp, Homo sapiens
tttgatgtcagcagttgctg

SEQ ID NO: 1913362 - DNA, 13 bp, Homo sapiens
tttgatttattaa

SEQ ID NO: 1913363 - DNA, 11 bp, Homo sapiens
tttgcatatcc

SEQ ID NO: 1913364 - DNA, 21 bp, Homo sapiens
tttgcatttacgcctgtaaat

SEQ ID NO: 1913365 - DNA, 20 bp, Homo sapiens
tttgccatgtgcttctgcca

SEQ ID NO: 1913366 - DNA, 15 bp, Homo sapiens
tttgcccctggcaaa

SEQ ID NO: 1913367 - DNA, 18 bp, Homo sapiens
tttgctgtagtgtttctt

SEQ ID NO: 1913368 - DNA, 17 bp, Homo sapiens
tttgctttcctttcctt

SEQ ID NO: 1913369 - DNA, 20 bp, Homo sapiens
tttggacacatttaaggtgt

SEQ ID NO: 1913370 - DNA, 16 bp, Homo sapiens
tttggcttacatttga

SEQ ID NO: 1913371 - DNA, 14 bp, Homo sapiens
tttgtaaatgactt

SEQ ID NO: 1913372 - DNA, 19 bp, Homo sapiens
tttgtaaatgactttcata

SEQ ID NO: 1913373 - DNA, 15 bp, Homo sapiens
tttgtaaattctgat

SEQ ID NO: 1913374 - DNA, 19 bp, Homo sapiens
tttgtagacattttgaaat

SEQ ID NO: 1913375 - DNA, 22 bp, Homo sapiens
tttgtagacattttgaaataaa

SEQ ID NO: 1913376 - DNA, 21 bp, Homo sapiens
tttgtagtgtgttttcataac

SEQ ID NO: 1913377 - DNA, 16 bp, Homo sapiens
tttgtatagttatgta

SEQ ID NO: 1913378 - DNA, 21 bp, Homo sapiens
tttgtatagttatgtaaataa

SEQ ID NO: 1913379 - DNA, 19 bp, Homo sapiens
tttgtgaactgtcatgata

SEQ ID NO: 1913380 - DNA, 20 bp, Homo sapiens
tttgtgtggagtcatttctg

SEQ ID NO: 1913381 - DNA, 18 bp, Homo sapiens
tttgtgtgttacaatgta

SEQ ID NO: 1913382 - DNA, 16 bp, Homo sapiens
tttgttgaaagaaagt

SEQ ID NO: 1913383 - DNA, 19 bp, Homo sapiens
tttgttgccagatttcaga

SEQ ID NO: 1913384 - DNA, 21 bp, Homo sapiens
tttgtttaataccctgtacat

SEQ ID NO: 1913385 - DNA, 15 bp, Homo sapiens
tttgtttttctgctt

SEQ ID NO: 1913386 - DNA, 19 bp, Homo sapiens
ttttaaattatgttttact

SEQ ID NO: 1913387 - DNA, 22 bp, Homo sapiens
ttttaagaaagaaatactgtat

SEQ ID NO: 1913388 - DNA, 12 bp, Homo sapiens
aagaaatgaaga

SEQ ID NO: 1913389 - DNA, 13 bp, Homo sapiens
aagaaattaactt

SEQ ID NO: 1913390 - DNA, 20 bp, Homo sapiens
aagaaattgtccttgaagct

SEQ ID NO: 1913391 - DNA, 12 bp, Homo sapiens
aagaactgcttt

SEQ ID NO: 1913392 - DNA, 17 bp, Homo sapiens
aagaatagcattgtaaa

SEQ ID NO: 1913393 - DNA, 14 bp, Homo sapiens
aagaatttaaagaa

SEQ ID NO: 1913394 - DNA, 23 bp, Homo sapiens
aagaccccactggagtctctctc

SEQ ID NO: 1913395 - DNA, 23 bp, Homo sapiens
aagactcactgtgtggcctcaga

SEQ ID NO: 1913396 - DNA, 20 bp, Homo sapiens
aagactccgtctcaaaaaaa

SEQ ID NO: 1913397 - DNA, 11 bp, Homo sapiens
aagagaaaaga

SEQ ID NO: 1913398 - DNA, 12 bp, Homo sapiens
aagagaaaagaa

SEQ ID NO: 1913399 - DNA, 14 bp, Homo sapiens
aagagaaaagaaaa

SEQ ID NO: 1913400 - DNA, 14 bp, Homo sapiens
aagagacagggccc

SEQ ID NO: 1913401 - DNA, 16 bp, Homo sapiens
aagagactgcttgaca

SEQ ID NO: 1913402 - DNA, 13 bp, Homo sapiens
aagagagctggag

SEQ ID NO: 1913403 - DNA, 23 bp, Homo sapiens
aagagagctggagtctgggctcc

SEQ ID NO: 1913404 - DNA, 20 bp, Homo sapiens
aagagatgacaacaaatttt

SEQ ID NO: 1913405 - DNA, 21 bp, Homo sapiens
aagagatgacaacaaattttg

SEQ ID NO: 1913406 - DNA, 12 bp, Homo sapiens
aagagccccact

SEQ ID NO: 1913407 - DNA, 13 bp, Homo sapiens
aagagccccactc

SEQ ID NO: 1913408 - DNA, 19 bp, Homo sapiens
aagagccccactctcagag

SEQ ID NO: 1913409 - DNA, 16 bp, Homo sapiens
aagagccttaaaacat

SEQ ID NO: 1913410 - DNA, 14 bp, Homo sapiens
aagaggttctaact

SEQ ID NO: 1913411 - DNA, 16 bp, Homo sapiens
aagagtggccccacct

SEQ ID NO: 1913412 - DNA, 22 bp, Homo sapiens
aagagtggccccacctggccct

SEQ ID NO: 1913413 - DNA, 13 bp, Homo sapiens
aagagtttgtaaa

SEQ ID NO: 1913414 - DNA, 15 bp, Homo sapiens
aagataattgtactt

SEQ ID NO: 1913415 - DNA, 13 bp, Homo sapiens
aagatatgtatat

SEQ ID NO: 1913416 - DNA, 20 bp, Homo sapiens
aagatcactgtttagatttg

SEQ ID NO: 1913417 - DNA, 16 bp, Homo sapiens
aagatgtagatttatt

SEQ ID NO: 1913418 - DNA, 18 bp, Homo sapiens
aagcacaccaatcttact

SEQ ID NO: 1913419 - DNA, 22 bp, Homo sapiens
aagcacaccaatcttactttgt

SEQ ID NO: 1913420 - DNA, 23 bp, Homo sapiens
aagcacaccaatcttactttgta

SEQ ID NO: 1913421 - DNA, 16 bp, Homo sapiens
aagcaccaaaataaga

SEQ ID NO: 1913422 - DNA, 19 bp, Homo sapiens
aagcaccaaaataagaaaa

SEQ ID NO: 1913423 - DNA, 22 bp, Homo sapiens
aagcaccaaaataagaaaagat

SEQ ID NO: 1913424 - DNA, 14 bp, Homo sapiens
aagcagtgcccagg

SEQ ID NO: 1913425 - DNA, 13 bp, Homo sapiens
aagcatctaagga

SEQ ID NO: 1913426 - DNA, 19 bp, Homo sapiens
aagcatgtttcattctctg

SEQ ID NO: 1913427 - DNA, 17 bp, Homo sapiens
aagcattttgtaataat

SEQ ID NO: 1913428 - DNA, 13 bp, Homo sapiens
aagccgtggccgg

SEQ ID NO: 1913429 - DNA, 21 bp, Homo sapiens
aagccgtggccggggtccagg

SEQ ID NO: 1913430 - DNA, 16 bp, Homo sapiens
aagcctggcaggggat

SEQ ID NO: 1913431 - DNA, 20 bp, Homo sapiens
aagccttcgaaaagaaattg

SEQ ID NO: 1913432 - DNA, 17 bp, Homo sapiens
aagccttcttggaaaat

SEQ ID NO: 1913433 - DNA, 14 bp, Homo sapiens
aagcgccctggccc

SEQ ID NO: 1913434 - DNA, 23 bp, Homo sapiens
aagcggtttgcatttacgcctgt

SEQ ID NO: 1913435 - DNA, 15 bp, Homo sapiens
aagctagtcaacagt

SEQ ID NO: 1913436 - DNA, 17 bp, Homo sapiens
aagctagtcaacagtac

SEQ ID NO: 1913437 - DNA, 19 bp, Homo sapiens
aagctagttgaatacttga

SEQ ID NO: 1913438 - DNA, 13 bp, Homo sapiens
aagctgaggccca

SEQ ID NO: 1913439 - DNA, 20 bp, Homo sapiens
aagctgaggctgctgccagg

SEQ ID NO: 1913440 - DNA, 14 bp, Homo sapiens
aagctgcatatgcc

SEQ ID NO: 1913441 - DNA, 15 bp, Homo sapiens
aagcttgtatctgat

SEQ ID NO: 1913442 - DNA, 23 bp, Homo sapiens
aagctttgtaattcagaaatcct

SEQ ID NO: 1913443 - DNA, 14 bp, Homo sapiens
aaggaacatttatc

SEQ ID NO: 1913444 - DNA, 19 bp, Homo sapiens
aaggactgactgaggcagt

SEQ ID NO: 1913445 - DNA, 23 bp, Homo sapiens
aaggagcaggccctgggcctcca

SEQ ID NO: 1913446 - DNA, 22 bp, Homo sapiens
aaggatgccaagaagtttaagg

SEQ ID NO: 1913447 - DNA, 17 bp, Homo sapiens
aaggcagaaagcaaaat

SEQ ID NO: 1913448 - DNA, 16 bp, Homo sapiens
aaggcagggcaagaac

SEQ ID NO: 1913449 - DNA, 22 bp, Homo sapiens
aaggcagggcaagaacagaagt

SEQ ID NO: 1913450 - DNA, 14 bp, Homo sapiens
aaggccacctcttc

SEQ ID NO: 1913451 - DNA, 20 bp, Homo sapiens
aaggccacctcttcctggcc

SEQ ID NO: 1913452 - DNA, 22 bp, Homo sapiens
aaggccacctcttcctggccgg

SEQ ID NO: 1913453 - DNA, 22 bp, Homo sapiens
aaggcctaattctatgcctgtc

SEQ ID NO: 1913454 - DNA, 14 bp, Homo sapiens
aaggcttataaaac

SEQ ID NO: 1913455 - DNA, 22 bp, Homo sapiens
aaggcttttcaaccacaaaact

SEQ ID NO: 1913456 - DNA, 16 bp, Homo sapiens
aagggaggcccagcgc

SEQ ID NO: 1913457 - DNA, 18 bp, Homo sapiens
aagggagtaagtagaggt

SEQ ID NO: 1913458 - DNA, 19 bp, Homo sapiens
aaggggactgccacctccc

SEQ ID NO: 1913459 - DNA, 19 bp, Homo sapiens
aaggggccagagccttgga

SEQ ID NO: 1913460 - DNA, 23 bp, Homo sapiens
aaggggcccctccttgtgctgcc

SEQ ID NO: 1913461 - DNA, 13 bp, Homo sapiens
aaggggttttctt

SEQ ID NO: 1913462 - DNA, 17 bp, Homo sapiens
aaggtgtgcctggcagc

SEQ ID NO: 1913463 - DNA, 15 bp, Homo sapiens
aaggtgtttgaaaat

SEQ ID NO: 1913464 - DNA, 21 bp, Homo sapiens
aaggtgtttgaaaatagttta

SEQ ID NO: 1913465 - DNA, 14 bp, Homo sapiens
aaggtttttgatag

SEQ ID NO: 1913466 - DNA, 16 bp, Homo sapiens
aaggttttttttgtac

SEQ ID NO: 1913467 - DNA, 20 bp, Homo sapiens
aagtaagggaagcagaagga

SEQ ID NO: 1913468 - DNA, 16 bp, Homo sapiens
aagtaagtctcaaggt

SEQ ID NO: 1913469 - DNA, 22 bp, Homo sapiens
aagtaatatttattaaattttt

SEQ ID NO: 1913470 - DNA, 21 bp, Homo sapiens
aagtaatctttaactgaactc

SEQ ID NO: 1913471 - DNA, 23 bp, Homo sapiens
aagtacactgaatttttatgtgt

SEQ ID NO: 1913472 - DNA, 15 bp, Homo sapiens
aagtagcacaggctg

SEQ ID NO: 1913473 - DNA, 15 bp, Homo sapiens
aagtaggaaaaataa

SEQ ID NO: 1913474 - DNA, 19 bp, Homo sapiens
aagtaggggaagaataatt

SEQ ID NO: 1913475 - DNA, 20 bp, Homo sapiens
aagtaggggaagaataattt

SEQ ID NO: 1913476 - DNA, 14 bp, Homo sapiens
aagtagttctgtat

SEQ ID NO: 1913477 - DNA, 23 bp, Homo sapiens
aagtagttctgtatttgaaagtg

SEQ ID NO: 1913478 - DNA, 22 bp, Homo sapiens
aagtatatattcccctaagatt

SEQ ID NO: 1913479 - DNA, 19 bp, Homo sapiens
aagtatttttataatgact

SEQ ID NO: 1913480 - DNA, 12 bp, Homo sapiens
aagtgaaaactt

SEQ ID NO: 1913481 - DNA, 20 bp, Homo sapiens
aagtgaacagattttattaa

SEQ ID NO: 1913482 - DNA, 15 bp, Homo sapiens
aagtgacggttccta

SEQ ID NO: 1913483 - DNA, 13 bp, Homo sapiens
aagtgcaaacaga

SEQ ID NO: 1913484 - DNA, 17 bp, Homo sapiens
aagtgcaatgccccctc

SEQ ID NO: 1913485 - DNA, 19 bp, Homo sapiens
aagtgcagaactgcagtca

SEQ ID NO: 1913486 - DNA, 19 bp, Homo sapiens
aagtgcatgggtcagggtg

SEQ ID NO: 1913487 - DNA, 13 bp, Homo sapiens
aagtgctattacg

SEQ ID NO: 1913488 - DNA, 14 bp, Homo sapiens
aagtgcttgtttta

SEQ ID NO: 1913489 - DNA, 23 bp, Homo sapiens
aagtgggttcgggaggtctctat

SEQ ID NO: 1913490 - DNA, 13 bp, Homo sapiens
aagtgtattgtaa

SEQ ID NO: 1913491 - DNA, 16 bp, Homo sapiens
aagtgtgaatactgct

SEQ ID NO: 1913492 - DNA, 14 bp, Homo sapiens
aagtgtgaccagtt

SEQ ID NO: 1913493 - DNA, 12 bp, Homo sapiens
aagtgttcattg

SEQ ID NO: 1913494 - DNA, 22 bp, Homo sapiens
aagttaactgttccccttggta

SEQ ID NO: 1913495 - DNA, 18 bp, Homo sapiens
aagttgagctatgactta

SEQ ID NO: 1913496 - DNA, 19 bp, Homo sapiens
aagttgagctatgacttaa

SEQ ID NO: 1913497 - DNA, 20 bp, Homo sapiens
aagttgagctatgacttaac

SEQ ID NO: 1913498 - DNA, 19 bp, Homo sapiens
aagttgtacttcatttcta

SEQ ID NO: 1913499 - DNA, 23 bp, Homo sapiens
aagttgtttcattgatttagtaa

SEQ ID NO: 1913500 - DNA, 12 bp, Homo sapiens
aataaaactgct

SEQ ID NO: 1913501 - DNA, 14 bp, Homo sapiens
aataaaagcccagg

SEQ ID NO: 1913502 - DNA, 15 bp, Homo sapiens
aataaaagcccagga

SEQ ID NO: 1913503 - DNA, 15 bp, Homo sapiens
aataaaggaaattca

SEQ ID NO: 1913504 - DNA, 12 bp, Homo sapiens
aataaagtgcaa

SEQ ID NO: 1913505 - DNA, 13 bp, Homo sapiens
aataaattttgaa

SEQ ID NO: 1913506 - DNA, 18 bp, Homo sapiens
aataacaaaaaagagaaa

SEQ ID NO: 1913507 - DNA, 19 bp, Homo sapiens
aataacaaaaaagagaaac

SEQ ID NO: 1913508 - DNA, 16 bp, Homo sapiens
aataagagagcaggat

SEQ ID NO: 1913509 - DNA, 17 bp, Homo sapiens
aataagctagttgaata

SEQ ID NO: 1913510 - DNA, 23 bp, Homo sapiens
aataagctagttgaatacttgaa

SEQ ID NO: 1913511 - DNA, 12 bp, Homo sapiens
aataataaagaa

SEQ ID NO: 1913512 - DNA, 23 bp, Homo sapiens
aataataagtccatctgtcactt

SEQ ID NO: 1913513 - DNA, 20 bp, Homo sapiens
aataatatgtttccttccct

SEQ ID NO: 1913514 - DNA, 17 bp, Homo sapiens
aatacacaagtaaacat

SEQ ID NO: 1913515 - DNA, 15 bp, Homo sapiens
aatacagactggatg

SEQ ID NO: 1913516 - DNA, 17 bp, Homo sapiens
aatacatttaaaacatt

SEQ ID NO: 1913517 - DNA, 20 bp, Homo sapiens
aatacatttaaaacattaaa

SEQ ID NO: 1913518 - DNA, 22 bp, Homo sapiens
aatacatttaaaacattaaaat

SEQ ID NO: 1913519 - DNA, 16 bp, Homo sapiens
aataccaacctgaaag

SEQ ID NO: 1913520 - DNA, 19 bp, Homo sapiens
accaccaactactacctgt

SEQ ID NO: 1913521 - DNA, 14 bp, Homo sapiens
accacttgtagatt

SEQ ID NO: 1913522 - DNA, 14 bp, Homo sapiens
accagaaccaaacc

SEQ ID NO: 1913523 - DNA, 10 bp, Homo sapiens
accagcaggc

SEQ ID NO: 1913524 - DNA, 12 bp, Homo sapiens
accagcaggcac

SEQ ID NO: 1913525 - DNA, 16 bp, Homo sapiens
accagcaggctcctca

SEQ ID NO: 1913526 - DNA, 15 bp, Homo sapiens
accagccttacagct

SEQ ID NO: 1913527 - DNA, 16 bp, Homo sapiens
accagcgcccccactc

SEQ ID NO: 1913528 - DNA, 23 bp, Homo sapiens
accagcgcccccactcctcctcc

SEQ ID NO: 1913529 - DNA, 12 bp, Homo sapiens
accagttttgat

SEQ ID NO: 1913530 - DNA, 17 bp, Homo sapiens
accagttttgatattta

SEQ ID NO: 1913531 - DNA, 19 bp, Homo sapiens
accatgcaacttcctttga

SEQ ID NO: 1913532 - DNA, 17 bp, Homo sapiens
accatgctgtctggcac

SEQ ID NO: 1913533 - DNA, 18 bp, Homo sapiens
accatgctgtctggcaca

SEQ ID NO: 1913534 - DNA, 21 bp, Homo sapiens
accatgctgtctggcacagcc

SEQ ID NO: 1913535 - DNA, 16 bp, Homo sapiens
accattccataatcat

SEQ ID NO: 1913536 - DNA, 18 bp, Homo sapiens
accattccataatcatgt

SEQ ID NO: 1913537 - DNA, 16 bp, Homo sapiens
accattctgtattgat

SEQ ID NO: 1913538 - DNA, 18 bp, Homo sapiens
accatttccccagggcac

SEQ ID NO: 1913539 - DNA, 19 bp, Homo sapiens
accatttccccagggcacg

SEQ ID NO: 1913540 - DNA, 20 bp, Homo sapiens
acccagaaacaacacaatcc

SEQ ID NO: 1913541 - DNA, 11 bp, Homo sapiens
acccagtggca

SEQ ID NO: 1913542 - DNA, 17 bp, Homo sapiens
acccagtggcagggcac

SEQ ID NO: 1913543 - DNA, 24 bp, Homo sapiens
acccagtggcagggcacagggcct

SEQ ID NO: 1913544 - DNA, 20 bp, Homo sapiens
acccatccaccgtcccctcc

SEQ ID NO: 1913545 - DNA, 16 bp, Homo sapiens
acccatgggcaggaga

SEQ ID NO: 1913546 - DNA, 15 bp, Homo sapiens
accccaagcgccctg

SEQ ID NO: 1913547 - DNA, 21 bp, Homo sapiens
accccaagcgccctggccccc

SEQ ID NO: 1913548 - DNA, 23 bp, Homo sapiens
accccaagcgccctggcccccac

SEQ ID NO: 1913549 - DNA, 20 bp, Homo sapiens
accccactggagtctctctc

SEQ ID NO: 1913550 - DNA, 17 bp, Homo sapiens
accccgcagcacgcctc

SEQ ID NO: 1913551 - DNA, 21 bp, Homo sapiens
accccgcagcacgcctctccc

SEQ ID NO: 1913552 - DNA, 19 bp, Homo sapiens
acccctcgcccagtcccag

SEQ ID NO: 1913553 - DNA, 23 bp, Homo sapiens
acccctcgcccagtcccagcagc

SEQ ID NO: 1913554 - DNA, 24 bp, Homo sapiens
acccctcgcccagtcccagcagcc

SEQ ID NO: 1913555 - DNA, 15 bp, Homo sapiens
acccctgcagctggg

SEQ ID NO: 1913556 - DNA, 22 bp, Homo sapiens
acccctgcagttcccctggaag

SEQ ID NO: 1913557 - DNA, 15 bp, Homo sapiens
acccctggaccccag

SEQ ID NO: 1913558 - DNA, 20 bp, Homo sapiens
acccctggaccccagcctca

SEQ ID NO: 1913559 - DNA, 23 bp, Homo sapiens
acccctggaccccagcctcaaat

SEQ ID NO: 1913560 - DNA, 15 bp, Homo sapiens
acccgactccagtcc

SEQ ID NO: 1913561 - DNA, 12 bp, Homo sapiens
accctccaaggc

SEQ ID NO: 1913562 - DNA, 15 bp, Homo sapiens
accctgccaggcaca

SEQ ID NO: 1913563 - DNA, 19 bp, Homo sapiens
accctgccaggcacaggca

SEQ ID NO: 1913564 - DNA, 15 bp, Homo sapiens
accctgcttggccca

SEQ ID NO: 1913565 - DNA, 16 bp, Homo sapiens
accctgcttggcccag

SEQ ID NO: 1913566 - DNA, 17 bp, Homo sapiens
accctgcttggcccagg

SEQ ID NO: 1913567 - DNA, 14 bp, Homo sapiens
acccttatttaaaa

SEQ ID NO: 1913568 - DNA, 21 bp, Homo sapiens
accgaactgggcatatttcta

SEQ ID NO: 1913569 - DNA, 22 bp, Homo sapiens
accgaggacagcctgcctctgc

SEQ ID NO: 1913570 - DNA, 20 bp, Homo sapiens
accgtgaagatactttgtat

SEQ ID NO: 1913571 - DNA, 16 bp, Homo sapiens
acctaacccagaaaat

SEQ ID NO: 1913572 - DNA, 23 bp, Homo sapiens
acctaattgcacaacagagactg

SEQ ID NO: 1913573 - DNA, 14 bp, Homo sapiens
acctaccaaaaaat

SEQ ID NO: 1913574 - DNA, 22 bp, Homo sapiens
acctatccagagagtattctaa

SEQ ID NO: 1913575 - DNA, 20 bp, Homo sapiens
acctcaaatgatgtgcctgc

SEQ ID NO: 1913576 - DNA, 22 bp, Homo sapiens
acctcaaatgatgtgcctgctt

SEQ ID NO: 1913577 - DNA, 18 bp, Homo sapiens
acctcacacacctctgcc

SEQ ID NO: 1913578 - DNA, 19 bp, Homo sapiens
acctcacacacctctgccc

SEQ ID NO: 1913579 - DNA, 18 bp, Homo sapiens
acctcatgctagcctcac

SEQ ID NO: 1913580 - DNA, 18 bp, Homo sapiens
acctcctaaaaggcccag

SEQ ID NO: 1913581 - DNA, 14 bp, Homo sapiens
acctcctaaataaa

SEQ ID NO: 1913582 - DNA, 15 bp, Homo sapiens
acctctgtgcagggc

SEQ ID NO: 1913583 - DNA, 17 bp, Homo sapiens
acctcttcctggccggt

SEQ ID NO: 1913584 - DNA, 13 bp, Homo sapiens
acctctttggaaa

SEQ ID NO: 1913585 - DNA, 13 bp, Homo sapiens
acctgaaagttcc

SEQ ID NO: 1913586 - DNA, 15 bp, Homo sapiens
acctgcaaaaaatag

SEQ ID NO: 1913587 - DNA, 15 bp, Homo sapiens
acctggccctctctg

SEQ ID NO: 1913588 - DNA, 23 bp, Homo sapiens
acctggccctctctgaaggaggc

SEQ ID NO: 1913589 - DNA, 15 bp, Homo sapiens
acctgtaatgacagg

SEQ ID NO: 1913590 - DNA, 20 bp, Homo sapiens
accttctatagcatcactta

SEQ ID NO: 1913591 - DNA, 19 bp, Homo sapiens
accttcttgggactgctgt

SEQ ID NO: 1913592 - DNA, 22 bp, Homo sapiens
accttcttgggactgctgtgaa

SEQ ID NO: 1913593 - DNA, 15 bp, Homo sapiens
accttggttcctggg

SEQ ID NO: 1913594 - DNA, 20 bp, Homo sapiens
acctttctataattttacaa

SEQ ID NO: 1913595 - DNA, 21 bp, Homo sapiens
acgaaactggaataagccttc

SEQ ID NO: 1913596 - DNA, 21 bp, Homo sapiens
acgactcttttccaaacacag

SEQ ID NO: 1913597 - DNA, 20 bp, Homo sapiens
acgaggtcaggagatcgaga

SEQ ID NO: 1913598 - DNA, 14 bp, Homo sapiens
acgatcacaaatga

SEQ ID NO: 1913599 - DNA, 19 bp, Homo sapiens
acgatcacaaatgacttta

SEQ ID NO: 1913600 - DNA, 13 bp, Homo sapiens
acgcccacttccc

SEQ ID NO: 1913601 - DNA, 18 bp, Homo sapiens
acgcccacttccctgggt

SEQ ID NO: 1913602 - DNA, 16 bp, Homo sapiens
acgcctctccccacct

SEQ ID NO: 1913603 - DNA, 19 bp, Homo sapiens
acgcctgtaaatgtattca

SEQ ID NO: 1913604 - DNA, 16 bp, Homo sapiens
acgctgactacagggc

SEQ ID NO: 1913605 - DNA, 18 bp, Homo sapiens
acgctgactacagggccg

SEQ ID NO: 1913606 - DNA, 17 bp, Homo sapiens
acggttcctacacagga

SEQ ID NO: 1913607 - DNA, 20 bp, Homo sapiens
acggttcctacacaggacag

SEQ ID NO: 1913608 - DNA, 16 bp, Homo sapiens
acgtaatcaaatatgt

SEQ ID NO: 1913609 - DNA, 17 bp, Homo sapiens
acgtacaagtagttctg

SEQ ID NO: 1913610 - DNA, 20 bp, Homo sapiens
acgtacaagtagttctgtat

SEQ ID NO: 1913611 - DNA, 21 bp, Homo sapiens
acgtacaagtagttctgtatt

SEQ ID NO: 1913612 - DNA, 22 bp, Homo sapiens
acgtacaagtagttctgtattt

SEQ ID NO: 1913613 - DNA, 24 bp, Homo sapiens
acgtacaagtagttctgtatttga

SEQ ID NO: 1913614 - DNA, 17 bp, Homo sapiens
acgtcagatgtttaaaa

SEQ ID NO: 1913615 - DNA, 20 bp, Homo sapiens
acgtcagatgtttaaaacac

SEQ ID NO: 1913616 - DNA, 20 bp, Homo sapiens
acgtcattgtgtaaggaaaa

SEQ ID NO: 1913617 - DNA, 18 bp, Homo sapiens
acgtctatttcatcagaa

SEQ ID NO: 1913618 - DNA, 21 bp, Homo sapiens
acgtctatttcatcagaacag

SEQ ID NO: 1913619 - DNA, 19 bp, Homo sapiens
acgtttggttcaaatgtgt

SEQ ID NO: 1913620 - DNA, 12 bp, Homo sapiens
acgttttaagga

SEQ ID NO: 1913621 - DNA, 18 bp, Homo sapiens
acgttttaaggactgact

SEQ ID NO: 1913622 - DNA, 19 bp, Homo sapiens
acgttttaaggactgactg

SEQ ID NO: 1913623 - DNA, 19 bp, Homo sapiens
acgttttctactttgaaat

SEQ ID NO: 1913624 - DNA, 17 bp, Homo sapiens
acgttttttctgcacaa

SEQ ID NO: 1913625 - DNA, 12 bp, Homo sapiens
actaaaaataga

SEQ ID NO: 1913626 - DNA, 18 bp, Homo sapiens
actaaaaatatcacactg

SEQ ID NO: 1913627 - DNA, 15 bp, Homo sapiens
actaaaataattttg

SEQ ID NO: 1913628 - DNA, 19 bp, Homo sapiens
actaaaataattttgtaat

SEQ ID NO: 1913629 - DNA, 18 bp, Homo sapiens
actagattacattcagtt

SEQ ID NO: 1913630 - DNA, 22 bp, Homo sapiens
actatctagggagccctgggcc

SEQ ID NO: 1913631 - DNA, 19 bp, Homo sapiens
actcactggtggttttccg

SEQ ID NO: 1913632 - DNA, 22 bp, Homo sapiens
actcatatcccctatttaacag

SEQ ID NO: 1913633 - DNA, 19 bp, Homo sapiens
actcatctggagttctcaa

SEQ ID NO: 1913634 - DNA, 17 bp, Homo sapiens
actcattcttttttcta

SEQ ID NO: 1913635 - DNA, 23 bp, Homo sapiens
actccaaaccttactctgagctc

SEQ ID NO: 1913636 - DNA, 12 bp, Homo sapiens
actcccacccta

SEQ ID NO: 1913637 - DNA, 15 bp, Homo sapiens
actcccaccctaccc

SEQ ID NO: 1913638 - DNA, 18 bp, Homo sapiens
actcccaccctaccccct

SEQ ID NO: 1913639 - DNA, 20 bp, Homo sapiens
actcccaccctacccccttt

SEQ ID NO: 1913640 - DNA, 18 bp, Homo sapiens
actcccatggctctgggc

SEQ ID NO: 1913641 - DNA, 11 bp, Homo sapiens
actcctcctcc

SEQ ID NO: 1913642 - DNA, 14 bp, Homo sapiens
actcctcctccttt

SEQ ID NO: 1913643 - DNA, 15 bp, Homo sapiens
actcctcctcctttc

SEQ ID NO: 1913644 - DNA, 23 bp, Homo sapiens
actcggatgtgtcctttctgaac

SEQ ID NO: 1913645 - DNA, 13 bp, Homo sapiens
actctaggactgg

SEQ ID NO: 1913646 - DNA, 17 bp, Homo sapiens
actctagtactgtgaat

SEQ ID NO: 1913647 - DNA, 15 bp, Homo sapiens
actctcagaggcccc

SEQ ID NO: 1913648 - DNA, 16 bp, Homo sapiens
actctcagaggcccca

SEQ ID NO: 1913649 - DNA, 22 bp, Homo sapiens
actctcaggaaatgctgaccca

SEQ ID NO: 1913650 - DNA, 10 bp, Homo sapiens
actctctctc

SEQ ID NO: 1913651 - DNA, 17 bp, Homo sapiens
agcttccagcaggaggg

SEQ ID NO: 1913652 - DNA, 23 bp, Homo sapiens
agcttctagtctggaactgctgc

SEQ ID NO: 1913653 - DNA, 17 bp, Homo sapiens
agcttctataagtgtga

SEQ ID NO: 1913654 - DNA, 12 bp, Homo sapiens
agcttgggctgg

SEQ ID NO: 1913655 - DNA, 15 bp, Homo sapiens
agcttgggctggcgg

SEQ ID NO: 1913656 - DNA, 13 bp, Homo sapiens
agcttgtatctga

SEQ ID NO: 1913657 - DNA, 23 bp, Homo sapiens
agctttctgagcaagaggatttt

SEQ ID NO: 1913658 - DNA, 19 bp, Homo sapiens
agctttgtaattcagaaat

SEQ ID NO: 1913659 - DNA, 22 bp, Homo sapiens
aggaaactaactggtgtgagtc

SEQ ID NO: 1913660 - DNA, 14 bp, Homo sapiens
aggaaactttgaac

SEQ ID NO: 1913661 - DNA, 19 bp, Homo sapiens
aggaaatcaaagtgctatt

SEQ ID NO: 1913662 - DNA, 11 bp, Homo sapiens
aggaagaaatt

SEQ ID NO: 1913663 - DNA, 20 bp, Homo sapiens
aggaaggctgtctcagataa

SEQ ID NO: 1913664 - DNA, 15 bp, Homo sapiens
aggaagtagcacagg

SEQ ID NO: 1913665 - DNA, 23 bp, Homo sapiens
aggaattgatacgtttattagga

SEQ ID NO: 1913666 - DNA, 15 bp, Homo sapiens
aggacactaagagga

SEQ ID NO: 1913667 - DNA, 17 bp, Homo sapiens
aggacactgcagaacag

SEQ ID NO: 1913668 - DNA, 14 bp, Homo sapiens
aggacagcctgcct

SEQ ID NO: 1913669 - DNA, 16 bp, Homo sapiens
aggacagcctgcctct

SEQ ID NO: 1913670 - DNA, 13 bp, Homo sapiens
aggaccagcccac

SEQ ID NO: 1913671 - DNA, 14 bp, Homo sapiens
aggaccagcccacg

SEQ ID NO: 1913672 - DNA, 18 bp, Homo sapiens
aggaccagcccacgctga

SEQ ID NO: 1913673 - DNA, 20 bp, Homo sapiens
aggacccctgcagttcccct

SEQ ID NO: 1913674 - DNA, 14 bp, Homo sapiens
aggaccctgccagg

SEQ ID NO: 1913675 - DNA, 23 bp, Homo sapiens
aggaccctgccaggcacaggcag

SEQ ID NO: 1913676 - DNA, 17 bp, Homo sapiens
aggactgactgaggcag

SEQ ID NO: 1913677 - DNA, 18 bp, Homo sapiens
aggactgactgaggcagt

SEQ ID NO: 1913678 - DNA, 21 bp, Homo sapiens
aggactgggcccgagggtggt

SEQ ID NO: 1913679 - DNA, 20 bp, Homo sapiens
aggagaatggcgtgaacccg

SEQ ID NO: 1913680 - DNA, 22 bp, Homo sapiens
aggagataatgtggattaaaac

SEQ ID NO: 1913681 - DNA, 21 bp, Homo sapiens
aggagcaggccctgggcctcc

SEQ ID NO: 1913682 - DNA, 14 bp, Homo sapiens
aggagccctgcctc

SEQ ID NO: 1913683 - DNA, 22 bp, Homo sapiens
aggaggatgcctaacagagagt

SEQ ID NO: 1913684 - DNA, 14 bp, Homo sapiens
aggaggcagagagg

SEQ ID NO: 1913685 - DNA, 21 bp, Homo sapiens
aggaggcagagagggtcactg

SEQ ID NO: 1913686 - DNA, 13 bp, Homo sapiens
aggaggcaggagt

SEQ ID NO: 1913687 - DNA, 16 bp, Homo sapiens
aggaggcaggagttgg

SEQ ID NO: 1913688 - DNA, 11 bp, Homo sapiens
aggaggccacc

SEQ ID NO: 1913689 - DNA, 13 bp, Homo sapiens
aggaggccacctc

SEQ ID NO: 1913690 - DNA, 22 bp, Homo sapiens
aggagggactctgtctggccag

SEQ ID NO: 1913691 - DNA, 18 bp, Homo sapiens
aggagtggattcctcccc

SEQ ID NO: 1913692 - DNA, 22 bp, Homo sapiens
aggagtggattcctccccaccc

SEQ ID NO: 1913693 - DNA, 15 bp, Homo sapiens
aggatacaggctgga

SEQ ID NO: 1913694 - DNA, 21 bp, Homo sapiens
aggatatcggcatttgtttct

SEQ ID NO: 1913695 - DNA, 15 bp, Homo sapiens
aggattagtttagaa

SEQ ID NO: 1913696 - DNA, 18 bp, Homo sapiens
aggcaaatccgaaatcag

SEQ ID NO: 1913697 - DNA, 14 bp, Homo sapiens
aggcacaggcaggg

SEQ ID NO: 1913698 - DNA, 21 bp, Homo sapiens
aggcacatggaatatatttta

SEQ ID NO: 1913699 - DNA, 13 bp, Homo sapiens
aggcacccttcca

SEQ ID NO: 1913700 - DNA, 19 bp, Homo sapiens
aggcagaaagcaaaattat

SEQ ID NO: 1913701 - DNA, 18 bp, Homo sapiens
aggcagcacgtgcacaaa

SEQ ID NO: 1913702 - DNA, 17 bp, Homo sapiens
aggcagcgccactgtcc

SEQ ID NO: 1913703 - DNA, 20 bp, Homo sapiens
aggcagggcaggaccagccc

SEQ ID NO: 1913704 - DNA, 23 bp, Homo sapiens
aggcaggtgatctgctgcagagc

SEQ ID NO: 1913705 - DNA, 13 bp, Homo sapiens
aggcatctctctg

SEQ ID NO: 1913706 - DNA, 17 bp, Homo sapiens
aggcatctctctgggat

SEQ ID NO: 1913707 - DNA, 16 bp, Homo sapiens
aggcatgttggactct

SEQ ID NO: 1913708 - DNA, 20 bp, Homo sapiens
aggcatgttggactctgagc

SEQ ID NO: 1913709 - DNA, 16 bp, Homo sapiens
aggccaagagtggccc

SEQ ID NO: 1913710 - DNA, 18 bp, Homo sapiens
aggccaagagtggcccca

SEQ ID NO: 1913711 - DNA, 20 bp, Homo sapiens
aggccaagagtggccccacc

SEQ ID NO: 1913712 - DNA, 16 bp, Homo sapiens
aggccaatcagaagct

SEQ ID NO: 1913713 - DNA, 12 bp, Homo sapiens
aggccaatgggc

SEQ ID NO: 1913714 - DNA, 15 bp, Homo sapiens
aggccaatgggctag

SEQ ID NO: 1913715 - DNA, 21 bp, Homo sapiens
aggccaatgggctagagggtg

SEQ ID NO: 1913716 - DNA, 13 bp, Homo sapiens
aggccacctccta

SEQ ID NO: 1913717 - DNA, 21 bp, Homo sapiens
aggccacctcctaaaaggccc

SEQ ID NO: 1913718 - DNA, 23 bp, Homo sapiens
aggccacctcttcctggccggtg

SEQ ID NO: 1913719 - DNA, 13 bp, Homo sapiens
aggccagcagcct

SEQ ID NO: 1913720 - DNA, 14 bp, Homo sapiens
aggcccaccctgct

SEQ ID NO: 1913721 - DNA, 22 bp, Homo sapiens
aggcccagagagaagagcccca

SEQ ID NO: 1913722 - DNA, 23 bp, Homo sapiens
aggcccagcgcggacatcccctg

SEQ ID NO: 1913723 - DNA, 13 bp, Homo sapiens
aggcccatggcca

SEQ ID NO: 1913724 - DNA, 19 bp, Homo sapiens
aggccccaataccccatgg

SEQ ID NO: 1913725 - DNA, 19 bp, Homo sapiens
aggccctcctccctcccag

SEQ ID NO: 1913726 - DNA, 13 bp, Homo sapiens
aggccctgggcct

SEQ ID NO: 1913727 - DNA, 19 bp, Homo sapiens
aggccctgggcctccacct

SEQ ID NO: 1913728 - DNA, 23 bp, Homo sapiens
aggccgttgctgacttagaatcc

SEQ ID NO: 1913729 - DNA, 18 bp, Homo sapiens
aggcgagcagggcaggcc

SEQ ID NO: 1913730 - DNA, 19 bp, Homo sapiens
aggcgcaagggaggcccag

SEQ ID NO: 1913731 - DNA, 21 bp, Homo sapiens
aggcggccggccgcactggga

SEQ ID NO: 1913732 - DNA, 17 bp, Homo sapiens
aggctcctcagccctct

SEQ ID NO: 1913733 - DNA, 20 bp, Homo sapiens
aggctcctcagccctctctt

SEQ ID NO: 1913734 - DNA, 13 bp, Homo sapiens
aggctcgagctcg

SEQ ID NO: 1913735 - DNA, 19 bp, Homo sapiens
aggctcgagctcggggctg

SEQ ID NO: 1913736 - DNA, 20 bp, Homo sapiens
aggctcgagctcggggctgg

SEQ ID NO: 1913737 - DNA, 14 bp, Homo sapiens
aggctgagtgcagg

SEQ ID NO: 1913738 - DNA, 18 bp, Homo sapiens
aggctgagtgcaggccca

SEQ ID NO: 1913739 - DNA, 16 bp, Homo sapiens
aggctgctgccaggcc

SEQ ID NO: 1913740 - DNA, 18 bp, Homo sapiens
aggctgctgccaggcccg

SEQ ID NO: 1913741 - DNA, 22 bp, Homo sapiens
aggctgtctcagataaattatg

SEQ ID NO: 1913742 - DNA, 16 bp, Homo sapiens
aggctgtggtcagaga

SEQ ID NO: 1913743 - DNA, 13 bp, Homo sapiens
aggcttggctcct

SEQ ID NO: 1913744 - DNA, 19 bp, Homo sapiens
aggctttatttataaaata

SEQ ID NO: 1913745 - DNA, 16 bp, Homo sapiens
agggaaagactggcaa

SEQ ID NO: 1913746 - DNA, 17 bp, Homo sapiens
agggaagctgaggccca

SEQ ID NO: 1913747 - DNA, 19 bp, Homo sapiens
agggaagctgaggcccatg

SEQ ID NO: 1913748 - DNA, 22 bp, Homo sapiens
agggaagctgaggcccatggcc

SEQ ID NO: 1913749 - DNA, 16 bp, Homo sapiens
agggacagtctcacca

SEQ ID NO: 1913750 - DNA, 15 bp, Homo sapiens
agggactctgtctgg

SEQ ID NO: 1913751 - DNA, 16 bp, Homo sapiens
agggagacagaccact

SEQ ID NO: 1913752 - DNA, 15 bp, Homo sapiens
agggagccctgggcc

SEQ ID NO: 1913753 - DNA, 18 bp, Homo sapiens
agggagccctgggccagg

SEQ ID NO: 1913754 - DNA, 14 bp, Homo sapiens
agggaggcccagcg

SEQ ID NO: 1913755 - DNA, 15 bp, Homo sapiens
agggcacagaaggct

SEQ ID NO: 1913756 - DNA, 15 bp, Homo sapiens
agggcacagggcctg

SEQ ID NO: 1913757 - DNA, 16 bp, Homo sapiens
agggcacagggcctgg

SEQ ID NO: 1913758 - DNA, 18 bp, Homo sapiens
agggcacagggcctggcc

SEQ ID NO: 1913759 - DNA, 12 bp, Homo sapiens
agggcaggacca

SEQ ID NO: 1913760 - DNA, 18 bp, Homo sapiens
agggcaggaccagcccac

SEQ ID NO: 1913761 - DNA, 18 bp, Homo sapiens
agggcagggacagggccg

SEQ ID NO: 1913762 - DNA, 13 bp, Homo sapiens
agggcatttggct

SEQ ID NO: 1913763 - DNA, 19 bp, Homo sapiens
agggcatttggcttcctct

SEQ ID NO: 1913764 - DNA, 24 bp, Homo sapiens
agggcatttggcttcctctgctgc

SEQ ID NO: 1913765 - DNA, 17 bp, Homo sapiens
agggcccgggcccaggc

SEQ ID NO: 1913766 - DNA, 13 bp, Homo sapiens
agggcctcagttt

SEQ ID NO: 1913767 - DNA, 15 bp, Homo sapiens
agggccttctgcctg

SEQ ID NO: 1913768 - DNA, 16 bp, Homo sapiens
agggccttctgcctgc

SEQ ID NO: 1913769 - DNA, 14 bp, Homo sapiens
agggctgggtcagg

SEQ ID NO: 1913770 - DNA, 15 bp, Homo sapiens
agggcttgtagttct

SEQ ID NO: 1913771 - DNA, 17 bp, Homo sapiens
aggggactgccacctcc

SEQ ID NO: 1913772 - DNA, 15 bp, Homo sapiens
aggggagacagagca

SEQ ID NO: 1913773 - DNA, 19 bp, Homo sapiens
aggggatccagctcaaggg

SEQ ID NO: 1913774 - DNA, 18 bp, Homo sapiens
aggggccaagcaggcact

SEQ ID NO: 1913775 - DNA, 16 bp, Homo sapiens
agggggacctcgggct

SEQ ID NO: 1913776 - DNA, 12 bp, Homo sapiens
agggggcttcct

SEQ ID NO: 1913777 - DNA, 22 bp, Homo sapiens
aggggtacacagagctaaggcc

SEQ ID NO: 1913778 - DNA, 22 bp, Homo sapiens
aggggtcttgcaaaattcctga

SEQ ID NO: 1913779 - DNA, 19 bp, Homo sapiens
aggggttccttctgggcat

SEQ ID NO: 1913780 - DNA, 21 bp, Homo sapiens
agggtctctagtgctgtgaaa

SEQ ID NO: 1913781 - DNA, 22 bp, Homo sapiens
agggtctctagtgctgtgaaaa

SEQ ID NO: 1913782 - DNA, 14 bp, Homo sapiens
agggtgtgaggcca

SEQ ID NO: 1913783 - DNA, 21 bp, Homo sapiens
agtttttcctaacgttttcta

SEQ ID NO: 1913784 - DNA, 18 bp, Homo sapiens
ataaaaaaaagaaaaaag

SEQ ID NO: 1913785 - DNA, 14 bp, Homo sapiens
ataaaaaatgacaa

SEQ ID NO: 1913786 - DNA, 24 bp, Homo sapiens
ataaaactgctagtgagttattgt

SEQ ID NO: 1913787 - DNA, 19 bp, Homo sapiens
ataaaagcctttgaaaata

SEQ ID NO: 1913788 - DNA, 20 bp, Homo sapiens
ataaaagtgccttagcatgt

SEQ ID NO: 1913789 - DNA, 22 bp, Homo sapiens
ataaaagtgccttagcatgtgt

SEQ ID NO: 1913790 - DNA, 20 bp, Homo sapiens
ataaacgcgggaaaaaagat

SEQ ID NO: 1913791 - DNA, 20 bp, Homo sapiens
ataaagataaatgcaaccat

SEQ ID NO: 1913792 - DNA, 14 bp, Homo sapiens
ataaagcaataaga

SEQ ID NO: 1913793 - DNA, 22 bp, Homo sapiens
ataaagctcgtccccattgctt

SEQ ID NO: 1913794 - DNA, 16 bp, Homo sapiens
ataaagtatttttata

SEQ ID NO: 1913795 - DNA, 22 bp, Homo sapiens
ataaagtatttttataatgact

SEQ ID NO: 1913796 - DNA, 19 bp, Homo sapiens
ataaagtgaacagatttta

SEQ ID NO: 1913797 - DNA, 23 bp, Homo sapiens
ataaatggcccggacatgtcttg

SEQ ID NO: 1913798 - DNA, 15 bp, Homo sapiens
ataaatgtattgatt

SEQ ID NO: 1913799 - DNA, 15 bp, Homo sapiens
ataaattatttgtta

SEQ ID NO: 1913800 - DNA, 14 bp, Homo sapiens
ataaattttgaaaa

SEQ ID NO: 1913801 - DNA, 18 bp, Homo sapiens
ataacaaaaaagagaaac

SEQ ID NO: 1913802 - DNA, 15 bp, Homo sapiens
ataacagtagtgtta

SEQ ID NO: 1913803 - DNA, 16 bp, Homo sapiens
ataactgttgttgata

SEQ ID NO: 1913804 - DNA, 21 bp, Homo sapiens
ataactgttgttgataaggaa

SEQ ID NO: 1913805 - DNA, 12 bp, Homo sapiens
ataagaaaagat

SEQ ID NO: 1913806 - DNA, 16 bp, Homo sapiens
ataagaggttctaact

SEQ ID NO: 1913807 - DNA, 20 bp, Homo sapiens
ataagatattttattttgaa

SEQ ID NO: 1913808 - DNA, 21 bp, Homo sapiens
ataagcaaaatgaaaagagaa

SEQ ID NO: 1913809 - DNA, 18 bp, Homo sapiens
ataagcactcctttaaag

SEQ ID NO: 1913810 - DNA, 15 bp, Homo sapiens
ataagcagttatgtg

SEQ ID NO: 1913811 - DNA, 18 bp, Homo sapiens
ataagctagttgaatact

SEQ ID NO: 1913812 - DNA, 20 bp, Homo sapiens
ataagctagttgaatacttg

SEQ ID NO: 1913813 - DNA, 23 bp, Homo sapiens
ataagctagttgaatacttgaac

SEQ ID NO: 1913814 - DNA, 20 bp, Homo sapiens
ataagtgtgaccagttttga

SEQ ID NO: 1913815 - DNA, 13 bp, Homo sapiens
ataataaagaata

SEQ ID NO: 1913816 - DNA, 13 bp, Homo sapiens
ataataatcatga

SEQ ID NO: 1913817 - DNA, 19 bp, Homo sapiens
ataatagtcacctgctgtt

SEQ ID NO: 1913818 - DNA, 19 bp, Homo sapiens
ataatatgtttccttccct

SEQ ID NO: 1913819 - DNA, 22 bp, Homo sapiens
ataatcaagagccttaaaacat

SEQ ID NO: 1913820 - DNA, 15 bp, Homo sapiens
ataatcatgttagag

SEQ ID NO: 1913821 - DNA, 20 bp, Homo sapiens
ataatggagaattaaaactt

SEQ ID NO: 1913822 - DNA, 22 bp, Homo sapiens
ataatgtctagattttgaaaaa

SEQ ID NO: 1913823 - DNA, 23 bp, Homo sapiens
ataatgtctagattttgaaaaat

SEQ ID NO: 1913824 - DNA, 22 bp, Homo sapiens
ataattgatgatgttgtaaaat

SEQ ID NO: 1913825 - DNA, 17 bp, Homo sapiens
ataattgtactttgaaa

SEQ ID NO: 1913826 - DNA, 18 bp, Homo sapiens
ataattgtactttgaaaa

SEQ ID NO: 1913827 - DNA, 13 bp, Homo sapiens
ataattttccttt

SEQ ID NO: 1913828 - DNA, 19 bp, Homo sapiens
ataattttcctttaatatg

SEQ ID NO: 1913829 - DNA, 12 bp, Homo sapiens
ataattttgtaa

SEQ ID NO: 1913830 - DNA, 13 bp, Homo sapiens
ataattttgtaat

SEQ ID NO: 1913831 - DNA, 14 bp, Homo sapiens
atacaaaactatta

SEQ ID NO: 1913832 - DNA, 21 bp, Homo sapiens
atacaaatgggttaatcctga

SEQ ID NO: 1913833 - DNA, 15 bp, Homo sapiens
atacacaagtaaaca

SEQ ID NO: 1913834 - DNA, 21 bp, Homo sapiens
atacagaccgaactgttgtat

SEQ ID NO: 1913835 - DNA, 13 bp, Homo sapiens
atacatcaaggag

SEQ ID NO: 1913836 - DNA, 15 bp, Homo sapiens
atacatgtttgcagt

SEQ ID NO: 1913837 - DNA, 18 bp, Homo sapiens
ataccaactgggcctctg

SEQ ID NO: 1913838 - DNA, 24 bp, Homo sapiens
ataccaactgggcctctgatgttc

SEQ ID NO: 1913839 - DNA, 19 bp, Homo sapiens
atactagaatcagatacaa

SEQ ID NO: 1913840 - DNA, 22 bp, Homo sapiens
atactgatggaatttttttgta

SEQ ID NO: 1913841 - DNA, 21 bp, Homo sapiens
atactgcaaactatttaaaga

SEQ ID NO: 1913842 - DNA, 19 bp, Homo sapiens
atactgcttgaataaacac

SEQ ID NO: 1913843 - DNA, 18 bp, Homo sapiens
atacttgaaccataaaat

SEQ ID NO: 1913844 - DNA, 22 bp, Homo sapiens
atacttgaaccataaaatgtcc

SEQ ID NO: 1913845 - DNA, 18 bp, Homo sapiens
atagaaatttgcccctgg

SEQ ID NO: 1913846 - DNA, 19 bp, Homo sapiens
atagacacttgagttaact

SEQ ID NO: 1913847 - DNA, 21 bp, Homo sapiens
atagacacttgagttaacttt

SEQ ID NO: 1913848 - DNA, 15 bp, Homo sapiens
atagacagcatgaga

SEQ ID NO: 1913849 - DNA, 16 bp, Homo sapiens
atagcagtagtctttt

SEQ ID NO: 1913850 - DNA, 20 bp, Homo sapiens
atagcccaggatatatttta

SEQ ID NO: 1913851 - DNA, 21 bp, Homo sapiens
atagcccaggatatattttat

SEQ ID NO: 1913852 - DNA, 15 bp, Homo sapiens
atagctttatttctt

SEQ ID NO: 1913853 - DNA, 23 bp, Homo sapiens
atagtagtctgtgtttaaagtga

SEQ ID NO: 1913854 - DNA, 18 bp, Homo sapiens
atagtagtctttaaaaga

SEQ ID NO: 1913855 - DNA, 16 bp, Homo sapiens
atagtgggaccacata

SEQ ID NO: 1913856 - DNA, 17 bp, Homo sapiens
atagttatgtaaataat

SEQ ID NO: 1913857 - DNA, 18 bp, Homo sapiens
atagttatgtaaataatt

SEQ ID NO: 1913858 - DNA, 21 bp, Homo sapiens
atagtttaaaaatctgccacc

SEQ ID NO: 1913859 - DNA, 19 bp, Homo sapiens
atagtttattttaaaacaa

SEQ ID NO: 1913860 - DNA, 18 bp, Homo sapiens
atagttttatttatattt

SEQ ID NO: 1913861 - DNA, 12 bp, Homo sapiens
atataaagtatt

SEQ ID NO: 1913862 - DNA, 14 bp, Homo sapiens
atataaagtatttt

SEQ ID NO: 1913863 - DNA, 22 bp, Homo sapiens
atataaagtatttttataatga

SEQ ID NO: 1913864 - DNA, 16 bp, Homo sapiens
atataaattgtcttaa

SEQ ID NO: 1913865 - DNA, 18 bp, Homo sapiens
atataagacttaatatgt

SEQ ID NO: 1913866 - DNA, 22 bp, Homo sapiens
atatatttcacgtgttccctct

SEQ ID NO: 1913867 - DNA, 11 bp, Homo sapiens
atatattttag

SEQ ID NO: 1913868 - DNA, 19 bp, Homo sapiens
atatattttgaaatattga

SEQ ID NO: 1913869 - DNA, 21 bp, Homo sapiens
atatatttttactgctttctg

SEQ ID NO: 1913870 - DNA, 20 bp, Homo sapiens
atatatttttcttatttatg

SEQ ID NO: 1913871 - DNA, 18 bp, Homo sapiens
atatcaaattaattgtgt

SEQ ID NO: 1913872 - DNA, 19 bp, Homo sapiens
atatcaaattaattgtgtg

SEQ ID NO: 1913873 - DNA, 20 bp, Homo sapiens
atatcaaattaattgtgtga

SEQ ID NO: 1913874 - DNA, 17 bp, Homo sapiens
atatcagcactggattg

SEQ ID NO: 1913875 - DNA, 11 bp, Homo sapiens
atatgattaaa

SEQ ID NO: 1913876 - DNA, 17 bp, Homo sapiens
atatgattaaaaatatc

SEQ ID NO: 1913877 - DNA, 21 bp, Homo sapiens
atatggaggttcaatgagatg

SEQ ID NO: 1913878 - DNA, 23 bp, Homo sapiens
atatgtatctttataattgatga

SEQ ID NO: 1913879 - DNA, 15 bp, Homo sapiens
atatgtatgtgttta

SEQ ID NO: 1913880 - DNA, 19 bp, Homo sapiens
atatgtatgtgtttagaat

SEQ ID NO: 1913881 - DNA, 18 bp, Homo sapiens
atatgtgaacgcccagag

SEQ ID NO: 1913882 - DNA, 22 bp, Homo sapiens
atatgtggtccatctctgaaaa

SEQ ID NO: 1913883 - DNA, 20 bp, Homo sapiens
atattaagtaagtctcaagg

SEQ ID NO: 1913884 - DNA, 23 bp, Homo sapiens
atattcccctaagatttgatata

SEQ ID NO: 1913885 - DNA, 14 bp, Homo sapiens
atattctattttac

SEQ ID NO: 1913886 - DNA, 23 bp, Homo sapiens
atattctgtggaaaaataaagga

SEQ ID NO: 1913887 - DNA, 12 bp, Homo sapiens
atattctttcaa

SEQ ID NO: 1913888 - DNA, 21 bp, Homo sapiens
atattgaggagcactgaaagt

SEQ ID NO: 1913889 - DNA, 22 bp, Homo sapiens
atattgcagtgtgaatgctggg

SEQ ID NO: 1913890 - DNA, 12 bp, Homo sapiens
atattggtttta

SEQ ID NO: 1913891 - DNA, 15 bp, Homo sapiens
atattgtaagaaata

SEQ ID NO: 1913892 - DNA, 20 bp, Homo sapiens
atattgtctcttttttaagt

SEQ ID NO: 1913893 - DNA, 14 bp, Homo sapiens
atatttaagcaata

SEQ ID NO: 1913894 - DNA, 20 bp, Homo sapiens
atatttagatgtaattttgt

SEQ ID NO: 1913895 - DNA, 17 bp, Homo sapiens
atatttcaagtacactg

SEQ ID NO: 1913896 - DNA, 18 bp, Homo sapiens
atatttcaagtacactga

SEQ ID NO: 1913897 - DNA, 12 bp, Homo sapiens
atatttgattta

SEQ ID NO: 1913898 - DNA, 16 bp, Homo sapiens
atatttgatttattaa

SEQ ID NO: 1913899 - DNA, 14 bp, Homo sapiens
atatttggaataaa

SEQ ID NO: 1913900 - DNA, 23 bp, Homo sapiens
atatttggaataaaaattccaga

SEQ ID NO: 1913901 - DNA, 13 bp, Homo sapiens
atattttgaaata

SEQ ID NO: 1913902 - DNA, 14 bp, Homo sapiens
atattttgaaatat

SEQ ID NO: 1913903 - DNA, 13 bp, Homo sapiens
atattttgtaaat

SEQ ID NO: 1913904 - DNA, 14 bp, Homo sapiens
atatttttactgct

SEQ ID NO: 1913905 - DNA, 21 bp, Homo sapiens
atatttttcttatttatgtaa

SEQ ID NO: 1913906 - DNA, 22 bp, Homo sapiens
atatttttgatctttgagtgta

SEQ ID NO: 1913907 - DNA, 15 bp, Homo sapiens
atattttttctcaaa

SEQ ID NO: 1913908 - DNA, 23 bp, Homo sapiens
atcaaaaaggcttataaaacaga

SEQ ID NO: 1913909 - DNA, 13 bp, Homo sapiens
atcaaatgtaaag

SEQ ID NO: 1913910 - DNA, 17 bp, Homo sapiens
atcaaattaattgtgtg

SEQ ID NO: 1913911 - DNA, 15 bp, Homo sapiens
atcaagagccttaaa

SEQ ID NO: 1913912 - DNA, 18 bp, Homo sapiens
atcaagagccttaaaaca

SEQ ID NO: 1913913 - DNA, 23 bp, Homo sapiens
atcaagaggacaatctagctctc

SEQ ID NO: 1913914 - DNA, 16 bp, Homo sapiens
atttattaacttaata

SEQ ID NO: 1913915 - DNA, 23 bp, Homo sapiens
atttattaacttaataatcaaga

SEQ ID NO: 1913916 - DNA, 22 bp, Homo sapiens
atttattgactcttgagttgtt

SEQ ID NO: 1913917 - DNA, 20 bp, Homo sapiens
atttatttcttttttgccaa

SEQ ID NO: 1913918 - DNA, 18 bp, Homo sapiens
atttatttttaagaaaga

SEQ ID NO: 1913919 - DNA, 19 bp, Homo sapiens
atttatttttaagaaagaa

SEQ ID NO: 1913920 - DNA, 23 bp, Homo sapiens
atttattttttttaattgtattt

SEQ ID NO: 1913921 - DNA, 21 bp, Homo sapiens
atttcacttgaaattaaagct

SEQ ID NO: 1913922 - DNA, 18 bp, Homo sapiens
atttcatcatattataca

SEQ ID NO: 1913923 - DNA, 21 bp, Homo sapiens
atttctctagaggctggcaag

SEQ ID NO: 1913924 - DNA, 14 bp, Homo sapiens
atttgaaagtgcct

SEQ ID NO: 1913925 - DNA, 13 bp, Homo sapiens
atttgaataatgt

SEQ ID NO: 1913926 - DNA, 15 bp, Homo sapiens
atttgatatatgtat

SEQ ID NO: 1913927 - DNA, 14 bp, Homo sapiens
atttgcccctggca

SEQ ID NO: 1913928 - DNA, 14 bp, Homo sapiens
atttgctttggaag

SEQ ID NO: 1913929 - DNA, 14 bp, Homo sapiens
atttggaacttaca

SEQ ID NO: 1913930 - DNA, 17 bp, Homo sapiens
atttggaacttacaaag

SEQ ID NO: 1913931 - DNA, 21 bp, Homo sapiens
atttggaataaaaattccaga

SEQ ID NO: 1913932 - DNA, 20 bp, Homo sapiens
atttggaatgtacatactga

SEQ ID NO: 1913933 - DNA, 15 bp, Homo sapiens
atttggagggcctgg

SEQ ID NO: 1913934 - DNA, 16 bp, Homo sapiens
atttggcttatattct

SEQ ID NO: 1913935 - DNA, 11 bp, Homo sapiens
atttggcttcc

SEQ ID NO: 1913936 - DNA, 15 bp, Homo sapiens
atttggcttcctctg

SEQ ID NO: 1913937 - DNA, 15 bp, Homo sapiens
atttggggaccacag

SEQ ID NO: 1913938 - DNA, 19 bp, Homo sapiens
atttggggaccacagaggc

SEQ ID NO: 1913939 - DNA, 21 bp, Homo sapiens
atttggtctctcccagctctg

SEQ ID NO: 1913940 - DNA, 22 bp, Homo sapiens
atttggtctctcccagctctgg

SEQ ID NO: 1913941 - DNA, 15 bp, Homo sapiens
atttgtgcacactca

SEQ ID NO: 1913942 - DNA, 15 bp, Homo sapiens
atttgtggtgatttg

SEQ ID NO: 1913943 - DNA, 21 bp, Homo sapiens
atttgtgtggagtcatttctg

SEQ ID NO: 1913944 - DNA, 23 bp, Homo sapiens
atttgtgtggagtcatttctgat

SEQ ID NO: 1913945 - DNA, 21 bp, Homo sapiens
atttgtttaaggttaattatg

SEQ ID NO: 1913946 - DNA, 21 bp, Homo sapiens
atttgtttaataccctgtaca

SEQ ID NO: 1913947 - DNA, 23 bp, Homo sapiens
atttgtttaataccctgtacata

SEQ ID NO: 1913948 - DNA, 20 bp, Homo sapiens
atttgtttctttctctgagg

SEQ ID NO: 1913949 - DNA, 13 bp, Homo sapiens
attttaaaacaat

SEQ ID NO: 1913950 - DNA, 15 bp, Homo sapiens
attttaaacagagga

SEQ ID NO: 1913951 - DNA, 22 bp, Homo sapiens
attttagttttgtattatcaat

SEQ ID NO: 1913952 - DNA, 15 bp, Homo sapiens
attttcacagcacta

SEQ ID NO: 1913953 - DNA, 21 bp, Homo sapiens
attttcagaagctgatgagga

SEQ ID NO: 1913954 - DNA, 13 bp, Homo sapiens
attttcagacatt

SEQ ID NO: 1913955 - DNA, 13 bp, Homo sapiens
attttcctttaat

SEQ ID NO: 1913956 - DNA, 12 bp, Homo sapiens
attttgaaaaat

SEQ ID NO: 1913957 - DNA, 17 bp, Homo sapiens
attttgaaaagtaatat

SEQ ID NO: 1913958 - DNA, 13 bp, Homo sapiens
attttgaccttgt

SEQ ID NO: 1913959 - DNA, 15 bp, Homo sapiens
attttgaccttgtat

SEQ ID NO: 1913960 - DNA, 14 bp, Homo sapiens
attttgatagtggg

SEQ ID NO: 1913961 - DNA, 17 bp, Homo sapiens
attttgcgtcagagaaa

SEQ ID NO: 1913962 - DNA, 10 bp, Homo sapiens
attttggtct

SEQ ID NO: 1913963 - DNA, 14 bp, Homo sapiens
attttggttttcta

SEQ ID NO: 1913964 - DNA, 17 bp, Homo sapiens
attttggttttctactg

SEQ ID NO: 1913965 - DNA, 15 bp, Homo sapiens
attttgtatttaaaa

SEQ ID NO: 1913966 - DNA, 20 bp, Homo sapiens
attttgtgaaacagacttgt

SEQ ID NO: 1913967 - DNA, 22 bp, Homo sapiens
attttgtgaaacagacttgtat

SEQ ID NO: 1913968 - DNA, 20 bp, Homo sapiens
atttttactgctttctgaat

SEQ ID NO: 1913969 - DNA, 11 bp, Homo sapiens
atttttctctc

SEQ ID NO: 1913970 - DNA, 17 bp, Homo sapiens
atttttcttatttatgt

SEQ ID NO: 1913971 - DNA, 22 bp, Homo sapiens
atttttcttatttatgtaacaa

SEQ ID NO: 1913972 - DNA, 15 bp, Homo sapiens
atttttgcttttgat

SEQ ID NO: 1913973 - DNA, 21 bp, Homo sapiens
atttttgcttttgataagaaa

SEQ ID NO: 1913974 - DNA, 23 bp, Homo sapiens
atttttttgaactcttctcatta

SEQ ID NO: 1913975 - DNA, 17 bp, Homo sapiens
atttttttgtatgaaaa

SEQ ID NO: 1913976 - DNA, 20 bp, Homo sapiens
attttttttaattgtatttt

SEQ ID NO: 1913977 - DNA, 22 bp, Homo sapiens
attttttttaattgtatttttg

SEQ ID NO: 1913978 - DNA, 22 bp, Homo sapiens
attttttttcatgctttatcaa

SEQ ID NO: 1913979 - DNA, 13 bp, Homo sapiens
caaaaaagagaaa

SEQ ID NO: 1913980 - DNA, 13 bp, Homo sapiens
caaaaaggcttat

SEQ ID NO: 1913981 - DNA, 16 bp, Homo sapiens
caaaacaaaggcctaa

SEQ ID NO: 1913982 - DNA, 23 bp, Homo sapiens
caaaacactcattcttttttcta

SEQ ID NO: 1913983 - DNA, 18 bp, Homo sapiens
caaaagtagaactttgta

SEQ ID NO: 1913984 - DNA, 19 bp, Homo sapiens
caaaagtagaactttgtat

SEQ ID NO: 1913985 - DNA, 20 bp, Homo sapiens
caaaagtagaactttgtata

SEQ ID NO: 1913986 - DNA, 22 bp, Homo sapiens
caaaagtagaactttgtatagt

SEQ ID NO: 1913987 - DNA, 18 bp, Homo sapiens
caaaagtttgtttgctta

SEQ ID NO: 1913988 - DNA, 20 bp, Homo sapiens
caaaataacaaaaaagagaa

SEQ ID NO: 1913989 - DNA, 16 bp, Homo sapiens
caaaataagaaaagat

SEQ ID NO: 1913990 - DNA, 18 bp, Homo sapiens
caaaataagaaaagatgt

SEQ ID NO: 1913991 - DNA, 20 bp, Homo sapiens
caaaatgaaaagagaaactt

SEQ ID NO: 1913992 - DNA, 18 bp, Homo sapiens
caaaatggctagaattat

SEQ ID NO: 1913993 - DNA, 17 bp, Homo sapiens
caaacagaagtgcatcc

SEQ ID NO: 1913994 - DNA, 18 bp, Homo sapiens
caaacagaagtgcatcct

SEQ ID NO: 1913995 - DNA, 15 bp, Homo sapiens
caaacctaattgcac

SEQ ID NO: 1913996 - DNA, 17 bp, Homo sapiens
caaaccttactctgagc

SEQ ID NO: 1913997 - DNA, 20 bp, Homo sapiens
caaaccttactctgagctca

SEQ ID NO: 1913998 - DNA, 19 bp, Homo sapiens
caaacctttctataatttt

SEQ ID NO: 1913999 - DNA, 17 bp, Homo sapiens
caaagacatttcaaata

SEQ ID NO: 1914000 - DNA, 21 bp, Homo sapiens
caaagaccaattttttgtgtg

SEQ ID NO: 1914001 - DNA, 13 bp, Homo sapiens
caaagagacaggg

SEQ ID NO: 1914002 - DNA, 18 bp, Homo sapiens
caaagcaccaaaataaga

SEQ ID NO: 1914003 - DNA, 18 bp, Homo sapiens
caaagcagcaacacacat

SEQ ID NO: 1914004 - DNA, 21 bp, Homo sapiens
caaagccaccaacagccactc

SEQ ID NO: 1914005 - DNA, 23 bp, Homo sapiens
caaaggcacatggaatatatttt

SEQ ID NO: 1914006 - DNA, 19 bp, Homo sapiens
caaagtgggtactttctga

SEQ ID NO: 1914007 - DNA, 22 bp, Homo sapiens
caaagtgggtactttctgaaaa

SEQ ID NO: 1914008 - DNA, 23 bp, Homo sapiens
caaagtgggtactttctgaaaat

SEQ ID NO: 1914009 - DNA, 22 bp, Homo sapiens
caaataatatgtttccttccct

SEQ ID NO: 1914010 - DNA, 13 bp, Homo sapiens
caaatatgtggtc

SEQ ID NO: 1914011 - DNA, 21 bp, Homo sapiens
caaatatttagatgtaatttt

SEQ ID NO: 1914012 - DNA, 17 bp, Homo sapiens
caaatccaggaccctgc

SEQ ID NO: 1914013 - DNA, 18 bp, Homo sapiens
caaatccaggaccctgcc

SEQ ID NO: 1914014 - DNA, 18 bp, Homo sapiens
caaatgactttattattt

SEQ ID NO: 1914015 - DNA, 20 bp, Homo sapiens
caaatgactttattatttat

SEQ ID NO: 1914016 - DNA, 21 bp, Homo sapiens
caaatgactttattatttatt

SEQ ID NO: 1914017 - DNA, 20 bp, Homo sapiens
caaatgatgtgcctgcttca

SEQ ID NO: 1914018 - DNA, 21 bp, Homo sapiens
caaatgcatctttgatgtgtt

SEQ ID NO: 1914019 - DNA, 13 bp, Homo sapiens
caaatggaagaga

SEQ ID NO: 1914020 - DNA, 14 bp, Homo sapiens
caaatggaagagaa

SEQ ID NO: 1914021 - DNA, 15 bp, Homo sapiens
caaatggaagagaag

SEQ ID NO: 1914022 - DNA, 21 bp, Homo sapiens
caaatggaagagaagagaaag

SEQ ID NO: 1914023 - DNA, 21 bp, Homo sapiens
caaatgggttaatcctgaatt

SEQ ID NO: 1914024 - DNA, 12 bp, Homo sapiens
caaatgtaaagt

SEQ ID NO: 1914025 - DNA, 18 bp, Homo sapiens
caaatgtgtgcccagctt

SEQ ID NO: 1914026 - DNA, 17 bp, Homo sapiens
caaatgtgttttggtcc

SEQ ID NO: 1914027 - DNA, 12 bp, Homo sapiens
caaattaattgt

SEQ ID NO: 1914028 - DNA, 19 bp, Homo sapiens
caaattaattgtgtgaact

SEQ ID NO: 1914029 - DNA, 20 bp, Homo sapiens
caaattccatagctcaataa

SEQ ID NO: 1914030 - DNA, 15 bp, Homo sapiens
caaatttaactttta

SEQ ID NO: 1914031 - DNA, 14 bp, Homo sapiens
caacaattcagcat

SEQ ID NO: 1914032 - DNA, 16 bp, Homo sapiens
caacacaatccgttgc

SEQ ID NO: 1914033 - DNA, 17 bp, Homo sapiens
caacacgtcattgtgta

SEQ ID NO: 1914034 - DNA, 17 bp, Homo sapiens
caacagccatttaggca

SEQ ID NO: 1914035 - DNA, 15 bp, Homo sapiens
caacagcctctgtgg

SEQ ID NO: 1914036 - DNA, 15 bp, Homo sapiens
caacatctttctttt

SEQ ID NO: 1914037 - DNA, 16 bp, Homo sapiens
caacattgtagcctca

SEQ ID NO: 1914038 - DNA, 13 bp, Homo sapiens
caaccacaaaact

SEQ ID NO: 1914039 - DNA, 21 bp, Homo sapiens
caaccagaaacaatgtgtcta

SEQ ID NO: 1914040 - DNA, 15 bp, Homo sapiens
caacccctcgcccag

SEQ ID NO: 1914041 - DNA, 23 bp, Homo sapiens
caacccctcgcccagtcccagca

SEQ ID NO: 1914042 - DNA, 12 bp, Homo sapiens
caacccctggac

SEQ ID NO: 1914043 - DNA, 22 bp, Homo sapiens
caacccctggaccccagcctca

SEQ ID NO: 1914044 - DNA, 22 bp, Homo sapiens
caacctgaaagttccttctgta

SEQ ID NO: 1914045 - DNA, 22 bp, Homo sapiens
cagtgatgtgcctaaataagtt

SEQ ID NO: 1914046 - DNA, 17 bp, Homo sapiens
cagtggagcagaaggca

SEQ ID NO: 1914047 - DNA, 19 bp, Homo sapiens
cagtggcagggcacagggc

SEQ ID NO: 1914048 - DNA, 21 bp, Homo sapiens
cagtggcgaaatccctgctca

SEQ ID NO: 1914049 - DNA, 22 bp, Homo sapiens
cagtggcgaaatccctgctcac

SEQ ID NO: 1914050 - DNA, 17 bp, Homo sapiens
cagtggctgtgaaggag

SEQ ID NO: 1914051 - DNA, 18 bp, Homo sapiens
cagtggcttctcccaaca

SEQ ID NO: 1914052 - DNA, 15 bp, Homo sapiens
cagtgggttcaggcc

SEQ ID NO: 1914053 - DNA, 17 bp, Homo sapiens
cagtgtgaatgctgggc

SEQ ID NO: 1914054 - DNA, 15 bp, Homo sapiens
cagtgtgtaaagtaa

SEQ ID NO: 1914055 - DNA, 16 bp, Homo sapiens
cagttatgtgacctca

SEQ ID NO: 1914056 - DNA, 17 bp, Homo sapiens
cagttgctggtaaaatg

SEQ ID NO: 1914057 - DNA, 19 bp, Homo sapiens
cagttgctggtaaaatgaa

SEQ ID NO: 1914058 - DNA, 14 bp, Homo sapiens
cagttgctgtcaca

SEQ ID NO: 1914059 - DNA, 15 bp, Homo sapiens
cagttgctgtcacaa

SEQ ID NO: 1914060 - DNA, 22 bp, Homo sapiens
cagttgctgtcagtcttgacct

SEQ ID NO: 1914061 - DNA, 23 bp, Homo sapiens
cagtttttcataagatattttat

SEQ ID NO: 1914062 - DNA, 19 bp, Homo sapiens
cataagaggttctaacttc

SEQ ID NO: 1914063 - DNA, 14 bp, Homo sapiens
cataagctttgtaa

SEQ ID NO: 1914064 - DNA, 16 bp, Homo sapiens
cataatactgaaccac

SEQ ID NO: 1914065 - DNA, 23 bp, Homo sapiens
cataatcatggctcttagaaact

SEQ ID NO: 1914066 - DNA, 20 bp, Homo sapiens
catacaaatgcatctttgat

SEQ ID NO: 1914067 - DNA, 12 bp, Homo sapiens
catacacaacgt

SEQ ID NO: 1914068 - DNA, 21 bp, Homo sapiens
catacacaacgtaatcaaata

SEQ ID NO: 1914069 - DNA, 14 bp, Homo sapiens
catacgtaaaaatc

SEQ ID NO: 1914070 - DNA, 15 bp, Homo sapiens
catactcgagtctga

SEQ ID NO: 1914071 - DNA, 18 bp, Homo sapiens
catactcgagtctgaggc

SEQ ID NO: 1914072 - DNA, 17 bp, Homo sapiens
catagagtacactgcct

SEQ ID NO: 1914073 - DNA, 21 bp, Homo sapiens
catagcatagctagagattgg

SEQ ID NO: 1914074 - DNA, 14 bp, Homo sapiens
catagccaaaatgt

SEQ ID NO: 1914075 - DNA, 14 bp, Homo sapiens
catagctcaataaa

SEQ ID NO: 1914076 - DNA, 15 bp, Homo sapiens
catagctcaataaaa

SEQ ID NO: 1914077 - DNA, 16 bp, Homo sapiens
catagctcaataaaag

SEQ ID NO: 1914078 - DNA, 19 bp, Homo sapiens
cataggaagttaaaagcac

SEQ ID NO: 1914079 - DNA, 19 bp, Homo sapiens
catagtgatagagtgcagt

SEQ ID NO: 1914080 - DNA, 20 bp, Homo sapiens
catataacttatattgtaag

SEQ ID NO: 1914081 - DNA, 22 bp, Homo sapiens
catatgcctacaaagctctgaa

SEQ ID NO: 1914082 - DNA, 21 bp, Homo sapiens
catattaagtaagtctcaagg

SEQ ID NO: 1914083 - DNA, 19 bp, Homo sapiens
catattctgatgtttctca

SEQ ID NO: 1914084 - DNA, 19 bp, Homo sapiens
catcacagggcctcagttt

SEQ ID NO: 1914085 - DNA, 18 bp, Homo sapiens
catcagctgctcagatcc

SEQ ID NO: 1914086 - DNA, 14 bp, Homo sapiens
catcaggggcagga

SEQ ID NO: 1914087 - DNA, 14 bp, Homo sapiens
catcatattataca

SEQ ID NO: 1914088 - DNA, 21 bp, Homo sapiens
catcatgcttacaaaaaagaa

SEQ ID NO: 1914089 - DNA, 15 bp, Homo sapiens
catcattccttttta

SEQ ID NO: 1914090 - DNA, 22 bp, Homo sapiens
catcattcctttttatttatat

SEQ ID NO: 1914091 - DNA, 17 bp, Homo sapiens
catccatcgtaattgtt

SEQ ID NO: 1914092 - DNA, 21 bp, Homo sapiens
catccatggggtctctcacag

SEQ ID NO: 1914093 - DNA, 22 bp, Homo sapiens
catccccacgtggacaagaaag

SEQ ID NO: 1914094 - DNA, 18 bp, Homo sapiens
catccccttccagctccc

SEQ ID NO: 1914095 - DNA, 15 bp, Homo sapiens
catcccgtttccctc

SEQ ID NO: 1914096 - DNA, 19 bp, Homo sapiens
catcccgtttccctccagg

SEQ ID NO: 1914097 - DNA, 16 bp, Homo sapiens
catccctctcctctgc

SEQ ID NO: 1914098 - DNA, 14 bp, Homo sapiens
catcctcatggccc

SEQ ID NO: 1914099 - DNA, 19 bp, Homo sapiens
catctctgaaaacaagaga

SEQ ID NO: 1914100 - DNA, 13 bp, Homo sapiens
catctctgaccag

SEQ ID NO: 1914101 - DNA, 14 bp, Homo sapiens
catctgattccagc

SEQ ID NO: 1914102 - DNA, 15 bp, Homo sapiens
catctggagttctca

SEQ ID NO: 1914103 - DNA, 18 bp, Homo sapiens
catctgggtagctgtaag

SEQ ID NO: 1914104 - DNA, 14 bp, Homo sapiens
catctgtgaataag

SEQ ID NO: 1914105 - DNA, 15 bp, Homo sapiens
catctttctttttaa

SEQ ID NO: 1914106 - DNA, 12 bp, Homo sapiens
catctttgatgt

SEQ ID NO: 1914107 - DNA, 21 bp, Homo sapiens
catcttttgttactcttggga

SEQ ID NO: 1914108 - DNA, 12 bp, Homo sapiens
catgaaagaaaa

SEQ ID NO: 1914109 - DNA, 22 bp, Homo sapiens
catgagaatgttttagcacagc

SEQ ID NO: 1914110 - DNA, 14 bp, Homo sapiens
catgaggaggcaga

SEQ ID NO: 1914111 - DNA, 16 bp, Homo sapiens
catgaggaggcagaga

SEQ ID NO: 1914112 - DNA, 14 bp, Homo sapiens
catgaggcctcctg

SEQ ID NO: 1914113 - DNA, 18 bp, Homo sapiens
catgcctcctcctgccct

SEQ ID NO: 1914114 - DNA, 20 bp, Homo sapiens
catgcctcctcctgccctcc

SEQ ID NO: 1914115 - DNA, 20 bp, Homo sapiens
catgctgtctggcacagcct

SEQ ID NO: 1914116 - DNA, 18 bp, Homo sapiens
catgcttcagtgaacata

SEQ ID NO: 1914117 - DNA, 13 bp, Homo sapiens
catggctctgggc

SEQ ID NO: 1914118 - DNA, 16 bp, Homo sapiens
catggctcttagaaac

SEQ ID NO: 1914119 - DNA, 19 bp, Homo sapiens
catggctcttagaaactca

SEQ ID NO: 1914120 - DNA, 19 bp, Homo sapiens
catggggtctctcacagac

SEQ ID NO: 1914121 - DNA, 14 bp, Homo sapiens
catgggtcagggtg

SEQ ID NO: 1914122 - DNA, 19 bp, Homo sapiens
catggtggttgggacccag

SEQ ID NO: 1914123 - DNA, 22 bp, Homo sapiens
catggtggttgggacccagtgg

SEQ ID NO: 1914124 - DNA, 17 bp, Homo sapiens
catgtaaaaagtgcagt

SEQ ID NO: 1914125 - DNA, 18 bp, Homo sapiens
catgtaaaaagtgcagta

SEQ ID NO: 1914126 - DNA, 15 bp, Homo sapiens
catgtgcttctgcca

SEQ ID NO: 1914127 - DNA, 15 bp, Homo sapiens
catgttgatttccta

SEQ ID NO: 1914128 - DNA, 22 bp, Homo sapiens
catgttggccaggctgctctca

SEQ ID NO: 1914129 - DNA, 21 bp, Homo sapiens
catgtttgcagtgttaagata

SEQ ID NO: 1914130 - DNA, 12 bp, Homo sapiens
cattaaaagaaa

SEQ ID NO: 1914131 - DNA, 17 bp, Homo sapiens
cattaaaagaaaataaa

SEQ ID NO: 1914132 - DNA, 11 bp, Homo sapiens
cattaaaatat

SEQ ID NO: 1914133 - DNA, 14 bp, Homo sapiens
cattaaaatataat

SEQ ID NO: 1914134 - DNA, 17 bp, Homo sapiens
cattacctctttggaaa

SEQ ID NO: 1914135 - DNA, 12 bp, Homo sapiens
cattaggcccca

SEQ ID NO: 1914136 - DNA, 13 bp, Homo sapiens
cattaggccccag

SEQ ID NO: 1914137 - DNA, 15 bp, Homo sapiens
cattatttttctgta

SEQ ID NO: 1914138 - DNA, 18 bp, Homo sapiens
cattcctttttatttata

SEQ ID NO: 1914139 - DNA, 16 bp, Homo sapiens
cattctaaatgaactc

SEQ ID NO: 1914140 - DNA, 17 bp, Homo sapiens
cattctaaatgaactca

SEQ ID NO: 1914141 - DNA, 17 bp, Homo sapiens
cattctagtattcttta

SEQ ID NO: 1914142 - DNA, 21 bp, Homo sapiens
cattcttctcttttctatgaa

SEQ ID NO: 1914143 - DNA, 13 bp, Homo sapiens
cattcttctgatc

SEQ ID NO: 1914144 - DNA, 18 bp, Homo sapiens
cattgagaccgtgaagat

SEQ ID NO: 1914145 - DNA, 20 bp, Homo sapiens
cattgagacttacggcaaga

SEQ ID NO: 1914146 - DNA, 19 bp, Homo sapiens
cattgatttagtaagtgtt

SEQ ID NO: 1914147 - DNA, 21 bp, Homo sapiens
cattgatttagtaagtgttct

SEQ ID NO: 1914148 - DNA, 17 bp, Homo sapiens
cattgcaaacaactgaa

SEQ ID NO: 1914149 - DNA, 17 bp, Homo sapiens
cattgcacaatatattt

SEQ ID NO: 1914150 - DNA, 17 bp, Homo sapiens
cattgcagtcactttga

SEQ ID NO: 1914151 - DNA, 18 bp, Homo sapiens
cattgcagtcactttgac

SEQ ID NO: 1914152 - DNA, 23 bp, Homo sapiens
cattgcctgatttgttccttctg

SEQ ID NO: 1914153 - DNA, 22 bp, Homo sapiens
catttaatggggaggacaaaat

SEQ ID NO: 1914154 - DNA, 17 bp, Homo sapiens
catttacgcctgtaaat

SEQ ID NO: 1914155 - DNA, 21 bp, Homo sapiens
catttacgcctgtaaatgtat

SEQ ID NO: 1914156 - DNA, 22 bp, Homo sapiens
catttactgcattcttctgatc

SEQ ID NO: 1914157 - DNA, 17 bp, Homo sapiens
catttagggagtattct

SEQ ID NO: 1914158 - DNA, 21 bp, Homo sapiens
catttagggagtattctaata

SEQ ID NO: 1914159 - DNA, 22 bp, Homo sapiens
catttcaaggtaaaatgtagct

SEQ ID NO: 1914160 - DNA, 16 bp, Homo sapiens
catttcatgaagcaag

SEQ ID NO: 1914161 - DNA, 17 bp, Homo sapiens
catttccccagggcacg

SEQ ID NO: 1914162 - DNA, 12 bp, Homo sapiens
catttctgattt

SEQ ID NO: 1914163 - DNA, 13 bp, Homo sapiens
catttgaaaatat

SEQ ID NO: 1914164 - DNA, 21 bp, Homo sapiens
catttgaaacccctgtaggcc

SEQ ID NO: 1914165 - DNA, 17 bp, Homo sapiens
catttggagggcctggg

SEQ ID NO: 1914166 - DNA, 18 bp, Homo sapiens
catttggagggcctgggc

SEQ ID NO: 1914167 - DNA, 11 bp, Homo sapiens
catttggcttc

SEQ ID NO: 1914168 - DNA, 16 bp, Homo sapiens
catttggcttcctctg

SEQ ID NO: 1914169 - DNA, 18 bp, Homo sapiens
cattttagaatgtcaata

SEQ ID NO: 1914170 - DNA, 22 bp, Homo sapiens
cattttcacagcactacttgct

SEQ ID NO: 1914171 - DNA, 19 bp, Homo sapiens
cattttcagattcaggcat

SEQ ID NO: 1914172 - DNA, 13 bp, Homo sapiens
cattttgagaatg

SEQ ID NO: 1914173 - DNA, 13 bp, Homo sapiens
cattttgtaataa

SEQ ID NO: 1914174 - DNA, 21 bp, Homo sapiens
cattttttttttttaaaggaa

SEQ ID NO: 1914175 - DNA, 15 bp, Homo sapiens
ccaaacacacagaag

SEQ ID NO: 1914176 - DNA, 13 bp, Homo sapiens
ccaaacacaggca

SEQ ID NO: 1914177 - DNA, 13 bp, Homo sapiens
cctgcctctccgc

SEQ ID NO: 1914178 - DNA, 21 bp, Homo sapiens
cctgcctctccgcccctgagc

SEQ ID NO: 1914179 - DNA, 23 bp, Homo sapiens
cctgcctctccgcccctgagccc

SEQ ID NO: 1914180 - DNA, 16 bp, Homo sapiens
cctgcctctgccacag

SEQ ID NO: 1914181 - DNA, 15 bp, Homo sapiens
cctgctcagaatctg

SEQ ID NO: 1914182 - DNA, 22 bp, Homo sapiens
cctgctctcgaggcagcagtgg

SEQ ID NO: 1914183 - DNA, 21 bp, Homo sapiens
cctgctggccggacacccgac

SEQ ID NO: 1914184 - DNA, 20 bp, Homo sapiens
cctgcttcagcctcccacag

SEQ ID NO: 1914185 - DNA, 14 bp, Homo sapiens
cctgcttggcccag

SEQ ID NO: 1914186 - DNA, 19 bp, Homo sapiens
cctggaagcagtgcccagg

SEQ ID NO: 1914187 - DNA, 23 bp, Homo sapiens
cctggaagcagtgcccaggtggc

SEQ ID NO: 1914188 - DNA, 14 bp, Homo sapiens
cctggaccccagcc

SEQ ID NO: 1914189 - DNA, 15 bp, Homo sapiens
cctggaccccagcct

SEQ ID NO: 1914190 - DNA, 16 bp, Homo sapiens
cctggaccccagcctc

SEQ ID NO: 1914191 - DNA, 14 bp, Homo sapiens
cctggagctcaagc

SEQ ID NO: 1914192 - DNA, 19 bp, Homo sapiens
cctggagctcaagccgtgg

SEQ ID NO: 1914193 - DNA, 22 bp, Homo sapiens
cctggcaaatgcacacacctca

SEQ ID NO: 1914194 - DNA, 13 bp, Homo sapiens
cctggcccatgta

SEQ ID NO: 1914195 - DNA, 15 bp, Homo sapiens
cctggcccccacatg

SEQ ID NO: 1914196 - DNA, 21 bp, Homo sapiens
cctggccggtgtgggggcccc

SEQ ID NO: 1914197 - DNA, 23 bp, Homo sapiens
cctggccggtgtgggggccccgt

SEQ ID NO: 1914198 - DNA, 12 bp, Homo sapiens
cctggctccctc

SEQ ID NO: 1914199 - DNA, 19 bp, Homo sapiens
cctggctccctcactctca

SEQ ID NO: 1914200 - DNA, 13 bp, Homo sapiens
cctgggccagggc

SEQ ID NO: 1914201 - DNA, 13 bp, Homo sapiens
cctgggcctccac

SEQ ID NO: 1914202 - DNA, 17 bp, Homo sapiens
cctggggcatccatggg

SEQ ID NO: 1914203 - DNA, 21 bp, Homo sapiens
cctggggcatccatggggtct

SEQ ID NO: 1914204 - DNA, 17 bp, Homo sapiens
cctgggttagactgcca

SEQ ID NO: 1914205 - DNA, 19 bp, Homo sapiens
cctgggttagactgccagc

SEQ ID NO: 1914206 - DNA, 22 bp, Homo sapiens
cctgggttagactgccagctct

SEQ ID NO: 1914207 - DNA, 23 bp, Homo sapiens
cctggttcaagcgattctcttgc

SEQ ID NO: 1914208 - DNA, 16 bp, Homo sapiens
cctggttgtgtgtccc

SEQ ID NO: 1914209 - DNA, 17 bp, Homo sapiens
cctgtaaatgtattcat

SEQ ID NO: 1914210 - DNA, 18 bp, Homo sapiens
cctgtaaatgtattcatt

SEQ ID NO: 1914211 - DNA, 20 bp, Homo sapiens
cctgtaaggggccagagcct

SEQ ID NO: 1914212 - DNA, 14 bp, Homo sapiens
cctgtacatatctt

SEQ ID NO: 1914213 - DNA, 15 bp, Homo sapiens
cctgtacatatcttt

SEQ ID NO: 1914214 - DNA, 13 bp, Homo sapiens
cctgtcccaggca

SEQ ID NO: 1914215 - DNA, 17 bp, Homo sapiens
cctgtgtgacatcacag

SEQ ID NO: 1914216 - DNA, 23 bp, Homo sapiens
cctgtgttaatttaagttttgac

SEQ ID NO: 1914217 - DNA, 13 bp, Homo sapiens
cctgtttcagacc

SEQ ID NO: 1914218 - DNA, 20 bp, Homo sapiens
ccttaagtgaggaaatcaaa

SEQ ID NO: 1914219 - DNA, 22 bp, Homo sapiens
ccttaagtgaggaaatcaaagt

SEQ ID NO: 1914220 - DNA, 14 bp, Homo sapiens
ccttatcagaggcc

SEQ ID NO: 1914221 - DNA, 23 bp, Homo sapiens
ccttccagctccctcccctgctc

SEQ ID NO: 1914222 - DNA, 20 bp, Homo sapiens
ccttccagtggcttctccca

SEQ ID NO: 1914223 - DNA, 21 bp, Homo sapiens
ccttccagtggcttctcccaa

SEQ ID NO: 1914224 - DNA, 21 bp, Homo sapiens
ccttccatctcttcctttcct

SEQ ID NO: 1914225 - DNA, 20 bp, Homo sapiens
ccttcccggttgtgagagcc

SEQ ID NO: 1914226 - DNA, 19 bp, Homo sapiens
ccttcgaaaagaaattgtc

SEQ ID NO: 1914227 - DNA, 15 bp, Homo sapiens
ccttctgccagaaga

SEQ ID NO: 1914228 - DNA, 22 bp, Homo sapiens
ccttctgtagcctgaagagttt

SEQ ID NO: 1914229 - DNA, 14 bp, Homo sapiens
ccttcttgggactg

SEQ ID NO: 1914230 - DNA, 20 bp, Homo sapiens
ccttcttgggactgctgtga

SEQ ID NO: 1914231 - DNA, 14 bp, Homo sapiens
ccttgccagctgct

SEQ ID NO: 1914232 - DNA, 20 bp, Homo sapiens
ccttgccagctgctgagccg

SEQ ID NO: 1914233 - DNA, 24 bp, Homo sapiens
ccttgccagctgctgagccgcaga

SEQ ID NO: 1914234 - DNA, 18 bp, Homo sapiens
ccttggcttggccctggc

SEQ ID NO: 1914235 - DNA, 21 bp, Homo sapiens
ccttgggcctcccactcccat

SEQ ID NO: 1914236 - DNA, 17 bp, Homo sapiens
ccttggttcctggggca

SEQ ID NO: 1914237 - DNA, 17 bp, Homo sapiens
ccttgtcattttggtct

SEQ ID NO: 1914238 - DNA, 14 bp, Homo sapiens
cctttaccgaggac

SEQ ID NO: 1914239 - DNA, 20 bp, Homo sapiens
cctttaccgaggacagcctg

SEQ ID NO: 1914240 - DNA, 17 bp, Homo sapiens
cctttcattttctttcc

SEQ ID NO: 1914241 - DNA, 11 bp, Homo sapiens
cctttcccact

SEQ ID NO: 1914242 - DNA, 17 bp, Homo sapiens
cctttccccttcccttc

SEQ ID NO: 1914243 - DNA, 22 bp, Homo sapiens
cctttcccctttttctttccct

SEQ ID NO: 1914244 - DNA, 18 bp, Homo sapiens
cctttcctttcctttcat

SEQ ID NO: 1914245 - DNA, 16 bp, Homo sapiens
cctttctacttccaag

SEQ ID NO: 1914246 - DNA, 22 bp, Homo sapiens
cctttctgccagggatggcagt

SEQ ID NO: 1914247 - DNA, 15 bp, Homo sapiens
cctttgcagctcaga

SEQ ID NO: 1914248 - DNA, 12 bp, Homo sapiens
cctttttattta

SEQ ID NO: 1914249 - DNA, 13 bp, Homo sapiens
cctttttatttat

SEQ ID NO: 1914250 - DNA, 16 bp, Homo sapiens
cctttttatttatatg

SEQ ID NO: 1914251 - DNA, 16 bp, Homo sapiens
cgaaatccctgctcac

SEQ ID NO: 1914252 - DNA, 17 bp, Homo sapiens
cgaatcatttgttcaaa

SEQ ID NO: 1914253 - DNA, 20 bp, Homo sapiens
cgaccagcaggctcctcagc

SEQ ID NO: 1914254 - DNA, 12 bp, Homo sapiens
cgaccagccagg

SEQ ID NO: 1914255 - DNA, 12 bp, Homo sapiens
cgagcagggcag

SEQ ID NO: 1914256 - DNA, 21 bp, Homo sapiens
cgaggctcgagctcggggctg

SEQ ID NO: 1914257 - DNA, 22 bp, Homo sapiens
cgagtctttctcactgcctttg

SEQ ID NO: 1914258 - DNA, 14 bp, Homo sapiens
cgatcctcccctgg

SEQ ID NO: 1914259 - DNA, 19 bp, Homo sapiens
cgcaagcaccatcccctcc

SEQ ID NO: 1914260 - DNA, 21 bp, Homo sapiens
cgcaagcaccatcccctccgg

SEQ ID NO: 1914261 - DNA, 17 bp, Homo sapiens
cgcaattctcgattctt

SEQ ID NO: 1914262 - DNA, 13 bp, Homo sapiens
cgcacagctgctc

SEQ ID NO: 1914263 - DNA, 23 bp, Homo sapiens
cgcaccctcctttctcaccagcc

SEQ ID NO: 1914264 - DNA, 22 bp, Homo sapiens
cgcagagaagtgacggttccta

SEQ ID NO: 1914265 - DNA, 22 bp, Homo sapiens
cgcagcacgcctctccccacct

SEQ ID NO: 1914266 - DNA, 21 bp, Homo sapiens
cgcagtcgtcagcctccctga

SEQ ID NO: 1914267 - DNA, 18 bp, Homo sapiens
cgccactgtccgctgtct

SEQ ID NO: 1914268 - DNA, 19 bp, Homo sapiens
cgccactgtccgctgtctc

SEQ ID NO: 1914269 - DNA, 21 bp, Homo sapiens
cgccactgtccgctgtctccc

SEQ ID NO: 1914270 - DNA, 13 bp, Homo sapiens
cgcccacttccct

SEQ ID NO: 1914271 - DNA, 17 bp, Homo sapiens
cgcccccactcctcctc

SEQ ID NO: 1914272 - DNA, 15 bp, Homo sapiens
cgcccctgagcccac

SEQ ID NO: 1914273 - DNA, 18 bp, Homo sapiens
cgcccctgagcccactgt

SEQ ID NO: 1914274 - DNA, 22 bp, Homo sapiens
cgcctccaacccctcgcccagt

SEQ ID NO: 1914275 - DNA, 15 bp, Homo sapiens
cgctgactacagggc

SEQ ID NO: 1914276 - DNA, 17 bp, Homo sapiens
cgctgactacagggccg

SEQ ID NO: 1914277 - DNA, 16 bp, Homo sapiens
cgcttaaggtggaaag

SEQ ID NO: 1914278 - DNA, 20 bp, Homo sapiens
cgcttccctggttcaagcga

SEQ ID NO: 1914279 - DNA, 22 bp, Homo sapiens
cggcaataaaagcccaggagcc

SEQ ID NO: 1914280 - DNA, 13 bp, Homo sapiens
cggcagaggtggt

SEQ ID NO: 1914281 - DNA, 13 bp, Homo sapiens
cggcctttcccac

SEQ ID NO: 1914282 - DNA, 13 bp, Homo sapiens
cgggcccaggcag

SEQ ID NO: 1914283 - DNA, 13 bp, Homo sapiens
cgggccctggagc

SEQ ID NO: 1914284 - DNA, 12 bp, Homo sapiens
cgggccggcctt

SEQ ID NO: 1914285 - DNA, 20 bp, Homo sapiens
cgggctgttctggtggcccc

SEQ ID NO: 1914286 - DNA, 14 bp, Homo sapiens
cggggcaggccagg

SEQ ID NO: 1914287 - DNA, 21 bp, Homo sapiens
cggggcaggccaggggagggg

SEQ ID NO: 1914288 - DNA, 16 bp, Homo sapiens
cggggctgggggctgc

SEQ ID NO: 1914289 - DNA, 20 bp, Homo sapiens
cggtccagaaggagcaggcc

SEQ ID NO: 1914290 - DNA, 22 bp, Homo sapiens
cggtccagaaggagcaggccct

SEQ ID NO: 1914291 - DNA, 22 bp, Homo sapiens
cggtctcggatcaggctcccag

SEQ ID NO: 1914292 - DNA, 22 bp, Homo sapiens
cgtacaagtagttctgtatttg

SEQ ID NO: 1914293 - DNA, 20 bp, Homo sapiens
cgtacataatactgaaccac

SEQ ID NO: 1914294 - DNA, 13 bp, Homo sapiens
cgtactctctctc

SEQ ID NO: 1914295 - DNA, 14 bp, Homo sapiens
cgtaggacccagtt

SEQ ID NO: 1914296 - DNA, 14 bp, Homo sapiens
cgtcattgtgtaag

SEQ ID NO: 1914297 - DNA, 13 bp, Homo sapiens
cgtccccccatcc

SEQ ID NO: 1914298 - DNA, 16 bp, Homo sapiens
cgtccccccatcccgt

SEQ ID NO: 1914299 - DNA, 14 bp, Homo sapiens
cgtctgccaccagc

SEQ ID NO: 1914300 - DNA, 23 bp, Homo sapiens
cgtctgccaccagcgcccccact

SEQ ID NO: 1914301 - DNA, 17 bp, Homo sapiens
cgtgaagatactttgta

SEQ ID NO: 1914302 - DNA, 23 bp, Homo sapiens
cgtggagaatcacaggctgggct

SEQ ID NO: 1914303 - DNA, 15 bp, Homo sapiens
cgtggccggggtcca

SEQ ID NO: 1914304 - DNA, 16 bp, Homo sapiens
cgtgggctgttacttg

SEQ ID NO: 1914305 - DNA, 17 bp, Homo sapiens
cgtgtaggaacctgcac

SEQ ID NO: 1914306 - DNA, 13 bp, Homo sapiens
cgttttaaggact

SEQ ID NO: 1914307 - DNA, 18 bp, Homo sapiens
cgttttctactttgaaat

SEQ ID NO: 1914308 - DNA, 18 bp, Homo sapiens
ctaaaaatatcacactga

SEQ ID NO: 1914309 - DNA, 20 bp, Homo sapiens
ctgtataaaggtgtgctgtg

SEQ ID NO: 1914310 - DNA, 20 bp, Homo sapiens
ctgtataatggagaattaaa

SEQ ID NO: 1914311 - DNA, 19 bp, Homo sapiens
ctgtatagctcttttccta

SEQ ID NO: 1914312 - DNA, 17 bp, Homo sapiens
ctgtatttgaaagtgcc

SEQ ID NO: 1914313 - DNA, 20 bp, Homo sapiens
ctgtatttgaaagtgccttt

SEQ ID NO: 1914314 - DNA, 15 bp, Homo sapiens
ctgtcatctgagaat

SEQ ID NO: 1914315 - DNA, 16 bp, Homo sapiens
ctgtcatctgagaatg

SEQ ID NO: 1914316 - DNA, 17 bp, Homo sapiens
ctgtcatctgagaatga

SEQ ID NO: 1914317 - DNA, 17 bp, Homo sapiens
ctgtccatttttattca

SEQ ID NO: 1914318 - DNA, 18 bp, Homo sapiens
ctgtccctcccctgggca

SEQ ID NO: 1914319 - DNA, 13 bp, Homo sapiens
ctgtccgctgtct

SEQ ID NO: 1914320 - DNA, 15 bp, Homo sapiens
ctgtccgctgtctcc

SEQ ID NO: 1914321 - DNA, 16 bp, Homo sapiens
ctgtccgctgtctccc

SEQ ID NO: 1914322 - DNA, 21 bp, Homo sapiens
ctgtccgctgtctccctcctg

SEQ ID NO: 1914323 - DNA, 22 bp, Homo sapiens
ctgtccgctgtctccctcctga

SEQ ID NO: 1914324 - DNA, 17 bp, Homo sapiens
ctgtcggggtcaagctg

SEQ ID NO: 1914325 - DNA, 17 bp, Homo sapiens
ctgtctcccaccctttc

SEQ ID NO: 1914326 - DNA, 18 bp, Homo sapiens
ctgtctcccaccctttct

SEQ ID NO: 1914327 - DNA, 22 bp, Homo sapiens
ctgtctcccaccctttctgcca

SEQ ID NO: 1914328 - DNA, 14 bp, Homo sapiens
ctgtctccctcctg

SEQ ID NO: 1914329 - DNA, 16 bp, Homo sapiens
ctgtctcttctatgta

SEQ ID NO: 1914330 - DNA, 18 bp, Homo sapiens
ctgtctggcacagcctgc

SEQ ID NO: 1914331 - DNA, 19 bp, Homo sapiens
ctgtgaaaaaaaaaatgct

SEQ ID NO: 1914332 - DNA, 14 bp, Homo sapiens
ctgtgaacatgcct

SEQ ID NO: 1914333 - DNA, 20 bp, Homo sapiens
ctgtgaacatgcctcctcct

SEQ ID NO: 1914334 - DNA, 21 bp, Homo sapiens
ctgtgaacatgcctcctcctg

SEQ ID NO: 1914335 - DNA, 22 bp, Homo sapiens
ctgtgaacatgcctcctcctgc

SEQ ID NO: 1914336 - DNA, 23 bp, Homo sapiens
ctgtgcagggcacagaaggctgg

SEQ ID NO: 1914337 - DNA, 19 bp, Homo sapiens
ctgtgcccagaatactgat

SEQ ID NO: 1914338 - DNA, 15 bp, Homo sapiens
ctgtgcgtggggctc

SEQ ID NO: 1914339 - DNA, 23 bp, Homo sapiens
ctgtgctgggaggtcccagggcc

SEQ ID NO: 1914340 - DNA, 12 bp, Homo sapiens
ctgtgctggtga

SEQ ID NO: 1914341 - DNA, 21 bp, Homo sapiens
ctgtggaaaaataaaggaaat

SEQ ID NO: 1914342 - DNA, 23 bp, Homo sapiens
ctgtggaaaaataaaggaaattc

SEQ ID NO: 1914343 - DNA, 11 bp, Homo sapiens
ctgtggcagca

SEQ ID NO: 1914344 - DNA, 16 bp, Homo sapiens
ctgtggcagcaggagg

SEQ ID NO: 1914345 - DNA, 17 bp, Homo sapiens
ctgtggttggctgggaa

SEQ ID NO: 1914346 - DNA, 17 bp, Homo sapiens
ctgtgtaccactgggat

SEQ ID NO: 1914347 - DNA, 15 bp, Homo sapiens
ctgtgtatatttgat

SEQ ID NO: 1914348 - DNA, 18 bp, Homo sapiens
ctgtgtatatttgattta

SEQ ID NO: 1914349 - DNA, 14 bp, Homo sapiens
ctgtgttaaaattt

SEQ ID NO: 1914350 - DNA, 19 bp, Homo sapiens
ctgtgttaaaattttttga

SEQ ID NO: 1914351 - DNA, 18 bp, Homo sapiens
ctgttacactttttggaa

SEQ ID NO: 1914352 - DNA, 16 bp, Homo sapiens
ctgttagtattgattc

SEQ ID NO: 1914353 - DNA, 17 bp, Homo sapiens
ctgttagtattgattca

SEQ ID NO: 1914354 - DNA, 15 bp, Homo sapiens
ctgttctggtggccc

SEQ ID NO: 1914355 - DNA, 19 bp, Homo sapiens
ctgttgactctagtactgt

SEQ ID NO: 1914356 - DNA, 15 bp, Homo sapiens
ctgttgcccaggctg

SEQ ID NO: 1914357 - DNA, 19 bp, Homo sapiens
ctgttggcaaatttgtgaa

SEQ ID NO: 1914358 - DNA, 21 bp, Homo sapiens
ctgttggcaaatttgtgaact

SEQ ID NO: 1914359 - DNA, 22 bp, Homo sapiens
ctgttgtataaatttatttact

SEQ ID NO: 1914360 - DNA, 14 bp, Homo sapiens
ctgtttcagaccag

SEQ ID NO: 1914361 - DNA, 23 bp, Homo sapiens
ctgtttcataagctttgtaattc

SEQ ID NO: 1914362 - DNA, 18 bp, Homo sapiens
ctgtttttcttctgaaat

SEQ ID NO: 1914363 - DNA, 17 bp, Homo sapiens
cttaaaacatcattcct

SEQ ID NO: 1914364 - DNA, 16 bp, Homo sapiens
cttaaaaccaatcaat

SEQ ID NO: 1914365 - DNA, 11 bp, Homo sapiens
cttaaatgaac

SEQ ID NO: 1914366 - DNA, 20 bp, Homo sapiens
cttaacatagccaaaatgtg

SEQ ID NO: 1914367 - DNA, 19 bp, Homo sapiens
cttaactggactgaattca

SEQ ID NO: 1914368 - DNA, 16 bp, Homo sapiens
cttaagaactgctttc

SEQ ID NO: 1914369 - DNA, 15 bp, Homo sapiens
cttaaggtggaaagt

SEQ ID NO: 1914370 - DNA, 16 bp, Homo sapiens
cttaaggtggaaagtg

SEQ ID NO: 1914371 - DNA, 21 bp, Homo sapiens
cttaagtgaggaaatcaaagt

SEQ ID NO: 1914372 - DNA, 14 bp, Homo sapiens
cttactctgagctc

SEQ ID NO: 1914373 - DNA, 14 bp, Homo sapiens
cttactgtgttaaa

SEQ ID NO: 1914374 - DNA, 21 bp, Homo sapiens
cttactgtgttaaaatttttt

SEQ ID NO: 1914375 - DNA, 11 bp, Homo sapiens
cttactttgta

SEQ ID NO: 1914376 - DNA, 14 bp, Homo sapiens
cttactttgtaaat

SEQ ID NO: 1914377 - DNA, 11 bp, Homo sapiens
cttagaaactc

SEQ ID NO: 1914378 - DNA, 18 bp, Homo sapiens
cttagaatccctgtgtta

SEQ ID NO: 1914379 - DNA, 19 bp, Homo sapiens
cttagaccaaaagcaacat

SEQ ID NO: 1914380 - DNA, 13 bp, Homo sapiens
cttagatcatagt

SEQ ID NO: 1914381 - DNA, 17 bp, Homo sapiens
cttagatcatagtttta

SEQ ID NO: 1914382 - DNA, 22 bp, Homo sapiens
cttagcatgtgttgcagctgtc

SEQ ID NO: 1914383 - DNA, 14 bp, Homo sapiens
cttataaaacagag

SEQ ID NO: 1914384 - DNA, 18 bp, Homo sapiens
cttatattgtaagaaata

SEQ ID NO: 1914385 - DNA, 14 bp, Homo sapiens
cttatcagaggccc

SEQ ID NO: 1914386 - DNA, 23 bp, Homo sapiens
cttatgatagcaaatggcctcat

SEQ ID NO: 1914387 - DNA, 16 bp, Homo sapiens
cttatttatgtaacaa

SEQ ID NO: 1914388 - DNA, 19 bp, Homo sapiens
cttcagacacaaaagtcca

SEQ ID NO: 1914389 - DNA, 18 bp, Homo sapiens
cttcagccaccctttctg

SEQ ID NO: 1914390 - DNA, 14 bp, Homo sapiens
cttcagtgaacata

SEQ ID NO: 1914391 - DNA, 19 bp, Homo sapiens
cttcatctcaatagtgatt

SEQ ID NO: 1914392 - DNA, 12 bp, Homo sapiens
cttccagcagga

SEQ ID NO: 1914393 - DNA, 12 bp, Homo sapiens
cttccagctccc

SEQ ID NO: 1914394 - DNA, 14 bp, Homo sapiens
cttccagctccctc

SEQ ID NO: 1914395 - DNA, 17 bp, Homo sapiens
cttccagctccctcccc

SEQ ID NO: 1914396 - DNA, 12 bp, Homo sapiens
cttccagtggct

SEQ ID NO: 1914397 - DNA, 20 bp, Homo sapiens
cttccagtggcttctcccaa

SEQ ID NO: 1914398 - DNA, 21 bp, Homo sapiens
cttccagtggcttctcccaac

SEQ ID NO: 1914399 - DNA, 10 bp, Homo sapiens
cttccatctc

SEQ ID NO: 1914400 - DNA, 18 bp, Homo sapiens
cttcccacaaagaatata

SEQ ID NO: 1914401 - DNA, 21 bp, Homo sapiens
cttcccagaccccgcagcacg

SEQ ID NO: 1914402 - DNA, 18 bp, Homo sapiens
cttccccaagcctggcag

SEQ ID NO: 1914403 - DNA, 13 bp, Homo sapiens
cttccctccatcc

SEQ ID NO: 1914404 - DNA, 23 bp, Homo sapiens
cttcccttccatctcttcctttc

SEQ ID NO: 1914405 - DNA, 17 bp, Homo sapiens
cttcccttcccttccct

SEQ ID NO: 1914406 - DNA, 11 bp, Homo sapiens
cttcctctgct

SEQ ID NO: 1914407 - DNA, 13 bp, Homo sapiens
cttcctctgctgc

SEQ ID NO: 1914408 - DNA, 23 bp, Homo sapiens
cttcctctgctgcatccccttcc

SEQ ID NO: 1914409 - DNA, 15 bp, Homo sapiens
cttccttacctggaa

SEQ ID NO: 1914410 - DNA, 13 bp, Homo sapiens
cttcctttccttt

SEQ ID NO: 1914411 - DNA, 21 bp, Homo sapiens
cttcctttcctttcctttctt

SEQ ID NO: 1914412 - DNA, 13 bp, Homo sapiens
cttcctttcttga

SEQ ID NO: 1914413 - DNA, 22 bp, Homo sapiens
cttctcattacttgttgcctat

SEQ ID NO: 1914414 - DNA, 17 bp, Homo sapiens
cttctcccaacactctt

SEQ ID NO: 1914415 - DNA, 12 bp, Homo sapiens
cttctgaaatac

SEQ ID NO: 1914416 - DNA, 15 bp, Homo sapiens
cttctgaaatacaac

SEQ ID NO: 1914417 - DNA, 20 bp, Homo sapiens
cttctgatcactgaaataaa

SEQ ID NO: 1914418 - DNA, 16 bp, Homo sapiens
cttctgccagaagact

SEQ ID NO: 1914419 - DNA, 19 bp, Homo sapiens
cttctgcctgctgaccata

SEQ ID NO: 1914420 - DNA, 19 bp, Homo sapiens
cttctgtagcctgaagagt

SEQ ID NO: 1914421 - DNA, 21 bp, Homo sapiens
cttctgtgcccagaatactga

SEQ ID NO: 1914422 - DNA, 16 bp, Homo sapiens
cttcttgggactgctg

SEQ ID NO: 1914423 - DNA, 20 bp, Homo sapiens
cttcttgggactgctgtgaa

SEQ ID NO: 1914424 - DNA, 16 bp, Homo sapiens
cttctttttccctttc

SEQ ID NO: 1914425 - DNA, 19 bp, Homo sapiens
cttctttttccctttcctt

SEQ ID NO: 1914426 - DNA, 15 bp, Homo sapiens
cttgaaaagagacag

SEQ ID NO: 1914427 - DNA, 18 bp, Homo sapiens
cttgaaaagagacaggca

SEQ ID NO: 1914428 - DNA, 14 bp, Homo sapiens
cttgaaccataaaa

SEQ ID NO: 1914429 - DNA, 18 bp, Homo sapiens
cttgaaccctaataagac

SEQ ID NO: 1914430 - DNA, 14 bp, Homo sapiens
cttgaagcttgtat

SEQ ID NO: 1914431 - DNA, 19 bp, Homo sapiens
cttgaagcttgtatctgat

SEQ ID NO: 1914432 - DNA, 15 bp, Homo sapiens
cttgagttaactttt

SEQ ID NO: 1914433 - DNA, 18 bp, Homo sapiens
cttgagttgtttttgtat

SEQ ID NO: 1914434 - DNA, 23 bp, Homo sapiens
cttgatagcctcattaaagcatt

SEQ ID NO: 1914435 - DNA, 16 bp, Homo sapiens
cttgcaaaattcctga

SEQ ID NO: 1914436 - DNA, 14 bp, Homo sapiens
cttgcagaaaatga

SEQ ID NO: 1914437 - DNA, 17 bp, Homo sapiens
cttgcagaaaatgaatg

SEQ ID NO: 1914438 - DNA, 13 bp, Homo sapiens
cttgcatttttgc

SEQ ID NO: 1914439 - DNA, 20 bp, Homo sapiens
cttgcatttttgcaggagca

SEQ ID NO: 1914440 - DNA, 21 bp, Homo sapiens
cttgccagctgctgagccgca

SEQ ID NO: 1914441 - DNA, 23 bp, Homo sapiens
cttgccatgcttcagtgaacata

SEQ ID NO: 1914442 - DNA, 15 bp, Homo sapiens
gacctgtatcaaact

SEQ ID NO: 1914443 - DNA, 18 bp, Homo sapiens
gacgtacaagtagttctg

SEQ ID NO: 1914444 - DNA, 16 bp, Homo sapiens
gacgtctgccaccagc

SEQ ID NO: 1914445 - DNA, 23 bp, Homo sapiens
gacgtctgccaccagcgccccca

SEQ ID NO: 1914446 - DNA, 19 bp, Homo sapiens
gactataccaactgggcct

SEQ ID NO: 1914447 - DNA, 13 bp, Homo sapiens
gactcaaaacact

SEQ ID NO: 1914448 - DNA, 18 bp, Homo sapiens
gactctacatgcttgttg

SEQ ID NO: 1914449 - DNA, 18 bp, Homo sapiens
gactctagtactgtgaat

SEQ ID NO: 1914450 - DNA, 23 bp, Homo sapiens
gactctagtactgtgaatccagt

SEQ ID NO: 1914451 - DNA, 13 bp, Homo sapiens
gactctgcactga

SEQ ID NO: 1914452 - DNA, 13 bp, Homo sapiens
gactctgccaggg

SEQ ID NO: 1914453 - DNA, 18 bp, Homo sapiens
gactctgccagggtgggg

SEQ ID NO: 1914454 - DNA, 15 bp, Homo sapiens
gactctgtctggcca

SEQ ID NO: 1914455 - DNA, 17 bp, Homo sapiens
gactctgtctggccagg

SEQ ID NO: 1914456 - DNA, 14 bp, Homo sapiens
gactgactgaggca

SEQ ID NO: 1914457 - DNA, 16 bp, Homo sapiens
gactgactgaggcagt

SEQ ID NO: 1914458 - DNA, 14 bp, Homo sapiens
gactgccacaagga

SEQ ID NO: 1914459 - DNA, 18 bp, Homo sapiens
gactgccacaaggaagaa

SEQ ID NO: 1914460 - DNA, 13 bp, Homo sapiens
gactgccacctcc

SEQ ID NO: 1914461 - DNA, 19 bp, Homo sapiens
gactgccagctcttcctag

SEQ ID NO: 1914462 - DNA, 19 bp, Homo sapiens
gactgctcctgagccccca

SEQ ID NO: 1914463 - DNA, 21 bp, Homo sapiens
gactgctgtgaacatgcctcc

SEQ ID NO: 1914464 - DNA, 17 bp, Homo sapiens
gactggatgtaccacca

SEQ ID NO: 1914465 - DNA, 18 bp, Homo sapiens
gactggtcttccttacct

SEQ ID NO: 1914466 - DNA, 22 bp, Homo sapiens
gactggtcttccttacctggaa

SEQ ID NO: 1914467 - DNA, 19 bp, Homo sapiens
gactgtggagactgctcct

SEQ ID NO: 1914468 - DNA, 17 bp, Homo sapiens
gacttaacatagccaaa

SEQ ID NO: 1914469 - DNA, 23 bp, Homo sapiens
gacttaacatagccaaaatgtga

SEQ ID NO: 1914470 - DNA, 22 bp, Homo sapiens
gacttccccaagcctggcaggg

SEQ ID NO: 1914471 - DNA, 14 bp, Homo sapiens
gacttctgtcttct

SEQ ID NO: 1914472 - DNA, 13 bp, Homo sapiens
gacttgcattttt

SEQ ID NO: 1914473 - DNA, 15 bp, Homo sapiens
gacttgcatttttgc

SEQ ID NO: 1914474 - DNA, 11 bp, Homo sapiens
gactttattag

SEQ ID NO: 1914475 - DNA, 13 bp, Homo sapiens
gactttattattt

SEQ ID NO: 1914476 - DNA, 21 bp, Homo sapiens
gactttcaaagtggatgcaat

SEQ ID NO: 1914477 - DNA, 23 bp, Homo sapiens
gactttcacatttggaatttaaa

SEQ ID NO: 1914478 - DNA, 19 bp, Homo sapiens
gactttctgtgtaccactg

SEQ ID NO: 1914479 - DNA, 18 bp, Homo sapiens
gactttgatgtcagcagt

SEQ ID NO: 1914480 - DNA, 12 bp, Homo sapiens
gagaaaagaaaa

SEQ ID NO: 1914481 - DNA, 15 bp, Homo sapiens
gagaaaagaaaaaaa

SEQ ID NO: 1914482 - DNA, 23 bp, Homo sapiens
gagaaacttaaatgaacacagct

SEQ ID NO: 1914483 - DNA, 23 bp, Homo sapiens
gagaaatcttaagtcataatgaa

SEQ ID NO: 1914484 - DNA, 15 bp, Homo sapiens
gagaagagccccact

SEQ ID NO: 1914485 - DNA, 21 bp, Homo sapiens
gagaagagccccactctcaga

SEQ ID NO: 1914486 - DNA, 13 bp, Homo sapiens
gagaatagaaatt

SEQ ID NO: 1914487 - DNA, 14 bp, Homo sapiens
gagaatcacaggct

SEQ ID NO: 1914488 - DNA, 12 bp, Homo sapiens
gagacagaccac

SEQ ID NO: 1914489 - DNA, 13 bp, Homo sapiens
gagacagaccact

SEQ ID NO: 1914490 - DNA, 14 bp, Homo sapiens
gagacttctgtctt

SEQ ID NO: 1914491 - DNA, 10 bp, Homo sapiens
gagactttga

SEQ ID NO: 1914492 - DNA, 11 bp, Homo sapiens
gagactttgat

SEQ ID NO: 1914493 - DNA, 15 bp, Homo sapiens
gagactttgatgtca

SEQ ID NO: 1914494 - DNA, 19 bp, Homo sapiens
gagactttgatgtcagcag

SEQ ID NO: 1914495 - DNA, 16 bp, Homo sapiens
gagagaaagtgacatg

SEQ ID NO: 1914496 - DNA, 19 bp, Homo sapiens
gagagaaatcttaagtcat

SEQ ID NO: 1914497 - DNA, 14 bp, Homo sapiens
gagagcctgtgatc

SEQ ID NO: 1914498 - DNA, 13 bp, Homo sapiens
gagatactctggg

SEQ ID NO: 1914499 - DNA, 14 bp, Homo sapiens
gagatggatggaca

SEQ ID NO: 1914500 - DNA, 14 bp, Homo sapiens
gagattgtggggag

SEQ ID NO: 1914501 - DNA, 13 bp, Homo sapiens
gagcagaaggcag

SEQ ID NO: 1914502 - DNA, 15 bp, Homo sapiens
gagcagaaggcagga

SEQ ID NO: 1914503 - DNA, 22 bp, Homo sapiens
gagcaggccctgggcctccacc

SEQ ID NO: 1914504 - DNA, 16 bp, Homo sapiens
gagcagtatcatgaag

SEQ ID NO: 1914505 - DNA, 13 bp, Homo sapiens
gagccccactctc

SEQ ID NO: 1914506 - DNA, 18 bp, Homo sapiens
gagccccactctcagagg

SEQ ID NO: 1914507 - DNA, 19 bp, Homo sapiens
gagccccactctcagaggc

SEQ ID NO: 1914508 - DNA, 21 bp, Homo sapiens
gagccccactctcagaggccc

SEQ ID NO: 1914509 - DNA, 21 bp, Homo sapiens
gagccctcagtcggggcaggc

SEQ ID NO: 1914510 - DNA, 24 bp, Homo sapiens
gagccctcagtcggggcaggccag

SEQ ID NO: 1914511 - DNA, 15 bp, Homo sapiens
gagccctgggccagg

SEQ ID NO: 1914512 - DNA, 13 bp, Homo sapiens
gagcctgcccagc

SEQ ID NO: 1914513 - DNA, 18 bp, Homo sapiens
gagccttaatgtatttga

SEQ ID NO: 1914514 - DNA, 15 bp, Homo sapiens
gagccttggaggaca

SEQ ID NO: 1914515 - DNA, 23 bp, Homo sapiens
gagcgaccagcaggctcctcagc

SEQ ID NO: 1914516 - DNA, 17 bp, Homo sapiens
gagctcaagccgtggcc

SEQ ID NO: 1914517 - DNA, 16 bp, Homo sapiens
gagctcattaataaaa

SEQ ID NO: 1914518 - DNA, 17 bp, Homo sapiens
gagctcggggctggggg

SEQ ID NO: 1914519 - DNA, 17 bp, Homo sapiens
gagctgcactgatcacc

SEQ ID NO: 1914520 - DNA, 20 bp, Homo sapiens
gaggacactaagaggaggca

SEQ ID NO: 1914521 - DNA, 22 bp, Homo sapiens
gaggacagcctgcctctgccac

SEQ ID NO: 1914522 - DNA, 15 bp, Homo sapiens
gaggagccctgcctc

SEQ ID NO: 1914523 - DNA, 15 bp, Homo sapiens
gaggcaggagttgga

SEQ ID NO: 1914524 - DNA, 16 bp, Homo sapiens
gaggcatctctctggg

SEQ ID NO: 1914525 - DNA, 19 bp, Homo sapiens
gaggccaagagtggcccca

SEQ ID NO: 1914526 - DNA, 21 bp, Homo sapiens
gaggccaagagtggccccacc

SEQ ID NO: 1914527 - DNA, 11 bp, Homo sapiens
gaggccacctc

SEQ ID NO: 1914528 - DNA, 15 bp, Homo sapiens
gaggcccatggccac

SEQ ID NO: 1914529 - DNA, 21 bp, Homo sapiens
gaggccgttgctgacttagaa

SEQ ID NO: 1914530 - DNA, 12 bp, Homo sapiens
gaggcgagcagg

SEQ ID NO: 1914531 - DNA, 17 bp, Homo sapiens
gaggcgagcagggcagg

SEQ ID NO: 1914532 - DNA, 21 bp, Homo sapiens
gaggcggccggccgcactggg

SEQ ID NO: 1914533 - DNA, 16 bp, Homo sapiens
gaggctcaaattttga

SEQ ID NO: 1914534 - DNA, 14 bp, Homo sapiens
gaggctcagattgt

SEQ ID NO: 1914535 - DNA, 20 bp, Homo sapiens
gaggctcgagctcggggctg

SEQ ID NO: 1914536 - DNA, 22 bp, Homo sapiens
gaggctcgagctcggggctggg

SEQ ID NO: 1914537 - DNA, 19 bp, Homo sapiens
gaggctgctgccaggcccg

SEQ ID NO: 1914538 - DNA, 23 bp, Homo sapiens
gaggctggcaagaaccagttgtt

SEQ ID NO: 1914539 - DNA, 16 bp, Homo sapiens
gaggctgggctggcca

SEQ ID NO: 1914540 - DNA, 24 bp, Homo sapiens
gaggctgtggtcagagagggaagc

SEQ ID NO: 1914541 - DNA, 16 bp, Homo sapiens
gagggacagtctcacc

SEQ ID NO: 1914542 - DNA, 23 bp, Homo sapiens
gagggacagtctcaccatttccc

SEQ ID NO: 1914543 - DNA, 16 bp, Homo sapiens
gagggactctgtctgg

SEQ ID NO: 1914544 - DNA, 20 bp, Homo sapiens
gagggactctgtctggccag

SEQ ID NO: 1914545 - DNA, 22 bp, Homo sapiens
gagggaggaggcaggagttgga

SEQ ID NO: 1914546 - DNA, 17 bp, Homo sapiens
gagggcatttggcttcc

SEQ ID NO: 1914547 - DNA, 18 bp, Homo sapiens
gagggcatttggcttcct

SEQ ID NO: 1914548 - DNA, 21 bp, Homo sapiens
gagggcatttggcttcctctg

SEQ ID NO: 1914549 - DNA, 20 bp, Homo sapiens
gagggcctgggcctggctcc

SEQ ID NO: 1914550 - DNA, 20 bp, Homo sapiens
gaggggagactttgatgtca

SEQ ID NO: 1914551 - DNA, 16 bp, Homo sapiens
gaggggccagcggccc

SEQ ID NO: 1914552 - DNA, 22 bp, Homo sapiens
gagggtgccggaaagagagctg

SEQ ID NO: 1914553 - DNA, 17 bp, Homo sapiens
gaggtcccagggcccta

SEQ ID NO: 1914554 - DNA, 13 bp, Homo sapiens
gaggtgctggttc

SEQ ID NO: 1914555 - DNA, 19 bp, Homo sapiens
gaggttcaatgagatggtg

SEQ ID NO: 1914556 - DNA, 17 bp, Homo sapiens
gagtaatcttgttggtt

SEQ ID NO: 1914557 - DNA, 16 bp, Homo sapiens
gagtagctcgtcctca

SEQ ID NO: 1914558 - DNA, 12 bp, Homo sapiens
gagtattctaat

SEQ ID NO: 1914559 - DNA, 14 bp, Homo sapiens
gagtcatttctgat

SEQ ID NO: 1914560 - DNA, 19 bp, Homo sapiens
gagtccaaactggaatgag

SEQ ID NO: 1914561 - DNA, 17 bp, Homo sapiens
gagtctctctctctcca

SEQ ID NO: 1914562 - DNA, 19 bp, Homo sapiens
gagtctgaggccgttgctg

SEQ ID NO: 1914563 - DNA, 20 bp, Homo sapiens
gagtctgagggcttgtagtt

SEQ ID NO: 1914564 - DNA, 11 bp, Homo sapiens
gagtctgtgtg

SEQ ID NO: 1914565 - DNA, 16 bp, Homo sapiens
gagtctgttctggtaa

SEQ ID NO: 1914566 - DNA, 18 bp, Homo sapiens
gagtgaatgtaatagtct

SEQ ID NO: 1914567 - DNA, 19 bp, Homo sapiens
gagtgagaggggaggccaa

SEQ ID NO: 1914568 - DNA, 13 bp, Homo sapiens
gagtgcaggccca

SEQ ID NO: 1914569 - DNA, 18 bp, Homo sapiens
gagtgcaggcccaccctg

SEQ ID NO: 1914570 - DNA, 16 bp, Homo sapiens
gagtggattcctcccc

SEQ ID NO: 1914571 - DNA, 19 bp, Homo sapiens
gagtggtacaagggagaag

SEQ ID NO: 1914572 - DNA, 14 bp, Homo sapiens
gagtgtattctatt

SEQ ID NO: 1914573 - DNA, 14 bp, Homo sapiens
gagtgttctgggat

SEQ ID NO: 1914574 - DNA, 12 bp, Homo sapiens
gagttaactttt

SEQ ID NO: 1914575 - DNA, 18 bp, Homo sapiens
ggccgcactgggagcagc

SEQ ID NO: 1914576 - DNA, 17 bp, Homo sapiens
ggccggaaaacaagcct

SEQ ID NO: 1914577 - DNA, 16 bp, Homo sapiens
ggccgttgctgactta

SEQ ID NO: 1914578 - DNA, 17 bp, Homo sapiens
ggcctaaaagtaaacat

SEQ ID NO: 1914579 - DNA, 23 bp, Homo sapiens
ggcctacatgctttgtgaacaag

SEQ ID NO: 1914580 - DNA, 22 bp, Homo sapiens
ggcctcagtttccctatctgca

SEQ ID NO: 1914581 - DNA, 18 bp, Homo sapiens
ggcctccacctctgtgca

SEQ ID NO: 1914582 - DNA, 16 bp, Homo sapiens
ggcctcccactcccat

SEQ ID NO: 1914583 - DNA, 18 bp, Homo sapiens
ggcctcccactcccatgg

SEQ ID NO: 1914584 - DNA, 22 bp, Homo sapiens
ggcctcccactcccatggctct

SEQ ID NO: 1914585 - DNA, 14 bp, Homo sapiens
ggcctggcttgtct

SEQ ID NO: 1914586 - DNA, 12 bp, Homo sapiens
ggcctgggcctg

SEQ ID NO: 1914587 - DNA, 17 bp, Homo sapiens
ggcctgggcctggctcc

SEQ ID NO: 1914588 - DNA, 18 bp, Homo sapiens
ggcctgtccaacacatct

SEQ ID NO: 1914589 - DNA, 13 bp, Homo sapiens
ggccttctgcctg

SEQ ID NO: 1914590 - DNA, 14 bp, Homo sapiens
ggccttctgcctgc

SEQ ID NO: 1914591 - DNA, 20 bp, Homo sapiens
ggccttctgcctgctgacca

SEQ ID NO: 1914592 - DNA, 15 bp, Homo sapiens
ggcgaatcatttgtt

SEQ ID NO: 1914593 - DNA, 20 bp, Homo sapiens
ggcgacagagcaagactccg

SEQ ID NO: 1914594 - DNA, 15 bp, Homo sapiens
ggcgagcagggcagg

SEQ ID NO: 1914595 - DNA, 12 bp, Homo sapiens
ggctagagggtg

SEQ ID NO: 1914596 - DNA, 13 bp, Homo sapiens
ggctcagcaaggc

SEQ ID NO: 1914597 - DNA, 18 bp, Homo sapiens
ggctcagcaaggccacct

SEQ ID NO: 1914598 - DNA, 20 bp, Homo sapiens
ggctcagcaaggccacctct

SEQ ID NO: 1914599 - DNA, 22 bp, Homo sapiens
ggctcagcaaggccacctcttc

SEQ ID NO: 1914600 - DNA, 15 bp, Homo sapiens
ggctcccgcctccaa

SEQ ID NO: 1914601 - DNA, 14 bp, Homo sapiens
ggctcctcagccct

SEQ ID NO: 1914602 - DNA, 15 bp, Homo sapiens
ggctcctcagccctc

SEQ ID NO: 1914603 - DNA, 20 bp, Homo sapiens
ggctcgagctcggggctggg

SEQ ID NO: 1914604 - DNA, 23 bp, Homo sapiens
ggctcgagctcggggctgggggc

SEQ ID NO: 1914605 - DNA, 21 bp, Homo sapiens
ggctgaagtgcatgggtcagg

SEQ ID NO: 1914606 - DNA, 17 bp, Homo sapiens
ggctgagtgcaggccca

SEQ ID NO: 1914607 - DNA, 19 bp, Homo sapiens
ggctgagtgcaggcccacc

SEQ ID NO: 1914608 - DNA, 21 bp, Homo sapiens
ggctgagtgcaggcccaccct

SEQ ID NO: 1914609 - DNA, 19 bp, Homo sapiens
ggctgcagggctgggtcag

SEQ ID NO: 1914610 - DNA, 21 bp, Homo sapiens
ggctgcagggctgggtcaggg

SEQ ID NO: 1914611 - DNA, 13 bp, Homo sapiens
ggctgctgccagg

SEQ ID NO: 1914612 - DNA, 16 bp, Homo sapiens
ggctggcaccagcagg

SEQ ID NO: 1914613 - DNA, 18 bp, Homo sapiens
ggctggcaccagcaggca

SEQ ID NO: 1914614 - DNA, 15 bp, Homo sapiens
ggctggcgggccctg

SEQ ID NO: 1914615 - DNA, 14 bp, Homo sapiens
ggctgggcactgct

SEQ ID NO: 1914616 - DNA, 16 bp, Homo sapiens
ggctgggggctgcagg

SEQ ID NO: 1914617 - DNA, 17 bp, Homo sapiens
ggctgtggtcagagagg

SEQ ID NO: 1914618 - DNA, 12 bp, Homo sapiens
ggcttcataatc

SEQ ID NO: 1914619 - DNA, 13 bp, Homo sapiens
ggcttcctctgct

SEQ ID NO: 1914620 - DNA, 16 bp, Homo sapiens
ggcttcctctgctgca

SEQ ID NO: 1914621 - DNA, 17 bp, Homo sapiens
ggcttcctgaggggaga

SEQ ID NO: 1914622 - DNA, 14 bp, Homo sapiens
ggcttctcccaaca

SEQ ID NO: 1914623 - DNA, 12 bp, Homo sapiens
ggcttggccctg

SEQ ID NO: 1914624 - DNA, 17 bp, Homo sapiens
ggctttatttttttgaa

SEQ ID NO: 1914625 - DNA, 18 bp, Homo sapiens
ggcttttggtgaatttgt

SEQ ID NO: 1914626 - DNA, 16 bp, Homo sapiens
gggaacgcccacttcc

SEQ ID NO: 1914627 - DNA, 20 bp, Homo sapiens
gggaacgcccacttccctgg

SEQ ID NO: 1914628 - DNA, 20 bp, Homo sapiens
gggacaaccttggcttggcc

SEQ ID NO: 1914629 - DNA, 18 bp, Homo sapiens
gggacactgtggcagcag

SEQ ID NO: 1914630 - DNA, 15 bp, Homo sapiens
gggacagtctcacca

SEQ ID NO: 1914631 - DNA, 12 bp, Homo sapiens
gggaccacagag

SEQ ID NO: 1914632 - DNA, 14 bp, Homo sapiens
gggaccacagaggc

SEQ ID NO: 1914633 - DNA, 18 bp, Homo sapiens
gggaccacagaggctgtg

SEQ ID NO: 1914634 - DNA, 12 bp, Homo sapiens
gggaccagcttg

SEQ ID NO: 1914635 - DNA, 14 bp, Homo sapiens
gggactgccacctc

SEQ ID NO: 1914636 - DNA, 16 bp, Homo sapiens
gggactgccacctccc

SEQ ID NO: 1914637 - DNA, 13 bp, Homo sapiens
gggagacagagca

SEQ ID NO: 1914638 - DNA, 14 bp, Homo sapiens
gggagactttgatg

SEQ ID NO: 1914639 - DNA, 20 bp, Homo sapiens
gggaggagccccagtggtga

SEQ ID NO: 1914640 - DNA, 16 bp, Homo sapiens
gggaggagtggattcc

SEQ ID NO: 1914641 - DNA, 21 bp, Homo sapiens
gggaggagtggattcctcccc

SEQ ID NO: 1914642 - DNA, 22 bp, Homo sapiens
gggaggagtggattcctcccca

SEQ ID NO: 1914643 - DNA, 22 bp, Homo sapiens
gggaggccaagagtggccccac

SEQ ID NO: 1914644 - DNA, 18 bp, Homo sapiens
gggaggtcccagggccct

SEQ ID NO: 1914645 - DNA, 19 bp, Homo sapiens
gggagtaagtagaggtggc

SEQ ID NO: 1914646 - DNA, 16 bp, Homo sapiens
gggatgattgaagaaa

SEQ ID NO: 1914647 - DNA, 13 bp, Homo sapiens
gggatggcagtgg

SEQ ID NO: 1914648 - DNA, 22 bp, Homo sapiens
gggcaatttttgtatccaagga

SEQ ID NO: 1914649 - DNA, 17 bp, Homo sapiens
gggcactgctctcacct

SEQ ID NO: 1914650 - DNA, 13 bp, Homo sapiens
gggcagcaggggc

SEQ ID NO: 1914651 - DNA, 18 bp, Homo sapiens
gggcagcttgggctggcg

SEQ ID NO: 1914652 - DNA, 17 bp, Homo sapiens
gggcaggaccagcccac

SEQ ID NO: 1914653 - DNA, 17 bp, Homo sapiens
gggccagcggccctccc

SEQ ID NO: 1914654 - DNA, 19 bp, Homo sapiens
gggccagcggccctcccag

SEQ ID NO: 1914655 - DNA, 13 bp, Homo sapiens
gggcccaggcaga

SEQ ID NO: 1914656 - DNA, 22 bp, Homo sapiens
gggcccctccttgtgctgccag

SEQ ID NO: 1914657 - DNA, 23 bp, Homo sapiens
gggccctagaagatcacagcagg

SEQ ID NO: 1914658 - DNA, 18 bp, Homo sapiens
gggcctccacctctgtgc

SEQ ID NO: 1914659 - DNA, 11 bp, Homo sapiens
gggcctcccac

SEQ ID NO: 1914660 - DNA, 14 bp, Homo sapiens
gggcctcccactcc

SEQ ID NO: 1914661 - DNA, 14 bp, Homo sapiens
gggcctggcccatg

SEQ ID NO: 1914662 - DNA, 15 bp, Homo sapiens
gggcctggctccctc

SEQ ID NO: 1914663 - DNA, 15 bp, Homo sapiens
gggcctgggcctggc

SEQ ID NO: 1914664 - DNA, 14 bp, Homo sapiens
gggctagagggtgc

SEQ ID NO: 1914665 - DNA, 13 bp, Homo sapiens
gggctcagcaagg

SEQ ID NO: 1914666 - DNA, 15 bp, Homo sapiens
gggctcagcaaggcc

SEQ ID NO: 1914667 - DNA, 15 bp, Homo sapiens
gggctgcagggctgg

SEQ ID NO: 1914668 - DNA, 19 bp, Homo sapiens
gggctggcaccagcaggca

SEQ ID NO: 1914669 - DNA, 17 bp, Homo sapiens
gggctggcgggccctgg

SEQ ID NO: 1914670 - DNA, 17 bp, Homo sapiens
gggctgggcactgctct

SEQ ID NO: 1914671 - DNA, 21 bp, Homo sapiens
gggctgggggatgggcctgag

SEQ ID NO: 1914672 - DNA, 15 bp, Homo sapiens
gggctgggggctgca

SEQ ID NO: 1914673 - DNA, 16 bp, Homo sapiens
gggcttctgtgcccag

SEQ ID NO: 1914674 - DNA, 17 bp, Homo sapiens
gggcttgtagttcttta

SEQ ID NO: 1914675 - DNA, 15 bp, Homo sapiens
ggggaagaataattt

SEQ ID NO: 1914676 - DNA, 20 bp, Homo sapiens
ggggacaaccttggcttggc

SEQ ID NO: 1914677 - DNA, 15 bp, Homo sapiens
ggggaccagcttggc

SEQ ID NO: 1914678 - DNA, 15 bp, Homo sapiens
ggggacctcgggctg

SEQ ID NO: 1914679 - DNA, 18 bp, Homo sapiens
ggggagactttgatgtca

SEQ ID NO: 1914680 - DNA, 17 bp, Homo sapiens
ggggatccagctcaagg

SEQ ID NO: 1914681 - DNA, 22 bp, Homo sapiens
ggggcaggccaggggaggggtg

SEQ ID NO: 1914682 - DNA, 20 bp, Homo sapiens
ggggccccgtctcaggtctg

SEQ ID NO: 1914683 - DNA, 12 bp, Homo sapiens
ggggctcagcaa

SEQ ID NO: 1914684 - DNA, 14 bp, Homo sapiens
ggggctcagcaagg

SEQ ID NO: 1914685 - DNA, 20 bp, Homo sapiens
ggggctcccgcctccaaccc

SEQ ID NO: 1914686 - DNA, 12 bp, Homo sapiens
ggggctgcaggg

SEQ ID NO: 1914687 - DNA, 21 bp, Homo sapiens
gggggacctcgggctgttctg

SEQ ID NO: 1914688 - DNA, 16 bp, Homo sapiens
gggggctcagcaaggc

SEQ ID NO: 1914689 - DNA, 17 bp, Homo sapiens
gggggctgcagggctgg

SEQ ID NO: 1914690 - DNA, 19 bp, Homo sapiens
ggggtctctcacagacagg

SEQ ID NO: 1914691 - DNA, 17 bp, Homo sapiens
ggggttacttcagccac

SEQ ID NO: 1914692 - DNA, 13 bp, Homo sapiens
gggtacacagagc

SEQ ID NO: 1914693 - DNA, 23 bp, Homo sapiens
gggtagctgtaaggcatgaagga

SEQ ID NO: 1914694 - DNA, 19 bp, Homo sapiens
gggtcaggggtacacagag

SEQ ID NO: 1914695 - DNA, 20 bp, Homo sapiens
gggtcaggggtacacagagc

SEQ ID NO: 1914696 - DNA, 12 bp, Homo sapiens
gggtcagggtgt

SEQ ID NO: 1914697 - DNA, 19 bp, Homo sapiens
gggtcagggtgtgaggcca

SEQ ID NO: 1914698 - DNA, 20 bp, Homo sapiens
gggtctctagtgctgtgaaa

SEQ ID NO: 1914699 - DNA, 18 bp, Homo sapiens
gggtcttgcaaaattcct

SEQ ID NO: 1914700 - DNA, 22 bp, Homo sapiens
gggtcttgcaaaattcctgacg

SEQ ID NO: 1914701 - DNA, 17 bp, Homo sapiens
gggtgtgtgcagggctg

SEQ ID NO: 1914702 - DNA, 20 bp, Homo sapiens
gggtttcaccatgttggcca

SEQ ID NO: 1914703 - DNA, 12 bp, Homo sapiens
ggtaaaatgaag

SEQ ID NO: 1914704 - DNA, 19 bp, Homo sapiens
ggtactgtctcggcagagg

SEQ ID NO: 1914705 - DNA, 20 bp, Homo sapiens
ggtactgtctcggcagaggt

SEQ ID NO: 1914706 - DNA, 16 bp, Homo sapiens
ggtactttctgaaaat

SEQ ID NO: 1914707 - DNA, 23 bp, Homo sapiens
ggtactttctgaaaatttatata

SEQ ID NO: 1914708 - DNA, 14 bp, Homo sapiens
gtttccctccaggt

SEQ ID NO: 1914709 - DNA, 22 bp, Homo sapiens
gtttctgatagtagtctttaaa

SEQ ID NO: 1914710 - DNA, 21 bp, Homo sapiens
gtttctgtggttggctgggaa

SEQ ID NO: 1914711 - DNA, 18 bp, Homo sapiens
gtttctttttattttagt

SEQ ID NO: 1914712 - DNA, 20 bp, Homo sapiens
gtttgatgcattaaaagaaa

SEQ ID NO: 1914713 - DNA, 22 bp, Homo sapiens
gtttggttcaaatgtgttttgg

SEQ ID NO: 1914714 - DNA, 14 bp, Homo sapiens
gtttgtaaatgact

SEQ ID NO: 1914715 - DNA, 14 bp, Homo sapiens
gtttgtatgtataa

SEQ ID NO: 1914716 - DNA, 10 bp, Homo sapiens
gtttgtttca

SEQ ID NO: 1914717 - DNA, 23 bp, Homo sapiens
gtttgttttttgtttttctgctt

SEQ ID NO: 1914718 - DNA, 19 bp, Homo sapiens
gttttaaggactgactgag

SEQ ID NO: 1914719 - DNA, 21 bp, Homo sapiens
gttttccgcattctttgtaca

SEQ ID NO: 1914720 - DNA, 14 bp, Homo sapiens
gttttctactttga

SEQ ID NO: 1914721 - DNA, 16 bp, Homo sapiens
gttttcttgataattt

SEQ ID NO: 1914722 - DNA, 17 bp, Homo sapiens
gttttcttttttcccct

SEQ ID NO: 1914723 - DNA, 20 bp, Homo sapiens
gttttgaaataaaaagagta

SEQ ID NO: 1914724 - DNA, 23 bp, Homo sapiens
gttttgagataagttttgtttca

SEQ ID NO: 1914725 - DNA, 15 bp, Homo sapiens
gttttgttgtatttt

SEQ ID NO: 1914726 - DNA, 18 bp, Homo sapiens
gtttttctgctttagact

SEQ ID NO: 1914727 - DNA, 19 bp, Homo sapiens
gtttttctgctttagactt

SEQ ID NO: 1914728 - DNA, 16 bp, Homo sapiens
gtttttcttctgaaat

SEQ ID NO: 1914729 - DNA, 22 bp, Homo sapiens
taaaaacagatttggaaagact

SEQ ID NO: 1914730 - DNA, 22 bp, Homo sapiens
taaaaagataaaaaaacagctt

SEQ ID NO: 1914731 - DNA, 17 bp, Homo sapiens
taaaaagtgtttaaatg

SEQ ID NO: 1914732 - DNA, 14 bp, Homo sapiens
taaaactttgtaga

SEQ ID NO: 1914733 - DNA, 14 bp, Homo sapiens
taaaagaaaataaa

SEQ ID NO: 1914734 - DNA, 22 bp, Homo sapiens
taaaagaaaataaaaaaaagaa

SEQ ID NO: 1914735 - DNA, 19 bp, Homo sapiens
taaaagcacaaaggaatga

SEQ ID NO: 1914736 - DNA, 16 bp, Homo sapiens
taaaagcattttgtaa

SEQ ID NO: 1914737 - DNA, 17 bp, Homo sapiens
taaaagcattttgtaat

SEQ ID NO: 1914738 - DNA, 14 bp, Homo sapiens
taaaagcccaggag

SEQ ID NO: 1914739 - DNA, 12 bp, Homo sapiens
taaaaggcccag

SEQ ID NO: 1914740 - DNA, 14 bp, Homo sapiens
taaaaggcccagag

SEQ ID NO: 1914741 - DNA, 12 bp, Homo sapiens
taaaagtgctgc

SEQ ID NO: 1914742 - DNA, 13 bp, Homo sapiens
taaaataattttg

SEQ ID NO: 1914743 - DNA, 14 bp, Homo sapiens
taaaataattttgt

SEQ ID NO: 1914744 - DNA, 22 bp, Homo sapiens
taaaattttttgagtgaagttt

SEQ ID NO: 1914745 - DNA, 16 bp, Homo sapiens
taaacagttatgaaaa

SEQ ID NO: 1914746 - DNA, 15 bp, Homo sapiens
taaacattatttttc

SEQ ID NO: 1914747 - DNA, 23 bp, Homo sapiens
taaacgtggagaatcacaggctg

SEQ ID NO: 1914748 - DNA, 22 bp, Homo sapiens
taaagaaaaatcagtttttgac

SEQ ID NO: 1914749 - DNA, 20 bp, Homo sapiens
taaagaatttgtcacaggaa

SEQ ID NO: 1914750 - DNA, 11 bp, Homo sapiens
taaagactcta

SEQ ID NO: 1914751 - DNA, 17 bp, Homo sapiens
taaagatttaggccaat

SEQ ID NO: 1914752 - DNA, 19 bp, Homo sapiens
taaagcaaccaaaaagaaa

SEQ ID NO: 1914753 - DNA, 23 bp, Homo sapiens
taaagctcgtccccattgcttaa

SEQ ID NO: 1914754 - DNA, 22 bp, Homo sapiens
taaagtctgttgattaaagatg

SEQ ID NO: 1914755 - DNA, 22 bp, Homo sapiens
taaagtgaacagattttattaa

SEQ ID NO: 1914756 - DNA, 17 bp, Homo sapiens
taaagttgtcttttaaa

SEQ ID NO: 1914757 - DNA, 18 bp, Homo sapiens
taaataagttataaagat

SEQ ID NO: 1914758 - DNA, 13 bp, Homo sapiens
taaataattcttt

SEQ ID NO: 1914759 - DNA, 21 bp, Homo sapiens
taaatatagcagtagtctttt

SEQ ID NO: 1914760 - DNA, 15 bp, Homo sapiens
taaatgactttcata

SEQ ID NO: 1914761 - DNA, 15 bp, Homo sapiens
taaatgctgaaataa

SEQ ID NO: 1914762 - DNA, 16 bp, Homo sapiens
taaattatgttttact

SEQ ID NO: 1914763 - DNA, 17 bp, Homo sapiens
taaattattgatgaaaa

SEQ ID NO: 1914764 - DNA, 11 bp, Homo sapiens
taaattctgat

SEQ ID NO: 1914765 - DNA, 13 bp, Homo sapiens
taaattctgattt

SEQ ID NO: 1914766 - DNA, 16 bp, Homo sapiens
taaattctgatttctt

SEQ ID NO: 1914767 - DNA, 20 bp, Homo sapiens
taaattctgatttcttttca

SEQ ID NO: 1914768 - DNA, 14 bp, Homo sapiens
taaattgtcttaat

SEQ ID NO: 1914769 - DNA, 15 bp, Homo sapiens
taaattttgaaaagt

SEQ ID NO: 1914770 - DNA, 22 bp, Homo sapiens
taaattttgaaaagtaatattt

SEQ ID NO: 1914771 - DNA, 21 bp, Homo sapiens
taaatttttttgtatgaaaac

SEQ ID NO: 1914772 - DNA, 22 bp, Homo sapiens
taaatttttttgtatgaaaaca

SEQ ID NO: 1914773 - DNA, 17 bp, Homo sapiens
taacaaaaaagagaaac

SEQ ID NO: 1914774 - DNA, 14 bp, Homo sapiens
taacaagaaaatga

SEQ ID NO: 1914775 - DNA, 16 bp, Homo sapiens
taacaagtcatttcaa

SEQ ID NO: 1914776 - DNA, 17 bp, Homo sapiens
taacagcagtttcaggt

SEQ ID NO: 1914777 - DNA, 23 bp, Homo sapiens
taacagggtctctagtgctgtga

SEQ ID NO: 1914778 - DNA, 17 bp, Homo sapiens
taacagtggacaaagtt

SEQ ID NO: 1914779 - DNA, 19 bp, Homo sapiens
taacatagccaaaatgtga

SEQ ID NO: 1914780 - DNA, 16 bp, Homo sapiens
taacccagaaaatctg

SEQ ID NO: 1914781 - DNA, 18 bp, Homo sapiens
taacgttttctactttga

SEQ ID NO: 1914782 - DNA, 20 bp, Homo sapiens
taacgttttctactttgaaa

SEQ ID NO: 1914783 - DNA, 23 bp, Homo sapiens
taacgttttctactttgaaatat

SEQ ID NO: 1914784 - DNA, 21 bp, Homo sapiens
taactaaaataattttgtaat

SEQ ID NO: 1914785 - DNA, 19 bp, Homo sapiens
taactaacaaacagattct

SEQ ID NO: 1914786 - DNA, 16 bp, Homo sapiens
taacttaataatcaag

SEQ ID NO: 1914787 - DNA, 21 bp, Homo sapiens
taacttaataatcaagagcct

SEQ ID NO: 1914788 - DNA, 18 bp, Homo sapiens
taactttggttaaaatct

SEQ ID NO: 1914789 - DNA, 15 bp, Homo sapiens
taacttttaaagaat

SEQ ID NO: 1914790 - DNA, 19 bp, Homo sapiens
taacttttaaagaattctt

SEQ ID NO: 1914791 - DNA, 16 bp, Homo sapiens
taagaaaagatgtaga

SEQ ID NO: 1914792 - DNA, 15 bp, Homo sapiens
taagaaatacagact

SEQ ID NO: 1914793 - DNA, 19 bp, Homo sapiens
taagaaattcctagtgtct

SEQ ID NO: 1914794 - DNA, 15 bp, Homo sapiens
taagacttaatatgt

SEQ ID NO: 1914795 - DNA, 21 bp, Homo sapiens
taagagcttccaattttcctt

SEQ ID NO: 1914796 - DNA, 22 bp, Homo sapiens
taagataattgtactttgaaaa

SEQ ID NO: 1914797 - DNA, 14 bp, Homo sapiens
taagatcactgttt

SEQ ID NO: 1914798 - DNA, 15 bp, Homo sapiens
taagatcactgttta

SEQ ID NO: 1914799 - DNA, 17 bp, Homo sapiens
taagatcccagtgtgaa

SEQ ID NO: 1914800 - DNA, 13 bp, Homo sapiens
taagccatgagaa

SEQ ID NO: 1914801 - DNA, 20 bp, Homo sapiens
taagccattctgactcatat

SEQ ID NO: 1914802 - DNA, 17 bp, Homo sapiens
taagcctaatatttatg

SEQ ID NO: 1914803 - DNA, 16 bp, Homo sapiens
taagctagttgaatac

SEQ ID NO: 1914804 - DNA, 19 bp, Homo sapiens
taagctagttgaatacttg

SEQ ID NO: 1914805 - DNA, 21 bp, Homo sapiens
taagctagttgaatacttgaa

SEQ ID NO: 1914806 - DNA, 18 bp, Homo sapiens
taagctggtgttataata

SEQ ID NO: 1914807 - DNA, 17 bp, Homo sapiens
taagctttgtaattcag

SEQ ID NO: 1914808 - DNA, 13 bp, Homo sapiens
taaggaaacattg

SEQ ID NO: 1914809 - DNA, 14 bp, Homo sapiens
taaggaatatggga

SEQ ID NO: 1914810 - DNA, 20 bp, Homo sapiens
taaggaatatgggagaaata

SEQ ID NO: 1914811 - DNA, 14 bp, Homo sapiens
taaggactgactga

SEQ ID NO: 1914812 - DNA, 19 bp, Homo sapiens
taaggactgactgaggcag

SEQ ID NO: 1914813 - DNA, 23 bp, Homo sapiens
taaggactttggcttacatttga

SEQ ID NO: 1914814 - DNA, 17 bp, Homo sapiens
taaggatacaggctgga

SEQ ID NO: 1914815 - DNA, 17 bp, Homo sapiens
taaggccaatgggctag

SEQ ID NO: 1914816 - DNA, 21 bp, Homo sapiens
taaggtggaaagtgttcattg

SEQ ID NO: 1914817 - DNA, 12 bp, Homo sapiens
taaggttaatta

SEQ ID NO: 1914818 - DNA, 17 bp, Homo sapiens
taagtatgtcaacagcc

SEQ ID NO: 1914819 - DNA, 21 bp, Homo sapiens
taagtattttcctgttgtcaa

SEQ ID NO: 1914820 - DNA, 15 bp, Homo sapiens
taagtgaaaatatag

SEQ ID NO: 1914821 - DNA, 19 bp, Homo sapiens
taagtgaggaaatcaaagt

SEQ ID NO: 1914822 - DNA, 21 bp, Homo sapiens
taagtgaggaaatcaaagtgc

SEQ ID NO: 1914823 - DNA, 18 bp, Homo sapiens
taagtgtgaccagttttg

SEQ ID NO: 1914824 - DNA, 23 bp, Homo sapiens
taagttggtaaagtatttactga

SEQ ID NO: 1914825 - DNA, 19 bp, Homo sapiens
taataagaccccactggag

SEQ ID NO: 1914826 - DNA, 17 bp, Homo sapiens
taataccctgtacatat

SEQ ID NO: 1914827 - DNA, 23 bp, Homo sapiens
taataccctgtacatatctttga

SEQ ID NO: 1914828 - DNA, 13 bp, Homo sapiens
taatactgaacca

SEQ ID NO: 1914829 - DNA, 15 bp, Homo sapiens
taatactgaaccact

SEQ ID NO: 1914830 - DNA, 21 bp, Homo sapiens
taatactgaaccacttgtaga

SEQ ID NO: 1914831 - DNA, 16 bp, Homo sapiens
taatatgttttattca

SEQ ID NO: 1914832 - DNA, 17 bp, Homo sapiens
taatatttattaaattt

SEQ ID NO: 1914833 - DNA, 21 bp, Homo sapiens
taatcactgtgtatatttgat

SEQ ID NO: 1914834 - DNA, 22 bp, Homo sapiens
taatcatggctcttagaaactc

SEQ ID NO: 1914835 - DNA, 16 bp, Homo sapiens
taatctactgcattta

SEQ ID NO: 1914836 - DNA, 22 bp, Homo sapiens
taatgctaatcttgtgaaaata

SEQ ID NO: 1914837 - DNA, 19 bp, Homo sapiens
taatggagaattaaaactt

SEQ ID NO: 1914838 - DNA, 16 bp, Homo sapiens
taatgtatacttgaaa

SEQ ID NO: 1914839 - DNA, 15 bp, Homo sapiens
taatgtctagatttt

SEQ ID NO: 1914840 - DNA, 22 bp, Homo sapiens
tccagtgaggcatctctctggg

SEQ ID NO: 1914841 - DNA, 17 bp, Homo sapiens
tccagtggcttctccca

SEQ ID NO: 1914842 - DNA, 15 bp, Homo sapiens
tccatagctcaataa

SEQ ID NO: 1914843 - DNA, 16 bp, Homo sapiens
tccatagctcaataaa

SEQ ID NO: 1914844 - DNA, 20 bp, Homo sapiens
tccatccctctcctctgccc

SEQ ID NO: 1914845 - DNA, 13 bp, Homo sapiens
tccatctctgaaa

SEQ ID NO: 1914846 - DNA, 13 bp, Homo sapiens
tccatctcttcct

SEQ ID NO: 1914847 - DNA, 14 bp, Homo sapiens
tccatctcttcctt

SEQ ID NO: 1914848 - DNA, 17 bp, Homo sapiens
tccatctgattccagca

SEQ ID NO: 1914849 - DNA, 12 bp, Homo sapiens
tccatggagttg

SEQ ID NO: 1914850 - DNA, 19 bp, Homo sapiens
tccatggggtctctcacag

SEQ ID NO: 1914851 - DNA, 19 bp, Homo sapiens
tccatgtgaaacatgttgc

SEQ ID NO: 1914852 - DNA, 11 bp, Homo sapiens
tccatttgctt

SEQ ID NO: 1914853 - DNA, 21 bp, Homo sapiens
tcccaacactcttggggacca

SEQ ID NO: 1914854 - DNA, 20 bp, Homo sapiens
tcccaccctacccccttttt

SEQ ID NO: 1914855 - DNA, 15 bp, Homo sapiens
tcccaccctttctgc

SEQ ID NO: 1914856 - DNA, 21 bp, Homo sapiens
tcccaccttcctcccacctca

SEQ ID NO: 1914857 - DNA, 14 bp, Homo sapiens
tcccactcccatgg

SEQ ID NO: 1914858 - DNA, 16 bp, Homo sapiens
tcccagaccccgcagc

SEQ ID NO: 1914859 - DNA, 18 bp, Homo sapiens
tcccagaccccgcagcac

SEQ ID NO: 1914860 - DNA, 18 bp, Homo sapiens
tcccaggagcctgcccag

SEQ ID NO: 1914861 - DNA, 20 bp, Homo sapiens
tcccaggcagcgccactgtc

SEQ ID NO: 1914862 - DNA, 16 bp, Homo sapiens
tcccagggagcaaggg

SEQ ID NO: 1914863 - DNA, 19 bp, Homo sapiens
tcccagggagcaagggcag

SEQ ID NO: 1914864 - DNA, 13 bp, Homo sapiens
tcccagggcccta

SEQ ID NO: 1914865 - DNA, 20 bp, Homo sapiens
tcccagttgctgtcacaaag

SEQ ID NO: 1914866 - DNA, 15 bp, Homo sapiens
tcccatggctctggg

SEQ ID NO: 1914867 - DNA, 17 bp, Homo sapiens
tccccaagcctggcagg

SEQ ID NO: 1914868 - DNA, 18 bp, Homo sapiens
tccccaagcctggcaggg

SEQ ID NO: 1914869 - DNA, 12 bp, Homo sapiens
tccccagggcac

SEQ ID NO: 1914870 - DNA, 12 bp, Homo sapiens
tccccccatccc

SEQ ID NO: 1914871 - DNA, 13 bp, Homo sapiens
tccccctctgccc

SEQ ID NO: 1914872 - DNA, 22 bp, Homo sapiens
tcccctaaagcctcaaaacaaa

SEQ ID NO: 1914873 - DNA, 14 bp, Homo sapiens
tcccctcctttacc

SEQ ID NO: 1914874 - DNA, 13 bp, Homo sapiens
tcccctgctggcc

SEQ ID NO: 1914875 - DNA, 20 bp, Homo sapiens
tcccctggaagcagtgccca

SEQ ID NO: 1914876 - DNA, 21 bp, Homo sapiens
tcccctggaagcagtgcccag

SEQ ID NO: 1914877 - DNA, 23 bp, Homo sapiens
tcccctggaagcagtgcccaggt

SEQ ID NO: 1914878 - DNA, 22 bp, Homo sapiens
tccccttccagctccctcccct

SEQ ID NO: 1914879 - DNA, 12 bp, Homo sapiens
tccccttcccag

SEQ ID NO: 1914880 - DNA, 13 bp, Homo sapiens
tccccttcccaga

SEQ ID NO: 1914881 - DNA, 17 bp, Homo sapiens
tccccttgccagctgct

SEQ ID NO: 1914882 - DNA, 17 bp, Homo sapiens
tccctcactctcaggaa

SEQ ID NO: 1914883 - DNA, 13 bp, Homo sapiens
tccctcccagctc

SEQ ID NO: 1914884 - DNA, 14 bp, Homo sapiens
tccctcctttcctt

SEQ ID NO: 1914885 - DNA, 16 bp, Homo sapiens
tccctcctttcctttt

SEQ ID NO: 1914886 - DNA, 19 bp, Homo sapiens
tccctgacgtctgccacca

SEQ ID NO: 1914887 - DNA, 20 bp, Homo sapiens
tccctgggttagactgccag

SEQ ID NO: 1914888 - DNA, 22 bp, Homo sapiens
tccctgggttagactgccagct

SEQ ID NO: 1914889 - DNA, 23 bp, Homo sapiens
tccctgggttagactgccagctc

SEQ ID NO: 1914890 - DNA, 14 bp, Homo sapiens
tccctggttcaagc

SEQ ID NO: 1914891 - DNA, 16 bp, Homo sapiens
tcccttccatctcttc

SEQ ID NO: 1914892 - DNA, 17 bp, Homo sapiens
tcccttccatctcttcc

SEQ ID NO: 1914893 - DNA, 20 bp, Homo sapiens
tcccttccatctcttccttt

SEQ ID NO: 1914894 - DNA, 13 bp, Homo sapiens
tccctttcctttc

SEQ ID NO: 1914895 - DNA, 15 bp, Homo sapiens
tccctttcctttcct

SEQ ID NO: 1914896 - DNA, 14 bp, Homo sapiens
tcccttttccatga

SEQ ID NO: 1914897 - DNA, 14 bp, Homo sapiens
tcccttttctttcc

SEQ ID NO: 1914898 - DNA, 15 bp, Homo sapiens
tcccttttctttcct

SEQ ID NO: 1914899 - DNA, 14 bp, Homo sapiens
tccgaaatcagcag

SEQ ID NO: 1914900 - DNA, 18 bp, Homo sapiens
tccgagtctttctcactg

SEQ ID NO: 1914901 - DNA, 19 bp, Homo sapiens
tccgagtctttctcactgc

SEQ ID NO: 1914902 - DNA, 21 bp, Homo sapiens
tccgagtctttctcactgcct

SEQ ID NO: 1914903 - DNA, 15 bp, Homo sapiens
tccgccccgtccccc

SEQ ID NO: 1914904 - DNA, 14 bp, Homo sapiens
tccgcccctgagcc

SEQ ID NO: 1914905 - DNA, 20 bp, Homo sapiens
tccgcccctgagcccactgt

SEQ ID NO: 1914906 - DNA, 21 bp, Homo sapiens
tccgcccctgagcccactgtg

SEQ ID NO: 1914907 - DNA, 18 bp, Homo sapiens
tccgctgtctccctcctg

SEQ ID NO: 1914908 - DNA, 19 bp, Homo sapiens
tccgctgtctccctcctga

SEQ ID NO: 1914909 - DNA, 16 bp, Homo sapiens
tccggctaagcaggcg

SEQ ID NO: 1914910 - DNA, 13 bp, Homo sapiens
tcctagtgtcttt

SEQ ID NO: 1914911 - DNA, 19 bp, Homo sapiens
tcctagtttgctgtggcct

SEQ ID NO: 1914912 - DNA, 12 bp, Homo sapiens
tcctattagtgt

SEQ ID NO: 1914913 - DNA, 15 bp, Homo sapiens
tcctcactggtctac

SEQ ID NO: 1914914 - DNA, 14 bp, Homo sapiens
tcctcagccctctc

SEQ ID NO: 1914915 - DNA, 18 bp, Homo sapiens
tcctcagccctctcttgc

SEQ ID NO: 1914916 - DNA, 20 bp, Homo sapiens
tcctcagccctctcttgcca

SEQ ID NO: 1914917 - DNA, 11 bp, Homo sapiens
tcctccccacc

SEQ ID NO: 1914918 - DNA, 17 bp, Homo sapiens
tcctccccaccctgtcc

SEQ ID NO: 1914919 - DNA, 22 bp, Homo sapiens
tcctccccaccctgtcccaggc

SEQ ID NO: 1914920 - DNA, 15 bp, Homo sapiens
tcctcccctggactc

SEQ ID NO: 1914921 - DNA, 13 bp, Homo sapiens
tcctcctgccctc

SEQ ID NO: 1914922 - DNA, 14 bp, Homo sapiens
tcctcctgccctcc

SEQ ID NO: 1914923 - DNA, 12 bp, Homo sapiens
tcctctgctgca

SEQ ID NO: 1914924 - DNA, 13 bp, Homo sapiens
tcctctgctgcat

SEQ ID NO: 1914925 - DNA, 17 bp, Homo sapiens
tcctctgctgcatcccc

SEQ ID NO: 1914926 - DNA, 20 bp, Homo sapiens
tcctctgctgcatccccttc

SEQ ID NO: 1914927 - DNA, 23 bp, Homo sapiens
tcctctgctgcatccccttccag

SEQ ID NO: 1914928 - DNA, 20 bp, Homo sapiens
tcctcttctaccatttccca

SEQ ID NO: 1914929 - DNA, 18 bp, Homo sapiens
tcctgacgagataagcag

SEQ ID NO: 1914930 - DNA, 11 bp, Homo sapiens
tcctgagcccc

SEQ ID NO: 1914931 - DNA, 16 bp, Homo sapiens
tcctgagcccccagct

SEQ ID NO: 1914932 - DNA, 23 bp, Homo sapiens
tcctgaggtgatgaagacagccc

SEQ ID NO: 1914933 - DNA, 21 bp, Homo sapiens
tcctgattattttcagaagct

SEQ ID NO: 1914934 - DNA, 23 bp, Homo sapiens
tcctggaggctcaaattttgagt

SEQ ID NO: 1914935 - DNA, 20 bp, Homo sapiens
tcctgggcagcttgggctgg

SEQ ID NO: 1914936 - DNA, 21 bp, Homo sapiens
tcctgggcagcttgggctggc

SEQ ID NO: 1914937 - DNA, 22 bp, Homo sapiens
tcctgggcagcttgggctggcg

SEQ ID NO: 1914938 - DNA, 19 bp, Homo sapiens
tcctggggcatccatgggg

SEQ ID NO: 1914939 - DNA, 17 bp, Homo sapiens
tcctgtcatctgagaat

SEQ ID NO: 1914940 - DNA, 19 bp, Homo sapiens
tcctgtcatctgagaatga

SEQ ID NO: 1914941 - DNA, 21 bp, Homo sapiens
tcctgtccattcggaaccagg

SEQ ID NO: 1914942 - DNA, 22 bp, Homo sapiens
tcctgttaggtattagaaagtg

SEQ ID NO: 1914943 - DNA, 16 bp, Homo sapiens
tcctgtttcagaccag

SEQ ID NO: 1914944 - DNA, 20 bp, Homo sapiens
tccttagatgtgtctcctgt

SEQ ID NO: 1914945 - DNA, 16 bp, Homo sapiens
tccttctgtagcctga

SEQ ID NO: 1914946 - DNA, 16 bp, Homo sapiens
tccttgaaccctaata

SEQ ID NO: 1914947 - DNA, 22 bp, Homo sapiens
tccttgaaccctaataagaccc

SEQ ID NO: 1914948 - DNA, 15 bp, Homo sapiens
tccttgaagcttgta

SEQ ID NO: 1914949 - DNA, 23 bp, Homo sapiens
tccttggaaatcaaatgtaaagt

SEQ ID NO: 1914950 - DNA, 16 bp, Homo sapiens
tccttgtgctgccagt

SEQ ID NO: 1914951 - DNA, 23 bp, Homo sapiens
tcctttaacctttgctgtagtgt

SEQ ID NO: 1914952 - DNA, 19 bp, Homo sapiens
tcctttcctttcctttctt

SEQ ID NO: 1914953 - DNA, 16 bp, Homo sapiens
tcctttctcaccagcc

SEQ ID NO: 1914954 - DNA, 23 bp, Homo sapiens
tccttttaagtggactctctgac

SEQ ID NO: 1914955 - DNA, 14 bp, Homo sapiens
tcctttttatttat

SEQ ID NO: 1914956 - DNA, 13 bp, Homo sapiens
tcctttttttccc

SEQ ID NO: 1914957 - DNA, 21 bp, Homo sapiens
tcgaaaagaaattgtccttga

SEQ ID NO: 1914958 - DNA, 14 bp, Homo sapiens
tcgacttgcatttt

SEQ ID NO: 1914959 - DNA, 17 bp, Homo sapiens
tcgagttacagcctggg

SEQ ID NO: 1914960 - DNA, 17 bp, Homo sapiens
tcgcccagtcccagcag

SEQ ID NO: 1914961 - DNA, 21 bp, Homo sapiens
tcgcccagtcccagcagccag

SEQ ID NO: 1914962 - DNA, 18 bp, Homo sapiens
tcgggctgttctggtggc

SEQ ID NO: 1914963 - DNA, 20 bp, Homo sapiens
tcggggctgggggctgcagg

SEQ ID NO: 1914964 - DNA, 15 bp, Homo sapiens
tcgtacataatactg

SEQ ID NO: 1914965 - DNA, 20 bp, Homo sapiens
tcgtggctaaggtaagaacg

SEQ ID NO: 1914966 - DNA, 18 bp, Homo sapiens
tcgttcgctcgctctctc

SEQ ID NO: 1914967 - DNA, 14 bp, Homo sapiens
tctaaaaaaataaa

SEQ ID NO: 1914968 - DNA, 22 bp, Homo sapiens
tctaaatttggaacttacaaag

SEQ ID NO: 1914969 - DNA, 13 bp, Homo sapiens
tctaacagtaaca

SEQ ID NO: 1914970 - DNA, 20 bp, Homo sapiens
tctaaccattctgtattgat

SEQ ID NO: 1914971 - DNA, 15 bp, Homo sapiens
tctaagagacctgaa

SEQ ID NO: 1914972 - DNA, 22 bp, Homo sapiens
tctaaggagttttgttgtattt

SEQ ID NO: 1914973 - DNA, 10 bp, Homo sapiens
tggtctttga

SEQ ID NO: 1914974 - DNA, 11 bp, Homo sapiens
tggtctttgag

SEQ ID NO: 1914975 - DNA, 14 bp, Homo sapiens
tggtcttttggtta

SEQ ID NO: 1914976 - DNA, 14 bp, Homo sapiens
tggttaagggactt

SEQ ID NO: 1914977 - DNA, 18 bp, Homo sapiens
tggttccatgcctgctct

SEQ ID NO: 1914978 - DNA, 18 bp, Homo sapiens
tggttcctggggcatcca

SEQ ID NO: 1914979 - DNA, 16 bp, Homo sapiens
tggttgagtgggggga

SEQ ID NO: 1914980 - DNA, 15 bp, Homo sapiens
tggtttacagatgtt

SEQ ID NO: 1914981 - DNA, 15 bp, Homo sapiens
tggtttacctgcacc

SEQ ID NO: 1914982 - DNA, 17 bp, Homo sapiens
tggttttctactgttat

SEQ ID NO: 1914983 - DNA, 19 bp, Homo sapiens
tgtaaaagaacagtaaaca

SEQ ID NO: 1914984 - DNA, 18 bp, Homo sapiens
tgtaaaagcattttgtaa

SEQ ID NO: 1914985 - DNA, 14 bp, Homo sapiens
tgtaaaatgaattt

SEQ ID NO: 1914986 - DNA, 15 bp, Homo sapiens
tgtaaataattcttt

SEQ ID NO: 1914987 - DNA, 20 bp, Homo sapiens
tgtaaatgctcctagagtat

SEQ ID NO: 1914988 - DNA, 18 bp, Homo sapiens
tgtaaatgtattcattct

SEQ ID NO: 1914989 - DNA, 19 bp, Homo sapiens
tgtaaatgtattcattctt

SEQ ID NO: 1914990 - DNA, 12 bp, Homo sapiens
tgtaaattctga

SEQ ID NO: 1914991 - DNA, 13 bp, Homo sapiens
tgtaaattctgat

SEQ ID NO: 1914992 - DNA, 22 bp, Homo sapiens
tgtaaattctgatttcttttca

SEQ ID NO: 1914993 - DNA, 18 bp, Homo sapiens
tgtaacaaagtttgctga

SEQ ID NO: 1914994 - DNA, 14 bp, Homo sapiens
tgtaacaagaaaat

SEQ ID NO: 1914995 - DNA, 15 bp, Homo sapiens
tgtaactaaaataat

SEQ ID NO: 1914996 - DNA, 23 bp, Homo sapiens
tgtaactaaaataattttgtaat

SEQ ID NO: 1914997 - DNA, 21 bp, Homo sapiens
tgtaagcgtatggctttattt

SEQ ID NO: 1914998 - DNA, 20 bp, Homo sapiens
tgtaaggttttttttgtacg

SEQ ID NO: 1914999 - DNA, 19 bp, Homo sapiens
tgtaataataaagaatagc

SEQ ID NO: 1915000 - DNA, 12 bp, Homo sapiens
tgtaataatgga

SEQ ID NO: 1915001 - DNA, 18 bp, Homo sapiens
tgtaatgtatacttgaaa

SEQ ID NO: 1915002 - DNA, 20 bp, Homo sapiens
tgtaattttgtgtaagaaat

SEQ ID NO: 1915003 - DNA, 18 bp, Homo sapiens
tgtacaatgactttattg

SEQ ID NO: 1915004 - DNA, 14 bp, Homo sapiens
tgtacagatatgca

SEQ ID NO: 1915005 - DNA, 18 bp, Homo sapiens
tgtacatttgaaaatatt

SEQ ID NO: 1915006 - DNA, 19 bp, Homo sapiens
tgtacccattgcagaccct

SEQ ID NO: 1915007 - DNA, 13 bp, Homo sapiens
tgtactttgaaaa

SEQ ID NO: 1915008 - DNA, 19 bp, Homo sapiens
tgtagacattttgaaataa

SEQ ID NO: 1915009 - DNA, 16 bp, Homo sapiens
tgtagacggaacagtg

SEQ ID NO: 1915010 - DNA, 18 bp, Homo sapiens
tgtagctgcgtcataagg

SEQ ID NO: 1915011 - DNA, 18 bp, Homo sapiens
tgtatagttatgtaaata

SEQ ID NO: 1915012 - DNA, 14 bp, Homo sapiens
tgtatattggtttt

SEQ ID NO: 1915013 - DNA, 12 bp, Homo sapiens
tgtatatttgat

SEQ ID NO: 1915014 - DNA, 14 bp, Homo sapiens
tgtatatttgattt

SEQ ID NO: 1915015 - DNA, 16 bp, Homo sapiens
tgtatatttgatttat

SEQ ID NO: 1915016 - DNA, 18 bp, Homo sapiens
tgtatatttttgatcttt

SEQ ID NO: 1915017 - DNA, 14 bp, Homo sapiens
tgtatcaaactgct

SEQ ID NO: 1915018 - DNA, 14 bp, Homo sapiens
tgtatcaaatacat

SEQ ID NO: 1915019 - DNA, 14 bp, Homo sapiens
tgtatgtgtttaga

SEQ ID NO: 1915020 - DNA, 15 bp, Homo sapiens
tgtatgtgtttagaa

SEQ ID NO: 1915021 - DNA, 16 bp, Homo sapiens
tgtatgtgtttagaat

SEQ ID NO: 1915022 - DNA, 13 bp, Homo sapiens
tgtattcattctt

SEQ ID NO: 1915023 - DNA, 14 bp, Homo sapiens
tgtattctgtaaaa

SEQ ID NO: 1915024 - DNA, 19 bp, Homo sapiens
tgtattgattatataagca

SEQ ID NO: 1915025 - DNA, 14 bp, Homo sapiens
tgtattgtcctatt

SEQ ID NO: 1915026 - DNA, 17 bp, Homo sapiens
tgtcaaaagtagaactt

SEQ ID NO: 1915027 - DNA, 20 bp, Homo sapiens
tgtcaaaagtagaactttgt

SEQ ID NO: 1915028 - DNA, 17 bp, Homo sapiens
tgtcaagtgtcagtaag

SEQ ID NO: 1915029 - DNA, 21 bp, Homo sapiens
tgtcacaggaaggctgtctca

SEQ ID NO: 1915030 - DNA, 20 bp, Homo sapiens
tgtcaccactacagtaagct

SEQ ID NO: 1915031 - DNA, 19 bp, Homo sapiens
tgtcagggttggaaagtcc

SEQ ID NO: 1915032 - DNA, 14 bp, Homo sapiens
tgtcatctgagaat

SEQ ID NO: 1915033 - DNA, 19 bp, Homo sapiens
tgtcatctgagaatgaaca

SEQ ID NO: 1915034 - DNA, 22 bp, Homo sapiens
tgtcatgatacgcttaaggtgg

SEQ ID NO: 1915035 - DNA, 16 bp, Homo sapiens
tgtccagtaagatcac

SEQ ID NO: 1915036 - DNA, 20 bp, Homo sapiens
tgtccagtaagatcactgtt

SEQ ID NO: 1915037 - DNA, 21 bp, Homo sapiens
tgtccagtaagatcactgttt

SEQ ID NO: 1915038 - DNA, 20 bp, Homo sapiens
tgtcccaagtctgacagcca

SEQ ID NO: 1915039 - DNA, 15 bp, Homo sapiens
tgtccgctgtctccc

SEQ ID NO: 1915040 - DNA, 17 bp, Homo sapiens
tgtccgctgtctccctc

SEQ ID NO: 1915041 - DNA, 18 bp, Homo sapiens
tgtccgctgtctccctcc

SEQ ID NO: 1915042 - DNA, 19 bp, Homo sapiens
tgtccgctgtctccctcct

SEQ ID NO: 1915043 - DNA, 20 bp, Homo sapiens
tgtccgctgtctccctcctg

SEQ ID NO: 1915044 - DNA, 17 bp, Homo sapiens
tgtcctattagtgttat

SEQ ID NO: 1915045 - DNA, 14 bp, Homo sapiens
tgtcctcctaaggg

SEQ ID NO: 1915046 - DNA, 18 bp, Homo sapiens
tgtccttgaagcttgtat

SEQ ID NO: 1915047 - DNA, 21 bp, Homo sapiens
tgtccttgaagcttgtatctg

SEQ ID NO: 1915048 - DNA, 14 bp, Homo sapiens
tgtcctttctgaac

SEQ ID NO: 1915049 - DNA, 22 bp, Homo sapiens
tgtcgtagttactctcaggcat

SEQ ID NO: 1915050 - DNA, 17 bp, Homo sapiens
tgtcgttaaaaacagat

SEQ ID NO: 1915051 - DNA, 17 bp, Homo sapiens
tgtctagattttgaaaa

SEQ ID NO: 1915052 - DNA, 22 bp, Homo sapiens
tgtctcaagtgcaatgccccct

SEQ ID NO: 1915053 - DNA, 23 bp, Homo sapiens
tgtctcccaccctttctgccagg

SEQ ID NO: 1915054 - DNA, 13 bp, Homo sapiens
tgtctccctcctg

SEQ ID NO: 1915055 - DNA, 18 bp, Homo sapiens
tgtctcctgtttcagacc

SEQ ID NO: 1915056 - DNA, 19 bp, Homo sapiens
tgtctcctgtttcagacca

SEQ ID NO: 1915057 - DNA, 16 bp, Homo sapiens
tgtctcggcagaggtg

SEQ ID NO: 1915058 - DNA, 18 bp, Homo sapiens
tgtctcggcagaggtggt

SEQ ID NO: 1915059 - DNA, 17 bp, Homo sapiens
tgtctggcacagcctgc

SEQ ID NO: 1915060 - DNA, 19 bp, Homo sapiens
tgtcttaatggatgaaatc

SEQ ID NO: 1915061 - DNA, 18 bp, Homo sapiens
tgtcttagtttgaatgaa

SEQ ID NO: 1915062 - DNA, 22 bp, Homo sapiens
tgtcttcctatcaaaaagatat

SEQ ID NO: 1915063 - DNA, 19 bp, Homo sapiens
tgtcttgcgggtctgtcag

SEQ ID NO: 1915064 - DNA, 14 bp, Homo sapiens
tgtgaaacagactt

SEQ ID NO: 1915065 - DNA, 18 bp, Homo sapiens
tgtgaacatgcctcctcc

SEQ ID NO: 1915066 - DNA, 20 bp, Homo sapiens
tgtgaacatgcctcctcctg

SEQ ID NO: 1915067 - DNA, 12 bp, Homo sapiens
tgtgaagctgga

SEQ ID NO: 1915068 - DNA, 22 bp, Homo sapiens
tgtgaagcttaagggtcatatg

SEQ ID NO: 1915069 - DNA, 14 bp, Homo sapiens
tgtgaatactgctt

SEQ ID NO: 1915070 - DNA, 18 bp, Homo sapiens
tgtgaatactgcttgaat

SEQ ID NO: 1915071 - DNA, 20 bp, Homo sapiens
tgtgacatcacagggcctca

SEQ ID NO: 1915072 - DNA, 19 bp, Homo sapiens
tgtgaccagttttgatatt

SEQ ID NO: 1915073 - DNA, 18 bp, Homo sapiens
tgtgacttccttggaaat

SEQ ID NO: 1915074 - DNA, 14 bp, Homo sapiens
tgtgagaacattag

SEQ ID NO: 1915075 - DNA, 14 bp, Homo sapiens
tgtgattcaatgcc

SEQ ID NO: 1915076 - DNA, 23 bp, Homo sapiens
tgtgcaaacaaaaggtgtgcctg

SEQ ID NO: 1915077 - DNA, 19 bp, Homo sapiens
tgtgcaagcttttcctaat

SEQ ID NO: 1915078 - DNA, 21 bp, Homo sapiens
tgtgcacactcaagtcctgca

SEQ ID NO: 1915079 - DNA, 16 bp, Homo sapiens
tgtgcagtatctgtga

SEQ ID NO: 1915080 - DNA, 17 bp, Homo sapiens
tgtgcccagaatactga

SEQ ID NO: 1915081 - DNA, 18 bp, Homo sapiens
tgtgcccagaatactgat

SEQ ID NO: 1915082 - DNA, 22 bp, Homo sapiens
tgtgcgtggggctcccgcctcc

SEQ ID NO: 1915083 - DNA, 13 bp, Homo sapiens
tgtgctgcagtgc

SEQ ID NO: 1915084 - DNA, 18 bp, Homo sapiens
tgtgctgccagtcagcct

SEQ ID NO: 1915085 - DNA, 18 bp, Homo sapiens
tgtgctgggaggtcccag

SEQ ID NO: 1915086 - DNA, 15 bp, Homo sapiens
tgtgcttctgccacc

SEQ ID NO: 1915087 - DNA, 20 bp, Homo sapiens
tgtggaaaaataaaggaaat

SEQ ID NO: 1915088 - DNA, 19 bp, Homo sapiens
tgtggaaattaagaagaaa

SEQ ID NO: 1915089 - DNA, 21 bp, Homo sapiens
tgtggaagacaagtctgtggc

SEQ ID NO: 1915090 - DNA, 22 bp, Homo sapiens
tgtggagactgctcctgagccc

SEQ ID NO: 1915091 - DNA, 23 bp, Homo sapiens
tgtggagactgctcctgagcccc

SEQ ID NO: 1915092 - DNA, 15 bp, Homo sapiens
tgtggcagcaggagg

SEQ ID NO: 1915093 - DNA, 20 bp, Homo sapiens
tgtggggtgtgtgcagggct

SEQ ID NO: 1915094 - DNA, 18 bp, Homo sapiens
tgtggtccatctctgaaa

SEQ ID NO: 1915095 - DNA, 20 bp, Homo sapiens
tgtggtccatctctgaaaac

SEQ ID NO: 1915096 - DNA, 14 bp, Homo sapiens
tgtggtgtctgtgt

SEQ ID NO: 1915097 - DNA, 22 bp, Homo sapiens
tgtgtaaggaaaaataaaagtg

SEQ ID NO: 1915098 - DNA, 15 bp, Homo sapiens
tgtgtatatttgatt

SEQ ID NO: 1915099 - DNA, 18 bp, Homo sapiens
tgtgtgacatcacagggc

SEQ ID NO: 1915100 - DNA, 20 bp, Homo sapiens
tgtgtgacatcacagggcct

SEQ ID NO: 1915101 - DNA, 19 bp, Homo sapiens
tgtgtgtccccttgcagcc

SEQ ID NO: 1915102 - DNA, 14 bp, Homo sapiens
tgtgttaaaatttt

SEQ ID NO: 1915103 - DNA, 18 bp, Homo sapiens
tgtgtttagaattgaagg

SEQ ID NO: 1915104 - DNA, 12 bp, Homo sapiens
tgttacatgtat

SEQ ID NO: 1915105 - DNA, 14 bp, Homo sapiens
tttcatgctttatc

SEQ ID NO: 1915106 - DNA, 14 bp, Homo sapiens
tttcatggtttata

SEQ ID NO: 1915107 - DNA, 13 bp, Homo sapiens
tttccctccaggt

SEQ ID NO: 1915108 - DNA, 22 bp, Homo sapiens
tttcctgccccaaccacaaact

SEQ ID NO: 1915109 - DNA, 20 bp, Homo sapiens
tttcctttcattttctttcc

SEQ ID NO: 1915110 - DNA, 18 bp, Homo sapiens
tttctataattttacaag

SEQ ID NO: 1915111 - DNA, 16 bp, Homo sapiens
tttctctagaggctgg

SEQ ID NO: 1915112 - DNA, 21 bp, Homo sapiens
tttctctagaggctggcaaga

SEQ ID NO: 1915113 - DNA, 16 bp, Homo sapiens
tttctctttctctctc

SEQ ID NO: 1915114 - DNA, 18 bp, Homo sapiens
tttctgaaaatttatata

SEQ ID NO: 1915115 - DNA, 15 bp, Homo sapiens
tttcttatttatgta

SEQ ID NO: 1915116 - DNA, 21 bp, Homo sapiens
tttcttgataattttccttta

SEQ ID NO: 1915117 - DNA, 21 bp, Homo sapiens
tttctttcctttccccttttt

SEQ ID NO: 1915118 - DNA, 17 bp, Homo sapiens
tttgaaaagtaatattt

SEQ ID NO: 1915119 - DNA, 15 bp, Homo sapiens
tttgaaaatagttta

SEQ ID NO: 1915120 - DNA, 18 bp, Homo sapiens
tttgaaaatagtttattt

SEQ ID NO: 1915121 - DNA, 14 bp, Homo sapiens
tttgaaagtgcctt

SEQ ID NO: 1915122 - DNA, 13 bp, Homo sapiens
tttgaaatggaaa

SEQ ID NO: 1915123 - DNA, 22 bp, Homo sapiens
tttgaactcttctcattacttg

SEQ ID NO: 1915124 - DNA, 20 bp, Homo sapiens
tttgaataatgtctagattt

SEQ ID NO: 1915125 - DNA, 23 bp, Homo sapiens
tttgacaagctggcttacactgg

SEQ ID NO: 1915126 - DNA, 18 bp, Homo sapiens
tttgaggattagtttaga

SEQ ID NO: 1915127 - DNA, 16 bp, Homo sapiens
tttgatgtcagcagtt

SEQ ID NO: 1915128 - DNA, 21 bp, Homo sapiens
tttgatgtcagcagttgctgg

SEQ ID NO: 1915129 - DNA, 21 bp, Homo sapiens
tttgatgtgttgttcttggca

SEQ ID NO: 1915130 - DNA, 21 bp, Homo sapiens
tttgatttattaacttaataa

SEQ ID NO: 1915131 - DNA, 14 bp, Homo sapiens
tttgccatgtgctt

SEQ ID NO: 1915132 - DNA, 16 bp, Homo sapiens
tttggaaagtagaaaa

SEQ ID NO: 1915133 - DNA, 14 bp, Homo sapiens
tttggaagtgatgt

SEQ ID NO: 1915134 - DNA, 13 bp, Homo sapiens
tttggcttcctct

SEQ ID NO: 1915135 - DNA, 18 bp, Homo sapiens
tttggcttcctctgctgc

SEQ ID NO: 1915136 - DNA, 15 bp, Homo sapiens
tttggttgaataaac

SEQ ID NO: 1915137 - DNA, 21 bp, Homo sapiens
tttgtaaaagaacagtaaaca

SEQ ID NO: 1915138 - DNA, 18 bp, Homo sapiens
tttgtaaatgactttcat

SEQ ID NO: 1915139 - DNA, 23 bp, Homo sapiens
tttgtaaatgactttcataataa

SEQ ID NO: 1915140 - DNA, 21 bp, Homo sapiens
tttgtaataataaagaatagc

SEQ ID NO: 1915141 - DNA, 22 bp, Homo sapiens
tttgtaatctagttgtcaataa

SEQ ID NO: 1915142 - DNA, 21 bp, Homo sapiens
tttgtacacccatgaaagaaa

SEQ ID NO: 1915143 - DNA, 11 bp, Homo sapiens
tttgtagacat

SEQ ID NO: 1915144 - DNA, 16 bp, Homo sapiens
tttgtatatgctgcat

SEQ ID NO: 1915145 - DNA, 15 bp, Homo sapiens
tttgtatgaaaacat

SEQ ID NO: 1915146 - DNA, 23 bp, Homo sapiens
tttgtatgaaaacatggaacagt

SEQ ID NO: 1915147 - DNA, 14 bp, Homo sapiens
tttgtatgtataat

SEQ ID NO: 1915148 - DNA, 15 bp, Homo sapiens
tttgtatgtataatt

SEQ ID NO: 1915149 - DNA, 15 bp, Homo sapiens
tttgtattgtcctat

SEQ ID NO: 1915150 - DNA, 18 bp, Homo sapiens
tttgtgaaacagacttgt

SEQ ID NO: 1915151 - DNA, 20 bp, Homo sapiens
tttgttgccagatttcagaa

SEQ ID NO: 1915152 - DNA, 17 bp, Homo sapiens
tttgtttctttctctga

SEQ ID NO: 1915153 - DNA, 15 bp, Homo sapiens
ttttaaagacttgca

SEQ ID NO: 1915154 - DNA, 22 bp, Homo sapiens
ttttaaggactgactgaggcag

SEQ ID NO: 1915155 - DNA, 22 bp, Homo sapiens
ttttaagtggactctctgacaa

SEQ ID NO: 1915156 - DNA, 17 bp, Homo sapiens
ttttactgctttctgaa

SEQ ID NO: 1915157 - DNA, 20 bp, Homo sapiens
ttttactgctttctgaatgt

SEQ ID NO: 1915158 - DNA, 23 bp, Homo sapiens
ttttagaattacaccacaagtat

SEQ ID NO: 1915159 - DNA, 22 bp, Homo sapiens
ttttaggtggcatagtggctta

SEQ ID NO: 1915160 - DNA, 13 bp, Homo sapiens
ttttagttctgac

SEQ ID NO: 1915161 - DNA, 15 bp, Homo sapiens
ttttagttctgactt

SEQ ID NO: 1915162 - DNA, 19 bp, Homo sapiens
ttttagttctgactttgaa

SEQ ID NO: 1915163 - DNA, 15 bp, Homo sapiens
ttttataagaaaacc

SEQ ID NO: 1915164 - DNA, 14 bp, Homo sapiens
ttttataatgactg

SEQ ID NO: 1915165 - DNA, 14 bp, Homo sapiens
ttttatatgtggaa

SEQ ID NO: 1915166 - DNA, 18 bp, Homo sapiens
ttttatatttcaagtaca

SEQ ID NO: 1915167 - DNA, 20 bp, Homo sapiens
ttttatgatgacgtacaagt

SEQ ID NO: 1915168 - DNA, 14 bp, Homo sapiens
ttttattaatcact

SEQ ID NO: 1915169 - DNA, 15 bp, Homo sapiens
ttttattaatcactg

SEQ ID NO: 1915170 - DNA, 18 bp, Homo sapiens
ttttattaatcactgtgt

SEQ ID NO: 1915171 - DNA, 20 bp, Homo sapiens
ttttattaatcactgtgtat

SEQ ID NO: 1915172 - DNA, 16 bp, Homo sapiens
ttttcaatatatttgt

SEQ ID NO: 1915173 - DNA, 14 bp, Homo sapiens
ttttcacagcacta

SEQ ID NO: 1915174 - DNA, 17 bp, Homo sapiens
ttttcataagatatttt

SEQ ID NO: 1915175 - DNA, 13 bp, Homo sapiens
ttttccattttat

SEQ ID NO: 1915176 - DNA, 15 bp, Homo sapiens
ttttccattttataa

SEQ ID NO: 1915177 - DNA, 20 bp, Homo sapiens
ttttcctgggacatcttctg

SEQ ID NO: 1915178 - DNA, 14 bp, Homo sapiens
ttttctcttcatat

SEQ ID NO: 1915179 - DNA, 19 bp, Homo sapiens
ttttctgctttagacttga

SEQ ID NO: 1915180 - DNA, 22 bp, Homo sapiens
ttttctgctttagacttgaaaa

SEQ ID NO: 1915181 - DNA, 13 bp, Homo sapiens
ttttcttatttat

SEQ ID NO: 1915182 - DNA, 19 bp, Homo sapiens
ttttcttggtagcacaaat

SEQ ID NO: 1915183 - DNA, 16 bp, Homo sapiens
ttttcttttgctttcc

SEQ ID NO: 1915184 - DNA, 17 bp, Homo sapiens
ttttgaactcttctcat

SEQ ID NO: 1915185 - DNA, 13 bp, Homo sapiens
ttttgcaggagca

SEQ ID NO: 1915186 - DNA, 14 bp, Homo sapiens
ttttgcattgtctg

SEQ ID NO: 1915187 - DNA, 17 bp, Homo sapiens
ttttgctttcctttcct

SEQ ID NO: 1915188 - DNA, 17 bp, Homo sapiens
ttttgtaataataaaga

SEQ ID NO: 1915189 - DNA, 19 bp, Homo sapiens
ttttgtacgcaattctcga

SEQ ID NO: 1915190 - DNA, 16 bp, Homo sapiens
ttttgtatatgctgca

SEQ ID NO: 1915191 - DNA, 14 bp, Homo sapiens
ttttgtatattggt

SEQ ID NO: 1915192 - DNA, 15 bp, Homo sapiens
tttttaaaaataaag

SEQ ID NO: 1915193 - DNA, 13 bp, Homo sapiens
tttttaagtgaaa

SEQ ID NO: 1915194 - DNA, 12 bp, Homo sapiens
tttttagaattt

SEQ ID NO: 1915195 - DNA, 22 bp, Homo sapiens
tttttatatttcaagtacactg

SEQ ID NO: 1915196 - DNA, 12 bp, Homo sapiens
tttttatgtgtg

SEQ ID NO: 1915197 - DNA, 21 bp, Homo sapiens
tttttatttatatgtatgtgt

SEQ ID NO: 1915198 - DNA, 19 bp, Homo sapiens
tttttgaactcttctcatt

SEQ ID NO: 1915199 - DNA, 14 bp, Homo sapiens
tttttgatagcatt

SEQ ID NO: 1915200 - DNA, 12 bp, Homo sapiens
tttttgttacat

SEQ ID NO: 1915201 - DNA, 14 bp, Homo sapiens
tttttgtttttctg

SEQ ID NO: 1915202 - DNA, 18 bp, Homo sapiens
ttttttaatctactgcat

SEQ ID NO: 1915203 - DNA, 19 bp, Homo sapiens
ttttttgaactcttctcat

SEQ ID NO: 1915204 - DNA, 18 bp, Homo sapiens
aaaaaaggatgcaacaat

SEQ ID NO: 1915205 - DNA, 13 bp, Homo sapiens
aaaaaatctaaca

SEQ ID NO: 1915206 - DNA, 22 bp, Homo sapiens
aaaaaatgctgaacattgcata

SEQ ID NO: 1915207 - DNA, 18 bp, Homo sapiens
aaaaacagatttggaaag

SEQ ID NO: 1915208 - DNA, 19 bp, Homo sapiens
aaaaagctagtcaacagta

SEQ ID NO: 1915209 - DNA, 16 bp, Homo sapiens
aaaaatatcaaattaa

SEQ ID NO: 1915210 - DNA, 14 bp, Homo sapiens
aaaaatttgtttaa

SEQ ID NO: 1915211 - DNA, 16 bp, Homo sapiens
aaaaatttgtttaaag

SEQ ID NO: 1915212 - DNA, 17 bp, Homo sapiens
aaaacaataggatgggc

SEQ ID NO: 1915213 - DNA, 18 bp, Homo sapiens
aaaacaccagctgtatat

SEQ ID NO: 1915214 - DNA, 22 bp, Homo sapiens
aaaacagtgctattctgagtga

SEQ ID NO: 1915215 - DNA, 22 bp, Homo sapiens
aaaacatcattcctttttattt

SEQ ID NO: 1915216 - DNA, 14 bp, Homo sapiens
aaaaccaggctttc

SEQ ID NO: 1915217 - DNA, 9 bp, Homo sapiens
aaaagaaaa

SEQ ID NO: 1915218 - DNA, 11 bp, Homo sapiens
aaaagaaaaaa

SEQ ID NO: 1915219 - DNA, 16 bp, Homo sapiens
aaaagaaaaaaaaaga

SEQ ID NO: 1915220 - DNA, 15 bp, Homo sapiens
aaaagaaaataaaaa

SEQ ID NO: 1915221 - DNA, 10 bp, Homo sapiens
aaaagaaagc

SEQ ID NO: 1915222 - DNA, 13 bp, Homo sapiens
aaaagagaaaaga

SEQ ID NO: 1915223 - DNA, 16 bp, Homo sapiens
aaaagagaaaagaaaa

SEQ ID NO: 1915224 - DNA, 23 bp, Homo sapiens
aaaagattataggaactgaggtt

SEQ ID NO: 1915225 - DNA, 14 bp, Homo sapiens
aaaagcagcataaa

SEQ ID NO: 1915226 - DNA, 15 bp, Homo sapiens
aaaagcattttgtaa

SEQ ID NO: 1915227 - DNA, 23 bp, Homo sapiens
aaaagccaggttccacagaggac

SEQ ID NO: 1915228 - DNA, 17 bp, Homo sapiens
aaaagcccaggagccca

SEQ ID NO: 1915229 - DNA, 21 bp, Homo sapiens
aaaaggaaggtagttcaagaa

SEQ ID NO: 1915230 - DNA, 11 bp, Homo sapiens
aaaagtaaaca

SEQ ID NO: 1915231 - DNA, 15 bp, Homo sapiens
aaaagtagaactttg

SEQ ID NO: 1915232 - DNA, 18 bp, Homo sapiens
aaaagttgaagatcgtga

SEQ ID NO: 1915233 - DNA, 18 bp, Homo sapiens
aaaagttgaccaatgaaa

SEQ ID NO: 1915234 - DNA, 15 bp, Homo sapiens
aaaataaaaaaaaga

SEQ ID NO: 1915235 - DNA, 21 bp, Homo sapiens
aaaataaaaaaaagaaaaaag

SEQ ID NO: 1915236 - DNA, 15 bp, Homo sapiens
aaaataaaataaata

SEQ ID NO: 1915237 - DNA, 14 bp, Homo sapiens
aaaataattttgta

SEQ ID NO: 1915238 - DNA, 13 bp, Homo sapiens
aaaatagtttatt

SEQ ID NO: 1915239 - DNA, 14 bp, Homo sapiens
aaaatagtttattt

SEQ ID NO: 1915240 - DNA, 13 bp, Homo sapiens
aaaatattgtagt

SEQ ID NO: 1915241 - DNA, 22 bp, Homo sapiens
aaaatatttgcacacatttaaa

SEQ ID NO: 1915242 - DNA, 21 bp, Homo sapiens
aagaaaaaaaaaaagaaagaa

SEQ ID NO: 1915243 - DNA, 19 bp, Homo sapiens
aagaaaaaaaaagaaaaaa

SEQ ID NO: 1915244 - DNA, 18 bp, Homo sapiens
aagaaaaaagagaaaaga

SEQ ID NO: 1915245 - DNA, 13 bp, Homo sapiens
aagaaaataaaaa

SEQ ID NO: 1915246 - DNA, 22 bp, Homo sapiens
aagaaaataaaaaaaagaaaaa

SEQ ID NO: 1915247 - DNA, 19 bp, Homo sapiens
aagaaacagctatgagagg

SEQ ID NO: 1915248 - DNA, 12 bp, Homo sapiens
aagaaagaaaga

SEQ ID NO: 1915249 - DNA, 15 bp, Homo sapiens
aagaaatactgtaca

SEQ ID NO: 1915250 - DNA, 16 bp, Homo sapiens
aagaaattgtccttga

SEQ ID NO: 1915251 - DNA, 12 bp, Homo sapiens
aagaacacaaga

SEQ ID NO: 1915252 - DNA, 14 bp, Homo sapiens
aagaagtttaagga

SEQ ID NO: 1915253 - DNA, 17 bp, Homo sapiens
aagaagtttaaggaata

SEQ ID NO: 1915254 - DNA, 23 bp, Homo sapiens
aagaatagcattgtaaaagcatt

SEQ ID NO: 1915255 - DNA, 15 bp, Homo sapiens
aagacaaaggcccaa

SEQ ID NO: 1915256 - DNA, 16 bp, Homo sapiens
aagacatttcaaataa

SEQ ID NO: 1915257 - DNA, 17 bp, Homo sapiens
aagaccccactggagtc

SEQ ID NO: 1915258 - DNA, 16 bp, Homo sapiens
aagagccccactctca

SEQ ID NO: 1915259 - DNA, 18 bp, Homo sapiens
aagagccccactctcaga

SEQ ID NO: 1915260 - DNA, 14 bp, Homo sapiens
aagagccttaaaac

SEQ ID NO: 1915261 - DNA, 16 bp, Homo sapiens
aagaggaaaagaaatc

SEQ ID NO: 1915262 - DNA, 17 bp, Homo sapiens
aagagtctggggaccag

SEQ ID NO: 1915263 - DNA, 15 bp, Homo sapiens
aagagtggccccacc

SEQ ID NO: 1915264 - DNA, 19 bp, Homo sapiens
aagagtggccccacctggc

SEQ ID NO: 1915265 - DNA, 11 bp, Homo sapiens
aagataaatgc

SEQ ID NO: 1915266 - DNA, 13 bp, Homo sapiens
aagatactttgta

SEQ ID NO: 1915267 - DNA, 12 bp, Homo sapiens
aagatattttat

SEQ ID NO: 1915268 - DNA, 23 bp, Homo sapiens
aagatcaaaaaggcttataaaac

SEQ ID NO: 1915269 - DNA, 12 bp, Homo sapiens
aagatcactgtt

SEQ ID NO: 1915270 - DNA, 16 bp, Homo sapiens
aagatgagtaggagtt

SEQ ID NO: 1915271 - DNA, 19 bp, Homo sapiens
aagcaaccatatagaaagc

SEQ ID NO: 1915272 - DNA, 15 bp, Homo sapiens
aagcaagaatggagg

SEQ ID NO: 1915273 - DNA, 21 bp, Homo sapiens
aagcaccaaaataagaaaaga

SEQ ID NO: 1915274 - DNA, 16 bp, Homo sapiens
aagcaccatcccctcc

SEQ ID NO: 1915275 - DNA, 20 bp, Homo sapiens
aagcactaagactgcttcta

SEQ ID NO: 1915276 - DNA, 18 bp, Homo sapiens
aagcactcctttaaagcc

SEQ ID NO: 1915277 - DNA, 23 bp, Homo sapiens
aagcaggcgcaagggaggcccag

SEQ ID NO: 1915278 - DNA, 13 bp, Homo sapiens
aagcagtgcccag

SEQ ID NO: 1915279 - DNA, 15 bp, Homo sapiens
aagcagtgcccaggt

SEQ ID NO: 1915280 - DNA, 12 bp, Homo sapiens
aagcattttgta

SEQ ID NO: 1915281 - DNA, 13 bp, Homo sapiens
aagcattttgtaa

SEQ ID NO: 1915282 - DNA, 14 bp, Homo sapiens
aagcattttgtaat

SEQ ID NO: 1915283 - DNA, 14 bp, Homo sapiens
aagccaaaattaag

SEQ ID NO: 1915284 - DNA, 17 bp, Homo sapiens
aagccaaaattaaggtg

SEQ ID NO: 1915285 - DNA, 16 bp, Homo sapiens
aagccatgagaatgtt

SEQ ID NO: 1915286 - DNA, 14 bp, Homo sapiens
aagcccaggagccc

SEQ ID NO: 1915287 - DNA, 16 bp, Homo sapiens
aagcccaggagcccat

SEQ ID NO: 1915288 - DNA, 20 bp, Homo sapiens
aagccgtggccggggtccag

SEQ ID NO: 1915289 - DNA, 18 bp, Homo sapiens
aagcctagatgttttata

SEQ ID NO: 1915290 - DNA, 19 bp, Homo sapiens
aagccttcgaaaagaaatt

SEQ ID NO: 1915291 - DNA, 21 bp, Homo sapiens
aagccttcgaaaagaaattgt

SEQ ID NO: 1915292 - DNA, 22 bp, Homo sapiens
aagccttcgaaaagaaattgtc

SEQ ID NO: 1915293 - DNA, 19 bp, Homo sapiens
aagcgccctggcccccaca

SEQ ID NO: 1915294 - DNA, 21 bp, Homo sapiens
aagcgccctggcccccacatg

SEQ ID NO: 1915295 - DNA, 17 bp, Homo sapiens
aagctaaggtttagata

SEQ ID NO: 1915296 - DNA, 15 bp, Homo sapiens
aagctagttgaatac

SEQ ID NO: 1915297 - DNA, 17 bp, Homo sapiens
aagctagttgaatactt

SEQ ID NO: 1915298 - DNA, 17 bp, Homo sapiens
aagctatccaaataact

SEQ ID NO: 1915299 - DNA, 14 bp, Homo sapiens
aagctgaggctgct

SEQ ID NO: 1915300 - DNA, 11 bp, Homo sapiens
aaggaagaaat

SEQ ID NO: 1915301 - DNA, 21 bp, Homo sapiens
aaggaatatgggagaaatagt

SEQ ID NO: 1915302 - DNA, 18 bp, Homo sapiens
aaggaatctagccagtga

SEQ ID NO: 1915303 - DNA, 21 bp, Homo sapiens
aaggacctcctaaataaatta

SEQ ID NO: 1915304 - DNA, 22 bp, Homo sapiens
aaggactttggcttacatttga

SEQ ID NO: 1915305 - DNA, 15 bp, Homo sapiens
aaggagattgtgggg

SEQ ID NO: 1915306 - DNA, 16 bp, Homo sapiens
aaggaggccacctcct

SEQ ID NO: 1915307 - DNA, 19 bp, Homo sapiens
aaggaggccacctcctaaa

SEQ ID NO: 1915308 - DNA, 15 bp, Homo sapiens
aaggatacaggctgg

SEQ ID NO: 1915309 - DNA, 22 bp, Homo sapiens
aaggcaaacctttctataattt

SEQ ID NO: 1915310 - DNA, 20 bp, Homo sapiens
aaggcaataccaacctgaaa

SEQ ID NO: 1915311 - DNA, 21 bp, Homo sapiens
aaggcaatgggctaccctcat

SEQ ID NO: 1915312 - DNA, 21 bp, Homo sapiens
aaggcaatggtttcacatggt

SEQ ID NO: 1915313 - DNA, 16 bp, Homo sapiens
aaggcagaaagcaaaa

SEQ ID NO: 1915314 - DNA, 17 bp, Homo sapiens
aaggcaggaccatgagg

SEQ ID NO: 1915315 - DNA, 12 bp, Homo sapiens
aaggcatgaagg

SEQ ID NO: 1915316 - DNA, 16 bp, Homo sapiens
aaggccagcagccttc

SEQ ID NO: 1915317 - DNA, 12 bp, Homo sapiens
aataaattttga

SEQ ID NO: 1915318 - DNA, 14 bp, Homo sapiens
aataaattttgaaa

SEQ ID NO: 1915319 - DNA, 20 bp, Homo sapiens
aataaattttgaaaagtaat

SEQ ID NO: 1915320 - DNA, 16 bp, Homo sapiens
aataacaaaaaagaga

SEQ ID NO: 1915321 - DNA, 12 bp, Homo sapiens
aataagaaaaga

SEQ ID NO: 1915322 - DNA, 18 bp, Homo sapiens
aataagcactcctttaaa

SEQ ID NO: 1915323 - DNA, 16 bp, Homo sapiens
aataagctagttgaat

SEQ ID NO: 1915324 - DNA, 13 bp, Homo sapiens
aataatcaagagc

SEQ ID NO: 1915325 - DNA, 16 bp, Homo sapiens
aataatgtctagattt

SEQ ID NO: 1915326 - DNA, 18 bp, Homo sapiens
aataatgtctagattttg

SEQ ID NO: 1915327 - DNA, 19 bp, Homo sapiens
aataatgtctagattttga

SEQ ID NO: 1915328 - DNA, 23 bp, Homo sapiens
aataattcttttttattaatcac

SEQ ID NO: 1915329 - DNA, 13 bp, Homo sapiens
aatacaagacaaa

SEQ ID NO: 1915330 - DNA, 15 bp, Homo sapiens
aatacacaagtaaac

SEQ ID NO: 1915331 - DNA, 21 bp, Homo sapiens
aatacatttaaaacattaaaa

SEQ ID NO: 1915332 - DNA, 15 bp, Homo sapiens
aatactgaaatgctt

SEQ ID NO: 1915333 - DNA, 20 bp, Homo sapiens
aatactgaaatgctttagca

SEQ ID NO: 1915334 - DNA, 16 bp, Homo sapiens
aatagaaaaaaagaaa

SEQ ID NO: 1915335 - DNA, 22 bp, Homo sapiens
aatagaaatttgcccctggcaa

SEQ ID NO: 1915336 - DNA, 16 bp, Homo sapiens
aatagacagcatgaga

SEQ ID NO: 1915337 - DNA, 21 bp, Homo sapiens
aatagcaagtggcataaagca

SEQ ID NO: 1915338 - DNA, 15 bp, Homo sapiens
aatagcaatattctt

SEQ ID NO: 1915339 - DNA, 15 bp, Homo sapiens
aatagctagctatta

SEQ ID NO: 1915340 - DNA, 15 bp, Homo sapiens
aatagctttaatgat

SEQ ID NO: 1915341 - DNA, 23 bp, Homo sapiens
aatagtatccagcacagatttgc

SEQ ID NO: 1915342 - DNA, 12 bp, Homo sapiens
aatagtgtggaa

SEQ ID NO: 1915343 - DNA, 19 bp, Homo sapiens
aatagtgtggaaattaaga

SEQ ID NO: 1915344 - DNA, 20 bp, Homo sapiens
aatagtgtggaaattaagaa

SEQ ID NO: 1915345 - DNA, 19 bp, Homo sapiens
aatagtttattttaaaaca

SEQ ID NO: 1915346 - DNA, 22 bp, Homo sapiens
aatagtttattttaaaacaata

SEQ ID NO: 1915347 - DNA, 14 bp, Homo sapiens
aatatattttgaaa

SEQ ID NO: 1915348 - DNA, 14 bp, Homo sapiens
aatatcaaattaat

SEQ ID NO: 1915349 - DNA, 21 bp, Homo sapiens
aatatcaaattaattgtgtga

SEQ ID NO: 1915350 - DNA, 16 bp, Homo sapiens
aatatcacactgaata

SEQ ID NO: 1915351 - DNA, 14 bp, Homo sapiens
aatatccatattaa

SEQ ID NO: 1915352 - DNA, 21 bp, Homo sapiens
aatatgtggtccatctctgaa

SEQ ID NO: 1915353 - DNA, 22 bp, Homo sapiens
aatatgttttattcagcttcta

SEQ ID NO: 1915354 - DNA, 12 bp, Homo sapiens
aatatttaagca

SEQ ID NO: 1915355 - DNA, 18 bp, Homo sapiens
aatatttaagcaataaaa

SEQ ID NO: 1915356 - DNA, 15 bp, Homo sapiens
aatatttattaaatt

SEQ ID NO: 1915357 - DNA, 14 bp, Homo sapiens
aatatttttaacaa

SEQ ID NO: 1915358 - DNA, 14 bp, Homo sapiens
aatcaaatgtaaag

SEQ ID NO: 1915359 - DNA, 12 bp, Homo sapiens
aatcaataatag

SEQ ID NO: 1915360 - DNA, 13 bp, Homo sapiens
aatcacaggctgg

SEQ ID NO: 1915361 - DNA, 21 bp, Homo sapiens
aatcacaggctgggctgggca

SEQ ID NO: 1915362 - DNA, 18 bp, Homo sapiens
aatcatttgttcaaagct

SEQ ID NO: 1915363 - DNA, 14 bp, Homo sapiens
aatccttgtattta

SEQ ID NO: 1915364 - DNA, 21 bp, Homo sapiens
aatcgagtgccgcatctcaca

SEQ ID NO: 1915365 - DNA, 15 bp, Homo sapiens
aatctactgcattta

SEQ ID NO: 1915366 - DNA, 14 bp, Homo sapiens
aatctgatacttag

SEQ ID NO: 1915367 - DNA, 11 bp, Homo sapiens
aatctgccacc

SEQ ID NO: 1915368 - DNA, 13 bp, Homo sapiens
aatctgccacctg

SEQ ID NO: 1915369 - DNA, 14 bp, Homo sapiens
aatctgccacctgc

SEQ ID NO: 1915370 - DNA, 23 bp, Homo sapiens
aatctggaccccatctgtgaata

SEQ ID NO: 1915371 - DNA, 24 bp, Homo sapiens
aatctggaccccatctgtgaataa

SEQ ID NO: 1915372 - DNA, 15 bp, Homo sapiens
aatcttaagtcataa

SEQ ID NO: 1915373 - DNA, 14 bp, Homo sapiens
aatcttactttgta

SEQ ID NO: 1915374 - DNA, 14 bp, Homo sapiens
aatgaaatacacaa

SEQ ID NO: 1915375 - DNA, 16 bp, Homo sapiens
aatgaacaaagaccaa

SEQ ID NO: 1915376 - DNA, 19 bp, Homo sapiens
aatgaacacagctctttaa

SEQ ID NO: 1915377 - DNA, 17 bp, Homo sapiens
aatgaagaatttaaaga

SEQ ID NO: 1915378 - DNA, 20 bp, Homo sapiens
aatgaataaagtgcaaacag

SEQ ID NO: 1915379 - DNA, 21 bp, Homo sapiens
aatgaataaagtgcaaacaga

SEQ ID NO: 1915380 - DNA, 18 bp, Homo sapiens
aatgactggtcttcctta

SEQ ID NO: 1915381 - DNA, 19 bp, Homo sapiens
aatgactggtcttccttac

SEQ ID NO: 1915382 - DNA, 22 bp, Homo sapiens
aatgactggtcttccttacctg

SEQ ID NO: 1915383 - DNA, 11 bp, Homo sapiens
aatgactttat

SEQ ID NO: 1915384 - DNA, 14 bp, Homo sapiens
aatgactttattat

SEQ ID NO: 1915385 - DNA, 15 bp, Homo sapiens
aatgactttattatt

SEQ ID NO: 1915386 - DNA, 17 bp, Homo sapiens
aatgactttattattta

SEQ ID NO: 1915387 - DNA, 18 bp, Homo sapiens
aatgagcagctttagcaa

SEQ ID NO: 1915388 - DNA, 18 bp, Homo sapiens
aatgagtccaaactggaa

SEQ ID NO: 1915389 - DNA, 19 bp, Homo sapiens
aatgattaatcataaagaa

SEQ ID NO: 1915390 - DNA, 17 bp, Homo sapiens
aatgcaaccatttgaaa

SEQ ID NO: 1915391 - DNA, 15 bp, Homo sapiens
aatgcatctttgatg

SEQ ID NO: 1915392 - DNA, 18 bp, Homo sapiens
aatgcatctttgatgtgt

SEQ ID NO: 1915393 - DNA, 19 bp, Homo sapiens
aatgcatctttgatgtgtt

SEQ ID NO: 1915394 - DNA, 15 bp, Homo sapiens
aatgccccctcccct

SEQ ID NO: 1915395 - DNA, 19 bp, Homo sapiens
aatgccccctcccctcctt

SEQ ID NO: 1915396 - DNA, 16 bp, Homo sapiens
aatgcggccttttcat

SEQ ID NO: 1915397 - DNA, 13 bp, Homo sapiens
aatgctgaaataa

SEQ ID NO: 1915398 - DNA, 18 bp, Homo sapiens
aggtggtctggtgccacc

SEQ ID NO: 1915399 - DNA, 15 bp, Homo sapiens
aggtgtttgaaaata

SEQ ID NO: 1915400 - DNA, 17 bp, Homo sapiens
aggtgtttgaaaatagt

SEQ ID NO: 1915401 - DNA, 15 bp, Homo sapiens
aggttcaatgagatg

SEQ ID NO: 1915402 - DNA, 12 bp, Homo sapiens
aggttttggtaa

SEQ ID NO: 1915403 - DNA, 16 bp, Homo sapiens
agtaaatgctgaaata

SEQ ID NO: 1915404 - DNA, 22 bp, Homo sapiens
agtaacacacccctgcttggga

SEQ ID NO: 1915405 - DNA, 22 bp, Homo sapiens
agtaagctggtttacagatgtt

SEQ ID NO: 1915406 - DNA, 23 bp, Homo sapiens
agtaagtagaggtggcttcagaa

SEQ ID NO: 1915407 - DNA, 15 bp, Homo sapiens
agtaagtctcaaggt

SEQ ID NO: 1915408 - DNA, 16 bp, Homo sapiens
agtaagtctcaaggta

SEQ ID NO: 1915409 - DNA, 19 bp, Homo sapiens
agtaatatttattaaattt

SEQ ID NO: 1915410 - DNA, 12 bp, Homo sapiens
agtacactgcct

SEQ ID NO: 1915411 - DNA, 17 bp, Homo sapiens
agtacactgcctgcctt

SEQ ID NO: 1915412 - DNA, 12 bp, Homo sapiens
agtaccatttaa

SEQ ID NO: 1915413 - DNA, 18 bp, Homo sapiens
agtaccctggttgtgtgt

SEQ ID NO: 1915414 - DNA, 12 bp, Homo sapiens
agtacttaaaag

SEQ ID NO: 1915415 - DNA, 14 bp, Homo sapiens
agtagaactttgta

SEQ ID NO: 1915416 - DNA, 16 bp, Homo sapiens
agtagaactttgtata

SEQ ID NO: 1915417 - DNA, 19 bp, Homo sapiens
agtagaactttgtatagtt

SEQ ID NO: 1915418 - DNA, 15 bp, Homo sapiens
agtagcacaggctga

SEQ ID NO: 1915419 - DNA, 22 bp, Homo sapiens
agtagcacaggctgagtgcagg

SEQ ID NO: 1915420 - DNA, 14 bp, Homo sapiens
agtagccatgagga

SEQ ID NO: 1915421 - DNA, 17 bp, Homo sapiens
agtagctcgtcctcact

SEQ ID NO: 1915422 - DNA, 17 bp, Homo sapiens
agtagtgttacatgtat

SEQ ID NO: 1915423 - DNA, 14 bp, Homo sapiens
agtagttctgtatt

SEQ ID NO: 1915424 - DNA, 15 bp, Homo sapiens
agtagttctgtattt

SEQ ID NO: 1915425 - DNA, 16 bp, Homo sapiens
agtagttctgtatttg

SEQ ID NO: 1915426 - DNA, 18 bp, Homo sapiens
agtagttctgtatttgaa

SEQ ID NO: 1915427 - DNA, 17 bp, Homo sapiens
agtatactcttaggcca

SEQ ID NO: 1915428 - DNA, 20 bp, Homo sapiens
agtatctaaatttggaactt

SEQ ID NO: 1915429 - DNA, 21 bp, Homo sapiens
agtatctaaatttggaactta

SEQ ID NO: 1915430 - DNA, 14 bp, Homo sapiens
agtatctgtgaact

SEQ ID NO: 1915431 - DNA, 16 bp, Homo sapiens
agtattctaataagct

SEQ ID NO: 1915432 - DNA, 17 bp, Homo sapiens
agtattctaataagcta

SEQ ID NO: 1915433 - DNA, 21 bp, Homo sapiens
agtattctaataagctagttg

SEQ ID NO: 1915434 - DNA, 23 bp, Homo sapiens
agtattctaataagctagttgaa

SEQ ID NO: 1915435 - DNA, 12 bp, Homo sapiens
agtcaacagtac

SEQ ID NO: 1915436 - DNA, 19 bp, Homo sapiens
agtcacggggaggtgctgg

SEQ ID NO: 1915437 - DNA, 20 bp, Homo sapiens
agtcactgcacgttttcatc

SEQ ID NO: 1915438 - DNA, 17 bp, Homo sapiens
agtcagaaactgtttct

SEQ ID NO: 1915439 - DNA, 14 bp, Homo sapiens
agtcataatgaata

SEQ ID NO: 1915440 - DNA, 13 bp, Homo sapiens
agtcatttctgat

SEQ ID NO: 1915441 - DNA, 15 bp, Homo sapiens
agtcccagcagccag

SEQ ID NO: 1915442 - DNA, 20 bp, Homo sapiens
agtccctgtaattgttgttt

SEQ ID NO: 1915443 - DNA, 23 bp, Homo sapiens
agtccctgtaattgttgtttgta

SEQ ID NO: 1915444 - DNA, 13 bp, Homo sapiens
agtcggggcaggc

SEQ ID NO: 1915445 - DNA, 14 bp, Homo sapiens
agtcgtcagcctcc

SEQ ID NO: 1915446 - DNA, 17 bp, Homo sapiens
agtcgtcagcctccctg

SEQ ID NO: 1915447 - DNA, 21 bp, Homo sapiens
agtctcgctctgttgcccagg

SEQ ID NO: 1915448 - DNA, 17 bp, Homo sapiens
agtctgacagccagagc

SEQ ID NO: 1915449 - DNA, 18 bp, Homo sapiens
agtctgagggcttgtagt

SEQ ID NO: 1915450 - DNA, 21 bp, Homo sapiens
agtctgagggcttgtagttct

SEQ ID NO: 1915451 - DNA, 12 bp, Homo sapiens
agtctgcatata

SEQ ID NO: 1915452 - DNA, 16 bp, Homo sapiens
agtctggaactgctgc

SEQ ID NO: 1915453 - DNA, 19 bp, Homo sapiens
agtctggaactgctgctga

SEQ ID NO: 1915454 - DNA, 17 bp, Homo sapiens
agtctggggaccagctt

SEQ ID NO: 1915455 - DNA, 19 bp, Homo sapiens
agtctgtgtggccagcagc

SEQ ID NO: 1915456 - DNA, 20 bp, Homo sapiens
agtctgtgtggccagcagcc

SEQ ID NO: 1915457 - DNA, 15 bp, Homo sapiens
agtctttctcactgc

SEQ ID NO: 1915458 - DNA, 17 bp, Homo sapiens
agtctttctcactgcct

SEQ ID NO: 1915459 - DNA, 16 bp, Homo sapiens
agtgaaaactttgtag

SEQ ID NO: 1915460 - DNA, 19 bp, Homo sapiens
agtgaacatactaattcta

SEQ ID NO: 1915461 - DNA, 14 bp, Homo sapiens
agtgaatgaagttg

SEQ ID NO: 1915462 - DNA, 20 bp, Homo sapiens
agtgaatttttaaagacaaa

SEQ ID NO: 1915463 - DNA, 14 bp, Homo sapiens
agtgacggttccta

SEQ ID NO: 1915464 - DNA, 23 bp, Homo sapiens
agtgacggttcctacacaggaca

SEQ ID NO: 1915465 - DNA, 13 bp, Homo sapiens
agtgagacagact

SEQ ID NO: 1915466 - DNA, 19 bp, Homo sapiens
agtgaggcatctctctggg

SEQ ID NO: 1915467 - DNA, 16 bp, Homo sapiens
agtgcaatgccccctc

SEQ ID NO: 1915468 - DNA, 23 bp, Homo sapiens
agtgcaatgccccctcccctcct

SEQ ID NO: 1915469 - DNA, 12 bp, Homo sapiens
agtgcaggccca

SEQ ID NO: 1915470 - DNA, 15 bp, Homo sapiens
agtgcaggcccaccc

SEQ ID NO: 1915471 - DNA, 17 bp, Homo sapiens
agtgcaggcccaccctg

SEQ ID NO: 1915472 - DNA, 18 bp, Homo sapiens
agtgcaggcccaccctgc

SEQ ID NO: 1915473 - DNA, 19 bp, Homo sapiens
agtgcaggcccaccctgct

SEQ ID NO: 1915474 - DNA, 18 bp, Homo sapiens
agtgccaacaattttcta

SEQ ID NO: 1915475 - DNA, 21 bp, Homo sapiens
agtgccagcttctttgcagct

SEQ ID NO: 1915476 - DNA, 13 bp, Homo sapiens
agtgcccaggtgg

SEQ ID NO: 1915477 - DNA, 23 bp, Homo sapiens
agtgccgcatctcacagctatgc

SEQ ID NO: 1915478 - DNA, 14 bp, Homo sapiens
agtgccttagcatg

SEQ ID NO: 1915479 - DNA, 17 bp, Homo sapiens
agtgcctttgcagctca

SEQ ID NO: 1915480 - DNA, 21 bp, Homo sapiens
agtgcctttgcagctcagaac

SEQ ID NO: 1915481 - DNA, 15 bp, Homo sapiens
agtggactctctgac

SEQ ID NO: 1915482 - DNA, 16 bp, Homo sapiens
agtggattcctcccca

SEQ ID NO: 1915483 - DNA, 13 bp, Homo sapiens
agtggcagggcac

SEQ ID NO: 1915484 - DNA, 22 bp, Homo sapiens
agtggcagggcacagggcctgg

SEQ ID NO: 1915485 - DNA, 14 bp, Homo sapiens
agtggccccacctg

SEQ ID NO: 1915486 - DNA, 19 bp, Homo sapiens
agtggccccacctggccct

SEQ ID NO: 1915487 - DNA, 14 bp, Homo sapiens
agtggcttctccca

SEQ ID NO: 1915488 - DNA, 15 bp, Homo sapiens
agtgggttcaggccc

SEQ ID NO: 1915489 - DNA, 15 bp, Homo sapiens
agtggttgaatatga

SEQ ID NO: 1915490 - DNA, 22 bp, Homo sapiens
agtgtactttgttaaaaacact

SEQ ID NO: 1915491 - DNA, 14 bp, Homo sapiens
agtgtattaaatga

SEQ ID NO: 1915492 - DNA, 17 bp, Homo sapiens
agtgtattaaatgaaca

SEQ ID NO: 1915493 - DNA, 12 bp, Homo sapiens
agtgtattgtaa

SEQ ID NO: 1915494 - DNA, 18 bp, Homo sapiens
agtgtattgtaatgtata

SEQ ID NO: 1915495 - DNA, 14 bp, Homo sapiens
agtgtgaatactgc

SEQ ID NO: 1915496 - DNA, 16 bp, Homo sapiens
agtgtgaatactgctt

SEQ ID NO: 1915497 - DNA, 17 bp, Homo sapiens
agtgtgaatgctgggcc

SEQ ID NO: 1915498 - DNA, 21 bp, Homo sapiens
agtgtggaaagcaaaataaca

SEQ ID NO: 1915499 - DNA, 13 bp, Homo sapiens
agtgttatatgaa

SEQ ID NO: 1915500 - DNA, 16 bp, Homo sapiens
agtgttatatgaacat

SEQ ID NO: 1915501 - DNA, 17 bp, Homo sapiens
agtgttatttatttctt

SEQ ID NO: 1915502 - DNA, 23 bp, Homo sapiens
agtgttcacatggctctcatgta

SEQ ID NO: 1915503 - DNA, 20 bp, Homo sapiens
agtgttctgggatttctcta

SEQ ID NO: 1915504 - DNA, 15 bp, Homo sapiens
agtgtttctttttat

SEQ ID NO: 1915505 - DNA, 13 bp, Homo sapiens
agttaactgttcc

SEQ ID NO: 1915506 - DNA, 17 bp, Homo sapiens
agttaactgttcccctt

SEQ ID NO: 1915507 - DNA, 16 bp, Homo sapiens
agttaactttttgtag

SEQ ID NO: 1915508 - DNA, 13 bp, Homo sapiens
agttaagaactat

SEQ ID NO: 1915509 - DNA, 18 bp, Homo sapiens
agttagtgagactagaca

SEQ ID NO: 1915510 - DNA, 13 bp, Homo sapiens
agttcaagaaatg

SEQ ID NO: 1915511 - DNA, 13 bp, Homo sapiens
agttccactgaga

SEQ ID NO: 1915512 - DNA, 22 bp, Homo sapiens
agttcccctggaagcagtgccc

SEQ ID NO: 1915513 - DNA, 24 bp, Homo sapiens
agttcccctggaagcagtgcccag

SEQ ID NO: 1915514 - DNA, 17 bp, Homo sapiens
agttctgactttgaatt

SEQ ID NO: 1915515 - DNA, 23 bp, Homo sapiens
agttctgactttgaatttatata

SEQ ID NO: 1915516 - DNA, 13 bp, Homo sapiens
agttctgtatttg

SEQ ID NO: 1915517 - DNA, 14 bp, Homo sapiens
agttctgtatttga

SEQ ID NO: 1915518 - DNA, 15 bp, Homo sapiens
agttctttaaactgt

SEQ ID NO: 1915519 - DNA, 14 bp, Homo sapiens
agttgaatacttga

SEQ ID NO: 1915520 - DNA, 16 bp, Homo sapiens
agttgaatacttgaac

SEQ ID NO: 1915521 - DNA, 17 bp, Homo sapiens
agttgaatacttgaacc

SEQ ID NO: 1915522 - DNA, 17 bp, Homo sapiens
agttgaccaatgaaatg

SEQ ID NO: 1915523 - DNA, 13 bp, Homo sapiens
agttgagctatga

SEQ ID NO: 1915524 - DNA, 17 bp, Homo sapiens
agttgctggtaaaatga

SEQ ID NO: 1915525 - DNA, 13 bp, Homo sapiens
agttgctgtcaca

SEQ ID NO: 1915526 - DNA, 21 bp, Homo sapiens
agttgctgtcagtcttgacct

SEQ ID NO: 1915527 - DNA, 23 bp, Homo sapiens
agttgctgtcagtcttgacctct

SEQ ID NO: 1915528 - DNA, 17 bp, Homo sapiens
agttgtttcattgattt

SEQ ID NO: 1915529 - DNA, 11 bp, Homo sapiens
agttgtttgat

SEQ ID NO: 1915530 - DNA, 16 bp, Homo sapiens
agttgtttttgtatat

SEQ ID NO: 1915531 - DNA, 17 bp, Homo sapiens
agtttaaaaatctgcca

SEQ ID NO: 1915532 - DNA, 19 bp, Homo sapiens
agtttaaaaatctgccacc

SEQ ID NO: 1915533 - DNA, 20 bp, Homo sapiens
agtttctgtcgttaaaaaca

SEQ ID NO: 1915534 - DNA, 13 bp, Homo sapiens
agtttctgtggtt

SEQ ID NO: 1915535 - DNA, 18 bp, Homo sapiens
agtttgaatatttaagca

SEQ ID NO: 1915536 - DNA, 22 bp, Homo sapiens
aggtgagcaagcccaggagaat

SEQ ID NO: 1915537 - DNA, 17 bp, Homo sapiens
aggtggaaagtgttcat

SEQ ID NO: 1915538 - DNA, 15 bp, Homo sapiens
acagctgttgactct

SEQ ID NO: 1915539 - DNA, 13 bp, Homo sapiens
acaggcagggcag

SEQ ID NO: 1915540 - DNA, 18 bp, Homo sapiens
acaggcagggcaggacca

SEQ ID NO: 1915541 - DNA, 21 bp, Homo sapiens
acaggcagggcaggaccagcc

SEQ ID NO: 1915542 - DNA, 17 bp, Homo sapiens
acaggctgggctgggca

SEQ ID NO: 1915543 - DNA, 14 bp, Homo sapiens
acagggaggggatg

SEQ ID NO: 1915544 - DNA, 21 bp, Homo sapiens
acaggggttccttctgggcat

SEQ ID NO: 1915545 - DNA, 21 bp, Homo sapiens
acagggtctctagtgctgtga

SEQ ID NO: 1915546 - DNA, 23 bp, Homo sapiens
acagtaagctggtttacagatgt

SEQ ID NO: 1915547 - DNA, 19 bp, Homo sapiens
acagtaccctggttgtgtg

SEQ ID NO: 1915548 - DNA, 22 bp, Homo sapiens
acagtcctatttagacatgtaa

SEQ ID NO: 1915549 - DNA, 18 bp, Homo sapiens
acagtctcaccatttccc

SEQ ID NO: 1915550 - DNA, 15 bp, Homo sapiens
acagtgctattctga

SEQ ID NO: 1915551 - DNA, 23 bp, Homo sapiens
acagtgtactttgttaaaaacac

SEQ ID NO: 1915552 - DNA, 22 bp, Homo sapiens
acataactgataattttaaaat

SEQ ID NO: 1915553 - DNA, 18 bp, Homo sapiens
acataatactgaaccact

SEQ ID NO: 1915554 - DNA, 16 bp, Homo sapiens
acatagccaaaatgtg

SEQ ID NO: 1915555 - DNA, 19 bp, Homo sapiens
acatagccaaaatgtgagt

SEQ ID NO: 1915556 - DNA, 17 bp, Homo sapiens
acatataaattgtctta

SEQ ID NO: 1915557 - DNA, 22 bp, Homo sapiens
acatataaattgtcttaatgga

SEQ ID NO: 1915558 - DNA, 23 bp, Homo sapiens
acatcactggcatggtggttggg

SEQ ID NO: 1915559 - DNA, 13 bp, Homo sapiens
acatcattccttt

SEQ ID NO: 1915560 - DNA, 21 bp, Homo sapiens
acatcattcctttttatttat

SEQ ID NO: 1915561 - DNA, 22 bp, Homo sapiens
acatcattcctttttatttata

SEQ ID NO: 1915562 - DNA, 16 bp, Homo sapiens
acatccctctctgctg

SEQ ID NO: 1915563 - DNA, 20 bp, Homo sapiens
acatcctgtcatctgagaat

SEQ ID NO: 1915564 - DNA, 22 bp, Homo sapiens
acatcctgtcatctgagaatga

SEQ ID NO: 1915565 - DNA, 23 bp, Homo sapiens
acatctcccttttccatgactgt

SEQ ID NO: 1915566 - DNA, 14 bp, Homo sapiens
acatgcctcctcct

SEQ ID NO: 1915567 - DNA, 22 bp, Homo sapiens
acatgcttgttgacagagagag

SEQ ID NO: 1915568 - DNA, 13 bp, Homo sapiens
acatgctttgtga

SEQ ID NO: 1915569 - DNA, 12 bp, Homo sapiens
acatggaacagt

SEQ ID NO: 1915570 - DNA, 18 bp, Homo sapiens
acatgggactatgctttt

SEQ ID NO: 1915571 - DNA, 18 bp, Homo sapiens
acatgtgaaaagaataga

SEQ ID NO: 1915572 - DNA, 14 bp, Homo sapiens
acattaggccccag

SEQ ID NO: 1915573 - DNA, 19 bp, Homo sapiens
acattgcatataacttata

SEQ ID NO: 1915574 - DNA, 23 bp, Homo sapiens
acattggcataatttttctttat

SEQ ID NO: 1915575 - DNA, 15 bp, Homo sapiens
acatttaaaaataaa

SEQ ID NO: 1915576 - DNA, 12 bp, Homo sapiens
acatttatttgg

SEQ ID NO: 1915577 - DNA, 22 bp, Homo sapiens
agatccattttttatatttcaa

SEQ ID NO: 1915578 - DNA, 15 bp, Homo sapiens
agatgacaacaaatt

SEQ ID NO: 1915579 - DNA, 13 bp, Homo sapiens
agatgtaattttg

SEQ ID NO: 1915580 - DNA, 17 bp, Homo sapiens
agatgtaattttgtgta

SEQ ID NO: 1915581 - DNA, 15 bp, Homo sapiens
agatgtagatttatt

SEQ ID NO: 1915582 - DNA, 17 bp, Homo sapiens
agatgtcctaatggtga

SEQ ID NO: 1915583 - DNA, 14 bp, Homo sapiens
agattcaggcattt

SEQ ID NO: 1915584 - DNA, 19 bp, Homo sapiens
agcaaacctaattgcacaa

SEQ ID NO: 1915585 - DNA, 19 bp, Homo sapiens
agcaaacttgttgaattta

SEQ ID NO: 1915586 - DNA, 14 bp, Homo sapiens
agcaacacgtcatt

SEQ ID NO: 1915587 - DNA, 18 bp, Homo sapiens
agcaacacgtcattgtgt

SEQ ID NO: 1915588 - DNA, 19 bp, Homo sapiens
agcaacattcgttctctaa

SEQ ID NO: 1915589 - DNA, 14 bp, Homo sapiens
agcaaccaaaaaga

SEQ ID NO: 1915590 - DNA, 22 bp, Homo sapiens
agcaaccatatagaaagctttg

SEQ ID NO: 1915591 - DNA, 19 bp, Homo sapiens
agcaacgatcacaaatgac

SEQ ID NO: 1915592 - DNA, 18 bp, Homo sapiens
cagcggccctcccaggcg

SEQ ID NO: 1915593 - DNA, 13 bp, Homo sapiens
cagctatgcaaaa

SEQ ID NO: 1915594 - DNA, 17 bp, Homo sapiens
cagctcaagggagtaag

SEQ ID NO: 1915595 - DNA, 11 bp, Homo sapiens
cagctccctcc

SEQ ID NO: 1915596 - DNA, 13 bp, Homo sapiens
cagctccctcccc

SEQ ID NO: 1915597 - DNA, 17 bp, Homo sapiens
cagctccctcccctgct

SEQ ID NO: 1915598 - DNA, 16 bp, Homo sapiens
cagctgactttcaaag

SEQ ID NO: 1915599 - DNA, 15 bp, Homo sapiens
cagctgctcagatcc

SEQ ID NO: 1915600 - DNA, 13 bp, Homo sapiens
cagctgctgagcc

SEQ ID NO: 1915601 - DNA, 17 bp, Homo sapiens
cagctgctgagccgcag

SEQ ID NO: 1915602 - DNA, 18 bp, Homo sapiens
cagctgctgagccgcaga

SEQ ID NO: 1915603 - DNA, 19 bp, Homo sapiens
cagctgctgagccgcagag

SEQ ID NO: 1915604 - DNA, 20 bp, Homo sapiens
cagctgctgagccgcagaga

SEQ ID NO: 1915605 - DNA, 18 bp, Homo sapiens
cagctgtatatatttttc

SEQ ID NO: 1915606 - DNA, 16 bp, Homo sapiens
cagctgtcaaggctca

SEQ ID NO: 1915607 - DNA, 14 bp, Homo sapiens
cagctgtcaccact

SEQ ID NO: 1915608 - DNA, 15 bp, Homo sapiens
cagctgtcaccacta

SEQ ID NO: 1915609 - DNA, 14 bp, Homo sapiens
cagctgtgctggga

SEQ ID NO: 1915610 - DNA, 17 bp, Homo sapiens
cagcttccccagtagct

SEQ ID NO: 1915611 - DNA, 19 bp, Homo sapiens
cagcttcctcttctaccat

SEQ ID NO: 1915612 - DNA, 17 bp, Homo sapiens
cagcttgggctggcggg

SEQ ID NO: 1915613 - DNA, 22 bp, Homo sapiens
cagcttgggctggcgggccctg

SEQ ID NO: 1915614 - DNA, 13 bp, Homo sapiens
cagctttgacccg

SEQ ID NO: 1915615 - DNA, 17 bp, Homo sapiens
cagcttttcctgggaca

SEQ ID NO: 1915616 - DNA, 21 bp, Homo sapiens
caggaaaaaaaaaaaaaagac

SEQ ID NO: 1915617 - DNA, 22 bp, Homo sapiens
caggaaatgctgacccatgggc

SEQ ID NO: 1915618 - DNA, 17 bp, Homo sapiens
caggaagtagcacaggc

SEQ ID NO: 1915619 - DNA, 21 bp, Homo sapiens
caggaagtagcacaggctgag

SEQ ID NO: 1915620 - DNA, 17 bp, Homo sapiens
caggacaggggttcctt

SEQ ID NO: 1915621 - DNA, 17 bp, Homo sapiens
caggaccagcccacgct

SEQ ID NO: 1915622 - DNA, 20 bp, Homo sapiens
caggacccctgcagttcccc

SEQ ID NO: 1915623 - DNA, 13 bp, Homo sapiens
caggaccctgcca

SEQ ID NO: 1915624 - DNA, 16 bp, Homo sapiens
caggaccctgccaggc

SEQ ID NO: 1915625 - DNA, 21 bp, Homo sapiens
caggaccctgccaggcacagg

SEQ ID NO: 1915626 - DNA, 21 bp, Homo sapiens
caggagactgtggagactgct

SEQ ID NO: 1915627 - DNA, 23 bp, Homo sapiens
caggaggaactttcaaaagtctg

SEQ ID NO: 1915628 - DNA, 12 bp, Homo sapiens
caggagggacag

SEQ ID NO: 1915629 - DNA, 20 bp, Homo sapiens
caggagggacagtctcacca

SEQ ID NO: 1915630 - DNA, 23 bp, Homo sapiens
caggagggactctgtctggccag

SEQ ID NO: 1915631 - DNA, 17 bp, Homo sapiens
caggatatattttattt

SEQ ID NO: 1915632 - DNA, 13 bp, Homo sapiens
caggcacaggcag

SEQ ID NO: 1915633 - DNA, 16 bp, Homo sapiens
caggcacaggcagggc

SEQ ID NO: 1915634 - DNA, 17 bp, Homo sapiens
caggcacaggcagggca

SEQ ID NO: 1915635 - DNA, 19 bp, Homo sapiens
caggcacaggcagggcagg

SEQ ID NO: 1915636 - DNA, 22 bp, Homo sapiens
caggcactgaagctgcggccct

SEQ ID NO: 1915637 - DNA, 14 bp, Homo sapiens
caggcagggcagga

SEQ ID NO: 1915638 - DNA, 22 bp, Homo sapiens
caggcagggcaggaccagccca

SEQ ID NO: 1915639 - DNA, 18 bp, Homo sapiens
caggcatgttggactctg

SEQ ID NO: 1915640 - DNA, 22 bp, Homo sapiens
caggcatgttggactctgagct

SEQ ID NO: 1915641 - DNA, 16 bp, Homo sapiens
caggcattttccccct

SEQ ID NO: 1915642 - DNA, 18 bp, Homo sapiens
caggcccgaaagaggcac

SEQ ID NO: 1915643 - DNA, 18 bp, Homo sapiens
caggcccggcatgaggcc

SEQ ID NO: 1915644 - DNA, 19 bp, Homo sapiens
caggcccggcatgaggccc

SEQ ID NO: 1915645 - DNA, 18 bp, Homo sapiens
caggccctcctccctccc

SEQ ID NO: 1915646 - DNA, 13 bp, Homo sapiens
caggccctgggcc

SEQ ID NO: 1915647 - DNA, 17 bp, Homo sapiens
caggccctgggcctcca

SEQ ID NO: 1915648 - DNA, 20 bp, Homo sapiens
caggccctgggcctccacct

SEQ ID NO: 1915649 - DNA, 23 bp, Homo sapiens
caggccctgggcctccacctctg

SEQ ID NO: 1915650 - DNA, 24 bp, Homo sapiens
caggctcccaggagcctgcccagc

SEQ ID NO: 1915651 - DNA, 13 bp, Homo sapiens
caggctgagctga

SEQ ID NO: 1915652 - DNA, 18 bp, Homo sapiens
caggctgagtgcaggccc

SEQ ID NO: 1915653 - DNA, 22 bp, Homo sapiens
caggctgagtgcaggcccaccc

SEQ ID NO: 1915654 - DNA, 13 bp, Homo sapiens
caggctgggctgg

SEQ ID NO: 1915655 - DNA, 16 bp, Homo sapiens
caggctgggctgggca

SEQ ID NO: 1915656 - DNA, 13 bp, Homo sapiens
caggctttctaga

SEQ ID NO: 1915657 - DNA, 16 bp, Homo sapiens
cagggaagccttgtgg

SEQ ID NO: 1915658 - DNA, 14 bp, Homo sapiens
cagggaggagcccc

SEQ ID NO: 1915659 - DNA, 18 bp, Homo sapiens
cagggatggcagtggctg

SEQ ID NO: 1915660 - DNA, 21 bp, Homo sapiens
cagggatggcagtggctgtga

SEQ ID NO: 1915661 - DNA, 15 bp, Homo sapiens
cagggcacagaaggc

SEQ ID NO: 1915662 - DNA, 12 bp, Homo sapiens
cagggcacaggg

SEQ ID NO: 1915663 - DNA, 14 bp, Homo sapiens
cagggcacagggcc

SEQ ID NO: 1915664 - DNA, 17 bp, Homo sapiens
cagggcacagggcctgg

SEQ ID NO: 1915665 - DNA, 21 bp, Homo sapiens
cagggcacagggcctggccca

SEQ ID NO: 1915666 - DNA, 20 bp, Homo sapiens
cagggcaggaccagcccacg

SEQ ID NO: 1915667 - DNA, 19 bp, Homo sapiens
cagggcccgggcccaggca

SEQ ID NO: 1915668 - DNA, 14 bp, Homo sapiens
cagggccttctgcc

SEQ ID NO: 1915669 - DNA, 22 bp, Homo sapiens
cagggctctgactctgccaggg

SEQ ID NO: 1915670 - DNA, 16 bp, Homo sapiens
cagggctgggtcaggg

SEQ ID NO: 1915671 - DNA, 23 bp, Homo sapiens
caggggtacacagagctaaggcc

SEQ ID NO: 1915672 - DNA, 19 bp, Homo sapiens
cagggtctctagtgctgtg

SEQ ID NO: 1915673 - DNA, 20 bp, Homo sapiens
cagggtctctagtgctgtga

SEQ ID NO: 1915674 - DNA, 23 bp, Homo sapiens
cagggtctctagtgctgtgaaaa

SEQ ID NO: 1915675 - DNA, 18 bp, Homo sapiens
caggtagaggtgcatgcc

SEQ ID NO: 1915676 - DNA, 20 bp, Homo sapiens
caggtcccagttgctgtcac

SEQ ID NO: 1915677 - DNA, 23 bp, Homo sapiens
caggtgatctgctgcagagcagt

SEQ ID NO: 1915678 - DNA, 20 bp, Homo sapiens
caggtgttggctgcctggcc

SEQ ID NO: 1915679 - DNA, 22 bp, Homo sapiens
caggtgttggctgcctggccca

SEQ ID NO: 1915680 - DNA, 17 bp, Homo sapiens
cagtaccttctgccaga

SEQ ID NO: 1915681 - DNA, 21 bp, Homo sapiens
cagtaccttctgccagaagac

SEQ ID NO: 1915682 - DNA, 14 bp, Homo sapiens
cagtagctgggacc

SEQ ID NO: 1915683 - DNA, 23 bp, Homo sapiens
cagtcacggggaggtgctggttc

SEQ ID NO: 1915684 - DNA, 14 bp, Homo sapiens
cagtcccagcagcc

SEQ ID NO: 1915685 - DNA, 18 bp, Homo sapiens
cagtcccagcagccagcc

SEQ ID NO: 1915686 - DNA, 20 bp, Homo sapiens
cagtctcaccatttccccag

SEQ ID NO: 1915687 - DNA, 21 bp, Homo sapiens
cagtctcaccatttccccagg

SEQ ID NO: 1915688 - DNA, 22 bp, Homo sapiens
cagtgaaaataagccatgagaa

SEQ ID NO: 1915689 - DNA, 21 bp, Homo sapiens
cagtgaacatactaattctat

SEQ ID NO: 1915690 - DNA, 16 bp, Homo sapiens
cagtgaggcatctctc

SEQ ID NO: 1915691 - DNA, 17 bp, Homo sapiens
cagtgaggcatctctct

SEQ ID NO: 1915692 - DNA, 22 bp, Homo sapiens
cagtgccagcttctttgcagct

SEQ ID NO: 1915693 - DNA, 13 bp, Homo sapiens
cagtggagcagaa

SEQ ID NO: 1915694 - DNA, 12 bp, Homo sapiens
cagtggcagggc

SEQ ID NO: 1915695 - DNA, 15 bp, Homo sapiens
cagtggcagggcaca

SEQ ID NO: 1915696 - DNA, 16 bp, Homo sapiens
cagtggcagggcacag

SEQ ID NO: 1915697 - DNA, 17 bp, Homo sapiens
cagtggcagggcacagg

SEQ ID NO: 1915698 - DNA, 15 bp, Homo sapiens
cagtggctgtgaagg

SEQ ID NO: 1915699 - DNA, 21 bp, Homo sapiens
cagtggctgtgaaggagtaat

SEQ ID NO: 1915700 - DNA, 11 bp, Homo sapiens
cagtggcttct

SEQ ID NO: 1915701 - DNA, 16 bp, Homo sapiens
cagtggcttctcccaa

SEQ ID NO: 1915702 - DNA, 17 bp, Homo sapiens
cagtggcttctcccaac

SEQ ID NO: 1915703 - DNA, 16 bp, Homo sapiens
cagtgggttcaggccc

SEQ ID NO: 1915704 - DNA, 19 bp, Homo sapiens
cagtgtactttgttaaaaa

SEQ ID NO: 1915705 - DNA, 18 bp, Homo sapiens
cagtgtgaatgctgggcc

SEQ ID NO: 1915706 - DNA, 13 bp, Homo sapiens
cagtgtgtaaagt

SEQ ID NO: 1915707 - DNA, 21 bp, Homo sapiens
cagttatgtgacctcacgtgc

SEQ ID NO: 1915708 - DNA, 21 bp, Homo sapiens
cagttcccctggaagcagtgc

SEQ ID NO: 1915709 - DNA, 18 bp, Homo sapiens
cagttgcccagatgaact

SEQ ID NO: 1915710 - DNA, 23 bp, Homo sapiens
cagttgctggtaaaatgaagaat

SEQ ID NO: 1915711 - DNA, 22 bp, Homo sapiens
cagtttaagaagtggtgacatt

SEQ ID NO: 1915712 - DNA, 23 bp, Homo sapiens
cagtttccctatctgcaaaatgg

SEQ ID NO: 1915713 - DNA, 23 bp, Homo sapiens
cagtttgaggattagtttagaac

SEQ ID NO: 1915714 - DNA, 13 bp, Homo sapiens
cataaagaaaaat

SEQ ID NO: 1915715 - DNA, 15 bp, Homo sapiens
cataagatattttat

SEQ ID NO: 1915716 - DNA, 14 bp, Homo sapiens
cataataaatagac

SEQ ID NO: 1915717 - DNA, 18 bp, Homo sapiens
cataataaatagacactt

SEQ ID NO: 1915718 - DNA, 20 bp, Homo sapiens
cataataaatagacacttga

SEQ ID NO: 1915719 - DNA, 15 bp, Homo sapiens
cataatactgaacca

SEQ ID NO: 1915720 - DNA, 17 bp, Homo sapiens
cataatactgaaccact

SEQ ID NO: 1915721 - DNA, 21 bp, Homo sapiens
cataatcatggctcttagaaa

SEQ ID NO: 1915722 - DNA, 23 bp, Homo sapiens
cataatcatgttagagttacttc

SEQ ID NO: 1915723 - DNA, 13 bp, Homo sapiens
cataatgaataaa

SEQ ID NO: 1915724 - DNA, 20 bp, Homo sapiens
cataatgaataaagtgcaaa

SEQ ID NO: 1915725 - DNA, 16 bp, Homo sapiens
cataattcatagtgat

SEQ ID NO: 1915726 - DNA, 19 bp, Homo sapiens
catacaaatgcatctttga

SEQ ID NO: 1915727 - DNA, 14 bp, Homo sapiens
cacctctgcccctt

SEQ ID NO: 1915728 - DNA, 15 bp, Homo sapiens
cacctctgccccttg

SEQ ID NO: 1915729 - DNA, 20 bp, Homo sapiens
cacctctgccccttgggcct

SEQ ID NO: 1915730 - DNA, 13 bp, Homo sapiens
cacctctgtgcag

SEQ ID NO: 1915731 - DNA, 20 bp, Homo sapiens
cacctgtaattccagcactt

SEQ ID NO: 1915732 - DNA, 17 bp, Homo sapiens
caccttcttgggactgc

SEQ ID NO: 1915733 - DNA, 15 bp, Homo sapiens
cacgcctagcctcac

SEQ ID NO: 1915734 - DNA, 17 bp, Homo sapiens
cacgcctagcctcacgc

SEQ ID NO: 1915735 - DNA, 14 bp, Homo sapiens
cacgcctctcccca

SEQ ID NO: 1915736 - DNA, 22 bp, Homo sapiens
cacgcctctccccaccttcttg

SEQ ID NO: 1915737 - DNA, 15 bp, Homo sapiens
cacgctcctttctga

SEQ ID NO: 1915738 - DNA, 22 bp, Homo sapiens
cacgctcctttctgatcttcac

SEQ ID NO: 1915739 - DNA, 19 bp, Homo sapiens
cacgctgactacagggccg

SEQ ID NO: 1915740 - DNA, 23 bp, Homo sapiens
cacggcttttggtgaatttgttt

SEQ ID NO: 1915741 - DNA, 16 bp, Homo sapiens
cacgtcattgtgtaag

SEQ ID NO: 1915742 - DNA, 19 bp, Homo sapiens
cacgtctatttcatcagaa

SEQ ID NO: 1915743 - DNA, 22 bp, Homo sapiens
cacgttgtgatgaagctgaggc

SEQ ID NO: 1915744 - DNA, 14 bp, Homo sapiens
cacgttttaaggac

SEQ ID NO: 1915745 - DNA, 16 bp, Homo sapiens
cacgttttaaggactg

SEQ ID NO: 1915746 - DNA, 18 bp, Homo sapiens
cacgttttcatctctagg

SEQ ID NO: 1915747 - DNA, 15 bp, Homo sapiens
cactacagtaagctg

SEQ ID NO: 1915748 - DNA, 22 bp, Homo sapiens
cactccaaaccttactctgagc

SEQ ID NO: 1915749 - DNA, 18 bp, Homo sapiens
cactcccatggctctggg

SEQ ID NO: 1915750 - DNA, 13 bp, Homo sapiens
cactcctcctcct

SEQ ID NO: 1915751 - DNA, 15 bp, Homo sapiens
cactcctcctccttt

SEQ ID NO: 1915752 - DNA, 14 bp, Homo sapiens
cactctcagaggcc

SEQ ID NO: 1915753 - DNA, 15 bp, Homo sapiens
cactctcagaggccc

SEQ ID NO: 1915754 - DNA, 22 bp, Homo sapiens
cactctcaggaaatgctgaccc

SEQ ID NO: 1915755 - DNA, 15 bp, Homo sapiens
cactcttggggacca

SEQ ID NO: 1915756 - DNA, 18 bp, Homo sapiens
cactgcacgttttcatct

SEQ ID NO: 1915757 - DNA, 16 bp, Homo sapiens
cactgcctgccttaag

SEQ ID NO: 1915758 - DNA, 20 bp, Homo sapiens
cactgcctgccttaagtgag

SEQ ID NO: 1915759 - DNA, 13 bp, Homo sapiens
cactgctctcacc

SEQ ID NO: 1915760 - DNA, 15 bp, Homo sapiens
cactgctctcacctt

SEQ ID NO: 1915761 - DNA, 21 bp, Homo sapiens
cactggattgtagaacttgtt

SEQ ID NO: 1915762 - DNA, 22 bp, Homo sapiens
cactggattgtagaacttgttg

SEQ ID NO: 1915763 - DNA, 11 bp, Homo sapiens
cactgggagca

SEQ ID NO: 1915764 - DNA, 21 bp, Homo sapiens
cactgggggacactgtggcag

SEQ ID NO: 1915765 - DNA, 22 bp, Homo sapiens
cactgtgcgtggggctcccgcc

SEQ ID NO: 1915766 - DNA, 21 bp, Homo sapiens
cactgtggaactgctattttc

SEQ ID NO: 1915767 - DNA, 18 bp, Homo sapiens
cactgtgtatatttgatt

SEQ ID NO: 1915768 - DNA, 23 bp, Homo sapiens
cactgtttagatttgccatagag

SEQ ID NO: 1915769 - DNA, 16 bp, Homo sapiens
cacttaaaacacgttt

SEQ ID NO: 1915770 - DNA, 22 bp, Homo sapiens
cacttaagttagttccactgag

SEQ ID NO: 1915771 - DNA, 17 bp, Homo sapiens
cacttgggggctcagca

SEQ ID NO: 1915772 - DNA, 19 bp, Homo sapiens
cacttgggggctcagcaag

SEQ ID NO: 1915773 - DNA, 16 bp, Homo sapiens
cactttgacaggttcc

SEQ ID NO: 1915774 - DNA, 16 bp, Homo sapiens
cactttttgttacata

SEQ ID NO: 1915775 - DNA, 14 bp, Homo sapiens
cagaacagcttcat

SEQ ID NO: 1915776 - DNA, 14 bp, Homo sapiens
cagaacctaggagg

SEQ ID NO: 1915777 - DNA, 15 bp, Homo sapiens
cagaacctaggagga

SEQ ID NO: 1915778 - DNA, 15 bp, Homo sapiens
cagaagacaaaggcc

SEQ ID NO: 1915779 - DNA, 20 bp, Homo sapiens
cagaaggggactgccacctc

SEQ ID NO: 1915780 - DNA, 21 bp, Homo sapiens
cagaaggggactgccacctcc

SEQ ID NO: 1915781 - DNA, 22 bp, Homo sapiens
cagaaggggactgccacctccc

SEQ ID NO: 1915782 - DNA, 22 bp, Homo sapiens
cagaagtaggggaagaataatt

SEQ ID NO: 1915783 - DNA, 13 bp, Homo sapiens
cagaagtgcatcc

SEQ ID NO: 1915784 - DNA, 21 bp, Homo sapiens
cagaagtgcatcctgattatt

SEQ ID NO: 1915785 - DNA, 14 bp, Homo sapiens
cagaatattctttt

SEQ ID NO: 1915786 - DNA, 22 bp, Homo sapiens
cagaatcttgtccaagttgttt

SEQ ID NO: 1915787 - DNA, 15 bp, Homo sapiens
cagacaccacagcct

SEQ ID NO: 1915788 - DNA, 18 bp, Homo sapiens
cagacaccacagcctccc

SEQ ID NO: 1915789 - DNA, 15 bp, Homo sapiens
cagacacccttggag

SEQ ID NO: 1915790 - DNA, 16 bp, Homo sapiens
cagacaggacccctgc

SEQ ID NO: 1915791 - DNA, 22 bp, Homo sapiens
cagaccccgcagcacgcctctc

SEQ ID NO: 1915792 - DNA, 12 bp, Homo sapiens
cagacctgcctg

SEQ ID NO: 1915793 - DNA, 21 bp, Homo sapiens
cagacttttttaaacatcaaa

SEQ ID NO: 1915794 - DNA, 23 bp, Homo sapiens
cagagagaagagccccactctca

SEQ ID NO: 1915795 - DNA, 18 bp, Homo sapiens
cagagagcgaccagcagg

SEQ ID NO: 1915796 - DNA, 22 bp, Homo sapiens
cagagagcgaccagcaggctcc

SEQ ID NO: 1915797 - DNA, 21 bp, Homo sapiens
cagagagggaagctgaggccc

SEQ ID NO: 1915798 - DNA, 17 bp, Homo sapiens
cagagagggtcactggg

SEQ ID NO: 1915799 - DNA, 22 bp, Homo sapiens
cagagagtaagcacttaaaaaa

SEQ ID NO: 1915800 - DNA, 15 bp, Homo sapiens
cagagcaacccctgg

SEQ ID NO: 1915801 - DNA, 22 bp, Homo sapiens
cagagcaacccctggaccccag

SEQ ID NO: 1915802 - DNA, 23 bp, Homo sapiens
cagagcaacccctggaccccagc

SEQ ID NO: 1915803 - DNA, 15 bp, Homo sapiens
cagagccttggagga

SEQ ID NO: 1915804 - DNA, 18 bp, Homo sapiens
cagagccttggaggacac

SEQ ID NO: 1915805 - DNA, 18 bp, Homo sapiens
cagagcgttagaggggcc

SEQ ID NO: 1915806 - DNA, 19 bp, Homo sapiens
cagagcgttagaggggcca

SEQ ID NO: 1915807 - DNA, 20 bp, Homo sapiens
cagagctaaggccaatgggc

SEQ ID NO: 1915808 - DNA, 15 bp, Homo sapiens
cagaggacacagaga

SEQ ID NO: 1915809 - DNA, 17 bp, Homo sapiens
cagaggacacagagaag

SEQ ID NO: 1915810 - DNA, 22 bp, Homo sapiens
cagaggccccaataccccatgg

SEQ ID NO: 1915811 - DNA, 17 bp, Homo sapiens
cagaggctgtggtcaga

SEQ ID NO: 1915812 - DNA, 18 bp, Homo sapiens
cagagggggaaataagag

SEQ ID NO: 1915813 - DNA, 18 bp, Homo sapiens
cagagtagccatgaggag

SEQ ID NO: 1915814 - DNA, 19 bp, Homo sapiens
cagagtagccatgaggagg

SEQ ID NO: 1915815 - DNA, 20 bp, Homo sapiens
cagagtagccatgaggaggc

SEQ ID NO: 1915816 - DNA, 18 bp, Homo sapiens
cagatgttttccactgag

SEQ ID NO: 1915817 - DNA, 14 bp, Homo sapiens
cagattcaggcatt

SEQ ID NO: 1915818 - DNA, 18 bp, Homo sapiens
cagattcttttatgtgat

SEQ ID NO: 1915819 - DNA, 14 bp, Homo sapiens
cagatttgctaata

SEQ ID NO: 1915820 - DNA, 18 bp, Homo sapiens
cagcaacacgtcattgtg

SEQ ID NO: 1915821 - DNA, 21 bp, Homo sapiens
cagcaaggccacctcttcctg

SEQ ID NO: 1915822 - DNA, 15 bp, Homo sapiens
cagcaagtgtgaata

SEQ ID NO: 1915823 - DNA, 20 bp, Homo sapiens
cagcacgcctctccccacct

SEQ ID NO: 1915824 - DNA, 19 bp, Homo sapiens
cagcagacatcaagctcaa

SEQ ID NO: 1915825 - DNA, 12 bp, Homo sapiens
cagcagccagcc

SEQ ID NO: 1915826 - DNA, 22 bp, Homo sapiens
cagcagcctctgatctgtgcag

SEQ ID NO: 1915827 - DNA, 11 bp, Homo sapiens
cagcagccttc

SEQ ID NO: 1915828 - DNA, 23 bp, Homo sapiens
cagcagccttccagtggcttctc

SEQ ID NO: 1915829 - DNA, 20 bp, Homo sapiens
cagcaggagggactctgtct

SEQ ID NO: 1915830 - DNA, 12 bp, Homo sapiens
cagcagggcctt

SEQ ID NO: 1915831 - DNA, 15 bp, Homo sapiens
cagcagggccttctg

SEQ ID NO: 1915832 - DNA, 20 bp, Homo sapiens
cagcagggccttctgcctgc

SEQ ID NO: 1915833 - DNA, 22 bp, Homo sapiens
cagcagggccttctgcctgctg

SEQ ID NO: 1915834 - DNA, 16 bp, Homo sapiens
cagcaggggccaagca

SEQ ID NO: 1915835 - DNA, 18 bp, Homo sapiens
cagcaggggccaagcagg

SEQ ID NO: 1915836 - DNA, 20 bp, Homo sapiens
cagcaggggccaagcaggca

SEQ ID NO: 1915837 - DNA, 18 bp, Homo sapiens
cagcagtgggttcaggcc

SEQ ID NO: 1915838 - DNA, 22 bp, Homo sapiens
cagcagttgctggtaaaatgaa

SEQ ID NO: 1915839 - DNA, 23 bp, Homo sapiens
cagcagttgctggtaaaatgaag

SEQ ID NO: 1915840 - DNA, 18 bp, Homo sapiens
cagccaaacacacagaag

SEQ ID NO: 1915841 - DNA, 14 bp, Homo sapiens
cagccaccctttct

SEQ ID NO: 1915842 - DNA, 14 bp, Homo sapiens
cagccactcagaaa

SEQ ID NO: 1915843 - DNA, 22 bp, Homo sapiens
cagccagggaaagactggcaag

SEQ ID NO: 1915844 - DNA, 23 bp, Homo sapiens
cagccagggaaagactggcaaga

SEQ ID NO: 1915845 - DNA, 17 bp, Homo sapiens
cagccatttctccatgg

SEQ ID NO: 1915846 - DNA, 23 bp, Homo sapiens
cagcccgatcctcccctggactc

SEQ ID NO: 1915847 - DNA, 22 bp, Homo sapiens
cagcccgcatcagctgctcaga

SEQ ID NO: 1915848 - DNA, 13 bp, Homo sapiens
cagcctccccttc

SEQ ID NO: 1915849 - DNA, 15 bp, Homo sapiens
cagcctccccttccc

SEQ ID NO: 1915850 - DNA, 16 bp, Homo sapiens
cagcctccccttccca

SEQ ID NO: 1915851 - DNA, 17 bp, Homo sapiens
cagcctccccttcccag

SEQ ID NO: 1915852 - DNA, 20 bp, Homo sapiens
cagcctccccttcccagacc

SEQ ID NO: 1915853 - DNA, 21 bp, Homo sapiens
cagcctccctgacgtctgcca

SEQ ID NO: 1915854 - DNA, 22 bp, Homo sapiens
cagcctccctgacgtctgccac

SEQ ID NO: 1915855 - DNA, 18 bp, Homo sapiens
cagcctgagatggatgga

SEQ ID NO: 1915856 - DNA, 19 bp, Homo sapiens
cagccttccagtggcttct

SEQ ID NO: 1915857 - DNA, 14 bp, Homo sapiens
cagcgaggctgggc

SEQ ID NO: 1915858 - DNA, 14 bp, Homo sapiens
cagcgcccccactc

SEQ ID NO: 1915859 - DNA, 16 bp, Homo sapiens
cagcgcccccactcct

SEQ ID NO: 1915860 - DNA, 19 bp, Homo sapiens
cagcgcccccactcctcct

SEQ ID NO: 1915861 - DNA, 20 bp, Homo sapiens
cagcgcggacatcccctgct

SEQ ID NO: 1915862 - DNA, 13 bp, Homo sapiens
atttgtgaactgt

SEQ ID NO: 1915863 - DNA, 17 bp, Homo sapiens
atttgtgaactgtcatg

SEQ ID NO: 1915864 - DNA, 17 bp, Homo sapiens
atttgtgatgtactgta

SEQ ID NO: 1915865 - DNA, 17 bp, Homo sapiens
atttgtgtgttacaatg

SEQ ID NO: 1915866 - DNA, 17 bp, Homo sapiens
atttgtttaaggttaat

SEQ ID NO: 1915867 - DNA, 18 bp, Homo sapiens
atttgtttctttctctga

SEQ ID NO: 1915868 - DNA, 16 bp, Homo sapiens
attttagaatgtcaat

SEQ ID NO: 1915869 - DNA, 19 bp, Homo sapiens
attttagaatgtcaataaa

SEQ ID NO: 1915870 - DNA, 18 bp, Homo sapiens
attttagttccttctata

SEQ ID NO: 1915871 - DNA, 15 bp, Homo sapiens
attttataaatgtat

SEQ ID NO: 1915872 - DNA, 15 bp, Homo sapiens
attttatttttagaa

SEQ ID NO: 1915873 - DNA, 18 bp, Homo sapiens
attttatttttagaattt

SEQ ID NO: 1915874 - DNA, 19 bp, Homo sapiens
attttcctgttgtcaagaa

SEQ ID NO: 1915875 - DNA, 13 bp, Homo sapiens
attttcttaaaac

SEQ ID NO: 1915876 - DNA, 13 bp, Homo sapiens
attttgaaaaatt

SEQ ID NO: 1915877 - DNA, 14 bp, Homo sapiens
attttgaaaaatta

SEQ ID NO: 1915878 - DNA, 14 bp, Homo sapiens
attttgaaaagtaa

SEQ ID NO: 1915879 - DNA, 21 bp, Homo sapiens
attttgaaaagtaatatttat

SEQ ID NO: 1915880 - DNA, 16 bp, Homo sapiens
attttgaccttgtatt

SEQ ID NO: 1915881 - DNA, 18 bp, Homo sapiens
attttgatgtaaagatgt

SEQ ID NO: 1915882 - DNA, 18 bp, Homo sapiens
attttgcgtcagagaaat

SEQ ID NO: 1915883 - DNA, 14 bp, Homo sapiens
attttgtaataata

SEQ ID NO: 1915884 - DNA, 19 bp, Homo sapiens
attttgtaataataaagaa

SEQ ID NO: 1915885 - DNA, 22 bp, Homo sapiens
attttgtaataataaagaatag

SEQ ID NO: 1915886 - DNA, 20 bp, Homo sapiens
attttgtaatgtatcaaata

SEQ ID NO: 1915887 - DNA, 23 bp, Homo sapiens
attttgtaatgtatcaaatacat

SEQ ID NO: 1915888 - DNA, 19 bp, Homo sapiens
attttgtgaaacagacttg

SEQ ID NO: 1915889 - DNA, 21 bp, Homo sapiens
attttgtgaaacagacttgta

SEQ ID NO: 1915890 - DNA, 24 bp, Homo sapiens
attttgtgaaacagacttgtatat

SEQ ID NO: 1915891 - DNA, 19 bp, Homo sapiens
atttttactgctttctgaa

SEQ ID NO: 1915892 - DNA, 12 bp, Homo sapiens
atttttataatg

SEQ ID NO: 1915893 - DNA, 15 bp, Homo sapiens
atttttataatgact

SEQ ID NO: 1915894 - DNA, 17 bp, Homo sapiens
atttttataatgactgg

SEQ ID NO: 1915895 - DNA, 13 bp, Homo sapiens
atttttctctctc

SEQ ID NO: 1915896 - DNA, 15 bp, Homo sapiens
atttttcttatttat

SEQ ID NO: 1915897 - DNA, 10 bp, Homo sapiens
atttttgctt

SEQ ID NO: 1915898 - DNA, 19 bp, Homo sapiens
atttttggttgaataaact

SEQ ID NO: 1915899 - DNA, 18 bp, Homo sapiens
attttttatatttcaagt

SEQ ID NO: 1915900 - DNA, 22 bp, Homo sapiens
atttttttgaactcttctcatt

SEQ ID NO: 1915901 - DNA, 14 bp, Homo sapiens
atttttttgtatga

SEQ ID NO: 1915902 - DNA, 14 bp, Homo sapiens
caaaaaagagaaac

SEQ ID NO: 1915903 - DNA, 22 bp, Homo sapiens
caaaaagaaaaaaaaaaagaaa

SEQ ID NO: 1915904 - DNA, 19 bp, Homo sapiens
caaaaatgttaagcatcta

SEQ ID NO: 1915905 - DNA, 12 bp, Homo sapiens
caaaacaaaggc

SEQ ID NO: 1915906 - DNA, 22 bp, Homo sapiens
caaaacaaaggcctaattctat

SEQ ID NO: 1915907 - DNA, 22 bp, Homo sapiens
caaaactctcattattctctaa

SEQ ID NO: 1915908 - DNA, 17 bp, Homo sapiens
caaaataacaaaaaaga

SEQ ID NO: 1915909 - DNA, 14 bp, Homo sapiens
caaaataagaaaag

SEQ ID NO: 1915910 - DNA, 22 bp, Homo sapiens
caaaataagaaaagatgtagat

SEQ ID NO: 1915911 - DNA, 13 bp, Homo sapiens
caaaatacttttt

SEQ ID NO: 1915912 - DNA, 19 bp, Homo sapiens
caaaatgaaaagagaaact

SEQ ID NO: 1915913 - DNA, 23 bp, Homo sapiens
caaacaaaaggtgtgcctggcag

SEQ ID NO: 1915914 - DNA, 13 bp, Homo sapiens
caaacctgtgaag

SEQ ID NO: 1915915 - DNA, 16 bp, Homo sapiens
caaaccttactctgag

SEQ ID NO: 1915916 - DNA, 21 bp, Homo sapiens
caaaccttactctgagctcat

SEQ ID NO: 1915917 - DNA, 17 bp, Homo sapiens
caaacttggatcagata

SEQ ID NO: 1915918 - DNA, 21 bp, Homo sapiens
caaagacatttcaaataactg

SEQ ID NO: 1915919 - DNA, 15 bp, Homo sapiens
caaagagacagggcc

SEQ ID NO: 1915920 - DNA, 17 bp, Homo sapiens
caaagcaccaaaataag

SEQ ID NO: 1915921 - DNA, 21 bp, Homo sapiens
caaagctctgaattcaggtcc

SEQ ID NO: 1915922 - DNA, 21 bp, Homo sapiens
caaagtgggtactttctgaaa

SEQ ID NO: 1915923 - DNA, 13 bp, Homo sapiens
caaataactgcag

SEQ ID NO: 1915924 - DNA, 18 bp, Homo sapiens
caaataactgcagaaaaa

SEQ ID NO: 1915925 - DNA, 19 bp, Homo sapiens
caaataagcactcctttaa

SEQ ID NO: 1915926 - DNA, 19 bp, Homo sapiens
caaatacatttaaaacatt

SEQ ID NO: 1915927 - DNA, 23 bp, Homo sapiens
caaatatgtggtccatctctgaa

SEQ ID NO: 1915928 - DNA, 23 bp, Homo sapiens
caaatatttagatgtaattttgt

SEQ ID NO: 1915929 - DNA, 20 bp, Homo sapiens
caaatccaggaccctgccag

SEQ ID NO: 1915930 - DNA, 13 bp, Homo sapiens
caaatgactttat

SEQ ID NO: 1915931 - DNA, 17 bp, Homo sapiens
caaatgactttattatt

SEQ ID NO: 1915932 - DNA, 17 bp, Homo sapiens
caaatgatgtgcctgct

SEQ ID NO: 1915933 - DNA, 21 bp, Homo sapiens
caaatgatgtgcctgcttcag

SEQ ID NO: 1915934 - DNA, 16 bp, Homo sapiens
caaatgcatctttgat

SEQ ID NO: 1915935 - DNA, 15 bp, Homo sapiens
caaatgtgtgcccag

SEQ ID NO: 1915936 - DNA, 16 bp, Homo sapiens
caaatgtgtgcccagc

SEQ ID NO: 1915937 - DNA, 20 bp, Homo sapiens
caaattaattgtgtgaactt

SEQ ID NO: 1915938 - DNA, 22 bp, Homo sapiens
caaattttggttttctactgtt

SEQ ID NO: 1915939 - DNA, 19 bp, Homo sapiens
caacacgtcattgtgtaag

SEQ ID NO: 1915940 - DNA, 14 bp, Homo sapiens
caaccccagacccc

SEQ ID NO: 1915941 - DNA, 17 bp, Homo sapiens
caacccctcgcccagtc

SEQ ID NO: 1915942 - DNA, 14 bp, Homo sapiens
caaccttcaagctg

SEQ ID NO: 1915943 - DNA, 15 bp, Homo sapiens
caaccttggcttggc

SEQ ID NO: 1915944 - DNA, 19 bp, Homo sapiens
caacgatcacaaatgactt

SEQ ID NO: 1915945 - DNA, 16 bp, Homo sapiens
caactgaaagaaaaag

SEQ ID NO: 1915946 - DNA, 16 bp, Homo sapiens
caactgaaatgtggat

SEQ ID NO: 1915947 - DNA, 12 bp, Homo sapiens
caagaaagtcca

SEQ ID NO: 1915948 - DNA, 17 bp, Homo sapiens
caagaaatgaagagctg

SEQ ID NO: 1915949 - DNA, 17 bp, Homo sapiens
caagacttattttcaca

SEQ ID NO: 1915950 - DNA, 17 bp, Homo sapiens
caagagactgcttgaca

SEQ ID NO: 1915951 - DNA, 18 bp, Homo sapiens
caagagactgcttgacaa

SEQ ID NO: 1915952 - DNA, 14 bp, Homo sapiens
caagagccttaaaa

SEQ ID NO: 1915953 - DNA, 17 bp, Homo sapiens
caagagccttaaaacat

SEQ ID NO: 1915954 - DNA, 15 bp, Homo sapiens
caagagtggccccac

SEQ ID NO: 1915955 - DNA, 16 bp, Homo sapiens
caagagtggccccacc

SEQ ID NO: 1915956 - DNA, 19 bp, Homo sapiens
caagagtggccccacctgg

SEQ ID NO: 1915957 - DNA, 17 bp, Homo sapiens
caagatcaaaaaggctt

SEQ ID NO: 1915958 - DNA, 21 bp, Homo sapiens
caagatcaaaaaggcttataa

SEQ ID NO: 1915959 - DNA, 20 bp, Homo sapiens
caagatgttgaggcgagcag

SEQ ID NO: 1915960 - DNA, 14 bp, Homo sapiens
caagccgtggccgg

SEQ ID NO: 1915961 - DNA, 14 bp, Homo sapiens
caagcctggcaggg

SEQ ID NO: 1915962 - DNA, 14 bp, Homo sapiens
caagcgccctggcc

SEQ ID NO: 1915963 - DNA, 15 bp, Homo sapiens
caagcgccctggccc

SEQ ID NO: 1915964 - DNA, 18 bp, Homo sapiens
caagctggaaaggccagc

SEQ ID NO: 1915965 - DNA, 21 bp, Homo sapiens
caagctggaaaggccagcagc

SEQ ID NO: 1915966 - DNA, 17 bp, Homo sapiens
caagctggcttacactg

SEQ ID NO: 1915967 - DNA, 15 bp, Homo sapiens
caagcttttcctaat

SEQ ID NO: 1915968 - DNA, 12 bp, Homo sapiens
caaggccacctc

SEQ ID NO: 1915969 - DNA, 19 bp, Homo sapiens
caaggccacctcttcctgg

SEQ ID NO: 1915970 - DNA, 20 bp, Homo sapiens
caaggccacctcttcctggc

SEQ ID NO: 1915971 - DNA, 22 bp, Homo sapiens
caaggccacctcttcctggccg

SEQ ID NO: 1915972 - DNA, 14 bp, Homo sapiens
caagggaggcccag

SEQ ID NO: 1915973 - DNA, 16 bp, Homo sapiens
caagggcggcctttcc

SEQ ID NO: 1915974 - DNA, 14 bp, Homo sapiens
caaggtaaggaggg

SEQ ID NO: 1915975 - DNA, 17 bp, Homo sapiens
caagtagttctgtattt

SEQ ID NO: 1915976 - DNA, 20 bp, Homo sapiens
caagtccctgtaattgttgt

SEQ ID NO: 1915977 - DNA, 14 bp, Homo sapiens
caagtcctgcagtc

SEQ ID NO: 1915978 - DNA, 16 bp, Homo sapiens
caagtgcaatgccccc

SEQ ID NO: 1915979 - DNA, 23 bp, Homo sapiens
caagtggatattttcttaaaacc

SEQ ID NO: 1915980 - DNA, 14 bp, Homo sapiens
caagtgtgaatact

SEQ ID NO: 1915981 - DNA, 15 bp, Homo sapiens
caagtgtgaatactg

SEQ ID NO: 1915982 - DNA, 16 bp, Homo sapiens
caagtgtgaatactgc

SEQ ID NO: 1915983 - DNA, 17 bp, Homo sapiens
caagttttccatatttt

SEQ ID NO: 1915984 - DNA, 22 bp, Homo sapiens
caataaaagcccaggagcccat

SEQ ID NO: 1915985 - DNA, 19 bp, Homo sapiens
caataaagagaaccatgtg

SEQ ID NO: 1915986 - DNA, 17 bp, Homo sapiens
caataaagcaataagaa

SEQ ID NO: 1915987 - DNA, 13 bp, Homo sapiens
caataaattttga

SEQ ID NO: 1915988 - DNA, 18 bp, Homo sapiens
caataaattttgaaaagt

SEQ ID NO: 1915989 - DNA, 18 bp, Homo sapiens
caataagaacaaatacaa

SEQ ID NO: 1915990 - DNA, 20 bp, Homo sapiens
caataatttgtggtgatttg

SEQ ID NO: 1915991 - DNA, 15 bp, Homo sapiens
caataccaacctgaa

SEQ ID NO: 1915992 - DNA, 18 bp, Homo sapiens
caataccaacctgaaagt

SEQ ID NO: 1915993 - DNA, 16 bp, Homo sapiens
caatcaataatagcta

SEQ ID NO: 1915994 - DNA, 19 bp, Homo sapiens
caatctcgtaggtgtcctg

SEQ ID NO: 1915995 - DNA, 19 bp, Homo sapiens
caatctggggaaataataa

SEQ ID NO: 1915996 - DNA, 14 bp, Homo sapiens
caatcttactttgt

SEQ ID NO: 1915997 - DNA, 15 bp, Homo sapiens
caatcttactttgta

SEQ ID NO: 1915998 - DNA, 22 bp, Homo sapiens
caatcttactttgtaaattctg

SEQ ID NO: 1915999 - DNA, 23 bp, Homo sapiens
caatcttactttgtaaattctga

SEQ ID NO: 1916000 - DNA, 13 bp, Homo sapiens
caatgccccctcc

SEQ ID NO: 1916001 - DNA, 16 bp, Homo sapiens
caatgctggagaaaaa

SEQ ID NO: 1916002 - DNA, 17 bp, Homo sapiens
caatggtagtttctgtg

SEQ ID NO: 1916003 - DNA, 20 bp, Homo sapiens
caatgtgtctatttctgaaa

SEQ ID NO: 1916004 - DNA, 11 bp, Homo sapiens
caatgtttaca

SEQ ID NO: 1916005 - DNA, 17 bp, Homo sapiens
caattagaaaaggaaat

SEQ ID NO: 1916006 - DNA, 20 bp, Homo sapiens
caattctcgattctttgaag

SEQ ID NO: 1916007 - DNA, 18 bp, Homo sapiens
caatttttggttgaataa

SEQ ID NO: 1916008 - DNA, 22 bp, Homo sapiens
cacaaactgcttcctttcttga

SEQ ID NO: 1916009 - DNA, 12 bp, Homo sapiens
cacaaatacatt

SEQ ID NO: 1916010 - DNA, 16 bp, Homo sapiens
cacaaatacattcctt

SEQ ID NO: 1916011 - DNA, 22 bp, Homo sapiens
cacaaatgactttattatttat

SEQ ID NO: 1916012 - DNA, 14 bp, Homo sapiens
cacaaggaagaaat

SEQ ID NO: 1916013 - DNA, 13 bp, Homo sapiens
cacaagtaaacat

SEQ ID NO: 1916014 - DNA, 13 bp, Homo sapiens
cacacacctcatg

SEQ ID NO: 1916015 - DNA, 12 bp, Homo sapiens
cacacagaaggg

SEQ ID NO: 1916016 - DNA, 14 bp, Homo sapiens
cacacctctgcccc

SEQ ID NO: 1916017 - DNA, 15 bp, Homo sapiens
cacacctctgcccct

SEQ ID NO: 1916018 - DNA, 15 bp, Homo sapiens
cacactgaataagag

SEQ ID NO: 1916019 - DNA, 19 bp, Homo sapiens
cacagaagccccacaccag

SEQ ID NO: 1916020 - DNA, 19 bp, Homo sapiens
cacagaaggggactgccac

SEQ ID NO: 1916021 - DNA, 10 bp, Homo sapiens
cacagacagg

SEQ ID NO: 1916022 - DNA, 13 bp, Homo sapiens
cacagacaggacc

SEQ ID NO: 1916023 - DNA, 14 bp, Homo sapiens
cacagacaggaccc

SEQ ID NO: 1916024 - DNA, 17 bp, Homo sapiens
cacagacaggacccctg

SEQ ID NO: 1916025 - DNA, 20 bp, Homo sapiens
cacagactttagctttctga

SEQ ID NO: 1916026 - DNA, 12 bp, Homo sapiens
cacagaggctgt

SEQ ID NO: 1916027 - DNA, 19 bp, Homo sapiens
cacagaggctgtggtcaga

SEQ ID NO: 1916028 - DNA, 20 bp, Homo sapiens
cacagcaacgatcacaaatg

SEQ ID NO: 1916029 - DNA, 16 bp, Homo sapiens
cacagcaaggctgtcg

SEQ ID NO: 1916030 - DNA, 13 bp, Homo sapiens
cacagcagggcct

SEQ ID NO: 1916031 - DNA, 20 bp, Homo sapiens
cacagcagggccttctgcct

SEQ ID NO: 1916032 - DNA, 14 bp, Homo sapiens
cacagcctcccctt

SEQ ID NO: 1916033 - DNA, 16 bp, Homo sapiens
cacagcctccccttcc

SEQ ID NO: 1916034 - DNA, 23 bp, Homo sapiens
cacagcctccccttcccagaccc

SEQ ID NO: 1916035 - DNA, 22 bp, Homo sapiens
cacagcctgcacttgggggctc

SEQ ID NO: 1916036 - DNA, 14 bp, Homo sapiens
cacagctgagaggc

SEQ ID NO: 1916037 - DNA, 19 bp, Homo sapiens
cacaggacaggggttcctt

SEQ ID NO: 1916038 - DNA, 12 bp, Homo sapiens
cacaggcagggc

SEQ ID NO: 1916039 - DNA, 20 bp, Homo sapiens
cacaggctgagtgcaggccc

SEQ ID NO: 1916040 - DNA, 22 bp, Homo sapiens
cacaggctgagtgcaggcccac

SEQ ID NO: 1916041 - DNA, 22 bp, Homo sapiens
cacaggctgggctgggcactgc

SEQ ID NO: 1916042 - DNA, 22 bp, Homo sapiens
cacatgggtactgtctcggcag

SEQ ID NO: 1916043 - DNA, 12 bp, Homo sapiens
cacatggtgatg

SEQ ID NO: 1916044 - DNA, 15 bp, Homo sapiens
cacatggtgatgttg

SEQ ID NO: 1916045 - DNA, 19 bp, Homo sapiens
cacatggttacatatcaaa

SEQ ID NO: 1916046 - DNA, 17 bp, Homo sapiens
caccaaaataagaaaag

SEQ ID NO: 1916047 - DNA, 13 bp, Homo sapiens
caccacagcctcc

SEQ ID NO: 1916048 - DNA, 15 bp, Homo sapiens
caccacagcctcccc

SEQ ID NO: 1916049 - DNA, 19 bp, Homo sapiens
caccacagcctccccttcc

SEQ ID NO: 1916050 - DNA, 21 bp, Homo sapiens
caccacagcctccccttccca

SEQ ID NO: 1916051 - DNA, 18 bp, Homo sapiens
caccagcgcccccactcc

SEQ ID NO: 1916052 - DNA, 19 bp, Homo sapiens
caccagcgcccccactcct

SEQ ID NO: 1916053 - DNA, 23 bp, Homo sapiens
caccagcgcccccactcctcctc

SEQ ID NO: 1916054 - DNA, 13 bp, Homo sapiens
caccatcccctcc

SEQ ID NO: 1916055 - DNA, 23 bp, Homo sapiens
caccattcgtacataatactgaa

SEQ ID NO: 1916056 - DNA, 15 bp, Homo sapiens
caccatttccccagg

SEQ ID NO: 1916057 - DNA, 18 bp, Homo sapiens
caccatttccccagggca

SEQ ID NO: 1916058 - DNA, 20 bp, Homo sapiens
caccatttccccagggcacg

SEQ ID NO: 1916059 - DNA, 18 bp, Homo sapiens
cacccagacctgcctgtc

SEQ ID NO: 1916060 - DNA, 23 bp, Homo sapiens
caccccaaacaaatggaagagaa

SEQ ID NO: 1916061 - DNA, 14 bp, Homo sapiens
cacccgactccagt

SEQ ID NO: 1916062 - DNA, 14 bp, Homo sapiens
caccctaccccctt

SEQ ID NO: 1916063 - DNA, 21 bp, Homo sapiens
caccctcctttctcaccagcc

SEQ ID NO: 1916064 - DNA, 15 bp, Homo sapiens
caccctgtcccaggc

SEQ ID NO: 1916065 - DNA, 16 bp, Homo sapiens
caccctgtcccaggca

SEQ ID NO: 1916066 - DNA, 22 bp, Homo sapiens
caccctgtcccaggcagcgcca

SEQ ID NO: 1916067 - DNA, 16 bp, Homo sapiens
caccctttctgccagg

SEQ ID NO: 1916068 - DNA, 17 bp, Homo sapiens
caccctttctggcacga

SEQ ID NO: 1916069 - DNA, 16 bp, Homo sapiens
caccgtcccctcccag

SEQ ID NO: 1916070 - DNA, 16 bp, Homo sapiens
caccgtccctctgcag

SEQ ID NO: 1916071 - DNA, 17 bp, Homo sapiens
caccgtccctctgcaga

SEQ ID NO: 1916072 - DNA, 16 bp, Homo sapiens
cacctaagtacttaaa

SEQ ID NO: 1916073 - DNA, 15 bp, Homo sapiens
cacctccccttgcca

SEQ ID NO: 1916074 - DNA, 19 bp, Homo sapiens
cacctccccttgccagctg

SEQ ID NO: 1916075 - DNA, 14 bp, Homo sapiens
tcttactttgtaaa

SEQ ID NO: 1916076 - DNA, 15 bp, Homo sapiens
tcttactttgtaaat

SEQ ID NO: 1916077 - DNA, 18 bp, Homo sapiens
tcttactttgtaaattct

SEQ ID NO: 1916078 - DNA, 14 bp, Homo sapiens
tcttagaaactcag

SEQ ID NO: 1916079 - DNA, 21 bp, Homo sapiens
tcttagcatacattcagacgt

SEQ ID NO: 1916080 - DNA, 18 bp, Homo sapiens
tcttagtttgaatgaaac

SEQ ID NO: 1916081 - DNA, 21 bp, Homo sapiens
tcttatatttacaacacttta

SEQ ID NO: 1916082 - DNA, 14 bp, Homo sapiens
tcttcacatgtaac

SEQ ID NO: 1916083 - DNA, 16 bp, Homo sapiens
tcttcagactgaggcc

SEQ ID NO: 1916084 - DNA, 22 bp, Homo sapiens
tcttccagtgaggcatctctct

SEQ ID NO: 1916085 - DNA, 24 bp, Homo sapiens
tcttccagtgaggcatctctctgg

SEQ ID NO: 1916086 - DNA, 22 bp, Homo sapiens
tcttcctatcaaaaagatatca

SEQ ID NO: 1916087 - DNA, 17 bp, Homo sapiens
tcttccttacctggaaa

SEQ ID NO: 1916088 - DNA, 11 bp, Homo sapiens
tcttctgaaat

SEQ ID NO: 1916089 - DNA, 22 bp, Homo sapiens
tcttctgagcttacgtagttct

SEQ ID NO: 1916090 - DNA, 21 bp, Homo sapiens
tcttgataattttcctttaat

SEQ ID NO: 1916091 - DNA, 23 bp, Homo sapiens
tcttgattcgtagatttaataac

SEQ ID NO: 1916092 - DNA, 23 bp, Homo sapiens
tcttgcatttaaaagacagcttt

SEQ ID NO: 1916093 - DNA, 18 bp, Homo sapiens
tcttgcctcagcttcccc

SEQ ID NO: 1916094 - DNA, 16 bp, Homo sapiens
tcttggcaataaattt

SEQ ID NO: 1916095 - DNA, 22 bp, Homo sapiens
tcttggcaataaattttgaaaa

SEQ ID NO: 1916096 - DNA, 15 bp, Homo sapiens
tctttaaactgtcgt

SEQ ID NO: 1916097 - DNA, 19 bp, Homo sapiens
tctttattgcttactgtgt

SEQ ID NO: 1916098 - DNA, 12 bp, Homo sapiens
tctttcctttcc

SEQ ID NO: 1916099 - DNA, 22 bp, Homo sapiens
tctttctaagagacctgaactg

SEQ ID NO: 1916100 - DNA, 21 bp, Homo sapiens
tctttctctctcactctcttc

SEQ ID NO: 1916101 - DNA, 15 bp, Homo sapiens
tctttctctgaggac

SEQ ID NO: 1916102 - DNA, 21 bp, Homo sapiens
tctttctggttgtttttaaac

SEQ ID NO: 1916103 - DNA, 16 bp, Homo sapiens
tctttggccagaacac

SEQ ID NO: 1916104 - DNA, 17 bp, Homo sapiens
tcttttccctcctttcc

SEQ ID NO: 1916105 - DNA, 19 bp, Homo sapiens
tcttttccctcctttcctt

SEQ ID NO: 1916106 - DNA, 21 bp, Homo sapiens
tcttttttattaatcactgtg

SEQ ID NO: 1916107 - DNA, 22 bp, Homo sapiens
tgaaaaaaaaaatgctgaacat

SEQ ID NO: 1916108 - DNA, 20 bp, Homo sapiens
tgaaaaattacctgtataat

SEQ ID NO: 1916109 - DNA, 15 bp, Homo sapiens
tgaaaacaagagact

SEQ ID NO: 1916110 - DNA, 13 bp, Homo sapiens
tgaaaactttgta

SEQ ID NO: 1916111 - DNA, 18 bp, Homo sapiens
tgaaaagagaaacttaaa

SEQ ID NO: 1916112 - DNA, 19 bp, Homo sapiens
tgaaaagtaatatttatta

SEQ ID NO: 1916113 - DNA, 20 bp, Homo sapiens
tgaaaatagtttattttaaa

SEQ ID NO: 1916114 - DNA, 23 bp, Homo sapiens
tgaaaatagtttattttaaaaca

SEQ ID NO: 1916115 - DNA, 15 bp, Homo sapiens
tgaaaatttatataa

SEQ ID NO: 1916116 - DNA, 20 bp, Homo sapiens
tgaaacccctgtaggcctca

SEQ ID NO: 1916117 - DNA, 17 bp, Homo sapiens
tgaaactccagatgcca

SEQ ID NO: 1916118 - DNA, 19 bp, Homo sapiens
tgaaactccagatgccaca

SEQ ID NO: 1916119 - DNA, 18 bp, Homo sapiens
tgaaactcccaccctacc

SEQ ID NO: 1916120 - DNA, 23 bp, Homo sapiens
tgaaagaggccaaacaggccctc

SEQ ID NO: 1916121 - DNA, 23 bp, Homo sapiens
tgaaagatatgtatatttttgat

SEQ ID NO: 1916122 - DNA, 11 bp, Homo sapiens
tgaaaggcttt

SEQ ID NO: 1916123 - DNA, 17 bp, Homo sapiens
tgaaagtatgttttact

SEQ ID NO: 1916124 - DNA, 16 bp, Homo sapiens
tgaaagtgcctttgca

SEQ ID NO: 1916125 - DNA, 14 bp, Homo sapiens
tgaaataaaagcta

SEQ ID NO: 1916126 - DNA, 19 bp, Homo sapiens
tgaacaaagaccaattttt

SEQ ID NO: 1916127 - DNA, 19 bp, Homo sapiens
tgaacaaccaaatgtgcat

SEQ ID NO: 1916128 - DNA, 15 bp, Homo sapiens
tgaacatacaaatgc

SEQ ID NO: 1916129 - DNA, 16 bp, Homo sapiens
tgaacatgcctcctcc

SEQ ID NO: 1916130 - DNA, 22 bp, Homo sapiens
tgaacatgcctcctcctgccct

SEQ ID NO: 1916131 - DNA, 21 bp, Homo sapiens
tgaaccacttgtagatttgat

SEQ ID NO: 1916132 - DNA, 18 bp, Homo sapiens
tgaaccataaaatgtcca

SEQ ID NO: 1916133 - DNA, 22 bp, Homo sapiens
tgaacccagaaacaacacaatc

SEQ ID NO: 1916134 - DNA, 23 bp, Homo sapiens
tgaaccctaataagaccccactg

SEQ ID NO: 1916135 - DNA, 19 bp, Homo sapiens
tgaacgtttggttcaaatg

SEQ ID NO: 1916136 - DNA, 21 bp, Homo sapiens
tgaacgtttggttcaaatgtg

SEQ ID NO: 1916137 - DNA, 21 bp, Homo sapiens
tgaactcttctcattacttgt

SEQ ID NO: 1916138 - DNA, 17 bp, Homo sapiens
tgaactggcctctgcct

SEQ ID NO: 1916139 - DNA, 23 bp, Homo sapiens
tgaagacagcccgatcctcccct

SEQ ID NO: 1916140 - DNA, 18 bp, Homo sapiens
tgaagagctgttgatggg

SEQ ID NO: 1916141 - DNA, 16 bp, Homo sapiens
tgaagagtttgtaaat

SEQ ID NO: 1916142 - DNA, 17 bp, Homo sapiens
tgaagatactttgtatt

SEQ ID NO: 1916143 - DNA, 16 bp, Homo sapiens
tgaagctgaggctgct

SEQ ID NO: 1916144 - DNA, 16 bp, Homo sapiens
tgaagcttgtatctga

SEQ ID NO: 1916145 - DNA, 17 bp, Homo sapiens
tgaaggaggccacctcc

SEQ ID NO: 1916146 - DNA, 20 bp, Homo sapiens
tgaaggaggccacctcctaa

SEQ ID NO: 1916147 - DNA, 21 bp, Homo sapiens
tgaaggaggccacctcctaaa

SEQ ID NO: 1916148 - DNA, 18 bp, Homo sapiens
tgaaggcagaaagcaaaa

SEQ ID NO: 1916149 - DNA, 15 bp, Homo sapiens
tgaaggggttttctt

SEQ ID NO: 1916150 - DNA, 14 bp, Homo sapiens
tgaagtaaaagtta

SEQ ID NO: 1916151 - DNA, 22 bp, Homo sapiens
tgaagtgatataaaagctgcat

SEQ ID NO: 1916152 - DNA, 16 bp, Homo sapiens
tgaagtgccttaaata

SEQ ID NO: 1916153 - DNA, 14 bp, Homo sapiens
tgaataaagtgcaa

SEQ ID NO: 1916154 - DNA, 17 bp, Homo sapiens
tgaataagccattctga

SEQ ID NO: 1916155 - DNA, 15 bp, Homo sapiens
tgaataatgtctaga

SEQ ID NO: 1916156 - DNA, 22 bp, Homo sapiens
tgaataatgtctagattttgaa

SEQ ID NO: 1916157 - DNA, 16 bp, Homo sapiens
tgaatacttgaaccat

SEQ ID NO: 1916158 - DNA, 19 bp, Homo sapiens
tgaatacttgaaccataaa

SEQ ID NO: 1916159 - DNA, 15 bp, Homo sapiens
tgaatatgattaaaa

SEQ ID NO: 1916160 - DNA, 12 bp, Homo sapiens
tgaatgctgtgg

SEQ ID NO: 1916161 - DNA, 19 bp, Homo sapiens
tgaatgtagacggaacagt

SEQ ID NO: 1916162 - DNA, 19 bp, Homo sapiens
tgaattcaccacagacttt

SEQ ID NO: 1916163 - DNA, 14 bp, Homo sapiens
tgaattggaatgca

SEQ ID NO: 1916164 - DNA, 14 bp, Homo sapiens
tgaatttgtttaag

SEQ ID NO: 1916165 - DNA, 18 bp, Homo sapiens
tgaatttttatgtgtgat

SEQ ID NO: 1916166 - DNA, 18 bp, Homo sapiens
tgacaaaggagcattgca

SEQ ID NO: 1916167 - DNA, 16 bp, Homo sapiens
tgagaatagaaatttg

SEQ ID NO: 1916168 - DNA, 23 bp, Homo sapiens
tgagaccgtgaagatactttgta

SEQ ID NO: 1916169 - DNA, 15 bp, Homo sapiens
tgagaggaacaagaa

SEQ ID NO: 1916170 - DNA, 19 bp, Homo sapiens
tgagaggctgtctgttgta

SEQ ID NO: 1916171 - DNA, 12 bp, Homo sapiens
tgagcccactgt

SEQ ID NO: 1916172 - DNA, 19 bp, Homo sapiens
tgagcccactgtgcgtggg

SEQ ID NO: 1916173 - DNA, 17 bp, Homo sapiens
tgagcccccagcttcca

SEQ ID NO: 1916174 - DNA, 14 bp, Homo sapiens
tgagccgcagagaa

SEQ ID NO: 1916175 - DNA, 19 bp, Homo sapiens
tgagctcccacttctgcca

SEQ ID NO: 1916176 - DNA, 21 bp, Homo sapiens
tgagctcccacttctgccaga

SEQ ID NO: 1916177 - DNA, 16 bp, Homo sapiens
tgaggaaatcaaagtg

SEQ ID NO: 1916178 - DNA, 18 bp, Homo sapiens
tgaggaaatcaaagtgct

SEQ ID NO: 1916179 - DNA, 22 bp, Homo sapiens
tgaggaaatcaaagtgctatta

SEQ ID NO: 1916180 - DNA, 22 bp, Homo sapiens
tgaggacaagagaaaaaagcca

SEQ ID NO: 1916181 - DNA, 13 bp, Homo sapiens
tgaggaggcagag

SEQ ID NO: 1916182 - DNA, 18 bp, Homo sapiens
tgaggcatctctctggga

SEQ ID NO: 1916183 - DNA, 14 bp, Homo sapiens
tgaggccgttgctg

SEQ ID NO: 1916184 - DNA, 17 bp, Homo sapiens
tgaggcgagcagggcag

SEQ ID NO: 1916185 - DNA, 18 bp, Homo sapiens
tgaggctgctgccaggcc

SEQ ID NO: 1916186 - DNA, 23 bp, Homo sapiens
tgaggctgctgccaggcccggca

SEQ ID NO: 1916187 - DNA, 17 bp, Homo sapiens
tgagggagacagaccac

SEQ ID NO: 1916188 - DNA, 12 bp, Homo sapiens
tgagggaggagg

SEQ ID NO: 1916189 - DNA, 17 bp, Homo sapiens
tgagggaggaggcagga

SEQ ID NO: 1916190 - DNA, 20 bp, Homo sapiens
tgagggcatttggcttcctc

SEQ ID NO: 1916191 - DNA, 14 bp, Homo sapiens
tgagggtaagtatt

SEQ ID NO: 1916192 - DNA, 18 bp, Homo sapiens
tgagggtttcagagagcc

SEQ ID NO: 1916193 - DNA, 20 bp, Homo sapiens
tgagtccaaactggaatgag

SEQ ID NO: 1916194 - DNA, 23 bp, Homo sapiens
tgagtctgtgtggccagcagcct

SEQ ID NO: 1916195 - DNA, 14 bp, Homo sapiens
tgagtctgttctgg

SEQ ID NO: 1916196 - DNA, 21 bp, Homo sapiens
tgagttaactttttgtaggat

SEQ ID NO: 1916197 - DNA, 22 bp, Homo sapiens
tgagttgttaccccaagcgccc

SEQ ID NO: 1916198 - DNA, 15 bp, Homo sapiens
tgagttgtttttgta

SEQ ID NO: 1916199 - DNA, 17 bp, Homo sapiens
tgataacaatgttttaa

SEQ ID NO: 1916200 - DNA, 20 bp, Homo sapiens
tgataacaatgttttaacaa

SEQ ID NO: 1916201 - DNA, 12 bp, Homo sapiens
tgataagaaaac

SEQ ID NO: 1916202 - DNA, 14 bp, Homo sapiens
tgataaggaacatt

SEQ ID NO: 1916203 - DNA, 13 bp, Homo sapiens
tgatatcagcact

SEQ ID NO: 1916204 - DNA, 15 bp, Homo sapiens
tgatatgataataat

SEQ ID NO: 1916205 - DNA, 14 bp, Homo sapiens
tgatcactgaaata

SEQ ID NO: 1916206 - DNA, 16 bp, Homo sapiens
tgatcactgaaataaa

SEQ ID NO: 1916207 - DNA, 18 bp, Homo sapiens
tgatcatacaaatgggtt

SEQ ID NO: 1916208 - DNA, 16 bp, Homo sapiens
tgatcctgcaattaaa

SEQ ID NO: 1916209 - DNA, 17 bp, Homo sapiens
tgatcctggaaatggtt

SEQ ID NO: 1916210 - DNA, 23 bp, Homo sapiens
tgatccttagatgtgtctcctgt

SEQ ID NO: 1916211 - DNA, 19 bp, Homo sapiens
tgatgaaataacacagcag

SEQ ID NO: 1916212 - DNA, 17 bp, Homo sapiens
tgatgaagctgaggctg

SEQ ID NO: 1916213 - DNA, 19 bp, Homo sapiens
tgatgacgtacaagtagtt

SEQ ID NO: 1916214 - DNA, 20 bp, Homo sapiens
tgatgatgttgtaaaatgaa

SEQ ID NO: 1916215 - DNA, 21 bp, Homo sapiens
tgatgcattaaaagaaaataa

SEQ ID NO: 1916216 - DNA, 20 bp, Homo sapiens
tgatgggatgattgaagaaa

SEQ ID NO: 1916217 - DNA, 17 bp, Homo sapiens
tgatgtatgttatttga

SEQ ID NO: 1916218 - DNA, 18 bp, Homo sapiens
tgatgtcaataacagtat

SEQ ID NO: 1916219 - DNA, 12 bp, Homo sapiens
tgatgtctttgg

SEQ ID NO: 1916220 - DNA, 20 bp, Homo sapiens
tgatgtgcctaaataagtta

SEQ ID NO: 1916221 - DNA, 14 bp, Homo sapiens
tgatgtgttgttct

SEQ ID NO: 1916222 - DNA, 22 bp, Homo sapiens
tgatgtgttgttcttggcaata

SEQ ID NO: 1916223 - DNA, 22 bp, Homo sapiens
tgattaaagatgagctttgtct

SEQ ID NO: 1916224 - DNA, 12 bp, Homo sapiens
tgattgaagaaa

SEQ ID NO: 1916225 - DNA, 16 bp, Homo sapiens
tgattgcctcaataaa

SEQ ID NO: 1916226 - DNA, 15 bp, Homo sapiens
tgatttaatttgaaa

SEQ ID NO: 1916227 - DNA, 12 bp, Homo sapiens
tgcaaaaaatag

SEQ ID NO: 1916228 - DNA, 21 bp, Homo sapiens
tgcaaaaagctagtcaacagt

SEQ ID NO: 1916229 - DNA, 13 bp, Homo sapiens
tgcaaacagaagt

SEQ ID NO: 1916230 - DNA, 17 bp, Homo sapiens
tgcaaacttggatcaga

SEQ ID NO: 1916231 - DNA, 13 bp, Homo sapiens
tgcaaaggaaata

SEQ ID NO: 1916232 - DNA, 13 bp, Homo sapiens
tgcaaattccata

SEQ ID NO: 1916233 - DNA, 20 bp, Homo sapiens
tgcaagggcggcctttccca

SEQ ID NO: 1916234 - DNA, 19 bp, Homo sapiens
tgcaaggtcttgcatttaa

SEQ ID NO: 1916235 - DNA, 22 bp, Homo sapiens
tgcaataaaaaatatattttta

SEQ ID NO: 1916236 - DNA, 19 bp, Homo sapiens
tgcaatgccccctcccctc

SEQ ID NO: 1916237 - DNA, 21 bp, Homo sapiens
tgcacaaatacggatcctgca

SEQ ID NO: 1916238 - DNA, 14 bp, Homo sapiens
tgcacgctggggaa

SEQ ID NO: 1916239 - DNA, 15 bp, Homo sapiens
tgcacgctggggaag

SEQ ID NO: 1916240 - DNA, 14 bp, Homo sapiens
tgcactcagactgt

SEQ ID NO: 1916241 - DNA, 16 bp, Homo sapiens
tgcactcagactgtat

SEQ ID NO: 1916242 - DNA, 14 bp, Homo sapiens
tgcactgactctgg

SEQ ID NO: 1916243 - DNA, 15 bp, Homo sapiens
tgcactgactctgga

SEQ ID NO: 1916244 - DNA, 15 bp, Homo sapiens
tgcactgctcacttt

SEQ ID NO: 1916245 - DNA, 19 bp, Homo sapiens
tgcacttgggggctcagca

SEQ ID NO: 1916246 - DNA, 23 bp, Homo sapiens
tgcagcacagctgagaggctgtc

SEQ ID NO: 1916247 - DNA, 23 bp, Homo sapiens
tgcagcctccgcttccctggttc

SEQ ID NO: 1916248 - DNA, 16 bp, Homo sapiens
tgcagctgtcaccact

SEQ ID NO: 1916249 - DNA, 22 bp, Homo sapiens
tgcaggagcagtatcatgaagc

SEQ ID NO: 1916250 - DNA, 12 bp, Homo sapiens
tgcagggctggg

SEQ ID NO: 1916251 - DNA, 15 bp, Homo sapiens
tgcagggctgggtca

SEQ ID NO: 1916252 - DNA, 13 bp, Homo sapiens
tgcagtaaatatt

SEQ ID NO: 1916253 - DNA, 22 bp, Homo sapiens
tgcagtcttagatcatagtttt

SEQ ID NO: 1916254 - DNA, 13 bp, Homo sapiens
tgcagtggagcag

SEQ ID NO: 1916255 - DNA, 17 bp, Homo sapiens
tgcagtgtgaatgctgg

SEQ ID NO: 1916256 - DNA, 18 bp, Homo sapiens
tgcagtgtgaatgctggg

SEQ ID NO: 1916257 - DNA, 15 bp, Homo sapiens
tgcagtgttaagata

SEQ ID NO: 1916258 - DNA, 18 bp, Homo sapiens
tgcatataacttatattg

SEQ ID NO: 1916259 - DNA, 21 bp, Homo sapiens
tgcatataacttatattgtaa

SEQ ID NO: 1916260 - DNA, 15 bp, Homo sapiens
tgcatccccttccag

SEQ ID NO: 1916261 - DNA, 19 bp, Homo sapiens
tgcatctgggtagctgtaa

SEQ ID NO: 1916262 - DNA, 20 bp, Homo sapiens
tgcatctgggtagctgtaag

SEQ ID NO: 1916263 - DNA, 21 bp, Homo sapiens
tgcatctgggtagctgtaagg

SEQ ID NO: 1916264 - DNA, 18 bp, Homo sapiens
tgcatctttgatgtgttg

SEQ ID NO: 1916265 - DNA, 23 bp, Homo sapiens
tgcatgggtcagggtgtgaggcc

SEQ ID NO: 1916266 - DNA, 14 bp, Homo sapiens
tgcatttaccaaaa

SEQ ID NO: 1916267 - DNA, 15 bp, Homo sapiens
tggcatagtggctta

SEQ ID NO: 1916268 - DNA, 16 bp, Homo sapiens
tggcatatctctgttc

SEQ ID NO: 1916269 - DNA, 15 bp, Homo sapiens
tggcatctggggctc

SEQ ID NO: 1916270 - DNA, 21 bp, Homo sapiens
tggcatggtggttgggaccca

SEQ ID NO: 1916271 - DNA, 22 bp, Homo sapiens
tggcatggtggttgggacccag

SEQ ID NO: 1916272 - DNA, 21 bp, Homo sapiens
tggccacatcctcatggccca

SEQ ID NO: 1916273 - DNA, 21 bp, Homo sapiens
tggccagcagcctctgatctg

SEQ ID NO: 1916274 - DNA, 20 bp, Homo sapiens
tggccaggaagtagcacagg

SEQ ID NO: 1916275 - DNA, 12 bp, Homo sapiens
ttacctggaaaa

SEQ ID NO: 1916276 - DNA, 16 bp, Homo sapiens
ttaccttgtcattttg

SEQ ID NO: 1916277 - DNA, 15 bp, Homo sapiens
ttactcacagccagc

SEQ ID NO: 1916278 - DNA, 12 bp, Homo sapiens
ttactcttggga

SEQ ID NO: 1916279 - DNA, 17 bp, Homo sapiens
ttactgctttctgaatg

SEQ ID NO: 1916280 - DNA, 23 bp, Homo sapiens
ttactttgtaaattctgatttct

SEQ ID NO: 1916281 - DNA, 17 bp, Homo sapiens
ttagaatgtcaataaat

SEQ ID NO: 1916282 - DNA, 17 bp, Homo sapiens
ttagaattgaaggtttt

SEQ ID NO: 1916283 - DNA, 19 bp, Homo sapiens
ttagaattttgtgaaacag

SEQ ID NO: 1916284 - DNA, 16 bp, Homo sapiens
ttagactgccagctct

SEQ ID NO: 1916285 - DNA, 17 bp, Homo sapiens
ttagactgccagctctt

SEQ ID NO: 1916286 - DNA, 12 bp, Homo sapiens
ttagacttgaaa

SEQ ID NO: 1916287 - DNA, 22 bp, Homo sapiens
ttagagggtgatggaacaagag

SEQ ID NO: 1916288 - DNA, 17 bp, Homo sapiens
ttagatcatagttttat

SEQ ID NO: 1916289 - DNA, 16 bp, Homo sapiens
ttagatgtaattttgt

SEQ ID NO: 1916290 - DNA, 15 bp, Homo sapiens
ttagattaagaaata

SEQ ID NO: 1916291 - DNA, 19 bp, Homo sapiens
ttagattaagaaatagaca

SEQ ID NO: 1916292 - DNA, 23 bp, Homo sapiens
ttagcatgtgttgcagctgtcac

SEQ ID NO: 1916293 - DNA, 18 bp, Homo sapiens
ttagctacgtttactcac

SEQ ID NO: 1916294 - DNA, 20 bp, Homo sapiens
ttagctttctgagcaagagg

SEQ ID NO: 1916295 - DNA, 21 bp, Homo sapiens
ttaggaaaagatatttttata

SEQ ID NO: 1916296 - DNA, 16 bp, Homo sapiens
ttaggccccagcaaca

SEQ ID NO: 1916297 - DNA, 15 bp, Homo sapiens
ttagtattgattcaa

SEQ ID NO: 1916298 - DNA, 14 bp, Homo sapiens
ttagtctttatact

SEQ ID NO: 1916299 - DNA, 14 bp, Homo sapiens
ttagtgttatatga

SEQ ID NO: 1916300 - DNA, 16 bp, Homo sapiens
ttagttccactgagac

SEQ ID NO: 1916301 - DNA, 22 bp, Homo sapiens
ttagttctgactttgaatttat

SEQ ID NO: 1916302 - DNA, 20 bp, Homo sapiens
ttagtttagaacaggttttt

SEQ ID NO: 1916303 - DNA, 13 bp, Homo sapiens
ttataattgatga

SEQ ID NO: 1916304 - DNA, 22 bp, Homo sapiens
ttatacagaccgaactgttgta

SEQ ID NO: 1916305 - DNA, 14 bp, Homo sapiens
ttatataactgttg

SEQ ID NO: 1916306 - DNA, 15 bp, Homo sapiens
ttatatgaacataca

SEQ ID NO: 1916307 - DNA, 19 bp, Homo sapiens
ttatatgtatgtgtttaga

SEQ ID NO: 1916308 - DNA, 20 bp, Homo sapiens
ttatatgtatgtgtttagaa

SEQ ID NO: 1916309 - DNA, 15 bp, Homo sapiens
ttatattctaagtca

SEQ ID NO: 1916310 - DNA, 19 bp, Homo sapiens
ttatattgacaacaaatca

SEQ ID NO: 1916311 - DNA, 11 bp, Homo sapiens
ttatatttcaa

SEQ ID NO: 1916312 - DNA, 19 bp, Homo sapiens
ttatcttggccttactgta

SEQ ID NO: 1916313 - DNA, 15 bp, Homo sapiens
ttatgactaaaaata

SEQ ID NO: 1916314 - DNA, 22 bp, Homo sapiens
ttatgatagcaaatggcctcat

SEQ ID NO: 1916315 - DNA, 15 bp, Homo sapiens
ttatgtaaataattc

SEQ ID NO: 1916316 - DNA, 16 bp, Homo sapiens
ttatgtaaataattct

SEQ ID NO: 1916317 - DNA, 22 bp, Homo sapiens
ttattaaatttttttgtatgaa

SEQ ID NO: 1916318 - DNA, 14 bp, Homo sapiens
ttattaacttaata

SEQ ID NO: 1916319 - DNA, 19 bp, Homo sapiens
ttattaacttaataatcaa

SEQ ID NO: 1916320 - DNA, 23 bp, Homo sapiens
ttattagcagctgactttcaaag

SEQ ID NO: 1916321 - DNA, 23 bp, Homo sapiens
ttattaggaaaagatatttttat

SEQ ID NO: 1916322 - DNA, 22 bp, Homo sapiens
ttattatcattgttcttttcaa

SEQ ID NO: 1916323 - DNA, 14 bp, Homo sapiens
ttattcaacagcaa

SEQ ID NO: 1916324 - DNA, 22 bp, Homo sapiens
ttattcaacagcaagtgtgaat

SEQ ID NO: 1916325 - DNA, 14 bp, Homo sapiens
ttattgactcttga

SEQ ID NO: 1916326 - DNA, 20 bp, Homo sapiens
ttattgactcttgagttgtt

SEQ ID NO: 1916327 - DNA, 21 bp, Homo sapiens
ttattgactcttgagttgttt

SEQ ID NO: 1916328 - DNA, 20 bp, Homo sapiens
ttattgcttactgtgttaaa

SEQ ID NO: 1916329 - DNA, 15 bp, Homo sapiens
ttatttactgctagt

SEQ ID NO: 1916330 - DNA, 13 bp, Homo sapiens
ttatttataaaat

SEQ ID NO: 1916331 - DNA, 16 bp, Homo sapiens
ttatttatatttattg

SEQ ID NO: 1916332 - DNA, 12 bp, Homo sapiens
ttatttgatgac

SEQ ID NO: 1916333 - DNA, 13 bp, Homo sapiens
ttatttttttgaa

SEQ ID NO: 1916334 - DNA, 15 bp, Homo sapiens
ttcaaacctgtgaag

SEQ ID NO: 1916335 - DNA, 15 bp, Homo sapiens
ttcaaataactgcag

SEQ ID NO: 1916336 - DNA, 18 bp, Homo sapiens
ttcaaatgtgttttggtc

SEQ ID NO: 1916337 - DNA, 11 bp, Homo sapiens
ttcaagaaatg

SEQ ID NO: 1916338 - DNA, 14 bp, Homo sapiens
ttcaagaaatgaag

SEQ ID NO: 1916339 - DNA, 13 bp, Homo sapiens
ttcaagatcaaaa

SEQ ID NO: 1916340 - DNA, 22 bp, Homo sapiens
ttcaatgtgatataaacagctt

SEQ ID NO: 1916341 - DNA, 21 bp, Homo sapiens
ttcacagtcaccaagtgtatt

SEQ ID NO: 1916342 - DNA, 20 bp, Homo sapiens
ttcactggccacagttgttt

SEQ ID NO: 1916343 - DNA, 22 bp, Homo sapiens
ttcacttaagttagttccactg

SEQ ID NO: 1916344 - DNA, 20 bp, Homo sapiens
ttcagacatttttggaaatt

SEQ ID NO: 1916345 - DNA, 23 bp, Homo sapiens
ttcagaccagccccaccatgcaa

SEQ ID NO: 1916346 - DNA, 13 bp, Homo sapiens
ttcagaggctcag

SEQ ID NO: 1916347 - DNA, 22 bp, Homo sapiens
ttcagaggctcagattgtaata

SEQ ID NO: 1916348 - DNA, 15 bp, Homo sapiens
ttcagcaaacttgtt

SEQ ID NO: 1916349 - DNA, 22 bp, Homo sapiens
ttcagcaaacttgttgaattta

SEQ ID NO: 1916350 - DNA, 20 bp, Homo sapiens
ttcaggtagaggtgcatgcc

SEQ ID NO: 1916351 - DNA, 20 bp, Homo sapiens
ttcaggtcccagttgctgtc

SEQ ID NO: 1916352 - DNA, 23 bp, Homo sapiens
ttcaggtcccagttgctgtcaca

SEQ ID NO: 1916353 - DNA, 15 bp, Homo sapiens
ttcatacacaacgta

SEQ ID NO: 1916354 - DNA, 19 bp, Homo sapiens
ttcatcatattatacagac

SEQ ID NO: 1916355 - DNA, 23 bp, Homo sapiens
ttcattcttaatttatgtaaggt

SEQ ID NO: 1916356 - DNA, 15 bp, Homo sapiens
ttcattgcacaatat

SEQ ID NO: 1916357 - DNA, 22 bp, Homo sapiens
ttcattggtactgccttaaaga

SEQ ID NO: 1916358 - DNA, 16 bp, Homo sapiens
ttcatttctagagaaa

SEQ ID NO: 1916359 - DNA, 13 bp, Homo sapiens
ttccagcaggagg

SEQ ID NO: 1916360 - DNA, 18 bp, Homo sapiens
ttccagctccctcccctg

SEQ ID NO: 1916361 - DNA, 22 bp, Homo sapiens
ttccagtgaggcatctctctgg

SEQ ID NO: 1916362 - DNA, 20 bp, Homo sapiens
ttccagtggcttctcccaac

SEQ ID NO: 1916363 - DNA, 14 bp, Homo sapiens
ttccatctgattcc

SEQ ID NO: 1916364 - DNA, 15 bp, Homo sapiens
ttccatgcctgctct

SEQ ID NO: 1916365 - DNA, 16 bp, Homo sapiens
ttccatgcctgctctc

SEQ ID NO: 1916366 - DNA, 22 bp, Homo sapiens
ttccatgcctgctctcgaggca

SEQ ID NO: 1916367 - DNA, 20 bp, Homo sapiens
ttcccaaatgtgtgcccagc

SEQ ID NO: 1916368 - DNA, 15 bp, Homo sapiens
ttcccaacacaaaga

SEQ ID NO: 1916369 - DNA, 23 bp, Homo sapiens
ttcccactggtccatctggtttt

SEQ ID NO: 1916370 - DNA, 13 bp, Homo sapiens
ttcccatctcctt

SEQ ID NO: 1916371 - DNA, 14 bp, Homo sapiens
ttccccttcccttc

SEQ ID NO: 1916372 - DNA, 13 bp, Homo sapiens
ttccctgggttag

SEQ ID NO: 1916373 - DNA, 21 bp, Homo sapiens
ttccctgggttagactgccag

SEQ ID NO: 1916374 - DNA, 21 bp, Homo sapiens
ttcccttccatctcttccttt

SEQ ID NO: 1916375 - DNA, 21 bp, Homo sapiens
ttccgagtctttctcactgcc

SEQ ID NO: 1916376 - DNA, 15 bp, Homo sapiens
ttcctaactgttttg

SEQ ID NO: 1916377 - DNA, 14 bp, Homo sapiens
ttcctacacaggac

SEQ ID NO: 1916378 - DNA, 17 bp, Homo sapiens
ttcctacacaggacagg

SEQ ID NO: 1916379 - DNA, 17 bp, Homo sapiens
ttcctatcaaaaagata

SEQ ID NO: 1916380 - DNA, 12 bp, Homo sapiens
ttcctctgctgc

SEQ ID NO: 1916381 - DNA, 14 bp, Homo sapiens
ttcctctgctgcat

SEQ ID NO: 1916382 - DNA, 23 bp, Homo sapiens
ttcctgttaggtattagaaagtg

SEQ ID NO: 1916383 - DNA, 15 bp, Homo sapiens
ttccttatcagaggc

SEQ ID NO: 1916384 - DNA, 12 bp, Homo sapiens
ttccttctgtag

SEQ ID NO: 1916385 - DNA, 23 bp, Homo sapiens
ttccttgaaccctaataagaccc

SEQ ID NO: 1916386 - DNA, 19 bp, Homo sapiens
ttcctttaacctttgctgt

SEQ ID NO: 1916387 - DNA, 12 bp, Homo sapiens
ttcctttcttga

SEQ ID NO: 1916388 - DNA, 16 bp, Homo sapiens
ttcctttgactttctg

SEQ ID NO: 1916389 - DNA, 20 bp, Homo sapiens
ttcctttttatttatatgta

SEQ ID NO: 1916390 - DNA, 20 bp, Homo sapiens
ttcctttttttcccttttct

SEQ ID NO: 1916391 - DNA, 13 bp, Homo sapiens
ttcgaaaagaaat

SEQ ID NO: 1916392 - DNA, 19 bp, Homo sapiens
ttctaaaaaaataaacaaa

SEQ ID NO: 1916393 - DNA, 19 bp, Homo sapiens
ttctaataagctagttgaa

SEQ ID NO: 1916394 - DNA, 23 bp, Homo sapiens
ttctaataagctagttgaatact

SEQ ID NO: 1916395 - DNA, 18 bp, Homo sapiens
ttctaattggctttacta

SEQ ID NO: 1916396 - DNA, 20 bp, Homo sapiens
ttctagtctggaactgctgc

SEQ ID NO: 1916397 - DNA, 22 bp, Homo sapiens
ttctagtctggaactgctgctg

SEQ ID NO: 1916398 - DNA, 23 bp, Homo sapiens
ttctagtctggaactgctgctga

SEQ ID NO: 1916399 - DNA, 16 bp, Homo sapiens
ttctatacatgtttgc

SEQ ID NO: 1916400 - DNA, 18 bp, Homo sapiens
ttctatgtctagcacatg

SEQ ID NO: 1916401 - DNA, 14 bp, Homo sapiens
ttctcactgccttt

SEQ ID NO: 1916402 - DNA, 16 bp, Homo sapiens
ttctcactgcctttgt

SEQ ID NO: 1916403 - DNA, 17 bp, Homo sapiens
ttctcccctctctttct

SEQ ID NO: 1916404 - DNA, 15 bp, Homo sapiens
ttctcctgcagcctg

SEQ ID NO: 1916405 - DNA, 20 bp, Homo sapiens
ttctccttaagagacaattt

SEQ ID NO: 1916406 - DNA, 13 bp, Homo sapiens
ttctctctcactc

SEQ ID NO: 1916407 - DNA, 20 bp, Homo sapiens
ttctctctcactctcttcct

SEQ ID NO: 1916408 - DNA, 21 bp, Homo sapiens
ttctctctcactctcttcctt

SEQ ID NO: 1916409 - DNA, 16 bp, Homo sapiens
ttctctgaggacaaga

SEQ ID NO: 1916410 - DNA, 22 bp, Homo sapiens
ttctcttgcctcagcttcccca

SEQ ID NO: 1916411 - DNA, 11 bp, Homo sapiens
ttctctttctc

SEQ ID NO: 1916412 - DNA, 20 bp, Homo sapiens
ttctgagcttacgtagttct

SEQ ID NO: 1916413 - DNA, 19 bp, Homo sapiens
ttctgatcactgaaataaa

SEQ ID NO: 1916414 - DNA, 20 bp, Homo sapiens
ttgtcaatgctggagaaaaa

SEQ ID NO: 1916415 - DNA, 17 bp, Homo sapiens
ttgtccaagttgtttca

SEQ ID NO: 1916416 - DNA, 11 bp, Homo sapiens
ttgtcccaagt

SEQ ID NO: 1916417 - DNA, 20 bp, Homo sapiens
ttgtcctattagtgttatat

SEQ ID NO: 1916418 - DNA, 14 bp, Homo sapiens
ttgtccttgaagct

SEQ ID NO: 1916419 - DNA, 19 bp, Homo sapiens
ttgtccttgaagcttgtat

SEQ ID NO: 1916420 - DNA, 22 bp, Homo sapiens
ttgtccttgaagcttgtatctg

SEQ ID NO: 1916421 - DNA, 13 bp, Homo sapiens
ttgtcttaatgga

SEQ ID NO: 1916422 - DNA, 19 bp, Homo sapiens
ttgtgatccaggaataaac

SEQ ID NO: 1916423 - DNA, 17 bp, Homo sapiens
ttgtgccttaaagacaa

SEQ ID NO: 1916424 - DNA, 21 bp, Homo sapiens
ttgtgctccgtagcttctagt

SEQ ID NO: 1916425 - DNA, 14 bp, Homo sapiens
ttgtgtaagaaata

SEQ ID NO: 1916426 - DNA, 18 bp, Homo sapiens
ttgtgtaagaaatacaga

SEQ ID NO: 1916427 - DNA, 15 bp, Homo sapiens
ttgtgtaaggaaaaa

SEQ ID NO: 1916428 - DNA, 13 bp, Homo sapiens
ttgtgtgaacttg

SEQ ID NO: 1916429 - DNA, 16 bp, Homo sapiens
ttgttctctaggaaaa

SEQ ID NO: 1916430 - DNA, 13 bp, Homo sapiens
ttgttcttgatag

SEQ ID NO: 1916431 - DNA, 15 bp, Homo sapiens
ttgttgaaagaaagt

SEQ ID NO: 1916432 - DNA, 22 bp, Homo sapiens
ttgttgagggcatttggcttcc

SEQ ID NO: 1916433 - DNA, 15 bp, Homo sapiens
ttgttgctgattttg

SEQ ID NO: 1916434 - DNA, 20 bp, Homo sapiens
ttgtttagaagagagtagct

SEQ ID NO: 1916435 - DNA, 15 bp, Homo sapiens
ttgtttcattgattt

SEQ ID NO: 1916436 - DNA, 15 bp, Homo sapiens
ttgtttcctttcact

SEQ ID NO: 1916437 - DNA, 19 bp, Homo sapiens
ttgtttctttctctgagga

SEQ ID NO: 1916438 - DNA, 22 bp, Homo sapiens
ttgtttgtatgtataattcaaa

SEQ ID NO: 1916439 - DNA, 12 bp, Homo sapiens
ttgtttttctgc

SEQ ID NO: 1916440 - DNA, 18 bp, Homo sapiens
tttaaaaatctgccacct

SEQ ID NO: 1916441 - DNA, 18 bp, Homo sapiens
tttaaaacaccttctata

SEQ ID NO: 1916442 - DNA, 20 bp, Homo sapiens
tttaaagaaaaaaatgtcaa

SEQ ID NO: 1916443 - DNA, 14 bp, Homo sapiens
tttaacaagtcatt

SEQ ID NO: 1916444 - DNA, 18 bp, Homo sapiens
tttaacctttgctgtagt

SEQ ID NO: 1916445 - DNA, 17 bp, Homo sapiens
tttaacttttaaagaat

SEQ ID NO: 1916446 - DNA, 17 bp, Homo sapiens
tttaagcaataaaactg

SEQ ID NO: 1916447 - DNA, 18 bp, Homo sapiens
tttaaggactgactgagg

SEQ ID NO: 1916448 - DNA, 18 bp, Homo sapiens
tttaagttttgacaagct

SEQ ID NO: 1916449 - DNA, 13 bp, Homo sapiens
tttaataccctgt

SEQ ID NO: 1916450 - DNA, 13 bp, Homo sapiens
tttaatctactgc

SEQ ID NO: 1916451 - DNA, 19 bp, Homo sapiens
tttaatgctaatcttgtga

SEQ ID NO: 1916452 - DNA, 13 bp, Homo sapiens
tttaattgtattt

SEQ ID NO: 1916453 - DNA, 21 bp, Homo sapiens
tttacctgcaccgttgactca

SEQ ID NO: 1916454 - DNA, 19 bp, Homo sapiens
tttactgactgcttataaa

SEQ ID NO: 1916455 - DNA, 15 bp, Homo sapiens
tttactgctttctga

SEQ ID NO: 1916456 - DNA, 22 bp, Homo sapiens
tttactttttttttattttatt

SEQ ID NO: 1916457 - DNA, 12 bp, Homo sapiens
tttagaattaca

SEQ ID NO: 1916458 - DNA, 21 bp, Homo sapiens
tttagaattgaaggtttttga

SEQ ID NO: 1916459 - DNA, 21 bp, Homo sapiens
tttagacatgtaatttgtgta

SEQ ID NO: 1916460 - DNA, 15 bp, Homo sapiens
tttagacttgaaaag

SEQ ID NO: 1916461 - DNA, 15 bp, Homo sapiens
tttaggacatgaaaa

SEQ ID NO: 1916462 - DNA, 17 bp, Homo sapiens
tttaggacatgaaaata

SEQ ID NO: 1916463 - DNA, 13 bp, Homo sapiens
tttagtctttata

SEQ ID NO: 1916464 - DNA, 14 bp, Homo sapiens
tttagttataaagg

SEQ ID NO: 1916465 - DNA, 18 bp, Homo sapiens
tttagttccttctataca

SEQ ID NO: 1916466 - DNA, 14 bp, Homo sapiens
tttagttctgactt

SEQ ID NO: 1916467 - DNA, 17 bp, Homo sapiens
tttagttctgactttga

SEQ ID NO: 1916468 - DNA, 14 bp, Homo sapiens
tttataatgactgg

SEQ ID NO: 1916469 - DNA, 23 bp, Homo sapiens
tttatacagatgccatatagtgt

SEQ ID NO: 1916470 - DNA, 13 bp, Homo sapiens
tttatataaagta

SEQ ID NO: 1916471 - DNA, 15 bp, Homo sapiens
tttatataaagtatt

SEQ ID NO: 1916472 - DNA, 13 bp, Homo sapiens
tttatataactgt

SEQ ID NO: 1916473 - DNA, 21 bp, Homo sapiens
tttatctaaggaaacattggc

SEQ ID NO: 1916474 - DNA, 18 bp, Homo sapiens
tttatgcaaggtcttgca

SEQ ID NO: 1916475 - DNA, 17 bp, Homo sapiens
tttatgtgggtgatttg

SEQ ID NO: 1916476 - DNA, 16 bp, Homo sapiens
tttatgtgtgattcaa

SEQ ID NO: 1916477 - DNA, 23 bp, Homo sapiens
tttattaaatttttttgtatgaa

SEQ ID NO: 1916478 - DNA, 16 bp, Homo sapiens
tttattgactcttgag

SEQ ID NO: 1916479 - DNA, 15 bp, Homo sapiens
tttatttatatttat

SEQ ID NO: 1916480 - DNA, 13 bp, Homo sapiens
tttattttaaaac

SEQ ID NO: 1916481 - DNA, 18 bp, Homo sapiens
tttattttgaaatggaaa

SEQ ID NO: 1916482 - DNA, 17 bp, Homo sapiens
tttatttttaagaaaga

SEQ ID NO: 1916483 - DNA, 15 bp, Homo sapiens
tttcaaataactgca

SEQ ID NO: 1916484 - DNA, 20 bp, Homo sapiens
tttcacagtgtgattttgat

SEQ ID NO: 1916485 - DNA, 15 bp, Homo sapiens
tttcataagatattt

SEQ ID NO: 1916486 - DNA, 21 bp, Homo sapiens
tttcataagctttgtaattca

SEQ ID NO: 1916487 - DNA, 20 bp, Homo sapiens
tttcataataaatagacact

SEQ ID NO: 1916488 - DNA, 17 bp, Homo sapiens
tttcatattttaaacag

SEQ ID NO: 1916489 - DNA, 24 bp, Homo sapiens
tttcatcagaacagctgttgactc

SEQ ID NO: 1916490 - DNA, 16 bp, Homo sapiens
tttcatcatattatac

SEQ ID NO: 1916491 - DNA, 16 bp, Homo sapiens
tttcatgctttatcaa

SEQ ID NO: 1916492 - DNA, 15 bp, Homo sapiens
tttcatgtaaaaagt

SEQ ID NO: 1916493 - DNA, 14 bp, Homo sapiens
tttccccagggcac

SEQ ID NO: 1916494 - DNA, 18 bp, Homo sapiens
tttcccctttttctttcc

SEQ ID NO: 1916495 - DNA, 22 bp, Homo sapiens
tttcccttttctttccttttca

SEQ ID NO: 1916496 - DNA, 17 bp, Homo sapiens
tttccgccacatccctc

SEQ ID NO: 1916497 - DNA, 19 bp, Homo sapiens
tttcctgggacatcttctg

SEQ ID NO: 1916498 - DNA, 11 bp, Homo sapiens
tttccttccct

SEQ ID NO: 1916499 - DNA, 15 bp, Homo sapiens
tttcctttcctttca

SEQ ID NO: 1916500 - DNA, 14 bp, Homo sapiens
tttcgtttgtttgt

SEQ ID NO: 1916501 - DNA, 17 bp, Homo sapiens
tttctaagagacctgaa

SEQ ID NO: 1916502 - DNA, 20 bp, Homo sapiens
tttctaagagacctgaactg

SEQ ID NO: 1916503 - DNA, 19 bp, Homo sapiens
tttctctctcactctcttc

SEQ ID NO: 1916504 - DNA, 12 bp, Homo sapiens
tttctctttctc

SEQ ID NO: 1916505 - DNA, 13 bp, Homo sapiens
tttctgaaaattt

SEQ ID NO: 1916506 - DNA, 17 bp, Homo sapiens
tttctgaaaatttatat

SEQ ID NO: 1916507 - DNA, 23 bp, Homo sapiens
tttcttaaaaccaatcaataata

SEQ ID NO: 1916508 - DNA, 14 bp, Homo sapiens
tttcttatttatgt

SEQ ID NO: 1916509 - DNA, 20 bp, Homo sapiens
tttcttatttatgtaacaaa

SEQ ID NO: 1916510 - DNA, 13 bp, Homo sapiens
tttctttcctttc

SEQ ID NO: 1916511 - DNA, 18 bp, Homo sapiens
tttcttttgctttccttt

SEQ ID NO: 1916512 - DNA, 11 bp, Homo sapiens
tttgaaaagta

SEQ ID NO: 1916513 - DNA, 14 bp, Homo sapiens
tttgaaaatagttt

SEQ ID NO: 1916514 - DNA, 21 bp, Homo sapiens
tttgaataatgtctagatttt

SEQ ID NO: 1916515 - DNA, 20 bp, Homo sapiens
tttgaatttatataaagtat

SEQ ID NO: 1916516 - DNA, 18 bp, Homo sapiens
tttgacagcgcacagctg

SEQ ID NO: 1916517 - DNA, 13 bp, Homo sapiens
tttgactttctgt

SEQ ID NO: 1916518 - DNA, 18 bp, Homo sapiens
tttgactttctgtgtacc

SEQ ID NO: 1916519 - DNA, 10 bp, Homo sapiens
tttgagctcc

SEQ ID NO: 1916520 - DNA, 19 bp, Homo sapiens
tttgagctcccacttctgc

SEQ ID NO: 1916521 - DNA, 16 bp, Homo sapiens
tttgaggattagttta

SEQ ID NO: 1916522 - DNA, 17 bp, Homo sapiens
tttgaggattagtttag

SEQ ID NO: 1916523 - DNA, 15 bp, Homo sapiens
tttgataagaaaacc

SEQ ID NO: 1916524 - DNA, 16 bp, Homo sapiens
tttgatatatgtatct

SEQ ID NO: 1916525 - DNA, 20 bp, Homo sapiens
tttgatgtaaagatgttctg

SEQ ID NO: 1916526 - DNA, 16 bp, Homo sapiens
tttgatttattaactt

SEQ ID NO: 1916527 - DNA, 14 bp, Homo sapiens
tttgatttgtacag

SEQ ID NO: 1916528 - DNA, 15 bp, Homo sapiens
tttgcaaaggagctc

SEQ ID NO: 1916529 - DNA, 22 bp, Homo sapiens
tttgccatagagtacactgcct

SEQ ID NO: 1916530 - DNA, 22 bp, Homo sapiens
tttgcgaatattttgtaaatta

SEQ ID NO: 1916531 - DNA, 22 bp, Homo sapiens
tttgctgaaagatatgtatatt

SEQ ID NO: 1916532 - DNA, 11 bp, Homo sapiens
tttggcaggca

SEQ ID NO: 1916533 - DNA, 15 bp, Homo sapiens
tttggcttcctctgc

SEQ ID NO: 1916534 - DNA, 23 bp, Homo sapiens
tttgggcttgttgtttgtaacaa

SEQ ID NO: 1916535 - DNA, 17 bp, Homo sapiens
tttggttgaataaacta

SEQ ID NO: 1916536 - DNA, 17 bp, Homo sapiens
tttggttttctactgtt

SEQ ID NO: 1916537 - DNA, 13 bp, Homo sapiens
tttgtaaatgact

SEQ ID NO: 1916538 - DNA, 16 bp, Homo sapiens
tttgtaaattctgatt

SEQ ID NO: 1916539 - DNA, 19 bp, Homo sapiens
tttgtaaattctgatttct

SEQ ID NO: 1916540 - DNA, 17 bp, Homo sapiens
tttgtatagttatgtaa

SEQ ID NO: 1916541 - DNA, 22 bp, Homo sapiens
tttgtatagttatgtaaataat

SEQ ID NO: 1916542 - DNA, 13 bp, Homo sapiens
tttgtatgaaaac

SEQ ID NO: 1916543 - DNA, 22 bp, Homo sapiens
tttgtattgtcctattagtgtt

SEQ ID NO: 1916544 - DNA, 18 bp, Homo sapiens
tacaaagacctagattat

SEQ ID NO: 1916545 - DNA, 16 bp, Homo sapiens
tacaaagggtctatct

SEQ ID NO: 1916546 - DNA, 23 bp, Homo sapiens
tacaaagggtctatcttgtaaat

SEQ ID NO: 1916547 - DNA, 17 bp, Homo sapiens
tacaaatgcatctttga

SEQ ID NO: 1916548 - DNA, 18 bp, Homo sapiens
tacaaatgcatctttgat

SEQ ID NO: 1916549 - DNA, 21 bp, Homo sapiens
tacaaatgcatctttgatgtg

SEQ ID NO: 1916550 - DNA, 23 bp, Homo sapiens
tacaaccagaaacaatgtgtcta

SEQ ID NO: 1916551 - DNA, 22 bp, Homo sapiens
tacaaggggatccagtgtgtaa

SEQ ID NO: 1916552 - DNA, 14 bp, Homo sapiens
tacaagtagttctg

SEQ ID NO: 1916553 - DNA, 21 bp, Homo sapiens
tacaagtagttctgtatttga

SEQ ID NO: 1916554 - DNA, 22 bp, Homo sapiens
tacaagtagttctgtatttgaa

SEQ ID NO: 1916555 - DNA, 14 bp, Homo sapiens
tacaatgactttat

SEQ ID NO: 1916556 - DNA, 17 bp, Homo sapiens
tacaatttcttttggtt

SEQ ID NO: 1916557 - DNA, 19 bp, Homo sapiens
tacaatttcttttggttca

SEQ ID NO: 1916558 - DNA, 20 bp, Homo sapiens
tacacaacgtaatcaaatat

SEQ ID NO: 1916559 - DNA, 14 bp, Homo sapiens
tacacaagtaaaca

SEQ ID NO: 1916560 - DNA, 20 bp, Homo sapiens
tacacatataaattgtctta

SEQ ID NO: 1916561 - DNA, 15 bp, Homo sapiens
tacaccacaagtatc

SEQ ID NO: 1916562 - DNA, 17 bp, Homo sapiens
tacaccacaagtatcta

SEQ ID NO: 1916563 - DNA, 20 bp, Homo sapiens
tacaccacaagtatctaaat

SEQ ID NO: 1916564 - DNA, 18 bp, Homo sapiens
tacactgaatttttatgt

SEQ ID NO: 1916565 - DNA, 18 bp, Homo sapiens
tacactgcctgccttaag

SEQ ID NO: 1916566 - DNA, 21 bp, Homo sapiens
tacactgcctgccttaagtga

SEQ ID NO: 1916567 - DNA, 18 bp, Homo sapiens
tacactggcaatggtagt

SEQ ID NO: 1916568 - DNA, 20 bp, Homo sapiens
tacagaccgaactgttgtat

SEQ ID NO: 1916569 - DNA, 21 bp, Homo sapiens
tacagaccgaactgttgtata

SEQ ID NO: 1916570 - DNA, 22 bp, Homo sapiens
tacagatgttttccactgagca

SEQ ID NO: 1916571 - DNA, 23 bp, Homo sapiens
tacataatactgaaccacttgta

SEQ ID NO: 1916572 - DNA, 14 bp, Homo sapiens
tacatatctttgag

SEQ ID NO: 1916573 - DNA, 17 bp, Homo sapiens
tacatatctttgagttc

SEQ ID NO: 1916574 - DNA, 18 bp, Homo sapiens
tacatgggactatgcttt

SEQ ID NO: 1916575 - DNA, 21 bp, Homo sapiens
tacattgtgaatgctgtggga

SEQ ID NO: 1916576 - DNA, 15 bp, Homo sapiens
tacatttaaaacatt

SEQ ID NO: 1916577 - DNA, 22 bp, Homo sapiens
tacatttccgccacatccctct

SEQ ID NO: 1916578 - DNA, 14 bp, Homo sapiens
taccaacctgaaag

SEQ ID NO: 1916579 - DNA, 17 bp, Homo sapiens
tacccattgcagaccct

SEQ ID NO: 1916580 - DNA, 14 bp, Homo sapiens
tacccctgcagctg

SEQ ID NO: 1916581 - DNA, 16 bp, Homo sapiens
tacccctgcagctggg

SEQ ID NO: 1916582 - DNA, 23 bp, Homo sapiens
taccgaggacagcctgcctctgc

SEQ ID NO: 1916583 - DNA, 20 bp, Homo sapiens
taccttctgccagaagactc

SEQ ID NO: 1916584 - DNA, 12 bp, Homo sapiens
tactaaggatac

SEQ ID NO: 1916585 - DNA, 19 bp, Homo sapiens
tactaaggatacaggctgg

SEQ ID NO: 1916586 - DNA, 18 bp, Homo sapiens
tactagactgccacaagg

SEQ ID NO: 1916587 - DNA, 18 bp, Homo sapiens
tactctaggactgggccc

SEQ ID NO: 1916588 - DNA, 11 bp, Homo sapiens
tactctctctc

SEQ ID NO: 1916589 - DNA, 22 bp, Homo sapiens
tactctgagctcattaataaaa

SEQ ID NO: 1916590 - DNA, 11 bp, Homo sapiens
tactctgggaa

SEQ ID NO: 1916591 - DNA, 14 bp, Homo sapiens
tactcttgggacat

SEQ ID NO: 1916592 - DNA, 16 bp, Homo sapiens
tactgaaccacttgta

SEQ ID NO: 1916593 - DNA, 17 bp, Homo sapiens
tactgaaccacttgtag

SEQ ID NO: 1916594 - DNA, 22 bp, Homo sapiens
tactgaaccacttgtagatttg

SEQ ID NO: 1916595 - DNA, 23 bp, Homo sapiens
tactgaaccacttgtagatttga

SEQ ID NO: 1916596 - DNA, 14 bp, Homo sapiens
tactgatggaattt

SEQ ID NO: 1916597 - DNA, 18 bp, Homo sapiens
tactgcattcttctgatc

SEQ ID NO: 1916598 - DNA, 18 bp, Homo sapiens
tactgcatttagggagta

SEQ ID NO: 1916599 - DNA, 19 bp, Homo sapiens
tactgctagtcttaagaac

SEQ ID NO: 1916600 - DNA, 18 bp, Homo sapiens
tactgcttgaataaacac

SEQ ID NO: 1916601 - DNA, 20 bp, Homo sapiens
tactgttatgtgagaacatt

SEQ ID NO: 1916602 - DNA, 17 bp, Homo sapiens
tacttagaccaaaagca

SEQ ID NO: 1916603 - DNA, 21 bp, Homo sapiens
tacttagaccaaaagcaacat

SEQ ID NO: 1916604 - DNA, 22 bp, Homo sapiens
tacttatttatgaacagacttt

SEQ ID NO: 1916605 - DNA, 22 bp, Homo sapiens
tacttcaaaagtttgtttgctt

SEQ ID NO: 1916606 - DNA, 23 bp, Homo sapiens
tacttccaagacttattttcaca

SEQ ID NO: 1916607 - DNA, 16 bp, Homo sapiens
tacttgaaccataaaa

SEQ ID NO: 1916608 - DNA, 16 bp, Homo sapiens
tacttgctttgagttg

SEQ ID NO: 1916609 - DNA, 17 bp, Homo sapiens
tacttgtattcctaact

SEQ ID NO: 1916610 - DNA, 14 bp, Homo sapiens
tacttgttgcctat

SEQ ID NO: 1916611 - DNA, 17 bp, Homo sapiens
tacttgttgcctataag

SEQ ID NO: 1916612 - DNA, 16 bp, Homo sapiens
tactttatagacattt

SEQ ID NO: 1916613 - DNA, 13 bp, Homo sapiens
tagaaaaggaaat

SEQ ID NO: 1916614 - DNA, 14 bp, Homo sapiens
tagaaactcaggaa

SEQ ID NO: 1916615 - DNA, 22 bp, Homo sapiens
tagaaagagccttaatgtattt

SEQ ID NO: 1916616 - DNA, 19 bp, Homo sapiens
tagaaatttgcccctggca

SEQ ID NO: 1916617 - DNA, 20 bp, Homo sapiens
tagaaatttgcccctggcaa

SEQ ID NO: 1916618 - DNA, 22 bp, Homo sapiens
tagaacttgttgctgattttga

SEQ ID NO: 1916619 - DNA, 13 bp, Homo sapiens
tagaactttgtat

SEQ ID NO: 1916620 - DNA, 19 bp, Homo sapiens
tagaaggagattgtgggga

SEQ ID NO: 1916621 - DNA, 13 bp, Homo sapiens
tagaatccctgtg

SEQ ID NO: 1916622 - DNA, 17 bp, Homo sapiens
tagaattgaaggttttt

SEQ ID NO: 1916623 - DNA, 18 bp, Homo sapiens
tagaattgaaggtttttg

SEQ ID NO: 1916624 - DNA, 19 bp, Homo sapiens
tagaattgaaggtttttga

SEQ ID NO: 1916625 - DNA, 15 bp, Homo sapiens
tagacacttgagtta

SEQ ID NO: 1916626 - DNA, 22 bp, Homo sapiens
tagactgccacaaggaagaaat

SEQ ID NO: 1916627 - DNA, 23 bp, Homo sapiens
tagactgccacaaggaagaaatt

SEQ ID NO: 1916628 - DNA, 17 bp, Homo sapiens
tagactgccagctcttc

SEQ ID NO: 1916629 - DNA, 22 bp, Homo sapiens
tagactgccagctcttcctagc

SEQ ID NO: 1916630 - DNA, 18 bp, Homo sapiens
tagacttgaaaagagaca

SEQ ID NO: 1916631 - DNA, 20 bp, Homo sapiens
tagacttgaaaagagacagg

SEQ ID NO: 1916632 - DNA, 14 bp, Homo sapiens
tagaggaatcaaga

SEQ ID NO: 1916633 - DNA, 16 bp, Homo sapiens
tagaggtgcatgccta

SEQ ID NO: 1916634 - DNA, 17 bp, Homo sapiens
tagagtacactgcctgc

SEQ ID NO: 1916635 - DNA, 13 bp, Homo sapiens
tagatgttttata

SEQ ID NO: 1916636 - DNA, 15 bp, Homo sapiens
tagatttatttcatc

SEQ ID NO: 1916637 - DNA, 13 bp, Homo sapiens
tagcacaggctga

SEQ ID NO: 1916638 - DNA, 19 bp, Homo sapiens
tagcacaggctgagtgcag

SEQ ID NO: 1916639 - DNA, 19 bp, Homo sapiens
tagcacatgttgatttcct

SEQ ID NO: 1916640 - DNA, 15 bp, Homo sapiens
tagcatcacttaaaa

SEQ ID NO: 1916641 - DNA, 23 bp, Homo sapiens
tagcatcacttaaaacacgtttt

SEQ ID NO: 1916642 - DNA, 16 bp, Homo sapiens
tagcatgtgttgcagc

SEQ ID NO: 1916643 - DNA, 23 bp, Homo sapiens
tagcatgtgttgcagctgtcacc

SEQ ID NO: 1916644 - DNA, 22 bp, Homo sapiens
tagcattgtaagcgtatggctt

SEQ ID NO: 1916645 - DNA, 19 bp, Homo sapiens
tagcatttgctgcatgggt

SEQ ID NO: 1916646 - DNA, 20 bp, Homo sapiens
tagcccaggatatattttat

SEQ ID NO: 1916647 - DNA, 22 bp, Homo sapiens
tagcccaggatatattttattt

SEQ ID NO: 1916648 - DNA, 14 bp, Homo sapiens
tagctaagccaaga

SEQ ID NO: 1916649 - DNA, 13 bp, Homo sapiens
tagctcaataaaa

SEQ ID NO: 1916650 - DNA, 14 bp, Homo sapiens
tagctcaataaaag

SEQ ID NO: 1916651 - DNA, 14 bp, Homo sapiens
tagctcttttccta

SEQ ID NO: 1916652 - DNA, 17 bp, Homo sapiens
tagctgtaaggcatgaa

SEQ ID NO: 1916653 - DNA, 17 bp, Homo sapiens
tagcttctagtctggaa

SEQ ID NO: 1916654 - DNA, 23 bp, Homo sapiens
tagctttaatgatatgcttgtaa

SEQ ID NO: 1916655 - DNA, 21 bp, Homo sapiens
tagctttctgagcaagaggat

SEQ ID NO: 1916656 - DNA, 17 bp, Homo sapiens
taggactgggcccgagg

SEQ ID NO: 1916657 - DNA, 17 bp, Homo sapiens
taggatgggcttctgtg

SEQ ID NO: 1916658 - DNA, 17 bp, Homo sapiens
taggggaagaataattt

SEQ ID NO: 1916659 - DNA, 13 bp, Homo sapiens
tagtaaatgctga

SEQ ID NO: 1916660 - DNA, 17 bp, Homo sapiens
tagtatctaataatgaa

SEQ ID NO: 1916661 - DNA, 17 bp, Homo sapiens
tagtctggaactgctgc

SEQ ID NO: 1916662 - DNA, 18 bp, Homo sapiens
tagtctggaactgctgct

SEQ ID NO: 1916663 - DNA, 21 bp, Homo sapiens
tagtctggaactgctgctgac

SEQ ID NO: 1916664 - DNA, 19 bp, Homo sapiens
tagtgagactagacatagt

SEQ ID NO: 1916665 - DNA, 12 bp, Homo sapiens
tagtgctgtgaa

SEQ ID NO: 1916666 - DNA, 13 bp, Homo sapiens
tagtgctgtgaaa

SEQ ID NO: 1916667 - DNA, 15 bp, Homo sapiens
tagtgttatatgaac

SEQ ID NO: 1916668 - DNA, 17 bp, Homo sapiens
tagtgttatatgaacat

SEQ ID NO: 1916669 - DNA, 13 bp, Homo sapiens
tagttatgtaaat

SEQ ID NO: 1916670 - DNA, 14 bp, Homo sapiens
tagttcaagaaatg

SEQ ID NO: 1916671 - DNA, 14 bp, Homo sapiens
tagttccactgaga

SEQ ID NO: 1916672 - DNA, 14 bp, Homo sapiens
tagttctgactttg

SEQ ID NO: 1916673 - DNA, 15 bp, Homo sapiens
tagttctgactttga

SEQ ID NO: 1916674 - DNA, 16 bp, Homo sapiens
tagttctgactttgaa

SEQ ID NO: 1916675 - DNA, 20 bp, Homo sapiens
tagttctgactttgaattta

SEQ ID NO: 1916676 - DNA, 12 bp, Homo sapiens
tagttctgtatt

SEQ ID NO: 1916677 - DNA, 15 bp, Homo sapiens
tagttctttaaactg

SEQ ID NO: 1916678 - DNA, 20 bp, Homo sapiens
tagttctttaaactgtcgtg

SEQ ID NO: 1916679 - DNA, 15 bp, Homo sapiens
tagttgaatacttga

SEQ ID NO: 1916680 - DNA, 17 bp, Homo sapiens
tagttgaatacttgaac

SEQ ID NO: 1916681 - DNA, 19 bp, Homo sapiens
tagttgaatacttgaacca

SEQ ID NO: 1916682 - DNA, 18 bp, Homo sapiens
tagtttaaaaatctgcca

SEQ ID NO: 1916683 - DNA, 20 bp, Homo sapiens
tagtttaaaaatctgccacc

SEQ ID NO: 1916684 - DNA, 14 bp, Homo sapiens
tagttttatttata

SEQ ID NO: 1916685 - DNA, 22 bp, Homo sapiens
tagttttatttatatttattga

SEQ ID NO: 1916686 - DNA, 11 bp, Homo sapiens
tataaaaacaa

SEQ ID NO: 1916687 - DNA, 18 bp, Homo sapiens
tataaacagaagtgactg

SEQ ID NO: 1916688 - DNA, 17 bp, Homo sapiens
tataaagtgaacagatt

SEQ ID NO: 1916689 - DNA, 17 bp, Homo sapiens
tataaattgtcttaatg

SEQ ID NO: 1916690 - DNA, 12 bp, Homo sapiens
tataactgttgt

SEQ ID NO: 1916691 - DNA, 22 bp, Homo sapiens
tataactgttgttgataaggaa

SEQ ID NO: 1916692 - DNA, 17 bp, Homo sapiens
tataacttatattgtaa

SEQ ID NO: 1916693 - DNA, 18 bp, Homo sapiens
tataagccaaaattaagg

SEQ ID NO: 1916694 - DNA, 23 bp, Homo sapiens
tataagccaaaattaaggtgttt

SEQ ID NO: 1916695 - DNA, 18 bp, Homo sapiens
tataagtgtgaccagttt

SEQ ID NO: 1916696 - DNA, 20 bp, Homo sapiens
tataatgaataaacagttat

SEQ ID NO: 1916697 - DNA, 14 bp, Homo sapiens
tatacaaatttaac

SEQ ID NO: 1916698 - DNA, 17 bp, Homo sapiens
tatacaaatttaacttt

SEQ ID NO: 1916699 - DNA, 13 bp, Homo sapiens
tatacatgtttgc

SEQ ID NO: 1916700 - DNA, 22 bp, Homo sapiens
tatactgcaaactatttaaaga

SEQ ID NO: 1916701 - DNA, 16 bp, Homo sapiens
tatacttgaaaaatgt

SEQ ID NO: 1916702 - DNA, 16 bp, Homo sapiens
tatagttatgtaaata

SEQ ID NO: 1916703 - DNA, 20 bp, Homo sapiens
tatagttatgtaaataattc

SEQ ID NO: 1916704 - DNA, 13 bp, Homo sapiens
tatataactgttg

SEQ ID NO: 1916705 - DNA, 12 bp, Homo sapiens
tatatgctgcat

SEQ ID NO: 1916706 - DNA, 19 bp, Homo sapiens
tatatgtatgtgtttagaa

SEQ ID NO: 1916707 - DNA, 16 bp, Homo sapiens
tatattctattttaca

SEQ ID NO: 1916708 - DNA, 13 bp, Homo sapiens
tatatttgtatta

SEQ ID NO: 1916709 - DNA, 22 bp, Homo sapiens
tatattttatttttagaatttt

SEQ ID NO: 1916710 - DNA, 13 bp, Homo sapiens
tatatttttactg

SEQ ID NO: 1916711 - DNA, 23 bp, Homo sapiens
tatcaaatacatttaaaacatta

SEQ ID NO: 1916712 - DNA, 12 bp, Homo sapiens
tatcaagaaagt

SEQ ID NO: 1916713 - DNA, 11 bp, Homo sapiens
tatcatgaagc

SEQ ID NO: 1916714 - DNA, 14 bp, Homo sapiens
tatccaatgaaata

SEQ ID NO: 1916715 - DNA, 19 bp, Homo sapiens
tatccaggaattgatacgt

SEQ ID NO: 1916716 - DNA, 16 bp, Homo sapiens
tatctaaatttggaac

SEQ ID NO: 1916717 - DNA, 13 bp, Homo sapiens
tatctacttgtgt

SEQ ID NO: 1916718 - DNA, 16 bp, Homo sapiens
tatctagtgtttgatt

SEQ ID NO: 1916719 - DNA, 20 bp, Homo sapiens
tatgaaaacatggaacagtg

SEQ ID NO: 1916720 - DNA, 18 bp, Homo sapiens
tatgaagtaaagtttctg

SEQ ID NO: 1916721 - DNA, 20 bp, Homo sapiens
tatgaatctatttgtgggtg

SEQ ID NO: 1916722 - DNA, 22 bp, Homo sapiens
tatgaatctatttttcttcaga

SEQ ID NO: 1916723 - DNA, 16 bp, Homo sapiens
tatgataataatcatg

SEQ ID NO: 1916724 - DNA, 21 bp, Homo sapiens
tatgatgacgtacaagtagtt

SEQ ID NO: 1916725 - DNA, 21 bp, Homo sapiens
tatgattaaaaatatcaaatt

SEQ ID NO: 1916726 - DNA, 23 bp, Homo sapiens
tatgattaaaaatatcaaattaa

SEQ ID NO: 1916727 - DNA, 17 bp, Homo sapiens
tatgatttaatttgaaa

SEQ ID NO: 1916728 - DNA, 18 bp, Homo sapiens
tatgatttaatttgaaat

SEQ ID NO: 1916729 - DNA, 22 bp, Homo sapiens
tatggccaggaagtagcacagg

SEQ ID NO: 1916730 - DNA, 23 bp, Homo sapiens
tatggccaggaagtagcacaggc

SEQ ID NO: 1916731 - DNA, 21 bp, Homo sapiens
tatggctttatttttttgaac

SEQ ID NO: 1916732 - DNA, 13 bp, Homo sapiens
tatgtaaataatt

SEQ ID NO: 1916733 - DNA, 20 bp, Homo sapiens
tatgtaaggttttttttgta

SEQ ID NO: 1916734 - DNA, 15 bp, Homo sapiens
tatgtatatttttga

SEQ ID NO: 1916735 - DNA, 22 bp, Homo sapiens
tatgtatctttataattgatga

SEQ ID NO: 1916736 - DNA, 18 bp, Homo sapiens
tatgtctagcacatgttg

SEQ ID NO: 1916737 - DNA, 13 bp, Homo sapiens
tattaaaaaacaa

SEQ ID NO: 1916738 - DNA, 16 bp, Homo sapiens
tattaagccattgaaa

SEQ ID NO: 1916739 - DNA, 13 bp, Homo sapiens
tattaatcactgt

SEQ ID NO: 1916740 - DNA, 23 bp, Homo sapiens
tattaatcactgtgtatatttga

SEQ ID NO: 1916741 - DNA, 14 bp, Homo sapiens
tattagtgttatat

SEQ ID NO: 1916742 - DNA, 18 bp, Homo sapiens
tattagtgttatatgaac

SEQ ID NO: 1916743 - DNA, 22 bp, Homo sapiens
tattatttattttttttaattg

SEQ ID NO: 1916744 - DNA, 13 bp, Homo sapiens
tattcctaactgt

SEQ ID NO: 1916745 - DNA, 18 bp, Homo sapiens
tattctaaaaaaataaac

SEQ ID NO: 1916746 - DNA, 15 bp, Homo sapiens
tattctaataagcta

SEQ ID NO: 1916747 - DNA, 20 bp, Homo sapiens
tattctaataagctagttga

SEQ ID NO: 1916748 - DNA, 14 bp, Homo sapiens
tattctattttaca

SEQ ID NO: 1916749 - DNA, 20 bp, Homo sapiens
tattctttttatattctgtg

SEQ ID NO: 1916750 - DNA, 19 bp, Homo sapiens
tattgatgcagacaaatga

SEQ ID NO: 1916751 - DNA, 21 bp, Homo sapiens
tattgtaatgtatacttgaaa

SEQ ID NO: 1916752 - DNA, 14 bp, Homo sapiens
tatttaatggttaa

SEQ ID NO: 1916753 - DNA, 22 bp, Homo sapiens
tatttatatgtatgtgtttaga

SEQ ID NO: 1916754 - DNA, 18 bp, Homo sapiens
tatttatatttattgact

SEQ ID NO: 1916755 - DNA, 13 bp, Homo sapiens
tatttatgtaaca

SEQ ID NO: 1916756 - DNA, 12 bp, Homo sapiens
tatttattgact

SEQ ID NO: 1916757 - DNA, 15 bp, Homo sapiens
tatttatttctttct

SEQ ID NO: 1916758 - DNA, 22 bp, Homo sapiens
tatttattttttttaattgtat

SEQ ID NO: 1916759 - DNA, 16 bp, Homo sapiens
tatttcagcaaacttg

SEQ ID NO: 1916760 - DNA, 12 bp, Homo sapiens
tatttctgaaag

SEQ ID NO: 1916761 - DNA, 14 bp, Homo sapiens
tatttgaaagtgcc

SEQ ID NO: 1916762 - DNA, 15 bp, Homo sapiens
tatttgaaagtgcct

SEQ ID NO: 1916763 - DNA, 16 bp, Homo sapiens
tatttgatttattaac

SEQ ID NO: 1916764 - DNA, 20 bp, Homo sapiens
tattttcagaagctgatgag

SEQ ID NO: 1916765 - DNA, 12 bp, Homo sapiens
tatttttataat

SEQ ID NO: 1916766 - DNA, 16 bp, Homo sapiens
tatttttataatgact

SEQ ID NO: 1916767 - DNA, 14 bp, Homo sapiens
tatttttctctctc

SEQ ID NO: 1916768 - DNA, 15 bp, Homo sapiens
tatttttcttcagac

SEQ ID NO: 1916769 - DNA, 14 bp, Homo sapiens
tatttttgaaaaat

SEQ ID NO: 1916770 - DNA, 16 bp, Homo sapiens
tatttttgatctttga

SEQ ID NO: 1916771 - DNA, 13 bp, Homo sapiens
tatttttgttgtt

SEQ ID NO: 1916772 - DNA, 13 bp, Homo sapiens
tatttttttgaac

SEQ ID NO: 1916773 - DNA, 21 bp, Homo sapiens
tcaaaaaggcttataaaacag

SEQ ID NO: 1916774 - DNA, 20 bp, Homo sapiens
tcaaaacctttcaaatatca

SEQ ID NO: 1916775 - DNA, 17 bp, Homo sapiens
tcaaaagtagaactttg

SEQ ID NO: 1916776 - DNA, 13 bp, Homo sapiens
tcaaaagtttgtt

SEQ ID NO: 1916777 - DNA, 14 bp, Homo sapiens
tcaaaagtttgttt

SEQ ID NO: 1916778 - DNA, 16 bp, Homo sapiens
tcaaaatactttttaa

SEQ ID NO: 1916779 - DNA, 14 bp, Homo sapiens
tcaaaatatgtgta

SEQ ID NO: 1916780 - DNA, 13 bp, Homo sapiens
tcaaaattcaaaa

SEQ ID NO: 1916781 - DNA, 15 bp, Homo sapiens
tcaaatccaggaccc

SEQ ID NO: 1916782 - DNA, 22 bp, Homo sapiens
tcaaatgatgtgcctgcttcag

SEQ ID NO: 1916783 - DNA, 14 bp, Homo sapiens
tcaaatgtgttttg

SEQ ID NO: 1916784 - DNA, 15 bp, Homo sapiens
tcaaattaattgtgt

SEQ ID NO: 1916785 - DNA, 22 bp, Homo sapiens
tcaacagcaagtgtgaatactg

SEQ ID NO: 1916786 - DNA, 18 bp, Homo sapiens
tcaagaaatgaagagctg

SEQ ID NO: 1916787 - DNA, 11 bp, Homo sapiens
tcaagagcctt

SEQ ID NO: 1916788 - DNA, 16 bp, Homo sapiens
tcaagagccttaaaac

SEQ ID NO: 1916789 - DNA, 20 bp, Homo sapiens
tcaagagccttaaaacatca

SEQ ID NO: 1916790 - DNA, 23 bp, Homo sapiens
tcaagaggacaatctagctctcc

SEQ ID NO: 1916791 - DNA, 23 bp, Homo sapiens
tcaagatcaaaaaggcttataaa

SEQ ID NO: 1916792 - DNA, 13 bp, Homo sapiens
tcaagtacactga

SEQ ID NO: 1916793 - DNA, 18 bp, Homo sapiens
tcaagtgcaatgccccct

SEQ ID NO: 1916794 - DNA, 21 bp, Homo sapiens
tcaagtgcaatgccccctccc

SEQ ID NO: 1916795 - DNA, 17 bp, Homo sapiens
tcaatgctggagaaaaa

SEQ ID NO: 1916796 - DNA, 22 bp, Homo sapiens
tcaatgctgtttgggtttccaa

SEQ ID NO: 1916797 - DNA, 21 bp, Homo sapiens
tcaatgtgatataaacagctt

SEQ ID NO: 1916798 - DNA, 17 bp, Homo sapiens
tcaattagaaaaggaaa

SEQ ID NO: 1916799 - DNA, 18 bp, Homo sapiens
tcaattagaaaaggaaat

SEQ ID NO: 1916800 - DNA, 15 bp, Homo sapiens
tcacaaatgacttta

SEQ ID NO: 1916801 - DNA, 19 bp, Homo sapiens
tcacaaatgactttattat

SEQ ID NO: 1916802 - DNA, 15 bp, Homo sapiens
tcacacacctctgcc

SEQ ID NO: 1916803 - DNA, 16 bp, Homo sapiens
tcacacacctctgccc

SEQ ID NO: 1916804 - DNA, 18 bp, Homo sapiens
tcacacacctctgcccct

SEQ ID NO: 1916805 - DNA, 19 bp, Homo sapiens
tcacacacctctgcccctt

SEQ ID NO: 1916806 - DNA, 14 bp, Homo sapiens
tcacagcagggcct

SEQ ID NO: 1916807 - DNA, 20 bp, Homo sapiens
tcacagccagcgaactgaca

SEQ ID NO: 1916808 - DNA, 20 bp, Homo sapiens
tcacagctatgcaaaaagct

SEQ ID NO: 1916809 - DNA, 14 bp, Homo sapiens
tcacaggctgggct

SEQ ID NO: 1916810 - DNA, 13 bp, Homo sapiens
tcacagggcctca

SEQ ID NO: 1916811 - DNA, 14 bp, Homo sapiens
tcacagggcctcag

SEQ ID NO: 1916812 - DNA, 16 bp, Homo sapiens
tcacagggcctcagtt

SEQ ID NO: 1916813 - DNA, 17 bp, Homo sapiens
tcacagtcaccaagtgt

SEQ ID NO: 1916814 - DNA, 17 bp, Homo sapiens
tcacagtgtgattttga

SEQ ID NO: 1916815 - DNA, 20 bp, Homo sapiens
tcacatttggaatttaaaga

SEQ ID NO: 1916816 - DNA, 15 bp, Homo sapiens
tcaccactacagtaa

SEQ ID NO: 1916817 - DNA, 20 bp, Homo sapiens
tcaccatttccccagggcac

SEQ ID NO: 1916818 - DNA, 15 bp, Homo sapiens
tcaccttggttcctg

SEQ ID NO: 1916819 - DNA, 15 bp, Homo sapiens
tcacgaaactggaat

SEQ ID NO: 1916820 - DNA, 14 bp, Homo sapiens
tcacgtgcaaagcc

SEQ ID NO: 1916821 - DNA, 11 bp, Homo sapiens
tcactctcagg

SEQ ID NO: 1916822 - DNA, 21 bp, Homo sapiens
tcactgggggacactgtggca

SEQ ID NO: 1916823 - DNA, 23 bp, Homo sapiens
tcactgggggacactgtggcagc

SEQ ID NO: 1916824 - DNA, 18 bp, Homo sapiens
tcactgtgtatatttgat

SEQ ID NO: 1916825 - DNA, 18 bp, Homo sapiens
tcactgtgtggcctcaga

SEQ ID NO: 1916826 - DNA, 13 bp, Homo sapiens
tcactgtttagat

SEQ ID NO: 1916827 - DNA, 15 bp, Homo sapiens
tcacttaaaacacgt

SEQ ID NO: 1916828 - DNA, 20 bp, Homo sapiens
tcagaaagggcagaagtagg

SEQ ID NO: 1916829 - DNA, 12 bp, Homo sapiens
tcagaacagctg

SEQ ID NO: 1916830 - DNA, 15 bp, Homo sapiens
tcagaactgtttttg

SEQ ID NO: 1916831 - DNA, 12 bp, Homo sapiens
tcagactgtata

SEQ ID NO: 1916832 - DNA, 17 bp, Homo sapiens
tcagagaaatgtctgtc

SEQ ID NO: 1916833 - DNA, 19 bp, Homo sapiens
tcagagagggaagctgagg

SEQ ID NO: 1916834 - DNA, 12 bp, Homo sapiens
tcagaggcccca

SEQ ID NO: 1916835 - DNA, 17 bp, Homo sapiens
tcagatgtttaaaacac

SEQ ID NO: 1916836 - DNA, 20 bp, Homo sapiens
tcagcaaacttgttgaattt

SEQ ID NO: 1916837 - DNA, 14 bp, Homo sapiens
tcagcaaggccacc

SEQ ID NO: 1916838 - DNA, 17 bp, Homo sapiens
tcagcaaggccacctct

SEQ ID NO: 1916839 - DNA, 21 bp, Homo sapiens
tcagcagatgttgaagacagg

SEQ ID NO: 1916840 - DNA, 13 bp, Homo sapiens
tcagcagttgctg

SEQ ID NO: 1916841 - DNA, 14 bp, Homo sapiens
tcagcagttgctgg

SEQ ID NO: 1916842 - DNA, 20 bp, Homo sapiens
tcagcagttgctggtaaaat

SEQ ID NO: 1916843 - DNA, 23 bp, Homo sapiens
tcagcatctgacctctaccttca

SEQ ID NO: 1916844 - DNA, 19 bp, Homo sapiens
tcagcattacctctttgga

SEQ ID NO: 1916845 - DNA, 23 bp, Homo sapiens
tcagcattagtgggaaaaagtgg

SEQ ID NO: 1916846 - DNA, 21 bp, Homo sapiens
tcagccaccctttctggcacg

SEQ ID NO: 1916847 - DNA, 14 bp, Homo sapiens
tcagccctctcttg

SEQ ID NO: 1916848 - DNA, 16 bp, Homo sapiens
tcagcctcccacagtg

SEQ ID NO: 1916849 - DNA, 23 bp, Homo sapiens
tcagctacccctgcagctgggga

SEQ ID NO: 1916850 - DNA, 13 bp, Homo sapiens
tcagcttccccag

SEQ ID NO: 1916851 - DNA, 18 bp, Homo sapiens
tcagcttccccagtagct

SEQ ID NO: 1916852 - DNA, 17 bp, Homo sapiens
tcaggcattttccccct

SEQ ID NO: 1916853 - DNA, 22 bp, Homo sapiens
tcaggcattttcccccttggct

SEQ ID NO: 1916854 - DNA, 15 bp, Homo sapiens
tcaggggcaggaacc

SEQ ID NO: 1916855 - DNA, 17 bp, Homo sapiens
tcagggtgtgaggccac

SEQ ID NO: 1916856 - DNA, 18 bp, Homo sapiens
tcaggtcccagttgctgt

SEQ ID NO: 1916857 - DNA, 21 bp, Homo sapiens
tcaggtgaaactccagatgcc

SEQ ID NO: 1916858 - DNA, 15 bp, Homo sapiens
tcagtgatgtgccta

SEQ ID NO: 1916859 - DNA, 14 bp, Homo sapiens
tcataaagaaaaat

SEQ ID NO: 1916860 - DNA, 21 bp, Homo sapiens
tcataaggagacttctgtctt

SEQ ID NO: 1916861 - DNA, 22 bp, Homo sapiens
tcataatcatggctcttagaaa

SEQ ID NO: 1916862 - DNA, 20 bp, Homo sapiens
tcataatgaataaagtgcaa

SEQ ID NO: 1916863 - DNA, 15 bp, Homo sapiens
tcatactgatgtgtt

SEQ ID NO: 1916864 - DNA, 16 bp, Homo sapiens
tcatagcattgtctat

SEQ ID NO: 1916865 - DNA, 15 bp, Homo sapiens
tcatagttttattta

SEQ ID NO: 1916866 - DNA, 17 bp, Homo sapiens
tcatagttttatttata

SEQ ID NO: 1916867 - DNA, 16 bp, Homo sapiens
tcatcagaacagctgt

SEQ ID NO: 1916868 - DNA, 16 bp, Homo sapiens
tcatctgagaatgaac

SEQ ID NO: 1916869 - DNA, 15 bp, Homo sapiens
tcatggatagatttt

SEQ ID NO: 1916870 - DNA, 18 bp, Homo sapiens
tcatggctcttagaaact

SEQ ID NO: 1916871 - DNA, 17 bp, Homo sapiens
tcattacttgttgccta

SEQ ID NO: 1916872 - DNA, 20 bp, Homo sapiens
tcattgcaaacaactgaaat

SEQ ID NO: 1916873 - DNA, 15 bp, Homo sapiens
tcattgcacaatata

SEQ ID NO: 1916874 - DNA, 16 bp, Homo sapiens
tcattgcacaatatat

SEQ ID NO: 1916875 - DNA, 12 bp, Homo sapiens
tcatttctgatt

SEQ ID NO: 1916876 - DNA, 20 bp, Homo sapiens
tcatttggggaccacagagg

SEQ ID NO: 1916877 - DNA, 14 bp, Homo sapiens
tccaaacacaggca

SEQ ID NO: 1916878 - DNA, 19 bp, Homo sapiens
tccaaaccttactctgagc

SEQ ID NO: 1916879 - DNA, 16 bp, Homo sapiens
tccaactccacaccct

SEQ ID NO: 1916880 - DNA, 18 bp, Homo sapiens
tccaagccgtaggaccca

SEQ ID NO: 1916881 - DNA, 13 bp, Homo sapiens
tccaattttcctt

SEQ ID NO: 1916882 - DNA, 15 bp, Homo sapiens
tccaattttccttca

SEQ ID NO: 1916883 - DNA, 19 bp, Homo sapiens
tccacccctctggcacctg

SEQ ID NO: 1916884 - DNA, 15 bp, Homo sapiens
tccaccgtcccctcc

SEQ ID NO: 1916885 - DNA, 17 bp, Homo sapiens
tccagaacctaggagga

SEQ ID NO: 1916886 - DNA, 18 bp, Homo sapiens
tccagaaggagcaggccc

SEQ ID NO: 1916887 - DNA, 18 bp, Homo sapiens
tccagaaggcaataccaa

SEQ ID NO: 1916888 - DNA, 19 bp, Homo sapiens
tccagaatgaagaattcag

SEQ ID NO: 1916889 - DNA, 21 bp, Homo sapiens
tccagcacaaccttcaagctg

SEQ ID NO: 1916890 - DNA, 14 bp, Homo sapiens
tccagcacagattt

SEQ ID NO: 1916891 - DNA, 14 bp, Homo sapiens
tccagctccctccc

SEQ ID NO: 1916892 - DNA, 16 bp, Homo sapiens
tccagctccctcccct

SEQ ID NO: 1916893 - DNA, 19 bp, Homo sapiens
tccagctccctcccctgct

SEQ ID NO: 1916894 - DNA, 19 bp, Homo sapiens
tccaggaccctgccaggca

SEQ ID NO: 1916895 - DNA, 21 bp, Homo sapiens
tccaggaccctgccaggcaca

SEQ ID NO: 1916896 - DNA, 20 bp, Homo sapiens
tccagtaagatcactgttta

SEQ ID NO: 1916897 - DNA, 17 bp, Homo sapiens
tccagtaccttctgcca

SEQ ID NO: 1916898 - DNA, 19 bp, Homo sapiens
tccagtaccttctgccaga

SEQ ID NO: 1916899 - DNA, 21 bp, Homo sapiens
tccagtattgtatatgagttt

SEQ ID NO: 1916900 - DNA, 19 bp, Homo sapiens
tccagtgaaaataagccat

SEQ ID NO: 1916901 - DNA, 19 bp, Homo sapiens
tccagtggcttctcccaac

SEQ ID NO: 1916902 - DNA, 16 bp, Homo sapiens
tccatatttttacaac

SEQ ID NO: 1916903 - DNA, 14 bp, Homo sapiens
tccatctctgaaaa

SEQ ID NO: 1916904 - DNA, 17 bp, Homo sapiens
tccatctctgaaaacaa

SEQ ID NO: 1916905 - DNA, 15 bp, Homo sapiens
tccatctcttccttt

SEQ ID NO: 1916906 - DNA, 14 bp, Homo sapiens
tccatctgtcactt

SEQ ID NO: 1916907 - DNA, 14 bp, Homo sapiens
tccatttcactggc

SEQ ID NO: 1916908 - DNA, 13 bp, Homo sapiens
tccattttataaa

SEQ ID NO: 1916909 - DNA, 17 bp, Homo sapiens
tcccaaaatcaccgtac

SEQ ID NO: 1916910 - DNA, 20 bp, Homo sapiens
tcccaaatgtgtgcccagct

SEQ ID NO: 1916911 - DNA, 21 bp, Homo sapiens
tcccaaatgtgtgcccagctt

SEQ ID NO: 1916912 - DNA, 14 bp, Homo sapiens
tcccaccctacccc

SEQ ID NO: 1916913 - DNA, 18 bp, Homo sapiens
tcccaccctacccccttt

SEQ ID NO: 1916914 - DNA, 17 bp, Homo sapiens
tcccaccctttctgcca

SEQ ID NO: 1916915 - DNA, 18 bp, Homo sapiens
tcccaccctttctgccag

SEQ ID NO: 1916916 - DNA, 13 bp, Homo sapiens
tcccactcccatg

SEQ ID NO: 1916917 - DNA, 16 bp, Homo sapiens
tcccactcccatggct

SEQ ID NO: 1916918 - DNA, 15 bp, Homo sapiens
tcccacttctgccag

SEQ ID NO: 1916919 - DNA, 16 bp, Homo sapiens
tcccacttttgccaga

SEQ ID NO: 1916920 - DNA, 20 bp, Homo sapiens
tcccagagctccctctgccc

SEQ ID NO: 1916921 - DNA, 13 bp, Homo sapiens
tcccagcagccag

SEQ ID NO: 1916922 - DNA, 14 bp, Homo sapiens
tcccagctccaccc

SEQ ID NO: 1916923 - DNA, 12 bp, Homo sapiens
tcccagctctgg

SEQ ID NO: 1916924 - DNA, 17 bp, Homo sapiens
tcccaggagcctgccca

SEQ ID NO: 1916925 - DNA, 15 bp, Homo sapiens
tcccaggcagcgcca

SEQ ID NO: 1916926 - DNA, 23 bp, Homo sapiens
tcccaggcagcgccactgtccgc

SEQ ID NO: 1916927 - DNA, 22 bp, Homo sapiens
tcccaggcgatcttgtgtctac

SEQ ID NO: 1916928 - DNA, 15 bp, Homo sapiens
tcccagttgctgtca

SEQ ID NO: 1916929 - DNA, 16 bp, Homo sapiens
tcccagttgctgtcac

SEQ ID NO: 1916930 - DNA, 12 bp, Homo sapiens
tcccatggctct

SEQ ID NO: 1916931 - DNA, 14 bp, Homo sapiens
tccccaccctgtcc

SEQ ID NO: 1916932 - DNA, 20 bp, Homo sapiens
tccccaccctgtcccaggca

SEQ ID NO: 1916933 - DNA, 15 bp, Homo sapiens
tccccaccttcttgg

SEQ ID NO: 1916934 - DNA, 13 bp, Homo sapiens
tccccccatcccg

SEQ ID NO: 1916935 - DNA, 22 bp, Homo sapiens
tcccctcctttaccgaggacag

SEQ ID NO: 1916936 - DNA, 23 bp, Homo sapiens
tcccctcctttaccgaggacagc

SEQ ID NO: 1916937 - DNA, 22 bp, Homo sapiens
tcccctggaagcagtgcccagg

SEQ ID NO: 1916938 - DNA, 21 bp, Homo sapiens
tccccttccagctccctcccc

SEQ ID NO: 1916939 - DNA, 14 bp, Homo sapiens
tccccttgccagct

SEQ ID NO: 1916940 - DNA, 15 bp, Homo sapiens
tccccttgccagctg

SEQ ID NO: 1916941 - DNA, 16 bp, Homo sapiens
tccccttgccagctgc

SEQ ID NO: 1916942 - DNA, 15 bp, Homo sapiens
tcccgcctccaaccc

SEQ ID NO: 1916943 - DNA, 21 bp, Homo sapiens
tcccgcctccaacccctcgcc

SEQ ID NO: 1916944 - DNA, 20 bp, Homo sapiens
tcccggcagcgaggctgggc

SEQ ID NO: 1916945 - DNA, 21 bp, Homo sapiens
tcccggcagcgaggctgggct

SEQ ID NO: 1916946 - DNA, 15 bp, Homo sapiens
tcccgtttccctcca

SEQ ID NO: 1916947 - DNA, 16 bp, Homo sapiens
tcccgtttccctccag

SEQ ID NO: 1916948 - DNA, 18 bp, Homo sapiens
tcccgtttccctccaggt

SEQ ID NO: 1916949 - DNA, 14 bp, Homo sapiens
tccctcccctgctc

SEQ ID NO: 1916950 - DNA, 16 bp, Homo sapiens
tccctcccctgctcag

SEQ ID NO: 1916951 - DNA, 12 bp, Homo sapiens
tccctcctttcc

SEQ ID NO: 1916952 - DNA, 23 bp, Homo sapiens
tccctcctttcctttttctttcc

SEQ ID NO: 1916953 - DNA, 16 bp, Homo sapiens
tccctctcctctgccc

SEQ ID NO: 1916954 - DNA, 17 bp, Homo sapiens
tccttgaagcttgtatc

SEQ ID NO: 1916955 - DNA, 19 bp, Homo sapiens
tccttgaagcttgtatctg

SEQ ID NO: 1916956 - DNA, 20 bp, Homo sapiens
tccttgaagcttgtatctga

SEQ ID NO: 1916957 - DNA, 20 bp, Homo sapiens
tccttggaaatcaaatgtaa

SEQ ID NO: 1916958 - DNA, 14 bp, Homo sapiens
tcctttaatatgaa

SEQ ID NO: 1916959 - DNA, 18 bp, Homo sapiens
tcctttaatatgaaattt

SEQ ID NO: 1916960 - DNA, 19 bp, Homo sapiens
tcctttccccttcccttcc

SEQ ID NO: 1916961 - DNA, 21 bp, Homo sapiens
tcctttcccctttttctttcc

SEQ ID NO: 1916962 - DNA, 17 bp, Homo sapiens
tcctttctgatcttcac

SEQ ID NO: 1916963 - DNA, 18 bp, Homo sapiens
tcctttgactttctgtgt

SEQ ID NO: 1916964 - DNA, 15 bp, Homo sapiens
tcctttttatttata

SEQ ID NO: 1916965 - DNA, 18 bp, Homo sapiens
tcctttttatttatatgt

SEQ ID NO: 1916966 - DNA, 14 bp, Homo sapiens
tcctttttctttcc

SEQ ID NO: 1916967 - DNA, 14 bp, Homo sapiens
tcgaaaagaaattg

SEQ ID NO: 1916968 - DNA, 23 bp, Homo sapiens
tcgaaaagaaattgtccttgaag

SEQ ID NO: 1916969 - DNA, 17 bp, Homo sapiens
tcgagctcggggctggg

SEQ ID NO: 1916970 - DNA, 14 bp, Homo sapiens
tcgcccagtcccag

SEQ ID NO: 1916971 - DNA, 23 bp, Homo sapiens
tcgcccagtcccagcagccagcc

SEQ ID NO: 1916972 - DNA, 17 bp, Homo sapiens
tcgctacatttccgcca

SEQ ID NO: 1916973 - DNA, 23 bp, Homo sapiens
tcgctagcatttcccaacacaaa

SEQ ID NO: 1916974 - DNA, 15 bp, Homo sapiens
tcggagcccccgcag

SEQ ID NO: 1916975 - DNA, 20 bp, Homo sapiens
tcggatgtgtcctttctgaa

SEQ ID NO: 1916976 - DNA, 19 bp, Homo sapiens
tcgggctgttctggtggcc

SEQ ID NO: 1916977 - DNA, 11 bp, Homo sapiens
tcggggctggg

SEQ ID NO: 1916978 - DNA, 14 bp, Homo sapiens
tcggggctgggggc

SEQ ID NO: 1916979 - DNA, 23 bp, Homo sapiens
tcggggctgggggctgcagggct

SEQ ID NO: 1916980 - DNA, 18 bp, Homo sapiens
tcgtactctctctctttt

SEQ ID NO: 1916981 - DNA, 15 bp, Homo sapiens
tcgtcagcctccctg

SEQ ID NO: 1916982 - DNA, 22 bp, Homo sapiens
tcgtgtcatactcgagtctgag

SEQ ID NO: 1916983 - DNA, 18 bp, Homo sapiens
tctaaaaaaataaacaaa

SEQ ID NO: 1916984 - DNA, 21 bp, Homo sapiens
tctaaaaaaataaacaaagtg

SEQ ID NO: 1916985 - DNA, 11 bp, Homo sapiens
tctaaggacaa

SEQ ID NO: 1916986 - DNA, 18 bp, Homo sapiens
tctaataagctagttgaa

SEQ ID NO: 1916987 - DNA, 14 bp, Homo sapiens
tctaccttcataag

SEQ ID NO: 1916988 - DNA, 19 bp, Homo sapiens
tctactgttatgtgagaac

SEQ ID NO: 1916989 - DNA, 22 bp, Homo sapiens
tctactgttatgtgagaacatt

SEQ ID NO: 1916990 - DNA, 11 bp, Homo sapiens
tctagaaagaa

SEQ ID NO: 1916991 - DNA, 17 bp, Homo sapiens
tctagaaagagccttaa

SEQ ID NO: 1916992 - DNA, 15 bp, Homo sapiens
tctagaggctggcaa

SEQ ID NO: 1916993 - DNA, 13 bp, Homo sapiens
tctagattttgaa

SEQ ID NO: 1916994 - DNA, 16 bp, Homo sapiens
tctagctttgtttagt

SEQ ID NO: 1916995 - DNA, 15 bp, Homo sapiens
tctagtaataaagac

SEQ ID NO: 1916996 - DNA, 17 bp, Homo sapiens
tctagtaataaagactc

SEQ ID NO: 1916997 - DNA, 16 bp, Homo sapiens
tctagtattctttatt

SEQ ID NO: 1916998 - DNA, 15 bp, Homo sapiens
tctagtgctgtgaaa

SEQ ID NO: 1916999 - DNA, 13 bp, Homo sapiens
tctataaataacc

SEQ ID NO: 1917000 - DNA, 14 bp, Homo sapiens
tctatttctgaaag

SEQ ID NO: 1917001 - DNA, 13 bp, Homo sapiens
tctattttacaac

SEQ ID NO: 1917002 - DNA, 12 bp, Homo sapiens
tctcacagacag

SEQ ID NO: 1917003 - DNA, 13 bp, Homo sapiens
tctcacagacagg

SEQ ID NO: 1917004 - DNA, 21 bp, Homo sapiens
tctcacagacaggacccctgc

SEQ ID NO: 1917005 - DNA, 22 bp, Homo sapiens
tctcacagctatgcaaaaagct

SEQ ID NO: 1917006 - DNA, 21 bp, Homo sapiens
tctcagcattacctctttgga

SEQ ID NO: 1917007 - DNA, 16 bp, Homo sapiens
tctcaggtctgagttg

SEQ ID NO: 1917008 - DNA, 21 bp, Homo sapiens
tctcattattctctaactatt

SEQ ID NO: 1917009 - DNA, 19 bp, Homo sapiens
tctccatccctctcctctg

SEQ ID NO: 1917010 - DNA, 15 bp, Homo sapiens
tctccatggagttgc

SEQ ID NO: 1917011 - DNA, 23 bp, Homo sapiens
tctccccacccagacctgcctgt

SEQ ID NO: 1917012 - DNA, 13 bp, Homo sapiens
tctccgcagaggc

SEQ ID NO: 1917013 - DNA, 22 bp, Homo sapiens
tctcctgcagcctgagatggat

SEQ ID NO: 1917014 - DNA, 15 bp, Homo sapiens
tctcggaactcccgc

SEQ ID NO: 1917015 - DNA, 13 bp, Homo sapiens
tctcggcagaggt

SEQ ID NO: 1917016 - DNA, 17 bp, Homo sapiens
tctctagaggctggcaa

SEQ ID NO: 1917017 - DNA, 11 bp, Homo sapiens
tctctcctcca

SEQ ID NO: 1917018 - DNA, 20 bp, Homo sapiens
tctctcggaactcccgcacc

SEQ ID NO: 1917019 - DNA, 17 bp, Homo sapiens
tctctctcaatttttgg

SEQ ID NO: 1917020 - DNA, 12 bp, Homo sapiens
tctctctcactc

SEQ ID NO: 1917021 - DNA, 17 bp, Homo sapiens
tctctgaaaacaagaga

SEQ ID NO: 1917022 - DNA, 23 bp, Homo sapiens
tctctgaaggaggccacctccta

SEQ ID NO: 1917023 - DNA, 13 bp, Homo sapiens
tctctgacaaagt

SEQ ID NO: 1917024 - DNA, 14 bp, Homo sapiens
tctctgacaaagtg

SEQ ID NO: 1917025 - DNA, 19 bp, Homo sapiens
tctctgcacacaagaggct

SEQ ID NO: 1917026 - DNA, 18 bp, Homo sapiens
tctctgtctgatcctgtc

SEQ ID NO: 1917027 - DNA, 12 bp, Homo sapiens
tctcttcctttc

SEQ ID NO: 1917028 - DNA, 20 bp, Homo sapiens
tctctttctaagagacctga

SEQ ID NO: 1917029 - DNA, 21 bp, Homo sapiens
tctgaaaagctgtgtacttta

SEQ ID NO: 1917030 - DNA, 15 bp, Homo sapiens
tctgaaaatttatat

SEQ ID NO: 1917031 - DNA, 24 bp, Homo sapiens
tctgaaaatttatataactgttgt

SEQ ID NO: 1917032 - DNA, 22 bp, Homo sapiens
tctgaaatacaaccagaaacaa

SEQ ID NO: 1917033 - DNA, 18 bp, Homo sapiens
tctgaaggaggccacctc

SEQ ID NO: 1917034 - DNA, 14 bp, Homo sapiens
tctgaccttaaatg

SEQ ID NO: 1917035 - DNA, 19 bp, Homo sapiens
tctgactcatatcccctat

SEQ ID NO: 1917036 - DNA, 13 bp, Homo sapiens
tctgactttgaat

SEQ ID NO: 1917037 - DNA, 14 bp, Homo sapiens
tctgactttgaatt

SEQ ID NO: 1917038 - DNA, 15 bp, Homo sapiens
tctgactttgaattt

SEQ ID NO: 1917039 - DNA, 16 bp, Homo sapiens
tctgactttgaattta

SEQ ID NO: 1917040 - DNA, 18 bp, Homo sapiens
tgcctcagcttccccagt

SEQ ID NO: 1917041 - DNA, 13 bp, Homo sapiens
tgcctcctcctgc

SEQ ID NO: 1917042 - DNA, 15 bp, Homo sapiens
tgcctcctcctgccc

SEQ ID NO: 1917043 - DNA, 21 bp, Homo sapiens
tgcctctccgcccctgagccc

SEQ ID NO: 1917044 - DNA, 22 bp, Homo sapiens
tgcctctccgcccctgagccca

SEQ ID NO: 1917045 - DNA, 12 bp, Homo sapiens
tgcctctgccac

SEQ ID NO: 1917046 - DNA, 21 bp, Homo sapiens
tgcctctggctctacacatat

SEQ ID NO: 1917047 - DNA, 12 bp, Homo sapiens
tgcctgcttcag

SEQ ID NO: 1917048 - DNA, 22 bp, Homo sapiens
tgccttaagtgaggaaatcaaa

SEQ ID NO: 1917049 - DNA, 22 bp, Homo sapiens
tgcctttatctaaggaaacatt

SEQ ID NO: 1917050 - DNA, 16 bp, Homo sapiens
tgcggggcagcagggg

SEQ ID NO: 1917051 - DNA, 14 bp, Homo sapiens
tgctaatattttta

SEQ ID NO: 1917052 - DNA, 18 bp, Homo sapiens
tgctaatcttgtgaaaat

SEQ ID NO: 1917053 - DNA, 21 bp, Homo sapiens
tgctaatcttgtgaaaataat

SEQ ID NO: 1917054 - DNA, 19 bp, Homo sapiens
tgctacttgagggccagga

SEQ ID NO: 1917055 - DNA, 19 bp, Homo sapiens
tgctagcctcacgaaactg

SEQ ID NO: 1917056 - DNA, 21 bp, Homo sapiens
tgctagcctcacgaaactgga

SEQ ID NO: 1917057 - DNA, 16 bp, Homo sapiens
tgctcagctgtcaagg

SEQ ID NO: 1917058 - DNA, 20 bp, Homo sapiens
tgctcagctgtcaaggctca

SEQ ID NO: 1917059 - DNA, 18 bp, Homo sapiens
tgctccattcatacacaa

SEQ ID NO: 1917060 - DNA, 15 bp, Homo sapiens
tgctcctgagccccc

SEQ ID NO: 1917061 - DNA, 16 bp, Homo sapiens
tgctcctgagccccca

SEQ ID NO: 1917062 - DNA, 19 bp, Homo sapiens
tgctctcaaacccctgacc

SEQ ID NO: 1917063 - DNA, 16 bp, Homo sapiens
tgctgaaagatatgta

SEQ ID NO: 1917064 - DNA, 17 bp, Homo sapiens
tgctgaacaaaattaaa

SEQ ID NO: 1917065 - DNA, 22 bp, Homo sapiens
tgctgaacaaaattaaacttca

SEQ ID NO: 1917066 - DNA, 19 bp, Homo sapiens
tgctgacccatgggcagga

SEQ ID NO: 1917067 - DNA, 13 bp, Homo sapiens
tgctgacttagaa

SEQ ID NO: 1917068 - DNA, 17 bp, Homo sapiens
tgctgattttgaccttg

SEQ ID NO: 1917069 - DNA, 19 bp, Homo sapiens
tgctgattttgaccttgta

SEQ ID NO: 1917070 - DNA, 23 bp, Homo sapiens
tgctgattttgaccttgtattga

SEQ ID NO: 1917071 - DNA, 13 bp, Homo sapiens
tgctgccaggccc

SEQ ID NO: 1917072 - DNA, 15 bp, Homo sapiens
tgctgctgacccctg

SEQ ID NO: 1917073 - DNA, 19 bp, Homo sapiens
tgctggaactcttgacagc

SEQ ID NO: 1917074 - DNA, 15 bp, Homo sapiens
tgctggccggacacc

SEQ ID NO: 1917075 - DNA, 18 bp, Homo sapiens
tgctgggcccctgctcaa

SEQ ID NO: 1917076 - DNA, 17 bp, Homo sapiens
tgctggtaaaatgaaga

SEQ ID NO: 1917077 - DNA, 14 bp, Homo sapiens
tgctgtgaaaaaaa

SEQ ID NO: 1917078 - DNA, 22 bp, Homo sapiens
tgctgtgaaaaaaaaaatgctg

SEQ ID NO: 1917079 - DNA, 17 bp, Homo sapiens
tgctgttacagttttct

SEQ ID NO: 1917080 - DNA, 12 bp, Homo sapiens
tgcttgaataaa

SEQ ID NO: 1917081 - DNA, 15 bp, Homo sapiens
tgcttgaataaacac

SEQ ID NO: 1917082 - DNA, 15 bp, Homo sapiens
tgcttggcccagggg

SEQ ID NO: 1917083 - DNA, 15 bp, Homo sapiens
tgcttgtaactaaaa

SEQ ID NO: 1917084 - DNA, 19 bp, Homo sapiens
tgcttgtattttttaatgc

SEQ ID NO: 1917085 - DNA, 18 bp, Homo sapiens
tgctttagacttgaaaag

SEQ ID NO: 1917086 - DNA, 12 bp, Homo sapiens
tgctttcctttc

SEQ ID NO: 1917087 - DNA, 22 bp, Homo sapiens
tgctttctttcgtttgtttgtt

SEQ ID NO: 1917088 - DNA, 21 bp, Homo sapiens
tgctttggtcacttttagatg

SEQ ID NO: 1917089 - DNA, 13 bp, Homo sapiens
tggaaaggccagc

SEQ ID NO: 1917090 - DNA, 15 bp, Homo sapiens
tggaaaggccagcag

SEQ ID NO: 1917091 - DNA, 23 bp, Homo sapiens
tggaaaggccagcagccttccag

SEQ ID NO: 1917092 - DNA, 18 bp, Homo sapiens
tggaaatcaaatgtaaag

SEQ ID NO: 1917093 - DNA, 16 bp, Homo sapiens
tggaacccccagccca

SEQ ID NO: 1917094 - DNA, 17 bp, Homo sapiens
tggaacccccagcccag

SEQ ID NO: 1917095 - DNA, 12 bp, Homo sapiens
tggaactgctgc

SEQ ID NO: 1917096 - DNA, 20 bp, Homo sapiens
tggaactgctgctgacccct

SEQ ID NO: 1917097 - DNA, 18 bp, Homo sapiens
tggaagagaagagaaagg

SEQ ID NO: 1917098 - DNA, 23 bp, Homo sapiens
tggaagcacaccaatcttacttt

SEQ ID NO: 1917099 - DNA, 16 bp, Homo sapiens
tggaagcggtttgcat

SEQ ID NO: 1917100 - DNA, 17 bp, Homo sapiens
tggaagggactcccagg

SEQ ID NO: 1917101 - DNA, 19 bp, Homo sapiens
tggaagggactcccaggac

SEQ ID NO: 1917102 - DNA, 23 bp, Homo sapiens
tggaataaaaattccagaatgaa

SEQ ID NO: 1917103 - DNA, 21 bp, Homo sapiens
tggaataagccttcgaaaaga

SEQ ID NO: 1917104 - DNA, 16 bp, Homo sapiens
tggaccccatctgtga

SEQ ID NO: 1917105 - DNA, 20 bp, Homo sapiens
tggaccccatctgtgaataa

SEQ ID NO: 1917106 - DNA, 21 bp, Homo sapiens
tggaccccatctgtgaataag

SEQ ID NO: 1917107 - DNA, 13 bp, Homo sapiens
tggactctctgac

SEQ ID NO: 1917108 - DNA, 14 bp, Homo sapiens
tggactctctgaca

SEQ ID NO: 1917109 - DNA, 18 bp, Homo sapiens
tggagaatcacaggctgg

SEQ ID NO: 1917110 - DNA, 22 bp, Homo sapiens
tggagaatcacaggctgggctg

SEQ ID NO: 1917111 - DNA, 23 bp, Homo sapiens
tggagaatcacaggctgggctgg

SEQ ID NO: 1917112 - DNA, 22 bp, Homo sapiens
tggagaatgcaccatactcatg

SEQ ID NO: 1917113 - DNA, 13 bp, Homo sapiens
tggagctcaagcc

SEQ ID NO: 1917114 - DNA, 17 bp, Homo sapiens
tggaggaagaactgaaa

SEQ ID NO: 1917115 - DNA, 20 bp, Homo sapiens
tggaggaagaactgaaaggc

SEQ ID NO: 1917116 - DNA, 23 bp, Homo sapiens
tggaggacactaagaggaggcag

SEQ ID NO: 1917117 - DNA, 12 bp, Homo sapiens
tggagggcctgg

SEQ ID NO: 1917118 - DNA, 13 bp, Homo sapiens
tggagggcctggg

SEQ ID NO: 1917119 - DNA, 17 bp, Homo sapiens
tggagggcctgggcctg

SEQ ID NO: 1917120 - DNA, 18 bp, Homo sapiens
tggagggcctgggcctgg

SEQ ID NO: 1917121 - DNA, 14 bp, Homo sapiens
tggagtctgggctc

SEQ ID NO: 1917122 - DNA, 16 bp, Homo sapiens
tggagtgaatgaagtt

SEQ ID NO: 1917123 - DNA, 12 bp, Homo sapiens
tggagtgaccaa

SEQ ID NO: 1917124 - DNA, 19 bp, Homo sapiens
tggagttctcaaagacctg

SEQ ID NO: 1917125 - DNA, 17 bp, Homo sapiens
tggatattttcttaaaa

SEQ ID NO: 1917126 - DNA, 17 bp, Homo sapiens
tggatgtttttagttct

SEQ ID NO: 1917127 - DNA, 22 bp, Homo sapiens
tggatgtttttagttctgactt

SEQ ID NO: 1917128 - DNA, 13 bp, Homo sapiens
tggattcctcccc

SEQ ID NO: 1917129 - DNA, 18 bp, Homo sapiens
tggattcctccccaccct

SEQ ID NO: 1917130 - DNA, 19 bp, Homo sapiens
tggattgtagaacttgttg

SEQ ID NO: 1917131 - DNA, 18 bp, Homo sapiens
tggcaaatgcacacacct

SEQ ID NO: 1917132 - DNA, 16 bp, Homo sapiens
tggcaaatttgtgaac

SEQ ID NO: 1917133 - DNA, 17 bp, Homo sapiens
tggcaataaattttgaa

SEQ ID NO: 1917134 - DNA, 18 bp, Homo sapiens
tggcaatggtagtttctg

SEQ ID NO: 1917135 - DNA, 17 bp, Homo sapiens
tggcacagcctgcactt

SEQ ID NO: 1917136 - DNA, 16 bp, Homo sapiens
tggcaccagcaggcac

SEQ ID NO: 1917137 - DNA, 17 bp, Homo sapiens
tggcagcccgcatcagc

SEQ ID NO: 1917138 - DNA, 21 bp, Homo sapiens
tggcaggacactgcagaacag

SEQ ID NO: 1917139 - DNA, 13 bp, Homo sapiens
tggcagggcacag

SEQ ID NO: 1917140 - DNA, 16 bp, Homo sapiens
tggcagggcacagggc

SEQ ID NO: 1917141 - DNA, 19 bp, Homo sapiens
tggcagggcacagggcctg

SEQ ID NO: 1917142 - DNA, 20 bp, Homo sapiens
tggcagggcacagggcctgg

SEQ ID NO: 1917143 - DNA, 21 bp, Homo sapiens
tggcagggcacagggcctggc

SEQ ID NO: 1917144 - DNA, 19 bp, Homo sapiens
tggcagtggctgtgaagga

SEQ ID NO: 1917145 - DNA, 15 bp, Homo sapiens
tggcataatttttct

SEQ ID NO: 1917146 - DNA, 17 bp, Homo sapiens
gtaattgttgtttgtat

SEQ ID NO: 1917147 - DNA, 22 bp, Homo sapiens
gtacaaaaaattcagtgatgtg

SEQ ID NO: 1917148 - DNA, 11 bp, Homo sapiens
gtacacagagc

SEQ ID NO: 1917149 - DNA, 20 bp, Homo sapiens
gtacacagagctaaggccaa

SEQ ID NO: 1917150 - DNA, 16 bp, Homo sapiens
gtacacccatgaaaga

SEQ ID NO: 1917151 - DNA, 13 bp, Homo sapiens
gtacactgcctgc

SEQ ID NO: 1917152 - DNA, 19 bp, Homo sapiens
gtacataatactgaaccac

SEQ ID NO: 1917153 - DNA, 16 bp, Homo sapiens
gtacatatctttgagt

SEQ ID NO: 1917154 - DNA, 15 bp, Homo sapiens
gtaccttctgccaga

SEQ ID NO: 1917155 - DNA, 20 bp, Homo sapiens
gtactaaggatacaggctgg

SEQ ID NO: 1917156 - DNA, 20 bp, Homo sapiens
gtactagtggcatggagaat

SEQ ID NO: 1917157 - DNA, 19 bp, Homo sapiens
gtactccacatatttcagt

SEQ ID NO: 1917158 - DNA, 15 bp, Homo sapiens
gtactctctctcttt

SEQ ID NO: 1917159 - DNA, 16 bp, Homo sapiens
gtactgtctcggcaga

SEQ ID NO: 1917160 - DNA, 18 bp, Homo sapiens
gtactgtctcggcagagg

SEQ ID NO: 1917161 - DNA, 20 bp, Homo sapiens
gtactgtctcggcagaggtg

SEQ ID NO: 1917162 - DNA, 13 bp, Homo sapiens
gtactttctgaaa

SEQ ID NO: 1917163 - DNA, 18 bp, Homo sapiens
gtactttgttaaaaacac

SEQ ID NO: 1917164 - DNA, 20 bp, Homo sapiens
gtactttgttaaaaacactg

SEQ ID NO: 1917165 - DNA, 20 bp, Homo sapiens
gtagaacttgttgctgattt

SEQ ID NO: 1917166 - DNA, 15 bp, Homo sapiens
gtagaggtggcttca

SEQ ID NO: 1917167 - DNA, 16 bp, Homo sapiens
gtagatttatttcatc

SEQ ID NO: 1917168 - DNA, 23 bp, Homo sapiens
gtagcaaattttggacctaaaca

SEQ ID NO: 1917169 - DNA, 20 bp, Homo sapiens
gtagcacaggctgagtgcag

SEQ ID NO: 1917170 - DNA, 14 bp, Homo sapiens
gtagctcgtcctca

SEQ ID NO: 1917171 - DNA, 19 bp, Homo sapiens
gtaggatacttgctccatt

SEQ ID NO: 1917172 - DNA, 13 bp, Homo sapiens
gtaggggaagaat

SEQ ID NO: 1917173 - DNA, 16 bp, Homo sapiens
gtagttctaccggctt

SEQ ID NO: 1917174 - DNA, 17 bp, Homo sapiens
gtagttctgtatttgaa

SEQ ID NO: 1917175 - DNA, 20 bp, Homo sapiens
gtagtttgaatatttaagca

SEQ ID NO: 1917176 - DNA, 12 bp, Homo sapiens
gtataaaaacaa

SEQ ID NO: 1917177 - DNA, 13 bp, Homo sapiens
gtataaatttatt

SEQ ID NO: 1917178 - DNA, 12 bp, Homo sapiens
gtataataggct

SEQ ID NO: 1917179 - DNA, 23 bp, Homo sapiens
gtatatattcccctaagatttga

SEQ ID NO: 1917180 - DNA, 17 bp, Homo sapiens
gtatatatttttcttat

SEQ ID NO: 1917181 - DNA, 15 bp, Homo sapiens
gtatatgctgcattg

SEQ ID NO: 1917182 - DNA, 19 bp, Homo sapiens
gtatatttgatttattaac

SEQ ID NO: 1917183 - DNA, 19 bp, Homo sapiens
gtatatttttgatctttga

SEQ ID NO: 1917184 - DNA, 22 bp, Homo sapiens
gtatatttttgatctttgagtg

SEQ ID NO: 1917185 - DNA, 13 bp, Homo sapiens
gtatcaaatacat

SEQ ID NO: 1917186 - DNA, 17 bp, Homo sapiens
gtatctaaatttggaac

SEQ ID NO: 1917187 - DNA, 18 bp, Homo sapiens
gtatctgatatcagcact

SEQ ID NO: 1917188 - DNA, 12 bp, Homo sapiens
gtatctgtgaac

SEQ ID NO: 1917189 - DNA, 21 bp, Homo sapiens
gtatggctttatttttttgaa

SEQ ID NO: 1917190 - DNA, 11 bp, Homo sapiens
gtatgtataat

SEQ ID NO: 1917191 - DNA, 17 bp, Homo sapiens
gtattctatttgtgtaa

SEQ ID NO: 1917192 - DNA, 14 bp, Homo sapiens
gtattctcataata

SEQ ID NO: 1917193 - DNA, 15 bp, Homo sapiens
gtattgaagttaact

SEQ ID NO: 1917194 - DNA, 18 bp, Homo sapiens
gtattgattatataagca

SEQ ID NO: 1917195 - DNA, 13 bp, Homo sapiens
gtattgtcctatt

SEQ ID NO: 1917196 - DNA, 21 bp, Homo sapiens
gtattgtcctattagtgttat

SEQ ID NO: 1917197 - DNA, 17 bp, Homo sapiens
gtatttgaaagtgcctt

SEQ ID NO: 1917198 - DNA, 18 bp, Homo sapiens
gtatttgatgtattctgt

SEQ ID NO: 1917199 - DNA, 17 bp, Homo sapiens
gtattttagaataaaat

SEQ ID NO: 1917200 - DNA, 17 bp, Homo sapiens
gtatttttataatgact

SEQ ID NO: 1917201 - DNA, 18 bp, Homo sapiens
gtattttttaaaacatca

SEQ ID NO: 1917202 - DNA, 18 bp, Homo sapiens
gtcaatgaacaagcattc

SEQ ID NO: 1917203 - DNA, 22 bp, Homo sapiens
gtcactctaggactctgcactg

SEQ ID NO: 1917204 - DNA, 17 bp, Homo sapiens
gtcacttcgtggctaag

SEQ ID NO: 1917205 - DNA, 15 bp, Homo sapiens
gtcagatgtttaaaa

SEQ ID NO: 1917206 - DNA, 17 bp, Homo sapiens
gtcagatgtttaaaaca

SEQ ID NO: 1917207 - DNA, 18 bp, Homo sapiens
gtcagatgtttaaaacac

SEQ ID NO: 1917208 - DNA, 21 bp, Homo sapiens
gtcagcctccctgacgtctgc

SEQ ID NO: 1917209 - DNA, 17 bp, Homo sapiens
gtcagggtgtgaggcca

SEQ ID NO: 1917210 - DNA, 15 bp, Homo sapiens
gtcagggttggaaag

SEQ ID NO: 1917211 - DNA, 19 bp, Homo sapiens
gtcatactcgagtctgagg

SEQ ID NO: 1917212 - DNA, 21 bp, Homo sapiens
gtcattcgctactatgattta

SEQ ID NO: 1917213 - DNA, 14 bp, Homo sapiens
gtcattgtgtaagg

SEQ ID NO: 1917214 - DNA, 19 bp, Homo sapiens
gtccaagccgtaggaccca

SEQ ID NO: 1917215 - DNA, 20 bp, Homo sapiens
gtccaagccgtaggacccag

SEQ ID NO: 1917216 - DNA, 20 bp, Homo sapiens
gtccagaaggagcaggccct

SEQ ID NO: 1917217 - DNA, 21 bp, Homo sapiens
gtccagaaggagcaggccctg

SEQ ID NO: 1917218 - DNA, 21 bp, Homo sapiens
gtccaggcatgttggactctg

SEQ ID NO: 1917219 - DNA, 22 bp, Homo sapiens
gtccaggtggaggtggcatccc

SEQ ID NO: 1917220 - DNA, 19 bp, Homo sapiens
gtccagtaagatcactgtt

SEQ ID NO: 1917221 - DNA, 23 bp, Homo sapiens
gtccagtaagatcactgtttaga

SEQ ID NO: 1917222 - DNA, 13 bp, Homo sapiens
gtccatctctgaa

SEQ ID NO: 1917223 - DNA, 18 bp, Homo sapiens
gtccatctctgaaaacaa

SEQ ID NO: 1917224 - DNA, 15 bp, Homo sapiens
gtcccaagtctgaca

SEQ ID NO: 1917225 - DNA, 11 bp, Homo sapiens
gtcccagcagc

SEQ ID NO: 1917226 - DNA, 16 bp, Homo sapiens
gtcccagcagccagcc

SEQ ID NO: 1917227 - DNA, 15 bp, Homo sapiens
gtcccaggcagcgcc

SEQ ID NO: 1917228 - DNA, 12 bp, Homo sapiens
gtcccagggccc

SEQ ID NO: 1917229 - DNA, 13 bp, Homo sapiens
gtccctctgcaga

SEQ ID NO: 1917230 - DNA, 23 bp, Homo sapiens
gtccctttcgacttgcatttttg

SEQ ID NO: 1917231 - DNA, 13 bp, Homo sapiens
gtcctaatggtga

SEQ ID NO: 1917232 - DNA, 17 bp, Homo sapiens
gtcctattagtgttata

SEQ ID NO: 1917233 - DNA, 20 bp, Homo sapiens
gtccttgaagcttgtatctg

SEQ ID NO: 1917234 - DNA, 22 bp, Homo sapiens
gtccttgaagcttgtatctgat

SEQ ID NO: 1917235 - DNA, 13 bp, Homo sapiens
gtcggggcaggcc

SEQ ID NO: 1917236 - DNA, 15 bp, Homo sapiens
gtcgtagttactctc

SEQ ID NO: 1917237 - DNA, 13 bp, Homo sapiens
gtcgtcagcctcc

SEQ ID NO: 1917238 - DNA, 17 bp, Homo sapiens
gtctagattttgaaaaa

SEQ ID NO: 1917239 - DNA, 21 bp, Homo sapiens
gtctatgacttatttccttca

SEQ ID NO: 1917240 - DNA, 19 bp, Homo sapiens
gtctcaagtgcaatgcccc

SEQ ID NO: 1917241 - DNA, 22 bp, Homo sapiens
gtctcaagtgcaatgccccctc

SEQ ID NO: 1917242 - DNA, 23 bp, Homo sapiens
gtctcaccatttccccagggcac

SEQ ID NO: 1917243 - DNA, 21 bp, Homo sapiens
gttgagggcatttggcttcct

SEQ ID NO: 1917244 - DNA, 12 bp, Homo sapiens
gttgctggtaaa

SEQ ID NO: 1917245 - DNA, 14 bp, Homo sapiens
gttgctggtacaca

SEQ ID NO: 1917246 - DNA, 15 bp, Homo sapiens
gttgctggtacacac

SEQ ID NO: 1917247 - DNA, 13 bp, Homo sapiens
gttggccaggctg

SEQ ID NO: 1917248 - DNA, 13 bp, Homo sapiens
gttggcctctgca

SEQ ID NO: 1917249 - DNA, 23 bp, Homo sapiens
gttgggacccagtggcagggcac

SEQ ID NO: 1917250 - DNA, 21 bp, Homo sapiens
gttggggggggtggggcagtg

SEQ ID NO: 1917251 - DNA, 16 bp, Homo sapiens
gttgtataaatttatt

SEQ ID NO: 1917252 - DNA, 17 bp, Homo sapiens
gttgtataaatttattt

SEQ ID NO: 1917253 - DNA, 13 bp, Homo sapiens
gttgtcaataaat

SEQ ID NO: 1917254 - DNA, 22 bp, Homo sapiens
gttgtgatgaagctgaggctgc

SEQ ID NO: 1917255 - DNA, 17 bp, Homo sapiens
gttgtttgtatgtataa

SEQ ID NO: 1917256 - DNA, 23 bp, Homo sapiens
gtttaaggaatatgggagaaata

SEQ ID NO: 1917257 - DNA, 15 bp, Homo sapiens
gtttaaggttaatta

SEQ ID NO: 1917258 - DNA, 18 bp, Homo sapiens
gtttaataccctgtacat

SEQ ID NO: 1917259 - DNA, 23 bp, Homo sapiens
gtttaattgaaagaatgtaaagc

SEQ ID NO: 1917260 - DNA, 21 bp, Homo sapiens
gtttacctaaaagctacagaa

SEQ ID NO: 1917261 - DNA, 16 bp, Homo sapiens
gtttactcacagccag

SEQ ID NO: 1917262 - DNA, 21 bp, Homo sapiens
gtttatcagaaagggcagaag

SEQ ID NO: 1917263 - DNA, 22 bp, Homo sapiens
gtttcaccatgttggccaggct

SEQ ID NO: 1917264 - DNA, 11 bp, Homo sapiens
gtttcagacca

SEQ ID NO: 1917265 - DNA, 12 bp, Homo sapiens
gtttcagggctg

SEQ ID NO: 1917266 - DNA, 19 bp, Homo sapiens
gtttcaggtagaggtgcat

SEQ ID NO: 1917267 - DNA, 16 bp, Homo sapiens
gtttccctatctgcaa

SEQ ID NO: 1917268 - DNA, 13 bp, Homo sapiens
gtttccttccctc

SEQ ID NO: 1917269 - DNA, 17 bp, Homo sapiens
gtttctgtcgttaaaaa

SEQ ID NO: 1917270 - DNA, 20 bp, Homo sapiens
gtttctttctctgaggacaa

SEQ ID NO: 1917271 - DNA, 17 bp, Homo sapiens
gtttgcagtgttaagat

SEQ ID NO: 1917272 - DNA, 20 bp, Homo sapiens
gtttgccactttgcaaagga

SEQ ID NO: 1917273 - DNA, 22 bp, Homo sapiens
gtttgctgaaagatatgtatat

SEQ ID NO: 1917274 - DNA, 14 bp, Homo sapiens
gttttagaattaca

SEQ ID NO: 1917275 - DNA, 23 bp, Homo sapiens
gttttaggtggcatagtggctta

SEQ ID NO: 1917276 - DNA, 18 bp, Homo sapiens
gttttatttatatttatt

SEQ ID NO: 1917277 - DNA, 22 bp, Homo sapiens
gttttatttatatttattgact

SEQ ID NO: 1917278 - DNA, 15 bp, Homo sapiens
gttttctatgaatct

SEQ ID NO: 1917279 - DNA, 21 bp, Homo sapiens
gttttcttgataattttcctt

SEQ ID NO: 1917280 - DNA, 15 bp, Homo sapiens
gtttttcttctgaaa

SEQ ID NO: 1917281 - DNA, 19 bp, Homo sapiens
gtttttgaaggcagaaagc

SEQ ID NO: 1917282 - DNA, 18 bp, Homo sapiens
gttttttgtttttctgct

SEQ ID NO: 1917283 - DNA, 11 bp, Homo sapiens
taaaaaaaaga

SEQ ID NO: 1917284 - DNA, 12 bp, Homo sapiens
taaaaaaaagaa

SEQ ID NO: 1917285 - DNA, 14 bp, Homo sapiens
taaaaaaaagaaaa

SEQ ID NO: 1917286 - DNA, 16 bp, Homo sapiens
taaaaaaaagaaaaaa

SEQ ID NO: 1917287 - DNA, 14 bp, Homo sapiens
taaaaaatgacaaa

SEQ ID NO: 1917288 - DNA, 23 bp, Homo sapiens
taaaaatagaaaaaaagaaatta

SEQ ID NO: 1917289 - DNA, 23 bp, Homo sapiens
taaaaatatcaaattaattgtgt

SEQ ID NO: 1917290 - DNA, 16 bp, Homo sapiens
taaaaatctctcattt

SEQ ID NO: 1917291 - DNA, 14 bp, Homo sapiens
taaaaatctgccac

SEQ ID NO: 1917292 - DNA, 13 bp, Homo sapiens
taaaaatgtcttt

SEQ ID NO: 1917293 - DNA, 16 bp, Homo sapiens
taaaaattccagaatg

SEQ ID NO: 1917294 - DNA, 19 bp, Homo sapiens
taaaaattccagaatgaag

SEQ ID NO: 1917295 - DNA, 19 bp, Homo sapiens
taaaacatcaattgatatt

SEQ ID NO: 1917296 - DNA, 16 bp, Homo sapiens
taaaacatcattcctt

SEQ ID NO: 1917297 - DNA, 17 bp, Homo sapiens
taaaacatcattccttt

SEQ ID NO: 1917298 - DNA, 12 bp, Homo sapiens
taaaacattaaa

SEQ ID NO: 1917299 - DNA, 14 bp, Homo sapiens
taaaactcacctcc

SEQ ID NO: 1917300 - DNA, 23 bp, Homo sapiens
taaaactttgtagacattttgaa

SEQ ID NO: 1917301 - DNA, 18 bp, Homo sapiens
taaaagaacagtaaacat

SEQ ID NO: 1917302 - DNA, 15 bp, Homo sapiens
taaaagcccaggagc

SEQ ID NO: 1917303 - DNA, 16 bp, Homo sapiens
taaaagcccaggagcc

SEQ ID NO: 1917304 - DNA, 15 bp, Homo sapiens
taaaagcctttgaaa

SEQ ID NO: 1917305 - DNA, 14 bp, Homo sapiens
taaaagttaagatc

SEQ ID NO: 1917306 - DNA, 15 bp, Homo sapiens
taaaataattttgta

SEQ ID NO: 1917307 - DNA, 15 bp, Homo sapiens
taaaatgaagaattt

SEQ ID NO: 1917308 - DNA, 19 bp, Homo sapiens
taaaatggcaagttttcca

SEQ ID NO: 1917309 - DNA, 21 bp, Homo sapiens
taaaatgtccagtaagatcac

SEQ ID NO: 1917310 - DNA, 22 bp, Homo sapiens
taaaatgtccagtaagatcact

SEQ ID NO: 1917311 - DNA, 21 bp, Homo sapiens
taaaattatcacctttgtcag

SEQ ID NO: 1917312 - DNA, 22 bp, Homo sapiens
taaacaccttatccctaacatg

SEQ ID NO: 1917313 - DNA, 14 bp, Homo sapiens
taaagaaaaaaatg

SEQ ID NO: 1917314 - DNA, 16 bp, Homo sapiens
taaagaaaaaaatgtc

SEQ ID NO: 1917315 - DNA, 14 bp, Homo sapiens
taaagaatttgtca

SEQ ID NO: 1917316 - DNA, 15 bp, Homo sapiens
taaagacaaagacat

SEQ ID NO: 1917317 - DNA, 15 bp, Homo sapiens
taaagagaaccatgt

SEQ ID NO: 1917318 - DNA, 21 bp, Homo sapiens
taaagcaaccaaaaagaaaaa

SEQ ID NO: 1917319 - DNA, 11 bp, Homo sapiens
taaagcctcaa

SEQ ID NO: 1917320 - DNA, 23 bp, Homo sapiens
taaaggaatctagccagtgaaca

SEQ ID NO: 1917321 - DNA, 23 bp, Homo sapiens
taaaggcctctgcctcacaacat

SEQ ID NO: 1917322 - DNA, 14 bp, Homo sapiens
taaagtatttttat

SEQ ID NO: 1917323 - DNA, 18 bp, Homo sapiens
taaagtatttttataatg

SEQ ID NO: 1917324 - DNA, 14 bp, Homo sapiens
taaagtgaacagat

SEQ ID NO: 1917325 - DNA, 20 bp, Homo sapiens
taaagtgaacagattttatt

SEQ ID NO: 1917326 - DNA, 13 bp, Homo sapiens
taaagtgtggaaa

SEQ ID NO: 1917327 - DNA, 12 bp, Homo sapiens
taaataattctt

SEQ ID NO: 1917328 - DNA, 19 bp, Homo sapiens
taaatatgtagataatgga

SEQ ID NO: 1917329 - DNA, 20 bp, Homo sapiens
taaatattgttttgcattgt

SEQ ID NO: 1917330 - DNA, 22 bp, Homo sapiens
taaatattgttttgcattgtct

SEQ ID NO: 1917331 - DNA, 19 bp, Homo sapiens
taaatgcaaccatttgaaa

SEQ ID NO: 1917332 - DNA, 17 bp, Homo sapiens
taaatgctcctagagta

SEQ ID NO: 1917333 - DNA, 22 bp, Homo sapiens
taaatggcccggacatgtcttg

SEQ ID NO: 1917334 - DNA, 12 bp, Homo sapiens
taaatgtaaagt

SEQ ID NO: 1917335 - DNA, 17 bp, Homo sapiens
taaatgtattcattctt

SEQ ID NO: 1917336 - DNA, 17 bp, Homo sapiens
taaatgtcaaatgtgaa

SEQ ID NO: 1917337 - DNA, 12 bp, Homo sapiens
taaattctgatt

SEQ ID NO: 1917338 - DNA, 14 bp, Homo sapiens
taaattctgatttc

SEQ ID NO: 1917339 - DNA, 23 bp, Homo sapiens
taaattggggtttatttcagcaa

SEQ ID NO: 1917340 - DNA, 20 bp, Homo sapiens
taaattgtattctcataata

SEQ ID NO: 1917341 - DNA, 14 bp, Homo sapiens
taaatttatttact

SEQ ID NO: 1917342 - DNA, 17 bp, Homo sapiens
taaatttttttgtatga

SEQ ID NO: 1917343 - DNA, 18 bp, Homo sapiens
taaatttttttgtatgaa

SEQ ID NO: 1917344 - DNA, 21 bp, Homo sapiens
taacaaagtttgctgaaagat

SEQ ID NO: 1917345 - DNA, 21 bp, Homo sapiens
taaccatggtgattaaaatga

SEQ ID NO: 1917346 - DNA, 12 bp, Homo sapiens
taactaaaataa

SEQ ID NO: 1917347 - DNA, 19 bp, Homo sapiens
taactaaaataattttgta

SEQ ID NO: 1917348 - DNA, 15 bp, Homo sapiens
taactgcagaaaaaa

SEQ ID NO: 1917349 - DNA, 15 bp, Homo sapiens
taactgttccccttg

SEQ ID NO: 1917350 - DNA, 19 bp, Homo sapiens
taacttatattgtaagaaa

SEQ ID NO: 1917351 - DNA, 21 bp, Homo sapiens
taacttatattgtaagaaata

SEQ ID NO: 1917352 - DNA, 13 bp, Homo sapiens
taagaagaaacta

SEQ ID NO: 1917353 - DNA, 17 bp, Homo sapiens
taagaagtggtgacatt

SEQ ID NO: 1917354 - DNA, 17 bp, Homo sapiens
taagataattgtacttt

SEQ ID NO: 1917355 - DNA, 19 bp, Homo sapiens
taagataattgtactttga

SEQ ID NO: 1917356 - DNA, 12 bp, Homo sapiens
taagatcactgt

SEQ ID NO: 1917357 - DNA, 13 bp, Homo sapiens
taagatcactgtt

SEQ ID NO: 1917358 - DNA, 21 bp, Homo sapiens
taagatcactgtttagatttg

SEQ ID NO: 1917359 - DNA, 21 bp, Homo sapiens
taagatcccagtgtgaagtat

SEQ ID NO: 1917360 - DNA, 20 bp, Homo sapiens
taagatttgatatatgtatc

SEQ ID NO: 1917361 - DNA, 15 bp, Homo sapiens
taagcaataaaactg

SEQ ID NO: 1917362 - DNA, 16 bp, Homo sapiens
taagcaggcgcaaggg

SEQ ID NO: 1917363 - DNA, 16 bp, Homo sapiens
taagcgtatggcttta

SEQ ID NO: 1917364 - DNA, 18 bp, Homo sapiens
taagctagttgaatactt

SEQ ID NO: 1917365 - DNA, 22 bp, Homo sapiens
taagctagttgaatacttgaac

SEQ ID NO: 1917366 - DNA, 19 bp, Homo sapiens
taagctggtttacagatgt

SEQ ID NO: 1917367 - DNA, 21 bp, Homo sapiens
taagctggtttacagatgttt

SEQ ID NO: 1917368 - DNA, 18 bp, Homo sapiens
taaggactgactgaggca

SEQ ID NO: 1917369 - DNA, 12 bp, Homo sapiens
taaggactttgg

SEQ ID NO: 1917370 - DNA, 16 bp, Homo sapiens
taaggatacaggctgg

SEQ ID NO: 1917371 - DNA, 16 bp, Homo sapiens
taaggtggaaagtgtt

SEQ ID NO: 1917372 - DNA, 16 bp, Homo sapiens
taaggtgtttgaaaat

SEQ ID NO: 1917373 - DNA, 18 bp, Homo sapiens
taaggtgtttgaaaatag

SEQ ID NO: 1917374 - DNA, 20 bp, Homo sapiens
taaggtgtttgaaaatagtt

SEQ ID NO: 1917375 - DNA, 16 bp, Homo sapiens
taaggttaattatggt

SEQ ID NO: 1917376 - DNA, 20 bp, Homo sapiens
taagtattttcctgttgtca

SEQ ID NO: 1917377 - DNA, 14 bp, Homo sapiens
taagtcataatgaa

SEQ ID NO: 1917378 - DNA, 16 bp, Homo sapiens
taagtctcaaggtagg

SEQ ID NO: 1917379 - DNA, 15 bp, Homo sapiens
taagtgtgaccagtt

SEQ ID NO: 1917380 - DNA, 19 bp, Homo sapiens
taagttagttccactgaga

SEQ ID NO: 1917381 - DNA, 14 bp, Homo sapiens
taataaagactcta

SEQ ID NO: 1917382 - DNA, 17 bp, Homo sapiens
taataagctagttgaat

SEQ ID NO: 1917383 - DNA, 23 bp, Homo sapiens
taataagctagttgaatacttga

SEQ ID NO: 1917384 - DNA, 22 bp, Homo sapiens
taataatcaagagccttaaaac

SEQ ID NO: 1917385 - DNA, 14 bp, Homo sapiens
taataatgaagtgt

SEQ ID NO: 1917386 - DNA, 20 bp, Homo sapiens
taataccctgtacatatctt

SEQ ID NO: 1917387 - DNA, 19 bp, Homo sapiens
taatactgaaccacttgta

SEQ ID NO: 1917388 - DNA, 20 bp, Homo sapiens
taatagtatccagcacagat

SEQ ID NO: 1917389 - DNA, 19 bp, Homo sapiens
taatagtcttgcagaaaat

SEQ ID NO: 1917390 - DNA, 12 bp, Homo sapiens
taatcaaatatg

SEQ ID NO: 1917391 - DNA, 14 bp, Homo sapiens
taatcaagagcctt

SEQ ID NO: 1917392 - DNA, 19 bp, Homo sapiens
taatcaagagccttaaaac

SEQ ID NO: 1917393 - DNA, 12 bp, Homo sapiens
taatcactgtgt

SEQ ID NO: 1917394 - DNA, 14 bp, Homo sapiens
taatcactgtgtat

SEQ ID NO: 1917395 - DNA, 22 bp, Homo sapiens
taatcactgtgtatatttgatt

SEQ ID NO: 1917396 - DNA, 19 bp, Homo sapiens
taatcatggctcttagaaa

SEQ ID NO: 1917397 - DNA, 13 bp, Homo sapiens
taatcctgaattc

SEQ ID NO: 1917398 - DNA, 16 bp, Homo sapiens
taatcttgtgaaaata

SEQ ID NO: 1917399 - DNA, 19 bp, Homo sapiens
taatcttgtgaaaataatt

SEQ ID NO: 1917400 - DNA, 18 bp, Homo sapiens
taatctttaactgaactc

SEQ ID NO: 1917401 - DNA, 16 bp, Homo sapiens
taatgaataaagtgca

SEQ ID NO: 1917402 - DNA, 22 bp, Homo sapiens
taatggagaattaaaactttgt

SEQ ID NO: 1917403 - DNA, 19 bp, Homo sapiens
taatgtatcaaatacattt

SEQ ID NO: 1917404 - DNA, 22 bp, Homo sapiens
taatgtatttgatgtattctgt

SEQ ID NO: 1917405 - DNA, 17 bp, Homo sapiens
taatgtctagattttga

SEQ ID NO: 1917406 - DNA, 18 bp, Homo sapiens
taatgtctagattttgaa

SEQ ID NO: 1917407 - DNA, 21 bp, Homo sapiens
taatgtctagattttgaaaaa

SEQ ID NO: 1917408 - DNA, 22 bp, Homo sapiens
taatgtctagattttgaaaaat

SEQ ID NO: 1917409 - DNA, 19 bp, Homo sapiens
taattcaaagcaccaaaat

SEQ ID NO: 1917410 - DNA, 18 bp, Homo sapiens
taattcagaaatccttgt

SEQ ID NO: 1917411 - DNA, 17 bp, Homo sapiens
taattcttttttattaa

SEQ ID NO: 1917412 - DNA, 17 bp, Homo sapiens
taattgaaagaatgtaa

SEQ ID NO: 1917413 - DNA, 17 bp, Homo sapiens
taattgagaatagaaat

SEQ ID NO: 1917414 - DNA, 20 bp, Homo sapiens
taattgatgatgttgtaaaa

SEQ ID NO: 1917415 - DNA, 14 bp, Homo sapiens
taattgcacaacag

SEQ ID NO: 1917416 - DNA, 14 bp, Homo sapiens
taattgtactttga

SEQ ID NO: 1917417 - DNA, 18 bp, Homo sapiens
taattgtactttgaaaac

SEQ ID NO: 1917418 - DNA, 12 bp, Homo sapiens
taattgtgtgaa

SEQ ID NO: 1917419 - DNA, 20 bp, Homo sapiens
taattgtgtgaacttggaag

SEQ ID NO: 1917420 - DNA, 21 bp, Homo sapiens
taattgtgtgaacttggaagc

SEQ ID NO: 1917421 - DNA, 19 bp, Homo sapiens
taattgttgtttgtatgta

SEQ ID NO: 1917422 - DNA, 23 bp, Homo sapiens
taattgttgtttgtatgtataat

SEQ ID NO: 1917423 - DNA, 18 bp, Homo sapiens
taattttgatagtgggac

SEQ ID NO: 1917424 - DNA, 12 bp, Homo sapiens
taattttgtaat

SEQ ID NO: 1917425 - DNA, 20 bp, Homo sapiens
taattttgtgtaagaaatac

SEQ ID NO: 1917426 - DNA, 23 bp, Homo sapiens
tacaaaactattaagtatgtcaa

SEQ ID NO: 1917427 - DNA, 14 bp, Homo sapiens
gggaaggcaatttc

SEQ ID NO: 1917428 - DNA, 22 bp, Homo sapiens
gggacatcctgtcatctgagaa

SEQ ID NO: 1917429 - DNA, 13 bp, Homo sapiens
gggaccacagagg

SEQ ID NO: 1917430 - DNA, 15 bp, Homo sapiens
gggacccagtggcag

SEQ ID NO: 1917431 - DNA, 20 bp, Homo sapiens
gggaccctccaaggccaggc

SEQ ID NO: 1917432 - DNA, 14 bp, Homo sapiens
gggacctcgggctg

SEQ ID NO: 1917433 - DNA, 10 bp, Homo sapiens
gggactctgc

SEQ ID NO: 1917434 - DNA, 19 bp, Homo sapiens
gggactctgtctggccagg

SEQ ID NO: 1917435 - DNA, 22 bp, Homo sapiens
gggactctgtctggccagggag

SEQ ID NO: 1917436 - DNA, 18 bp, Homo sapiens
gggactgccacctcccct

SEQ ID NO: 1917437 - DNA, 22 bp, Homo sapiens
gggactgccacctccccttgcc

SEQ ID NO: 1917438 - DNA, 12 bp, Homo sapiens
gggactgctgtg

SEQ ID NO: 1917439 - DNA, 22 bp, Homo sapiens
gggactgctgtgaacatgcctc

SEQ ID NO: 1917440 - DNA, 16 bp, Homo sapiens
gggacttgtcccaagt

SEQ ID NO: 1917441 - DNA, 16 bp, Homo sapiens
gggagagaaatcttaa

SEQ ID NO: 1917442 - DNA, 23 bp, Homo sapiens
gggaggccaagagtggccccacc

SEQ ID NO: 1917443 - DNA, 16 bp, Homo sapiens
gggaggtcccagggcc

SEQ ID NO: 1917444 - DNA, 20 bp, Homo sapiens
gggaggtcccagggccctag

SEQ ID NO: 1917445 - DNA, 13 bp, Homo sapiens
gggagtttggtca

SEQ ID NO: 1917446 - DNA, 17 bp, Homo sapiens
gggatgattgaagaaac

SEQ ID NO: 1917447 - DNA, 14 bp, Homo sapiens
gggatggcagtggc

SEQ ID NO: 1917448 - DNA, 17 bp, Homo sapiens
gggatggcagtggctgt

SEQ ID NO: 1917449 - DNA, 18 bp, Homo sapiens
gggatggcagtggctgtg

SEQ ID NO: 1917450 - DNA, 13 bp, Homo sapiens
gggcaatggaaat

SEQ ID NO: 1917451 - DNA, 13 bp, Homo sapiens
gggcacagggcct

SEQ ID NO: 1917452 - DNA, 18 bp, Homo sapiens
gggcacagggcctggccc

SEQ ID NO: 1917453 - DNA, 17 bp, Homo sapiens
gggcagcttgggctggc

SEQ ID NO: 1917454 - DNA, 19 bp, Homo sapiens
gggcagcttgggctggcgg

SEQ ID NO: 1917455 - DNA, 21 bp, Homo sapiens
gggcaggaccagcccacgctg

SEQ ID NO: 1917456 - DNA, 13 bp, Homo sapiens
gggcaggccaggg

SEQ ID NO: 1917457 - DNA, 15 bp, Homo sapiens
gggccaagcaggcac

SEQ ID NO: 1917458 - DNA, 12 bp, Homo sapiens
gggccagagcct

SEQ ID NO: 1917459 - DNA, 16 bp, Homo sapiens
gggccagagccttgga

SEQ ID NO: 1917460 - DNA, 21 bp, Homo sapiens
gggccagcggccctcccaggc

SEQ ID NO: 1917461 - DNA, 22 bp, Homo sapiens
gggccagcggccctcccaggcg

SEQ ID NO: 1917462 - DNA, 23 bp, Homo sapiens
gggcccccagcgagagtccctgc

SEQ ID NO: 1917463 - DNA, 14 bp, Homo sapiens
gggcctccacctct

SEQ ID NO: 1917464 - DNA, 15 bp, Homo sapiens
gggcctccacctctg

SEQ ID NO: 1917465 - DNA, 16 bp, Homo sapiens
gggcctccacctctgt

SEQ ID NO: 1917466 - DNA, 9 bp, Homo sapiens
gggcctccc

SEQ ID NO: 1917467 - DNA, 15 bp, Homo sapiens
gggcctcccactccc

SEQ ID NO: 1917468 - DNA, 17 bp, Homo sapiens
gggcctggctccctcac

SEQ ID NO: 1917469 - DNA, 19 bp, Homo sapiens
gggctcagcaaggccacct

SEQ ID NO: 1917470 - DNA, 13 bp, Homo sapiens
gggctcccgcctc

SEQ ID NO: 1917471 - DNA, 20 bp, Homo sapiens
gggctgcagggctgggtcag

SEQ ID NO: 1917472 - DNA, 18 bp, Homo sapiens
gggctggcaccagcaggc

SEQ ID NO: 1917473 - DNA, 17 bp, Homo sapiens
gggctgggggctgcagg

SEQ ID NO: 1917474 - DNA, 18 bp, Homo sapiens
gggcttcctgaggggaga

SEQ ID NO: 1917475 - DNA, 16 bp, Homo sapiens
ggggaccacagaggct

SEQ ID NO: 1917476 - DNA, 17 bp, Homo sapiens
ggggactccttccttga

SEQ ID NO: 1917477 - DNA, 14 bp, Homo sapiens
ggggactgccacct

SEQ ID NO: 1917478 - DNA, 17 bp, Homo sapiens
ggggactgccacctccc

SEQ ID NO: 1917479 - DNA, 19 bp, Homo sapiens
ggggaggagtggattcctc

SEQ ID NO: 1917480 - DNA, 13 bp, Homo sapiens
ggggcagcagggg

SEQ ID NO: 1917481 - DNA, 21 bp, Homo sapiens
ggggccagagccttggaggac

SEQ ID NO: 1917482 - DNA, 18 bp, Homo sapiens
ggggccagcggccctccc

SEQ ID NO: 1917483 - DNA, 18 bp, Homo sapiens
ggggctggcaccagcagg

SEQ ID NO: 1917484 - DNA, 17 bp, Homo sapiens
ggggctgggggctgcag

SEQ ID NO: 1917485 - DNA, 19 bp, Homo sapiens
ggggctgggggctgcaggg

SEQ ID NO: 1917486 - DNA, 20 bp, Homo sapiens
gggggaacgcccacttccct

SEQ ID NO: 1917487 - DNA, 22 bp, Homo sapiens
gggggaggagtggattcctccc

SEQ ID NO: 1917488 - DNA, 20 bp, Homo sapiens
gggggctcagcaaggccacc

SEQ ID NO: 1917489 - DNA, 15 bp, Homo sapiens
gggggctgcagggct

SEQ ID NO: 1917490 - DNA, 15 bp, Homo sapiens
ggggtctctcacaga

SEQ ID NO: 1917491 - DNA, 17 bp, Homo sapiens
ggggtctctcacagaca

SEQ ID NO: 1917492 - DNA, 19 bp, Homo sapiens
ggggttccagcacaaagtt

SEQ ID NO: 1917493 - DNA, 23 bp, Homo sapiens
gggtacacagagctaaggccaat

SEQ ID NO: 1917494 - DNA, 22 bp, Homo sapiens
gggtactttctgaaaatttata

SEQ ID NO: 1917495 - DNA, 13 bp, Homo sapiens
gggtccaggcatg

SEQ ID NO: 1917496 - DNA, 15 bp, Homo sapiens
gggtctctagtgctg

SEQ ID NO: 1917497 - DNA, 18 bp, Homo sapiens
gggtctctcacagacagg

SEQ ID NO: 1917498 - DNA, 22 bp, Homo sapiens
gggtctctcacagacaggaccc

SEQ ID NO: 1917499 - DNA, 17 bp, Homo sapiens
ggtactgtctcggcaga

SEQ ID NO: 1917500 - DNA, 12 bp, Homo sapiens
ggtactttctga

SEQ ID NO: 1917501 - DNA, 12 bp, Homo sapiens
ggtagctgtaag

SEQ ID NO: 1917502 - DNA, 16 bp, Homo sapiens
ggtagtcggagccccc

SEQ ID NO: 1917503 - DNA, 13 bp, Homo sapiens
ggtagtttctgtg

SEQ ID NO: 1917504 - DNA, 15 bp, Homo sapiens
ggtcactgggggaca

SEQ ID NO: 1917505 - DNA, 18 bp, Homo sapiens
ggtcagggtgtgaggcca

SEQ ID NO: 1917506 - DNA, 22 bp, Homo sapiens
ggtccaggcatgttggactctg

SEQ ID NO: 1917507 - DNA, 14 bp, Homo sapiens
ggtccatctctgaa

SEQ ID NO: 1917508 - DNA, 15 bp, Homo sapiens
ggtccatctctgaaa

SEQ ID NO: 1917509 - DNA, 14 bp, Homo sapiens
ggtcccagggccct

SEQ ID NO: 1917510 - DNA, 19 bp, Homo sapiens
ggtcccagttgctgtcaca

SEQ ID NO: 1917511 - DNA, 18 bp, Homo sapiens
ggtcgcttgggaatttta

SEQ ID NO: 1917512 - DNA, 23 bp, Homo sapiens
ggtctgatgttggaatctgctcc

SEQ ID NO: 1917513 - DNA, 19 bp, Homo sapiens
ggtctgggtttggcaggca

SEQ ID NO: 1917514 - DNA, 19 bp, Homo sapiens
ggtcttccttacctggaaa

SEQ ID NO: 1917515 - DNA, 19 bp, Homo sapiens
ggtgacctcacacacctct

SEQ ID NO: 1917516 - DNA, 19 bp, Homo sapiens
ggtgccggaaagagagctg

SEQ ID NO: 1917517 - DNA, 20 bp, Homo sapiens
ggtgccggaaagagagctgg

SEQ ID NO: 1917518 - DNA, 23 bp, Homo sapiens
ggtgccggaaagagagctggagt

SEQ ID NO: 1917519 - DNA, 21 bp, Homo sapiens
ggtggccccttctatgcccag

SEQ ID NO: 1917520 - DNA, 15 bp, Homo sapiens
ggtgggttaattaaa

SEQ ID NO: 1917521 - DNA, 17 bp, Homo sapiens
ggtggtttacctgcacc

SEQ ID NO: 1917522 - DNA, 23 bp, Homo sapiens
ggtgtctgtgttccaaccactga

SEQ ID NO: 1917523 - DNA, 13 bp, Homo sapiens
ggtgtgagcagca

SEQ ID NO: 1917524 - DNA, 15 bp, Homo sapiens
ggtgtgggggccccg

SEQ ID NO: 1917525 - DNA, 16 bp, Homo sapiens
ggtgtgtgcagggctg

SEQ ID NO: 1917526 - DNA, 13 bp, Homo sapiens
ggtgtttgaaaat

SEQ ID NO: 1917527 - DNA, 14 bp, Homo sapiens
ggtgtttgaaaata

SEQ ID NO: 1917528 - DNA, 13 bp, Homo sapiens
ggttaagggactt

SEQ ID NO: 1917529 - DNA, 13 bp, Homo sapiens
ggttaattgagaa

SEQ ID NO: 1917530 - DNA, 23 bp, Homo sapiens
ggttattttgatgtaaagatgtt

SEQ ID NO: 1917531 - DNA, 13 bp, Homo sapiens
ggttcaaatgtgt

SEQ ID NO: 1917532 - DNA, 13 bp, Homo sapiens
ggctgtgaaggag

SEQ ID NO: 1917533 - DNA, 16 bp, Homo sapiens
ggctgtggtcagagag

SEQ ID NO: 1917534 - DNA, 19 bp, Homo sapiens
ggctgtggtcagagaggga

SEQ ID NO: 1917535 - DNA, 19 bp, Homo sapiens
ggctgttctggtggcccct

SEQ ID NO: 1917536 - DNA, 23 bp, Homo sapiens
ggcttaactggactgaattcaaa

SEQ ID NO: 1917537 - DNA, 14 bp, Homo sapiens
ggcttataaaacag

SEQ ID NO: 1917538 - DNA, 13 bp, Homo sapiens
ggcttatattcta

SEQ ID NO: 1917539 - DNA, 12 bp, Homo sapiens
ggcttcctctgc

SEQ ID NO: 1917540 - DNA, 15 bp, Homo sapiens
ggcttcctctgctgc

SEQ ID NO: 1917541 - DNA, 20 bp, Homo sapiens
ggcttcctgaggggagacag

SEQ ID NO: 1917542 - DNA, 16 bp, Homo sapiens
ggcttctgtgcccaga

SEQ ID NO: 1917543 - DNA, 15 bp, Homo sapiens
ggcttggccctggca

SEQ ID NO: 1917544 - DNA, 16 bp, Homo sapiens
ggcttgtagttcttta

SEQ ID NO: 1917545 - DNA, 18 bp, Homo sapiens
ggctttgccattaaaatg

SEQ ID NO: 1917546 - DNA, 20 bp, Homo sapiens
ggcttttcttggccaacaga

SEQ ID NO: 1917547 - DNA, 12 bp, Homo sapiens
gggaacgcccac

SEQ ID NO: 1917548 - DNA, 19 bp, Homo sapiens
gggaacgcccacttccctg

SEQ ID NO: 1917549 - DNA, 14 bp, Homo sapiens
gggaagctgaggcc

SEQ ID NO: 1917550 - DNA, 17 bp, Homo sapiens
gggaagctgaggcccat

SEQ ID NO: 1917551 - DNA, 22 bp, Homo sapiens
catacaaatgcatctttgatgt

SEQ ID NO: 1917552 - DNA, 18 bp, Homo sapiens
catactagaatcagatac

SEQ ID NO: 1917553 - DNA, 15 bp, Homo sapiens
catagagtacactgc

SEQ ID NO: 1917554 - DNA, 18 bp, Homo sapiens
catagctcaataaaagaa

SEQ ID NO: 1917555 - DNA, 19 bp, Homo sapiens
catagctcaataaaagaat

SEQ ID NO: 1917556 - DNA, 21 bp, Homo sapiens
catagctcaataaaagaatct

SEQ ID NO: 1917557 - DNA, 21 bp, Homo sapiens
catataaattgtcttaatgga

SEQ ID NO: 1917558 - DNA, 22 bp, Homo sapiens
catataacttatattgtaagaa

SEQ ID NO: 1917559 - DNA, 19 bp, Homo sapiens
catatcaaaacatcccaat

SEQ ID NO: 1917560 - DNA, 16 bp, Homo sapiens
catatgaatgaaaaaa

SEQ ID NO: 1917561 - DNA, 22 bp, Homo sapiens
catattactgtacatgggacta

SEQ ID NO: 1917562 - DNA, 23 bp, Homo sapiens
catatttggaataaaaattccag

SEQ ID NO: 1917563 - DNA, 17 bp, Homo sapiens
catattttaaacagagg

SEQ ID NO: 1917564 - DNA, 12 bp, Homo sapiens
catcacaataaa

SEQ ID NO: 1917565 - DNA, 15 bp, Homo sapiens
catcacagggcctca

SEQ ID NO: 1917566 - DNA, 22 bp, Homo sapiens
catcacagggcctcagtttccc

SEQ ID NO: 1917567 - DNA, 14 bp, Homo sapiens
catcacttaaaaca

SEQ ID NO: 1917568 - DNA, 12 bp, Homo sapiens
catcagaacagc

SEQ ID NO: 1917569 - DNA, 21 bp, Homo sapiens
catcagctacccctgcagctg

SEQ ID NO: 1917570 - DNA, 19 bp, Homo sapiens
catcattcctttttattta

SEQ ID NO: 1917571 - DNA, 17 bp, Homo sapiens
catccaccgtcccctcc

SEQ ID NO: 1917572 - DNA, 20 bp, Homo sapiens
catccatggggtctctcaca

SEQ ID NO: 1917573 - DNA, 22 bp, Homo sapiens
catccatggggtctctcacaga

SEQ ID NO: 1917574 - DNA, 14 bp, Homo sapiens
catccccttccagc

SEQ ID NO: 1917575 - DNA, 13 bp, Homo sapiens
catcccggcagcg

SEQ ID NO: 1917576 - DNA, 17 bp, Homo sapiens
catcccgtttccctcca

SEQ ID NO: 1917577 - DNA, 18 bp, Homo sapiens
catcccgtttccctccag

SEQ ID NO: 1917578 - DNA, 14 bp, Homo sapiens
cttcctctgctgca

SEQ ID NO: 1917579 - DNA, 20 bp, Homo sapiens
cttcctctgctgcatcccct

SEQ ID NO: 1917580 - DNA, 21 bp, Homo sapiens
cttcctctgctgcatcccctt

SEQ ID NO: 1917581 - DNA, 13 bp, Homo sapiens
cttcctgagggga

SEQ ID NO: 1917582 - DNA, 22 bp, Homo sapiens
cttcctgaggggagacagagca

SEQ ID NO: 1917583 - DNA, 23 bp, Homo sapiens
cttcctggccggtgtgggggccc

SEQ ID NO: 1917584 - DNA, 11 bp, Homo sapiens
cttcctttcat

SEQ ID NO: 1917585 - DNA, 14 bp, Homo sapiens
cttcgaaaagaaat

SEQ ID NO: 1917586 - DNA, 20 bp, Homo sapiens
cttcgtggctaaggtaagaa

SEQ ID NO: 1917587 - DNA, 21 bp, Homo sapiens
cttctagtctggaactgctgc

SEQ ID NO: 1917588 - DNA, 22 bp, Homo sapiens
cttctagtctggaactgctgct

SEQ ID NO: 1917589 - DNA, 24 bp, Homo sapiens
cttctagtctggaactgctgctga

SEQ ID NO: 1917590 - DNA, 16 bp, Homo sapiens
cttctatagcatcact

SEQ ID NO: 1917591 - DNA, 18 bp, Homo sapiens
cttctatagcatcactta

SEQ ID NO: 1917592 - DNA, 14 bp, Homo sapiens
cttctcattacttg

SEQ ID NO: 1917593 - DNA, 19 bp, Homo sapiens
cttctcctgcagcctgaga

SEQ ID NO: 1917594 - DNA, 22 bp, Homo sapiens
cttctctgtttttcttctgaaa

SEQ ID NO: 1917595 - DNA, 14 bp, Homo sapiens
cttctgccagaaga

SEQ ID NO: 1917596 - DNA, 15 bp, Homo sapiens
cttctgtagcctgaa

SEQ ID NO: 1917597 - DNA, 14 bp, Homo sapiens
cttctgtgcccaga

SEQ ID NO: 1917598 - DNA, 19 bp, Homo sapiens
cttctgtgcccagaatact

SEQ ID NO: 1917599 - DNA, 23 bp, Homo sapiens
cttctgtgcccagaatactgatg

SEQ ID NO: 1917600 - DNA, 21 bp, Homo sapiens
cttcttcccacaaagaatata

SEQ ID NO: 1917601 - DNA, 18 bp, Homo sapiens
cttcttgggactgctgtg

SEQ ID NO: 1917602 - DNA, 19 bp, Homo sapiens
cttcttgggactgctgtga

SEQ ID NO: 1917603 - DNA, 15 bp, Homo sapiens
cttctttgcagcttc

SEQ ID NO: 1917604 - DNA, 21 bp, Homo sapiens
cttctttttccctttcctttc

SEQ ID NO: 1917605 - DNA, 22 bp, Homo sapiens
cttgaaccctaataagacccca

SEQ ID NO: 1917606 - DNA, 23 bp, Homo sapiens
cttgaaccctaataagaccccac

SEQ ID NO: 1917607 - DNA, 15 bp, Homo sapiens
cttgaagcttgtatc

SEQ ID NO: 1917608 - DNA, 23 bp, Homo sapiens
cttgaataaacaccactggatta

SEQ ID NO: 1917609 - DNA, 19 bp, Homo sapiens
cttgacgtattattgtcct

SEQ ID NO: 1917610 - DNA, 20 bp, Homo sapiens
cttgactaaaaaaaaaagaa

SEQ ID NO: 1917611 - DNA, 19 bp, Homo sapiens
cttgagttgtttttgtata

SEQ ID NO: 1917612 - DNA, 20 bp, Homo sapiens
cttgagttgtttttgtatat

SEQ ID NO: 1917613 - DNA, 18 bp, Homo sapiens
cttgcatttaaaagacag

SEQ ID NO: 1917614 - DNA, 16 bp, Homo sapiens
cttgccaaaaagcaca

SEQ ID NO: 1917615 - DNA, 12 bp, Homo sapiens
cttgccagctgc

SEQ ID NO: 1917616 - DNA, 16 bp, Homo sapiens
cttgccagctgctgag

SEQ ID NO: 1917617 - DNA, 14 bp, Homo sapiens
cttggagctctgag

SEQ ID NO: 1917618 - DNA, 20 bp, Homo sapiens
cttggatcagatagcaggag

SEQ ID NO: 1917619 - DNA, 21 bp, Homo sapiens
cttggcaataaattttgaaaa

SEQ ID NO: 1917620 - DNA, 18 bp, Homo sapiens
cttggcccagggggcttc

SEQ ID NO: 1917621 - DNA, 20 bp, Homo sapiens
cttggcctcaccctctggct

SEQ ID NO: 1917622 - DNA, 13 bp, Homo sapiens
cttgggaatttta

SEQ ID NO: 1917623 - DNA, 16 bp, Homo sapiens
cttgggactgctgtga

SEQ ID NO: 1917624 - DNA, 18 bp, Homo sapiens
cttgggccgagcctgcct

SEQ ID NO: 1917625 - DNA, 17 bp, Homo sapiens
cttgggcctcccactcc

SEQ ID NO: 1917626 - DNA, 16 bp, Homo sapiens
cttgggctggcgggcc

SEQ ID NO: 1917627 - DNA, 15 bp, Homo sapiens
cttgggggctcagca

SEQ ID NO: 1917628 - DNA, 22 bp, Homo sapiens
gaacaagtccctgtaattgttg

SEQ ID NO: 1917629 - DNA, 22 bp, Homo sapiens
gaacagctgttgactctagtac

SEQ ID NO: 1917630 - DNA, 21 bp, Homo sapiens
gaacagtgtggcctcttctga

SEQ ID NO: 1917631 - DNA, 17 bp, Homo sapiens
gaacagtttacttggaa

SEQ ID NO: 1917632 - DNA, 14 bp, Homo sapiens
gaacataattctta

SEQ ID NO: 1917633 - DNA, 14 bp, Homo sapiens
gaacatgcctcctc

SEQ ID NO: 1917634 - DNA, 17 bp, Homo sapiens
gaacatgcctcctcctg

SEQ ID NO: 1917635 - DNA, 21 bp, Homo sapiens
gaacattgcatataacttata

SEQ ID NO: 1917636 - DNA, 15 bp, Homo sapiens
gaacattggttcttt

SEQ ID NO: 1917637 - DNA, 22 bp, Homo sapiens
gaaccaaacccaccctttctac

SEQ ID NO: 1917638 - DNA, 14 bp, Homo sapiens
gaaccataaaatgt

SEQ ID NO: 1917639 - DNA, 19 bp, Homo sapiens
gaaccataaaatgtccagt

SEQ ID NO: 1917640 - DNA, 14 bp, Homo sapiens
gaactcttctcatt

SEQ ID NO: 1917641 - DNA, 17 bp, Homo sapiens
gaactcttctcattact

SEQ ID NO: 1917642 - DNA, 20 bp, Homo sapiens
gaactgctgctgacccctgt

SEQ ID NO: 1917643 - DNA, 16 bp, Homo sapiens
gaactgctttctttcg

SEQ ID NO: 1917644 - DNA, 13 bp, Homo sapiens
gaacttacaaagg

SEQ ID NO: 1917645 - DNA, 16 bp, Homo sapiens
gaacttgttgctgatt

SEQ ID NO: 1917646 - DNA, 17 bp, Homo sapiens
gaacttgttgctgattt

SEQ ID NO: 1917647 - DNA, 20 bp, Homo sapiens
gaacttgttgctgattttga

SEQ ID NO: 1917648 - DNA, 13 bp, Homo sapiens
gaacttttttcaa

SEQ ID NO: 1917649 - DNA, 16 bp, Homo sapiens
gaagaaacagctatga

SEQ ID NO: 1917650 - DNA, 13 bp, Homo sapiens
gaagacagcagga

SEQ ID NO: 1917651 - DNA, 13 bp, Homo sapiens
gaagagccccact

SEQ ID NO: 1917652 - DNA, 15 bp, Homo sapiens
gaagagtttgtaaat

SEQ ID NO: 1917653 - DNA, 20 bp, Homo sapiens
gaagagtttgtaaatgactt

SEQ ID NO: 1917654 - DNA, 13 bp, Homo sapiens
gaagatactttgt

SEQ ID NO: 1917655 - DNA, 14 bp, Homo sapiens
gaagatactttgta

SEQ ID NO: 1917656 - DNA, 15 bp, Homo sapiens
gaagatcacagcagg

SEQ ID NO: 1917657 - DNA, 19 bp, Homo sapiens
gaagatcacagcagggcct

SEQ ID NO: 1917658 - DNA, 16 bp, Homo sapiens
gaagcagtgcccaggt

SEQ ID NO: 1917659 - DNA, 15 bp, Homo sapiens
gaagcggtttgcatt

SEQ ID NO: 1917660 - DNA, 13 bp, Homo sapiens
gaagctgaggccc

SEQ ID NO: 1917661 - DNA, 15 bp, Homo sapiens
gaagctgaggcccat

SEQ ID NO: 1917662 - DNA, 20 bp, Homo sapiens
gaagctgaggcccatggcca

SEQ ID NO: 1917663 - DNA, 12 bp, Homo sapiens
gaagctgaggct

SEQ ID NO: 1917664 - DNA, 14 bp, Homo sapiens
gaagctgaggctgc

SEQ ID NO: 1917665 - DNA, 20 bp, Homo sapiens
gaagctgaggctgctgccag

SEQ ID NO: 1917666 - DNA, 14 bp, Homo sapiens
gaagcttgtatctg

SEQ ID NO: 1917667 - DNA, 17 bp, Homo sapiens
gaagcttgtatctgata

SEQ ID NO: 1917668 - DNA, 14 bp, Homo sapiens
gaaggagcaggccc

SEQ ID NO: 1917669 - DNA, 12 bp, Homo sapiens
gaaggaggccac

SEQ ID NO: 1917670 - DNA, 15 bp, Homo sapiens
gaaggaggccacctc

SEQ ID NO: 1917671 - DNA, 16 bp, Homo sapiens
gaaggaggccacctcc

SEQ ID NO: 1917672 - DNA, 15 bp, Homo sapiens
gaaggggactgccac

SEQ ID NO: 1917673 - DNA, 18 bp, Homo sapiens
gaaggggactgccacctc

SEQ ID NO: 1917674 - DNA, 19 bp, Homo sapiens
gaaggggactgccacctcc

SEQ ID NO: 1917675 - DNA, 14 bp, Homo sapiens
gaaggggttttctt

SEQ ID NO: 1917676 - DNA, 15 bp, Homo sapiens
gaagtagcacaggct

SEQ ID NO: 1917677 - DNA, 16 bp, Homo sapiens
gaagtagcacaggctg

SEQ ID NO: 1917678 - DNA, 16 bp, Homo sapiens
gaagtaggggaagaat

SEQ ID NO: 1917679 - DNA, 21 bp, Homo sapiens
gaagtaggggaagaataattt

SEQ ID NO: 1917680 - DNA, 19 bp, Homo sapiens
gaagtatatttttgcaggt

SEQ ID NO: 1917681 - DNA, 18 bp, Homo sapiens
gaagtgcagaactgcagt

SEQ ID NO: 1917682 - DNA, 20 bp, Homo sapiens
gaagtgcagaactgcagtca

SEQ ID NO: 1917683 - DNA, 21 bp, Homo sapiens
gaagtgcatgggtcagggtgt

SEQ ID NO: 1917684 - DNA, 23 bp, Homo sapiens
gaagttaactgttccccttggta

SEQ ID NO: 1917685 - DNA, 21 bp, Homo sapiens
gaagttactgttacttgataa

SEQ ID NO: 1917686 - DNA, 18 bp, Homo sapiens
gaagttctagaattctag

SEQ ID NO: 1917687 - DNA, 16 bp, Homo sapiens
gaataaactagattac

SEQ ID NO: 1917688 - DNA, 16 bp, Homo sapiens
gaataaagtgcaaaca

SEQ ID NO: 1917689 - DNA, 20 bp, Homo sapiens
gaataaagtgcaaacagaag

SEQ ID NO: 1917690 - DNA, 20 bp, Homo sapiens
gaataagccattctgactca

SEQ ID NO: 1917691 - DNA, 19 bp, Homo sapiens
gaataatgtctagattttg

SEQ ID NO: 1917692 - DNA, 21 bp, Homo sapiens
gaataatgtctagattttgaa

SEQ ID NO: 1917693 - DNA, 22 bp, Homo sapiens
gaataatgtctagattttgaaa

SEQ ID NO: 1917694 - DNA, 16 bp, Homo sapiens
gaatactgatggaatt

SEQ ID NO: 1917695 - DNA, 13 bp, Homo sapiens
gaatactgcttga

SEQ ID NO: 1917696 - DNA, 14 bp, Homo sapiens
gaatactgcttgaa

SEQ ID NO: 1917697 - DNA, 12 bp, Homo sapiens
gaatacttgaac

SEQ ID NO: 1917698 - DNA, 14 bp, Homo sapiens
gaatacttgaacca

SEQ ID NO: 1917699 - DNA, 21 bp, Homo sapiens
gaatatgattaaaaatatcaa

SEQ ID NO: 1917700 - DNA, 20 bp, Homo sapiens
gaatatgtggtctccctggc

SEQ ID NO: 1917701 - DNA, 22 bp, Homo sapiens
gaatattctttttatattctgt

SEQ ID NO: 1917702 - DNA, 19 bp, Homo sapiens
gaatattgccattatgctt

SEQ ID NO: 1917703 - DNA, 20 bp, Homo sapiens
gaatatttaagcaataaaac

SEQ ID NO: 1917704 - DNA, 17 bp, Homo sapiens
gaatctgataccaaaga

SEQ ID NO: 1917705 - DNA, 21 bp, Homo sapiens
gaatctggaccccatctgtga

SEQ ID NO: 1917706 - DNA, 23 bp, Homo sapiens
gaatctggaccccatctgtgaat

SEQ ID NO: 1917707 - DNA, 17 bp, Homo sapiens
gaatgaagttgtacttc

SEQ ID NO: 1917708 - DNA, 21 bp, Homo sapiens
gaatgcaccatactcatgcat

SEQ ID NO: 1917709 - DNA, 17 bp, Homo sapiens
gaatgttttagcacagc

SEQ ID NO: 1917710 - DNA, 15 bp, Homo sapiens
gaattaaaactttgt

SEQ ID NO: 1917711 - DNA, 19 bp, Homo sapiens
gaattcaaatattctttca

SEQ ID NO: 1917712 - DNA, 18 bp, Homo sapiens
gaatttaaagacaaaaat

SEQ ID NO: 1917713 - DNA, 12 bp, Homo sapiens
gaatttatataa

SEQ ID NO: 1917714 - DNA, 21 bp, Homo sapiens
gaatttatttttaagaaagaa

SEQ ID NO: 1917715 - DNA, 20 bp, Homo sapiens
gacaaactgccagttttgtt

SEQ ID NO: 1917716 - DNA, 20 bp, Homo sapiens
gacaaccttggcttggccct

SEQ ID NO: 1917717 - DNA, 22 bp, Homo sapiens
gacaatctagctctccatactt

SEQ ID NO: 1917718 - DNA, 23 bp, Homo sapiens
gaccctgccaggcacaggcaggg

SEQ ID NO: 1917719 - DNA, 19 bp, Homo sapiens
gaccctgcccctaactcct

SEQ ID NO: 1917720 - DNA, 15 bp, Homo sapiens
gacccttatttaaaa

SEQ ID NO: 1917721 - DNA, 19 bp, Homo sapiens
gaccgtgaagatactttgt

SEQ ID NO: 1917722 - DNA, 19 bp, Homo sapiens
gacctggggctgctgtgaa

SEQ ID NO: 1917723 - DNA, 21 bp, Homo sapiens
gacctgtatcaaactgctttt

SEQ ID NO: 1917724 - DNA, 21 bp, Homo sapiens
gacggttcctacacaggacag

SEQ ID NO: 1917725 - DNA, 16 bp, Homo sapiens
gacgtacaagtagttc

SEQ ID NO: 1917726 - DNA, 19 bp, Homo sapiens
gacgtacaagtagttctgt

SEQ ID NO: 1917727 - DNA, 12 bp, Homo sapiens
gacgtctgccac

SEQ ID NO: 1917728 - DNA, 14 bp, Homo sapiens
gacgtctgccacca

SEQ ID NO: 1917729 - DNA, 20 bp, Homo sapiens
gacgtctgccaccagcgccc

SEQ ID NO: 1917730 - DNA, 18 bp, Homo sapiens
gactatgcttttctcaaa

SEQ ID NO: 1917731 - DNA, 20 bp, Homo sapiens
gactcccaggaccctgtgcc

SEQ ID NO: 1917732 - DNA, 15 bp, Homo sapiens
gactccttccttgaa

SEQ ID NO: 1917733 - DNA, 22 bp, Homo sapiens
gactcttttccaaacacaggca

SEQ ID NO: 1917734 - DNA, 14 bp, Homo sapiens
gactgaattcaaat

SEQ ID NO: 1917735 - DNA, 15 bp, Homo sapiens
gactgactgaggcag

SEQ ID NO: 1917736 - DNA, 15 bp, Homo sapiens
gactgccagctcttc

SEQ ID NO: 1917737 - DNA, 22 bp, Homo sapiens
gactgctgtgaacatgcctcct

SEQ ID NO: 1917738 - DNA, 23 bp, Homo sapiens
gactgctgtgaacatgcctcctc

SEQ ID NO: 1917739 - DNA, 16 bp, Homo sapiens
gactggcaagaaaaga

SEQ ID NO: 1917740 - DNA, 15 bp, Homo sapiens
gactgggcccgaggg

SEQ ID NO: 1917741 - DNA, 18 bp, Homo sapiens
gactgtggagactgctcc

SEQ ID NO: 1917742 - DNA, 12 bp, Homo sapiens
gacttagaatcc

SEQ ID NO: 1917743 - DNA, 18 bp, Homo sapiens
gacttccccaagcctggc

SEQ ID NO: 1917744 - DNA, 21 bp, Homo sapiens
gacttgtatattctattttac

SEQ ID NO: 1917745 - DNA, 22 bp, Homo sapiens
gacttgtcccaagtctgacagc

SEQ ID NO: 1917746 - DNA, 16 bp, Homo sapiens
gacttgttcttgatag

SEQ ID NO: 1917747 - DNA, 12 bp, Homo sapiens
gacttgtttccc

SEQ ID NO: 1917748 - DNA, 15 bp, Homo sapiens
gactttagctttctg

SEQ ID NO: 1917749 - DNA, 14 bp, Homo sapiens
gactttattattta

SEQ ID NO: 1917750 - DNA, 15 bp, Homo sapiens
gactttattatttat

SEQ ID NO: 1917751 - DNA, 13 bp, Homo sapiens
gactttgaattta

SEQ ID NO: 1917752 - DNA, 18 bp, Homo sapiens
gactttgaatttatataa

SEQ ID NO: 1917753 - DNA, 11 bp, Homo sapiens
gagaaaaacaa

SEQ ID NO: 1917754 - DNA, 9 bp, Homo sapiens
gagaaaaga

SEQ ID NO: 1917755 - DNA, 10 bp, Homo sapiens
gagaaaagaa

SEQ ID NO: 1917756 - DNA, 20 bp, Homo sapiens
gagaaaagaaaaaaaaagaa

SEQ ID NO: 1917757 - DNA, 17 bp, Homo sapiens
gagaaatcttaagtcat

SEQ ID NO: 1917758 - DNA, 19 bp, Homo sapiens
gagaacattaggccccagc

SEQ ID NO: 1917759 - DNA, 12 bp, Homo sapiens
gagaagagaaag

SEQ ID NO: 1917760 - DNA, 18 bp, Homo sapiens
gagaagtgacggttccta

SEQ ID NO: 1917761 - DNA, 17 bp, Homo sapiens
gagaatgaacaaagacc

SEQ ID NO: 1917762 - DNA, 19 bp, Homo sapiens
gagacagagcaacccctgg

SEQ ID NO: 1917763 - DNA, 12 bp, Homo sapiens
gagacagggccc

SEQ ID NO: 1917764 - DNA, 20 bp, Homo sapiens
gagacagggtttcaccatgt

SEQ ID NO: 1917765 - DNA, 20 bp, Homo sapiens
gagacctgtatcaaactgct

SEQ ID NO: 1917766 - DNA, 17 bp, Homo sapiens
gagactgctcctgagcc

SEQ ID NO: 1917767 - DNA, 18 bp, Homo sapiens
gagactgctcctgagccc

SEQ ID NO: 1917768 - DNA, 21 bp, Homo sapiens
gagactgtggagactgctcct

SEQ ID NO: 1917769 - DNA, 16 bp, Homo sapiens
gagacttacggcaaga

SEQ ID NO: 1917770 - DNA, 16 bp, Homo sapiens
gagagaagagccccac

SEQ ID NO: 1917771 - DNA, 14 bp, Homo sapiens
gagagatactctgg

SEQ ID NO: 1917772 - DNA, 15 bp, Homo sapiens
gagagatactctggg

SEQ ID NO: 1917773 - DNA, 22 bp, Homo sapiens
gagagccctcagtcggggcagg

SEQ ID NO: 1917774 - DNA, 22 bp, Homo sapiens
gagagcgaccagcaggctcctc

SEQ ID NO: 1917775 - DNA, 20 bp, Homo sapiens
gagagctggagtctgggctc

SEQ ID NO: 1917776 - DNA, 22 bp, Homo sapiens
gagagctggagtctgggctcct

SEQ ID NO: 1917777 - DNA, 16 bp, Homo sapiens
gagagggaagctgagg

SEQ ID NO: 1917778 - DNA, 19 bp, Homo sapiens
gagagggaagctgaggccc

SEQ ID NO: 1917779 - DNA, 13 bp, Homo sapiens
gagagtattctaa

SEQ ID NO: 1917780 - DNA, 18 bp, Homo sapiens
gagatcaaaaaaatatat

SEQ ID NO: 1917781 - DNA, 16 bp, Homo sapiens
gagatggatggacaga

SEQ ID NO: 1917782 - DNA, 18 bp, Homo sapiens
gagcaacaagaatctaaa

SEQ ID NO: 1917783 - DNA, 21 bp, Homo sapiens
gagcaacccctggaccccagc

SEQ ID NO: 1917784 - DNA, 20 bp, Homo sapiens
gagcagacacccttggagct

SEQ ID NO: 1917785 - DNA, 17 bp, Homo sapiens
gagcaggccctgggcct

SEQ ID NO: 1917786 - DNA, 23 bp, Homo sapiens
gagcaggccctgggcctccacct

SEQ ID NO: 1917787 - DNA, 20 bp, Homo sapiens
gagccccactctcagaggcc

SEQ ID NO: 1917788 - DNA, 22 bp, Homo sapiens
gagccccactctcagaggcccc

SEQ ID NO: 1917789 - DNA, 20 bp, Homo sapiens
gagcccccagcttccagcag

SEQ ID NO: 1917790 - DNA, 22 bp, Homo sapiens
gagcccccagcttccagcagga

SEQ ID NO: 1917791 - DNA, 20 bp, Homo sapiens
gagccctcagtcggggcagg

SEQ ID NO: 1917792 - DNA, 16 bp, Homo sapiens
gagccctgggccaggg

SEQ ID NO: 1917793 - DNA, 17 bp, Homo sapiens
gagccctgggccagggc

SEQ ID NO: 1917794 - DNA, 20 bp, Homo sapiens
gagcctgcggggcagcaggg

SEQ ID NO: 1917795 - DNA, 20 bp, Homo sapiens
gagcgaccagcaggctcctc

SEQ ID NO: 1917796 - DNA, 16 bp, Homo sapiens
gagctaaggccaatgg

SEQ ID NO: 1917797 - DNA, 22 bp, Homo sapiens
gagctaaggccaatgggctaga

SEQ ID NO: 1917798 - DNA, 16 bp, Homo sapiens
gagctagaacattcca

SEQ ID NO: 1917799 - DNA, 13 bp, Homo sapiens
gagctatgactta

SEQ ID NO: 1917800 - DNA, 17 bp, Homo sapiens
gagctcatttggggacc

SEQ ID NO: 1917801 - DNA, 19 bp, Homo sapiens
gagctcccacttctgccag

SEQ ID NO: 1917802 - DNA, 12 bp, Homo sapiens
gagctcggggct

SEQ ID NO: 1917803 - DNA, 23 bp, Homo sapiens
gagctcggggctgggggctgcag

SEQ ID NO: 1917804 - DNA, 19 bp, Homo sapiens
gagctggagtctgggctcc

SEQ ID NO: 1917805 - DNA, 18 bp, Homo sapiens
gagctgttgatgggatga

SEQ ID NO: 1917806 - DNA, 20 bp, Homo sapiens
gagcttccaattttccttca

SEQ ID NO: 1917807 - DNA, 23 bp, Homo sapiens
gagctttgtctacttcaaaagtt

SEQ ID NO: 1917808 - DNA, 13 bp, Homo sapiens
gaggaatatcaat

SEQ ID NO: 1917809 - DNA, 13 bp, Homo sapiens
gaggacacagaga

SEQ ID NO: 1917810 - DNA, 12 bp, Homo sapiens
gaggacagcctg

SEQ ID NO: 1917811 - DNA, 17 bp, Homo sapiens
gaggacagcctgcctct

SEQ ID NO: 1917812 - DNA, 15 bp, Homo sapiens
gaggagccccagtgg

SEQ ID NO: 1917813 - DNA, 14 bp, Homo sapiens
gaggaggcagagag

SEQ ID NO: 1917814 - DNA, 21 bp, Homo sapiens
gaggaggcagagagggtcact

SEQ ID NO: 1917815 - DNA, 19 bp, Homo sapiens
gaggagtggattcctcccc

SEQ ID NO: 1917816 - DNA, 15 bp, Homo sapiens
gaggcagtttgagga

SEQ ID NO: 1917817 - DNA, 16 bp, Homo sapiens
gaggccaagagtggcc

SEQ ID NO: 1917818 - DNA, 17 bp, Homo sapiens
gaggccaagagtggccc

SEQ ID NO: 1917819 - DNA, 22 bp, Homo sapiens
gaggccaagagtggccccacct

SEQ ID NO: 1917820 - DNA, 20 bp, Homo sapiens
gaggcgagcagggcaggccc

SEQ ID NO: 1917821 - DNA, 20 bp, Homo sapiens
gagggaagctgaggcccatg

SEQ ID NO: 1917822 - DNA, 22 bp, Homo sapiens
gagggaagctgaggcccatggc

SEQ ID NO: 1917823 - DNA, 16 bp, Homo sapiens
gagggagacagaccac

SEQ ID NO: 1917824 - DNA, 19 bp, Homo sapiens
gagggcatttggcttcctc

SEQ ID NO: 1917825 - DNA, 20 bp, Homo sapiens
gagggcatttggcttcctct

SEQ ID NO: 1917826 - DNA, 22 bp, Homo sapiens
gagggcatttggcttcctctgc

SEQ ID NO: 1917827 - DNA, 23 bp, Homo sapiens
gagggcatttggcttcctctgct

SEQ ID NO: 1917828 - DNA, 23 bp, Homo sapiens
gaggggccagcggccctcccagg

SEQ ID NO: 1917829 - DNA, 20 bp, Homo sapiens
gagggtggtttacctgcacc

SEQ ID NO: 1917830 - DNA, 14 bp, Homo sapiens
gaggtcccagggcc

SEQ ID NO: 1917831 - DNA, 16 bp, Homo sapiens
gaggtgcatgcctaat

SEQ ID NO: 1917832 - DNA, 15 bp, Homo sapiens
gagtagccatgagga

SEQ ID NO: 1917833 - DNA, 19 bp, Homo sapiens
gagtagctcgtcctcactg

SEQ ID NO: 1917834 - DNA, 22 bp, Homo sapiens
gagtatatttaagaagccaagg

SEQ ID NO: 1917835 - DNA, 21 bp, Homo sapiens
gagtctcgctctgttgcccag

SEQ ID NO: 1917836 - DNA, 21 bp, Homo sapiens
gagtctgaccctttaatccaa

SEQ ID NO: 1917837 - DNA, 12 bp, Homo sapiens
gagtctgaggcc

SEQ ID NO: 1917838 - DNA, 23 bp, Homo sapiens
gagtctgaggccgttgctgactt

SEQ ID NO: 1917839 - DNA, 15 bp, Homo sapiens
gagtctttctcactg

SEQ ID NO: 1917840 - DNA, 17 bp, Homo sapiens
gagtctttctcactgcc

SEQ ID NO: 1917841 - DNA, 18 bp, Homo sapiens
gagtctttctcactgcct

SEQ ID NO: 1917842 - DNA, 19 bp, Homo sapiens
gagtgaggaatggcagtga

SEQ ID NO: 1917843 - DNA, 14 bp, Homo sapiens
gagtgcaggcccac

SEQ ID NO: 1917844 - DNA, 17 bp, Homo sapiens
gagtggattcctcccca

SEQ ID NO: 1917845 - DNA, 17 bp, Homo sapiens
gagtggcatctggggct

SEQ ID NO: 1917846 - DNA, 12 bp, Homo sapiens
gcagggcacaga

SEQ ID NO: 1917847 - DNA, 17 bp, Homo sapiens
gcagggcaggaccagcc

SEQ ID NO: 1917848 - DNA, 19 bp, Homo sapiens
gcagggcaggaccagccca

SEQ ID NO: 1917849 - DNA, 16 bp, Homo sapiens
gcagggccttctgcct

SEQ ID NO: 1917850 - DNA, 13 bp, Homo sapiens
gcagggctgggtc

SEQ ID NO: 1917851 - DNA, 19 bp, Homo sapiens
gcagggctgggtcaggggt

SEQ ID NO: 1917852 - DNA, 18 bp, Homo sapiens
gcaggggccaagcaggca

SEQ ID NO: 1917853 - DNA, 13 bp, Homo sapiens
gcagtcaccgccg

SEQ ID NO: 1917854 - DNA, 22 bp, Homo sapiens
gcagtgatgtttgccatttgct

SEQ ID NO: 1917855 - DNA, 19 bp, Homo sapiens
gcagtggagcagaaggcag

SEQ ID NO: 1917856 - DNA, 13 bp, Homo sapiens
gcagtggctgtga

SEQ ID NO: 1917857 - DNA, 17 bp, Homo sapiens
gcagtgtgaatgctggg

SEQ ID NO: 1917858 - DNA, 19 bp, Homo sapiens
gcagtgtgaatgctgggcc

SEQ ID NO: 1917859 - DNA, 14 bp, Homo sapiens
gcagtgttaagata

SEQ ID NO: 1917860 - DNA, 23 bp, Homo sapiens
gcagttcccctggaagcagtgcc

SEQ ID NO: 1917861 - DNA, 16 bp, Homo sapiens
gcagttcgaccagcca

SEQ ID NO: 1917862 - DNA, 21 bp, Homo sapiens
gcatatattaaagcatcagga

SEQ ID NO: 1917863 - DNA, 14 bp, Homo sapiens
gcatatccttttag

SEQ ID NO: 1917864 - DNA, 21 bp, Homo sapiens
gcatattctagtaataaagac

SEQ ID NO: 1917865 - DNA, 22 bp, Homo sapiens
gcatattctagtaataaagact

SEQ ID NO: 1917866 - DNA, 16 bp, Homo sapiens
gcatcacttaaaacac

SEQ ID NO: 1917867 - DNA, 16 bp, Homo sapiens
gcatcattctctaata

SEQ ID NO: 1917868 - DNA, 12 bp, Homo sapiens
gcatccatgggg

SEQ ID NO: 1917869 - DNA, 22 bp, Homo sapiens
gcatccatggggtctctcacag

SEQ ID NO: 1917870 - DNA, 13 bp, Homo sapiens
gcatccccttcca

SEQ ID NO: 1917871 - DNA, 16 bp, Homo sapiens
gcatccccttccagct

SEQ ID NO: 1917872 - DNA, 18 bp, Homo sapiens
gcatcctgattattttca

SEQ ID NO: 1917873 - DNA, 14 bp, Homo sapiens
gcatctctgaccag

SEQ ID NO: 1917874 - DNA, 20 bp, Homo sapiens
gcatgaggccccgaggctcg

SEQ ID NO: 1917875 - DNA, 19 bp, Homo sapiens
gcatggagaatgcaccata

SEQ ID NO: 1917876 - DNA, 15 bp, Homo sapiens
gcatgggtcagggtg

SEQ ID NO: 1917877 - DNA, 13 bp, Homo sapiens
gcattaaaagaaa

SEQ ID NO: 1917878 - DNA, 15 bp, Homo sapiens
gcattaaaagaaaat

SEQ ID NO: 1917879 - DNA, 16 bp, Homo sapiens
gcattacctctttgga

SEQ ID NO: 1917880 - DNA, 17 bp, Homo sapiens
gcattcacatatctgct

SEQ ID NO: 1917881 - DNA, 23 bp, Homo sapiens
gcattctctccatttcactggct

SEQ ID NO: 1917882 - DNA, 20 bp, Homo sapiens
gcattgcagtcactttgaca

SEQ ID NO: 1917883 - DNA, 12 bp, Homo sapiens
gcattgtaagcg

SEQ ID NO: 1917884 - DNA, 21 bp, Homo sapiens
gcattgtaagcgtatggcttt

SEQ ID NO: 1917885 - DNA, 17 bp, Homo sapiens
gcatttacgcctgtaaa

SEQ ID NO: 1917886 - DNA, 15 bp, Homo sapiens
gcatttggcttcctc

SEQ ID NO: 1917887 - DNA, 19 bp, Homo sapiens
gcatttggcttcctctgct

SEQ ID NO: 1917888 - DNA, 16 bp, Homo sapiens
gcatttttgcaggagc

SEQ ID NO: 1917889 - DNA, 14 bp, Homo sapiens
gccaaaattaaggt

SEQ ID NO: 1917890 - DNA, 23 bp, Homo sapiens
gccaaaattaaggtgtttgaaaa

SEQ ID NO: 1917891 - DNA, 14 bp, Homo sapiens
gccaaacaggccct

SEQ ID NO: 1917892 - DNA, 16 bp, Homo sapiens
gccaacccctctctca

SEQ ID NO: 1917893 - DNA, 20 bp, Homo sapiens
gccaagagtggccccacctg

SEQ ID NO: 1917894 - DNA, 21 bp, Homo sapiens
gccaagagtggccccacctgg

SEQ ID NO: 1917895 - DNA, 13 bp, Homo sapiens
gccaagcaggcac

SEQ ID NO: 1917896 - DNA, 23 bp, Homo sapiens
gccaaggctatttttcagaactg

SEQ ID NO: 1917897 - DNA, 15 bp, Homo sapiens
gccacaaggaagaaa

SEQ ID NO: 1917898 - DNA, 22 bp, Homo sapiens
gccacaaggaagaaattaactt

SEQ ID NO: 1917899 - DNA, 15 bp, Homo sapiens
gccacagcaaggctg

SEQ ID NO: 1917900 - DNA, 19 bp, Homo sapiens
gccacatcctcatggccca

SEQ ID NO: 1917901 - DNA, 14 bp, Homo sapiens
gccaccctttctgg

SEQ ID NO: 1917902 - DNA, 23 bp, Homo sapiens
gccacctcctaaaaggcccagag

SEQ ID NO: 1917903 - DNA, 21 bp, Homo sapiens
gccacctgagttcctgaggtg

SEQ ID NO: 1917904 - DNA, 21 bp, Homo sapiens
gccactgtccgctgtctccct

SEQ ID NO: 1917905 - DNA, 17 bp, Homo sapiens
gccagagccttggagga

SEQ ID NO: 1917906 - DNA, 11 bp, Homo sapiens
gccagcagcct

SEQ ID NO: 1917907 - DNA, 20 bp, Homo sapiens
gccagcagcctctgatctgt

SEQ ID NO: 1917908 - DNA, 13 bp, Homo sapiens
gccagcggccctc

SEQ ID NO: 1917909 - DNA, 14 bp, Homo sapiens
gccagcggccctcc

SEQ ID NO: 1917910 - DNA, 18 bp, Homo sapiens
gccagcttctttgcagct

SEQ ID NO: 1917911 - DNA, 20 bp, Homo sapiens
gccaggaagtagcacaggct

SEQ ID NO: 1917912 - DNA, 22 bp, Homo sapiens
gccaggaagtagcacaggctga

SEQ ID NO: 1917913 - DNA, 12 bp, Homo sapiens
gccaggcacagg

SEQ ID NO: 1917914 - DNA, 13 bp, Homo sapiens
gccaggcacaggc

SEQ ID NO: 1917915 - DNA, 14 bp, Homo sapiens
gccaggcacaggca

SEQ ID NO: 1917916 - DNA, 16 bp, Homo sapiens
gccaggcacaggcagg

SEQ ID NO: 1917917 - DNA, 17 bp, Homo sapiens
gccagggaggagcccca

SEQ ID NO: 1917918 - DNA, 13 bp, Homo sapiens
gccagggatggca

SEQ ID NO: 1917919 - DNA, 20 bp, Homo sapiens
gccagggatggcagtggctg

SEQ ID NO: 1917920 - DNA, 22 bp, Homo sapiens
gccatagagtacactgcctgcc

SEQ ID NO: 1917921 - DNA, 14 bp, Homo sapiens
gccatgaggaggca

SEQ ID NO: 1917922 - DNA, 16 bp, Homo sapiens
gccatggccctgagcc

SEQ ID NO: 1917923 - DNA, 15 bp, Homo sapiens
gcccacgctgactac

SEQ ID NO: 1917924 - DNA, 16 bp, Homo sapiens
gcccactgtgcgtggg

SEQ ID NO: 1917925 - DNA, 23 bp, Homo sapiens
gcccactgtgcgtggggctcccg

SEQ ID NO: 1917926 - DNA, 17 bp, Homo sapiens
gcccagagagaagagcc

SEQ ID NO: 1917927 - DNA, 20 bp, Homo sapiens
gcccagagagaagagcccca

SEQ ID NO: 1917928 - DNA, 14 bp, Homo sapiens
gcccagctgtgctg

SEQ ID NO: 1917929 - DNA, 17 bp, Homo sapiens
gcccaggagaatgctgc

SEQ ID NO: 1917930 - DNA, 13 bp, Homo sapiens
gcccaggagccca

SEQ ID NO: 1917931 - DNA, 15 bp, Homo sapiens
gcccaggagcccatt

SEQ ID NO: 1917932 - DNA, 20 bp, Homo sapiens
gcccaggctggagtgcagtg

SEQ ID NO: 1917933 - DNA, 12 bp, Homo sapiens
gcccagtcccag

SEQ ID NO: 1917934 - DNA, 13 bp, Homo sapiens
gcccagtcccagc

SEQ ID NO: 1917935 - DNA, 19 bp, Homo sapiens
gcccagtcccagcagccag

SEQ ID NO: 1917936 - DNA, 16 bp, Homo sapiens
gcccatcaggggcagg

SEQ ID NO: 1917937 - DNA, 17 bp, Homo sapiens
gcccatcaggggcagga

SEQ ID NO: 1917938 - DNA, 20 bp, Homo sapiens
gcccatgtatggccaggaag

SEQ ID NO: 1917939 - DNA, 21 bp, Homo sapiens
gcccatgtatggccaggaagt

SEQ ID NO: 1917940 - DNA, 18 bp, Homo sapiens
gcccatttggagggcctg

SEQ ID NO: 1917941 - DNA, 13 bp, Homo sapiens
gccccattaactg

SEQ ID NO: 1917942 - DNA, 12 bp, Homo sapiens
gcccccactcct

SEQ ID NO: 1917943 - DNA, 19 bp, Homo sapiens
gcccccagcttccagcagg

SEQ ID NO: 1917944 - DNA, 15 bp, Homo sapiens
gcccccgcagtcgtc

SEQ ID NO: 1917945 - DNA, 23 bp, Homo sapiens
gcccccgcagtcgtcagcctccc

SEQ ID NO: 1917946 - DNA, 17 bp, Homo sapiens
gccccctcccctccttt

SEQ ID NO: 1917947 - DNA, 15 bp, Homo sapiens
gccccgaggctcgag

SEQ ID NO: 1917948 - DNA, 19 bp, Homo sapiens
gccccgtccccccatcccg

SEQ ID NO: 1917949 - DNA, 16 bp, Homo sapiens
gcccctgagcccactg

SEQ ID NO: 1917950 - DNA, 13 bp, Homo sapiens
gccccttctatgc

SEQ ID NO: 1917951 - DNA, 23 bp, Homo sapiens
gccccttctatgcccagctgtgc

SEQ ID NO: 1917952 - DNA, 13 bp, Homo sapiens
gccccttgggcct

SEQ ID NO: 1917953 - DNA, 14 bp, Homo sapiens
gccccttgggcctc

SEQ ID NO: 1917954 - DNA, 16 bp, Homo sapiens
gccccttgggcctccc

SEQ ID NO: 1917955 - DNA, 18 bp, Homo sapiens
gccccttgggcctcccac

SEQ ID NO: 1917956 - DNA, 21 bp, Homo sapiens
gccccttgggcctcccactcc

SEQ ID NO: 1917957 - DNA, 21 bp, Homo sapiens
gcccgatcctcccctggactc

SEQ ID NO: 1917958 - DNA, 13 bp, Homo sapiens
gcccgcatcagct

SEQ ID NO: 1917959 - DNA, 15 bp, Homo sapiens
gcccgcatcagctgc

SEQ ID NO: 1917960 - DNA, 20 bp, Homo sapiens
gcccgcatcagctgctcaga

SEQ ID NO: 1917961 - DNA, 16 bp, Homo sapiens
gcccgggcccaggcag

SEQ ID NO: 1917962 - DNA, 21 bp, Homo sapiens
gccctagaagatcacagcagg

SEQ ID NO: 1917963 - DNA, 21 bp, Homo sapiens
gccctcccaggcgatcttgtg

SEQ ID NO: 1917964 - DNA, 21 bp, Homo sapiens
gccctccgccccgtcccccca

SEQ ID NO: 1917965 - DNA, 23 bp, Homo sapiens
gccctccgccccgtccccccatc

SEQ ID NO: 1917966 - DNA, 18 bp, Homo sapiens
gccctcctccctcccagc

SEQ ID NO: 1917967 - DNA, 20 bp, Homo sapiens
gccctcctccctcccagctc

SEQ ID NO: 1917968 - DNA, 22 bp, Homo sapiens
gccctcctccctcccagctcca

SEQ ID NO: 1917969 - DNA, 19 bp, Homo sapiens
gccctgatctccgcagagg

SEQ ID NO: 1917970 - DNA, 13 bp, Homo sapiens
gccctggccccca

SEQ ID NO: 1917971 - DNA, 16 bp, Homo sapiens
gccctggcccccacat

SEQ ID NO: 1917972 - DNA, 12 bp, Homo sapiens
gccctgggccag

SEQ ID NO: 1917973 - DNA, 14 bp, Homo sapiens
gccctgggccaggg

SEQ ID NO: 1917974 - DNA, 13 bp, Homo sapiens
gccctgggcctcc

SEQ ID NO: 1917975 - DNA, 16 bp, Homo sapiens
gccctgggcctccacc

SEQ ID NO: 1917976 - DNA, 19 bp, Homo sapiens
gccctgggcctccacctct

SEQ ID NO: 1917977 - DNA, 16 bp, Homo sapiens
gccgcactgggagcag

SEQ ID NO: 1917978 - DNA, 17 bp, Homo sapiens
gccgcactgggagcagc

SEQ ID NO: 1917979 - DNA, 23 bp, Homo sapiens
gccgccggcaataaaagcccagg

SEQ ID NO: 1917980 - DNA, 19 bp, Homo sapiens
gccggaaagagagctggag

SEQ ID NO: 1917981 - DNA, 22 bp, Homo sapiens
gccggacacccgactccagtcc

SEQ ID NO: 1917982 - DNA, 22 bp, Homo sapiens
gccggcaataaaagcccaggag

SEQ ID NO: 1917983 - DNA, 15 bp, Homo sapiens
gcctaaaagtaaaca

SEQ ID NO: 1917984 - DNA, 21 bp, Homo sapiens
gcctaatatttatgactttca

SEQ ID NO: 1917985 - DNA, 21 bp, Homo sapiens
gcctattttcatgatttcttt

SEQ ID NO: 1917986 - DNA, 14 bp, Homo sapiens
gcctcaaatccagg

SEQ ID NO: 1917987 - DNA, 16 bp, Homo sapiens
gcctcaaatccaggac

SEQ ID NO: 1917988 - DNA, 22 bp, Homo sapiens
gcctcaaatccaggaccctgcc

SEQ ID NO: 1917989 - DNA, 14 bp, Homo sapiens
gcctcaataaagct

SEQ ID NO: 1917990 - DNA, 12 bp, Homo sapiens
gcctccacctct

SEQ ID NO: 1917991 - DNA, 15 bp, Homo sapiens
gcctccacctctgtg

SEQ ID NO: 1917992 - DNA, 16 bp, Homo sapiens
gcctccacctctgtgc

SEQ ID NO: 1917993 - DNA, 16 bp, Homo sapiens
gcctcccacagtgctg

SEQ ID NO: 1917994 - DNA, 16 bp, Homo sapiens
gcctcccactcccatg

SEQ ID NO: 1917995 - DNA, 17 bp, Homo sapiens
gcctcccactcccatgg

SEQ ID NO: 1917996 - DNA, 13 bp, Homo sapiens
gcctccccttccc

SEQ ID NO: 1917997 - DNA, 14 bp, Homo sapiens
gcctccccttccca

SEQ ID NO: 1917998 - DNA, 18 bp, Homo sapiens
gcctccccttcccagacc

SEQ ID NO: 1917999 - DNA, 19 bp, Homo sapiens
gcctccctgacgtctgcca

SEQ ID NO: 1918000 - DNA, 20 bp, Homo sapiens
gcctccctgacgtctgccac

SEQ ID NO: 1918001 - DNA, 12 bp, Homo sapiens
gcctcctcctgc

SEQ ID NO: 1918002 - DNA, 17 bp, Homo sapiens
gcctcctcctgccctcc

SEQ ID NO: 1918003 - DNA, 18 bp, Homo sapiens
gcctcctcctgccctccg

SEQ ID NO: 1918004 - DNA, 14 bp, Homo sapiens
gcctctccccacct

SEQ ID NO: 1918005 - DNA, 23 bp, Homo sapiens
gcctctccgcccctgagcccact

SEQ ID NO: 1918006 - DNA, 14 bp, Homo sapiens
gcctctgccacagc

SEQ ID NO: 1918007 - DNA, 17 bp, Homo sapiens
gcctcttctcctgcagc

SEQ ID NO: 1918008 - DNA, 22 bp, Homo sapiens
gcctgcacttgggggctcagca

SEQ ID NO: 1918009 - DNA, 16 bp, Homo sapiens
gcctgcctctgccaca

SEQ ID NO: 1918010 - DNA, 21 bp, Homo sapiens
gcctgccttaagtgaggaaat

SEQ ID NO: 1918011 - DNA, 12 bp, Homo sapiens
gcctggcagggg

SEQ ID NO: 1918012 - DNA, 21 bp, Homo sapiens
gcctggcaggggatccagctc

SEQ ID NO: 1918013 - DNA, 14 bp, Homo sapiens
gcctgggcctggct

SEQ ID NO: 1918014 - DNA, 15 bp, Homo sapiens
gcctgggcctggctc

SEQ ID NO: 1918015 - DNA, 16 bp, Homo sapiens
gcctgggcctggctcc

SEQ ID NO: 1918016 - DNA, 20 bp, Homo sapiens
gcctgggcgacagagcaaga

SEQ ID NO: 1918017 - DNA, 17 bp, Homo sapiens
gcctgtcttaattttct

SEQ ID NO: 1918018 - DNA, 13 bp, Homo sapiens
gccttaaagacaa

SEQ ID NO: 1918019 - DNA, 20 bp, Homo sapiens
gccttaagtgaggaaatcaa

SEQ ID NO: 1918020 - DNA, 21 bp, Homo sapiens
gccttccagtggcttctccca

SEQ ID NO: 1918021 - DNA, 22 bp, Homo sapiens
gccttccagtggcttctcccaa

SEQ ID NO: 1918022 - DNA, 23 bp, Homo sapiens
gccttcgaaaagaaattgtcctt

SEQ ID NO: 1918023 - DNA, 14 bp, Homo sapiens
gcgaaagaaaactc

SEQ ID NO: 1918024 - DNA, 15 bp, Homo sapiens
gcgaccagcaggctc

SEQ ID NO: 1918025 - DNA, 16 bp, Homo sapiens
gcgaccagcaggctcc

SEQ ID NO: 1918026 - DNA, 18 bp, Homo sapiens
gcgaccagcaggctcctc

SEQ ID NO: 1918027 - DNA, 22 bp, Homo sapiens
gcgaccagcaggctcctcagcc

SEQ ID NO: 1918028 - DNA, 17 bp, Homo sapiens
gcgatgttagttttaga

SEQ ID NO: 1918029 - DNA, 14 bp, Homo sapiens
gcgcacagctgctc

SEQ ID NO: 1918030 - DNA, 16 bp, Homo sapiens
gcgcagttgctgtcag

SEQ ID NO: 1918031 - DNA, 18 bp, Homo sapiens
gcgccactgtccgctgtc

SEQ ID NO: 1918032 - DNA, 13 bp, Homo sapiens
gcgccctggcccc

SEQ ID NO: 1918033 - DNA, 16 bp, Homo sapiens
gcgccctggcccccac

SEQ ID NO: 1918034 - DNA, 22 bp, Homo sapiens
gcgcggatttctctttctctct

SEQ ID NO: 1918035 - DNA, 20 bp, Homo sapiens
gcggacatcccctgctggcc

SEQ ID NO: 1918036 - DNA, 22 bp, Homo sapiens
gcggacatcccctgctggccgg

SEQ ID NO: 1918037 - DNA, 20 bp, Homo sapiens
gcggatttctctttctctct

SEQ ID NO: 1918038 - DNA, 14 bp, Homo sapiens
gcggccctcccagg

SEQ ID NO: 1918039 - DNA, 21 bp, Homo sapiens
gcggccctgatctccgcagag

SEQ ID NO: 1918040 - DNA, 21 bp, Homo sapiens
gcggccggccgcactgggagc

SEQ ID NO: 1918041 - DNA, 13 bp, Homo sapiens
gcggggcagcagg

SEQ ID NO: 1918042 - DNA, 14 bp, Homo sapiens
gcggggcagcaggg

SEQ ID NO: 1918043 - DNA, 17 bp, Homo sapiens
gcgtattttgtatttaa

SEQ ID NO: 1918044 - DNA, 18 bp, Homo sapiens
gcgtggggctcccgcctc

SEQ ID NO: 1918045 - DNA, 23 bp, Homo sapiens
gctaaggccaatgggctagaggg

SEQ ID NO: 1918046 - DNA, 17 bp, Homo sapiens
gctaatatttttaacaa

SEQ ID NO: 1918047 - DNA, 12 bp, Homo sapiens
gctaattgtacc

SEQ ID NO: 1918048 - DNA, 16 bp, Homo sapiens
gctacgtttactcaca

SEQ ID NO: 1918049 - DNA, 18 bp, Homo sapiens
gctacttgagggccagga

SEQ ID NO: 1918050 - DNA, 20 bp, Homo sapiens
gctagcctcacgaaactgga

SEQ ID NO: 1918051 - DNA, 22 bp, Homo sapiens
gctagcctcacgaaactggaat

SEQ ID NO: 1918052 - DNA, 17 bp, Homo sapiens
gctagcggttgaatctt

SEQ ID NO: 1918053 - DNA, 22 bp, Homo sapiens
gctattgtttctttaagaaagt

SEQ ID NO: 1918054 - DNA, 18 bp, Homo sapiens
gctcaagccgtggccggg

SEQ ID NO: 1918055 - DNA, 18 bp, Homo sapiens
gctcaataaaagaatctg

SEQ ID NO: 1918056 - DNA, 17 bp, Homo sapiens
gctcactgcagcctccg

SEQ ID NO: 1918057 - DNA, 17 bp, Homo sapiens
gctcactgtggtgtctg

SEQ ID NO: 1918058 - DNA, 19 bp, Homo sapiens
gctcactgtggtgtctgtg

SEQ ID NO: 1918059 - DNA, 17 bp, Homo sapiens
gctcagaaccacagcaa

SEQ ID NO: 1918060 - DNA, 21 bp, Homo sapiens
gctcagatcccacttttgcca

SEQ ID NO: 1918061 - DNA, 14 bp, Homo sapiens
gctcagcaaggcca

SEQ ID NO: 1918062 - DNA, 14 bp, Homo sapiens
gctcattaataaaa

SEQ ID NO: 1918063 - DNA, 16 bp, Homo sapiens
gctcattcagcatctg

SEQ ID NO: 1918064 - DNA, 16 bp, Homo sapiens
gctcatttcatgaagc

SEQ ID NO: 1918065 - DNA, 22 bp, Homo sapiens
gctcatttggggaccacagagg

SEQ ID NO: 1918066 - DNA, 19 bp, Homo sapiens
gctcccctaaagcctcaaa

SEQ ID NO: 1918067 - DNA, 19 bp, Homo sapiens
gctcccgcctccaacccct

SEQ ID NO: 1918068 - DNA, 15 bp, Homo sapiens
gctccctcactctca

SEQ ID NO: 1918069 - DNA, 17 bp, Homo sapiens
gctccctcactctcagg

SEQ ID NO: 1918070 - DNA, 12 bp, Homo sapiens
gctccctcccct

SEQ ID NO: 1918071 - DNA, 18 bp, Homo sapiens
gctccctcccctgctcag

SEQ ID NO: 1918072 - DNA, 17 bp, Homo sapiens
gctccgaaacaagagac

SEQ ID NO: 1918073 - DNA, 12 bp, Homo sapiens
gctcctcagccc

SEQ ID NO: 1918074 - DNA, 16 bp, Homo sapiens
gctcctcagccctctc

SEQ ID NO: 1918075 - DNA, 17 bp, Homo sapiens
gctcctcagccctctct

SEQ ID NO: 1918076 - DNA, 16 bp, Homo sapiens
gctcctgagcccccag

SEQ ID NO: 1918077 - DNA, 13 bp, Homo sapiens
gctcggggctggg

SEQ ID NO: 1918078 - DNA, 19 bp, Homo sapiens
gctcggggctgggggctgc

SEQ ID NO: 1918079 - DNA, 22 bp, Homo sapiens
gctctcatgtacttttaaatta

SEQ ID NO: 1918080 - DNA, 19 bp, Homo sapiens
gctctcctcagaagaaaga

SEQ ID NO: 1918081 - DNA, 20 bp, Homo sapiens
gctctctaacccacaggtgt

SEQ ID NO: 1918082 - DNA, 22 bp, Homo sapiens
gctctgctcccctaaagcctca

SEQ ID NO: 1918083 - DNA, 20 bp, Homo sapiens
gctctgggcggtccagaagg

SEQ ID NO: 1918084 - DNA, 15 bp, Homo sapiens
gctctgttgcccagg

SEQ ID NO: 1918085 - DNA, 18 bp, Homo sapiens
gctctgttgcccaggctg

SEQ ID NO: 1918086 - DNA, 16 bp, Homo sapiens
gctcttagaaactcag

SEQ ID NO: 1918087 - DNA, 17 bp, Homo sapiens
gctgaacattgcatata

SEQ ID NO: 1918088 - DNA, 20 bp, Homo sapiens
gctgaagtgcatgggtcagg

SEQ ID NO: 1918089 - DNA, 21 bp, Homo sapiens
gctgaagtgcatgggtcaggg

SEQ ID NO: 1918090 - DNA, 19 bp, Homo sapiens
gctgaccataacagtgcca

SEQ ID NO: 1918091 - DNA, 20 bp, Homo sapiens
gctgaccataacagtgccag

SEQ ID NO: 1918092 - DNA, 18 bp, Homo sapiens
gctgacccatgggcagga

SEQ ID NO: 1918093 - DNA, 10 bp, Homo sapiens
aaaaaaagaa

SEQ ID NO: 1918094 - DNA, 12 bp, Homo sapiens
aaaaaagaaaga

SEQ ID NO: 1918095 - DNA, 11 bp, Homo sapiens
aaaaagaaaaa

SEQ ID NO: 1918096 - DNA, 18 bp, Homo sapiens
aaaaagaaagaaagagga

SEQ ID NO: 1918097 - DNA, 12 bp, Homo sapiens
aaaaagagaaac

SEQ ID NO: 1918098 - DNA, 15 bp, Homo sapiens
aaaaatatcaaatta

SEQ ID NO: 1918099 - DNA, 22 bp, Homo sapiens
aaaaatcaaatcatgtacattt

SEQ ID NO: 1918100 - DNA, 14 bp, Homo sapiens
aaaaatgctgaaca

SEQ ID NO: 1918101 - DNA, 15 bp, Homo sapiens
aaaaatgctgaacat

SEQ ID NO: 1918102 - DNA, 19 bp, Homo sapiens
aaaaatgctgaacattgca

SEQ ID NO: 1918103 - DNA, 13 bp, Homo sapiens
aaaacaaataata

SEQ ID NO: 1918104 - DNA, 11 bp, Homo sapiens
aaaacactgct

SEQ ID NO: 1918105 - DNA, 22 bp, Homo sapiens
aaaacagagtaatcttgttggt

SEQ ID NO: 1918106 - DNA, 18 bp, Homo sapiens
aaaacagtgctattctga

SEQ ID NO: 1918107 - DNA, 21 bp, Homo sapiens
aaaacatcattcctttttatt

SEQ ID NO: 1918108 - DNA, 16 bp, Homo sapiens
aaaaccaggctttcta

SEQ ID NO: 1918109 - DNA, 17 bp, Homo sapiens
aaaagaaaaaaaaagaa

SEQ ID NO: 1918110 - DNA, 18 bp, Homo sapiens
aaaagaaaaaaaaagaaa

SEQ ID NO: 1918111 - DNA, 19 bp, Homo sapiens
aaaagaaaaaaaaagaaaa

SEQ ID NO: 1918112 - DNA, 22 bp, Homo sapiens
aaaagaaaaaaaaagaaaaaag

SEQ ID NO: 1918113 - DNA, 20 bp, Homo sapiens
aaaagaaactctatggtctt

SEQ ID NO: 1918114 - DNA, 14 bp, Homo sapiens
aaaagaaattgtcc

SEQ ID NO: 1918115 - DNA, 14 bp, Homo sapiens
aaaagagaaaagaa

SEQ ID NO: 1918116 - DNA, 13 bp, Homo sapiens
aaaagagaaactt

SEQ ID NO: 1918117 - DNA, 14 bp, Homo sapiens
aaaagagaaactta

SEQ ID NO: 1918118 - DNA, 13 bp, Homo sapiens
aaaagagtgaatg

SEQ ID NO: 1918119 - DNA, 18 bp, Homo sapiens
aaaagagtgaatgtaata

SEQ ID NO: 1918120 - DNA, 15 bp, Homo sapiens
aaaagagttaaggca

SEQ ID NO: 1918121 - DNA, 14 bp, Homo sapiens
aaaagatgtagatt

SEQ ID NO: 1918122 - DNA, 23 bp, Homo sapiens
aaaagatgtagatttatttcatc

SEQ ID NO: 1918123 - DNA, 21 bp, Homo sapiens
aaaagattataggaactgagg

SEQ ID NO: 1918124 - DNA, 14 bp, Homo sapiens
aaaataaaggaaat

SEQ ID NO: 1918125 - DNA, 18 bp, Homo sapiens
aaaatatcacactgaata

SEQ ID NO: 1918126 - DNA, 19 bp, Homo sapiens
aaaatcagtttttgactga

SEQ ID NO: 1918127 - DNA, 16 bp, Homo sapiens
aaaatgaaaagagaaa

SEQ ID NO: 1918128 - DNA, 19 bp, Homo sapiens
aaaatgaaaagagaaactt

SEQ ID NO: 1918129 - DNA, 14 bp, Homo sapiens
aaaatgaagaattt

SEQ ID NO: 1918130 - DNA, 14 bp, Homo sapiens
aaaatgggagatct

SEQ ID NO: 1918131 - DNA, 15 bp, Homo sapiens
aaaatgtagctgcgt

SEQ ID NO: 1918132 - DNA, 14 bp, Homo sapiens
aaaatgtcaaaagt

SEQ ID NO: 1918133 - DNA, 21 bp, Homo sapiens
aaaatgtcaaaagtagaactt

SEQ ID NO: 1918134 - DNA, 20 bp, Homo sapiens
aaaatgtgagtggttgaata

SEQ ID NO: 1918135 - DNA, 20 bp, Homo sapiens
aaaattaaggtgtttgaaaa

SEQ ID NO: 1918136 - DNA, 21 bp, Homo sapiens
aaacaaactctcaaatcatga

SEQ ID NO: 1918137 - DNA, 21 bp, Homo sapiens
aaacaaatggaagagaagaga

SEQ ID NO: 1918138 - DNA, 14 bp, Homo sapiens
aaacagaagtgcat

SEQ ID NO: 1918139 - DNA, 22 bp, Homo sapiens
aaacagacttgtatattctatt

SEQ ID NO: 1918140 - DNA, 12 bp, Homo sapiens
aaacctgtgaag

SEQ ID NO: 1918141 - DNA, 18 bp, Homo sapiens
aaacctttctataatttt

SEQ ID NO: 1918142 - DNA, 20 bp, Homo sapiens
aaactcaggaaagaggagat

SEQ ID NO: 1918143 - DNA, 13 bp, Homo sapiens
aaactctatggtc

SEQ ID NO: 1918144 - DNA, 16 bp, Homo sapiens
aaactctcattattct

SEQ ID NO: 1918145 - DNA, 18 bp, Homo sapiens
aaactctgttacactttt

SEQ ID NO: 1918146 - DNA, 20 bp, Homo sapiens
aaactgcttcctttcttgat

SEQ ID NO: 1918147 - DNA, 16 bp, Homo sapiens
aaactggaataagcct

SEQ ID NO: 1918148 - DNA, 21 bp, Homo sapiens
aaactggaataagccttcgaa

SEQ ID NO: 1918149 - DNA, 15 bp, Homo sapiens
aaactggaatgagca

SEQ ID NO: 1918150 - DNA, 20 bp, Homo sapiens
aaactttgtagacattttga

SEQ ID NO: 1918151 - DNA, 12 bp, Homo sapiens
aaactttgtagt

SEQ ID NO: 1918152 - DNA, 10 bp, Homo sapiens
aaagaaaaaa

SEQ ID NO: 1918153 - DNA, 15 bp, Homo sapiens
aaagaaaaaaatgtc

SEQ ID NO: 1918154 - DNA, 16 bp, Homo sapiens
aaagaaaaaaatgtca

SEQ ID NO: 1918155 - DNA, 10 bp, Homo sapiens
aaagaaagaa

SEQ ID NO: 1918156 - DNA, 15 bp, Homo sapiens
aaagaaattgtcctt

SEQ ID NO: 1918157 - DNA, 16 bp, Homo sapiens
aaagacctagattatt

SEQ ID NO: 1918158 - DNA, 14 bp, Homo sapiens
aaagagaaccatgt

SEQ ID NO: 1918159 - DNA, 14 bp, Homo sapiens
aaagagacaggcag

SEQ ID NO: 1918160 - DNA, 16 bp, Homo sapiens
aaagatatgtatattt

SEQ ID NO: 1918161 - DNA, 18 bp, Homo sapiens
aaagatatgtatattttt

SEQ ID NO: 1918162 - DNA, 13 bp, Homo sapiens
aaagatattttta

SEQ ID NO: 1918163 - DNA, 20 bp, Homo sapiens
aaagatgagctttgtctact

SEQ ID NO: 1918164 - DNA, 15 bp, Homo sapiens
aaagatgagtaggag

SEQ ID NO: 1918165 - DNA, 18 bp, Homo sapiens
aaagcaccaaaataagaa

SEQ ID NO: 1918166 - DNA, 23 bp, Homo sapiens
aaagcaccaaaataagaaaagat

SEQ ID NO: 1918167 - DNA, 15 bp, Homo sapiens
aaagcattttgtaat

SEQ ID NO: 1918168 - DNA, 19 bp, Homo sapiens
aaaggacctcctaaataaa

SEQ ID NO: 1918169 - DNA, 18 bp, Homo sapiens
aaaggagtgagtgaaact

SEQ ID NO: 1918170 - DNA, 20 bp, Homo sapiens
aaaggcacatggaatatatt

SEQ ID NO: 1918171 - DNA, 14 bp, Homo sapiens
aaaggcttataaaa

SEQ ID NO: 1918172 - DNA, 15 bp, Homo sapiens
aaagtaaaagcagca

SEQ ID NO: 1918173 - DNA, 18 bp, Homo sapiens
aaagtaatatttattaaa

SEQ ID NO: 1918174 - DNA, 21 bp, Homo sapiens
aaagtagaactttgtatagtt

SEQ ID NO: 1918175 - DNA, 15 bp, Homo sapiens
aaagtatttttataa

SEQ ID NO: 1918176 - DNA, 19 bp, Homo sapiens
aaagtatttttataatgac

SEQ ID NO: 1918177 - DNA, 20 bp, Homo sapiens
aaagtctgttgattaaagat

SEQ ID NO: 1918178 - DNA, 20 bp, Homo sapiens
aaagtgcaaacagaagtgca

SEQ ID NO: 1918179 - DNA, 11 bp, Homo sapiens
aaagtgcagta

SEQ ID NO: 1918180 - DNA, 11 bp, Homo sapiens
aaagtttcatg

SEQ ID NO: 1918181 - DNA, 12 bp, Homo sapiens
aaataaaaatgg

SEQ ID NO: 1918182 - DNA, 17 bp, Homo sapiens
aaataaacaaagtgaag

SEQ ID NO: 1918183 - DNA, 14 bp, Homo sapiens
aaataacaaaaaag

SEQ ID NO: 1918184 - DNA, 14 bp, Homo sapiens
aaataattcttttt

SEQ ID NO: 1918185 - DNA, 19 bp, Homo sapiens
aaataattcttttttatta

SEQ ID NO: 1918186 - DNA, 13 bp, Homo sapiens
aaataattttgta

SEQ ID NO: 1918187 - DNA, 17 bp, Homo sapiens
aaatacacaagtaaaca

SEQ ID NO: 1918188 - DNA, 14 bp, Homo sapiens
aaatacatcaagga

SEQ ID NO: 1918189 - DNA, 17 bp, Homo sapiens
aaatacatttaaaacat

SEQ ID NO: 1918190 - DNA, 23 bp, Homo sapiens
aaataccaaaccttctgactttg

SEQ ID NO: 1918191 - DNA, 15 bp, Homo sapiens
aaatactgtacaatg

SEQ ID NO: 1918192 - DNA, 17 bp, Homo sapiens
aaatagacagcatgaga

SEQ ID NO: 1918193 - DNA, 21 bp, Homo sapiens
aaatagtgtggaaattaagaa

SEQ ID NO: 1918194 - DNA, 12 bp, Homo sapiens
aaatagtttatt

SEQ ID NO: 1918195 - DNA, 17 bp, Homo sapiens
aaatagtttattttaaa

SEQ ID NO: 1918196 - DNA, 23 bp, Homo sapiens
aaatatcaaattaattgtgtgaa

SEQ ID NO: 1918197 - DNA, 17 bp, Homo sapiens
aaatatcacactgaata

SEQ ID NO: 1918198 - DNA, 21 bp, Homo sapiens
aaatatgtggtccatctctga

SEQ ID NO: 1918199 - DNA, 23 bp, Homo sapiens
aaatatgtggtccatctctgaaa

SEQ ID NO: 1918200 - DNA, 21 bp, Homo sapiens
aaatattgtagtttgaatatt

SEQ ID NO: 1918201 - DNA, 16 bp, Homo sapiens
aaatattgttttgcat

SEQ ID NO: 1918202 - DNA, 16 bp, Homo sapiens
aaatcaaatgtaaagt

SEQ ID NO: 1918203 - DNA, 12 bp, Homo sapiens
aaatccaggacc

SEQ ID NO: 1918204 - DNA, 21 bp, Homo sapiens
aaatccaggaccctgccaggc

SEQ ID NO: 1918205 - DNA, 11 bp, Homo sapiens
aaatctgccac

SEQ ID NO: 1918206 - DNA, 14 bp, Homo sapiens
aaatcttaagtcat

SEQ ID NO: 1918207 - DNA, 22 bp, Homo sapiens
aaatgaacacagctctttaaca

SEQ ID NO: 1918208 - DNA, 17 bp, Homo sapiens
aaatgaactcaatataa

SEQ ID NO: 1918209 - DNA, 13 bp, Homo sapiens
aaatgaagaattt

SEQ ID NO: 1918210 - DNA, 19 bp, Homo sapiens
aaatgactttcataataaa

SEQ ID NO: 1918211 - DNA, 21 bp, Homo sapiens
acaagtcatttcaaaatatgt

SEQ ID NO: 1918212 - DNA, 17 bp, Homo sapiens
acaagtccctgtaattg

SEQ ID NO: 1918213 - DNA, 21 bp, Homo sapiens
acaagttgagctatgacttaa

SEQ ID NO: 1918214 - DNA, 22 bp, Homo sapiens
acaataggatgggcttctgtgc

SEQ ID NO: 1918215 - DNA, 20 bp, Homo sapiens
acaatgatatccaatattaa

SEQ ID NO: 1918216 - DNA, 19 bp, Homo sapiens
acaatgtgtctatttctga

SEQ ID NO: 1918217 - DNA, 16 bp, Homo sapiens
acaatttcttttggtt

SEQ ID NO: 1918218 - DNA, 13 bp, Homo sapiens
acacaagtaaaca

SEQ ID NO: 1918219 - DNA, 12 bp, Homo sapiens
acacacctctgc

SEQ ID NO: 1918220 - DNA, 14 bp, Homo sapiens
acacacctctgccc

SEQ ID NO: 1918221 - DNA, 15 bp, Homo sapiens
acacacctctgcccc

SEQ ID NO: 1918222 - DNA, 22 bp, Homo sapiens
acacactggaaattgaaataaa

SEQ ID NO: 1918223 - DNA, 18 bp, Homo sapiens
acacaggacaggggttcc

SEQ ID NO: 1918224 - DNA, 19 bp, Homo sapiens
acacagtaccatttaatgg

SEQ ID NO: 1918225 - DNA, 23 bp, Homo sapiens
acacatataaattgtcttaatgg

SEQ ID NO: 1918226 - DNA, 22 bp, Homo sapiens
acaccaatcttactttgtaaat

SEQ ID NO: 1918227 - DNA, 22 bp, Homo sapiens
acacccagagtagccatgagga

SEQ ID NO: 1918228 - DNA, 14 bp, Homo sapiens
acacccttggagct

SEQ ID NO: 1918229 - DNA, 11 bp, Homo sapiens
acacctcatgc

SEQ ID NO: 1918230 - DNA, 12 bp, Homo sapiens
acacctctgccc

SEQ ID NO: 1918231 - DNA, 14 bp, Homo sapiens
acacgttttaagga

SEQ ID NO: 1918232 - DNA, 17 bp, Homo sapiens
acacgttttaaggactg

SEQ ID NO: 1918233 - DNA, 20 bp, Homo sapiens
acactgaatttttatgtgtg

SEQ ID NO: 1918234 - DNA, 21 bp, Homo sapiens
acactgaatttttatgtgtga

SEQ ID NO: 1918235 - DNA, 20 bp, Homo sapiens
acactgctgaggcttcataa

SEQ ID NO: 1918236 - DNA, 14 bp, Homo sapiens
acactgtggcagca

SEQ ID NO: 1918237 - DNA, 16 bp, Homo sapiens
acagacaccacagcct

SEQ ID NO: 1918238 - DNA, 18 bp, Homo sapiens
acagacaccacagcctcc

SEQ ID NO: 1918239 - DNA, 21 bp, Homo sapiens
acagacaccacagcctcccct

SEQ ID NO: 1918240 - DNA, 19 bp, Homo sapiens
acagaccgaactgttgtat

SEQ ID NO: 1918241 - DNA, 20 bp, Homo sapiens
acagactttagctttctgag

SEQ ID NO: 1918242 - DNA, 20 bp, Homo sapiens
acagagcaacccctggaccc

SEQ ID NO: 1918243 - DNA, 23 bp, Homo sapiens
acagagcaacccctggaccccag

SEQ ID NO: 1918244 - DNA, 14 bp, Homo sapiens
acagagctaaggcc

SEQ ID NO: 1918245 - DNA, 13 bp, Homo sapiens
acagaggctgtgg

SEQ ID NO: 1918246 - DNA, 20 bp, Homo sapiens
acagaggctgtggtcagaga

SEQ ID NO: 1918247 - DNA, 15 bp, Homo sapiens
acagagtaatcttgt

SEQ ID NO: 1918248 - DNA, 14 bp, Homo sapiens
acagatttgctttt

SEQ ID NO: 1918249 - DNA, 15 bp, Homo sapiens
acagatttggaaaga

SEQ ID NO: 1918250 - DNA, 17 bp, Homo sapiens
acagattttattaatca

SEQ ID NO: 1918251 - DNA, 20 bp, Homo sapiens
acagcaacgatcacaaatga

SEQ ID NO: 1918252 - DNA, 15 bp, Homo sapiens
acagcaagtgtgaat

SEQ ID NO: 1918253 - DNA, 23 bp, Homo sapiens
acagcagggccttctgcctgctg

SEQ ID NO: 1918254 - DNA, 17 bp, Homo sapiens
acagccctatttcttga

SEQ ID NO: 1918255 - DNA, 14 bp, Homo sapiens
acagcctccccttc

SEQ ID NO: 1918256 - DNA, 20 bp, Homo sapiens
acagcctccccttcccagac

SEQ ID NO: 1918257 - DNA, 12 bp, Homo sapiens
acagcctctgtg

SEQ ID NO: 1918258 - DNA, 16 bp, Homo sapiens
acagcgttatgtgtct

SEQ ID NO: 1918259 - DNA, 18 bp, Homo sapiens
acagctctttaacatggt

SEQ ID NO: 1918260 - DNA, 13 bp, Homo sapiens
acagctgttgact

SEQ ID NO: 1918261 - DNA, 17 bp, Homo sapiens
acaggctgagtgcaggc

SEQ ID NO: 1918262 - DNA, 19 bp, Homo sapiens
acaggctgagtgcaggccc

SEQ ID NO: 1918263 - DNA, 22 bp, Homo sapiens
acaggctgagtgcaggcccacc

SEQ ID NO: 1918264 - DNA, 21 bp, Homo sapiens
acaggctgggctgggcactgc

SEQ ID NO: 1918265 - DNA, 20 bp, Homo sapiens
acagggcccgggcccaggca

SEQ ID NO: 1918266 - DNA, 21 bp, Homo sapiens
acagggcccgggcccaggcag

SEQ ID NO: 1918267 - DNA, 13 bp, Homo sapiens
acagggcctggcc

SEQ ID NO: 1918268 - DNA, 14 bp, Homo sapiens
acagggcctggccc

SEQ ID NO: 1918269 - DNA, 15 bp, Homo sapiens
acagggcctggccca

SEQ ID NO: 1918270 - DNA, 16 bp, Homo sapiens
acagggcctggcccat

SEQ ID NO: 1918271 - DNA, 17 bp, Homo sapiens
acagggcctggcccatg

SEQ ID NO: 1918272 - DNA, 13 bp, Homo sapiens
acaggggttcctt

SEQ ID NO: 1918273 - DNA, 23 bp, Homo sapiens
acagggtctctagtgctgtgaaa

SEQ ID NO: 1918274 - DNA, 16 bp, Homo sapiens
acaggttccttttaag

SEQ ID NO: 1918275 - DNA, 13 bp, Homo sapiens
acagtaagctggt

SEQ ID NO: 1918276 - DNA, 12 bp, Homo sapiens
acagtctcacca

SEQ ID NO: 1918277 - DNA, 13 bp, Homo sapiens
acagtgccagctt

SEQ ID NO: 1918278 - DNA, 21 bp, Homo sapiens
acagtgtactttgttaaaaac

SEQ ID NO: 1918279 - DNA, 22 bp, Homo sapiens
acagtgtactttgttaaaaaca

SEQ ID NO: 1918280 - DNA, 14 bp, Homo sapiens
acagtgtgattttg

SEQ ID NO: 1918281 - DNA, 11 bp, Homo sapiens
acagttgtttg

SEQ ID NO: 1918282 - DNA, 13 bp, Homo sapiens
acagttgtttgat

SEQ ID NO: 1918283 - DNA, 22 bp, Homo sapiens
acagttgtttgatgcattaaaa

SEQ ID NO: 1918284 - DNA, 18 bp, Homo sapiens
acagtttaagaagtggtg

SEQ ID NO: 1918285 - DNA, 19 bp, Homo sapiens
acagtttacttggaaattg

SEQ ID NO: 1918286 - DNA, 21 bp, Homo sapiens
acagttttccttatcagaggc

SEQ ID NO: 1918287 - DNA, 15 bp, Homo sapiens
acatacgtaaaaatc

SEQ ID NO: 1918288 - DNA, 13 bp, Homo sapiens
acatagaaagagt

SEQ ID NO: 1918289 - DNA, 21 bp, Homo sapiens
acataggaagttaaaagcaca

SEQ ID NO: 1918290 - DNA, 22 bp, Homo sapiens
acataggcttatacaaatttaa

SEQ ID NO: 1918291 - DNA, 14 bp, Homo sapiens
acatatctttgagt

SEQ ID NO: 1918292 - DNA, 16 bp, Homo sapiens
acatatctttgagttc

SEQ ID NO: 1918293 - DNA, 18 bp, Homo sapiens
acatcaaggagttatgct

SEQ ID NO: 1918294 - DNA, 21 bp, Homo sapiens
acatgcattcacatatctgct

SEQ ID NO: 1918295 - DNA, 13 bp, Homo sapiens
acatgcctcctcc

SEQ ID NO: 1918296 - DNA, 16 bp, Homo sapiens
acatgcctcctcctgc

SEQ ID NO: 1918297 - DNA, 11 bp, Homo sapiens
acatggtgatg

SEQ ID NO: 1918298 - DNA, 14 bp, Homo sapiens
acatgtgaaaagaa

SEQ ID NO: 1918299 - DNA, 19 bp, Homo sapiens
acattaggccccagcaaca

SEQ ID NO: 1918300 - DNA, 12 bp, Homo sapiens
acattgtgaatg

SEQ ID NO: 1918301 - DNA, 21 bp, Homo sapiens
acattgtgaatgctgtgggaa

SEQ ID NO: 1918302 - DNA, 21 bp, Homo sapiens
acatttagtaaatgctgaaat

SEQ ID NO: 1918303 - DNA, 22 bp, Homo sapiens
acatttagtaaatgctgaaata

SEQ ID NO: 1918304 - DNA, 21 bp, Homo sapiens
acatttcaaggtaaaatgtag

SEQ ID NO: 1918305 - DNA, 23 bp, Homo sapiens
acatttcaaggtaaaatgtagct

SEQ ID NO: 1918306 - DNA, 13 bp, Homo sapiens
acatttgaaaata

SEQ ID NO: 1918307 - DNA, 11 bp, Homo sapiens
acatttgaata

SEQ ID NO: 1918308 - DNA, 17 bp, Homo sapiens
acatttgaataatgtct

SEQ ID NO: 1918309 - DNA, 19 bp, Homo sapiens
acattttgaaataaaaatg

SEQ ID NO: 1918310 - DNA, 22 bp, Homo sapiens
accaaacccaccctttctactt

SEQ ID NO: 1918311 - DNA, 12 bp, Homo sapiens
accaacctgaaa

SEQ ID NO: 1918312 - DNA, 13 bp, Homo sapiens
accaacctgaaag

SEQ ID NO: 1918313 - DNA, 21 bp, Homo sapiens
accaatcttactttgtaaatt

SEQ ID NO: 1918314 - DNA, 12 bp, Homo sapiens
accacagacttt

SEQ ID NO: 1918315 - DNA, 23 bp, Homo sapiens
accacagactttagctttctgag

SEQ ID NO: 1918316 - DNA, 14 bp, Homo sapiens
accacagcctcccc

SEQ ID NO: 1918317 - DNA, 15 bp, Homo sapiens
accacagcctcccct

SEQ ID NO: 1918318 - DNA, 19 bp, Homo sapiens
accacagcctccccttccc

SEQ ID NO: 1918319 - DNA, 20 bp, Homo sapiens
accacagcctccccttccca

SEQ ID NO: 1918320 - DNA, 15 bp, Homo sapiens
accacaggtgcccgc

SEQ ID NO: 1918321 - DNA, 13 bp, Homo sapiens
accacttgtagat

SEQ ID NO: 1918322 - DNA, 19 bp, Homo sapiens
accacttgtagatttgatt

SEQ ID NO: 1918323 - DNA, 17 bp, Homo sapiens
accagaagacaaaggcc

SEQ ID NO: 1918324 - DNA, 14 bp, Homo sapiens
accagcaggctcct

SEQ ID NO: 1918325 - DNA, 17 bp, Homo sapiens
accagcgcccccactcc

SEQ ID NO: 1918326 - DNA, 22 bp, Homo sapiens
accagcgcccccactcctcctc

SEQ ID NO: 1918327 - DNA, 15 bp, Homo sapiens
accagctttgacccg

SEQ ID NO: 1918328 - DNA, 15 bp, Homo sapiens
accagttctgggcaa

SEQ ID NO: 1918329 - DNA, 14 bp, Homo sapiens
accagttttgatat

SEQ ID NO: 1918330 - DNA, 19 bp, Homo sapiens
accatgtcgtagttactct

SEQ ID NO: 1918331 - DNA, 23 bp, Homo sapiens
accattgagaccgtgaagatact

SEQ ID NO: 1918332 - DNA, 17 bp, Homo sapiens
accatttccccagggca

SEQ ID NO: 1918333 - DNA, 21 bp, Homo sapiens
acccagaaaatctgaattgga

SEQ ID NO: 1918334 - DNA, 15 bp, Homo sapiens
acccagacctgcctg

SEQ ID NO: 1918335 - DNA, 16 bp, Homo sapiens
acccagacctgcctgt

SEQ ID NO: 1918336 - DNA, 16 bp, Homo sapiens
acccatgaaagaaaac

SEQ ID NO: 1918337 - DNA, 13 bp, Homo sapiens
acccatgggcagg

SEQ ID NO: 1918338 - DNA, 17 bp, Homo sapiens
acccatgggcaggagac

SEQ ID NO: 1918339 - DNA, 13 bp, Homo sapiens
accccacgggagg

SEQ ID NO: 1918340 - DNA, 14 bp, Homo sapiens
accccactggagtc

SEQ ID NO: 1918341 - DNA, 20 bp, Homo sapiens
accccagcctcaaatccagg

SEQ ID NO: 1918342 - DNA, 18 bp, Homo sapiens
accccatctgtgaataag

SEQ ID NO: 1918343 - DNA, 17 bp, Homo sapiens
acccccagcccagcaga

SEQ ID NO: 1918344 - DNA, 18 bp, Homo sapiens
accccgcagcacgcctct

SEQ ID NO: 1918345 - DNA, 19 bp, Homo sapiens
accccgcagcacgcctctc

SEQ ID NO: 1918346 - DNA, 22 bp, Homo sapiens
acccctcgcccagtcccagcag

SEQ ID NO: 1918347 - DNA, 11 bp, Homo sapiens
acccctgcccc

SEQ ID NO: 1918348 - DNA, 12 bp, Homo sapiens
acccctggaccc

SEQ ID NO: 1918349 - DNA, 14 bp, Homo sapiens
acccctggacccca

SEQ ID NO: 1918350 - DNA, 17 bp, Homo sapiens
acccctggaccccagcc

SEQ ID NO: 1918351 - DNA, 18 bp, Homo sapiens
acccctggaccccagcct

SEQ ID NO: 1918352 - DNA, 24 bp, Homo sapiens
acccctgtaaggggccagagcctt

SEQ ID NO: 1918353 - DNA, 16 bp, Homo sapiens
acccctgtaggcctca

SEQ ID NO: 1918354 - DNA, 17 bp, Homo sapiens
acccctgtaggcctcag

SEQ ID NO: 1918355 - DNA, 17 bp, Homo sapiens
acccctgtgtgacatca

SEQ ID NO: 1918356 - DNA, 18 bp, Homo sapiens
accctgatcacctcaggg

SEQ ID NO: 1918357 - DNA, 17 bp, Homo sapiens
accctgccaggcacagg

SEQ ID NO: 1918358 - DNA, 21 bp, Homo sapiens
accctgccaggcacaggcagg

SEQ ID NO: 1918359 - DNA, 14 bp, Homo sapiens
accctgctgagtct

SEQ ID NO: 1918360 - DNA, 18 bp, Homo sapiens
accctgcttggcccaggg

SEQ ID NO: 1918361 - DNA, 22 bp, Homo sapiens
accctggcaaagcagcaacaca

SEQ ID NO: 1918362 - DNA, 14 bp, Homo sapiens
accctggttgtgtg

SEQ ID NO: 1918363 - DNA, 14 bp, Homo sapiens
accctgtcccaggc

SEQ ID NO: 1918364 - DNA, 23 bp, Homo sapiens
acccttccatctgattccagcac

SEQ ID NO: 1918365 - DNA, 14 bp, Homo sapiens
acccttggagctct

SEQ ID NO: 1918366 - DNA, 13 bp, Homo sapiens
accctttctggca

SEQ ID NO: 1918367 - DNA, 14 bp, Homo sapiens
accctttctggcac

SEQ ID NO: 1918368 - DNA, 16 bp, Homo sapiens
accctttctggcacga

SEQ ID NO: 1918369 - DNA, 17 bp, Homo sapiens
accctttctggcacgaa

SEQ ID NO: 1918370 - DNA, 12 bp, Homo sapiens
accgaggacagc

SEQ ID NO: 1918371 - DNA, 16 bp, Homo sapiens
accgaggacagcctgc

SEQ ID NO: 1918372 - DNA, 17 bp, Homo sapiens
accgaggacagcctgcc

SEQ ID NO: 1918373 - DNA, 16 bp, Homo sapiens
accgtcccctcccagg

SEQ ID NO: 1918374 - DNA, 18 bp, Homo sapiens
accgtcccctcccaggga

SEQ ID NO: 1918375 - DNA, 16 bp, Homo sapiens
accgtccctctgcaga

SEQ ID NO: 1918376 - DNA, 14 bp, Homo sapiens
accgtgaagatact

SEQ ID NO: 1918377 - DNA, 19 bp, Homo sapiens
accgtgaagatactttgta

SEQ ID NO: 1918378 - DNA, 21 bp, Homo sapiens
accgtgaagatactttgtatt

SEQ ID NO: 1918379 - DNA, 17 bp, Homo sapiens
acctaagtacttaaaag

SEQ ID NO: 1918380 - DNA, 15 bp, Homo sapiens
acctaattgcacaac

SEQ ID NO: 1918381 - DNA, 23 bp, Homo sapiens
acctagattattgaattcttcac

SEQ ID NO: 1918382 - DNA, 12 bp, Homo sapiens
acctaggaggat

SEQ ID NO: 1918383 - DNA, 20 bp, Homo sapiens
acctcacacacctctgcccc

SEQ ID NO: 1918384 - DNA, 19 bp, Homo sapiens
acctcccccgacgctctct

SEQ ID NO: 1918385 - DNA, 19 bp, Homo sapiens
acctccccttgccagctgc

SEQ ID NO: 1918386 - DNA, 21 bp, Homo sapiens
acctcctaaaaggcccagaga

SEQ ID NO: 1918387 - DNA, 23 bp, Homo sapiens
acctcgggctgttctggtggccc

SEQ ID NO: 1918388 - DNA, 21 bp, Homo sapiens
acctctgccccttgggcctcc

SEQ ID NO: 1918389 - DNA, 22 bp, Homo sapiens
acctctgccccttgggcctccc

SEQ ID NO: 1918390 - DNA, 23 bp, Homo sapiens
acctgaacccagaaacaacacaa

SEQ ID NO: 1918391 - DNA, 21 bp, Homo sapiens
acctgaaggggttttcttgat

SEQ ID NO: 1918392 - DNA, 20 bp, Homo sapiens
acctggatatccatgagctg

SEQ ID NO: 1918393 - DNA, 20 bp, Homo sapiens
acctggggctgctgtgaagc

SEQ ID NO: 1918394 - DNA, 20 bp, Homo sapiens
acctgtttcataagctttgt

SEQ ID NO: 1918395 - DNA, 18 bp, Homo sapiens
accttactctgagctcat

SEQ ID NO: 1918396 - DNA, 20 bp, Homo sapiens
accttcaagctgctttttgt

SEQ ID NO: 1918397 - DNA, 15 bp, Homo sapiens
accttcataagatct

SEQ ID NO: 1918398 - DNA, 18 bp, Homo sapiens
accttctatagcatcact

SEQ ID NO: 1918399 - DNA, 15 bp, Homo sapiens
accttctgccagaag

SEQ ID NO: 1918400 - DNA, 12 bp, Homo sapiens
accttggcttgg

SEQ ID NO: 1918401 - DNA, 13 bp, Homo sapiens
accttggttcctg

SEQ ID NO: 1918402 - DNA, 18 bp, Homo sapiens
accttgtcattttggtct

SEQ ID NO: 1918403 - DNA, 16 bp, Homo sapiens
acgaaactggaataag

SEQ ID NO: 1918404 - DNA, 13 bp, Homo sapiens
acgaaatggctga

SEQ ID NO: 1918405 - DNA, 23 bp, Homo sapiens
acgactcttttccaaacacaggc

SEQ ID NO: 1918406 - DNA, 17 bp, Homo sapiens
acgatcacaaatgactt

SEQ ID NO: 1918407 - DNA, 19 bp, Homo sapiens
acgcaattctcgattcttt

SEQ ID NO: 1918408 - DNA, 18 bp, Homo sapiens
acgcctgtaaatgtattc

SEQ ID NO: 1918409 - DNA, 20 bp, Homo sapiens
acgctcctttctgatcttca

SEQ ID NO: 1918410 - DNA, 22 bp, Homo sapiens
acggatcctgcactgactctgg

SEQ ID NO: 1918411 - DNA, 19 bp, Homo sapiens
acggttcaaacctgtgaag

SEQ ID NO: 1918412 - DNA, 10 bp, Homo sapiens
acggttccta

SEQ ID NO: 1918413 - DNA, 18 bp, Homo sapiens
acggttcctacacaggac

SEQ ID NO: 1918414 - DNA, 13 bp, Homo sapiens
acgtattattgtc

SEQ ID NO: 1918415 - DNA, 12 bp, Homo sapiens
acgtctgccacc

SEQ ID NO: 1918416 - DNA, 15 bp, Homo sapiens
acgtctgccaccagc

SEQ ID NO: 1918417 - DNA, 21 bp, Homo sapiens
acgtggagaatcacaggctgg

SEQ ID NO: 1918418 - DNA, 22 bp, Homo sapiens
acgtggagaatcacaggctggg

SEQ ID NO: 1918419 - DNA, 19 bp, Homo sapiens
acgttcctctccacctgca

SEQ ID NO: 1918420 - DNA, 14 bp, Homo sapiens
acgttttaaggact

SEQ ID NO: 1918421 - DNA, 14 bp, Homo sapiens
actaaaataatttt

SEQ ID NO: 1918422 - DNA, 17 bp, Homo sapiens
actaaaataattttgta

SEQ ID NO: 1918423 - DNA, 16 bp, Homo sapiens
actaaaccacttaaaa

SEQ ID NO: 1918424 - DNA, 16 bp, Homo sapiens
actaagactgcttcta

SEQ ID NO: 1918425 - DNA, 14 bp, Homo sapiens
actaattctatgtc

SEQ ID NO: 1918426 - DNA, 22 bp, Homo sapiens
actataccaactgggcctctga

SEQ ID NO: 1918427 - DNA, 16 bp, Homo sapiens
actcaggaaagaggag

SEQ ID NO: 1918428 - DNA, 22 bp, Homo sapiens
actcatctggagttctcaaaga

SEQ ID NO: 1918429 - DNA, 21 bp, Homo sapiens
actccaaaccttactctgagc

SEQ ID NO: 1918430 - DNA, 15 bp, Homo sapiens
actccactgcgcctg

SEQ ID NO: 1918431 - DNA, 23 bp, Homo sapiens
actcctcctcctttctttgctgt

SEQ ID NO: 1918432 - DNA, 21 bp, Homo sapiens
actcggatgtgtcctttctga

SEQ ID NO: 1918433 - DNA, 17 bp, Homo sapiens
actctaggactgggccc

SEQ ID NO: 1918434 - DNA, 13 bp, Homo sapiens
actctatggtctt

SEQ ID NO: 1918435 - DNA, 21 bp, Homo sapiens
actctcaggaaatgctgaccc

SEQ ID NO: 1918436 - DNA, 16 bp, Homo sapiens
actctctgacaaagtg

SEQ ID NO: 1918437 - DNA, 17 bp, Homo sapiens
actctctgacaaagtgg

SEQ ID NO: 1918438 - DNA, 12 bp, Homo sapiens
actctgagctca

SEQ ID NO: 1918439 - DNA, 13 bp, Homo sapiens
actctgagctcat

SEQ ID NO: 1918440 - DNA, 11 bp, Homo sapiens
actctgggaac

SEQ ID NO: 1918441 - DNA, 22 bp, Homo sapiens
actctgggaacttctttgcagt

SEQ ID NO: 1918442 - DNA, 20 bp, Homo sapiens
actctggggctggcaccagc

SEQ ID NO: 1918443 - DNA, 12 bp, Homo sapiens
actcttctcatt

SEQ ID NO: 1918444 - DNA, 17 bp, Homo sapiens
actcttctcattacttg

SEQ ID NO: 1918445 - DNA, 18 bp, Homo sapiens
actcttctcattacttgt

SEQ ID NO: 1918446 - DNA, 24 bp, Homo sapiens
actcttctcattacttgttgccta

SEQ ID NO: 1918447 - DNA, 14 bp, Homo sapiens
actgaaaatgaact

SEQ ID NO: 1918448 - DNA, 21 bp, Homo sapiens
actgaaaatgaactgtaaatg

SEQ ID NO: 1918449 - DNA, 16 bp, Homo sapiens
actgaaaggcttttca

SEQ ID NO: 1918450 - DNA, 17 bp, Homo sapiens
actgaaaggcttttcaa

SEQ ID NO: 1918451 - DNA, 17 bp, Homo sapiens
actgaaatgctttagca

SEQ ID NO: 1918452 - DNA, 18 bp, Homo sapiens
actgaatggctgacctga

SEQ ID NO: 1918453 - DNA, 22 bp, Homo sapiens
actgactataccaactgggcct

SEQ ID NO: 1918454 - DNA, 21 bp, Homo sapiens
actgatggaatttttttgtac

SEQ ID NO: 1918455 - DNA, 19 bp, Homo sapiens
actgatgtgttgtgcctta

SEQ ID NO: 1918456 - DNA, 17 bp, Homo sapiens
actgcattcttctgatc

SEQ ID NO: 1918457 - DNA, 16 bp, Homo sapiens
actgccagctcttcct

SEQ ID NO: 1918458 - DNA, 16 bp, Homo sapiens
actgctcctgagcccc

SEQ ID NO: 1918459 - DNA, 11 bp, Homo sapiens
actgctctcac

SEQ ID NO: 1918460 - DNA, 22 bp, Homo sapiens
actgctctcaccttggttcctg

SEQ ID NO: 1918461 - DNA, 15 bp, Homo sapiens
actgctgtgaacatg

SEQ ID NO: 1918462 - DNA, 18 bp, Homo sapiens
actgctgtgaacatgcct

SEQ ID NO: 1918463 - DNA, 21 bp, Homo sapiens
actgctgtgaacatgcctcct

SEQ ID NO: 1918464 - DNA, 18 bp, Homo sapiens
actgcttcctttcttgat

SEQ ID NO: 1918465 - DNA, 13 bp, Homo sapiens
actgcttgaataa

SEQ ID NO: 1918466 - DNA, 14 bp, Homo sapiens
actgcttgacaaag

SEQ ID NO: 1918467 - DNA, 14 bp, Homo sapiens
actgctttctgaat

SEQ ID NO: 1918468 - DNA, 23 bp, Homo sapiens
actgcttttgtagtgtgttttca

SEQ ID NO: 1918469 - DNA, 16 bp, Homo sapiens
actggagtctctctct

SEQ ID NO: 1918470 - DNA, 21 bp, Homo sapiens
actggagtctctctctctcca

SEQ ID NO: 1918471 - DNA, 13 bp, Homo sapiens
actggagtgaatg

SEQ ID NO: 1918472 - DNA, 21 bp, Homo sapiens
actgggggacactgtggcagc

SEQ ID NO: 1918473 - DNA, 15 bp, Homo sapiens
actggtctacactgg

SEQ ID NO: 1918474 - DNA, 22 bp, Homo sapiens
actgtacaatgactttattgca

SEQ ID NO: 1918475 - DNA, 16 bp, Homo sapiens
actgtccgctgtctcc

SEQ ID NO: 1918476 - DNA, 20 bp, Homo sapiens
actgtccgctgtctccctcc

SEQ ID NO: 1918477 - DNA, 22 bp, Homo sapiens
actgtccgctgtctccctcctg

SEQ ID NO: 1918478 - DNA, 18 bp, Homo sapiens
actgtctcggcagaggtg

SEQ ID NO: 1918479 - DNA, 23 bp, Homo sapiens
actgtgcgtggggctcccgcctc

SEQ ID NO: 1918480 - DNA, 22 bp, Homo sapiens
actgtggagactgctcctgagc

SEQ ID NO: 1918481 - DNA, 15 bp, Homo sapiens
actgtggcagcagga

SEQ ID NO: 1918482 - DNA, 18 bp, Homo sapiens
actgtggcagcaggaggg

SEQ ID NO: 1918483 - DNA, 19 bp, Homo sapiens
actgtggcagcaggaggga

SEQ ID NO: 1918484 - DNA, 19 bp, Homo sapiens
agagctggagtctgggctc

SEQ ID NO: 1918485 - DNA, 19 bp, Homo sapiens
agaggacaatctagctctc

SEQ ID NO: 1918486 - DNA, 23 bp, Homo sapiens
agaggagccctgcctctccgccc

SEQ ID NO: 1918487 - DNA, 22 bp, Homo sapiens
agaggattggctcccatctttt

SEQ ID NO: 1918488 - DNA, 15 bp, Homo sapiens
agaggctgtggtcag

SEQ ID NO: 1918489 - DNA, 16 bp, Homo sapiens
agaggctgtggtcaga

SEQ ID NO: 1918490 - DNA, 17 bp, Homo sapiens
agagggaagctgaggcc

SEQ ID NO: 1918491 - DNA, 22 bp, Homo sapiens
agagggaagctgaggcccatgg

SEQ ID NO: 1918492 - DNA, 21 bp, Homo sapiens
agaggggccagcggccctccc

SEQ ID NO: 1918493 - DNA, 14 bp, Homo sapiens
agaggtggcttcag

SEQ ID NO: 1918494 - DNA, 13 bp, Homo sapiens
agaggtggtctgg

SEQ ID NO: 1918495 - DNA, 14 bp, Homo sapiens
agaggtgtgtgacg

SEQ ID NO: 1918496 - DNA, 12 bp, Homo sapiens
agagtacactgc

SEQ ID NO: 1918497 - DNA, 22 bp, Homo sapiens
agagtagccatgaggaggcaga

SEQ ID NO: 1918498 - DNA, 23 bp, Homo sapiens
agagtatatttaagaagccaagg

SEQ ID NO: 1918499 - DNA, 14 bp, Homo sapiens
agagtctgagggct

SEQ ID NO: 1918500 - DNA, 20 bp, Homo sapiens
agagtgccaacttctttcat

SEQ ID NO: 1918501 - DNA, 21 bp, Homo sapiens
agagtggccccacctggccct

SEQ ID NO: 1918502 - DNA, 17 bp, Homo sapiens
agataaaaaaacagctt

SEQ ID NO: 1918503 - DNA, 22 bp, Homo sapiens
agataattgtactttgaaaaca

SEQ ID NO: 1918504 - DNA, 12 bp, Homo sapiens
agatactctggg

SEQ ID NO: 1918505 - DNA, 15 bp, Homo sapiens
agatactttgtattg

SEQ ID NO: 1918506 - DNA, 22 bp, Homo sapiens
agatactttgtattgtcctatt

SEQ ID NO: 1918507 - DNA, 15 bp, Homo sapiens
agatcaaaaaggctt

SEQ ID NO: 1918508 - DNA, 19 bp, Homo sapiens
agatcaaaaaggcttataa

SEQ ID NO: 1918509 - DNA, 15 bp, Homo sapiens
agatcacagcagggc

SEQ ID NO: 1918510 - DNA, 17 bp, Homo sapiens
agatcacagcagggcct

SEQ ID NO: 1918511 - DNA, 15 bp, Homo sapiens
agatcactgtttaga

SEQ ID NO: 1918512 - DNA, 16 bp, Homo sapiens
agatcactgtttagat

SEQ ID NO: 1918513 - DNA, 23 bp, Homo sapiens
agatcatagttttatttatattt

SEQ ID NO: 1918514 - DNA, 15 bp, Homo sapiens
agatggatggacaga

SEQ ID NO: 1918515 - DNA, 19 bp, Homo sapiens
agatggatggacagacaga

SEQ ID NO: 1918516 - DNA, 18 bp, Homo sapiens
agatgtagatttatttca

SEQ ID NO: 1918517 - DNA, 20 bp, Homo sapiens
agatgtggttaattttgcat

SEQ ID NO: 1918518 - DNA, 23 bp, Homo sapiens
agatgttgaggcgagcagggcag

SEQ ID NO: 1918519 - DNA, 16 bp, Homo sapiens
agatgttttccactga

SEQ ID NO: 1918520 - DNA, 13 bp, Homo sapiens
agattaagaaata

SEQ ID NO: 1918521 - DNA, 15 bp, Homo sapiens
agattaagaaataga

SEQ ID NO: 1918522 - DNA, 19 bp, Homo sapiens
agattgtggggagagaaat

SEQ ID NO: 1918523 - DNA, 14 bp, Homo sapiens
agatttgatatatg

SEQ ID NO: 1918524 - DNA, 16 bp, Homo sapiens
agatttgatatatgta

SEQ ID NO: 1918525 - DNA, 17 bp, Homo sapiens
agatttgatatatgtat

SEQ ID NO: 1918526 - DNA, 21 bp, Homo sapiens
agatttgccatagagtacact

SEQ ID NO: 1918527 - DNA, 12 bp, Homo sapiens
agattttgaaaa

SEQ ID NO: 1918528 - DNA, 17 bp, Homo sapiens
agattttgaaaaattac

SEQ ID NO: 1918529 - DNA, 18 bp, Homo sapiens
agcaaaatgaaaagagaa

SEQ ID NO: 1918530 - DNA, 22 bp, Homo sapiens
agcaaaatgaaaagagaaactt

SEQ ID NO: 1918531 - DNA, 15 bp, Homo sapiens
agcaaatggcctcat

SEQ ID NO: 1918532 - DNA, 20 bp, Homo sapiens
agcaaatggcctcatgtcaa

SEQ ID NO: 1918533 - DNA, 21 bp, Homo sapiens
agcaacccctggaccccagcc

SEQ ID NO: 1918534 - DNA, 21 bp, Homo sapiens
agcaaggccacctcttcctgg

SEQ ID NO: 1918535 - DNA, 22 bp, Homo sapiens
agcaaggccacctcttcctggc

SEQ ID NO: 1918536 - DNA, 21 bp, Homo sapiens
agcaatattcttggagattga

SEQ ID NO: 1918537 - DNA, 20 bp, Homo sapiens
agcacaaccttcaagctgct

SEQ ID NO: 1918538 - DNA, 14 bp, Homo sapiens
agcacaagatgttg

SEQ ID NO: 1918539 - DNA, 19 bp, Homo sapiens
agcacaggctgagtgcagg

SEQ ID NO: 1918540 - DNA, 20 bp, Homo sapiens
agcacaggctgagtgcaggc

SEQ ID NO: 1918541 - DNA, 23 bp, Homo sapiens
agcacaggctgagtgcaggccca

SEQ ID NO: 1918542 - DNA, 13 bp, Homo sapiens
agcacgcctctcc

SEQ ID NO: 1918543 - DNA, 15 bp, Homo sapiens
agcacgcctctcccc

SEQ ID NO: 1918544 - DNA, 20 bp, Homo sapiens
agcacgcctctccccacctt

SEQ ID NO: 1918545 - DNA, 14 bp, Homo sapiens
agcagaaggcagga

SEQ ID NO: 1918546 - DNA, 23 bp, Homo sapiens
agcagactgttctaaaatataat

SEQ ID NO: 1918547 - DNA, 17 bp, Homo sapiens
agcagatgttgaagaca

SEQ ID NO: 1918548 - DNA, 12 bp, Homo sapiens
agcagcctctga

SEQ ID NO: 1918549 - DNA, 17 bp, Homo sapiens
agcagcctctgatctgt

SEQ ID NO: 1918550 - DNA, 19 bp, Homo sapiens
agcagcgcggatttctctt

SEQ ID NO: 1918551 - DNA, 17 bp, Homo sapiens
agcagctttagcaaaga

SEQ ID NO: 1918552 - DNA, 21 bp, Homo sapiens
agcaggccctgggcctccacc

SEQ ID NO: 1918553 - DNA, 20 bp, Homo sapiens
agcaggctcctcagccctct

SEQ ID NO: 1918554 - DNA, 16 bp, Homo sapiens
agcagggcaggccccc

SEQ ID NO: 1918555 - DNA, 19 bp, Homo sapiens
agcagggccttctgcctgc

SEQ ID NO: 1918556 - DNA, 21 bp, Homo sapiens
agcagggccttctgcctgctg

SEQ ID NO: 1918557 - DNA, 16 bp, Homo sapiens
agcagtgcccaggtgg

SEQ ID NO: 1918558 - DNA, 20 bp, Homo sapiens
agcagtgcccaggtggctgt

SEQ ID NO: 1918559 - DNA, 21 bp, Homo sapiens
agcagttatgtgacctcacgt

SEQ ID NO: 1918560 - DNA, 17 bp, Homo sapiens
agcagttgctggtaaaa

SEQ ID NO: 1918561 - DNA, 21 bp, Homo sapiens
agcagttgctggtaaaatgaa

SEQ ID NO: 1918562 - DNA, 17 bp, Homo sapiens
agcatactagaatcaga

SEQ ID NO: 1918563 - DNA, 14 bp, Homo sapiens
agcatcacttaaaa

SEQ ID NO: 1918564 - DNA, 20 bp, Homo sapiens
agcatgtgttgcagctgtca

SEQ ID NO: 1918565 - DNA, 18 bp, Homo sapiens
agcatgtttcattctctg

SEQ ID NO: 1918566 - DNA, 19 bp, Homo sapiens
agcattctaaatgaactca

SEQ ID NO: 1918567 - DNA, 12 bp, Homo sapiens
agcattctctcc

SEQ ID NO: 1918568 - DNA, 19 bp, Homo sapiens
agcattgcagtcactttga

SEQ ID NO: 1918569 - DNA, 16 bp, Homo sapiens
agcatttgtgtgttac

SEQ ID NO: 1918570 - DNA, 17 bp, Homo sapiens
agccaaaattaaggtgt

SEQ ID NO: 1918571 - DNA, 22 bp, Homo sapiens
agccaaacacacagaaggggac

SEQ ID NO: 1918572 - DNA, 19 bp, Homo sapiens
agccaccctttctggcacg

SEQ ID NO: 1918573 - DNA, 22 bp, Homo sapiens
agccagccaaacacacagaagg

SEQ ID NO: 1918574 - DNA, 23 bp, Homo sapiens
agccagccaaacacacagaaggg

SEQ ID NO: 1918575 - DNA, 17 bp, Homo sapiens
agccatgaggaggcaga

SEQ ID NO: 1918576 - DNA, 22 bp, Homo sapiens
agccatttctccatggagttgc

SEQ ID NO: 1918577 - DNA, 22 bp, Homo sapiens
agcccacgctgactacagggcc

SEQ ID NO: 1918578 - DNA, 14 bp, Homo sapiens
agcccaggagccca

SEQ ID NO: 1918579 - DNA, 15 bp, Homo sapiens
agccccactctcaga

SEQ ID NO: 1918580 - DNA, 19 bp, Homo sapiens
agccccactctcagaggcc

SEQ ID NO: 1918581 - DNA, 14 bp, Homo sapiens
agccccattaactg

SEQ ID NO: 1918582 - DNA, 15 bp, Homo sapiens
agccccattaactgc

SEQ ID NO: 1918583 - DNA, 16 bp, Homo sapiens
agcccccagcttccag

SEQ ID NO: 1918584 - DNA, 22 bp, Homo sapiens
agcccccagcttccagcaggag

SEQ ID NO: 1918585 - DNA, 18 bp, Homo sapiens
agccccctggtctttgag

SEQ ID NO: 1918586 - DNA, 14 bp, Homo sapiens
agcccgcatcagct

SEQ ID NO: 1918587 - DNA, 21 bp, Homo sapiens
agccctcagtcggggcaggcc

SEQ ID NO: 1918588 - DNA, 13 bp, Homo sapiens
agccctctcttgc

SEQ ID NO: 1918589 - DNA, 13 bp, Homo sapiens
agccctgcctctc

SEQ ID NO: 1918590 - DNA, 15 bp, Homo sapiens
agccctgcctctccg

SEQ ID NO: 1918591 - DNA, 16 bp, Homo sapiens
agccctgcctctccgc

SEQ ID NO: 1918592 - DNA, 17 bp, Homo sapiens
agccctgggccagggcg

SEQ ID NO: 1918593 - DNA, 15 bp, Homo sapiens
agccgtaggacccag

SEQ ID NO: 1918594 - DNA, 15 bp, Homo sapiens
agcctagatgtttta

SEQ ID NO: 1918595 - DNA, 16 bp, Homo sapiens
agcctagatgttttat

SEQ ID NO: 1918596 - DNA, 17 bp, Homo sapiens
agcctagcgtggtggct

SEQ ID NO: 1918597 - DNA, 18 bp, Homo sapiens
agcctaggcttggctcct

SEQ ID NO: 1918598 - DNA, 20 bp, Homo sapiens
agcctcaaaacaaaggccta

SEQ ID NO: 1918599 - DNA, 18 bp, Homo sapiens
agcctcaaatccaggacc

SEQ ID NO: 1918600 - DNA, 21 bp, Homo sapiens
agcctcaaatccaggaccctg

SEQ ID NO: 1918601 - DNA, 22 bp, Homo sapiens
agcctcaaatccaggaccctgc

SEQ ID NO: 1918602 - DNA, 19 bp, Homo sapiens
agcctcacgaaactggaat

SEQ ID NO: 1918603 - DNA, 14 bp, Homo sapiens
agcctccccttccc

SEQ ID NO: 1918604 - DNA, 18 bp, Homo sapiens
agcctccccttcccagac

SEQ ID NO: 1918605 - DNA, 21 bp, Homo sapiens
agcctccctgacgtctgccac

SEQ ID NO: 1918606 - DNA, 14 bp, Homo sapiens
agcctctgatctgt

SEQ ID NO: 1918607 - DNA, 15 bp, Homo sapiens
agcctctgatctgtg

SEQ ID NO: 1918608 - DNA, 20 bp, Homo sapiens
agcctgagatggatggacag

SEQ ID NO: 1918609 - DNA, 23 bp, Homo sapiens
agcctgcccagccccctggtctt

SEQ ID NO: 1918610 - DNA, 17 bp, Homo sapiens
agcctgcctctgccaca

SEQ ID NO: 1918611 - DNA, 17 bp, Homo sapiens
agcctgcggggcagcag

SEQ ID NO: 1918612 - DNA, 19 bp, Homo sapiens
agccttaaaacatcattcc

SEQ ID NO: 1918613 - DNA, 22 bp, Homo sapiens
agccttaaaacatcattccttt

SEQ ID NO: 1918614 - DNA, 20 bp, Homo sapiens
agccttccagtggcttctcc

SEQ ID NO: 1918615 - DNA, 18 bp, Homo sapiens
agcgaccagcaggctcct

SEQ ID NO: 1918616 - DNA, 21 bp, Homo sapiens
agcgaccagcaggctcctcag

SEQ ID NO: 1918617 - DNA, 18 bp, Homo sapiens
agcgaggctgggctggcc

SEQ ID NO: 1918618 - DNA, 18 bp, Homo sapiens
agcgccactgtccgctgt

SEQ ID NO: 1918619 - DNA, 13 bp, Homo sapiens
caacacaaagatt

SEQ ID NO: 1918620 - DNA, 23 bp, Homo sapiens
caacacgtcattgtgtaaggaaa

SEQ ID NO: 1918621 - DNA, 15 bp, Homo sapiens
caacactttaatggg

SEQ ID NO: 1918622 - DNA, 22 bp, Homo sapiens
caacagccatttaggcaaataa

SEQ ID NO: 1918623 - DNA, 18 bp, Homo sapiens
caacatctttctttttaa

SEQ ID NO: 1918624 - DNA, 22 bp, Homo sapiens
caaccaagtatgaatctatttg

SEQ ID NO: 1918625 - DNA, 21 bp, Homo sapiens
caacccctcgcccagtcccag

SEQ ID NO: 1918626 - DNA, 16 bp, Homo sapiens
caacgatcacaaatga

SEQ ID NO: 1918627 - DNA, 13 bp, Homo sapiens
caacttatgacta

SEQ ID NO: 1918628 - DNA, 23 bp, Homo sapiens
caacttcctttgactttctgtgt

SEQ ID NO: 1918629 - DNA, 16 bp, Homo sapiens
caactttttttttccc

SEQ ID NO: 1918630 - DNA, 18 bp, Homo sapiens
caagaacacaagaagacc

SEQ ID NO: 1918631 - DNA, 13 bp, Homo sapiens
caagaacagaagt

SEQ ID NO: 1918632 - DNA, 12 bp, Homo sapiens
caagaaccagtt

SEQ ID NO: 1918633 - DNA, 15 bp, Homo sapiens
caagaagtttaagga

SEQ ID NO: 1918634 - DNA, 19 bp, Homo sapiens
caagaatagcattgtaaaa

SEQ ID NO: 1918635 - DNA, 15 bp, Homo sapiens
caagagccttaaaac

SEQ ID NO: 1918636 - DNA, 17 bp, Homo sapiens
caagagtggccccacct

SEQ ID NO: 1918637 - DNA, 13 bp, Homo sapiens
caagcaccatccc

SEQ ID NO: 1918638 - DNA, 22 bp, Homo sapiens
caagcagactgttctaaaatat

SEQ ID NO: 1918639 - DNA, 17 bp, Homo sapiens
caagcattctctccatt

SEQ ID NO: 1918640 - DNA, 20 bp, Homo sapiens
caagccgtggccggggtcca

SEQ ID NO: 1918641 - DNA, 16 bp, Homo sapiens
caagcctgagggagga

SEQ ID NO: 1918642 - DNA, 12 bp, Homo sapiens
caagcctggcag

SEQ ID NO: 1918643 - DNA, 19 bp, Homo sapiens
caagcgccctggcccccac

SEQ ID NO: 1918644 - DNA, 14 bp, Homo sapiens
caagctcaaggcaa

SEQ ID NO: 1918645 - DNA, 18 bp, Homo sapiens
caagctcaaggcaatggg

SEQ ID NO: 1918646 - DNA, 22 bp, Homo sapiens
caagctggaaaggccagcagcc

SEQ ID NO: 1918647 - DNA, 13 bp, Homo sapiens
caaggaagaaatt

SEQ ID NO: 1918648 - DNA, 16 bp, Homo sapiens
caaggcaatgggctac

SEQ ID NO: 1918649 - DNA, 15 bp, Homo sapiens
caagggaggcccagc

SEQ ID NO: 1918650 - DNA, 18 bp, Homo sapiens
caagggcggcctttccca

SEQ ID NO: 1918651 - DNA, 21 bp, Homo sapiens
caagtagttctgtatttgaaa

SEQ ID NO: 1918652 - DNA, 20 bp, Homo sapiens
caagtctaccctgatcacct

SEQ ID NO: 1918653 - DNA, 14 bp, Homo sapiens
caagtggatatttt

SEQ ID NO: 1918654 - DNA, 18 bp, Homo sapiens
caagtggcataaagcata

SEQ ID NO: 1918655 - DNA, 19 bp, Homo sapiens
caagttgagctatgactta

SEQ ID NO: 1918656 - DNA, 16 bp, Homo sapiens
caataaaagcccagga

SEQ ID NO: 1918657 - DNA, 11 bp, Homo sapiens
caataaagcaa

SEQ ID NO: 1918658 - DNA, 13 bp, Homo sapiens
caataaatttgct

SEQ ID NO: 1918659 - DNA, 15 bp, Homo sapiens
caataaattttgaaa

SEQ ID NO: 1918660 - DNA, 17 bp, Homo sapiens
caataaattttgaaaag

SEQ ID NO: 1918661 - DNA, 15 bp, Homo sapiens
caataataagtccat

SEQ ID NO: 1918662 - DNA, 23 bp, Homo sapiens
caataataagtccatctgtcact

SEQ ID NO: 1918663 - DNA, 23 bp, Homo sapiens
caataatagctagctattactgc

SEQ ID NO: 1918664 - DNA, 15 bp, Homo sapiens
caatagaacagttta

SEQ ID NO: 1918665 - DNA, 18 bp, Homo sapiens
caatagcattagaaataa

SEQ ID NO: 1918666 - DNA, 21 bp, Homo sapiens
caatagcccaggatatatttt

SEQ ID NO: 1918667 - DNA, 14 bp, Homo sapiens
caatataagagctt

SEQ ID NO: 1918668 - DNA, 19 bp, Homo sapiens
caatcacacgtggtgacct

SEQ ID NO: 1918669 - DNA, 20 bp, Homo sapiens
caatcattgcaaacaactga

SEQ ID NO: 1918670 - DNA, 17 bp, Homo sapiens
caatcttactttgtaaa

SEQ ID NO: 1918671 - DNA, 19 bp, Homo sapiens
caatcttactttgtaaatt

SEQ ID NO: 1918672 - DNA, 23 bp, Homo sapiens
caatgaaatacacaagtaaacat

SEQ ID NO: 1918673 - DNA, 17 bp, Homo sapiens
caatgccccctcccctc

SEQ ID NO: 1918674 - DNA, 19 bp, Homo sapiens
caatgccccctcccctcct

SEQ ID NO: 1918675 - DNA, 22 bp, Homo sapiens
caatgccccctcccctccttta

SEQ ID NO: 1918676 - DNA, 14 bp, Homo sapiens
caatgggctagagg

SEQ ID NO: 1918677 - DNA, 14 bp, Homo sapiens
caatggtagtttct

SEQ ID NO: 1918678 - DNA, 20 bp, Homo sapiens
caatggtagtttctgtggtt

SEQ ID NO: 1918679 - DNA, 21 bp, Homo sapiens
caatgtgtctatttctgaaag

SEQ ID NO: 1918680 - DNA, 19 bp, Homo sapiens
caattctcccgggactctg

SEQ ID NO: 1918681 - DNA, 17 bp, Homo sapiens
caattctcgattctttg

SEQ ID NO: 1918682 - DNA, 14 bp, Homo sapiens
caatttctctgcac

SEQ ID NO: 1918683 - DNA, 12 bp, Homo sapiens
cacaagatgttg

SEQ ID NO: 1918684 - DNA, 14 bp, Homo sapiens
cacaagtatctaaa

SEQ ID NO: 1918685 - DNA, 18 bp, Homo sapiens
cacaagtatctaaatttg

SEQ ID NO: 1918686 - DNA, 22 bp, Homo sapiens
cacaataaagagaaccatgtgc

SEQ ID NO: 1918687 - DNA, 22 bp, Homo sapiens
cacaattgaattagttttttct

SEQ ID NO: 1918688 - DNA, 14 bp, Homo sapiens
cacacacctctgcc

SEQ ID NO: 1918689 - DNA, 15 bp, Homo sapiens
cacacacctctgccc

SEQ ID NO: 1918690 - DNA, 22 bp, Homo sapiens
cacacagaaggggactgccacc

SEQ ID NO: 1918691 - DNA, 17 bp, Homo sapiens
cacacgtggtgacctca

SEQ ID NO: 1918692 - DNA, 19 bp, Homo sapiens
cacacgtggtgacctcaca

SEQ ID NO: 1918693 - DNA, 23 bp, Homo sapiens
cacactggaaattgaaataaaga

SEQ ID NO: 1918694 - DNA, 23 bp, Homo sapiens
cacagaaggggactgccacctcc

SEQ ID NO: 1918695 - DNA, 22 bp, Homo sapiens
cacagcaacgatcacaaatgac

SEQ ID NO: 1918696 - DNA, 14 bp, Homo sapiens
cacagcaaggctgt

SEQ ID NO: 1918697 - DNA, 17 bp, Homo sapiens
cacagcctccccttccc

SEQ ID NO: 1918698 - DNA, 20 bp, Homo sapiens
cacagcctccccttcccaga

SEQ ID NO: 1918699 - DNA, 21 bp, Homo sapiens
atggccaggaagtagcacagg

SEQ ID NO: 1918700 - DNA, 23 bp, Homo sapiens
atggccaggaagtagcacaggct

SEQ ID NO: 1918701 - DNA, 22 bp, Homo sapiens
atgggaatataatattgtctct

SEQ ID NO: 1918702 - DNA, 16 bp, Homo sapiens
atgggatgattgaaga

SEQ ID NO: 1918703 - DNA, 18 bp, Homo sapiens
atgggatgattgaagaaa

SEQ ID NO: 1918704 - DNA, 17 bp, Homo sapiens
atgggctagagggtgcc

SEQ ID NO: 1918705 - DNA, 17 bp, Homo sapiens
atggggaggacaaaatg

SEQ ID NO: 1918706 - DNA, 16 bp, Homo sapiens
atggggtctctcacag

SEQ ID NO: 1918707 - DNA, 20 bp, Homo sapiens
atggggtctctcacagacag

SEQ ID NO: 1918708 - DNA, 13 bp, Homo sapiens
atggtagtttctg

SEQ ID NO: 1918709 - DNA, 15 bp, Homo sapiens
atggtagtttctgtg

SEQ ID NO: 1918710 - DNA, 19 bp, Homo sapiens
atggtagtttctgtggttg

SEQ ID NO: 1918711 - DNA, 15 bp, Homo sapiens
atggtccatagcact

SEQ ID NO: 1918712 - DNA, 21 bp, Homo sapiens
atgtaaagcaaccaaaaagaa

SEQ ID NO: 1918713 - DNA, 16 bp, Homo sapiens
atgtaaataattcttt

SEQ ID NO: 1918714 - DNA, 22 bp, Homo sapiens
atgtaatagtcttgcagaaaat

SEQ ID NO: 1918715 - DNA, 17 bp, Homo sapiens
atgtaattttgtgtaag

SEQ ID NO: 1918716 - DNA, 13 bp, Homo sapiens
atgtacatactga

SEQ ID NO: 1918717 - DNA, 21 bp, Homo sapiens
atgtataattcaaagcaccaa

SEQ ID NO: 1918718 - DNA, 16 bp, Homo sapiens
atgtatacttgaaaaa

SEQ ID NO: 1918719 - DNA, 17 bp, Homo sapiens
atgtatcaaatacattt

SEQ ID NO: 1918720 - DNA, 14 bp, Homo sapiens
atgtatctttataa

SEQ ID NO: 1918721 - DNA, 15 bp, Homo sapiens
atgtatgtgtttaga

SEQ ID NO: 1918722 - DNA, 15 bp, Homo sapiens
atgtatgttatttga

SEQ ID NO: 1918723 - DNA, 22 bp, Homo sapiens
atgtcaaaagtagaactttgta

SEQ ID NO: 1918724 - DNA, 23 bp, Homo sapiens
atgtcaaaagtagaactttgtat

SEQ ID NO: 1918725 - DNA, 19 bp, Homo sapiens
atgtcaaatatttagatgt

SEQ ID NO: 1918726 - DNA, 23 bp, Homo sapiens
atgtcaaatatttagatgtaatt

SEQ ID NO: 1918727 - DNA, 18 bp, Homo sapiens
atgtcaatgaacaagcat

SEQ ID NO: 1918728 - DNA, 16 bp, Homo sapiens
atgtccagtaagatca

SEQ ID NO: 1918729 - DNA, 19 bp, Homo sapiens
atgtccagtaagatcactg

SEQ ID NO: 1918730 - DNA, 20 bp, Homo sapiens
atgtccagtaagatcactgt

SEQ ID NO: 1918731 - DNA, 16 bp, Homo sapiens
atgtcctaatggtgat

SEQ ID NO: 1918732 - DNA, 19 bp, Homo sapiens
atgtcgtagttactctcag

SEQ ID NO: 1918733 - DNA, 17 bp, Homo sapiens
atgtctagattttgaaa

SEQ ID NO: 1918734 - DNA, 14 bp, Homo sapiens
atgtctcaagtgca

SEQ ID NO: 1918735 - DNA, 19 bp, Homo sapiens
atgtgagaacattaggccc

SEQ ID NO: 1918736 - DNA, 14 bp, Homo sapiens
atgtgcctaaataa

SEQ ID NO: 1918737 - DNA, 15 bp, Homo sapiens
atgtgcctgcttcag

SEQ ID NO: 1918738 - DNA, 20 bp, Homo sapiens
atgtggtccatctctgaaaa

SEQ ID NO: 1918739 - DNA, 21 bp, Homo sapiens
atgtggtccatctctgaaaac

SEQ ID NO: 1918740 - DNA, 14 bp, Homo sapiens
atgtgtttagaatt

SEQ ID NO: 1918741 - DNA, 16 bp, Homo sapiens
atgtgtttagaattga

SEQ ID NO: 1918742 - DNA, 13 bp, Homo sapiens
atgttggactctg

SEQ ID NO: 1918743 - DNA, 15 bp, Homo sapiens
atgttggccaggctg

SEQ ID NO: 1918744 - DNA, 14 bp, Homo sapiens
atgttgtaaaatga

SEQ ID NO: 1918745 - DNA, 12 bp, Homo sapiens
atgtttaaaaca

SEQ ID NO: 1918746 - DNA, 14 bp, Homo sapiens
atgtttaaaacacc

SEQ ID NO: 1918747 - DNA, 16 bp, Homo sapiens
atgtttaaaacacctt

SEQ ID NO: 1918748 - DNA, 14 bp, Homo sapiens
atgtttccttccct

SEQ ID NO: 1918749 - DNA, 17 bp, Homo sapiens
atgtttgccatttgctg

SEQ ID NO: 1918750 - DNA, 13 bp, Homo sapiens
atgttttcacagt

SEQ ID NO: 1918751 - DNA, 12 bp, Homo sapiens
atgtttttgaag

SEQ ID NO: 1918752 - DNA, 21 bp, Homo sapiens
atgtttttgaaggcagaaagc

SEQ ID NO: 1918753 - DNA, 16 bp, Homo sapiens
attaaaactttgtaga

SEQ ID NO: 1918754 - DNA, 21 bp, Homo sapiens
attaaaggtggaaaatctatt

SEQ ID NO: 1918755 - DNA, 17 bp, Homo sapiens
attaaatttttttgtat

SEQ ID NO: 1918756 - DNA, 18 bp, Homo sapiens
attaaatttttttgtatg

SEQ ID NO: 1918757 - DNA, 19 bp, Homo sapiens
attaaatttttttgtatga

SEQ ID NO: 1918758 - DNA, 22 bp, Homo sapiens
attaaatttttttgtatgaaaa

SEQ ID NO: 1918759 - DNA, 19 bp, Homo sapiens
attaacttaccctgtatat

SEQ ID NO: 1918760 - DNA, 11 bp, Homo sapiens
attaagaaata

SEQ ID NO: 1918761 - DNA, 12 bp, Homo sapiens
attaagaaatag

SEQ ID NO: 1918762 - DNA, 14 bp, Homo sapiens
attaagaagaaact

SEQ ID NO: 1918763 - DNA, 17 bp, Homo sapiens
attaaggtgtttgaaaa

SEQ ID NO: 1918764 - DNA, 20 bp, Homo sapiens
attaaggtgtttgaaaatag

SEQ ID NO: 1918765 - DNA, 15 bp, Homo sapiens
attaatcactgtgta

SEQ ID NO: 1918766 - DNA, 16 bp, Homo sapiens
attaattgtgtgaact

SEQ ID NO: 1918767 - DNA, 20 bp, Homo sapiens
attacaccacaagtatctaa

SEQ ID NO: 1918768 - DNA, 18 bp, Homo sapiens
attacgtactaaggatac

SEQ ID NO: 1918769 - DNA, 18 bp, Homo sapiens
attacttgttgcctataa

SEQ ID NO: 1918770 - DNA, 22 bp, Homo sapiens
attagaaaaggaaataggtttt

SEQ ID NO: 1918771 - DNA, 15 bp, Homo sapiens
attagtgttatatga

SEQ ID NO: 1918772 - DNA, 16 bp, Homo sapiens
attagtgttatatgaa

SEQ ID NO: 1918773 - DNA, 14 bp, Homo sapiens
attatacaatgata

SEQ ID NO: 1918774 - DNA, 20 bp, Homo sapiens
attatataagcaaaatgaaa

SEQ ID NO: 1918775 - DNA, 20 bp, Homo sapiens
attatcttagtctatagaaa

SEQ ID NO: 1918776 - DNA, 14 bp, Homo sapiens
attattgatgaaaa

SEQ ID NO: 1918777 - DNA, 22 bp, Homo sapiens
attattgtcctttgattccaaa

SEQ ID NO: 1918778 - DNA, 18 bp, Homo sapiens
attattttcagaagctga

SEQ ID NO: 1918779 - DNA, 19 bp, Homo sapiens
attcaaagcaccaaaataa

SEQ ID NO: 1918780 - DNA, 18 bp, Homo sapiens
attcaaatattctttcaa

SEQ ID NO: 1918781 - DNA, 22 bp, Homo sapiens
attcaacagcaagtgtgaatac

SEQ ID NO: 1918782 - DNA, 16 bp, Homo sapiens
attcagattgtttaaa

SEQ ID NO: 1918783 - DNA, 12 bp, Homo sapiens
attcagcatctg

SEQ ID NO: 1918784 - DNA, 18 bp, Homo sapiens
attcaggggaaacttgat

SEQ ID NO: 1918785 - DNA, 21 bp, Homo sapiens
attcattcttaatttatgtaa

SEQ ID NO: 1918786 - DNA, 18 bp, Homo sapiens
attccatagctcaataaa

SEQ ID NO: 1918787 - DNA, 16 bp, Homo sapiens
attcccttgttattca

SEQ ID NO: 1918788 - DNA, 21 bp, Homo sapiens
attccgagtctttctcactgc

SEQ ID NO: 1918789 - DNA, 11 bp, Homo sapiens
attcctcccca

SEQ ID NO: 1918790 - DNA, 21 bp, Homo sapiens
attcctccccaccctgtccca

SEQ ID NO: 1918791 - DNA, 16 bp, Homo sapiens
attcctctgctgaaca

SEQ ID NO: 1918792 - DNA, 16 bp, Homo sapiens
cagtaagatcactgtt

SEQ ID NO: 1918793 - DNA, 17 bp, Homo sapiens
cagtaagatcactgttt

SEQ ID NO: 1918794 - DNA, 20 bp, Homo sapiens
cagtaagctggtttacagat

SEQ ID NO: 1918795 - DNA, 23 bp, Homo sapiens
cagtaagctggtttacagatgtt

SEQ ID NO: 1918796 - DNA, 16 bp, Homo sapiens
cagtaccttctgccag

SEQ ID NO: 1918797 - DNA, 22 bp, Homo sapiens
cagtaccttctgccagaagact

SEQ ID NO: 1918798 - DNA, 14 bp, Homo sapiens
cagtagcaggcccg

SEQ ID NO: 1918799 - DNA, 19 bp, Homo sapiens
cagtagctgggaccacagg

SEQ ID NO: 1918800 - DNA, 15 bp, Homo sapiens
cagtatcatgaagcc

SEQ ID NO: 1918801 - DNA, 13 bp, Homo sapiens
cagtcactttgac

SEQ ID NO: 1918802 - DNA, 12 bp, Homo sapiens
cagtcccagcag

SEQ ID NO: 1918803 - DNA, 13 bp, Homo sapiens
cagtcccagcagc

SEQ ID NO: 1918804 - DNA, 17 bp, Homo sapiens
cagtcccagcagccagc

SEQ ID NO: 1918805 - DNA, 15 bp, Homo sapiens
cagtcggggcaggcc

SEQ ID NO: 1918806 - DNA, 18 bp, Homo sapiens
cagtcgtcagcctccctg

SEQ ID NO: 1918807 - DNA, 17 bp, Homo sapiens
cagtctcaccatttccc

SEQ ID NO: 1918808 - DNA, 23 bp, Homo sapiens
cagtgaaaataagccatgagaat

SEQ ID NO: 1918809 - DNA, 21 bp, Homo sapiens
cagtgatgtttgccatttgct

SEQ ID NO: 1918810 - DNA, 13 bp, Homo sapiens
cagtgcccaggtg

SEQ ID NO: 1918811 - DNA, 15 bp, Homo sapiens
cagtgcccaggtggc

SEQ ID NO: 1918812 - DNA, 17 bp, Homo sapiens
cagtgctattctgagtg

SEQ ID NO: 1918813 - DNA, 18 bp, Homo sapiens
cagtgctgggattacagg

SEQ ID NO: 1918814 - DNA, 14 bp, Homo sapiens
cagtggcagggcac

SEQ ID NO: 1918815 - DNA, 19 bp, Homo sapiens
cagtggcgaaatccctgct

SEQ ID NO: 1918816 - DNA, 20 bp, Homo sapiens
cagtggcgaaatccctgctc

SEQ ID NO: 1918817 - DNA, 23 bp, Homo sapiens
cagtggcgaaatccctgctcact

SEQ ID NO: 1918818 - DNA, 12 bp, Homo sapiens
cagtggctgtga

SEQ ID NO: 1918819 - DNA, 17 bp, Homo sapiens
cagtgtactttgttaaa

SEQ ID NO: 1918820 - DNA, 12 bp, Homo sapiens
cagtgtgatttt

SEQ ID NO: 1918821 - DNA, 13 bp, Homo sapiens
cagtgtttggtgc

SEQ ID NO: 1918822 - DNA, 14 bp, Homo sapiens
cagttatgaaaact

SEQ ID NO: 1918823 - DNA, 20 bp, Homo sapiens
cagttgctggtaaaatgaag

SEQ ID NO: 1918824 - DNA, 21 bp, Homo sapiens
cagttgctggtaaaatgaaga

SEQ ID NO: 1918825 - DNA, 22 bp, Homo sapiens
cagttgctggtaaaatgaagaa

SEQ ID NO: 1918826 - DNA, 21 bp, Homo sapiens
cagtttgaggattagtttaga

SEQ ID NO: 1918827 - DNA, 22 bp, Homo sapiens
cataaaatgtccagtaagatca

SEQ ID NO: 1918828 - DNA, 18 bp, Homo sapiens
cataagaggttctaactt

SEQ ID NO: 1918829 - DNA, 17 bp, Homo sapiens
cataaggagacttctgt

SEQ ID NO: 1918830 - DNA, 20 bp, Homo sapiens
cataatcatggctcttagaa

SEQ ID NO: 1918831 - DNA, 13 bp, Homo sapiens
cataattcttatt

SEQ ID NO: 1918832 - DNA, 14 bp, Homo sapiens
cataattcttatta

SEQ ID NO: 1918833 - DNA, 13 bp, Homo sapiens
catacacaacgta

SEQ ID NO: 1918834 - DNA, 16 bp, Homo sapiens
catactcgagtctgag

SEQ ID NO: 1918835 - DNA, 19 bp, Homo sapiens
catactcgagtctgaggcc

SEQ ID NO: 1918836 - DNA, 20 bp, Homo sapiens
catagaaagagtctgaccct

SEQ ID NO: 1918837 - DNA, 19 bp, Homo sapiens
catagagtacactgcctgc

SEQ ID NO: 1918838 - DNA, 22 bp, Homo sapiens
catagcacctaacaacattgta

SEQ ID NO: 1918839 - DNA, 16 bp, Homo sapiens
catagccaaaatgtga

SEQ ID NO: 1918840 - DNA, 13 bp, Homo sapiens
catagctcaataa

SEQ ID NO: 1918841 - DNA, 15 bp, Homo sapiens
catagttttatttat

SEQ ID NO: 1918842 - DNA, 23 bp, Homo sapiens
catataactggagtaataaaaca

SEQ ID NO: 1918843 - DNA, 23 bp, Homo sapiens
catataacttatattgtaagaaa

SEQ ID NO: 1918844 - DNA, 18 bp, Homo sapiens
catatcccctatttaaca

SEQ ID NO: 1918845 - DNA, 21 bp, Homo sapiens
catatctttgagttcaacctt

SEQ ID NO: 1918846 - DNA, 14 bp, Homo sapiens
catatgaactttca

SEQ ID NO: 1918847 - DNA, 19 bp, Homo sapiens
catattactgtacatggga

SEQ ID NO: 1918848 - DNA, 24 bp, Homo sapiens
catatttctaattggctttactat

SEQ ID NO: 1918849 - DNA, 16 bp, Homo sapiens
catattttaaacagag

SEQ ID NO: 1918850 - DNA, 14 bp, Homo sapiens
catcagaacagctg

SEQ ID NO: 1918851 - DNA, 16 bp, Homo sapiens
catcatattatacaga

SEQ ID NO: 1918852 - DNA, 20 bp, Homo sapiens
catcattcctttttatttat

SEQ ID NO: 1918853 - DNA, 20 bp, Homo sapiens
catccaccgtcccctcccag

SEQ ID NO: 1918854 - DNA, 11 bp, Homo sapiens
catccatgggg

SEQ ID NO: 1918855 - DNA, 13 bp, Homo sapiens
catccccttccag

SEQ ID NO: 1918856 - DNA, 16 bp, Homo sapiens
catccccttccagctc

SEQ ID NO: 1918857 - DNA, 23 bp, Homo sapiens
catcccggcagcgaggctgggct

SEQ ID NO: 1918858 - DNA, 16 bp, Homo sapiens
catcccgtttccctcc

SEQ ID NO: 1918859 - DNA, 18 bp, Homo sapiens
catccctctcctctgccc

SEQ ID NO: 1918860 - DNA, 20 bp, Homo sapiens
catccgtttgccaatcattg

SEQ ID NO: 1918861 - DNA, 14 bp, Homo sapiens
catcctgggcagct

SEQ ID NO: 1918862 - DNA, 23 bp, Homo sapiens
catcctgggcagcttgggctggc

SEQ ID NO: 1918863 - DNA, 19 bp, Homo sapiens
catcctgtcatctgagaat

SEQ ID NO: 1918864 - DNA, 20 bp, Homo sapiens
catctaggggagccttgatt

SEQ ID NO: 1918865 - DNA, 13 bp, Homo sapiens
catctcacagcta

SEQ ID NO: 1918866 - DNA, 15 bp, Homo sapiens
catctctgaaaacaa

SEQ ID NO: 1918867 - DNA, 14 bp, Homo sapiens
catctctgaccaga

SEQ ID NO: 1918868 - DNA, 16 bp, Homo sapiens
catctgagaatgaaca

SEQ ID NO: 1918869 - DNA, 16 bp, Homo sapiens
catctggagttctcaa

SEQ ID NO: 1918870 - DNA, 20 bp, Homo sapiens
catctgggtagctgtaaggc

SEQ ID NO: 1918871 - DNA, 19 bp, Homo sapiens
catctggttttctctccag

SEQ ID NO: 1918872 - DNA, 12 bp, Homo sapiens
catctgtcactt

SEQ ID NO: 1918873 - DNA, 11 bp, Homo sapiens
catctgtgaat

SEQ ID NO: 1918874 - DNA, 13 bp, Homo sapiens
catctttgatgtg

SEQ ID NO: 1918875 - DNA, 14 bp, Homo sapiens
catctttgatgtgt

SEQ ID NO: 1918876 - DNA, 16 bp, Homo sapiens
catctttgatgtgttg

SEQ ID NO: 1918877 - DNA, 18 bp, Homo sapiens
catctttgatgtgttgtt

SEQ ID NO: 1918878 - DNA, 22 bp, Homo sapiens
catgaaggatgccaagaagttt

SEQ ID NO: 1918879 - DNA, 19 bp, Homo sapiens
catgaggccccgaggctcg

SEQ ID NO: 1918880 - DNA, 19 bp, Homo sapiens
catgaggcctcctgccatg

SEQ ID NO: 1918881 - DNA, 20 bp, Homo sapiens
catgatcacaactgagatca

SEQ ID NO: 1918882 - DNA, 22 bp, Homo sapiens
catgatgaatgacctgactttt

SEQ ID NO: 1918883 - DNA, 20 bp, Homo sapiens
catgcctactaaatgtacag

SEQ ID NO: 1918884 - DNA, 15 bp, Homo sapiens
catgcctcctcctgc

SEQ ID NO: 1918885 - DNA, 19 bp, Homo sapiens
catgcctcctcctgccctc

SEQ ID NO: 1918886 - DNA, 13 bp, Homo sapiens
catgcctgctctc

SEQ ID NO: 1918887 - DNA, 12 bp, Homo sapiens
catgctgtctgg

SEQ ID NO: 1918888 - DNA, 23 bp, Homo sapiens
catgctgtctggcacagcctgca

SEQ ID NO: 1918889 - DNA, 14 bp, Homo sapiens
catggaccatgctg

SEQ ID NO: 1918890 - DNA, 19 bp, Homo sapiens
catggccacatcctcatgg

SEQ ID NO: 1918891 - DNA, 22 bp, Homo sapiens
catggccacatcctcatggccc

SEQ ID NO: 1918892 - DNA, 17 bp, Homo sapiens
catggcccatcaggggc

SEQ ID NO: 1918893 - DNA, 22 bp, Homo sapiens
catggcgtattttgtatttaaa

SEQ ID NO: 1918894 - DNA, 14 bp, Homo sapiens
catgggcaggagac

SEQ ID NO: 1918895 - DNA, 15 bp, Homo sapiens
catggggtctctcac

SEQ ID NO: 1918896 - DNA, 16 bp, Homo sapiens
catggggtctctcaca

SEQ ID NO: 1918897 - DNA, 16 bp, Homo sapiens
catgggtactgtctcg

SEQ ID NO: 1918898 - DNA, 22 bp, Homo sapiens
catgggtactgtctcggcagag

SEQ ID NO: 1918899 - DNA, 19 bp, Homo sapiens
catgggtcagggtgtgagg

SEQ ID NO: 1918900 - DNA, 15 bp, Homo sapiens
catggtgattaaaat

SEQ ID NO: 1918901 - DNA, 22 bp, Homo sapiens
catggttacatatcaaaacatc

SEQ ID NO: 1918902 - DNA, 19 bp, Homo sapiens
catggttcaggtacacata

SEQ ID NO: 1918903 - DNA, 20 bp, Homo sapiens
catggttcaggtacacatat

SEQ ID NO: 1918904 - DNA, 21 bp, Homo sapiens
catgtaaaaagtgcagtaaat

SEQ ID NO: 1918905 - DNA, 17 bp, Homo sapiens
catgtaaagagctggga

SEQ ID NO: 1918906 - DNA, 15 bp, Homo sapiens
catgtaactttcgta

SEQ ID NO: 1918907 - DNA, 21 bp, Homo sapiens
catgtacccattgcagaccct

SEQ ID NO: 1918908 - DNA, 18 bp, Homo sapiens
catgtacttttaaattat

SEQ ID NO: 1918909 - DNA, 22 bp, Homo sapiens
catgtggggaggttaatctagg

SEQ ID NO: 1918910 - DNA, 17 bp, Homo sapiens
catgtgttgcagctgtc

SEQ ID NO: 1918911 - DNA, 15 bp, Homo sapiens
catgttagagttact

SEQ ID NO: 1918912 - DNA, 17 bp, Homo sapiens
catgttgccaaaatggt

SEQ ID NO: 1918913 - DNA, 23 bp, Homo sapiens
catgttggccaggctgctctcaa

SEQ ID NO: 1918914 - DNA, 20 bp, Homo sapiens
cattaaaagaaaataaaaaa

SEQ ID NO: 1918915 - DNA, 23 bp, Homo sapiens
cattacctctttggaaaaggaag

SEQ ID NO: 1918916 - DNA, 18 bp, Homo sapiens
cattacttgttgcctata

SEQ ID NO: 1918917 - DNA, 23 bp, Homo sapiens
cattattctctaactattacaca

SEQ ID NO: 1918918 - DNA, 22 bp, Homo sapiens
cattcagacgttttttctgcac

SEQ ID NO: 1918919 - DNA, 18 bp, Homo sapiens
cattctagtattctttat

SEQ ID NO: 1918920 - DNA, 21 bp, Homo sapiens
cattcttaatttatgtaaggt

SEQ ID NO: 1918921 - DNA, 11 bp, Homo sapiens
cattgagactt

SEQ ID NO: 1918922 - DNA, 20 bp, Homo sapiens
cattgcaaacaactgaaatg

SEQ ID NO: 1918923 - DNA, 21 bp, Homo sapiens
cattgcctgatttgttccttc

SEQ ID NO: 1918924 - DNA, 15 bp, Homo sapiens
cattgtaaaagcatt

SEQ ID NO: 1918925 - DNA, 23 bp, Homo sapiens
cattgtaaaagcattttgtaata

SEQ ID NO: 1918926 - DNA, 13 bp, Homo sapiens
catttaaaagaca

SEQ ID NO: 1918927 - DNA, 17 bp, Homo sapiens
catttaaagacaaagac

SEQ ID NO: 1918928 - DNA, 20 bp, Homo sapiens
catttactgcattcttctga

SEQ ID NO: 1918929 - DNA, 11 bp, Homo sapiens
catttatcaat

SEQ ID NO: 1918930 - DNA, 19 bp, Homo sapiens
catttatccaggaattgat

SEQ ID NO: 1918931 - DNA, 13 bp, Homo sapiens
catttcaaaatat

SEQ ID NO: 1918932 - DNA, 19 bp, Homo sapiens
catttcaaataactgcaga

SEQ ID NO: 1918933 - DNA, 14 bp, Homo sapiens
catttccccagggc

SEQ ID NO: 1918934 - DNA, 15 bp, Homo sapiens
catttccccagggca

SEQ ID NO: 1918935 - DNA, 11 bp, Homo sapiens
catttctgatt

SEQ ID NO: 1918936 - DNA, 19 bp, Homo sapiens
catttgaaacccctgtagg

SEQ ID NO: 1918937 - DNA, 13 bp, Homo sapiens
catttgatttgta

SEQ ID NO: 1918938 - DNA, 15 bp, Homo sapiens
catttgctgcatggg

SEQ ID NO: 1918939 - DNA, 14 bp, Homo sapiens
catttgctttggaa

SEQ ID NO: 1918940 - DNA, 17 bp, Homo sapiens
catttggcttcctctgc

SEQ ID NO: 1918941 - DNA, 13 bp, Homo sapiens
catttggtgcttg

SEQ ID NO: 1918942 - DNA, 21 bp, Homo sapiens
catttgtttctttctctgagg

SEQ ID NO: 1918943 - DNA, 14 bp, Homo sapiens
cattttaaggcaat

SEQ ID NO: 1918944 - DNA, 16 bp, Homo sapiens
cattttctttcctttc

SEQ ID NO: 1918945 - DNA, 12 bp, Homo sapiens
cattttgcatga

SEQ ID NO: 1918946 - DNA, 14 bp, Homo sapiens
ccaaaataagaaaa

SEQ ID NO: 1918947 - DNA, 16 bp, Homo sapiens
ccaaaataagaaaaga

SEQ ID NO: 1918948 - DNA, 18 bp, Homo sapiens
ccaaaataagaaaagatg

SEQ ID NO: 1918949 - DNA, 15 bp, Homo sapiens
ccaaaattaaggtgt

SEQ ID NO: 1918950 - DNA, 13 bp, Homo sapiens
ccaaacacacaga

SEQ ID NO: 1918951 - DNA, 17 bp, Homo sapiens
ccaaacacacagaaggg

SEQ ID NO: 1918952 - DNA, 18 bp, Homo sapiens
ccaaacacacagaagggg

SEQ ID NO: 1918953 - DNA, 14 bp, Homo sapiens
ccaaacacaggcaa

SEQ ID NO: 1918954 - DNA, 20 bp, Homo sapiens
ccaaacccaccctttctact

SEQ ID NO: 1918955 - DNA, 20 bp, Homo sapiens
ccaaaccttactctgagctc

SEQ ID NO: 1918956 - DNA, 21 bp, Homo sapiens
ccaaataatatgtttccttcc

SEQ ID NO: 1918957 - DNA, 20 bp, Homo sapiens
ccaaattgctgggattacag

SEQ ID NO: 1918958 - DNA, 20 bp, Homo sapiens
ccaacatctttctttttaag

SEQ ID NO: 1918959 - DNA, 22 bp, Homo sapiens
ccaacccctcgcccagtcccag

SEQ ID NO: 1918960 - DNA, 18 bp, Homo sapiens
ccaagaacacaagaagac

SEQ ID NO: 1918961 - DNA, 13 bp, Homo sapiens
ccaagagtggccc

SEQ ID NO: 1918962 - DNA, 11 bp, Homo sapiens
ccaagcctggc

SEQ ID NO: 1918963 - DNA, 14 bp, Homo sapiens
ccaagcctggcagg

SEQ ID NO: 1918964 - DNA, 16 bp, Homo sapiens
ccaagcctggcagggg

SEQ ID NO: 1918965 - DNA, 14 bp, Homo sapiens
ccaagcgccctggc

SEQ ID NO: 1918966 - DNA, 17 bp, Homo sapiens
ccaagcgccctggcccc

SEQ ID NO: 1918967 - DNA, 22 bp, Homo sapiens
ccaagcgccctggcccccacat

SEQ ID NO: 1918968 - DNA, 22 bp, Homo sapiens
ccaagcttagggtatttttcct

SEQ ID NO: 1918969 - DNA, 14 bp, Homo sapiens
ccaagtctgacagc

SEQ ID NO: 1918970 - DNA, 18 bp, Homo sapiens
ccaagtctgacagccaga

SEQ ID NO: 1918971 - DNA, 20 bp, Homo sapiens
ccaagtctgacagccagagc

SEQ ID NO: 1918972 - DNA, 14 bp, Homo sapiens
ccaatcttactttg

SEQ ID NO: 1918973 - DNA, 16 bp, Homo sapiens
ccaatgggctagaggg

SEQ ID NO: 1918974 - DNA, 12 bp, Homo sapiens
ccaattttcctt

SEQ ID NO: 1918975 - DNA, 16 bp, Homo sapiens
ccacaaggaagaaatt

SEQ ID NO: 1918976 - DNA, 13 bp, Homo sapiens
ccacagaggacac

SEQ ID NO: 1918977 - DNA, 11 bp, Homo sapiens
ccacagaggct

SEQ ID NO: 1918978 - DNA, 22 bp, Homo sapiens
ccacagcaacgatcacaaatga

SEQ ID NO: 1918979 - DNA, 17 bp, Homo sapiens
ccacagcaaggctgtcg

SEQ ID NO: 1918980 - DNA, 18 bp, Homo sapiens
ccacagcctccccttccc

SEQ ID NO: 1918981 - DNA, 15 bp, Homo sapiens
ccacatcctcatggc

SEQ ID NO: 1918982 - DNA, 16 bp, Homo sapiens
ccaccacgcctagcct

SEQ ID NO: 1918983 - DNA, 12 bp, Homo sapiens
ccaccagcgccc

SEQ ID NO: 1918984 - DNA, 15 bp, Homo sapiens
ccaccagcgccccca

SEQ ID NO: 1918985 - DNA, 23 bp, Homo sapiens
ccaccagcgcccccactcctcct

SEQ ID NO: 1918986 - DNA, 21 bp, Homo sapiens
ccaccatgcaacttcctttga

SEQ ID NO: 1918987 - DNA, 15 bp, Homo sapiens
ccacccctctggcac

SEQ ID NO: 1918988 - DNA, 18 bp, Homo sapiens
ccaccctgcttggcccag

SEQ ID NO: 1918989 - DNA, 17 bp, Homo sapiens
ccaccctgtcccaggca

SEQ ID NO: 1918990 - DNA, 18 bp, Homo sapiens
ccaccctgtcccaggcag

SEQ ID NO: 1918991 - DNA, 22 bp, Homo sapiens
ccaccctgtcccaggcagcgcc

SEQ ID NO: 1918992 - DNA, 14 bp, Homo sapiens
ccaccgtcccctcc

SEQ ID NO: 1918993 - DNA, 23 bp, Homo sapiens
ccacctcacctgtcgcacccact

SEQ ID NO: 1918994 - DNA, 19 bp, Homo sapiens
ccacctcccaagagggctc

SEQ ID NO: 1918995 - DNA, 14 bp, Homo sapiens
ccacctccccttgc

SEQ ID NO: 1918996 - DNA, 19 bp, Homo sapiens
ccacctccccttgccagct

SEQ ID NO: 1918997 - DNA, 18 bp, Homo sapiens
ccacctcctaaaaggccc

SEQ ID NO: 1918998 - DNA, 15 bp, Homo sapiens
actgtgttaaaattt

SEQ ID NO: 1918999 - DNA, 17 bp, Homo sapiens
actgtgttaaaattttt

SEQ ID NO: 1919000 - DNA, 19 bp, Homo sapiens
actgttatgtgagaacatt

SEQ ID NO: 1919001 - DNA, 12 bp, Homo sapiens
actgttgtataa

SEQ ID NO: 1919002 - DNA, 19 bp, Homo sapiens
actgtttagatttgccata

SEQ ID NO: 1919003 - DNA, 21 bp, Homo sapiens
actgttttgtatatgctgcat

SEQ ID NO: 1919004 - DNA, 12 bp, Homo sapiens
acttaaaacacg

SEQ ID NO: 1919005 - DNA, 22 bp, Homo sapiens
acttaaatgaacacagctcttt

SEQ ID NO: 1919006 - DNA, 15 bp, Homo sapiens
acttaataatcaaga

SEQ ID NO: 1919007 - DNA, 22 bp, Homo sapiens
acttatgaagtaaagtttctga

SEQ ID NO: 1919008 - DNA, 15 bp, Homo sapiens
acttcaaaagtttgt

SEQ ID NO: 1919009 - DNA, 21 bp, Homo sapiens
acttcatctcaatagtgattt

SEQ ID NO: 1919010 - DNA, 19 bp, Homo sapiens
acttccccaagcctggcag

SEQ ID NO: 1919011 - DNA, 20 bp, Homo sapiens
acttccccaagcctggcagg

SEQ ID NO: 1919012 - DNA, 22 bp, Homo sapiens
acttccctccatccacccctct

SEQ ID NO: 1919013 - DNA, 23 bp, Homo sapiens
acttctataaagtgaacagattt

SEQ ID NO: 1919014 - DNA, 11 bp, Homo sapiens
acttgaaaaga

SEQ ID NO: 1919015 - DNA, 15 bp, Homo sapiens
acttgaaccataaaa

SEQ ID NO: 1919016 - DNA, 16 bp, Homo sapiens
acttgaaccataaaat

SEQ ID NO: 1919017 - DNA, 20 bp, Homo sapiens
acttgaaccataaaatgtcc

SEQ ID NO: 1919018 - DNA, 14 bp, Homo sapiens
acttgcatttttgc

SEQ ID NO: 1919019 - DNA, 22 bp, Homo sapiens
acttgctccattcatacacaac

SEQ ID NO: 1919020 - DNA, 15 bp, Homo sapiens
acttgggggctcagc

SEQ ID NO: 1919021 - DNA, 21 bp, Homo sapiens
acttgggggctcagcaaggcc

SEQ ID NO: 1919022 - DNA, 17 bp, Homo sapiens
acttgtagatttgattt

SEQ ID NO: 1919023 - DNA, 18 bp, Homo sapiens
acttgtattcctaactgt

SEQ ID NO: 1919024 - DNA, 14 bp, Homo sapiens
acttgttgaattta

SEQ ID NO: 1919025 - DNA, 21 bp, Homo sapiens
acttgttgcctataagccaaa

SEQ ID NO: 1919026 - DNA, 22 bp, Homo sapiens
acttgttgctgattttgacctt

SEQ ID NO: 1919027 - DNA, 22 bp, Homo sapiens
actttaaaactgctcatttcat

SEQ ID NO: 1919028 - DNA, 14 bp, Homo sapiens
actttatagacatt

SEQ ID NO: 1919029 - DNA, 12 bp, Homo sapiens
actttctgaaaa

SEQ ID NO: 1919030 - DNA, 13 bp, Homo sapiens
actttctgaaaat

SEQ ID NO: 1919031 - DNA, 13 bp, Homo sapiens
actttgaaatatt

SEQ ID NO: 1919032 - DNA, 22 bp, Homo sapiens
actttgatgtcagcagttgctg

SEQ ID NO: 1919033 - DNA, 19 bp, Homo sapiens
actttggaaagtagaaaag

SEQ ID NO: 1919034 - DNA, 23 bp, Homo sapiens
actttggcttacatttgaataat

SEQ ID NO: 1919035 - DNA, 17 bp, Homo sapiens
actttgtaaattctgat

SEQ ID NO: 1919036 - DNA, 23 bp, Homo sapiens
actttgtaaattctgatttcttt

SEQ ID NO: 1919037 - DNA, 18 bp, Homo sapiens
actttgtagacattttga

SEQ ID NO: 1919038 - DNA, 17 bp, Homo sapiens
actttgtatagttatgt

SEQ ID NO: 1919039 - DNA, 13 bp, Homo sapiens
acttttaaagaat

SEQ ID NO: 1919040 - DNA, 12 bp, Homo sapiens
acttttagatgt

SEQ ID NO: 1919041 - DNA, 23 bp, Homo sapiens
acttttctcccctctctttctaa

SEQ ID NO: 1919042 - DNA, 19 bp, Homo sapiens
actttttgtaggatacttg

SEQ ID NO: 1919043 - DNA, 18 bp, Homo sapiens
agaaaaaaaaagaaaaaa

SEQ ID NO: 1919044 - DNA, 19 bp, Homo sapiens
agaaaaaaaaagaaaaaag

SEQ ID NO: 1919045 - DNA, 19 bp, Homo sapiens
agaaaagacgcaccagccc

SEQ ID NO: 1919046 - DNA, 12 bp, Homo sapiens
agaaaaggaaat

SEQ ID NO: 1919047 - DNA, 16 bp, Homo sapiens
agaaaataaaaaaaag

SEQ ID NO: 1919048 - DNA, 17 bp, Homo sapiens
agaaaataaaaaaaaga

SEQ ID NO: 1919049 - DNA, 21 bp, Homo sapiens
agaaaataaaaaaaagaaaaa

SEQ ID NO: 1919050 - DNA, 19 bp, Homo sapiens
agaaacggaatagtgtggg

SEQ ID NO: 1919051 - DNA, 17 bp, Homo sapiens
agaaacttaaatgaaca

SEQ ID NO: 1919052 - DNA, 12 bp, Homo sapiens
agaaatcttaag

SEQ ID NO: 1919053 - DNA, 20 bp, Homo sapiens
agaaatcttaagtcataatg

SEQ ID NO: 1919054 - DNA, 13 bp, Homo sapiens
agaaattaactta

SEQ ID NO: 1919055 - DNA, 13 bp, Homo sapiens
agaaattgtcctt

SEQ ID NO: 1919056 - DNA, 14 bp, Homo sapiens
agaaattgtccttg

SEQ ID NO: 1919057 - DNA, 21 bp, Homo sapiens
agaaattgtccttgaagcttg

SEQ ID NO: 1919058 - DNA, 12 bp, Homo sapiens
agaacagctgtt

SEQ ID NO: 1919059 - DNA, 21 bp, Homo sapiens
agaacaggtttttttgtttgt

SEQ ID NO: 1919060 - DNA, 13 bp, Homo sapiens
agaacagtaaaca

SEQ ID NO: 1919061 - DNA, 19 bp, Homo sapiens
agaacattaggccccagca

SEQ ID NO: 1919062 - DNA, 19 bp, Homo sapiens
agaagactcactgtgtggc

SEQ ID NO: 1919063 - DNA, 23 bp, Homo sapiens
agaagacttccccaagcctggca

SEQ ID NO: 1919064 - DNA, 15 bp, Homo sapiens
agaagagaaaggaca

SEQ ID NO: 1919065 - DNA, 14 bp, Homo sapiens
agaagagccccact

SEQ ID NO: 1919066 - DNA, 17 bp, Homo sapiens
agaagagccccactctc

SEQ ID NO: 1919067 - DNA, 20 bp, Homo sapiens
agaagagccccactctcaga

SEQ ID NO: 1919068 - DNA, 22 bp, Homo sapiens
agaagcactaagactgcttcta

SEQ ID NO: 1919069 - DNA, 18 bp, Homo sapiens
agaagcatctctgaccag

SEQ ID NO: 1919070 - DNA, 13 bp, Homo sapiens
agaaggagcaggc

SEQ ID NO: 1919071 - DNA, 19 bp, Homo sapiens
agaaggggactgccacctc

SEQ ID NO: 1919072 - DNA, 21 bp, Homo sapiens
agaaggtttactttttggtgt

SEQ ID NO: 1919073 - DNA, 16 bp, Homo sapiens
agaagtgcatcctgat

SEQ ID NO: 1919074 - DNA, 15 bp, Homo sapiens
agaagtttaaggaat

SEQ ID NO: 1919075 - DNA, 17 bp, Homo sapiens
agaagtttaaggaatat

SEQ ID NO: 1919076 - DNA, 20 bp, Homo sapiens
agaagtttgggaaaagcctt

SEQ ID NO: 1919077 - DNA, 23 bp, Homo sapiens
agaagtttgggaaaagccttctt

SEQ ID NO: 1919078 - DNA, 20 bp, Homo sapiens
agaataaacttacatattta

SEQ ID NO: 1919079 - DNA, 11 bp, Homo sapiens
agaatactgat

SEQ ID NO: 1919080 - DNA, 17 bp, Homo sapiens
agaatactgatggaatt

SEQ ID NO: 1919081 - DNA, 21 bp, Homo sapiens
agaatagaaatttgcccctgg

SEQ ID NO: 1919082 - DNA, 12 bp, Homo sapiens
agaataggatta

SEQ ID NO: 1919083 - DNA, 15 bp, Homo sapiens
agaatccctgtgtta

SEQ ID NO: 1919084 - DNA, 12 bp, Homo sapiens
agaatgaacaaa

SEQ ID NO: 1919085 - DNA, 14 bp, Homo sapiens
agaatgtcaataaa

SEQ ID NO: 1919086 - DNA, 24 bp, Homo sapiens
agaattaaaactttgtagacattt

SEQ ID NO: 1919087 - DNA, 21 bp, Homo sapiens
agaattacaccacaagtatct

SEQ ID NO: 1919088 - DNA, 14 bp, Homo sapiens
agaattgaaggttt

SEQ ID NO: 1919089 - DNA, 21 bp, Homo sapiens
agaattgaaggtttttgatag

SEQ ID NO: 1919090 - DNA, 22 bp, Homo sapiens
agaattttgtgaaacagacttg

SEQ ID NO: 1919091 - DNA, 13 bp, Homo sapiens
agacaaaggccca

SEQ ID NO: 1919092 - DNA, 14 bp, Homo sapiens
agacaaaggcccaa

SEQ ID NO: 1919093 - DNA, 16 bp, Homo sapiens
agacaaatgaaataat

SEQ ID NO: 1919094 - DNA, 21 bp, Homo sapiens
agacaccacagcctccccttc

SEQ ID NO: 1919095 - DNA, 19 bp, Homo sapiens
agacagacaccacagcctc

SEQ ID NO: 1919096 - DNA, 22 bp, Homo sapiens
agacagacaccacagcctcccc

SEQ ID NO: 1919097 - DNA, 14 bp, Homo sapiens
agacagactagaag

SEQ ID NO: 1919098 - DNA, 18 bp, Homo sapiens
agacatgtaatttgtgta

SEQ ID NO: 1919099 - DNA, 20 bp, Homo sapiens
agacatttcaaataactgca

SEQ ID NO: 1919100 - DNA, 21 bp, Homo sapiens
agacattttgaaataaaaatg

SEQ ID NO: 1919101 - DNA, 18 bp, Homo sapiens
agacatttttggaaattt

SEQ ID NO: 1919102 - DNA, 21 bp, Homo sapiens
agaccgtgaagatactttgta

SEQ ID NO: 1919103 - DNA, 13 bp, Homo sapiens
agacctgaactgg

SEQ ID NO: 1919104 - DNA, 13 bp, Homo sapiens
agactgccagctc

SEQ ID NO: 1919105 - DNA, 14 bp, Homo sapiens
agactgccagctct

SEQ ID NO: 1919106 - DNA, 22 bp, Homo sapiens
agactgccagctcttcctagct

SEQ ID NO: 1919107 - DNA, 20 bp, Homo sapiens
agactgctcctgagccccca

SEQ ID NO: 1919108 - DNA, 18 bp, Homo sapiens
agactgtggagactgctc

SEQ ID NO: 1919109 - DNA, 17 bp, Homo sapiens
agacttattttcacatg

SEQ ID NO: 1919110 - DNA, 21 bp, Homo sapiens
agacttccccaagcctggcag

SEQ ID NO: 1919111 - DNA, 15 bp, Homo sapiens
agacttgaaaagaga

SEQ ID NO: 1919112 - DNA, 17 bp, Homo sapiens
agacttgaaaagagaca

SEQ ID NO: 1919113 - DNA, 20 bp, Homo sapiens
agacttgaaaagagacaggc

SEQ ID NO: 1919114 - DNA, 11 bp, Homo sapiens
agactttgatg

SEQ ID NO: 1919115 - DNA, 13 bp, Homo sapiens
agactttgatgtc

SEQ ID NO: 1919116 - DNA, 14 bp, Homo sapiens
agagaaaaaagcca

SEQ ID NO: 1919117 - DNA, 12 bp, Homo sapiens
agagaaaagaaa

SEQ ID NO: 1919118 - DNA, 13 bp, Homo sapiens
agagaagagaaag

SEQ ID NO: 1919119 - DNA, 14 bp, Homo sapiens
agagaagagcccca

SEQ ID NO: 1919120 - DNA, 21 bp, Homo sapiens
agagaagagccccactctcag

SEQ ID NO: 1919121 - DNA, 12 bp, Homo sapiens
agagacaggcag

SEQ ID NO: 1919122 - DNA, 13 bp, Homo sapiens
agagacaggcagg

SEQ ID NO: 1919123 - DNA, 20 bp, Homo sapiens
agagacagggtttcaccatg

SEQ ID NO: 1919124 - DNA, 17 bp, Homo sapiens
agagactgcttgacaaa

SEQ ID NO: 1919125 - DNA, 12 bp, Homo sapiens
agagagtagctc

SEQ ID NO: 1919126 - DNA, 15 bp, Homo sapiens
agagagtattctaaa

SEQ ID NO: 1919127 - DNA, 23 bp, Homo sapiens
agagcaacccctggaccccagcc

SEQ ID NO: 1919128 - DNA, 24 bp, Homo sapiens
agagcaacccctggaccccagcct

SEQ ID NO: 1919129 - DNA, 22 bp, Homo sapiens
agagccccactctcagaggccc

SEQ ID NO: 1919130 - DNA, 23 bp, Homo sapiens
agagccccactctcagaggcccc

SEQ ID NO: 1919131 - DNA, 23 bp, Homo sapiens
agagccctcagtcggggcaggcc

SEQ ID NO: 1919132 - DNA, 16 bp, Homo sapiens
agagccttaaaacatc

SEQ ID NO: 1919133 - DNA, 20 bp, Homo sapiens
agagcgaccagcaggctcct

SEQ ID NO: 1919134 - DNA, 18 bp, Homo sapiens
agcgcccccactcctcct

SEQ ID NO: 1919135 - DNA, 19 bp, Homo sapiens
agcgcccccactcctcctc

SEQ ID NO: 1919136 - DNA, 18 bp, Homo sapiens
agcgccctggcccccaca

SEQ ID NO: 1919137 - DNA, 20 bp, Homo sapiens
agcgccctggcccccacatg

SEQ ID NO: 1919138 - DNA, 19 bp, Homo sapiens
agcgcggacatcccctgct

SEQ ID NO: 1919139 - DNA, 14 bp, Homo sapiens
agcggccctcccag

SEQ ID NO: 1919140 - DNA, 17 bp, Homo sapiens
agcggccctcccaggcg

SEQ ID NO: 1919141 - DNA, 21 bp, Homo sapiens
agctaaggccaatgggctaga

SEQ ID NO: 1919142 - DNA, 18 bp, Homo sapiens
agctagttgaatacttga

SEQ ID NO: 1919143 - DNA, 23 bp, Homo sapiens
agctagttgaatacttgaaccat

SEQ ID NO: 1919144 - DNA, 24 bp, Homo sapiens
agctagttgaatacttgaaccata

SEQ ID NO: 1919145 - DNA, 14 bp, Homo sapiens
agctatatgcattt

SEQ ID NO: 1919146 - DNA, 13 bp, Homo sapiens
agctatgagagga

SEQ ID NO: 1919147 - DNA, 13 bp, Homo sapiens
agctatgcaaaaa

SEQ ID NO: 1919148 - DNA, 17 bp, Homo sapiens
agctatgcaaaaagcta

SEQ ID NO: 1919149 - DNA, 16 bp, Homo sapiens
agctcaagccgtggcc

SEQ ID NO: 1919150 - DNA, 18 bp, Homo sapiens
agctcaaggcaatgggct

SEQ ID NO: 1919151 - DNA, 20 bp, Homo sapiens
agctcatttggggaccacag

SEQ ID NO: 1919152 - DNA, 18 bp, Homo sapiens
agctcccacttctgccag

SEQ ID NO: 1919153 - DNA, 19 bp, Homo sapiens
agctcccacttctgccaga

SEQ ID NO: 1919154 - DNA, 14 bp, Homo sapiens
agctccctcccctg

SEQ ID NO: 1919155 - DNA, 19 bp, Homo sapiens
agctccctcccctgctcag

SEQ ID NO: 1919156 - DNA, 19 bp, Homo sapiens
agctctgaattcaggtccc

SEQ ID NO: 1919157 - DNA, 23 bp, Homo sapiens
agctctgagttccggcaccagta

SEQ ID NO: 1919158 - DNA, 14 bp, Homo sapiens
agctcttcctagct

SEQ ID NO: 1919159 - DNA, 12 bp, Homo sapiens
agctctttaaca

SEQ ID NO: 1919160 - DNA, 17 bp, Homo sapiens
agctgaggcccatggcc

SEQ ID NO: 1919161 - DNA, 18 bp, Homo sapiens
agctgaggcccatggcca

SEQ ID NO: 1919162 - DNA, 13 bp, Homo sapiens
agctgaggctgct

SEQ ID NO: 1919163 - DNA, 14 bp, Homo sapiens
agctgaggctgctg

SEQ ID NO: 1919164 - DNA, 18 bp, Homo sapiens
agctgaggctgctgccag

SEQ ID NO: 1919165 - DNA, 21 bp, Homo sapiens
agctgaggctgctgccaggcc

SEQ ID NO: 1919166 - DNA, 14 bp, Homo sapiens
agctgcgtcataag

SEQ ID NO: 1919167 - DNA, 19 bp, Homo sapiens
agctgctcagatcccactt

SEQ ID NO: 1919168 - DNA, 17 bp, Homo sapiens
agctgctgagccgcaga

SEQ ID NO: 1919169 - DNA, 19 bp, Homo sapiens
agctggaaaggccagcagc

SEQ ID NO: 1919170 - DNA, 23 bp, Homo sapiens
agctggaaaggccagcagccttc

SEQ ID NO: 1919171 - DNA, 16 bp, Homo sapiens
agctggagaggagccc

SEQ ID NO: 1919172 - DNA, 23 bp, Homo sapiens
agctggagaggagccctgcctct

SEQ ID NO: 1919173 - DNA, 17 bp, Homo sapiens
agctggtgttataatac

SEQ ID NO: 1919174 - DNA, 17 bp, Homo sapiens
agctgtaaggcatgaag

SEQ ID NO: 1919175 - DNA, 16 bp, Homo sapiens
agctgtcaaggctcag

SEQ ID NO: 1919176 - DNA, 14 bp, Homo sapiens
agctgtcaccacta

SEQ ID NO: 1919177 - DNA, 16 bp, Homo sapiens
agctgtgctgggaggt

SEQ ID NO: 1919178 - DNA, 23 bp, Homo sapiens
agctgttgactctagtactgtga

SEQ ID NO: 1919179 - DNA, 17 bp, Homo sapiens
agctgttgatgggatga

SEQ ID NO: 1919180 - DNA, 22 bp, Homo sapiens
agctgttggcctctgcaaagga

SEQ ID NO: 1919181 - DNA, 16 bp, Homo sapiens
agcttaagggtcatat

SEQ ID NO: 1919182 - DNA, 15 bp, Homo sapiens
agcttacgtagttct

SEQ ID NO: 1919183 - DNA, 22 bp, Homo sapiens
agcttgggctggcgggccctgg

SEQ ID NO: 1919184 - DNA, 15 bp, Homo sapiens
agctttgtaattcag

SEQ ID NO: 1919185 - DNA, 18 bp, Homo sapiens
agctttgtttagtcttta

SEQ ID NO: 1919186 - DNA, 21 bp, Homo sapiens
aggaaacattggcataatttt

SEQ ID NO: 1919187 - DNA, 14 bp, Homo sapiens
aggaaatcaaagtg

SEQ ID NO: 1919188 - DNA, 22 bp, Homo sapiens
aggaaatgctgacccatgggca

SEQ ID NO: 1919189 - DNA, 23 bp, Homo sapiens
aggaaatgctgacccatgggcag

SEQ ID NO: 1919190 - DNA, 20 bp, Homo sapiens
aggaaattcagattgtttaa

SEQ ID NO: 1919191 - DNA, 15 bp, Homo sapiens
aggaacaagaaggtg

SEQ ID NO: 1919192 - DNA, 15 bp, Homo sapiens
aggaaggctttgaaa

SEQ ID NO: 1919193 - DNA, 21 bp, Homo sapiens
aggacactaagaggaggcagg

SEQ ID NO: 1919194 - DNA, 20 bp, Homo sapiens
aggacagcctgcctctgcca

SEQ ID NO: 1919195 - DNA, 21 bp, Homo sapiens
aggacagcctgcctctgccac

SEQ ID NO: 1919196 - DNA, 16 bp, Homo sapiens
aggacaggggttcctt

SEQ ID NO: 1919197 - DNA, 12 bp, Homo sapiens
aggaccagccca

SEQ ID NO: 1919198 - DNA, 16 bp, Homo sapiens
aggaccctgccaggca

SEQ ID NO: 1919199 - DNA, 13 bp, Homo sapiens
aggacctgcaaac

SEQ ID NO: 1919200 - DNA, 15 bp, Homo sapiens
aggactgactgaggc

SEQ ID NO: 1919201 - DNA, 23 bp, Homo sapiens
aggagataatgtggattaaaacc

SEQ ID NO: 1919202 - DNA, 11 bp, Homo sapiens
aggagccctgc

SEQ ID NO: 1919203 - DNA, 15 bp, Homo sapiens
aggagccctgcctct

SEQ ID NO: 1919204 - DNA, 17 bp, Homo sapiens
aggagccctgcctctcc

SEQ ID NO: 1919205 - DNA, 14 bp, Homo sapiens
aggaggccacctcc

SEQ ID NO: 1919206 - DNA, 19 bp, Homo sapiens
aggagggacagtctcacca

SEQ ID NO: 1919207 - DNA, 13 bp, Homo sapiens
aggagggactctg

SEQ ID NO: 1919208 - DNA, 21 bp, Homo sapiens
aggagtgatcgtcagatgtgt

SEQ ID NO: 1919209 - DNA, 17 bp, Homo sapiens
aggagtggattcctccc

SEQ ID NO: 1919210 - DNA, 19 bp, Homo sapiens
aggagtggattcctcccca

SEQ ID NO: 1919211 - DNA, 18 bp, Homo sapiens
aggatgctcccccaggga

SEQ ID NO: 1919212 - DNA, 16 bp, Homo sapiens
aggatgtgctgcagtg

SEQ ID NO: 1919213 - DNA, 17 bp, Homo sapiens
aggattagtttagaaca

SEQ ID NO: 1919214 - DNA, 22 bp, Homo sapiens
aggcaaacctttctataatttt

SEQ ID NO: 1919215 - DNA, 12 bp, Homo sapiens
aggcacaggcag

SEQ ID NO: 1919216 - DNA, 13 bp, Homo sapiens
aggcacaggcagg

SEQ ID NO: 1919217 - DNA, 16 bp, Homo sapiens
aggcacaggcagggca

SEQ ID NO: 1919218 - DNA, 18 bp, Homo sapiens
aggcactgaagctgcggc

SEQ ID NO: 1919219 - DNA, 16 bp, Homo sapiens
aggcagcagtgggttc

SEQ ID NO: 1919220 - DNA, 14 bp, Homo sapiens
aggcagccctgcct

SEQ ID NO: 1919221 - DNA, 15 bp, Homo sapiens
aggcagggcaggacc

SEQ ID NO: 1919222 - DNA, 16 bp, Homo sapiens
aggcagggcaggacca

SEQ ID NO: 1919223 - DNA, 17 bp, Homo sapiens
aggcagggcaggaccag

SEQ ID NO: 1919224 - DNA, 21 bp, Homo sapiens
aggcagggcaggaccagccca

SEQ ID NO: 1919225 - DNA, 22 bp, Homo sapiens
aggcagggcaggaccagcccac

SEQ ID NO: 1919226 - DNA, 23 bp, Homo sapiens
aggcagtttgaggattagtttag

SEQ ID NO: 1919227 - DNA, 15 bp, Homo sapiens
aggcatgggccacca

SEQ ID NO: 1919228 - DNA, 17 bp, Homo sapiens
aggccaaacaggccctc

SEQ ID NO: 1919229 - DNA, 21 bp, Homo sapiens
aggccaagagtggccccacct

SEQ ID NO: 1919230 - DNA, 22 bp, Homo sapiens
aggccaagagtggccccacctg

SEQ ID NO: 1919231 - DNA, 12 bp, Homo sapiens
aggccacctcct

SEQ ID NO: 1919232 - DNA, 23 bp, Homo sapiens
aggccacctcctaaaaggcccag

SEQ ID NO: 1919233 - DNA, 12 bp, Homo sapiens
aggccagcagcc

SEQ ID NO: 1919234 - DNA, 14 bp, Homo sapiens
aggccagcagcctt

SEQ ID NO: 1919235 - DNA, 15 bp, Homo sapiens
aggccagcagccttc

SEQ ID NO: 1919236 - DNA, 18 bp, Homo sapiens
aggccagcagccttccag

SEQ ID NO: 1919237 - DNA, 20 bp, Homo sapiens
aggccagcagccttccagtg

SEQ ID NO: 1919238 - DNA, 11 bp, Homo sapiens
aggccagggga

SEQ ID NO: 1919239 - DNA, 13 bp, Homo sapiens
aggcccaccctgc

SEQ ID NO: 1919240 - DNA, 23 bp, Homo sapiens
aggcccaccctgcttggcccagg

SEQ ID NO: 1919241 - DNA, 23 bp, Homo sapiens
aggcccagagagaagagccccac

SEQ ID NO: 1919242 - DNA, 16 bp, Homo sapiens
aggccccaatacccca

SEQ ID NO: 1919243 - DNA, 21 bp, Homo sapiens
aggccccagcaacacgtcatt

SEQ ID NO: 1919244 - DNA, 18 bp, Homo sapiens
aggcccggcatgaggccc

SEQ ID NO: 1919245 - DNA, 22 bp, Homo sapiens
aggccctcctccctcccagctc

SEQ ID NO: 1919246 - DNA, 23 bp, Homo sapiens
aggccctcctccctcccagctcc

SEQ ID NO: 1919247 - DNA, 21 bp, Homo sapiens
aggccctgggcctccacctct

SEQ ID NO: 1919248 - DNA, 23 bp, Homo sapiens
aggccctgggcctccacctctgt

SEQ ID NO: 1919249 - DNA, 18 bp, Homo sapiens
aggccgttgctgacttag

SEQ ID NO: 1919250 - DNA, 21 bp, Homo sapiens
aggccgttgctgacttagaat

SEQ ID NO: 1919251 - DNA, 17 bp, Homo sapiens
aggcctaaaagtaaaca

SEQ ID NO: 1919252 - DNA, 23 bp, Homo sapiens
aggcctacatgctttgtgaacaa

SEQ ID NO: 1919253 - DNA, 23 bp, Homo sapiens
aggcctttagttataaaggaatc

SEQ ID NO: 1919254 - DNA, 22 bp, Homo sapiens
aggcgctggagcctgcggggca

SEQ ID NO: 1919255 - DNA, 19 bp, Homo sapiens
aggcggccggccgcactgg

SEQ ID NO: 1919256 - DNA, 15 bp, Homo sapiens
aggctcctcagccct

SEQ ID NO: 1919257 - DNA, 17 bp, Homo sapiens
aggctgagtgcaggccc

SEQ ID NO: 1919258 - DNA, 21 bp, Homo sapiens
aggctgagtgcaggcccaccc

SEQ ID NO: 1919259 - DNA, 14 bp, Homo sapiens
aggctgctgccagg

SEQ ID NO: 1919260 - DNA, 10 bp, Homo sapiens
aggctgggct

SEQ ID NO: 1919261 - DNA, 19 bp, Homo sapiens
aggctgggctgggcactgc

SEQ ID NO: 1919262 - DNA, 21 bp, Homo sapiens
aggctgggctgggcactgctc

SEQ ID NO: 1919263 - DNA, 14 bp, Homo sapiens
aggctgtggtcaga

SEQ ID NO: 1919264 - DNA, 12 bp, Homo sapiens
agggaaagactg

SEQ ID NO: 1919265 - DNA, 20 bp, Homo sapiens
agggaacaagttgagctatg

SEQ ID NO: 1919266 - DNA, 21 bp, Homo sapiens
agggaacaagttgagctatga

SEQ ID NO: 1919267 - DNA, 14 bp, Homo sapiens
agggactctgtctg

SEQ ID NO: 1919268 - DNA, 14 bp, Homo sapiens
agggagacagacca

SEQ ID NO: 1919269 - DNA, 19 bp, Homo sapiens
agggagccctgggccaggg

SEQ ID NO: 1919270 - DNA, 13 bp, Homo sapiens
agggaggagcccc

SEQ ID NO: 1919271 - DNA, 15 bp, Homo sapiens
agggaggagccccag

SEQ ID NO: 1919272 - DNA, 20 bp, Homo sapiens
agggagtaagtagaggtggc

SEQ ID NO: 1919273 - DNA, 16 bp, Homo sapiens
agggatggaggaagaa

SEQ ID NO: 1919274 - DNA, 19 bp, Homo sapiens
agggatggcagtggctgtg

SEQ ID NO: 1919275 - DNA, 13 bp, Homo sapiens
agggcacagaagg

SEQ ID NO: 1919276 - DNA, 20 bp, Homo sapiens
agggcacagggcctggccca

SEQ ID NO: 1919277 - DNA, 13 bp, Homo sapiens
agggcaggaccag

SEQ ID NO: 1919278 - DNA, 18 bp, Homo sapiens
agggcatttggcttcctc

SEQ ID NO: 1919279 - DNA, 22 bp, Homo sapiens
agggcatttggcttcctctgct

SEQ ID NO: 1919280 - DNA, 16 bp, Homo sapiens
agggcccgggcccagg

SEQ ID NO: 1919281 - DNA, 17 bp, Homo sapiens
agggcctgggcctggct

SEQ ID NO: 1919282 - DNA, 21 bp, Homo sapiens
agggcctgggcctggctccct

SEQ ID NO: 1919283 - DNA, 16 bp, Homo sapiens
agggcttgtagttctt

SEQ ID NO: 1919284 - DNA, 17 bp, Homo sapiens
agggcttgtagttcttt

SEQ ID NO: 1919285 - DNA, 16 bp, Homo sapiens
aggggactgccacctc

SEQ ID NO: 1919286 - DNA, 16 bp, Homo sapiens
aggggagacagagcaa

SEQ ID NO: 1919287 - DNA, 15 bp, Homo sapiens
aggggagactttgat

SEQ ID NO: 1919288 - DNA, 19 bp, Homo sapiens
aggggccagaccctgccca

SEQ ID NO: 1919289 - DNA, 21 bp, Homo sapiens
aggggccagagccttggagga

SEQ ID NO: 1919290 - DNA, 22 bp, Homo sapiens
aggggccagcggccctcccagg

SEQ ID NO: 1919291 - DNA, 18 bp, Homo sapiens
aggggctagctaagccaa

SEQ ID NO: 1919292 - DNA, 22 bp, Homo sapiens
agggggacctcgggctgttctg

SEQ ID NO: 1919293 - DNA, 18 bp, Homo sapiens
aggggggtttcagggctg

SEQ ID NO: 1919294 - DNA, 15 bp, Homo sapiens
aggggtacacagagc

SEQ ID NO: 1919295 - DNA, 19 bp, Homo sapiens
agggtgatggaacaagaga

SEQ ID NO: 1919296 - DNA, 21 bp, Homo sapiens
agggtgccggaaagagagctg

SEQ ID NO: 1919297 - DNA, 23 bp, Homo sapiens
agggtgccggaaagagagctgga

SEQ ID NO: 1919298 - DNA, 12 bp, Homo sapiens
agggtggtttac

SEQ ID NO: 1919299 - DNA, 15 bp, Homo sapiens
agggtgtgaggccac

SEQ ID NO: 1919300 - DNA, 20 bp, Homo sapiens
agggttggaaagtccaagcc

SEQ ID NO: 1919301 - DNA, 17 bp, Homo sapiens
aggtatttttgaaagca

SEQ ID NO: 1919302 - DNA, 14 bp, Homo sapiens
aggtcccagttgct

SEQ ID NO: 1919303 - DNA, 19 bp, Homo sapiens
aggtcccagttgctgtcac

SEQ ID NO: 1919304 - DNA, 20 bp, Homo sapiens
aggtcccagttgctgtcaca

SEQ ID NO: 1919305 - DNA, 23 bp, Homo sapiens
aggtctgagttgttaccccaagc

SEQ ID NO: 1919306 - DNA, 22 bp, Homo sapiens
aggtgaaactccagatgccaca

SEQ ID NO: 1919307 - DNA, 21 bp, Homo sapiens
aggtgaacattggttctttca

SEQ ID NO: 1919308 - DNA, 24 bp, Homo sapiens
aggtgtggcagaagcttgcagatg

SEQ ID NO: 1919309 - DNA, 17 bp, Homo sapiens
aggtgttgttgagggca

SEQ ID NO: 1919310 - DNA, 14 bp, Homo sapiens
aggtgtttgaaaat

SEQ ID NO: 1919311 - DNA, 23 bp, Homo sapiens
aggtttttgatagcattgtaagc

SEQ ID NO: 1919312 - DNA, 16 bp, Homo sapiens
aggttttttttgtacg

SEQ ID NO: 1919313 - DNA, 21 bp, Homo sapiens
agtaagggaacaagttgagct

SEQ ID NO: 1919314 - DNA, 14 bp, Homo sapiens
agtaataaagactc

SEQ ID NO: 1919315 - DNA, 13 bp, Homo sapiens
agtaatatttatt

SEQ ID NO: 1919316 - DNA, 21 bp, Homo sapiens
agtacactgaatttttatgtg

SEQ ID NO: 1919317 - DNA, 19 bp, Homo sapiens
agtacactgcctgccttaa

SEQ ID NO: 1919318 - DNA, 14 bp, Homo sapiens
agtacgtgtggctt

SEQ ID NO: 1919319 - DNA, 19 bp, Homo sapiens
agtagacttgctttggtca

SEQ ID NO: 1919320 - DNA, 21 bp, Homo sapiens
agtagcacaggctgagtgcag

SEQ ID NO: 1919321 - DNA, 14 bp, Homo sapiens
agtagtgttacatg

SEQ ID NO: 1919322 - DNA, 13 bp, Homo sapiens
agtagttctgtat

SEQ ID NO: 1919323 - DNA, 21 bp, Homo sapiens
agtagttctgtatttgaaagt

SEQ ID NO: 1919324 - DNA, 23 bp, Homo sapiens
agtatagtttaaaaatctgccac

SEQ ID NO: 1919325 - DNA, 13 bp, Homo sapiens
agtatcatgaagc

SEQ ID NO: 1919326 - DNA, 17 bp, Homo sapiens
agtatgtcaacagccat

SEQ ID NO: 1919327 - DNA, 18 bp, Homo sapiens
agtattctaaaaaaataa

SEQ ID NO: 1919328 - DNA, 11 bp, Homo sapiens
agtattgattc

SEQ ID NO: 1919329 - DNA, 15 bp, Homo sapiens
agtatttactgactg

SEQ ID NO: 1919330 - DNA, 24 bp, Homo sapiens
agtatttactgactgcttataaac

SEQ ID NO: 1919331 - DNA, 21 bp, Homo sapiens
agtattttcctgttgtcaaga

SEQ ID NO: 1919332 - DNA, 19 bp, Homo sapiens
agtcaagacgaacatgtag

SEQ ID NO: 1919333 - DNA, 18 bp, Homo sapiens
agtcactctaggactctg

SEQ ID NO: 1919334 - DNA, 12 bp, Homo sapiens
agtcactttgac

SEQ ID NO: 1919335 - DNA, 21 bp, Homo sapiens
agtcatttcaaaatatgtgta

SEQ ID NO: 1919336 - DNA, 20 bp, Homo sapiens
agtccaagccgtaggaccca

SEQ ID NO: 1919337 - DNA, 14 bp, Homo sapiens
agtcccagcagcca

SEQ ID NO: 1919338 - DNA, 17 bp, Homo sapiens
agtcccagcagccagcc

SEQ ID NO: 1919339 - DNA, 18 bp, Homo sapiens
agtcccagcagccagcca

SEQ ID NO: 1919340 - DNA, 18 bp, Homo sapiens
agtccctgtaattgttgt

SEQ ID NO: 1919341 - DNA, 18 bp, Homo sapiens
agtcggggcaggccaggg

SEQ ID NO: 1919342 - DNA, 15 bp, Homo sapiens
agtcgtcagcctccc

SEQ ID NO: 1919343 - DNA, 20 bp, Homo sapiens
agtctcaccatttccccagg

SEQ ID NO: 1919344 - DNA, 19 bp, Homo sapiens
agtctcgctctgttgccca

SEQ ID NO: 1919345 - DNA, 18 bp, Homo sapiens
agtctgaggccgttgctg

SEQ ID NO: 1919346 - DNA, 18 bp, Homo sapiens
agtctggaactgctgctg

SEQ ID NO: 1919347 - DNA, 22 bp, Homo sapiens
agtctggaactgctgctgaccc

SEQ ID NO: 1919348 - DNA, 13 bp, Homo sapiens
agtcttagatcat

SEQ ID NO: 1919349 - DNA, 18 bp, Homo sapiens
agtctttctcactgcctt

SEQ ID NO: 1919350 - DNA, 14 bp, Homo sapiens
agtgaaaatatagc

SEQ ID NO: 1919351 - DNA, 16 bp, Homo sapiens
agtgaagtaaaagtta

SEQ ID NO: 1919352 - DNA, 15 bp, Homo sapiens
agtgaatgtaatagt

SEQ ID NO: 1919353 - DNA, 18 bp, Homo sapiens
agtgaatttttaaagaca

SEQ ID NO: 1919354 - DNA, 20 bp, Homo sapiens
agtgacggttcctacacagg

SEQ ID NO: 1919355 - DNA, 17 bp, Homo sapiens
agtgagaggggaggcca

SEQ ID NO: 1919356 - DNA, 19 bp, Homo sapiens
agtgagaggggaggccaag

SEQ ID NO: 1919357 - DNA, 14 bp, Homo sapiens
agtgaggaaatcaa

SEQ ID NO: 1919358 - DNA, 20 bp, Homo sapiens
agtgaggaaatcaaagtgct

SEQ ID NO: 1919359 - DNA, 18 bp, Homo sapiens
agtgaggcatctctctgg

SEQ ID NO: 1919360 - DNA, 18 bp, Homo sapiens
agtgagtgaaactcccac

SEQ ID NO: 1919361 - DNA, 16 bp, Homo sapiens
agtgcaaacagaagtg

SEQ ID NO: 1919362 - DNA, 18 bp, Homo sapiens
agtgcaaacagaagtgca

SEQ ID NO: 1919363 - DNA, 20 bp, Homo sapiens
agtgcaaacagaagtgcatc

SEQ ID NO: 1919364 - DNA, 17 bp, Homo sapiens
agtgcaatgccccctcc

SEQ ID NO: 1919365 - DNA, 20 bp, Homo sapiens
agtgcaatgccccctcccct

SEQ ID NO: 1919366 - DNA, 22 bp, Homo sapiens
agtgcaatgccccctcccctcc

SEQ ID NO: 1919367 - DNA, 22 bp, Homo sapiens
agtgcatgggtcagggtgtgag

SEQ ID NO: 1919368 - DNA, 19 bp, Homo sapiens
agtgccgcatctcacagct

SEQ ID NO: 1919369 - DNA, 20 bp, Homo sapiens
agtgccttagcatgtgttgc

SEQ ID NO: 1919370 - DNA, 18 bp, Homo sapiens
agtgcctttgcagctcag

SEQ ID NO: 1919371 - DNA, 19 bp, Homo sapiens
agtgctattacgaagttca

SEQ ID NO: 1919372 - DNA, 23 bp, Homo sapiens
agtgctattacgaagttcaagat

SEQ ID NO: 1919373 - DNA, 23 bp, Homo sapiens
agtgctgacccaacagcctctgt

SEQ ID NO: 1919374 - DNA, 20 bp, Homo sapiens
agtgctgggattacaggcat

SEQ ID NO: 1919375 - DNA, 14 bp, Homo sapiens
agtggactctctga

SEQ ID NO: 1919376 - DNA, 21 bp, Homo sapiens
agtggactctctgacaaagtg

SEQ ID NO: 1919377 - DNA, 17 bp, Homo sapiens
agtggatattttcttaa

SEQ ID NO: 1919378 - DNA, 18 bp, Homo sapiens
agtggatattttcttaaa

SEQ ID NO: 1919379 - DNA, 15 bp, Homo sapiens
agtggattcctcccc

SEQ ID NO: 1919380 - DNA, 17 bp, Homo sapiens
agtggattcctccccac

SEQ ID NO: 1919381 - DNA, 18 bp, Homo sapiens
atctttgagtgtattcta

SEQ ID NO: 1919382 - DNA, 18 bp, Homo sapiens
atgaaataacacagcagt

SEQ ID NO: 1919383 - DNA, 20 bp, Homo sapiens
atgaaataataaagagattt

SEQ ID NO: 1919384 - DNA, 12 bp, Homo sapiens
atgaacagactt

SEQ ID NO: 1919385 - DNA, 16 bp, Homo sapiens
atgaacatacaaatgc

SEQ ID NO: 1919386 - DNA, 15 bp, Homo sapiens
atgaactgtaaatgc

SEQ ID NO: 1919387 - DNA, 16 bp, Homo sapiens
atgaagaatttaaaga

SEQ ID NO: 1919388 - DNA, 18 bp, Homo sapiens
atgaagctgaggctgctg

SEQ ID NO: 1919389 - DNA, 14 bp, Homo sapiens
atgaagtaaagttt

SEQ ID NO: 1919390 - DNA, 24 bp, Homo sapiens
atgacgtacaagtagttctgtatt

SEQ ID NO: 1919391 - DNA, 17 bp, Homo sapiens
atgactggtcttcctta

SEQ ID NO: 1919392 - DNA, 17 bp, Homo sapiens
atgactttattatttat

SEQ ID NO: 1919393 - DNA, 13 bp, Homo sapiens
atgactttattgc

SEQ ID NO: 1919394 - DNA, 21 bp, Homo sapiens
atgactttcacatttggaatt

SEQ ID NO: 1919395 - DNA, 19 bp, Homo sapiens
atgagtccaaactggaatg

SEQ ID NO: 1919396 - DNA, 15 bp, Homo sapiens
atgagtttcacagtg

SEQ ID NO: 1919397 - DNA, 23 bp, Homo sapiens
atgatacgcttaaggtggaaagt

SEQ ID NO: 1919398 - DNA, 23 bp, Homo sapiens
atgatatgcttgtaactaaaata

SEQ ID NO: 1919399 - DNA, 13 bp, Homo sapiens
atgattaatgcat

SEQ ID NO: 1919400 - DNA, 13 bp, Homo sapiens
atgcagtcttaga

SEQ ID NO: 1919401 - DNA, 13 bp, Homo sapiens
atgcatattactg

SEQ ID NO: 1919402 - DNA, 16 bp, Homo sapiens
atgcattaaaagaaaa

SEQ ID NO: 1919403 - DNA, 17 bp, Homo sapiens
atgcattaaaagaaaat

SEQ ID NO: 1919404 - DNA, 23 bp, Homo sapiens
atgcattttattttagacacaaa

SEQ ID NO: 1919405 - DNA, 20 bp, Homo sapiens
atgcccagctgtgctgggag

SEQ ID NO: 1919406 - DNA, 21 bp, Homo sapiens
atgcccagctgtgctgggagg

SEQ ID NO: 1919407 - DNA, 13 bp, Homo sapiens
atgccccctcccc

SEQ ID NO: 1919408 - DNA, 23 bp, Homo sapiens
atgctagcctcacgaaactggaa

SEQ ID NO: 1919409 - DNA, 17 bp, Homo sapiens
atgctgaaataaaatga

SEQ ID NO: 1919410 - DNA, 16 bp, Homo sapiens
atgctggagaaaaata

SEQ ID NO: 1919411 - DNA, 20 bp, Homo sapiens
atgcttttaaactgattacg

SEQ ID NO: 1919412 - DNA, 12 bp, Homo sapiens
atggaagagaag

SEQ ID NO: 1919413 - DNA, 18 bp, Homo sapiens
atggaatttttttgtacg

SEQ ID NO: 1919414 - DNA, 23 bp, Homo sapiens
atggaccatgctgtctggcacag

SEQ ID NO: 1919415 - DNA, 14 bp, Homo sapiens
atggatagattttc

SEQ ID NO: 1919416 - DNA, 19 bp, Homo sapiens
atggcagaggaatatcaat

SEQ ID NO: 1919417 - DNA, 21 bp, Homo sapiens
atggcagcatgcaaacttgga

SEQ ID NO: 1919418 - DNA, 18 bp, Homo sapiens
atggcagtggctgtgaag

SEQ ID NO: 1919419 - DNA, 14 bp, Homo sapiens
ccacctctgtgcag

SEQ ID NO: 1919420 - DNA, 16 bp, Homo sapiens
ccacctgagttcctga

SEQ ID NO: 1919421 - DNA, 11 bp, Homo sapiens
ccacctgcaca

SEQ ID NO: 1919422 - DNA, 12 bp, Homo sapiens
ccacctggagcc

SEQ ID NO: 1919423 - DNA, 17 bp, Homo sapiens
ccacctggccctctctg

SEQ ID NO: 1919424 - DNA, 23 bp, Homo sapiens
ccaccttcttgggactgctgtga

SEQ ID NO: 1919425 - DNA, 23 bp, Homo sapiens
ccacgtctatttcatcagaacag

SEQ ID NO: 1919426 - DNA, 13 bp, Homo sapiens
ccacgttttgaaa

SEQ ID NO: 1919427 - DNA, 18 bp, Homo sapiens
ccactacagtaagctggt

SEQ ID NO: 1919428 - DNA, 19 bp, Homo sapiens
ccactcccatggctctggg

SEQ ID NO: 1919429 - DNA, 12 bp, Homo sapiens
ccactcctcctc

SEQ ID NO: 1919430 - DNA, 13 bp, Homo sapiens
ccactcctcctcc

SEQ ID NO: 1919431 - DNA, 14 bp, Homo sapiens
ccactcctcctcct

SEQ ID NO: 1919432 - DNA, 11 bp, Homo sapiens
ccactctcaga

SEQ ID NO: 1919433 - DNA, 13 bp, Homo sapiens
ccactctcagagg

SEQ ID NO: 1919434 - DNA, 19 bp, Homo sapiens
ccagaagacaaaggcccaa

SEQ ID NO: 1919435 - DNA, 15 bp, Homo sapiens
ccagacctgcctgtc

SEQ ID NO: 1919436 - DNA, 22 bp, Homo sapiens
ccagagagaagagccccactct

SEQ ID NO: 1919437 - DNA, 18 bp, Homo sapiens
ccagagccttggaggaca

SEQ ID NO: 1919438 - DNA, 20 bp, Homo sapiens
ccagagcgttagaggggcca

SEQ ID NO: 1919439 - DNA, 22 bp, Homo sapiens
ccagagcgttagaggggccagc

SEQ ID NO: 1919440 - DNA, 23 bp, Homo sapiens
ccagagtagccatgaggaggcag

SEQ ID NO: 1919441 - DNA, 16 bp, Homo sapiens
ccagcaacacgtcatt

SEQ ID NO: 1919442 - DNA, 23 bp, Homo sapiens
ccagcacaaccttcaagctgctt

SEQ ID NO: 1919443 - DNA, 16 bp, Homo sapiens
ccagcagccagccaaa

SEQ ID NO: 1919444 - DNA, 18 bp, Homo sapiens
ccagcagcctctgatctg

SEQ ID NO: 1919445 - DNA, 11 bp, Homo sapiens
ccagcagcctt

SEQ ID NO: 1919446 - DNA, 13 bp, Homo sapiens
ccagcagccttcc

SEQ ID NO: 1919447 - DNA, 22 bp, Homo sapiens
ccagcagccttccagtggcttc

SEQ ID NO: 1919448 - DNA, 12 bp, Homo sapiens
ccagcaggaggg

SEQ ID NO: 1919449 - DNA, 13 bp, Homo sapiens
ccagcccacgctg

SEQ ID NO: 1919450 - DNA, 21 bp, Homo sapiens
ccagcccacgctgactacagg

SEQ ID NO: 1919451 - DNA, 14 bp, Homo sapiens
ccagcccagcagac

SEQ ID NO: 1919452 - DNA, 20 bp, Homo sapiens
ccagcctcaaatccaggacc

SEQ ID NO: 1919453 - DNA, 15 bp, Homo sapiens
ccagcgcggacatcc

SEQ ID NO: 1919454 - DNA, 16 bp, Homo sapiens
ccagcggccctcccag

SEQ ID NO: 1919455 - DNA, 17 bp, Homo sapiens
ccagcggccctcccagg

SEQ ID NO: 1919456 - DNA, 12 bp, Homo sapiens
ccagctccaccc

SEQ ID NO: 1919457 - DNA, 15 bp, Homo sapiens
ccagctccctcccct

SEQ ID NO: 1919458 - DNA, 20 bp, Homo sapiens
ccagctccctcccctgctca

SEQ ID NO: 1919459 - DNA, 14 bp, Homo sapiens
ccagctgctgagcc

SEQ ID NO: 1919460 - DNA, 16 bp, Homo sapiens
ccagctgctgagccgc

SEQ ID NO: 1919461 - DNA, 18 bp, Homo sapiens
ccagctgctgagccgcag

SEQ ID NO: 1919462 - DNA, 19 bp, Homo sapiens
ccagctgctgagccgcaga

SEQ ID NO: 1919463 - DNA, 16 bp, Homo sapiens
ccaggaagtagcacag

SEQ ID NO: 1919464 - DNA, 16 bp, Homo sapiens
ccaggaccctgccagg

SEQ ID NO: 1919465 - DNA, 17 bp, Homo sapiens
ccaggaccctgccaggc

SEQ ID NO: 1919466 - DNA, 13 bp, Homo sapiens
ccaggagcccatt

SEQ ID NO: 1919467 - DNA, 16 bp, Homo sapiens
ccaggatatattttat

SEQ ID NO: 1919468 - DNA, 20 bp, Homo sapiens
ccaggatgctcccccaggga

SEQ ID NO: 1919469 - DNA, 21 bp, Homo sapiens
ccaggatgctcccccagggaa

SEQ ID NO: 1919470 - DNA, 13 bp, Homo sapiens
ccaggattgtcac

SEQ ID NO: 1919471 - DNA, 13 bp, Homo sapiens
ccaggcacaggca

SEQ ID NO: 1919472 - DNA, 14 bp, Homo sapiens
ccaggcacaggcag

SEQ ID NO: 1919473 - DNA, 16 bp, Homo sapiens
ccaggcacaggcaggg

SEQ ID NO: 1919474 - DNA, 18 bp, Homo sapiens
ccaggcacaggcagggca

SEQ ID NO: 1919475 - DNA, 19 bp, Homo sapiens
ccaggcacaggcagggcag

SEQ ID NO: 1919476 - DNA, 17 bp, Homo sapiens
ccaggcccggcatgagg

SEQ ID NO: 1919477 - DNA, 19 bp, Homo sapiens
ccaggctttctagaaagaa

SEQ ID NO: 1919478 - DNA, 17 bp, Homo sapiens
ccagggaggagccccag

SEQ ID NO: 1919479 - DNA, 13 bp, Homo sapiens
ccagggatggcag

SEQ ID NO: 1919480 - DNA, 18 bp, Homo sapiens
ccagggatggcagtggct

SEQ ID NO: 1919481 - DNA, 22 bp, Homo sapiens
ccaggggtcttgcaaaattcct

SEQ ID NO: 1919482 - DNA, 17 bp, Homo sapiens
ccaggtatttttctatt

SEQ ID NO: 1919483 - DNA, 18 bp, Homo sapiens
ccaggttccacagaggac

SEQ ID NO: 1919484 - DNA, 12 bp, Homo sapiens
ccagtaagatca

SEQ ID NO: 1919485 - DNA, 15 bp, Homo sapiens
ccagtaagatcactg

SEQ ID NO: 1919486 - DNA, 15 bp, Homo sapiens
ccagtagcaggcccg

SEQ ID NO: 1919487 - DNA, 17 bp, Homo sapiens
ccagtcccagcagccag

SEQ ID NO: 1919488 - DNA, 20 bp, Homo sapiens
ccagtcccagcagccagcca

SEQ ID NO: 1919489 - DNA, 20 bp, Homo sapiens
ccagtgaggcatctctctgg

SEQ ID NO: 1919490 - DNA, 13 bp, Homo sapiens
ccagtggcagggc

SEQ ID NO: 1919491 - DNA, 18 bp, Homo sapiens
ccagtggcagggcacagg

SEQ ID NO: 1919492 - DNA, 20 bp, Homo sapiens
ccagtggcagggcacagggc

SEQ ID NO: 1919493 - DNA, 22 bp, Homo sapiens
ccagtggcagggcacagggcct

SEQ ID NO: 1919494 - DNA, 23 bp, Homo sapiens
ccagtggcagggcacagggcctg

SEQ ID NO: 1919495 - DNA, 18 bp, Homo sapiens
ccagtggcttctcccaac

SEQ ID NO: 1919496 - DNA, 21 bp, Homo sapiens
ccagttgcccagatgaactgg

SEQ ID NO: 1919497 - DNA, 19 bp, Homo sapiens
ccatagagtacactgcctg

SEQ ID NO: 1919498 - DNA, 17 bp, Homo sapiens
ccatagctcaataaaag

SEQ ID NO: 1919499 - DNA, 22 bp, Homo sapiens
ccatattaagtaagtctcaagg

SEQ ID NO: 1919500 - DNA, 16 bp, Homo sapiens
ccatcaggggcaggaa

SEQ ID NO: 1919501 - DNA, 23 bp, Homo sapiens
ccatccacatgggtactgtctcg

SEQ ID NO: 1919502 - DNA, 21 bp, Homo sapiens
ccatccacccctctggcacct

SEQ ID NO: 1919503 - DNA, 11 bp, Homo sapiens
ccatcccctcc

SEQ ID NO: 1919504 - DNA, 18 bp, Homo sapiens
ccatcccgtttccctcca

SEQ ID NO: 1919505 - DNA, 16 bp, Homo sapiens
ccatccctctcctctg

SEQ ID NO: 1919506 - DNA, 21 bp, Homo sapiens
ccatctaggggagccttgatt

SEQ ID NO: 1919507 - DNA, 19 bp, Homo sapiens
ccatctcctttctctggta

SEQ ID NO: 1919508 - DNA, 13 bp, Homo sapiens
ccatctctgaaaa

SEQ ID NO: 1919509 - DNA, 14 bp, Homo sapiens
ccatctctgaaaac

SEQ ID NO: 1919510 - DNA, 15 bp, Homo sapiens
ccatctcttcctttc

SEQ ID NO: 1919511 - DNA, 16 bp, Homo sapiens
ccatctcttcctttcc

SEQ ID NO: 1919512 - DNA, 17 bp, Homo sapiens
ccatctcttcctttcct

SEQ ID NO: 1919513 - DNA, 15 bp, Homo sapiens
ccatctgtgaataag

SEQ ID NO: 1919514 - DNA, 23 bp, Homo sapiens
ccatgagaatgttttagcacagc

SEQ ID NO: 1919515 - DNA, 17 bp, Homo sapiens
ccatgaggaggcagaga

SEQ ID NO: 1919516 - DNA, 18 bp, Homo sapiens
ccatgaggaggcagagag

SEQ ID NO: 1919517 - DNA, 18 bp, Homo sapiens
ccatgctgtctggcacag

SEQ ID NO: 1919518 - DNA, 20 bp, Homo sapiens
ccatgctgtctggcacagcc

SEQ ID NO: 1919519 - DNA, 23 bp, Homo sapiens
ccatgctgtctggcacagcctgc

SEQ ID NO: 1919520 - DNA, 17 bp, Homo sapiens
ccatgttggccaggctg

SEQ ID NO: 1919521 - DNA, 14 bp, Homo sapiens
ccattaactgcttc

SEQ ID NO: 1919522 - DNA, 20 bp, Homo sapiens
ccattcgtacataatactga

SEQ ID NO: 1919523 - DNA, 21 bp, Homo sapiens
ccattcgtacataatactgaa

SEQ ID NO: 1919524 - DNA, 23 bp, Homo sapiens
ccatttactgcattcttctgatc

SEQ ID NO: 1919525 - DNA, 17 bp, Homo sapiens
ccatttccccagggcac

SEQ ID NO: 1919526 - DNA, 14 bp, Homo sapiens
ccattttttatatt

SEQ ID NO: 1919527 - DNA, 17 bp, Homo sapiens
ccattttttatatttca

SEQ ID NO: 1919528 - DNA, 20 bp, Homo sapiens
ccattttttatatttcaagt

SEQ ID NO: 1919529 - DNA, 18 bp, Homo sapiens
cccaaacaaatggaagag

SEQ ID NO: 1919530 - DNA, 16 bp, Homo sapiens
cccaacagcctctgtg

SEQ ID NO: 1919531 - DNA, 12 bp, Homo sapiens
cccaccctaccc

SEQ ID NO: 1919532 - DNA, 14 bp, Homo sapiens
cccaccctaccccc

SEQ ID NO: 1919533 - DNA, 21 bp, Homo sapiens
cccaccctgcttggcccaggg

SEQ ID NO: 1919534 - DNA, 15 bp, Homo sapiens
cccaccctgtcccag

SEQ ID NO: 1919535 - DNA, 17 bp, Homo sapiens
cccaccctgtcccaggc

SEQ ID NO: 1919536 - DNA, 18 bp, Homo sapiens
cccaccctttctgccagg

SEQ ID NO: 1919537 - DNA, 23 bp, Homo sapiens
cccaccttcttgggactgctgtg

SEQ ID NO: 1919538 - DNA, 16 bp, Homo sapiens
cccacgctgactacag

SEQ ID NO: 1919539 - DNA, 19 bp, Homo sapiens
cccacgctgactacagggc

SEQ ID NO: 1919540 - DNA, 21 bp, Homo sapiens
cccacgctgactacagggccg

SEQ ID NO: 1919541 - DNA, 15 bp, Homo sapiens
cccactcctcctcct

SEQ ID NO: 1919542 - DNA, 16 bp, Homo sapiens
cccactcctcctcctt

SEQ ID NO: 1919543 - DNA, 11 bp, Homo sapiens
cccactctcag

SEQ ID NO: 1919544 - DNA, 17 bp, Homo sapiens
cccactctcagaggccc

SEQ ID NO: 1919545 - DNA, 18 bp, Homo sapiens
cccactggagtctctctc

SEQ ID NO: 1919546 - DNA, 14 bp, Homo sapiens
cccacttctgccag

SEQ ID NO: 1919547 - DNA, 14 bp, Homo sapiens
cccagaagtgcaga

SEQ ID NO: 1919548 - DNA, 13 bp, Homo sapiens
cccagaccccgca

SEQ ID NO: 1919549 - DNA, 22 bp, Homo sapiens
cccagagagaagagccccactc

SEQ ID NO: 1919550 - DNA, 12 bp, Homo sapiens
cccagcagccag

SEQ ID NO: 1919551 - DNA, 15 bp, Homo sapiens
cccagcagccagcca

SEQ ID NO: 1919552 - DNA, 17 bp, Homo sapiens
cccagccctccagtacc

SEQ ID NO: 1919553 - DNA, 21 bp, Homo sapiens
cccagcctcaaatccaggacc

SEQ ID NO: 1919554 - DNA, 10 bp, Homo sapiens
cccagctctg

SEQ ID NO: 1919555 - DNA, 11 bp, Homo sapiens
cccagctctgg

SEQ ID NO: 1919556 - DNA, 13 bp, Homo sapiens
cccagcttccagc

SEQ ID NO: 1919557 - DNA, 12 bp, Homo sapiens
cccaggagccca

SEQ ID NO: 1919558 - DNA, 16 bp, Homo sapiens
cccaggagcccatttg

SEQ ID NO: 1919559 - DNA, 19 bp, Homo sapiens
cccagtcccagcagccagc

SEQ ID NO: 1919560 - DNA, 14 bp, Homo sapiens
cccagtggcagggc

SEQ ID NO: 1919561 - DNA, 15 bp, Homo sapiens
cccagtggcagggca

SEQ ID NO: 1919562 - DNA, 23 bp, Homo sapiens
cccagtggcagggcacagggcct

SEQ ID NO: 1919563 - DNA, 16 bp, Homo sapiens
cccagttgctgtcaca

SEQ ID NO: 1919564 - DNA, 13 bp, Homo sapiens
cccatggccacat

SEQ ID NO: 1919565 - DNA, 22 bp, Homo sapiens
cccatggccacatcctcatggc

SEQ ID NO: 1919566 - DNA, 15 bp, Homo sapiens
cccatggctctgggc

SEQ ID NO: 1919567 - DNA, 19 bp, Homo sapiens
cccatgtatggccaggaag

SEQ ID NO: 1919568 - DNA, 19 bp, Homo sapiens
cccatttggagggcctggg

SEQ ID NO: 1919569 - DNA, 14 bp, Homo sapiens
ccccaagcctggca

SEQ ID NO: 1919570 - DNA, 17 bp, Homo sapiens
ccccaagcctggcaggg

SEQ ID NO: 1919571 - DNA, 17 bp, Homo sapiens
ccccaccctgtcccagg

SEQ ID NO: 1919572 - DNA, 14 bp, Homo sapiens
ccccacctggccct

SEQ ID NO: 1919573 - DNA, 19 bp, Homo sapiens
ccccactcctcctcctttc

SEQ ID NO: 1919574 - DNA, 14 bp, Homo sapiens
ccccagcttccagc

SEQ ID NO: 1919575 - DNA, 16 bp, Homo sapiens
ccccagcttccagcag

SEQ ID NO: 1919576 - DNA, 19 bp, Homo sapiens
ccccagcttccagcaggag

SEQ ID NO: 1919577 - DNA, 17 bp, Homo sapiens
ccccagtagctgggacc

SEQ ID NO: 1919578 - DNA, 19 bp, Homo sapiens
ccccatcccgtttccctcc

SEQ ID NO: 1919579 - DNA, 13 bp, Homo sapiens
ccccatctgtgaa

SEQ ID NO: 1919580 - DNA, 20 bp, Homo sapiens
ccccgcagtcgtcagcctcc

SEQ ID NO: 1919581 - DNA, 23 bp, Homo sapiens
cccctcgcccagtcccagcagcc

SEQ ID NO: 1919582 - DNA, 11 bp, Homo sapiens
cccctgagccc

SEQ ID NO: 1919583 - DNA, 15 bp, Homo sapiens
cccctgagcccactg

SEQ ID NO: 1919584 - DNA, 17 bp, Homo sapiens
cccctggaagcagtgcc

SEQ ID NO: 1919585 - DNA, 19 bp, Homo sapiens
cccctggaagcagtgccca

SEQ ID NO: 1919586 - DNA, 20 bp, Homo sapiens
cccctggaagcagtgcccag

SEQ ID NO: 1919587 - DNA, 14 bp, Homo sapiens
cccctggaccccag

SEQ ID NO: 1919588 - DNA, 11 bp, Homo sapiens
cccctggcaaa

SEQ ID NO: 1919589 - DNA, 15 bp, Homo sapiens
cccctgtaggcctca

SEQ ID NO: 1919590 - DNA, 22 bp, Homo sapiens
ccccttcccagaccccgcagca

SEQ ID NO: 1919591 - DNA, 14 bp, Homo sapiens
ccccttgccagctg

SEQ ID NO: 1919592 - DNA, 13 bp, Homo sapiens
ccccttgggcctc

SEQ ID NO: 1919593 - DNA, 14 bp, Homo sapiens
cccgcagcacgcct

SEQ ID NO: 1919594 - DNA, 19 bp, Homo sapiens
cccgcagcacgcctctccc

SEQ ID NO: 1919595 - DNA, 20 bp, Homo sapiens
cccgcagtcgtcagcctccc

SEQ ID NO: 1919596 - DNA, 14 bp, Homo sapiens
cccgcctccaaccc

SEQ ID NO: 1919597 - DNA, 20 bp, Homo sapiens
cccggcagcgaggctgggct

SEQ ID NO: 1919598 - DNA, 16 bp, Homo sapiens
cccggcatgaggcccc

SEQ ID NO: 1919599 - DNA, 23 bp, Homo sapiens
cccggttgtgagagcctgtgatc

SEQ ID NO: 1919600 - DNA, 20 bp, Homo sapiens
cccgtgtaggaacctgcaca

SEQ ID NO: 1919601 - DNA, 20 bp, Homo sapiens
ccctagaagatcacagcagg

SEQ ID NO: 1919602 - DNA, 23 bp, Homo sapiens
ccctatttaacagggtctctagt

SEQ ID NO: 1919603 - DNA, 12 bp, Homo sapiens
ccctccaggtgt

SEQ ID NO: 1919604 - DNA, 13 bp, Homo sapiens
ccctcccaggcga

SEQ ID NO: 1919605 - DNA, 15 bp, Homo sapiens
ccctcccctgctcag

SEQ ID NO: 1919606 - DNA, 16 bp, Homo sapiens
ccctccgccccgtccc

SEQ ID NO: 1919607 - DNA, 12 bp, Homo sapiens
ccctcgcccagt

SEQ ID NO: 1919608 - DNA, 20 bp, Homo sapiens
ccctcgcccagtcccagcag

SEQ ID NO: 1919609 - DNA, 12 bp, Homo sapiens
ccctctcctctg

SEQ ID NO: 1919610 - DNA, 15 bp, Homo sapiens
ccctctcctctgccc

SEQ ID NO: 1919611 - DNA, 17 bp, Homo sapiens
cactaagaggaggcagg

SEQ ID NO: 1919612 - DNA, 22 bp, Homo sapiens
cactaagaggaggcaggaggag

SEQ ID NO: 1919613 - DNA, 22 bp, Homo sapiens
cactatctagggagccctgggc

SEQ ID NO: 1919614 - DNA, 20 bp, Homo sapiens
cactccaaaccttactctga

SEQ ID NO: 1919615 - DNA, 20 bp, Homo sapiens
cactctaggactctgcactg

SEQ ID NO: 1919616 - DNA, 19 bp, Homo sapiens
cactgagcatcacaataaa

SEQ ID NO: 1919617 - DNA, 17 bp, Homo sapiens
cactgcacgttttcatc

SEQ ID NO: 1919618 - DNA, 23 bp, Homo sapiens
cactgcagcctccgcttccctgg

SEQ ID NO: 1919619 - DNA, 15 bp, Homo sapiens
cactgcctgccttaa

SEQ ID NO: 1919620 - DNA, 14 bp, Homo sapiens
cactgctctcacct

SEQ ID NO: 1919621 - DNA, 23 bp, Homo sapiens
cactgctctcaccttggttcctg

SEQ ID NO: 1919622 - DNA, 19 bp, Homo sapiens
cactggattgtagaacttg

SEQ ID NO: 1919623 - DNA, 20 bp, Homo sapiens
cactggattgtagaacttgt

SEQ ID NO: 1919624 - DNA, 20 bp, Homo sapiens
cactgggggacactgtggca

SEQ ID NO: 1919625 - DNA, 20 bp, Homo sapiens
cactggtctacactggttgc

SEQ ID NO: 1919626 - DNA, 20 bp, Homo sapiens
cactgtccgctgtctccctc

SEQ ID NO: 1919627 - DNA, 21 bp, Homo sapiens
cactgtccgctgtctccctcc

SEQ ID NO: 1919628 - DNA, 21 bp, Homo sapiens
cactgtgaaagttggaatatg

SEQ ID NO: 1919629 - DNA, 15 bp, Homo sapiens
cactgtgcagtggag

SEQ ID NO: 1919630 - DNA, 13 bp, Homo sapiens
cactgtggcagca

SEQ ID NO: 1919631 - DNA, 15 bp, Homo sapiens
cactgtggcagcagg

SEQ ID NO: 1919632 - DNA, 17 bp, Homo sapiens
cactgtggcagcaggag

SEQ ID NO: 1919633 - DNA, 15 bp, Homo sapiens
cactgtggtgtctgt

SEQ ID NO: 1919634 - DNA, 13 bp, Homo sapiens
cactgtgtatatt

SEQ ID NO: 1919635 - DNA, 16 bp, Homo sapiens
cactgtgtatatttga

SEQ ID NO: 1919636 - DNA, 17 bp, Homo sapiens
cactgtgtatatttgat

SEQ ID NO: 1919637 - DNA, 15 bp, Homo sapiens
cactgtttagatttg

SEQ ID NO: 1919638 - DNA, 14 bp, Homo sapiens
cacttgtagatttg

SEQ ID NO: 1919639 - DNA, 16 bp, Homo sapiens
cacttgtagatttgat

SEQ ID NO: 1919640 - DNA, 13 bp, Homo sapiens
cagaaaatgaatg

SEQ ID NO: 1919641 - DNA, 15 bp, Homo sapiens
cagaaacaatgtgtc

SEQ ID NO: 1919642 - DNA, 17 bp, Homo sapiens
cagaaacaatgtgtcta

SEQ ID NO: 1919643 - DNA, 13 bp, Homo sapiens
cagaacagctgtt

SEQ ID NO: 1919644 - DNA, 21 bp, Homo sapiens
cagaacttccctccatccacc

SEQ ID NO: 1919645 - DNA, 11 bp, Homo sapiens
cagaagctgat

SEQ ID NO: 1919646 - DNA, 16 bp, Homo sapiens
cagaagctgatgagga

SEQ ID NO: 1919647 - DNA, 16 bp, Homo sapiens
cagaaggagcaggccc

SEQ ID NO: 1919648 - DNA, 17 bp, Homo sapiens
cagaaggagcaggccct

SEQ ID NO: 1919649 - DNA, 23 bp, Homo sapiens
cagaaggagcaggccctgggcct

SEQ ID NO: 1919650 - DNA, 16 bp, Homo sapiens
cagaaggcttttttaa

SEQ ID NO: 1919651 - DNA, 16 bp, Homo sapiens
cagaaggggactgcca

SEQ ID NO: 1919652 - DNA, 17 bp, Homo sapiens
cagaaggggactgccac

SEQ ID NO: 1919653 - DNA, 19 bp, Homo sapiens
cagaaggggactgccacct

SEQ ID NO: 1919654 - DNA, 13 bp, Homo sapiens
cagaagtagggga

SEQ ID NO: 1919655 - DNA, 18 bp, Homo sapiens
cagaagtaggggaagaat

SEQ ID NO: 1919656 - DNA, 14 bp, Homo sapiens
cagaagtgcatcct

SEQ ID NO: 1919657 - DNA, 19 bp, Homo sapiens
cagacaccacagcctcccc

SEQ ID NO: 1919658 - DNA, 20 bp, Homo sapiens
cagacaccacagcctcccct

SEQ ID NO: 1919659 - DNA, 21 bp, Homo sapiens
cagacaccacagcctcccctt

SEQ ID NO: 1919660 - DNA, 23 bp, Homo sapiens
cagacaggacccctgcagttccc

SEQ ID NO: 1919661 - DNA, 10 bp, Homo sapiens
cagaccagcc

SEQ ID NO: 1919662 - DNA, 20 bp, Homo sapiens
cagaccgcgggcactgccgc

SEQ ID NO: 1919663 - DNA, 17 bp, Homo sapiens
cagacctgcctgtctcc

SEQ ID NO: 1919664 - DNA, 20 bp, Homo sapiens
cagacctgcctgtctcccac

SEQ ID NO: 1919665 - DNA, 19 bp, Homo sapiens
cagacgctcattcagcatc

SEQ ID NO: 1919666 - DNA, 21 bp, Homo sapiens
cagacgctcattcagcatctg

SEQ ID NO: 1919667 - DNA, 14 bp, Homo sapiens
cagactgaggcctt

SEQ ID NO: 1919668 - DNA, 17 bp, Homo sapiens
cagacttttaaagactt

SEQ ID NO: 1919669 - DNA, 20 bp, Homo sapiens
cagagaagtgacggttccta

SEQ ID NO: 1919670 - DNA, 17 bp, Homo sapiens
cagagagaagagcccca

SEQ ID NO: 1919671 - DNA, 19 bp, Homo sapiens
cagagagaagagccccact

SEQ ID NO: 1919672 - DNA, 22 bp, Homo sapiens
cagagagaagagccccactctc

SEQ ID NO: 1919673 - DNA, 21 bp, Homo sapiens
cagagagcgaccagcaggctc

SEQ ID NO: 1919674 - DNA, 24 bp, Homo sapiens
cagagagggaagctgaggcccatg

SEQ ID NO: 1919675 - DNA, 21 bp, Homo sapiens
cagagcaacccctggacccca

SEQ ID NO: 1919676 - DNA, 17 bp, Homo sapiens
cagagctaaggccaatg

SEQ ID NO: 1919677 - DNA, 19 bp, Homo sapiens
cagagctaaggccaatggg

SEQ ID NO: 1919678 - DNA, 22 bp, Homo sapiens
cagaggccctcctgtgctggtg

SEQ ID NO: 1919679 - DNA, 21 bp, Homo sapiens
cagaggctcagattgtaatat

SEQ ID NO: 1919680 - DNA, 15 bp, Homo sapiens
cagaggctgtggtca

SEQ ID NO: 1919681 - DNA, 20 bp, Homo sapiens
cagaggctgtggtcagagag

SEQ ID NO: 1919682 - DNA, 20 bp, Homo sapiens
cagaggtggtctggtgccac

SEQ ID NO: 1919683 - DNA, 21 bp, Homo sapiens
cagagtagccatgaggaggca

SEQ ID NO: 1919684 - DNA, 22 bp, Homo sapiens
cagagtagccatgaggaggcag

SEQ ID NO: 1919685 - DNA, 15 bp, Homo sapiens
cagataccaagcatg

SEQ ID NO: 1919686 - DNA, 13 bp, Homo sapiens
aaaaaaaaagaaa

SEQ ID NO: 1919687 - DNA, 10 bp, Homo sapiens
aaaaaaaaga

SEQ ID NO: 1919688 - DNA, 9 bp, Homo sapiens
aaaaaaaga

SEQ ID NO: 1919689 - DNA, 9 bp, Homo sapiens
aaaaaagaa

SEQ ID NO: 1919690 - DNA, 20 bp, Homo sapiens
aaaaaatgctgaacattgca

SEQ ID NO: 1919691 - DNA, 21 bp, Homo sapiens
aaaaaattcagtgatgtgcct

SEQ ID NO: 1919692 - DNA, 15 bp, Homo sapiens
aaaaacaaataatat

SEQ ID NO: 1919693 - DNA, 11 bp, Homo sapiens
aaaaacagctt

SEQ ID NO: 1919694 - DNA, 13 bp, Homo sapiens
aaaaataaaagtg

SEQ ID NO: 1919695 - DNA, 15 bp, Homo sapiens
aaaaataaaggaaat

SEQ ID NO: 1919696 - DNA, 16 bp, Homo sapiens
aaaaatgctgaacatt

SEQ ID NO: 1919697 - DNA, 18 bp, Homo sapiens
aaaacaataggatgggct

SEQ ID NO: 1919698 - DNA, 14 bp, Homo sapiens
aaaacaccagcttt

SEQ ID NO: 1919699 - DNA, 15 bp, Homo sapiens
aaaacaccttctata

SEQ ID NO: 1919700 - DNA, 14 bp, Homo sapiens
aaaacatcattcct

SEQ ID NO: 1919701 - DNA, 20 bp, Homo sapiens
aaaacatgagcttacattct

SEQ ID NO: 1919702 - DNA, 22 bp, Homo sapiens
aaaacatgcgatgttagtttta

SEQ ID NO: 1919703 - DNA, 22 bp, Homo sapiens
aaaactttgtagacattttgaa

SEQ ID NO: 1919704 - DNA, 14 bp, Homo sapiens
aaaagaaaataaaa

SEQ ID NO: 1919705 - DNA, 21 bp, Homo sapiens
aaaagataaaaaaacagcttt

SEQ ID NO: 1919706 - DNA, 14 bp, Homo sapiens
aaaagcattttgta

SEQ ID NO: 1919707 - DNA, 16 bp, Homo sapiens
aaaagcattttgtaat

SEQ ID NO: 1919708 - DNA, 14 bp, Homo sapiens
aaaagcctttgaaa

SEQ ID NO: 1919709 - DNA, 17 bp, Homo sapiens
aaaagcctttgaaaata

SEQ ID NO: 1919710 - DNA, 17 bp, Homo sapiens
aaaaggcttataaaaca

SEQ ID NO: 1919711 - DNA, 13 bp, Homo sapiens
aaaagtaatattt

SEQ ID NO: 1919712 - DNA, 15 bp, Homo sapiens
aaaagtaatatttat

SEQ ID NO: 1919713 - DNA, 13 bp, Homo sapiens
aaaagtagaactt

SEQ ID NO: 1919714 - DNA, 17 bp, Homo sapiens
aaaagtagaactttgta

SEQ ID NO: 1919715 - DNA, 16 bp, Homo sapiens
aaaataaaaaaaagaa

SEQ ID NO: 1919716 - DNA, 17 bp, Homo sapiens
aaaataaaaaaaagaaa

SEQ ID NO: 1919717 - DNA, 18 bp, Homo sapiens
aaaataaaaaaaagaaaa

SEQ ID NO: 1919718 - DNA, 13 bp, Homo sapiens
aaaataaagcaag

SEQ ID NO: 1919719 - DNA, 14 bp, Homo sapiens
aaaataaatgtaaa

SEQ ID NO: 1919720 - DNA, 12 bp, Homo sapiens
aaaataagaaaa

SEQ ID NO: 1919721 - DNA, 14 bp, Homo sapiens
aaaataagaaaaga

SEQ ID NO: 1919722 - DNA, 15 bp, Homo sapiens
aaaataagaaaagat

SEQ ID NO: 1919723 - DNA, 17 bp, Homo sapiens
aaaatatatttttatat

SEQ ID NO: 1919724 - DNA, 13 bp, Homo sapiens
aaaatatcaaatt

SEQ ID NO: 1919725 - DNA, 19 bp, Homo sapiens
aaaatatcacactgaataa

SEQ ID NO: 1919726 - DNA, 19 bp, Homo sapiens
aaaatctctcatttgtgtg

SEQ ID NO: 1919727 - DNA, 16 bp, Homo sapiens
aaaatgaagaatttaa

SEQ ID NO: 1919728 - DNA, 23 bp, Homo sapiens
aaaatgattaatgcatttatcaa

SEQ ID NO: 1919729 - DNA, 15 bp, Homo sapiens
aaaatgctgaacatt

SEQ ID NO: 1919730 - DNA, 16 bp, Homo sapiens
aaaatggctagaatta

SEQ ID NO: 1919731 - DNA, 15 bp, Homo sapiens
aaaatgtcaaaagta

SEQ ID NO: 1919732 - DNA, 18 bp, Homo sapiens
aaaatgtgagtggttgaa

SEQ ID NO: 1919733 - DNA, 23 bp, Homo sapiens
aaaattatgtttgccactttgca

SEQ ID NO: 1919734 - DNA, 15 bp, Homo sapiens
aaaatttatataact

SEQ ID NO: 1919735 - DNA, 13 bp, Homo sapiens
aaaatttgtttaa

SEQ ID NO: 1919736 - DNA, 20 bp, Homo sapiens
aaacaaaggcctaattctat

SEQ ID NO: 1919737 - DNA, 16 bp, Homo sapiens
aaacaaatggaagaga

SEQ ID NO: 1919738 - DNA, 17 bp, Homo sapiens
aaacaaatggaagagaa

SEQ ID NO: 1919739 - DNA, 13 bp, Homo sapiens
aaacaactgaaat

SEQ ID NO: 1919740 - DNA, 17 bp, Homo sapiens
aaacacgttttaaggac

SEQ ID NO: 1919741 - DNA, 18 bp, Homo sapiens
aaacagtgctattctgag

SEQ ID NO: 1919742 - DNA, 22 bp, Homo sapiens
aaacatcattcctttttattta

SEQ ID NO: 1919743 - DNA, 21 bp, Homo sapiens
aaacatgcgatgttagtttta

SEQ ID NO: 1919744 - DNA, 18 bp, Homo sapiens
aaacattccagagaaaat

SEQ ID NO: 1919745 - DNA, 17 bp, Homo sapiens
aaacccaccctttctac

SEQ ID NO: 1919746 - DNA, 18 bp, Homo sapiens
aaaccttactctgagctc

SEQ ID NO: 1919747 - DNA, 21 bp, Homo sapiens
aaacctttctataattttaca

SEQ ID NO: 1919748 - DNA, 16 bp, Homo sapiens
aaacgcttcagttgtt

SEQ ID NO: 1919749 - DNA, 10 bp, Homo sapiens
aaactcccac

SEQ ID NO: 1919750 - DNA, 21 bp, Homo sapiens
aaactcccaccctaccccctt

SEQ ID NO: 1919751 - DNA, 20 bp, Homo sapiens
aaactgccagttttgtttcc

SEQ ID NO: 1919752 - DNA, 20 bp, Homo sapiens
aaactgcgggaatactgtct

SEQ ID NO: 1919753 - DNA, 16 bp, Homo sapiens
aaactgctcatttcat

SEQ ID NO: 1919754 - DNA, 19 bp, Homo sapiens
aaactgcttcctttcttga

SEQ ID NO: 1919755 - DNA, 13 bp, Homo sapiens
aaactggaatgag

SEQ ID NO: 1919756 - DNA, 14 bp, Homo sapiens
aaactggaatgagc

SEQ ID NO: 1919757 - DNA, 21 bp, Homo sapiens
aaactgtcgtgtcatactcga

SEQ ID NO: 1919758 - DNA, 15 bp, Homo sapiens
aaacttgttgaattt

SEQ ID NO: 1919759 - DNA, 11 bp, Homo sapiens
aaagaaaaaaa

SEQ ID NO: 1919760 - DNA, 22 bp, Homo sapiens
aaagaaaaaaaaaaagaaagaa

SEQ ID NO: 1919761 - DNA, 16 bp, Homo sapiens
aaagaaaaaaaaagaa

SEQ ID NO: 1919762 - DNA, 18 bp, Homo sapiens
aaagaaaaaagagaaaag

SEQ ID NO: 1919763 - DNA, 12 bp, Homo sapiens
aaagaaaataaa

SEQ ID NO: 1919764 - DNA, 21 bp, Homo sapiens
aaagaaaataaaaaaaagaaa

SEQ ID NO: 1919765 - DNA, 16 bp, Homo sapiens
aaagaaagaggaaaag

SEQ ID NO: 1919766 - DNA, 16 bp, Homo sapiens
aaagaaatacacaggg

SEQ ID NO: 1919767 - DNA, 21 bp, Homo sapiens
aaagaaatacacagggagggg

SEQ ID NO: 1919768 - DNA, 15 bp, Homo sapiens
aaagaacgctgattt

SEQ ID NO: 1919769 - DNA, 12 bp, Homo sapiens
aaagagaaaaga

SEQ ID NO: 1919770 - DNA, 14 bp, Homo sapiens
aaagagaaaagaaa

SEQ ID NO: 1919771 - DNA, 23 bp, Homo sapiens
aaagatagaatggcttctctgtt

SEQ ID NO: 1919772 - DNA, 19 bp, Homo sapiens
aaagatatgtatatttttg

SEQ ID NO: 1919773 - DNA, 23 bp, Homo sapiens
aaagcaaaataacaaaaaagaga

SEQ ID NO: 1919774 - DNA, 13 bp, Homo sapiens
aaagcacaaagga

SEQ ID NO: 1919775 - DNA, 16 bp, Homo sapiens
aaagcaccaaaataag

SEQ ID NO: 1919776 - DNA, 17 bp, Homo sapiens
aaagcaccaaaataaga

SEQ ID NO: 1919777 - DNA, 22 bp, Homo sapiens
aaagcaccaaaataagaaaaga

SEQ ID NO: 1919778 - DNA, 21 bp, Homo sapiens
aaagcattttgtaataataaa

SEQ ID NO: 1919779 - DNA, 13 bp, Homo sapiens
aaagcccaggagc

SEQ ID NO: 1919780 - DNA, 14 bp, Homo sapiens
aaagcccaggagcc

SEQ ID NO: 1919781 - DNA, 19 bp, Homo sapiens
aaaggccagcagccttcca

SEQ ID NO: 1919782 - DNA, 17 bp, Homo sapiens
aaaggcttataaaacag

SEQ ID NO: 1919783 - DNA, 19 bp, Homo sapiens
aaagtaaaagcagcataaa

SEQ ID NO: 1919784 - DNA, 15 bp, Homo sapiens
aaagtacaaggggat

SEQ ID NO: 1919785 - DNA, 15 bp, Homo sapiens
aaagtagaactttgt

SEQ ID NO: 1919786 - DNA, 17 bp, Homo sapiens
aaagtagaactttgtat

SEQ ID NO: 1919787 - DNA, 20 bp, Homo sapiens
aaagtatttactgactgctt

SEQ ID NO: 1919788 - DNA, 20 bp, Homo sapiens
aaagtatttttataatgact

SEQ ID NO: 1919789 - DNA, 18 bp, Homo sapiens
aaagtctgttgattaaag

SEQ ID NO: 1919790 - DNA, 19 bp, Homo sapiens
aaagtctgttgattaaaga

SEQ ID NO: 1919791 - DNA, 22 bp, Homo sapiens
aaagtgaacagattttattaat

SEQ ID NO: 1919792 - DNA, 12 bp, Homo sapiens
aaagtgcctttg

SEQ ID NO: 1919793 - DNA, 20 bp, Homo sapiens
aaagtgggtactttctgaaa

SEQ ID NO: 1919794 - DNA, 22 bp, Homo sapiens
aaagtgggtactttctgaaaat

SEQ ID NO: 1919795 - DNA, 15 bp, Homo sapiens
aaagtgtggaaagca

SEQ ID NO: 1919796 - DNA, 14 bp, Homo sapiens
acaaaaaagagaaa

SEQ ID NO: 1919797 - DNA, 15 bp, Homo sapiens
acaaaaaagagaaac

SEQ ID NO: 1919798 - DNA, 17 bp, Homo sapiens
acaaagtgggtactttc

SEQ ID NO: 1919799 - DNA, 19 bp, Homo sapiens
acaaatacaatacatagga

SEQ ID NO: 1919800 - DNA, 17 bp, Homo sapiens
acaaatgactgtctctt

SEQ ID NO: 1919801 - DNA, 16 bp, Homo sapiens
acaaatgactttatta

SEQ ID NO: 1919802 - DNA, 21 bp, Homo sapiens
acaaatgactttattatttat

SEQ ID NO: 1919803 - DNA, 18 bp, Homo sapiens
acaaatgcatctttgatg

SEQ ID NO: 1919804 - DNA, 15 bp, Homo sapiens
acaaatggaagagaa

SEQ ID NO: 1919805 - DNA, 16 bp, Homo sapiens
acaaatggaagagaag

SEQ ID NO: 1919806 - DNA, 21 bp, Homo sapiens
acaagaaggtggaaggcagtg

SEQ ID NO: 1919807 - DNA, 19 bp, Homo sapiens
acaagctggcttacactgg

SEQ ID NO: 1919808 - DNA, 19 bp, Homo sapiens
acaagtagttctgtatttg

SEQ ID NO: 1919809 - DNA, 21 bp, Homo sapiens
acaagtagttctgtatttgaa

SEQ ID NO: 1919810 - DNA, 22 bp, Homo sapiens
acaagtagttctgtatttgaaa

SEQ ID NO: 1919811 - DNA, 23 bp, Homo sapiens
acaagtagttctgtatttgaaag

SEQ ID NO: 1919812 - DNA, 16 bp, Homo sapiens
acaagtccctgtaatt

SEQ ID NO: 1919813 - DNA, 21 bp, Homo sapiens
acaatataagagcttccaatt

SEQ ID NO: 1919814 - DNA, 13 bp, Homo sapiens
acaatcatgtaca

SEQ ID NO: 1919815 - DNA, 16 bp, Homo sapiens
acaatgttttaacaag

SEQ ID NO: 1919816 - DNA, 20 bp, Homo sapiens
acacaacgtaatcaaatatg

SEQ ID NO: 1919817 - DNA, 12 bp, Homo sapiens
acacacctcatg

SEQ ID NO: 1919818 - DNA, 13 bp, Homo sapiens
acacacctctgcc

SEQ ID NO: 1919819 - DNA, 16 bp, Homo sapiens
acacacctctgcccct

SEQ ID NO: 1919820 - DNA, 15 bp, Homo sapiens
acacagagctaaggc

SEQ ID NO: 1919821 - DNA, 20 bp, Homo sapiens
acaccaatcttactttgtaa

SEQ ID NO: 1919822 - DNA, 13 bp, Homo sapiens
acaccacagcctc

SEQ ID NO: 1919823 - DNA, 15 bp, Homo sapiens
acaccacagcctccc

SEQ ID NO: 1919824 - DNA, 17 bp, Homo sapiens
acaccacagcctcccct

SEQ ID NO: 1919825 - DNA, 18 bp, Homo sapiens
acaccacagcctcccctt

SEQ ID NO: 1919826 - DNA, 12 bp, Homo sapiens
acaccagctgta

SEQ ID NO: 1919827 - DNA, 14 bp, Homo sapiens
acacccatgaaaga

SEQ ID NO: 1919828 - DNA, 18 bp, Homo sapiens
acacccttggagctctga

SEQ ID NO: 1919829 - DNA, 19 bp, Homo sapiens
acacctctgccccttgggc

SEQ ID NO: 1919830 - DNA, 14 bp, Homo sapiens
acacgtcattgtgt

SEQ ID NO: 1919831 - DNA, 15 bp, Homo sapiens
acacgttttaaggac

SEQ ID NO: 1919832 - DNA, 16 bp, Homo sapiens
acactgcctgccttaa

SEQ ID NO: 1919833 - DNA, 20 bp, Homo sapiens
acactggcaatggtagtttc

SEQ ID NO: 1919834 - DNA, 21 bp, Homo sapiens
acactggcaatggtagtttct

SEQ ID NO: 1919835 - DNA, 17 bp, Homo sapiens
acacttgagttaacttt

SEQ ID NO: 1919836 - DNA, 13 bp, Homo sapiens
acactttaatggg

SEQ ID NO: 1919837 - DNA, 17 bp, Homo sapiens
acagaaggggactgcca

SEQ ID NO: 1919838 - DNA, 22 bp, Homo sapiens
acagaaggggactgccacctcc

SEQ ID NO: 1919839 - DNA, 16 bp, Homo sapiens
acagaagtgactgatg

SEQ ID NO: 1919840 - DNA, 13 bp, Homo sapiens
acagaagtgcatc

SEQ ID NO: 1919841 - DNA, 15 bp, Homo sapiens
acagaagtgcatcct

SEQ ID NO: 1919842 - DNA, 15 bp, Homo sapiens
acagacaccacagcc

SEQ ID NO: 1919843 - DNA, 18 bp, Homo sapiens
acagaccgaactgttgta

SEQ ID NO: 1919844 - DNA, 14 bp, Homo sapiens
acagacttgtatat

SEQ ID NO: 1919845 - DNA, 19 bp, Homo sapiens
acagactttagctttctga

SEQ ID NO: 1919846 - DNA, 18 bp, Homo sapiens
acagaggctgtggtcaga

SEQ ID NO: 1919847 - DNA, 13 bp, Homo sapiens
acagattctttat

SEQ ID NO: 1919848 - DNA, 14 bp, Homo sapiens
acagatttggaaag

SEQ ID NO: 1919849 - DNA, 21 bp, Homo sapiens
acagatttggaaagactggac

SEQ ID NO: 1919850 - DNA, 22 bp, Homo sapiens
acagcaacgatcacaaatgact

SEQ ID NO: 1919851 - DNA, 12 bp, Homo sapiens
acagccactcag

SEQ ID NO: 1919852 - DNA, 14 bp, Homo sapiens
acagccactcagaa

SEQ ID NO: 1919853 - DNA, 16 bp, Homo sapiens
acagcccgatcctccc

SEQ ID NO: 1919854 - DNA, 21 bp, Homo sapiens
acagcccgatcctcccctgga

SEQ ID NO: 1919855 - DNA, 15 bp, Homo sapiens
acagccctatttctt

SEQ ID NO: 1919856 - DNA, 18 bp, Homo sapiens
acagccctatttcttgat

SEQ ID NO: 1919857 - DNA, 12 bp, Homo sapiens
acagcctcccct

SEQ ID NO: 1919858 - DNA, 16 bp, Homo sapiens
acagcctgcctctgcc

SEQ ID NO: 1919859 - DNA, 17 bp, Homo sapiens
acagcctgcctctgcca

SEQ ID NO: 1919860 - DNA, 19 bp, Homo sapiens
acagcctgcctctgccaca

SEQ ID NO: 1919861 - DNA, 21 bp, Homo sapiens
acagctatgcaaaaagctagt

SEQ ID NO: 1919862 - DNA, 16 bp, Homo sapiens
acaggacccctgcagt

SEQ ID NO: 1919863 - DNA, 23 bp, Homo sapiens
acaggcaaatccgaaatcagcag

SEQ ID NO: 1919864 - DNA, 12 bp, Homo sapiens
acaggcagggca

SEQ ID NO: 1919865 - DNA, 22 bp, Homo sapiens
acaggcagggcaggaccagccc

SEQ ID NO: 1919866 - DNA, 23 bp, Homo sapiens
acaggccctcctccctcccagct

SEQ ID NO: 1919867 - DNA, 16 bp, Homo sapiens
acaggcgaaagaaaac

SEQ ID NO: 1919868 - DNA, 16 bp, Homo sapiens
acaggctgagtgcagg

SEQ ID NO: 1919869 - DNA, 18 bp, Homo sapiens
acaggctgagtgcaggcc

SEQ ID NO: 1919870 - DNA, 21 bp, Homo sapiens
acaggctgagtgcaggcccac

SEQ ID NO: 1919871 - DNA, 23 bp, Homo sapiens
acaggctgagtgcaggcccaccc

SEQ ID NO: 1919872 - DNA, 15 bp, Homo sapiens
acaggctgggctggg

SEQ ID NO: 1919873 - DNA, 19 bp, Homo sapiens
acagggcccgggcccaggc

SEQ ID NO: 1919874 - DNA, 12 bp, Homo sapiens
acagggcctggc

SEQ ID NO: 1919875 - DNA, 16 bp, Homo sapiens
acaggggttccttctg

SEQ ID NO: 1919876 - DNA, 13 bp, Homo sapiens
acaggtgcccgcc

SEQ ID NO: 1919877 - DNA, 22 bp, Homo sapiens
acagtaagctggtttacagatg

SEQ ID NO: 1919878 - DNA, 20 bp, Homo sapiens
acagtaccctggttgtgtgt

SEQ ID NO: 1919879 - DNA, 14 bp, Homo sapiens
acagtactttgaat

SEQ ID NO: 1919880 - DNA, 22 bp, Homo sapiens
acagtctcaccatttccccagg

SEQ ID NO: 1919881 - DNA, 17 bp, Homo sapiens
acataatactgaaccac

SEQ ID NO: 1919882 - DNA, 11 bp, Homo sapiens
acatacaaatg

SEQ ID NO: 1919883 - DNA, 21 bp, Homo sapiens
acatacaaatgcatctttgat

SEQ ID NO: 1919884 - DNA, 15 bp, Homo sapiens
acatatctttgagtt

SEQ ID NO: 1919885 - DNA, 16 bp, Homo sapiens
acatcacagggcctca

SEQ ID NO: 1919886 - DNA, 17 bp, Homo sapiens
acatcacagggcctcag

SEQ ID NO: 1919887 - DNA, 19 bp, Homo sapiens
acatcacagggcctcagtt

SEQ ID NO: 1919888 - DNA, 12 bp, Homo sapiens
acatcactggca

SEQ ID NO: 1919889 - DNA, 16 bp, Homo sapiens
acatcattccttttta

SEQ ID NO: 1919890 - DNA, 17 bp, Homo sapiens
acatcattcctttttat

SEQ ID NO: 1919891 - DNA, 15 bp, Homo sapiens
acatccctctctgct

SEQ ID NO: 1919892 - DNA, 20 bp, Homo sapiens
acatcctcatggcccatcag

SEQ ID NO: 1919893 - DNA, 23 bp, Homo sapiens
acatcctgtcatctgagaatgaa

SEQ ID NO: 1919894 - DNA, 11 bp, Homo sapiens
acatgcctcct

SEQ ID NO: 1919895 - DNA, 20 bp, Homo sapiens
acatgcctcctcctgccctc

SEQ ID NO: 1919896 - DNA, 21 bp, Homo sapiens
acatgcctcctcctgccctcc

SEQ ID NO: 1919897 - DNA, 22 bp, Homo sapiens
acatgcctcctcctgccctccg

SEQ ID NO: 1919898 - DNA, 23 bp, Homo sapiens
acatgcctcctcctgccctccgc

SEQ ID NO: 1919899 - DNA, 19 bp, Homo sapiens
acatgcgatgttagtttta

SEQ ID NO: 1919900 - DNA, 20 bp, Homo sapiens
acatggaatatattttaata

SEQ ID NO: 1919901 - DNA, 18 bp, Homo sapiens
acatggttacatatcaaa

SEQ ID NO: 1919902 - DNA, 17 bp, Homo sapiens
acatgtgaaaagaatag

SEQ ID NO: 1919903 - DNA, 13 bp, Homo sapiens
acattgtgaatgc

SEQ ID NO: 1919904 - DNA, 14 bp, Homo sapiens
acatttaaaaataa

SEQ ID NO: 1919905 - DNA, 14 bp, Homo sapiens
acatttaaaacatt

SEQ ID NO: 1919906 - DNA, 18 bp, Homo sapiens
acatttaaaacattaaaa

SEQ ID NO: 1919907 - DNA, 22 bp, Homo sapiens
acatttaaaacattaaaatata

SEQ ID NO: 1919908 - DNA, 21 bp, Homo sapiens
acatttatccaggaattgata

SEQ ID NO: 1919909 - DNA, 16 bp, Homo sapiens
acatttgaataatgtc

SEQ ID NO: 1919910 - DNA, 18 bp, Homo sapiens
acattttagaatgtcaat

SEQ ID NO: 1919911 - DNA, 19 bp, Homo sapiens
acattttagaatgtcaata

SEQ ID NO: 1919912 - DNA, 15 bp, Homo sapiens
acatttttggaaatt

SEQ ID NO: 1919913 - DNA, 16 bp, Homo sapiens
accaaaataagaaaag

SEQ ID NO: 1919914 - DNA, 17 bp, Homo sapiens
accaaaataagaaaaga

SEQ ID NO: 1919915 - DNA, 14 bp, Homo sapiens
accaaagagacagg

SEQ ID NO: 1919916 - DNA, 18 bp, Homo sapiens
accaaagagacagggccc

SEQ ID NO: 1919917 - DNA, 15 bp, Homo sapiens
accaacctgaaagtt

SEQ ID NO: 1919918 - DNA, 18 bp, Homo sapiens
accaagtgtattgtaatg

SEQ ID NO: 1919919 - DNA, 16 bp, Homo sapiens
accaatcttactttgt

SEQ ID NO: 1919920 - DNA, 17 bp, Homo sapiens
accaatcttactttgta

SEQ ID NO: 1919921 - DNA, 21 bp, Homo sapiens
accaattttttgtgtgtgaag

SEQ ID NO: 1919922 - DNA, 22 bp, Homo sapiens
accaattttttgtgtgtgaagc

SEQ ID NO: 1919923 - DNA, 11 bp, Homo sapiens
accacaagtat

SEQ ID NO: 1919924 - DNA, 13 bp, Homo sapiens
accacacccaact

SEQ ID NO: 1919925 - DNA, 16 bp, Homo sapiens
accacagaggctgtgg

SEQ ID NO: 1919926 - DNA, 18 bp, Homo sapiens
accacagaggctgtggtc

SEQ ID NO: 1919927 - DNA, 23 bp, Homo sapiens
accacagcaacgatcacaaatga

SEQ ID NO: 1919928 - DNA, 21 bp, Homo sapiens
accacagcctccccttcccag

SEQ ID NO: 1919929 - DNA, 18 bp, Homo sapiens
agaacattccatttgctt

SEQ ID NO: 1919930 - DNA, 16 bp, Homo sapiens
agaacctaggaggatg

SEQ ID NO: 1919931 - DNA, 16 bp, Homo sapiens
agaacgctgatttaaa

SEQ ID NO: 1919932 - DNA, 18 bp, Homo sapiens
agaacgtgcttgtggaag

SEQ ID NO: 1919933 - DNA, 16 bp, Homo sapiens
agaactgaaaggcttt

SEQ ID NO: 1919934 - DNA, 18 bp, Homo sapiens
agaactgcagtcactgca

SEQ ID NO: 1919935 - DNA, 23 bp, Homo sapiens
agaactgcagtcactgcacgttt

SEQ ID NO: 1919936 - DNA, 23 bp, Homo sapiens
agaacttgttgctgattttgacc

SEQ ID NO: 1919937 - DNA, 12 bp, Homo sapiens
agaactttgtat

SEQ ID NO: 1919938 - DNA, 13 bp, Homo sapiens
agaactttgtata

SEQ ID NO: 1919939 - DNA, 17 bp, Homo sapiens
agaactttgtatagtta

SEQ ID NO: 1919940 - DNA, 13 bp, Homo sapiens
agaagaaactagg

SEQ ID NO: 1919941 - DNA, 12 bp, Homo sapiens
agaagagcccca

SEQ ID NO: 1919942 - DNA, 13 bp, Homo sapiens
agaagccaagggg

SEQ ID NO: 1919943 - DNA, 15 bp, Homo sapiens
agaaggagcaggccc

SEQ ID NO: 1919944 - DNA, 15 bp, Homo sapiens
agaaggggactgcca

SEQ ID NO: 1919945 - DNA, 16 bp, Homo sapiens
agaagtacgtgttact

SEQ ID NO: 1919946 - DNA, 16 bp, Homo sapiens
agaagtttaaggaata

SEQ ID NO: 1919947 - DNA, 13 bp, Homo sapiens
agaagtttctgtc

SEQ ID NO: 1919948 - DNA, 14 bp, Homo sapiens
agaatagaaatttg

SEQ ID NO: 1919949 - DNA, 16 bp, Homo sapiens
agaataggattaatga

SEQ ID NO: 1919950 - DNA, 16 bp, Homo sapiens
agaatcacaggctggg

SEQ ID NO: 1919951 - DNA, 19 bp, Homo sapiens
agaatccctgtgttaattt

SEQ ID NO: 1919952 - DNA, 13 bp, Homo sapiens
agaatgaacaaag

SEQ ID NO: 1919953 - DNA, 16 bp, Homo sapiens
agaatggcttctctgt

SEQ ID NO: 1919954 - DNA, 15 bp, Homo sapiens
agaatgtcaataaat

SEQ ID NO: 1919955 - DNA, 21 bp, Homo sapiens
agaattcttagcatacattca

SEQ ID NO: 1919956 - DNA, 23 bp, Homo sapiens
agaattcttagcatacattcaga

SEQ ID NO: 1919957 - DNA, 13 bp, Homo sapiens
agaattgaaggtt

SEQ ID NO: 1919958 - DNA, 13 bp, Homo sapiens
agaatttaaagaa

SEQ ID NO: 1919959 - DNA, 16 bp, Homo sapiens
agaatttgtcacagga

SEQ ID NO: 1919960 - DNA, 14 bp, Homo sapiens
agacaaagacattt

SEQ ID NO: 1919961 - DNA, 22 bp, Homo sapiens
agacaaagacatttcaaataac

SEQ ID NO: 1919962 - DNA, 15 bp, Homo sapiens
agacaccacagcctc

SEQ ID NO: 1919963 - DNA, 22 bp, Homo sapiens
agacaccacagcctccccttcc

SEQ ID NO: 1919964 - DNA, 17 bp, Homo sapiens
agacacccttggagctc

SEQ ID NO: 1919965 - DNA, 14 bp, Homo sapiens
agacaggacccctg

SEQ ID NO: 1919966 - DNA, 22 bp, Homo sapiens
agacaggacccctgcagttccc

SEQ ID NO: 1919967 - DNA, 16 bp, Homo sapiens
agacatcaagctcaag

SEQ ID NO: 1919968 - DNA, 13 bp, Homo sapiens
agacattttgaaa

SEQ ID NO: 1919969 - DNA, 23 bp, Homo sapiens
agacattttgaaataaaaatgga

SEQ ID NO: 1919970 - DNA, 24 bp, Homo sapiens
agacattttgaaataaaaatggat

SEQ ID NO: 1919971 - DNA, 16 bp, Homo sapiens
agaccccactggagtc

SEQ ID NO: 1919972 - DNA, 12 bp, Homo sapiens
agaccctgcccc

SEQ ID NO: 1919973 - DNA, 16 bp, Homo sapiens
agacccttatttaaaa

SEQ ID NO: 1919974 - DNA, 18 bp, Homo sapiens
agaccgtgaagatacttt

SEQ ID NO: 1919975 - DNA, 14 bp, Homo sapiens
agacgaacatgtag

SEQ ID NO: 1919976 - DNA, 17 bp, Homo sapiens
agacgttttttctgcac

SEQ ID NO: 1919977 - DNA, 22 bp, Homo sapiens
agactgccacaaggaagaaatt

SEQ ID NO: 1919978 - DNA, 21 bp, Homo sapiens
agactgctcctgagcccccag

SEQ ID NO: 1919979 - DNA, 19 bp, Homo sapiens
agactgtggagactgctcc

SEQ ID NO: 1919980 - DNA, 13 bp, Homo sapiens
agacttaatatgt

SEQ ID NO: 1919981 - DNA, 22 bp, Homo sapiens
agacttccccaagcctggcagg

SEQ ID NO: 1919982 - DNA, 18 bp, Homo sapiens
agacttgaaaagagacag

SEQ ID NO: 1919983 - DNA, 21 bp, Homo sapiens
agacttgaaaagagacaggca

SEQ ID NO: 1919984 - DNA, 14 bp, Homo sapiens
agactttgatgtca

SEQ ID NO: 1919985 - DNA, 11 bp, Homo sapiens
agagaaaagaa

SEQ ID NO: 1919986 - DNA, 21 bp, Homo sapiens
agagaaaagaaaaaaaaagaa

SEQ ID NO: 1919987 - DNA, 19 bp, Homo sapiens
agagaacttttttcaaaat

SEQ ID NO: 1919988 - DNA, 19 bp, Homo sapiens
agagacaatagcattagaa

SEQ ID NO: 1919989 - DNA, 13 bp, Homo sapiens
agagacagggccc

SEQ ID NO: 1919990 - DNA, 23 bp, Homo sapiens
agagacagggcccgggcccaggc

SEQ ID NO: 1919991 - DNA, 20 bp, Homo sapiens
agagagcgaccagcaggctc

SEQ ID NO: 1919992 - DNA, 22 bp, Homo sapiens
agagagcgaccagcaggctcct

SEQ ID NO: 1919993 - DNA, 22 bp, Homo sapiens
agagcaacccctggaccccagc

SEQ ID NO: 1919994 - DNA, 17 bp, Homo sapiens
agagccccactctcaga

SEQ ID NO: 1919995 - DNA, 13 bp, Homo sapiens
agagccttaaaac

SEQ ID NO: 1919996 - DNA, 15 bp, Homo sapiens
agagccttaaaacat

SEQ ID NO: 1919997 - DNA, 18 bp, Homo sapiens
agagcctttttctaggcc

SEQ ID NO: 1919998 - DNA, 16 bp, Homo sapiens
agagctaaggccaatg

SEQ ID NO: 1919999 - DNA, 23 bp, Homo sapiens
agagctaaggccaatgggctaga

SEQ ID NO: 1920000 - DNA, 18 bp, Homo sapiens
agagctgttgatgggatg

SEQ ID NO: 1920001 - DNA, 19 bp, Homo sapiens
agaggagataatgtggatt

SEQ ID NO: 1920002 - DNA, 22 bp, Homo sapiens
agaggattttgcgtcagagaaa

SEQ ID NO: 1920003 - DNA, 19 bp, Homo sapiens
agaggccaaacaggccctc

SEQ ID NO: 1920004 - DNA, 20 bp, Homo sapiens
agaggccccaataccccatg

SEQ ID NO: 1920005 - DNA, 18 bp, Homo sapiens
agaggctcagattgtaat

SEQ ID NO: 1920006 - DNA, 14 bp, Homo sapiens
agaggctgtctgtt

SEQ ID NO: 1920007 - DNA, 20 bp, Homo sapiens
agaggctgtggtcagagagg

SEQ ID NO: 1920008 - DNA, 20 bp, Homo sapiens
agaggggccagcggccctcc

SEQ ID NO: 1920009 - DNA, 22 bp, Homo sapiens
agagggtgccggaaagagagct

SEQ ID NO: 1920010 - DNA, 14 bp, Homo sapiens
agaggttctaactt

SEQ ID NO: 1920011 - DNA, 18 bp, Homo sapiens
agagtaatcttgttggtt

SEQ ID NO: 1920012 - DNA, 15 bp, Homo sapiens
agagtacactgcctg

SEQ ID NO: 1920013 - DNA, 19 bp, Homo sapiens
agagtacactgcctgcctt

SEQ ID NO: 1920014 - DNA, 20 bp, Homo sapiens
agagtagccatgaggaggca

SEQ ID NO: 1920015 - DNA, 19 bp, Homo sapiens
agagtattctaaaaaaata

SEQ ID NO: 1920016 - DNA, 14 bp, Homo sapiens
agagtggccccacc

SEQ ID NO: 1920017 - DNA, 15 bp, Homo sapiens
agagtggccccacct

SEQ ID NO: 1920018 - DNA, 19 bp, Homo sapiens
agagtggccccacctggcc

SEQ ID NO: 1920019 - DNA, 12 bp, Homo sapiens
agagtttgtaaa

SEQ ID NO: 1920020 - DNA, 17 bp, Homo sapiens
agataattgtactttga

SEQ ID NO: 1920021 - DNA, 20 bp, Homo sapiens
agataattgtactttgaaaa

SEQ ID NO: 1920022 - DNA, 21 bp, Homo sapiens
agataattgtactttgaaaac

SEQ ID NO: 1920023 - DNA, 11 bp, Homo sapiens
agatactttgt

SEQ ID NO: 1920024 - DNA, 20 bp, Homo sapiens
agatactttgtattgtccta

SEQ ID NO: 1920025 - DNA, 14 bp, Homo sapiens
agatagcaggagga

SEQ ID NO: 1920026 - DNA, 19 bp, Homo sapiens
agatattatatacaacaca

SEQ ID NO: 1920027 - DNA, 11 bp, Homo sapiens
agatattttat

SEQ ID NO: 1920028 - DNA, 16 bp, Homo sapiens
agatcaaaaaggctta

SEQ ID NO: 1920029 - DNA, 20 bp, Homo sapiens
agatcaaaaaggcttataaa

SEQ ID NO: 1920030 - DNA, 16 bp, Homo sapiens
agatcatagttttatt

SEQ ID NO: 1920031 - DNA, 17 bp, Homo sapiens
agatcatagttttattt

SEQ ID NO: 1920032 - DNA, 19 bp, Homo sapiens
agatcatagttttatttat

SEQ ID NO: 1920033 - DNA, 20 bp, Homo sapiens
agatcatagttttatttata

SEQ ID NO: 1920034 - DNA, 21 bp, Homo sapiens
agatgacaacaaattttggtt

SEQ ID NO: 1920035 - DNA, 21 bp, Homo sapiens
agatgttgagaggaacaagaa

SEQ ID NO: 1920036 - DNA, 16 bp, Homo sapiens
agatgtttaaaacacc

SEQ ID NO: 1920037 - DNA, 11 bp, Homo sapiens
agattctttta

SEQ ID NO: 1920038 - DNA, 16 bp, Homo sapiens
agattgtggggagaga

SEQ ID NO: 1920039 - DNA, 19 bp, Homo sapiens
agatttgccatagagtaca

SEQ ID NO: 1920040 - DNA, 12 bp, Homo sapiens
agattttcacct

SEQ ID NO: 1920041 - DNA, 22 bp, Homo sapiens
agcaaaataacaaaaaagagaa

SEQ ID NO: 1920042 - DNA, 23 bp, Homo sapiens
agcaaaataacaaaaaagagaaa

SEQ ID NO: 1920043 - DNA, 16 bp, Homo sapiens
agcaaaatgaaaagag

SEQ ID NO: 1920044 - DNA, 20 bp, Homo sapiens
agcaaacctaattgcacaac

SEQ ID NO: 1920045 - DNA, 19 bp, Homo sapiens
agcaacccctggaccccag

SEQ ID NO: 1920046 - DNA, 20 bp, Homo sapiens
agcaacccctggaccccagc

SEQ ID NO: 1920047 - DNA, 23 bp, Homo sapiens
agcaacccctggaccccagcctc

SEQ ID NO: 1920048 - DNA, 21 bp, Homo sapiens
agcaacgatcacaaatgactt

SEQ ID NO: 1920049 - DNA, 22 bp, Homo sapiens
agcaacgatcacaaatgacttt

SEQ ID NO: 1920050 - DNA, 13 bp, Homo sapiens
agcaataaaactg

SEQ ID NO: 1920051 - DNA, 16 bp, Homo sapiens
agcaataaaactgcta

SEQ ID NO: 1920052 - DNA, 12 bp, Homo sapiens
agcaataatttc

SEQ ID NO: 1920053 - DNA, 18 bp, Homo sapiens
agcacaaccttcaagctg

SEQ ID NO: 1920054 - DNA, 21 bp, Homo sapiens
agcacaccaatcttactttgt

SEQ ID NO: 1920055 - DNA, 22 bp, Homo sapiens
agcacaggctgagtgcaggccc

SEQ ID NO: 1920056 - DNA, 16 bp, Homo sapiens
agcaccaaaataagaa

SEQ ID NO: 1920057 - DNA, 18 bp, Homo sapiens
agcaccaaaataagaaaa

SEQ ID NO: 1920058 - DNA, 16 bp, Homo sapiens
agcaccatcccctccg

SEQ ID NO: 1920059 - DNA, 23 bp, Homo sapiens
agcacccatccaccgtcccctcc

SEQ ID NO: 1920060 - DNA, 18 bp, Homo sapiens
agcacgcctctccccacc

SEQ ID NO: 1920061 - DNA, 11 bp, Homo sapiens
atcacaaatga

SEQ ID NO: 1920062 - DNA, 12 bp, Homo sapiens
atcacaaatgac

SEQ ID NO: 1920063 - DNA, 15 bp, Homo sapiens
atcacaaatgacttt

SEQ ID NO: 1920064 - DNA, 20 bp, Homo sapiens
atcacaaatgactttattat

SEQ ID NO: 1920065 - DNA, 16 bp, Homo sapiens
atcacaacaagaaatt

SEQ ID NO: 1920066 - DNA, 22 bp, Homo sapiens
atcacagcagggccttctgcct

SEQ ID NO: 1920067 - DNA, 15 bp, Homo sapiens
atcacaggctgggct

SEQ ID NO: 1920068 - DNA, 22 bp, Homo sapiens
atcacaggctgggctgggcact

SEQ ID NO: 1920069 - DNA, 14 bp, Homo sapiens
atcacagggcctca

SEQ ID NO: 1920070 - DNA, 15 bp, Homo sapiens
atcacctcagggcat

SEQ ID NO: 1920071 - DNA, 18 bp, Homo sapiens
atcactgtgtatatttga

SEQ ID NO: 1920072 - DNA, 15 bp, Homo sapiens
atcactgtttagatt

SEQ ID NO: 1920073 - DNA, 13 bp, Homo sapiens
atcagaacagctg

SEQ ID NO: 1920074 - DNA, 13 bp, Homo sapiens
atcagaatcttgt

SEQ ID NO: 1920075 - DNA, 23 bp, Homo sapiens
atcagcgccggcctccagaactt

SEQ ID NO: 1920076 - DNA, 14 bp, Homo sapiens
atcaggctcccagg

SEQ ID NO: 1920077 - DNA, 19 bp, Homo sapiens
atcatagttttatttatat

SEQ ID NO: 1920078 - DNA, 23 bp, Homo sapiens
atcatagttttatttatatttat

SEQ ID NO: 1920079 - DNA, 15 bp, Homo sapiens
atcatattatacaga

SEQ ID NO: 1920080 - DNA, 20 bp, Homo sapiens
atcatgaagtgatataaaag

SEQ ID NO: 1920081 - DNA, 17 bp, Homo sapiens
atcatgatcacaactga

SEQ ID NO: 1920082 - DNA, 15 bp, Homo sapiens
atcatgtacatttga

SEQ ID NO: 1920083 - DNA, 24 bp, Homo sapiens
atcatgttagagttacttctataa

SEQ ID NO: 1920084 - DNA, 19 bp, Homo sapiens
atcatttgttcaaagctgt

SEQ ID NO: 1920085 - DNA, 16 bp, Homo sapiens
atccacccctctggca

SEQ ID NO: 1920086 - DNA, 19 bp, Homo sapiens
atccaccgtcccctcccag

SEQ ID NO: 1920087 - DNA, 13 bp, Homo sapiens
atccaggaccctg

SEQ ID NO: 1920088 - DNA, 12 bp, Homo sapiens
atccagtgtgta

SEQ ID NO: 1920089 - DNA, 18 bp, Homo sapiens
atccatggggtctctcac

SEQ ID NO: 1920090 - DNA, 19 bp, Homo sapiens
atccatggggtctctcaca

SEQ ID NO: 1920091 - DNA, 22 bp, Homo sapiens
atccatggggtctctcacagac

SEQ ID NO: 1920092 - DNA, 16 bp, Homo sapiens
atccccttccagctcc

SEQ ID NO: 1920093 - DNA, 15 bp, Homo sapiens
atccctctcctctgc

SEQ ID NO: 1920094 - DNA, 20 bp, Homo sapiens
atccctgctcactgcagcct

SEQ ID NO: 1920095 - DNA, 20 bp, Homo sapiens
atccctgtgttaatttaagt

SEQ ID NO: 1920096 - DNA, 15 bp, Homo sapiens
atccgaaatcagcag

SEQ ID NO: 1920097 - DNA, 15 bp, Homo sapiens
atcctcccctggact

SEQ ID NO: 1920098 - DNA, 18 bp, Homo sapiens
atcctgcactgactctgg

SEQ ID NO: 1920099 - DNA, 19 bp, Homo sapiens
atcctgcactgactctgga

SEQ ID NO: 1920100 - DNA, 18 bp, Homo sapiens
atcctgtcatctgagaat

SEQ ID NO: 1920101 - DNA, 20 bp, Homo sapiens
atcctgtcatctgagaatga

SEQ ID NO: 1920102 - DNA, 21 bp, Homo sapiens
atccttatctagtgtttgatt

SEQ ID NO: 1920103 - DNA, 19 bp, Homo sapiens
atccttttagtctgcatat

SEQ ID NO: 1920104 - DNA, 11 bp, Homo sapiens
atcgtaattgt

SEQ ID NO: 1920105 - DNA, 13 bp, Homo sapiens
atctaataatgaa

SEQ ID NO: 1920106 - DNA, 10 bp, Homo sapiens
atctactgca

SEQ ID NO: 1920107 - DNA, 13 bp, Homo sapiens
atctagctctcca

SEQ ID NO: 1920108 - DNA, 21 bp, Homo sapiens
atctcccttttccatgactgt

SEQ ID NO: 1920109 - DNA, 13 bp, Homo sapiens
atctctgaaaaca

SEQ ID NO: 1920110 - DNA, 13 bp, Homo sapiens
atctcttcctttc

SEQ ID NO: 1920111 - DNA, 14 bp, Homo sapiens
atctcttcctttcc

SEQ ID NO: 1920112 - DNA, 16 bp, Homo sapiens
atctgaattggaatgc

SEQ ID NO: 1920113 - DNA, 22 bp, Homo sapiens
atctgataccaaagagacaggg

SEQ ID NO: 1920114 - DNA, 15 bp, Homo sapiens
atctgatatcagcac

SEQ ID NO: 1920115 - DNA, 17 bp, Homo sapiens
atctgctgcagagcagt

SEQ ID NO: 1920116 - DNA, 19 bp, Homo sapiens
atctggaccccatctgtga

SEQ ID NO: 1920117 - DNA, 11 bp, Homo sapiens
atctggatata

SEQ ID NO: 1920118 - DNA, 14 bp, Homo sapiens
atctgggtagctgt

SEQ ID NO: 1920119 - DNA, 17 bp, Homo sapiens
atctgggtagctgtaag

SEQ ID NO: 1920120 - DNA, 15 bp, Homo sapiens
atctggttttctctc

SEQ ID NO: 1920121 - DNA, 12 bp, Homo sapiens
atctgtgaataa

SEQ ID NO: 1920122 - DNA, 17 bp, Homo sapiens
atctgtgtaaaatctga

SEQ ID NO: 1920123 - DNA, 16 bp, Homo sapiens
atcttgtccaagttgt

SEQ ID NO: 1920124 - DNA, 18 bp, Homo sapiens
atctttctttttaagaaa

SEQ ID NO: 1920125 - DNA, 20 bp, Homo sapiens
atctttctttttaagaaatt

SEQ ID NO: 1920126 - DNA, 22 bp, Homo sapiens
atctttctttttaagaaattcc

SEQ ID NO: 1920127 - DNA, 19 bp, Homo sapiens
atctttgagtgtattctat

SEQ ID NO: 1920128 - DNA, 12 bp, Homo sapiens
atctttgatgtg

SEQ ID NO: 1920129 - DNA, 17 bp, Homo sapiens
atctttgatgtgttgtt

SEQ ID NO: 1920130 - DNA, 21 bp, Homo sapiens
atctttgatgtgttgttcttg

SEQ ID NO: 1920131 - DNA, 20 bp, Homo sapiens
atgaaaaacaaaaataacat

SEQ ID NO: 1920132 - DNA, 17 bp, Homo sapiens
atgaaaacatggaacag

SEQ ID NO: 1920133 - DNA, 16 bp, Homo sapiens
atgaaaagagaaactt

SEQ ID NO: 1920134 - DNA, 20 bp, Homo sapiens
atgaaatacacaagtaaaca

SEQ ID NO: 1920135 - DNA, 19 bp, Homo sapiens
atgaacaaagaccaatttt

SEQ ID NO: 1920136 - DNA, 15 bp, Homo sapiens
atgaacttattaata

SEQ ID NO: 1920137 - DNA, 16 bp, Homo sapiens
atgaagagctgttgat

SEQ ID NO: 1920138 - DNA, 13 bp, Homo sapiens
atgaagcaagaat

SEQ ID NO: 1920139 - DNA, 16 bp, Homo sapiens
atgaagctgaggctgc

SEQ ID NO: 1920140 - DNA, 14 bp, Homo sapiens
atgaataaagtgca

SEQ ID NO: 1920141 - DNA, 15 bp, Homo sapiens
atgaatacctttgtt

SEQ ID NO: 1920142 - DNA, 12 bp, Homo sapiens
atgaatactttg

SEQ ID NO: 1920143 - DNA, 16 bp, Homo sapiens
atgacaaaattctttc

SEQ ID NO: 1920144 - DNA, 20 bp, Homo sapiens
atgactggtcttccttacct

SEQ ID NO: 1920145 - DNA, 14 bp, Homo sapiens
atgactttttgaaa

SEQ ID NO: 1920146 - DNA, 18 bp, Homo sapiens
atgactttttgaaagtaa

SEQ ID NO: 1920147 - DNA, 23 bp, Homo sapiens
atgagcaaggaatacaagacaaa

SEQ ID NO: 1920148 - DNA, 21 bp, Homo sapiens
atgagctttgtctacttcaaa

SEQ ID NO: 1920149 - DNA, 17 bp, Homo sapiens
atgagggagacagacca

SEQ ID NO: 1920150 - DNA, 23 bp, Homo sapiens
atgagtgtgatccagtttttcat

SEQ ID NO: 1920151 - DNA, 22 bp, Homo sapiens
atgagtttcacagtgtgatttt

SEQ ID NO: 1920152 - DNA, 14 bp, Homo sapiens
atgagttttaacaa

SEQ ID NO: 1920153 - DNA, 19 bp, Homo sapiens
atgatacgcttaaggtgga

SEQ ID NO: 1920154 - DNA, 17 bp, Homo sapiens
atgatgttgtaaaatga

SEQ ID NO: 1920155 - DNA, 17 bp, Homo sapiens
atgattaaaaatatcaa

SEQ ID NO: 1920156 - DNA, 12 bp, Homo sapiens
atgcaaaaagaa

SEQ ID NO: 1920157 - DNA, 15 bp, Homo sapiens
atgcaaccatttgaa

SEQ ID NO: 1920158 - DNA, 15 bp, Homo sapiens
atgcatctttgatgt

SEQ ID NO: 1920159 - DNA, 15 bp, Homo sapiens
atgcattaaaagaaa

SEQ ID NO: 1920160 - DNA, 23 bp, Homo sapiens
atgccaagaagtttaaggaatat

SEQ ID NO: 1920161 - DNA, 20 bp, Homo sapiens
atgccccctcccctccttta

SEQ ID NO: 1920162 - DNA, 16 bp, Homo sapiens
atgcctcctcctgccc

SEQ ID NO: 1920163 - DNA, 18 bp, Homo sapiens
atgcctcctcctgccctc

SEQ ID NO: 1920164 - DNA, 15 bp, Homo sapiens
atgcgcagttgctgt

SEQ ID NO: 1920165 - DNA, 20 bp, Homo sapiens
atgctagcctcacgaaactg

SEQ ID NO: 1920166 - DNA, 22 bp, Homo sapiens
atgctagcctcacgaaactgga

SEQ ID NO: 1920167 - DNA, 17 bp, Homo sapiens
atgctgaacattgcata

SEQ ID NO: 1920168 - DNA, 13 bp, Homo sapiens
atgctgacccatg

SEQ ID NO: 1920169 - DNA, 20 bp, Homo sapiens
atgctgcctcattttcacag

SEQ ID NO: 1920170 - DNA, 13 bp, Homo sapiens
atgctgggcccct

SEQ ID NO: 1920171 - DNA, 16 bp, Homo sapiens
atgctgtctggcacag

SEQ ID NO: 1920172 - DNA, 15 bp, Homo sapiens
atgcttacaaaaaag

SEQ ID NO: 1920173 - DNA, 15 bp, Homo sapiens
atgctttgtgaacaa

SEQ ID NO: 1920174 - DNA, 11 bp, Homo sapiens
atggaagagaa

SEQ ID NO: 1920175 - DNA, 17 bp, Homo sapiens
atggaatttttttgtac

SEQ ID NO: 1920176 - DNA, 22 bp, Homo sapiens
atggaggaccacgtctatttca

SEQ ID NO: 1920177 - DNA, 20 bp, Homo sapiens
atggagttaaactttagtgc

SEQ ID NO: 1920178 - DNA, 16 bp, Homo sapiens
atggccacatcctcat

SEQ ID NO: 1920179 - DNA, 22 bp, Homo sapiens
atggccaggaagtagcacaggc

SEQ ID NO: 1920180 - DNA, 14 bp, Homo sapiens
atggctagaattat

SEQ ID NO: 1920181 - DNA, 20 bp, Homo sapiens
atgggacattagcattgagt

SEQ ID NO: 1920182 - DNA, 17 bp, Homo sapiens
atgggatgattgaagaa

SEQ ID NO: 1920183 - DNA, 19 bp, Homo sapiens
atgggatgattgaagaaac

SEQ ID NO: 1920184 - DNA, 22 bp, Homo sapiens
atgggcaaaatggctagaatta

SEQ ID NO: 1920185 - DNA, 12 bp, Homo sapiens
atgggcaggaga

SEQ ID NO: 1920186 - DNA, 19 bp, Homo sapiens
atggggtctctcacagaca

SEQ ID NO: 1920187 - DNA, 19 bp, Homo sapiens
atgggtactgtctcggcag

SEQ ID NO: 1920188 - DNA, 15 bp, Homo sapiens
atgggtcagggtgtg

SEQ ID NO: 1920189 - DNA, 18 bp, Homo sapiens
atgggtcagggtgtgagg

SEQ ID NO: 1920190 - DNA, 18 bp, Homo sapiens
atggtcttatatttacaa

SEQ ID NO: 1920191 - DNA, 13 bp, Homo sapiens
atggtgatgttga

SEQ ID NO: 1920192 - DNA, 13 bp, Homo sapiens
atgtaaataattc

SEQ ID NO: 1920193 - DNA, 22 bp, Homo sapiens
atgtaaggttttttttgtacgc

SEQ ID NO: 1920194 - DNA, 13 bp, Homo sapiens
cactaagaacaaa

SEQ ID NO: 1920195 - DNA, 17 bp, Homo sapiens
cactaagactgcttcta

SEQ ID NO: 1920196 - DNA, 24 bp, Homo sapiens
cactcagaaaagacgcaccagccc

SEQ ID NO: 1920197 - DNA, 18 bp, Homo sapiens
cactcattcttttttcta

SEQ ID NO: 1920198 - DNA, 23 bp, Homo sapiens
cactccaaaccttactctgagct

SEQ ID NO: 1920199 - DNA, 19 bp, Homo sapiens
cactcccatggctctgggc

SEQ ID NO: 1920200 - DNA, 10 bp, Homo sapiens
cactcctcct

SEQ ID NO: 1920201 - DNA, 14 bp, Homo sapiens
cactcctcctcctt

SEQ ID NO: 1920202 - DNA, 16 bp, Homo sapiens
cactcctcctcctttc

SEQ ID NO: 1920203 - DNA, 21 bp, Homo sapiens
cactcctcctcctttctttgc

SEQ ID NO: 1920204 - DNA, 16 bp, Homo sapiens
cactctcagaggcccc

SEQ ID NO: 1920205 - DNA, 14 bp, Homo sapiens
cactctcttccttt

SEQ ID NO: 1920206 - DNA, 20 bp, Homo sapiens
cactgaatggctgacctgac

SEQ ID NO: 1920207 - DNA, 21 bp, Homo sapiens
cactgaatggctgacctgacc

SEQ ID NO: 1920208 - DNA, 20 bp, Homo sapiens
cactgactataccaactggg

SEQ ID NO: 1920209 - DNA, 12 bp, Homo sapiens
cactgactctgg

SEQ ID NO: 1920210 - DNA, 20 bp, Homo sapiens
cactgactgaactgtaatgt

SEQ ID NO: 1920211 - DNA, 23 bp, Homo sapiens
cactgagaccccaggctgttagg

SEQ ID NO: 1920212 - DNA, 16 bp, Homo sapiens
cactgagcatcacaat

SEQ ID NO: 1920213 - DNA, 18 bp, Homo sapiens
cactgagcatcacaataa

SEQ ID NO: 1920214 - DNA, 21 bp, Homo sapiens
cactgcctatgaacagaccat

SEQ ID NO: 1920215 - DNA, 14 bp, Homo sapiens
cactgcctgcctta

SEQ ID NO: 1920216 - DNA, 22 bp, Homo sapiens
cactggagtctctctctctcca

SEQ ID NO: 1920217 - DNA, 18 bp, Homo sapiens
cactggattgtagaactt

SEQ ID NO: 1920218 - DNA, 18 bp, Homo sapiens
cactggcaatggtagttt

SEQ ID NO: 1920219 - DNA, 17 bp, Homo sapiens
cactggccacagttgtt

SEQ ID NO: 1920220 - DNA, 10 bp, Homo sapiens
cactgggagc

SEQ ID NO: 1920221 - DNA, 18 bp, Homo sapiens
cactgggggacactgtgg

SEQ ID NO: 1920222 - DNA, 22 bp, Homo sapiens
cactgggggacactgtggcagc

SEQ ID NO: 1920223 - DNA, 17 bp, Homo sapiens
cactgtccgctgtctcc

SEQ ID NO: 1920224 - DNA, 23 bp, Homo sapiens
cactgtccgctgtctccctcctg

SEQ ID NO: 1920225 - DNA, 14 bp, Homo sapiens
cactgtggcagcag

SEQ ID NO: 1920226 - DNA, 14 bp, Homo sapiens
cactgtggtgtctg

SEQ ID NO: 1920227 - DNA, 20 bp, Homo sapiens
cactgtgtatatttgattta

SEQ ID NO: 1920228 - DNA, 12 bp, Homo sapiens
cactgtttagat

SEQ ID NO: 1920229 - DNA, 20 bp, Homo sapiens
cactgtttagatttgccata

SEQ ID NO: 1920230 - DNA, 20 bp, Homo sapiens
cacttaagttagttccactg

SEQ ID NO: 1920231 - DNA, 17 bp, Homo sapiens
cacttctgccagatgtc

SEQ ID NO: 1920232 - DNA, 17 bp, Homo sapiens
cacttgtagatttgatt

SEQ ID NO: 1920233 - DNA, 16 bp, Homo sapiens
cacttgtccatgtgaa

SEQ ID NO: 1920234 - DNA, 12 bp, Homo sapiens
cactttaatggg

SEQ ID NO: 1920235 - DNA, 18 bp, Homo sapiens
cactttccctgatcctgc

SEQ ID NO: 1920236 - DNA, 17 bp, Homo sapiens
cagaaatccttgtattt

SEQ ID NO: 1920237 - DNA, 17 bp, Homo sapiens
cagaacaccgtgggctg

SEQ ID NO: 1920238 - DNA, 12 bp, Homo sapiens
cagaacagctgt

SEQ ID NO: 1920239 - DNA, 20 bp, Homo sapiens
cagaacagctgttgactcta

SEQ ID NO: 1920240 - DNA, 18 bp, Homo sapiens
cagaacttagcaatttcc

SEQ ID NO: 1920241 - DNA, 11 bp, Homo sapiens
cagaagaaaga

SEQ ID NO: 1920242 - DNA, 17 bp, Homo sapiens
cagaagacaaaggccca

SEQ ID NO: 1920243 - DNA, 14 bp, Homo sapiens
cagaaggagcaggc

SEQ ID NO: 1920244 - DNA, 19 bp, Homo sapiens
cagaaggagcaggccctgg

SEQ ID NO: 1920245 - DNA, 12 bp, Homo sapiens
cagaaggcagga

SEQ ID NO: 1920246 - DNA, 15 bp, Homo sapiens
cagaaggcaggacca

SEQ ID NO: 1920247 - DNA, 20 bp, Homo sapiens
cagaaggcaggaccatgagg

SEQ ID NO: 1920248 - DNA, 15 bp, Homo sapiens
cagaaggggactgcc

SEQ ID NO: 1920249 - DNA, 23 bp, Homo sapiens
cagaaggggactgccacctcccc

SEQ ID NO: 1920250 - DNA, 13 bp, Homo sapiens
cagaagtgactga

SEQ ID NO: 1920251 - DNA, 22 bp, Homo sapiens
cagaagtgcatcctgattattt

SEQ ID NO: 1920252 - DNA, 15 bp, Homo sapiens
cagacaaatgaaata

SEQ ID NO: 1920253 - DNA, 17 bp, Homo sapiens
cagacaaatgaaataat

SEQ ID NO: 1920254 - DNA, 16 bp, Homo sapiens
cagacaccacagcctc

SEQ ID NO: 1920255 - DNA, 22 bp, Homo sapiens
cagacagacaccacagcctccc

SEQ ID NO: 1920256 - DNA, 23 bp, Homo sapiens
cagacagacaccacagcctcccc

SEQ ID NO: 1920257 - DNA, 18 bp, Homo sapiens
cagacaggacccctgcag

SEQ ID NO: 1920258 - DNA, 15 bp, Homo sapiens
cagacatttttggaa

SEQ ID NO: 1920259 - DNA, 19 bp, Homo sapiens
cagacatttttggaaattt

SEQ ID NO: 1920260 - DNA, 17 bp, Homo sapiens
cagaccacttttctata

SEQ ID NO: 1920261 - DNA, 18 bp, Homo sapiens
cagaccccgcagcacgcc

SEQ ID NO: 1920262 - DNA, 19 bp, Homo sapiens
cagaccccgcagcacgcct

SEQ ID NO: 1920263 - DNA, 20 bp, Homo sapiens
cagaccccgcagcacgcctc

SEQ ID NO: 1920264 - DNA, 23 bp, Homo sapiens
cagaccccgcagcacgcctctcc

SEQ ID NO: 1920265 - DNA, 22 bp, Homo sapiens
cagacgctcattcagcatctga

SEQ ID NO: 1920266 - DNA, 15 bp, Homo sapiens
cagacttgtatattc

SEQ ID NO: 1920267 - DNA, 17 bp, Homo sapiens
cagacttgtatattcta

SEQ ID NO: 1920268 - DNA, 15 bp, Homo sapiens
cagagagaagagccc

SEQ ID NO: 1920269 - DNA, 18 bp, Homo sapiens
cagagagaagagccccac

SEQ ID NO: 1920270 - DNA, 21 bp, Homo sapiens
cagagagaagagccccactct

SEQ ID NO: 1920271 - DNA, 19 bp, Homo sapiens
cagagagagatactctggg

SEQ ID NO: 1920272 - DNA, 19 bp, Homo sapiens
cagagagcgaccagcaggc

SEQ ID NO: 1920273 - DNA, 23 bp, Homo sapiens
cagagagcgaccagcaggctcct

SEQ ID NO: 1920274 - DNA, 20 bp, Homo sapiens
cagagagggaagctgaggcc

SEQ ID NO: 1920275 - DNA, 19 bp, Homo sapiens
cagagagggtcactggggg

SEQ ID NO: 1920276 - DNA, 18 bp, Homo sapiens
cagagctaaggccaatgg

SEQ ID NO: 1920277 - DNA, 11 bp, Homo sapiens
cagaggcccca

SEQ ID NO: 1920278 - DNA, 21 bp, Homo sapiens
cagaggctgtggtcagagagg

SEQ ID NO: 1920279 - DNA, 19 bp, Homo sapiens
cagaggtggtctggtgcca

SEQ ID NO: 1920280 - DNA, 23 bp, Homo sapiens
cagagtagccatgaggaggcaga

SEQ ID NO: 1920281 - DNA, 15 bp, Homo sapiens
cagatgtttaaaaca

SEQ ID NO: 1920282 - DNA, 19 bp, Homo sapiens
cagattgctgaatggagtt

SEQ ID NO: 1920283 - DNA, 19 bp, Homo sapiens
cagatttgcttttctttgc

SEQ ID NO: 1920284 - DNA, 13 bp, Homo sapiens
cagatttggaaag

SEQ ID NO: 1920285 - DNA, 17 bp, Homo sapiens
cagcaacacgtcattgt

SEQ ID NO: 1920286 - DNA, 16 bp, Homo sapiens
cagcaacgatcacaaa

SEQ ID NO: 1920287 - DNA, 23 bp, Homo sapiens
cagcaacgatcacaaatgacttt

SEQ ID NO: 1920288 - DNA, 14 bp, Homo sapiens
cagcaaggccacct

SEQ ID NO: 1920289 - DNA, 15 bp, Homo sapiens
cagcaaggccacctc

SEQ ID NO: 1920290 - DNA, 19 bp, Homo sapiens
cagcaaggccacctcttcc

SEQ ID NO: 1920291 - DNA, 20 bp, Homo sapiens
cagcaaggccacctcttcct

SEQ ID NO: 1920292 - DNA, 12 bp, Homo sapiens
cagcaaggctgt

SEQ ID NO: 1920293 - DNA, 21 bp, Homo sapiens
cagcacaaccttcaagctgct

SEQ ID NO: 1920294 - DNA, 17 bp, Homo sapiens
cagcacgcctctcccca

SEQ ID NO: 1920295 - DNA, 21 bp, Homo sapiens
cagcacgcctctccccacctt

SEQ ID NO: 1920296 - DNA, 21 bp, Homo sapiens
cagcagacatcaagctcaagg

SEQ ID NO: 1920297 - DNA, 13 bp, Homo sapiens
cagcagccagcca

SEQ ID NO: 1920298 - DNA, 17 bp, Homo sapiens
cagcagcctctgatctg

SEQ ID NO: 1920299 - DNA, 18 bp, Homo sapiens
cagcagcctctgatctgt

SEQ ID NO: 1920300 - DNA, 14 bp, Homo sapiens
cagcagccttccag

SEQ ID NO: 1920301 - DNA, 16 bp, Homo sapiens
cagcagccttccagtg

SEQ ID NO: 1920302 - DNA, 22 bp, Homo sapiens
cagcagccttccagtggcttct

SEQ ID NO: 1920303 - DNA, 19 bp, Homo sapiens
cagcaggagggacagtctc

SEQ ID NO: 1920304 - DNA, 13 bp, Homo sapiens
cagcaggctcctc

SEQ ID NO: 1920305 - DNA, 14 bp, Homo sapiens
cagcaggctcctca

SEQ ID NO: 1920306 - DNA, 22 bp, Homo sapiens
cagcaggctcctcagccctctc

SEQ ID NO: 1920307 - DNA, 21 bp, Homo sapiens
cagcagggccttctgcctgct

SEQ ID NO: 1920308 - DNA, 23 bp, Homo sapiens
cagcagggccttctgcctgctga

SEQ ID NO: 1920309 - DNA, 17 bp, Homo sapiens
cagcagttgctggtaaa

SEQ ID NO: 1920310 - DNA, 20 bp, Homo sapiens
cagcagttgctggtaaaatg

SEQ ID NO: 1920311 - DNA, 16 bp, Homo sapiens
cagcattagtgggaaa

SEQ ID NO: 1920312 - DNA, 23 bp, Homo sapiens
cagccaaacacacagaaggggac

SEQ ID NO: 1920313 - DNA, 20 bp, Homo sapiens
cagccaccctttctggcacg

SEQ ID NO: 1920314 - DNA, 21 bp, Homo sapiens
cagccaccctttctggcacga

SEQ ID NO: 1920315 - DNA, 15 bp, Homo sapiens
cagcccacgctgact

SEQ ID NO: 1920316 - DNA, 17 bp, Homo sapiens
cagcccgatcctcccct

SEQ ID NO: 1920317 - DNA, 19 bp, Homo sapiens
cagcccgatcctcccctgg

SEQ ID NO: 1920318 - DNA, 22 bp, Homo sapiens
cagcccgatcctcccctggact

SEQ ID NO: 1920319 - DNA, 14 bp, Homo sapiens
cagcccgcatcagc

SEQ ID NO: 1920320 - DNA, 14 bp, Homo sapiens
cagccctctcttgc

SEQ ID NO: 1920321 - DNA, 16 bp, Homo sapiens
cagccctctcttgcca

SEQ ID NO: 1920322 - DNA, 18 bp, Homo sapiens
cagcctcaaatccaggac

SEQ ID NO: 1920323 - DNA, 20 bp, Homo sapiens
cagcctcaaatccaggaccc

SEQ ID NO: 1920324 - DNA, 16 bp, Homo sapiens
cagcctcccacagtgc

SEQ ID NO: 1920325 - DNA, 16 bp, Homo sapiens
ccaaacaggccctcct

SEQ ID NO: 1920326 - DNA, 18 bp, Homo sapiens
ccaaacaggccctcctcc

SEQ ID NO: 1920327 - DNA, 22 bp, Homo sapiens
ccaaaccttactctgagctcat

SEQ ID NO: 1920328 - DNA, 21 bp, Homo sapiens
ccaaagagacagggcccgggc

SEQ ID NO: 1920329 - DNA, 16 bp, Homo sapiens
ccaaatatatttaatg

SEQ ID NO: 1920330 - DNA, 20 bp, Homo sapiens
ccaaatgtgtgcccagctta

SEQ ID NO: 1920331 - DNA, 20 bp, Homo sapiens
ccaacagccactcagaaaag

SEQ ID NO: 1920332 - DNA, 14 bp, Homo sapiens
ccaacagcctctgt

SEQ ID NO: 1920333 - DNA, 15 bp, Homo sapiens
ccaacagcctctgtg

SEQ ID NO: 1920334 - DNA, 16 bp, Homo sapiens
ccaacagcctctgtgg

SEQ ID NO: 1920335 - DNA, 14 bp, Homo sapiens
ccaaccccagaccc

SEQ ID NO: 1920336 - DNA, 17 bp, Homo sapiens
ccaacccctcgcccagt

SEQ ID NO: 1920337 - DNA, 17 bp, Homo sapiens
ccaagaagtttaaggaa

SEQ ID NO: 1920338 - DNA, 18 bp, Homo sapiens
ccaagagggctcctcact

SEQ ID NO: 1920339 - DNA, 15 bp, Homo sapiens
ccaagagtggcccca

SEQ ID NO: 1920340 - DNA, 20 bp, Homo sapiens
ccaagagtggccccacctgg

SEQ ID NO: 1920341 - DNA, 13 bp, Homo sapiens
ccaagcgccctgg

SEQ ID NO: 1920342 - DNA, 16 bp, Homo sapiens
ccaaggccaggccttg

SEQ ID NO: 1920343 - DNA, 15 bp, Homo sapiens
ccaagtactttccaa

SEQ ID NO: 1920344 - DNA, 17 bp, Homo sapiens
ccaagtggatattttct

SEQ ID NO: 1920345 - DNA, 17 bp, Homo sapiens
ccaagtgtattgtaatg

SEQ ID NO: 1920346 - DNA, 16 bp, Homo sapiens
ccaataccccatggac

SEQ ID NO: 1920347 - DNA, 15 bp, Homo sapiens
ccaatcttactttgt

SEQ ID NO: 1920348 - DNA, 20 bp, Homo sapiens
ccaatcttactttgtaaatt

SEQ ID NO: 1920349 - DNA, 23 bp, Homo sapiens
ccaattttttaagtgaaaatata

SEQ ID NO: 1920350 - DNA, 13 bp, Homo sapiens
ccacaaggaagaa

SEQ ID NO: 1920351 - DNA, 17 bp, Homo sapiens
ccacagcctccccttcc

SEQ ID NO: 1920352 - DNA, 21 bp, Homo sapiens
ccacagcctccccttcccaga

SEQ ID NO: 1920353 - DNA, 13 bp, Homo sapiens
ccaccagcgcccc

SEQ ID NO: 1920354 - DNA, 19 bp, Homo sapiens
ccaccagcgcccccactcc

SEQ ID NO: 1920355 - DNA, 20 bp, Homo sapiens
ccaccagcgcccccactcct

SEQ ID NO: 1920356 - DNA, 22 bp, Homo sapiens
ccaccagcgcccccactcctcc

SEQ ID NO: 1920357 - DNA, 12 bp, Homo sapiens
ccacccctctgg

SEQ ID NO: 1920358 - DNA, 14 bp, Homo sapiens
ccaccctaccccct

SEQ ID NO: 1920359 - DNA, 19 bp, Homo sapiens
ccaccctgcttggcccagg

SEQ ID NO: 1920360 - DNA, 20 bp, Homo sapiens
ccaccctgcttggcccaggg

SEQ ID NO: 1920361 - DNA, 14 bp, Homo sapiens
ccaccctgtcccag

SEQ ID NO: 1920362 - DNA, 23 bp, Homo sapiens
ccaccctgtcccaggcagcgcca

SEQ ID NO: 1920363 - DNA, 12 bp, Homo sapiens
ccaccctttcta

SEQ ID NO: 1920364 - DNA, 16 bp, Homo sapiens
ccaccctttctgccag

SEQ ID NO: 1920365 - DNA, 15 bp, Homo sapiens
ccaccctttctggca

SEQ ID NO: 1920366 - DNA, 16 bp, Homo sapiens
ccaccctttctggcac

SEQ ID NO: 1920367 - DNA, 13 bp, Homo sapiens
ccaccgtcccctc

SEQ ID NO: 1920368 - DNA, 16 bp, Homo sapiens
ccaccgtccctctgca

SEQ ID NO: 1920369 - DNA, 18 bp, Homo sapiens
ccacctccccttgccagc

SEQ ID NO: 1920370 - DNA, 20 bp, Homo sapiens
ccacctccccttgccagctg

SEQ ID NO: 1920371 - DNA, 16 bp, Homo sapiens
ccacctccctcccacc

SEQ ID NO: 1920372 - DNA, 21 bp, Homo sapiens
ccacctcctaaaaggcccaga

SEQ ID NO: 1920373 - DNA, 22 bp, Homo sapiens
ccacctcctaaaaggcccagag

SEQ ID NO: 1920374 - DNA, 23 bp, Homo sapiens
ccacctcctaaaaggcccagaga

SEQ ID NO: 1920375 - DNA, 19 bp, Homo sapiens
ccacgctgactacagggcc

SEQ ID NO: 1920376 - DNA, 20 bp, Homo sapiens
ccacgctgactacagggccg

SEQ ID NO: 1920377 - DNA, 18 bp, Homo sapiens
ccactgtccgctgtctcc

SEQ ID NO: 1920378 - DNA, 23 bp, Homo sapiens
ccactgtccgctgtctccctcct

SEQ ID NO: 1920379 - DNA, 12 bp, Homo sapiens
ccacttgtagat

SEQ ID NO: 1920380 - DNA, 12 bp, Homo sapiens
ccagaatactga

SEQ ID NO: 1920381 - DNA, 21 bp, Homo sapiens
ccagaatactgatggaatttt

SEQ ID NO: 1920382 - DNA, 23 bp, Homo sapiens
ccagaatactgatggaatttttt

SEQ ID NO: 1920383 - DNA, 14 bp, Homo sapiens
ccagaccccgcagc

SEQ ID NO: 1920384 - DNA, 21 bp, Homo sapiens
ccagaccccgcagcacgcctc

SEQ ID NO: 1920385 - DNA, 22 bp, Homo sapiens
ccagacgctcattcagcatctg

SEQ ID NO: 1920386 - DNA, 12 bp, Homo sapiens
ccagagaacaag

SEQ ID NO: 1920387 - DNA, 16 bp, Homo sapiens
ccagagagaagagccc

SEQ ID NO: 1920388 - DNA, 18 bp, Homo sapiens
ccagagagaagagcccca

SEQ ID NO: 1920389 - DNA, 23 bp, Homo sapiens
ccagagagaagagccccactctc

SEQ ID NO: 1920390 - DNA, 21 bp, Homo sapiens
ccagagttttctatgaatcta

SEQ ID NO: 1920391 - DNA, 18 bp, Homo sapiens
ccagcaacacgtcattgt

SEQ ID NO: 1920392 - DNA, 23 bp, Homo sapiens
ccagcagacatcaagctcaaggc

SEQ ID NO: 1920393 - DNA, 14 bp, Homo sapiens
ccagcagccttcca

SEQ ID NO: 1920394 - DNA, 23 bp, Homo sapiens
ccagcagccttccagtggcttct

SEQ ID NO: 1920395 - DNA, 12 bp, Homo sapiens
ccagcaggcact

SEQ ID NO: 1920396 - DNA, 17 bp, Homo sapiens
ccagcaggctcctcagc

SEQ ID NO: 1920397 - DNA, 18 bp, Homo sapiens
ccagcaggctcctcagcc

SEQ ID NO: 1920398 - DNA, 20 bp, Homo sapiens
ccagcaggctcctcagccct

SEQ ID NO: 1920399 - DNA, 18 bp, Homo sapiens
ccagccaaacacacagaa

SEQ ID NO: 1920400 - DNA, 21 bp, Homo sapiens
ccagccaaacacacagaaggg

SEQ ID NO: 1920401 - DNA, 21 bp, Homo sapiens
ccagcctaggcttggctcctt

SEQ ID NO: 1920402 - DNA, 17 bp, Homo sapiens
ccagcctcaaatccagg

SEQ ID NO: 1920403 - DNA, 16 bp, Homo sapiens
ccagcgcccccactcc

SEQ ID NO: 1920404 - DNA, 20 bp, Homo sapiens
ccagcgcccccactcctcct

SEQ ID NO: 1920405 - DNA, 20 bp, Homo sapiens
ccagcgcggacatcccctgc

SEQ ID NO: 1920406 - DNA, 12 bp, Homo sapiens
ccagcggccctc

SEQ ID NO: 1920407 - DNA, 13 bp, Homo sapiens
ccagcggccctcc

SEQ ID NO: 1920408 - DNA, 18 bp, Homo sapiens
ccagcggccctcccaggc

SEQ ID NO: 1920409 - DNA, 13 bp, Homo sapiens
ccagctccacccc

SEQ ID NO: 1920410 - DNA, 12 bp, Homo sapiens
ccagctccctcc

SEQ ID NO: 1920411 - DNA, 13 bp, Homo sapiens
ccagctccctccc

SEQ ID NO: 1920412 - DNA, 16 bp, Homo sapiens
ccagctccctcccctg

SEQ ID NO: 1920413 - DNA, 17 bp, Homo sapiens
ccagctccctcccctgc

SEQ ID NO: 1920414 - DNA, 21 bp, Homo sapiens
ccagctccctcccctgctcag

SEQ ID NO: 1920415 - DNA, 15 bp, Homo sapiens
ccagctgctgagccg

SEQ ID NO: 1920416 - DNA, 22 bp, Homo sapiens
ccagctgtgctgggaggtccca

SEQ ID NO: 1920417 - DNA, 13 bp, Homo sapiens
ccagcttccagca

SEQ ID NO: 1920418 - DNA, 14 bp, Homo sapiens
ccagcttccagcag

SEQ ID NO: 1920419 - DNA, 19 bp, Homo sapiens
ccaggaagtagcacaggct

SEQ ID NO: 1920420 - DNA, 21 bp, Homo sapiens
ccaggaagtagcacaggctga

SEQ ID NO: 1920421 - DNA, 19 bp, Homo sapiens
ccaggaccctgccaggcac

SEQ ID NO: 1920422 - DNA, 20 bp, Homo sapiens
ccaggaccctgccaggcaca

SEQ ID NO: 1920423 - DNA, 21 bp, Homo sapiens
ccaggaccctgccaggcacag

SEQ ID NO: 1920424 - DNA, 23 bp, Homo sapiens
ccaggaccctgccaggcacaggc

SEQ ID NO: 1920425 - DNA, 17 bp, Homo sapiens
ccaggagcctgcccagc

SEQ ID NO: 1920426 - DNA, 19 bp, Homo sapiens
ccaggattgtcactccaaa

SEQ ID NO: 1920427 - DNA, 17 bp, Homo sapiens
ccaggcacaggcagggc

SEQ ID NO: 1920428 - DNA, 20 bp, Homo sapiens
ccaggcacaggcagggcagg

SEQ ID NO: 1920429 - DNA, 23 bp, Homo sapiens
ccaggcagagagcgaccagcagg

SEQ ID NO: 1920430 - DNA, 16 bp, Homo sapiens
ccaggcagcgccactg

SEQ ID NO: 1920431 - DNA, 22 bp, Homo sapiens
ccaggcagcgccactgtccgct

SEQ ID NO: 1920432 - DNA, 13 bp, Homo sapiens
ccaggcccggcat

SEQ ID NO: 1920433 - DNA, 18 bp, Homo sapiens
ccaggcccggcatgaggc

SEQ ID NO: 1920434 - DNA, 14 bp, Homo sapiens
ccaggctgctctca

SEQ ID NO: 1920435 - DNA, 12 bp, Homo sapiens
ccaggctttcta

SEQ ID NO: 1920436 - DNA, 16 bp, Homo sapiens
ccagggatggcagtgg

SEQ ID NO: 1920437 - DNA, 20 bp, Homo sapiens
ccaggtggaggtggcatccc

SEQ ID NO: 1920438 - DNA, 14 bp, Homo sapiens
ccagtaagatcact

SEQ ID NO: 1920439 - DNA, 17 bp, Homo sapiens
ccagtaccttctgccag

SEQ ID NO: 1920440 - DNA, 21 bp, Homo sapiens
ccagtaccttctgccagaaga

SEQ ID NO: 1920441 - DNA, 13 bp, Homo sapiens
ccagtcccagcag

SEQ ID NO: 1920442 - DNA, 18 bp, Homo sapiens
ccagtcccagcagccagc

SEQ ID NO: 1920443 - DNA, 13 bp, Homo sapiens
ccagtgaggcatc

SEQ ID NO: 1920444 - DNA, 14 bp, Homo sapiens
ccagtggcagggca

SEQ ID NO: 1920445 - DNA, 15 bp, Homo sapiens
ccagtggcagggcac

SEQ ID NO: 1920446 - DNA, 12 bp, Homo sapiens
ccagtggcttct

SEQ ID NO: 1920447 - DNA, 13 bp, Homo sapiens
ccagtggcttctc

SEQ ID NO: 1920448 - DNA, 16 bp, Homo sapiens
ccagtggcttctccca

SEQ ID NO: 1920449 - DNA, 17 bp, Homo sapiens
ccagtggcttctcccaa

SEQ ID NO: 1920450 - DNA, 16 bp, Homo sapiens
ccagttcacatttatt

SEQ ID NO: 1920451 - DNA, 13 bp, Homo sapiens
ccagttgctgtca

SEQ ID NO: 1920452 - DNA, 14 bp, Homo sapiens
ccagttgtggcaac

SEQ ID NO: 1920453 - DNA, 20 bp, Homo sapiens
ccataacagtgccagcttct

SEQ ID NO: 1920454 - DNA, 14 bp, Homo sapiens
ccatataactggag

SEQ ID NO: 1920455 - DNA, 23 bp, Homo sapiens
ccatcagctacccctgcagctgg

SEQ ID NO: 1920456 - DNA, 19 bp, Homo sapiens
ccatcccgtttccctccag

SEQ ID NO: 1920457 - DNA, 13 bp, Homo sapiens
ctaaaaggcccag

SEQ ID NO: 1920458 - DNA, 23 bp, Homo sapiens
ctaaaaggcccagagagaagagc

SEQ ID NO: 1920459 - DNA, 14 bp, Homo sapiens
ctaaaagtaaacat

SEQ ID NO: 1920460 - DNA, 16 bp, Homo sapiens
ctaaaatataatagaa

SEQ ID NO: 1920461 - DNA, 19 bp, Homo sapiens
ctaaataaattatttgtta

SEQ ID NO: 1920462 - DNA, 18 bp, Homo sapiens
ctaaataagttataaaga

SEQ ID NO: 1920463 - DNA, 20 bp, Homo sapiens
ctaaatttggaacttacaaa

SEQ ID NO: 1920464 - DNA, 21 bp, Homo sapiens
ctaaatttggaacttacaaag

SEQ ID NO: 1920465 - DNA, 20 bp, Homo sapiens
ctaacaacattgtagcctca

SEQ ID NO: 1920466 - DNA, 17 bp, Homo sapiens
ctaacatggtaaaaccc

SEQ ID NO: 1920467 - DNA, 20 bp, Homo sapiens
ctaacgttttctactttgaa

SEQ ID NO: 1920468 - DNA, 21 bp, Homo sapiens
ctaacgttttctactttgaaa

SEQ ID NO: 1920469 - DNA, 20 bp, Homo sapiens
ctaaggagttttgttgtatt

SEQ ID NO: 1920470 - DNA, 17 bp, Homo sapiens
ctaaggccaatgggcta

SEQ ID NO: 1920471 - DNA, 17 bp, Homo sapiens
ctaataacatgtgaaaa

SEQ ID NO: 1920472 - DNA, 14 bp, Homo sapiens
ctaataagacccca

SEQ ID NO: 1920473 - DNA, 17 bp, Homo sapiens
ctaatatttttaacaag

SEQ ID NO: 1920474 - DNA, 21 bp, Homo sapiens
ctaatcctagtttgctgtggc

SEQ ID NO: 1920475 - DNA, 13 bp, Homo sapiens
ctacacaggacag

SEQ ID NO: 1920476 - DNA, 23 bp, Homo sapiens
ctacacggttcaaacctgtgaag

SEQ ID NO: 1920477 - DNA, 18 bp, Homo sapiens
ctacagaaaagaaactct

SEQ ID NO: 1920478 - DNA, 15 bp, Homo sapiens
ctacagtaagctggt

SEQ ID NO: 1920479 - DNA, 20 bp, Homo sapiens
ctaccctgatcacctcaggg

SEQ ID NO: 1920480 - DNA, 19 bp, Homo sapiens
ctactctaggactgggccc

SEQ ID NO: 1920481 - DNA, 16 bp, Homo sapiens
ctactgcatttaggga

SEQ ID NO: 1920482 - DNA, 19 bp, Homo sapiens
ctactgttatgtgagaaca

SEQ ID NO: 1920483 - DNA, 20 bp, Homo sapiens
ctactgttatgtgagaacat

SEQ ID NO: 1920484 - DNA, 21 bp, Homo sapiens
ctagaacattccatttgcttg

SEQ ID NO: 1920485 - DNA, 21 bp, Homo sapiens
ctagaagatcacagcagggcc

SEQ ID NO: 1920486 - DNA, 23 bp, Homo sapiens
ctagaggcctttagttataaagg

SEQ ID NO: 1920487 - DNA, 13 bp, Homo sapiens
ctagattttgaaa

SEQ ID NO: 1920488 - DNA, 14 bp, Homo sapiens
ctagattttgaaaa

SEQ ID NO: 1920489 - DNA, 21 bp, Homo sapiens
ctagcacatgttgatttccta

SEQ ID NO: 1920490 - DNA, 13 bp, Homo sapiens
ctagcctcacgct

SEQ ID NO: 1920491 - DNA, 13 bp, Homo sapiens
ctagctggagagg

SEQ ID NO: 1920492 - DNA, 23 bp, Homo sapiens
ctagctggagaggagccctgcct

SEQ ID NO: 1920493 - DNA, 22 bp, Homo sapiens
ctaggctttatttataaaataa

SEQ ID NO: 1920494 - DNA, 16 bp, Homo sapiens
ctaggtagagtctgag

SEQ ID NO: 1920495 - DNA, 21 bp, Homo sapiens
ctagtcaacagtaccctggtt

SEQ ID NO: 1920496 - DNA, 13 bp, Homo sapiens
ctagtcttaagaa

SEQ ID NO: 1920497 - DNA, 13 bp, Homo sapiens
ctagtgctgtgaa

SEQ ID NO: 1920498 - DNA, 22 bp, Homo sapiens
ctagtgctgtgaaaaaaaaaat

SEQ ID NO: 1920499 - DNA, 15 bp, Homo sapiens
ctagtgtttgattgt

SEQ ID NO: 1920500 - DNA, 12 bp, Homo sapiens
ctagttgaatac

SEQ ID NO: 1920501 - DNA, 21 bp, Homo sapiens
ctagttgaatacttgaaccat

SEQ ID NO: 1920502 - DNA, 17 bp, Homo sapiens
ctataagccaaaattaa

SEQ ID NO: 1920503 - DNA, 14 bp, Homo sapiens
ctataattttacaa

SEQ ID NO: 1920504 - DNA, 23 bp, Homo sapiens
ctataattttgatagtgggacca

SEQ ID NO: 1920505 - DNA, 17 bp, Homo sapiens
ctatacatgtttgcagt

SEQ ID NO: 1920506 - DNA, 19 bp, Homo sapiens
ctatacatgtttgcagtgt

SEQ ID NO: 1920507 - DNA, 17 bp, Homo sapiens
ctataccaactgggcct

SEQ ID NO: 1920508 - DNA, 22 bp, Homo sapiens
ctatagaaatgatcattgcatg

SEQ ID NO: 1920509 - DNA, 14 bp, Homo sapiens
ctatattgcagtgt

SEQ ID NO: 1920510 - DNA, 22 bp, Homo sapiens
ctatctagggagccctgggcca

SEQ ID NO: 1920511 - DNA, 13 bp, Homo sapiens
ctatcttgtaaat

SEQ ID NO: 1920512 - DNA, 16 bp, Homo sapiens
ctatgacttaacatag

SEQ ID NO: 1920513 - DNA, 14 bp, Homo sapiens
ctatgcccagctgt

SEQ ID NO: 1920514 - DNA, 21 bp, Homo sapiens
ctattacacatgggcatattc

SEQ ID NO: 1920515 - DNA, 14 bp, Homo sapiens
ctattagtgttata

SEQ ID NO: 1920516 - DNA, 15 bp, Homo sapiens
ctatttaaaaaagag

SEQ ID NO: 1920517 - DNA, 13 bp, Homo sapiens
ctcaaaacaaagg

SEQ ID NO: 1920518 - DNA, 19 bp, Homo sapiens
ctcaaagccccattaactg

SEQ ID NO: 1920519 - DNA, 22 bp, Homo sapiens
ctcaaagccccattaactgctt

SEQ ID NO: 1920520 - DNA, 14 bp, Homo sapiens
ctcaaatccaggac

SEQ ID NO: 1920521 - DNA, 20 bp, Homo sapiens
ctcaaatgatgtgcctgctt

SEQ ID NO: 1920522 - DNA, 14 bp, Homo sapiens
ctcaaattttgagt

SEQ ID NO: 1920523 - DNA, 21 bp, Homo sapiens
ctcaagccgtggccggggtcc

SEQ ID NO: 1920524 - DNA, 15 bp, Homo sapiens
ctcaaggcaatgggc

SEQ ID NO: 1920525 - DNA, 14 bp, Homo sapiens
ctcaagtctaccct

SEQ ID NO: 1920526 - DNA, 16 bp, Homo sapiens
ctcaagtgcaatgccc

SEQ ID NO: 1920527 - DNA, 21 bp, Homo sapiens
ctcaagtgcaatgccccctcc

SEQ ID NO: 1920528 - DNA, 14 bp, Homo sapiens
ctcaataaagctcg

SEQ ID NO: 1920529 - DNA, 16 bp, Homo sapiens
ctcaatataaaaacat

SEQ ID NO: 1920530 - DNA, 21 bp, Homo sapiens
ctcaatttttggttgaataaa

SEQ ID NO: 1920531 - DNA, 18 bp, Homo sapiens
ctcacacacctctgcccc

SEQ ID NO: 1920532 - DNA, 19 bp, Homo sapiens
ctcacacacctctgcccct

SEQ ID NO: 1920533 - DNA, 20 bp, Homo sapiens
ctcacacacctctgcccctt

SEQ ID NO: 1920534 - DNA, 13 bp, Homo sapiens
ctcacagacagga

SEQ ID NO: 1920535 - DNA, 15 bp, Homo sapiens
ctcacagacaggacc

SEQ ID NO: 1920536 - DNA, 18 bp, Homo sapiens
ctcacagacaggacccct

SEQ ID NO: 1920537 - DNA, 20 bp, Homo sapiens
ctcacagacaggacccctgc

SEQ ID NO: 1920538 - DNA, 12 bp, Homo sapiens
ctcacagccagc

SEQ ID NO: 1920539 - DNA, 22 bp, Homo sapiens
ctcacagctatgcaaaaagcta

SEQ ID NO: 1920540 - DNA, 18 bp, Homo sapiens
ctcaccatttccccaggg

SEQ ID NO: 1920541 - DNA, 20 bp, Homo sapiens
ctcaccatttccccagggca

SEQ ID NO: 1920542 - DNA, 15 bp, Homo sapiens
ctcacgaaactggaa

SEQ ID NO: 1920543 - DNA, 16 bp, Homo sapiens
ctcactatctagggag

SEQ ID NO: 1920544 - DNA, 21 bp, Homo sapiens
ctcactctcaggaaatgctga

SEQ ID NO: 1920545 - DNA, 15 bp, Homo sapiens
ctcactggtctacac

SEQ ID NO: 1920546 - DNA, 13 bp, Homo sapiens
ctcagactgtata

SEQ ID NO: 1920547 - DNA, 22 bp, Homo sapiens
ctcagaggccccaataccccat

SEQ ID NO: 1920548 - DNA, 13 bp, Homo sapiens
ctcagcaaggcca

SEQ ID NO: 1920549 - DNA, 17 bp, Homo sapiens
ctcagcaaggccacctc

SEQ ID NO: 1920550 - DNA, 18 bp, Homo sapiens
ctcagcttccccagtagc

SEQ ID NO: 1920551 - DNA, 20 bp, Homo sapiens
ctcaggaaatgctgacccat

SEQ ID NO: 1920552 - DNA, 15 bp, Homo sapiens
ctcagtcggggcagg

SEQ ID NO: 1920553 - DNA, 19 bp, Homo sapiens
ctcatggcccatcaggggc

SEQ ID NO: 1920554 - DNA, 23 bp, Homo sapiens
ctcatttggggaccacagaggct

SEQ ID NO: 1920555 - DNA, 20 bp, Homo sapiens
ctccaaaccttactctgagc

SEQ ID NO: 1920556 - DNA, 18 bp, Homo sapiens
ctccaacccctcgcccag

SEQ ID NO: 1920557 - DNA, 20 bp, Homo sapiens
ctccaacccctcgcccagtc

SEQ ID NO: 1920558 - DNA, 14 bp, Homo sapiens
ctccaaggccaggc

SEQ ID NO: 1920559 - DNA, 15 bp, Homo sapiens
ctccaattttttaag

SEQ ID NO: 1920560 - DNA, 23 bp, Homo sapiens
ctccaattttttaagtgaaaata

SEQ ID NO: 1920561 - DNA, 20 bp, Homo sapiens
ctccacatatttcagtgagg

SEQ ID NO: 1920562 - DNA, 11 bp, Homo sapiens
ctccacctctg

SEQ ID NO: 1920563 - DNA, 13 bp, Homo sapiens
ctccacctctgtg

SEQ ID NO: 1920564 - DNA, 14 bp, Homo sapiens
ctccacctctgtgc

SEQ ID NO: 1920565 - DNA, 19 bp, Homo sapiens
ctccaggtgttgttgaggg

SEQ ID NO: 1920566 - DNA, 20 bp, Homo sapiens
ctccagtaccttctgccaga

SEQ ID NO: 1920567 - DNA, 13 bp, Homo sapiens
ctccatactttga

SEQ ID NO: 1920568 - DNA, 18 bp, Homo sapiens
ctccatccacccctctgg

SEQ ID NO: 1920569 - DNA, 20 bp, Homo sapiens
ctccatccctctcctctgcc

SEQ ID NO: 1920570 - DNA, 12 bp, Homo sapiens
ctccattcatac

SEQ ID NO: 1920571 - DNA, 11 bp, Homo sapiens
ctcccacccta

SEQ ID NO: 1920572 - DNA, 15 bp, Homo sapiens
ctcccaccctacccc

SEQ ID NO: 1920573 - DNA, 15 bp, Homo sapiens
ctcccactcccatgg

SEQ ID NO: 1920574 - DNA, 19 bp, Homo sapiens
ctcccactcccatggctct

SEQ ID NO: 1920575 - DNA, 12 bp, Homo sapiens
ctcccagctctg

SEQ ID NO: 1920576 - DNA, 14 bp, Homo sapiens
ctcccagctctggg

SEQ ID NO: 1920577 - DNA, 20 bp, Homo sapiens
ctcccatcttttgttactct

SEQ ID NO: 1920578 - DNA, 14 bp, Homo sapiens
ctcccatggctctg

SEQ ID NO: 1920579 - DNA, 14 bp, Homo sapiens
ctccccaccctgtc

SEQ ID NO: 1920580 - DNA, 15 bp, Homo sapiens
ctccccaccctgtcc

SEQ ID NO: 1920581 - DNA, 12 bp, Homo sapiens
ctcccctccttt

SEQ ID NO: 1920582 - DNA, 13 bp, Homo sapiens
ctcccctccttta

SEQ ID NO: 1920583 - DNA, 13 bp, Homo sapiens
ctcccctgctcag

SEQ ID NO: 1920584 - DNA, 23 bp, Homo sapiens
ctccccttcccagaccccgcagc

SEQ ID NO: 1920585 - DNA, 22 bp, Homo sapiens
ctcccgtgtaggaacctgcaca

SEQ ID NO: 1920586 - DNA, 14 bp, Homo sapiens
ctccctcccagctc

SEQ ID NO: 1920587 - DNA, 16 bp, Homo sapiens
ctccctcccagctcca

SEQ ID NO: 1920588 - DNA, 15 bp, Homo sapiens
ctccctcccctgctc

SEQ ID NO: 1920589 - DNA, 16 bp, Homo sapiens
ctccctcccctgctca

SEQ ID NO: 1920590 - DNA, 20 bp, Homo sapiens
cttgcctcagcttccccagt

SEQ ID NO: 1920591 - DNA, 20 bp, Homo sapiens
cttggaaatcaaatgtaaag

SEQ ID NO: 1920592 - DNA, 22 bp, Homo sapiens
cttggcccagggggcttcctga

SEQ ID NO: 1920593 - DNA, 22 bp, Homo sapiens
cttggctctcaatgctgtttgg

SEQ ID NO: 1920594 - DNA, 16 bp, Homo sapiens
cttggcttggccctgg

SEQ ID NO: 1920595 - DNA, 12 bp, Homo sapiens
cttgggcctccc

SEQ ID NO: 1920596 - DNA, 18 bp, Homo sapiens
cttgggcctcccactccc

SEQ ID NO: 1920597 - DNA, 13 bp, Homo sapiens
cttgggctggcgg

SEQ ID NO: 1920598 - DNA, 18 bp, Homo sapiens
cttgggctggcgggccct

SEQ ID NO: 1920599 - DNA, 22 bp, Homo sapiens
cttggtatttgtttaataccct

SEQ ID NO: 1920600 - DNA, 16 bp, Homo sapiens
cttggtcacttcgtgg

SEQ ID NO: 1920601 - DNA, 12 bp, Homo sapiens
cttgtaaatatt

SEQ ID NO: 1920602 - DNA, 17 bp, Homo sapiens
cttgtaactaaaataat

SEQ ID NO: 1920603 - DNA, 22 bp, Homo sapiens
cttgtaactaaaataattttgt

SEQ ID NO: 1920604 - DNA, 15 bp, Homo sapiens
cttgtagatttgatt

SEQ ID NO: 1920605 - DNA, 13 bp, Homo sapiens
cttgtagttcttt

SEQ ID NO: 1920606 - DNA, 21 bp, Homo sapiens
cttgtatttagtaagtgcttg

SEQ ID NO: 1920607 - DNA, 15 bp, Homo sapiens
cttgtcattttggtc

SEQ ID NO: 1920608 - DNA, 17 bp, Homo sapiens
cttgttgctgattttga

SEQ ID NO: 1920609 - DNA, 14 bp, Homo sapiens
ctttaaactgtcgt

SEQ ID NO: 1920610 - DNA, 14 bp, Homo sapiens
ctttaatatgaaat

SEQ ID NO: 1920611 - DNA, 17 bp, Homo sapiens
ctttaatatgaaatttt

SEQ ID NO: 1920612 - DNA, 22 bp, Homo sapiens
ctttaatgatatgcttgtaact

SEQ ID NO: 1920613 - DNA, 23 bp, Homo sapiens
ctttaccgaggacagcctgcctc

SEQ ID NO: 1920614 - DNA, 13 bp, Homo sapiens
ctttagacttgaa

SEQ ID NO: 1920615 - DNA, 15 bp, Homo sapiens
ctttagacttgaaaa

SEQ ID NO: 1920616 - DNA, 13 bp, Homo sapiens
ctttattatttat

SEQ ID NO: 1920617 - DNA, 14 bp, Homo sapiens
ctttattatttatt

SEQ ID NO: 1920618 - DNA, 22 bp, Homo sapiens
ctttattgcttactgtgttaaa

SEQ ID NO: 1920619 - DNA, 17 bp, Homo sapiens
ctttatttttttgaact

SEQ ID NO: 1920620 - DNA, 14 bp, Homo sapiens
ctttcaaaaacatg

SEQ ID NO: 1920621 - DNA, 19 bp, Homo sapiens
ctttcataataaatagaca

SEQ ID NO: 1920622 - DNA, 16 bp, Homo sapiens
ctttcatattttaaac

SEQ ID NO: 1920623 - DNA, 15 bp, Homo sapiens
ctttcattttctttc

SEQ ID NO: 1920624 - DNA, 22 bp, Homo sapiens
ctttcattttctttcctttccc

SEQ ID NO: 1920625 - DNA, 12 bp, Homo sapiens
ctttcccctttt

SEQ ID NO: 1920626 - DNA, 13 bp, Homo sapiens
ctttcccttcttt

SEQ ID NO: 1920627 - DNA, 10 bp, Homo sapiens
ctttcctttc

SEQ ID NO: 1920628 - DNA, 13 bp, Homo sapiens
ctttcctttcttt

SEQ ID NO: 1920629 - DNA, 15 bp, Homo sapiens
ctttctacttccaag

SEQ ID NO: 1920630 - DNA, 16 bp, Homo sapiens
ctttctacttccaaga

SEQ ID NO: 1920631 - DNA, 15 bp, Homo sapiens
ctttctcaccagccc

SEQ ID NO: 1920632 - DNA, 11 bp, Homo sapiens
ctttctctctc

SEQ ID NO: 1920633 - DNA, 21 bp, Homo sapiens
ctttctctctcactctcttcc

SEQ ID NO: 1920634 - DNA, 22 bp, Homo sapiens
ctttctctctcactctcttcct

SEQ ID NO: 1920635 - DNA, 21 bp, Homo sapiens
ctttctgagcaagaggatttt

SEQ ID NO: 1920636 - DNA, 15 bp, Homo sapiens
ctttctgccagggat

SEQ ID NO: 1920637 - DNA, 22 bp, Homo sapiens
ctttctgccagggatggcagtg

SEQ ID NO: 1920638 - DNA, 19 bp, Homo sapiens
ctttctgtgtaccactggg

SEQ ID NO: 1920639 - DNA, 21 bp, Homo sapiens
ctttcttagctgatgtctttg

SEQ ID NO: 1920640 - DNA, 18 bp, Homo sapiens
ctttctttgctgtttgca

SEQ ID NO: 1920641 - DNA, 22 bp, Homo sapiens
ctttgaaaacaccagctgtata

SEQ ID NO: 1920642 - DNA, 14 bp, Homo sapiens
ctttgaatttatat

SEQ ID NO: 1920643 - DNA, 19 bp, Homo sapiens
ctttgaatttatataaagt

SEQ ID NO: 1920644 - DNA, 19 bp, Homo sapiens
ctttgacagcgcacagctg

SEQ ID NO: 1920645 - DNA, 22 bp, Homo sapiens
ctttgagtgtattctatttgtg

SEQ ID NO: 1920646 - DNA, 13 bp, Homo sapiens
ctttgatgtgttg

SEQ ID NO: 1920647 - DNA, 15 bp, Homo sapiens
ctttgatgtgttgtt

SEQ ID NO: 1920648 - DNA, 20 bp, Homo sapiens
ctttgatgtgttgttcttgg

SEQ ID NO: 1920649 - DNA, 14 bp, Homo sapiens
ctttgctgtagtgt

SEQ ID NO: 1920650 - DNA, 18 bp, Homo sapiens
ctttggcttacatttgaa

SEQ ID NO: 1920651 - DNA, 12 bp, Homo sapiens
ctttgtaaattc

SEQ ID NO: 1920652 - DNA, 15 bp, Homo sapiens
ctttgtaaattctga

SEQ ID NO: 1920653 - DNA, 16 bp, Homo sapiens
ctttgtagcatttggt

SEQ ID NO: 1920654 - DNA, 21 bp, Homo sapiens
ctttgtatagttatgtaaata

SEQ ID NO: 1920655 - DNA, 21 bp, Homo sapiens
ctttgtgtgctgttagtattg

SEQ ID NO: 1920656 - DNA, 17 bp, Homo sapiens
ctttgttaaaaacactg

SEQ ID NO: 1920657 - DNA, 22 bp, Homo sapiens
ctttgttcaataaaggaaatat

SEQ ID NO: 1920658 - DNA, 13 bp, Homo sapiens
ctttgttgaaaga

SEQ ID NO: 1920659 - DNA, 18 bp, Homo sapiens
cttttcaatatatttgta

SEQ ID NO: 1920660 - DNA, 15 bp, Homo sapiens
cttttcaccattcgt

SEQ ID NO: 1920661 - DNA, 19 bp, Homo sapiens
cttttcttttgctttcctt

SEQ ID NO: 1920662 - DNA, 20 bp, Homo sapiens
cttttcttttgctttccttt

SEQ ID NO: 1920663 - DNA, 22 bp, Homo sapiens
cttttcttttgctttcctttcc

SEQ ID NO: 1920664 - DNA, 14 bp, Homo sapiens
cttttgctttcctt

SEQ ID NO: 1920665 - DNA, 21 bp, Homo sapiens
cttttgtagtgtgttttcata

SEQ ID NO: 1920666 - DNA, 13 bp, Homo sapiens
ctttttatttata

SEQ ID NO: 1920667 - DNA, 14 bp, Homo sapiens
ctttttatttatat

SEQ ID NO: 1920668 - DNA, 15 bp, Homo sapiens
ctttttccctttcct

SEQ ID NO: 1920669 - DNA, 19 bp, Homo sapiens
cttttttattaatcactgt

SEQ ID NO: 1920670 - DNA, 20 bp, Homo sapiens
cttttttgatatgataataa

SEQ ID NO: 1920671 - DNA, 19 bp, Homo sapiens
gaaaaaaaaaaagaaagaa

SEQ ID NO: 1920672 - DNA, 15 bp, Homo sapiens
gaaaaataaaggaaa

SEQ ID NO: 1920673 - DNA, 16 bp, Homo sapiens
gaaaaataaaggaaat

SEQ ID NO: 1920674 - DNA, 21 bp, Homo sapiens
gaaaaatcagtttttgactga

SEQ ID NO: 1920675 - DNA, 19 bp, Homo sapiens
gaaaagaaaaaaaaagaaa

SEQ ID NO: 1920676 - DNA, 20 bp, Homo sapiens
gaaaagaaaaaaaaagaaaa

SEQ ID NO: 1920677 - DNA, 19 bp, Homo sapiens
gaaaagaaattgtccttga

SEQ ID NO: 1920678 - DNA, 13 bp, Homo sapiens
gaaaagagaaact

SEQ ID NO: 1920679 - DNA, 14 bp, Homo sapiens
gaaaagagaaactt

SEQ ID NO: 1920680 - DNA, 18 bp, Homo sapiens
gaaaagagacaggcaggt

SEQ ID NO: 1920681 - DNA, 17 bp, Homo sapiens
gaaaagatgtagattta

SEQ ID NO: 1920682 - DNA, 21 bp, Homo sapiens
gaaaagatgtagatttatttc

SEQ ID NO: 1920683 - DNA, 16 bp, Homo sapiens
gaaaagtaatatttat

SEQ ID NO: 1920684 - DNA, 19 bp, Homo sapiens
gaaaagtaatatttattaa

SEQ ID NO: 1920685 - DNA, 19 bp, Homo sapiens
gaaaataaaaaaaagaaaa

SEQ ID NO: 1920686 - DNA, 22 bp, Homo sapiens
gaaaataaaaaaaagaaaaaag

SEQ ID NO: 1920687 - DNA, 15 bp, Homo sapiens
gaaaataattgacag

SEQ ID NO: 1920688 - DNA, 13 bp, Homo sapiens
gaaaatagtttat

SEQ ID NO: 1920689 - DNA, 19 bp, Homo sapiens
gaaaatttcacttgaaatt

SEQ ID NO: 1920690 - DNA, 11 bp, Homo sapiens
gaaactggaat

SEQ ID NO: 1920691 - DNA, 15 bp, Homo sapiens
gaaagaaagaggaaa

SEQ ID NO: 1920692 - DNA, 14 bp, Homo sapiens
gaaagaatgtaaag

SEQ ID NO: 1920693 - DNA, 16 bp, Homo sapiens
gaaagaggaaaagaaa

SEQ ID NO: 1920694 - DNA, 18 bp, Homo sapiens
gaaagaggcacccttcca

SEQ ID NO: 1920695 - DNA, 19 bp, Homo sapiens
gaaagaggcacccttccat

SEQ ID NO: 1920696 - DNA, 18 bp, Homo sapiens
gaaagatatgtatatttt

SEQ ID NO: 1920697 - DNA, 21 bp, Homo sapiens
gaaagatatgtatatttttga

SEQ ID NO: 1920698 - DNA, 18 bp, Homo sapiens
gaaagtgcctttgcagct

SEQ ID NO: 1920699 - DNA, 20 bp, Homo sapiens
gaaagtgcctttgcagctca

SEQ ID NO: 1920700 - DNA, 23 bp, Homo sapiens
gaaagtgcctttgcagctcagaa

SEQ ID NO: 1920701 - DNA, 14 bp, Homo sapiens
gaaagtgttcattg

SEQ ID NO: 1920702 - DNA, 12 bp, Homo sapiens
gaaataaaagct

SEQ ID NO: 1920703 - DNA, 17 bp, Homo sapiens
gaaataacacagcagtt

SEQ ID NO: 1920704 - DNA, 19 bp, Homo sapiens
gaaatacacaagtaaacat

SEQ ID NO: 1920705 - DNA, 17 bp, Homo sapiens
gaaatacagactggatg

SEQ ID NO: 1920706 - DNA, 16 bp, Homo sapiens
gaaatatgtattctgt

SEQ ID NO: 1920707 - DNA, 16 bp, Homo sapiens
gaaatcaaatgtaaag

SEQ ID NO: 1920708 - DNA, 15 bp, Homo sapiens
gaaatccctgctcac

SEQ ID NO: 1920709 - DNA, 18 bp, Homo sapiens
gaaatccctgctcactgc

SEQ ID NO: 1920710 - DNA, 18 bp, Homo sapiens
gaaatcttaagtcataat

SEQ ID NO: 1920711 - DNA, 21 bp, Homo sapiens
gaaatcttaagtcataatgaa

SEQ ID NO: 1920712 - DNA, 18 bp, Homo sapiens
gaaatgaagagctgttga

SEQ ID NO: 1920713 - DNA, 22 bp, Homo sapiens
gaaatgctgacccatgggcagg

SEQ ID NO: 1920714 - DNA, 16 bp, Homo sapiens
gaaatggctgaagtgc

SEQ ID NO: 1920715 - DNA, 17 bp, Homo sapiens
gaaatggctgaagtgca

SEQ ID NO: 1920716 - DNA, 18 bp, Homo sapiens
gaaatgtggatgtgattg

SEQ ID NO: 1920717 - DNA, 18 bp, Homo sapiens
gaaattcagattgtttaa

SEQ ID NO: 1920718 - DNA, 17 bp, Homo sapiens
gaaattgtccttgaagc

SEQ ID NO: 1920719 - DNA, 18 bp, Homo sapiens
gaaattgtccttgaagct

SEQ ID NO: 1920720 - DNA, 11 bp, Homo sapiens
gaacagaccat

SEQ ID NO: 1920721 - DNA, 12 bp, Homo sapiens
gaacagatttta

SEQ ID NO: 1920722 - DNA, 21 bp, Homo sapiens
gaacaggtttttttgtttgtt

SEQ ID NO: 1920723 - DNA, 18 bp, Homo sapiens
gagtttcacagtgtgatt

SEQ ID NO: 1920724 - DNA, 22 bp, Homo sapiens
gataaattatggtaaaattttg

SEQ ID NO: 1920725 - DNA, 11 bp, Homo sapiens
gataagaaaac

SEQ ID NO: 1920726 - DNA, 23 bp, Homo sapiens
gataaggaacatttatccaggaa

SEQ ID NO: 1920727 - DNA, 16 bp, Homo sapiens
gataagttttgtttca

SEQ ID NO: 1920728 - DNA, 18 bp, Homo sapiens
gataattgtactttgaaa

SEQ ID NO: 1920729 - DNA, 13 bp, Homo sapiens
gataccaaagaga

SEQ ID NO: 1920730 - DNA, 20 bp, Homo sapiens
gatacgcttaaggtggaaag

SEQ ID NO: 1920731 - DNA, 14 bp, Homo sapiens
gatactctgggaac

SEQ ID NO: 1920732 - DNA, 22 bp, Homo sapiens
gatacttagaccaaaagcaaca

SEQ ID NO: 1920733 - DNA, 14 bp, Homo sapiens
gatagagtgcagtg

SEQ ID NO: 1920734 - DNA, 15 bp, Homo sapiens
gatatcagcactgga

SEQ ID NO: 1920735 - DNA, 22 bp, Homo sapiens
gatatcagcactggattgtaga

SEQ ID NO: 1920736 - DNA, 22 bp, Homo sapiens
gatatgcaaattccatagctca

SEQ ID NO: 1920737 - DNA, 13 bp, Homo sapiens
gatattaatgtat

SEQ ID NO: 1920738 - DNA, 18 bp, Homo sapiens
gatattatatacaacaca

SEQ ID NO: 1920739 - DNA, 20 bp, Homo sapiens
gatattttattttgaaatgg

SEQ ID NO: 1920740 - DNA, 14 bp, Homo sapiens
gatattttcttaaa

SEQ ID NO: 1920741 - DNA, 20 bp, Homo sapiens
gatcaaaaaggcttataaaa

SEQ ID NO: 1920742 - DNA, 12 bp, Homo sapiens
gatcacaaatga

SEQ ID NO: 1920743 - DNA, 16 bp, Homo sapiens
gatcacaaatgacttt

SEQ ID NO: 1920744 - DNA, 15 bp, Homo sapiens
gatcacagcagggcc

SEQ ID NO: 1920745 - DNA, 14 bp, Homo sapiens
gatcactgtttaga

SEQ ID NO: 1920746 - DNA, 12 bp, Homo sapiens
gatcatagtttt

SEQ ID NO: 1920747 - DNA, 13 bp, Homo sapiens
gatcatagtttta

SEQ ID NO: 1920748 - DNA, 16 bp, Homo sapiens
gatcatagttttattt

SEQ ID NO: 1920749 - DNA, 13 bp, Homo sapiens
gatccagctcaag

SEQ ID NO: 1920750 - DNA, 18 bp, Homo sapiens
gatctgctgcagagcagt

SEQ ID NO: 1920751 - DNA, 14 bp, Homo sapiens
gatctgtgtaaaat

SEQ ID NO: 1920752 - DNA, 14 bp, Homo sapiens
gatctttgagtgta

SEQ ID NO: 1920753 - DNA, 20 bp, Homo sapiens
gatctttgagtgtattctat

SEQ ID NO: 1920754 - DNA, 14 bp, Homo sapiens
gatgaagacagccc

SEQ ID NO: 1920755 - DNA, 21 bp, Homo sapiens
gatgacgtacaagtagttctg

SEQ ID NO: 1920756 - DNA, 18 bp, Homo sapiens
gatgactgaaaatgaact

SEQ ID NO: 1920757 - DNA, 15 bp, Homo sapiens
gatgcattaaaagaa

SEQ ID NO: 1920758 - DNA, 16 bp, Homo sapiens
gatgcattaaaagaaa

SEQ ID NO: 1920759 - DNA, 21 bp, Homo sapiens
gatgctcccccagggaagaaa

SEQ ID NO: 1920760 - DNA, 13 bp, Homo sapiens
gatggcagtggct

SEQ ID NO: 1920761 - DNA, 13 bp, Homo sapiens
gatgtaaagatgt

SEQ ID NO: 1920762 - DNA, 13 bp, Homo sapiens
gatgtatgttatt

SEQ ID NO: 1920763 - DNA, 18 bp, Homo sapiens
gatgtgtcctttctgaac

SEQ ID NO: 1920764 - DNA, 17 bp, Homo sapiens
gatgttagttttcctta

SEQ ID NO: 1920765 - DNA, 14 bp, Homo sapiens
gatgtttaaaacac

SEQ ID NO: 1920766 - DNA, 22 bp, Homo sapiens
gatgtttttagttctgactttg

SEQ ID NO: 1920767 - DNA, 22 bp, Homo sapiens
gattaaaaatatcaaattaatt

SEQ ID NO: 1920768 - DNA, 14 bp, Homo sapiens
gattagtttagaac

SEQ ID NO: 1920769 - DNA, 16 bp, Homo sapiens
gattattttcagaagc

SEQ ID NO: 1920770 - DNA, 19 bp, Homo sapiens
gattcccttgttattcaac

SEQ ID NO: 1920771 - DNA, 14 bp, Homo sapiens
gattcctccccacc

SEQ ID NO: 1920772 - DNA, 24 bp, Homo sapiens
gattcctccccaccctgtcccagg

SEQ ID NO: 1920773 - DNA, 17 bp, Homo sapiens
gattgaagaaacagcta

SEQ ID NO: 1920774 - DNA, 18 bp, Homo sapiens
gattgcctcaataaagct

SEQ ID NO: 1920775 - DNA, 16 bp, Homo sapiens
gattgtagaacttgtt

SEQ ID NO: 1920776 - DNA, 17 bp, Homo sapiens
gattgtagaacttgttg

SEQ ID NO: 1920777 - DNA, 18 bp, Homo sapiens
gatttctctttctctctc

SEQ ID NO: 1920778 - DNA, 13 bp, Homo sapiens
gcaaaattcctga

SEQ ID NO: 1920779 - DNA, 17 bp, Homo sapiens
gcaaacaactgaaatgt

SEQ ID NO: 1920780 - DNA, 16 bp, Homo sapiens
gcaaacagaagtgcat

SEQ ID NO: 1920781 - DNA, 22 bp, Homo sapiens
gcaaagaactcttaccctggca

SEQ ID NO: 1920782 - DNA, 21 bp, Homo sapiens
gcaaataagcactcctttaaa

SEQ ID NO: 1920783 - DNA, 17 bp, Homo sapiens
gcaaattccatagctca

SEQ ID NO: 1920784 - DNA, 17 bp, Homo sapiens
gcaaatttgtgaactgt

SEQ ID NO: 1920785 - DNA, 14 bp, Homo sapiens
gcaacacacatgct

SEQ ID NO: 1920786 - DNA, 15 bp, Homo sapiens
gcaacacgtcattgt

SEQ ID NO: 1920787 - DNA, 14 bp, Homo sapiens
gcaaccatttgaaa

SEQ ID NO: 1920788 - DNA, 23 bp, Homo sapiens
gcaacgatcacaaatgactttat

SEQ ID NO: 1920789 - DNA, 14 bp, Homo sapiens
gcaagaacagaagt

SEQ ID NO: 1920790 - DNA, 17 bp, Homo sapiens
gcaagcaccatcccctc

SEQ ID NO: 1920791 - DNA, 22 bp, Homo sapiens
gcaaggccacctcttcctggcc

SEQ ID NO: 1920792 - DNA, 15 bp, Homo sapiens
gcaagggaggcccag

SEQ ID NO: 1920793 - DNA, 16 bp, Homo sapiens
gcaagggcagggacag

SEQ ID NO: 1920794 - DNA, 21 bp, Homo sapiens
gcaagggcagggacagggccg

SEQ ID NO: 1920795 - DNA, 13 bp, Homo sapiens
gcaataaaactgc

SEQ ID NO: 1920796 - DNA, 15 bp, Homo sapiens
gcaataaaactgcta

SEQ ID NO: 1920797 - DNA, 17 bp, Homo sapiens
gcaataaaagcccagga

SEQ ID NO: 1920798 - DNA, 22 bp, Homo sapiens
gcaataaaagcccaggagccca

SEQ ID NO: 1920799 - DNA, 14 bp, Homo sapiens
gcaataagaacaaa

SEQ ID NO: 1920800 - DNA, 14 bp, Homo sapiens
gcaatgccccctcc

SEQ ID NO: 1920801 - DNA, 17 bp, Homo sapiens
gcaatgccccctcccct

SEQ ID NO: 1920802 - DNA, 22 bp, Homo sapiens
gcaatgccccctcccctccttt

SEQ ID NO: 1920803 - DNA, 22 bp, Homo sapiens
gcaattctcgattctttgaaga

SEQ ID NO: 1920804 - DNA, 17 bp, Homo sapiens
gcaatttctctgcacac

SEQ ID NO: 1920805 - DNA, 18 bp, Homo sapiens
gcacaaccttcaagctgc

SEQ ID NO: 1920806 - DNA, 14 bp, Homo sapiens
gcacagaaggctgg

SEQ ID NO: 1920807 - DNA, 19 bp, Homo sapiens
gcacagcgttatgtgtctg

SEQ ID NO: 1920808 - DNA, 20 bp, Homo sapiens
gcacaggcagggcaggacca

SEQ ID NO: 1920809 - DNA, 20 bp, Homo sapiens
gcacaggctgagtgcaggcc

SEQ ID NO: 1920810 - DNA, 17 bp, Homo sapiens
gcacagggcctggccca

SEQ ID NO: 1920811 - DNA, 21 bp, Homo sapiens
gcacattccaattgtgcagtg

SEQ ID NO: 1920812 - DNA, 17 bp, Homo sapiens
gcaccaaaataagaaaa

SEQ ID NO: 1920813 - DNA, 18 bp, Homo sapiens
gcaccaaaataagaaaag

SEQ ID NO: 1920814 - DNA, 19 bp, Homo sapiens
gcaccaaaataagaaaaga

SEQ ID NO: 1920815 - DNA, 14 bp, Homo sapiens
gcaccatcccctcc

SEQ ID NO: 1920816 - DNA, 20 bp, Homo sapiens
gcacccttccatctgattcc

SEQ ID NO: 1920817 - DNA, 12 bp, Homo sapiens
gcacctgggttg

SEQ ID NO: 1920818 - DNA, 13 bp, Homo sapiens
gcacgcctctccc

SEQ ID NO: 1920819 - DNA, 14 bp, Homo sapiens
gcacgcctctcccc

SEQ ID NO: 1920820 - DNA, 16 bp, Homo sapiens
gcacgcctctccccac

SEQ ID NO: 1920821 - DNA, 17 bp, Homo sapiens
gcacgcctctccccacc

SEQ ID NO: 1920822 - DNA, 17 bp, Homo sapiens
gcactaatgttttggtc

SEQ ID NO: 1920823 - DNA, 16 bp, Homo sapiens
gcactacttgcttata

SEQ ID NO: 1920824 - DNA, 15 bp, Homo sapiens
gcactgctctcacct

SEQ ID NO: 1920825 - DNA, 19 bp, Homo sapiens
gcactggattgtagaactt

SEQ ID NO: 1920826 - DNA, 14 bp, Homo sapiens
gcacttcaggaggc

SEQ ID NO: 1920827 - DNA, 19 bp, Homo sapiens
gcagaactgcagtcactgc

SEQ ID NO: 1920828 - DNA, 23 bp, Homo sapiens
gcagaacttccctccatccaccc

SEQ ID NO: 1920829 - DNA, 23 bp, Homo sapiens
gcagactgttctaaaatataata

SEQ ID NO: 1920830 - DNA, 17 bp, Homo sapiens
gcagacttttaaagact

SEQ ID NO: 1920831 - DNA, 11 bp, Homo sapiens
gcagaggtggt

SEQ ID NO: 1920832 - DNA, 18 bp, Homo sapiens
gcagcaggagggactctg

SEQ ID NO: 1920833 - DNA, 20 bp, Homo sapiens
gcagcctctgatctgtgcag

SEQ ID NO: 1920834 - DNA, 15 bp, Homo sapiens
gcagcgaggctgggc

SEQ ID NO: 1920835 - DNA, 16 bp, Homo sapiens
gcagcgaggctgggct

SEQ ID NO: 1920836 - DNA, 21 bp, Homo sapiens
gcagcgcggatttctctttct

SEQ ID NO: 1920837 - DNA, 11 bp, Homo sapiens
gcagctgtcac

SEQ ID NO: 1920838 - DNA, 12 bp, Homo sapiens
gcagctgtcacc

SEQ ID NO: 1920839 - DNA, 16 bp, Homo sapiens
gcagcttgggctggcg

SEQ ID NO: 1920840 - DNA, 22 bp, Homo sapiens
gcagcttgggctggcgggccct

SEQ ID NO: 1920841 - DNA, 18 bp, Homo sapiens
gcaggaccagcccacgct

SEQ ID NO: 1920842 - DNA, 19 bp, Homo sapiens
gcaggaccagcccacgctg

SEQ ID NO: 1920843 - DNA, 22 bp, Homo sapiens
gcaggaccagcccacgctgact

SEQ ID NO: 1920844 - DNA, 22 bp, Homo sapiens
gcaggagcagtatcatgaagcc

SEQ ID NO: 1920845 - DNA, 15 bp, Homo sapiens
gcaggagggactctg

SEQ ID NO: 1920846 - DNA, 21 bp, Homo sapiens
gcaggagggactctgtctggc

SEQ ID NO: 1920847 - DNA, 11 bp, Homo sapiens
gcaggcccacc

SEQ ID NO: 1920848 - DNA, 14 bp, Homo sapiens
gcaggcccaccctg

SEQ ID NO: 1920849 - DNA, 15 bp, Homo sapiens
gcaggcccaccctgc

SEQ ID NO: 1920850 - DNA, 23 bp, Homo sapiens
gcaggcccccggggaggggccag

SEQ ID NO: 1920851 - DNA, 15 bp, Homo sapiens
gcaggccctgggcct

SEQ ID NO: 1920852 - DNA, 16 bp, Homo sapiens
gcaggccctgggcctc

SEQ ID NO: 1920853 - DNA, 22 bp, Homo sapiens
gcaggccctgggcctccacctc

SEQ ID NO: 1920854 - DNA, 23 bp, Homo sapiens
gcaggccctgggcctccacctct

SEQ ID NO: 1920855 - DNA, 15 bp, Homo sapiens
gcaggctcctcagcc

SEQ ID NO: 1920856 - DNA, 17 bp, Homo sapiens
gccgttgctgacttaga

SEQ ID NO: 1920857 - DNA, 19 bp, Homo sapiens
gcctacatgctttgtgaac

SEQ ID NO: 1920858 - DNA, 22 bp, Homo sapiens
gcctataagccaaaattaaggt

SEQ ID NO: 1920859 - DNA, 18 bp, Homo sapiens
gcctcaaatccaggaccc

SEQ ID NO: 1920860 - DNA, 19 bp, Homo sapiens
gcctcaaatccaggaccct

SEQ ID NO: 1920861 - DNA, 14 bp, Homo sapiens
gcctcacgaaactg

SEQ ID NO: 1920862 - DNA, 16 bp, Homo sapiens
gcctcagcttccccag

SEQ ID NO: 1920863 - DNA, 12 bp, Homo sapiens
gcctcagggctc

SEQ ID NO: 1920864 - DNA, 19 bp, Homo sapiens
gcctcatgtcaaatattta

SEQ ID NO: 1920865 - DNA, 21 bp, Homo sapiens
gcctccaacccctcgcccagt

SEQ ID NO: 1920866 - DNA, 22 bp, Homo sapiens
gcctccaacccctcgcccagtc

SEQ ID NO: 1920867 - DNA, 22 bp, Homo sapiens
gcctccaattttttaagtgaaa

SEQ ID NO: 1920868 - DNA, 13 bp, Homo sapiens
gcctccacctctg

SEQ ID NO: 1920869 - DNA, 14 bp, Homo sapiens
gcctcccactccca

SEQ ID NO: 1920870 - DNA, 16 bp, Homo sapiens
gcctccgcttccctgg

SEQ ID NO: 1920871 - DNA, 12 bp, Homo sapiens
gcctctccccac

SEQ ID NO: 1920872 - DNA, 20 bp, Homo sapiens
gcctctccgcccctgagccc

SEQ ID NO: 1920873 - DNA, 16 bp, Homo sapiens
gcctctgatctgtgca

SEQ ID NO: 1920874 - DNA, 17 bp, Homo sapiens
gcctctgcaaaggaaat

SEQ ID NO: 1920875 - DNA, 23 bp, Homo sapiens
gcctctgccacagcaaggctgtc

SEQ ID NO: 1920876 - DNA, 20 bp, Homo sapiens
gcctgagatggatggacaga

SEQ ID NO: 1920877 - DNA, 16 bp, Homo sapiens
gcctgatttgttcctt

SEQ ID NO: 1920878 - DNA, 23 bp, Homo sapiens
gcctgcacttgggggctcagcaa

SEQ ID NO: 1920879 - DNA, 14 bp, Homo sapiens
gcctgcctctgcca

SEQ ID NO: 1920880 - DNA, 15 bp, Homo sapiens
gcctgctctcgaggc

SEQ ID NO: 1920881 - DNA, 12 bp, Homo sapiens
gcctggcccatg

SEQ ID NO: 1920882 - DNA, 11 bp, Homo sapiens
gcctgggcctg

SEQ ID NO: 1920883 - DNA, 13 bp, Homo sapiens
gcctgggcctggc

SEQ ID NO: 1920884 - DNA, 16 bp, Homo sapiens
gcctgtcttaattttc

SEQ ID NO: 1920885 - DNA, 16 bp, Homo sapiens
gccttaaaacatcatt

SEQ ID NO: 1920886 - DNA, 19 bp, Homo sapiens
gccttaaaacatcattcct

SEQ ID NO: 1920887 - DNA, 20 bp, Homo sapiens
gccttagcatgtgttgcagc

SEQ ID NO: 1920888 - DNA, 18 bp, Homo sapiens
gccttcgaaaagaaattg

SEQ ID NO: 1920889 - DNA, 14 bp, Homo sapiens
gcgaatcatttgtt

SEQ ID NO: 1920890 - DNA, 17 bp, Homo sapiens
gcgaccagcaggctcct

SEQ ID NO: 1920891 - DNA, 13 bp, Homo sapiens
gcgaggctgggct

SEQ ID NO: 1920892 - DNA, 21 bp, Homo sapiens
gcgatgttagttttagaatta

SEQ ID NO: 1920893 - DNA, 21 bp, Homo sapiens
gcgattctcttgcctcagctt

SEQ ID NO: 1920894 - DNA, 17 bp, Homo sapiens
gcgccactgtccgctgt

SEQ ID NO: 1920895 - DNA, 14 bp, Homo sapiens
gcgcccccactcct

SEQ ID NO: 1920896 - DNA, 17 bp, Homo sapiens
gcgcccccactcctcct

SEQ ID NO: 1920897 - DNA, 18 bp, Homo sapiens
gcgcccccactcctcctc

SEQ ID NO: 1920898 - DNA, 15 bp, Homo sapiens
gcgccctggccccca

SEQ ID NO: 1920899 - DNA, 13 bp, Homo sapiens
gcggccctcccag

SEQ ID NO: 1920900 - DNA, 15 bp, Homo sapiens
gcggccctcccaggc

SEQ ID NO: 1920901 - DNA, 16 bp, Homo sapiens
gcggccctcccaggcg

SEQ ID NO: 1920902 - DNA, 18 bp, Homo sapiens
gcgtatggctttattttt

SEQ ID NO: 1920903 - DNA, 22 bp, Homo sapiens
gcgttagaggggccagcggccc

SEQ ID NO: 1920904 - DNA, 22 bp, Homo sapiens
gctaaaggttaccgatttcaaa

SEQ ID NO: 1920905 - DNA, 19 bp, Homo sapiens
gctaaggccaatgggctag

SEQ ID NO: 1920906 - DNA, 19 bp, Homo sapiens
gctagctaagccaagaggc

SEQ ID NO: 1920907 - DNA, 13 bp, Homo sapiens
gctagttgaatac

SEQ ID NO: 1920908 - DNA, 16 bp, Homo sapiens
gctagttgaatacttg

SEQ ID NO: 1920909 - DNA, 11 bp, Homo sapiens
gctatgactta

SEQ ID NO: 1920910 - DNA, 23 bp, Homo sapiens
gctattacgaagttcaagatcaa

SEQ ID NO: 1920911 - DNA, 16 bp, Homo sapiens
gctcagcaaggccacc

SEQ ID NO: 1920912 - DNA, 18 bp, Homo sapiens
gctcagcaaggccacctc

SEQ ID NO: 1920913 - DNA, 19 bp, Homo sapiens
gctcagcaaggccacctct

SEQ ID NO: 1920914 - DNA, 21 bp, Homo sapiens
gctcatttggggaccacagag

SEQ ID NO: 1920915 - DNA, 21 bp, Homo sapiens
gctccattcatacacaacgta

SEQ ID NO: 1920916 - DNA, 17 bp, Homo sapiens
gctcccacttctgccag

SEQ ID NO: 1920917 - DNA, 18 bp, Homo sapiens
gctcccacttctgccaga

SEQ ID NO: 1920918 - DNA, 13 bp, Homo sapiens
gctcccaggagcc

SEQ ID NO: 1920919 - DNA, 21 bp, Homo sapiens
gctcccaggagcctgcccagc

SEQ ID NO: 1920920 - DNA, 17 bp, Homo sapiens
gctccctcccctgctca

SEQ ID NO: 1920921 - DNA, 14 bp, Homo sapiens
gctcctcagccctc

SEQ ID NO: 1920922 - DNA, 15 bp, Homo sapiens
gctcctcagccctct

SEQ ID NO: 1920923 - DNA, 12 bp, Homo sapiens
gctcctgagccc

SEQ ID NO: 1920924 - DNA, 12 bp, Homo sapiens
gctcctttctga

SEQ ID NO: 1920925 - DNA, 13 bp, Homo sapiens
gctcgagctcggg

SEQ ID NO: 1920926 - DNA, 18 bp, Homo sapiens
gctcgagctcggggctgg

SEQ ID NO: 1920927 - DNA, 20 bp, Homo sapiens
gctcggggctgggggctgca

SEQ ID NO: 1920928 - DNA, 19 bp, Homo sapiens
gctctcaccttggttcctg

SEQ ID NO: 1920929 - DNA, 21 bp, Homo sapiens
gctctcaccttggttcctggg

SEQ ID NO: 1920930 - DNA, 16 bp, Homo sapiens
gctctccatactttga

SEQ ID NO: 1920931 - DNA, 17 bp, Homo sapiens
gctctcttttattctgt

SEQ ID NO: 1920932 - DNA, 18 bp, Homo sapiens
gctctgaattcaggtccc

SEQ ID NO: 1920933 - DNA, 16 bp, Homo sapiens
gctctgttgcccaggc

SEQ ID NO: 1920934 - DNA, 23 bp, Homo sapiens
gctctgttgcccaggctggagtg

SEQ ID NO: 1920935 - DNA, 12 bp, Homo sapiens
gctcttttccta

SEQ ID NO: 1920936 - DNA, 13 bp, Homo sapiens
gctgaagtgcatg

SEQ ID NO: 1920937 - DNA, 14 bp, Homo sapiens
gctgacccatgggc

SEQ ID NO: 1920938 - DNA, 13 bp, Homo sapiens
gctgaggcccatg

SEQ ID NO: 1920939 - DNA, 16 bp, Homo sapiens
gctgaggcccatggcc

SEQ ID NO: 1920940 - DNA, 22 bp, Homo sapiens
gctgaggctgctgccaggcccg

SEQ ID NO: 1920941 - DNA, 23 bp, Homo sapiens
gctgaggctgctgccaggcccgg

SEQ ID NO: 1920942 - DNA, 22 bp, Homo sapiens
gctgagtgaggaatggcagtga

SEQ ID NO: 1920943 - DNA, 18 bp, Homo sapiens
gctgagtgcaggcccacc

SEQ ID NO: 1920944 - DNA, 23 bp, Homo sapiens
gctgagtgcaggcccaccctgct

SEQ ID NO: 1920945 - DNA, 22 bp, Homo sapiens
gctgagtgttctgggatttctc

SEQ ID NO: 1920946 - DNA, 20 bp, Homo sapiens
gctgattttgaccttgtatt

SEQ ID NO: 1920947 - DNA, 13 bp, Homo sapiens
gctgcagagcagt

SEQ ID NO: 1920948 - DNA, 14 bp, Homo sapiens
gctgcagggctggg

SEQ ID NO: 1920949 - DNA, 18 bp, Homo sapiens
gctgcatccccttccagc

SEQ ID NO: 1920950 - DNA, 21 bp, Homo sapiens
gctgcatccccttccagctcc

SEQ ID NO: 1920951 - DNA, 12 bp, Homo sapiens
gctgctgagccg

SEQ ID NO: 1920952 - DNA, 14 bp, Homo sapiens
gctgctgagccgca

SEQ ID NO: 1920953 - DNA, 16 bp, Homo sapiens
gctgctgagccgcaga

SEQ ID NO: 1920954 - DNA, 20 bp, Homo sapiens
gctgctgagccgcagagaag

SEQ ID NO: 1920955 - DNA, 13 bp, Homo sapiens
gctgctgccaggc

SEQ ID NO: 1920956 - DNA, 15 bp, Homo sapiens
gctgctgccaggccc

SEQ ID NO: 1920957 - DNA, 18 bp, Homo sapiens
gctggaaaggccagcagc

SEQ ID NO: 1920958 - DNA, 23 bp, Homo sapiens
gctggaaaggccagcagccttcc

SEQ ID NO: 1920959 - DNA, 14 bp, Homo sapiens
gctggaatattaaa

SEQ ID NO: 1920960 - DNA, 17 bp, Homo sapiens
gctggagaggagccctg

SEQ ID NO: 1920961 - DNA, 15 bp, Homo sapiens
gctggagtctgggct

SEQ ID NO: 1920962 - DNA, 16 bp, Homo sapiens
gctggcgggccctgga

SEQ ID NO: 1920963 - DNA, 23 bp, Homo sapiens
gctggggaagaatttactttgga

SEQ ID NO: 1920964 - DNA, 14 bp, Homo sapiens
gctggtaaaatgaa

SEQ ID NO: 1920965 - DNA, 18 bp, Homo sapiens
gctggtaaaatgaagaat

SEQ ID NO: 1920966 - DNA, 17 bp, Homo sapiens
gctgtaaggcatgaagg

SEQ ID NO: 1920967 - DNA, 13 bp, Homo sapiens
gctgtgaaaaaaa

SEQ ID NO: 1920968 - DNA, 22 bp, Homo sapiens
gctgtgaacatgcctcctcctg

SEQ ID NO: 1920969 - DNA, 14 bp, Homo sapiens
gctgtgtgtggctt

SEQ ID NO: 1920970 - DNA, 22 bp, Homo sapiens
gctgttacttgctttgagttgg

SEQ ID NO: 1920971 - DNA, 23 bp, Homo sapiens
gctgttaggggttattggtgtaa

SEQ ID NO: 1920972 - DNA, 23 bp, Homo sapiens
gcttaaggtggaaagtgttcatt

SEQ ID NO: 1920973 - DNA, 19 bp, Homo sapiens
gcttacatttgaataatgt

SEQ ID NO: 1920974 - DNA, 22 bp, Homo sapiens
gcttacgtagttctaccggctt

SEQ ID NO: 1920975 - DNA, 13 bp, Homo sapiens
gcttataaaacag

SEQ ID NO: 1920976 - DNA, 20 bp, Homo sapiens
gcttccagcaggagggacag

SEQ ID NO: 1920977 - DNA, 16 bp, Homo sapiens
gcttccccagtagctg

SEQ ID NO: 1920978 - DNA, 17 bp, Homo sapiens
gcttcctataattttga

SEQ ID NO: 1920979 - DNA, 23 bp, Homo sapiens
gcttcctataattttgatagtgg

SEQ ID NO: 1920980 - DNA, 13 bp, Homo sapiens
gcttcctctgctg

SEQ ID NO: 1920981 - DNA, 15 bp, Homo sapiens
gcttcctctgctgca

SEQ ID NO: 1920982 - DNA, 16 bp, Homo sapiens
gcttcctctgctgcat

SEQ ID NO: 1920983 - DNA, 17 bp, Homo sapiens
gcttcctctgctgcatc

SEQ ID NO: 1920984 - DNA, 21 bp, Homo sapiens
gcttcctctgctgcatcccct

SEQ ID NO: 1920985 - DNA, 15 bp, Homo sapiens
gcttctcccaacact

SEQ ID NO: 1920986 - DNA, 16 bp, Homo sapiens
gcttctcccaacactc

SEQ ID NO: 1920987 - DNA, 23 bp, Homo sapiens
gcttctctgtttttcttctgaaa

SEQ ID NO: 1920988 - DNA, 20 bp, Homo sapiens
ggtagaggtgcatgcctaat

SEQ ID NO: 1920989 - DNA, 22 bp, Homo sapiens
ggtagttcaagaaatgaagagc

SEQ ID NO: 1920990 - DNA, 15 bp, Homo sapiens
ggtatcaagaaagtc

SEQ ID NO: 1920991 - DNA, 22 bp, Homo sapiens
ggtattaacgtgtcagggctga

SEQ ID NO: 1920992 - DNA, 14 bp, Homo sapiens
ggtatttgtttaat

SEQ ID NO: 1920993 - DNA, 15 bp, Homo sapiens
ggtcacttcgtggct

SEQ ID NO: 1920994 - DNA, 14 bp, Homo sapiens
ggtcagggtgtgag

SEQ ID NO: 1920995 - DNA, 19 bp, Homo sapiens
ggtcagggtgtgaggccac

SEQ ID NO: 1920996 - DNA, 21 bp, Homo sapiens
ggtccagaaggagcaggccct

SEQ ID NO: 1920997 - DNA, 14 bp, Homo sapiens
ggtcgggggggacc

SEQ ID NO: 1920998 - DNA, 16 bp, Homo sapiens
ggtctatcttgtaaat

SEQ ID NO: 1920999 - DNA, 19 bp, Homo sapiens
ggtctcggatcaggctccc

SEQ ID NO: 1921000 - DNA, 16 bp, Homo sapiens
ggtctcgggggtgggc

SEQ ID NO: 1921001 - DNA, 16 bp, Homo sapiens
ggtctctagtgctgtg

SEQ ID NO: 1921002 - DNA, 21 bp, Homo sapiens
ggtctctcacagacaggaccc

SEQ ID NO: 1921003 - DNA, 23 bp, Homo sapiens
ggtctctcacagacaggacccct

SEQ ID NO: 1921004 - DNA, 16 bp, Homo sapiens
ggtctctcccagctct

SEQ ID NO: 1921005 - DNA, 21 bp, Homo sapiens
ggtctgagttgttaccccaag

SEQ ID NO: 1921006 - DNA, 16 bp, Homo sapiens
ggtctgtcagggttgg

SEQ ID NO: 1921007 - DNA, 13 bp, Homo sapiens
ggtcttatattta

SEQ ID NO: 1921008 - DNA, 22 bp, Homo sapiens
ggtgacctcacacacctctgcc

SEQ ID NO: 1921009 - DNA, 23 bp, Homo sapiens
ggtgacctcacacacctctgccc

SEQ ID NO: 1921010 - DNA, 22 bp, Homo sapiens
ggtgatggaacaagagaagtac

SEQ ID NO: 1921011 - DNA, 22 bp, Homo sapiens
ggtgcacgctggggaagaattt

SEQ ID NO: 1921012 - DNA, 14 bp, Homo sapiens
ggtggccccttcta

SEQ ID NO: 1921013 - DNA, 12 bp, Homo sapiens
ggtgtgaggcca

SEQ ID NO: 1921014 - DNA, 15 bp, Homo sapiens
ggtgtgaggccacac

SEQ ID NO: 1921015 - DNA, 14 bp, Homo sapiens
ggtgtgctatagct

SEQ ID NO: 1921016 - DNA, 23 bp, Homo sapiens
ggtgtgggggccccgtctcaggt

SEQ ID NO: 1921017 - DNA, 20 bp, Homo sapiens
ggtgtttgaaaatagtttat

SEQ ID NO: 1921018 - DNA, 23 bp, Homo sapiens
ggttacttcagccaccctttctg

SEQ ID NO: 1921019 - DNA, 16 bp, Homo sapiens
ggttcaccattgagac

SEQ ID NO: 1921020 - DNA, 18 bp, Homo sapiens
ggttcctacacaggacag

SEQ ID NO: 1921021 - DNA, 16 bp, Homo sapiens
ggttgctcctttgatt

SEQ ID NO: 1921022 - DNA, 19 bp, Homo sapiens
ggttgggacccagtggcag

SEQ ID NO: 1921023 - DNA, 22 bp, Homo sapiens
ggtttcacatggttacatatca

SEQ ID NO: 1921024 - DNA, 19 bp, Homo sapiens
ggtttcaccatgttggcca

SEQ ID NO: 1921025 - DNA, 13 bp, Homo sapiens
ggtttcagggctg

SEQ ID NO: 1921026 - DNA, 20 bp, Homo sapiens
ggttttcttttttccccttt

SEQ ID NO: 1921027 - DNA, 18 bp, Homo sapiens
gtaaaagaacagtaaaca

SEQ ID NO: 1921028 - DNA, 17 bp, Homo sapiens
gtaaaatgaagaattta

SEQ ID NO: 1921029 - DNA, 13 bp, Homo sapiens
gtaaataattctt

SEQ ID NO: 1921030 - DNA, 15 bp, Homo sapiens
gtaaataattctttt

SEQ ID NO: 1921031 - DNA, 18 bp, Homo sapiens
gtaaatgtattcattctt

SEQ ID NO: 1921032 - DNA, 19 bp, Homo sapiens
gtaaatgtattcattctta

SEQ ID NO: 1921033 - DNA, 14 bp, Homo sapiens
gtaaattctgattt

SEQ ID NO: 1921034 - DNA, 18 bp, Homo sapiens
gtaaattctgatttcttt

SEQ ID NO: 1921035 - DNA, 19 bp, Homo sapiens
gtaaatttagcatatcaat

SEQ ID NO: 1921036 - DNA, 17 bp, Homo sapiens
gtaacaaagtttgctga

SEQ ID NO: 1921037 - DNA, 22 bp, Homo sapiens
gtaacaaagtttgctgaaagat

SEQ ID NO: 1921038 - DNA, 13 bp, Homo sapiens
gtaactaaaataa

SEQ ID NO: 1921039 - DNA, 20 bp, Homo sapiens
gtaactaaaataattttgta

SEQ ID NO: 1921040 - DNA, 14 bp, Homo sapiens
gtaagagtgtttat

SEQ ID NO: 1921041 - DNA, 21 bp, Homo sapiens
gtaagctggtttacagatgtt

SEQ ID NO: 1921042 - DNA, 24 bp, Homo sapiens
gtaaggactttggcttacatttga

SEQ ID NO: 1921043 - DNA, 13 bp, Homo sapiens
gtaaggttttttt

SEQ ID NO: 1921044 - DNA, 18 bp, Homo sapiens
gtaatagtcttgcagaaa

SEQ ID NO: 1921045 - DNA, 19 bp, Homo sapiens
gtaatgtatcaaatacatt

SEQ ID NO: 1921046 - DNA, 17 bp, Homo sapiens
gtaattgtagacctgtt

SEQ ID NO: 1921047 - DNA, 21 bp, Homo sapiens
gtaattgttgtttgtatgtat

SEQ ID NO: 1921048 - DNA, 23 bp, Homo sapiens
gtaattgttgtttgtatgtataa

SEQ ID NO: 1921049 - DNA, 14 bp, Homo sapiens
gtacaagtagttct

SEQ ID NO: 1921050 - DNA, 16 bp, Homo sapiens
gtacaagtagttctgt

SEQ ID NO: 1921051 - DNA, 21 bp, Homo sapiens
gtacaagtagttctgtatttg

SEQ ID NO: 1921052 - DNA, 22 bp, Homo sapiens
gtacaagtagttctgtatttga

SEQ ID NO: 1921053 - DNA, 16 bp, Homo sapiens
gtacagatatgcaaat

SEQ ID NO: 1921054 - DNA, 12 bp, Homo sapiens
gtacatgggact

SEQ ID NO: 1921055 - DNA, 22 bp, Homo sapiens
gtaccatttaatggggaggaca

SEQ ID NO: 1921056 - DNA, 23 bp, Homo sapiens
gtaccatttaatggggaggacaa

SEQ ID NO: 1921057 - DNA, 19 bp, Homo sapiens
gtacgacgtcagatgttta

SEQ ID NO: 1921058 - DNA, 19 bp, Homo sapiens
gtactagtggcatggagaa

SEQ ID NO: 1921059 - DNA, 17 bp, Homo sapiens
gtactgtctcggcagag

SEQ ID NO: 1921060 - DNA, 22 bp, Homo sapiens
gtactttcatattttaaacaga

SEQ ID NO: 1921061 - DNA, 14 bp, Homo sapiens
gtactttctgaaaa

SEQ ID NO: 1921062 - DNA, 19 bp, Homo sapiens
gtactttctgaaaatttat

SEQ ID NO: 1921063 - DNA, 23 bp, Homo sapiens
gtactttgaaaacaccagctgta

SEQ ID NO: 1921064 - DNA, 14 bp, Homo sapiens
gtagaactttgtat

SEQ ID NO: 1921065 - DNA, 21 bp, Homo sapiens
gtagaactttgtatagttatg

SEQ ID NO: 1921066 - DNA, 15 bp, Homo sapiens
gtagacattttgaaa

SEQ ID NO: 1921067 - DNA, 20 bp, Homo sapiens
gtagccatgaggaggcagag

SEQ ID NO: 1921068 - DNA, 24 bp, Homo sapiens
gtagcctgaagagtttgtaaatga

SEQ ID NO: 1921069 - DNA, 16 bp, Homo sapiens
gtagctcgtcctcact

SEQ ID NO: 1921070 - DNA, 22 bp, Homo sapiens
gtaggcagcctgagagtctaga

SEQ ID NO: 1921071 - DNA, 20 bp, Homo sapiens
gtaggggggtttcagggctg

SEQ ID NO: 1921072 - DNA, 18 bp, Homo sapiens
gtagtgtgttttcataac

SEQ ID NO: 1921073 - DNA, 14 bp, Homo sapiens
gtagtgtttctttt

SEQ ID NO: 1921074 - DNA, 14 bp, Homo sapiens
gtagttctgtattt

SEQ ID NO: 1921075 - DNA, 18 bp, Homo sapiens
gtagttctgtatttgaaa

SEQ ID NO: 1921076 - DNA, 20 bp, Homo sapiens
gtagttctgtatttgaaagt

SEQ ID NO: 1921077 - DNA, 14 bp, Homo sapiens
gtagttctttaaac

SEQ ID NO: 1921078 - DNA, 12 bp, Homo sapiens
gtataaatttat

SEQ ID NO: 1921079 - DNA, 23 bp, Homo sapiens
gtataaatttatttactgctagt

SEQ ID NO: 1921080 - DNA, 22 bp, Homo sapiens
gtataattcacccaccagactt

SEQ ID NO: 1921081 - DNA, 12 bp, Homo sapiens
gtatacttgaaa

SEQ ID NO: 1921082 - DNA, 23 bp, Homo sapiens
gtatagtttaaaaatctgccacc

SEQ ID NO: 1921083 - DNA, 20 bp, Homo sapiens
gtatatattcccctaagatt

SEQ ID NO: 1921084 - DNA, 18 bp, Homo sapiens
gtatatttgatttattaa

SEQ ID NO: 1921085 - DNA, 14 bp, Homo sapiens
gtatcaaactgctt

SEQ ID NO: 1921086 - DNA, 14 bp, Homo sapiens
gtatcaaatacatt

SEQ ID NO: 1921087 - DNA, 15 bp, Homo sapiens
gtatccaatgaaata

SEQ ID NO: 1921088 - DNA, 18 bp, Homo sapiens
gtatctaaatttggaact

SEQ ID NO: 1921089 - DNA, 17 bp, Homo sapiens
gtatgaaaacatggaac

SEQ ID NO: 1921090 - DNA, 14 bp, Homo sapiens
gtatgatctgtgta

SEQ ID NO: 1921091 - DNA, 22 bp, Homo sapiens
gtatgtgtttagaattgaaggt

SEQ ID NO: 1921092 - DNA, 17 bp, Homo sapiens
gtattaattatttaaag

SEQ ID NO: 1921093 - DNA, 22 bp, Homo sapiens
gtattctaataagctagttgaa

SEQ ID NO: 1921094 - DNA, 15 bp, Homo sapiens
gtattctatttgtgt

SEQ ID NO: 1921095 - DNA, 14 bp, Homo sapiens
gtattctttattat

SEQ ID NO: 1921096 - DNA, 23 bp, Homo sapiens
gtattctttattatttttctctc

SEQ ID NO: 1921097 - DNA, 22 bp, Homo sapiens
gtattgattcaaatgtcagcag

SEQ ID NO: 1921098 - DNA, 10 bp, Homo sapiens
gtattgtaca

SEQ ID NO: 1921099 - DNA, 16 bp, Homo sapiens
gtatttttctatttct

SEQ ID NO: 1921100 - DNA, 17 bp, Homo sapiens
gtattttttaatgctaa

SEQ ID NO: 1921101 - DNA, 17 bp, Homo sapiens
gtcaaaagtagaacttt

SEQ ID NO: 1921102 - DNA, 22 bp, Homo sapiens
gtcagagagggaagctgaggcc

SEQ ID NO: 1921103 - DNA, 13 bp, Homo sapiens
gtcagatgtttaa

SEQ ID NO: 1921104 - DNA, 19 bp, Homo sapiens
gtcagatgtttaaaacacc

SEQ ID NO: 1921105 - DNA, 22 bp, Homo sapiens
gtcagcctccctgacgtctgcc

SEQ ID NO: 1921106 - DNA, 18 bp, Homo sapiens
gtcagggtgtgaggccac

SEQ ID NO: 1921107 - DNA, 20 bp, Homo sapiens
gtcatactcgagtctgaggc

SEQ ID NO: 1921108 - DNA, 13 bp, Homo sapiens
gtcatctgagaat

SEQ ID NO: 1921109 - DNA, 19 bp, Homo sapiens
gtcatctgagaatgaacaa

SEQ ID NO: 1921110 - DNA, 17 bp, Homo sapiens
gtcattttggtctaagg

SEQ ID NO: 1921111 - DNA, 15 bp, Homo sapiens
gtccaagttgtttca

SEQ ID NO: 1921112 - DNA, 20 bp, Homo sapiens
gtccagtaagatcactgttt

SEQ ID NO: 1921113 - DNA, 14 bp, Homo sapiens
gtccatctctgaaa

SEQ ID NO: 1921114 - DNA, 12 bp, Homo sapiens
gtcccaggcagc

SEQ ID NO: 1921115 - DNA, 15 bp, Homo sapiens
gtcccagttgctgtc

SEQ ID NO: 1921116 - DNA, 16 bp, Homo sapiens
gtccctcccctgggca

SEQ ID NO: 1921117 - DNA, 16 bp, Homo sapiens
gtccgctgtctccctc

SEQ ID NO: 1921118 - DNA, 17 bp, Homo sapiens
gtccgctgtctccctcc

SEQ ID NO: 1921119 - DNA, 12 bp, Homo sapiens
tagtagagacag

SEQ ID NO: 1921120 - DNA, 14 bp, Homo sapiens
tagtattctttatt

SEQ ID NO: 1921121 - DNA, 12 bp, Homo sapiens
tagtattgattc

SEQ ID NO: 1921122 - DNA, 23 bp, Homo sapiens
tagtcaacagtaccctggttgtg

SEQ ID NO: 1921123 - DNA, 17 bp, Homo sapiens
tagtcttaagaactgct

SEQ ID NO: 1921124 - DNA, 16 bp, Homo sapiens
tagtgctgtgaaaaaa

SEQ ID NO: 1921125 - DNA, 21 bp, Homo sapiens
tagtgtagattccatttactg

SEQ ID NO: 1921126 - DNA, 16 bp, Homo sapiens
tagtgtgttttcataa

SEQ ID NO: 1921127 - DNA, 19 bp, Homo sapiens
tagttatgtaaataattct

SEQ ID NO: 1921128 - DNA, 20 bp, Homo sapiens
tagttatgtaaataattctt

SEQ ID NO: 1921129 - DNA, 15 bp, Homo sapiens
tagttcaagaaatga

SEQ ID NO: 1921130 - DNA, 20 bp, Homo sapiens
tagttcaagaaatgaagagc

SEQ ID NO: 1921131 - DNA, 17 bp, Homo sapiens
tagttctgactttgaat

SEQ ID NO: 1921132 - DNA, 21 bp, Homo sapiens
tagttctgtatttgaaagtgc

SEQ ID NO: 1921133 - DNA, 12 bp, Homo sapiens
tagttctttaaa

SEQ ID NO: 1921134 - DNA, 20 bp, Homo sapiens
tagttgaatacttgaaccat

SEQ ID NO: 1921135 - DNA, 21 bp, Homo sapiens
tagttgaatacttgaaccata

SEQ ID NO: 1921136 - DNA, 17 bp, Homo sapiens
tagtttattttaaaaca

SEQ ID NO: 1921137 - DNA, 14 bp, Homo sapiens
tagtttctgtggtt

SEQ ID NO: 1921138 - DNA, 21 bp, Homo sapiens
tagttttatttatatttattg

SEQ ID NO: 1921139 - DNA, 14 bp, Homo sapiens
tataaagtattttt

SEQ ID NO: 1921140 - DNA, 20 bp, Homo sapiens
tataaattgtcttaatggat

SEQ ID NO: 1921141 - DNA, 14 bp, Homo sapiens
tataaatttattta

SEQ ID NO: 1921142 - DNA, 15 bp, Homo sapiens
tataaatttatttac

SEQ ID NO: 1921143 - DNA, 22 bp, Homo sapiens
tataaatttatttactgctagt

SEQ ID NO: 1921144 - DNA, 17 bp, Homo sapiens
tataactgttgttgata

SEQ ID NO: 1921145 - DNA, 19 bp, Homo sapiens
tataactgttgttgataag

SEQ ID NO: 1921146 - DNA, 16 bp, Homo sapiens
tataagcaaaatgaaa

SEQ ID NO: 1921147 - DNA, 19 bp, Homo sapiens
tataagccaaaattaaggt

SEQ ID NO: 1921148 - DNA, 17 bp, Homo sapiens
tataatgaataaacagt

SEQ ID NO: 1921149 - DNA, 17 bp, Homo sapiens
tataattgatgatgttg

SEQ ID NO: 1921150 - DNA, 23 bp, Homo sapiens
tatacaaatttaacttttaaaga

SEQ ID NO: 1921151 - DNA, 23 bp, Homo sapiens
tatacatgtttgcagtgttaaga

SEQ ID NO: 1921152 - DNA, 24 bp, Homo sapiens
tatagaaaggagacctgtatcaaa

SEQ ID NO: 1921153 - DNA, 16 bp, Homo sapiens
tatagatatatttggc

SEQ ID NO: 1921154 - DNA, 16 bp, Homo sapiens
tatagcatcacttaaa

SEQ ID NO: 1921155 - DNA, 14 bp, Homo sapiens
tatatgtatgtgtt

SEQ ID NO: 1921156 - DNA, 17 bp, Homo sapiens
tatattggttttatgat

SEQ ID NO: 1921157 - DNA, 19 bp, Homo sapiens
tatattgtaagaaatactg

SEQ ID NO: 1921158 - DNA, 18 bp, Homo sapiens
tatatttacaacacttta

SEQ ID NO: 1921159 - DNA, 12 bp, Homo sapiens
tatatttattga

SEQ ID NO: 1921160 - DNA, 13 bp, Homo sapiens
tatatttattgac

SEQ ID NO: 1921161 - DNA, 12 bp, Homo sapiens
tatatttcaagt

SEQ ID NO: 1921162 - DNA, 13 bp, Homo sapiens
tatatttgattta

SEQ ID NO: 1921163 - DNA, 16 bp, Homo sapiens
tatatttgatttatta

SEQ ID NO: 1921164 - DNA, 17 bp, Homo sapiens
tatatttgatttattaa

SEQ ID NO: 1921165 - DNA, 16 bp, Homo sapiens
tatatttggcttatat

SEQ ID NO: 1921166 - DNA, 18 bp, Homo sapiens
tatatttttatatgtgga

SEQ ID NO: 1921167 - DNA, 12 bp, Homo sapiens
tatcaaaacatc

SEQ ID NO: 1921168 - DNA, 14 bp, Homo sapiens
tatcaaattaattg

SEQ ID NO: 1921169 - DNA, 19 bp, Homo sapiens
tatcaaattaattgtgtga

SEQ ID NO: 1921170 - DNA, 21 bp, Homo sapiens
tatcaaattaattgtgtgaac

SEQ ID NO: 1921171 - DNA, 18 bp, Homo sapiens
tatcagttttatagcttt

SEQ ID NO: 1921172 - DNA, 15 bp, Homo sapiens
tatccaggaattgat

SEQ ID NO: 1921173 - DNA, 19 bp, Homo sapiens
tatctaataatgaagtgtt

SEQ ID NO: 1921174 - DNA, 15 bp, Homo sapiens
tatctagtgtttgat

SEQ ID NO: 1921175 - DNA, 21 bp, Homo sapiens
tatctgatatcagcactggat

SEQ ID NO: 1921176 - DNA, 15 bp, Homo sapiens
tatctgtaagagtgt

SEQ ID NO: 1921177 - DNA, 15 bp, Homo sapiens
tatcttgtaaatatt

SEQ ID NO: 1921178 - DNA, 18 bp, Homo sapiens
tatgaaaacatggaacag

SEQ ID NO: 1921179 - DNA, 21 bp, Homo sapiens
tatgaaaacatggaacagtgt

SEQ ID NO: 1921180 - DNA, 20 bp, Homo sapiens
tatgaaattttttttcatgc

SEQ ID NO: 1921181 - DNA, 14 bp, Homo sapiens
tatgaacagacttt

SEQ ID NO: 1921182 - DNA, 13 bp, Homo sapiens
tatgaatactttg

SEQ ID NO: 1921183 - DNA, 20 bp, Homo sapiens
tatgatgttagttttcctta

SEQ ID NO: 1921184 - DNA, 17 bp, Homo sapiens
tatgcccagctgtgctg

SEQ ID NO: 1921185 - DNA, 20 bp, Homo sapiens
tatgcttgtaactaaaataa

SEQ ID NO: 1921186 - DNA, 17 bp, Homo sapiens
tatgcttttaaactgat

SEQ ID NO: 1921187 - DNA, 14 bp, Homo sapiens
tatgtaaataattc

SEQ ID NO: 1921188 - DNA, 20 bp, Homo sapiens
tatgtaaatggtatgtcatt

SEQ ID NO: 1921189 - DNA, 21 bp, Homo sapiens
tatgtaaatggtatgtcattc

SEQ ID NO: 1921190 - DNA, 20 bp, Homo sapiens
tatgtatatttttgatcttt

SEQ ID NO: 1921191 - DNA, 22 bp, Homo sapiens
tatgtatatttttgatctttga

SEQ ID NO: 1921192 - DNA, 15 bp, Homo sapiens
tatgtatgtgtttag

SEQ ID NO: 1921193 - DNA, 16 bp, Homo sapiens
tatgtattctgtaaaa

SEQ ID NO: 1921194 - DNA, 12 bp, Homo sapiens
tatgtgagaaca

SEQ ID NO: 1921195 - DNA, 13 bp, Homo sapiens
tatgttatttgat

SEQ ID NO: 1921196 - DNA, 19 bp, Homo sapiens
tatgttatttgatgactga

SEQ ID NO: 1921197 - DNA, 16 bp, Homo sapiens
tatgttttcacagtca

SEQ ID NO: 1921198 - DNA, 14 bp, Homo sapiens
tatgtttttgaagg

SEQ ID NO: 1921199 - DNA, 23 bp, Homo sapiens
tattaaatttttttgtatgaaaa

SEQ ID NO: 1921200 - DNA, 16 bp, Homo sapiens
tattaacttaataatc

SEQ ID NO: 1921201 - DNA, 18 bp, Homo sapiens
tattaacttaataatcaa

SEQ ID NO: 1921202 - DNA, 16 bp, Homo sapiens
tattaatcactgtgta

SEQ ID NO: 1921203 - DNA, 19 bp, Homo sapiens
tattaatcactgtgtatat

SEQ ID NO: 1921204 - DNA, 20 bp, Homo sapiens
tattaatcactgtgtatatt

SEQ ID NO: 1921205 - DNA, 22 bp, Homo sapiens
tattactagactgccacaagga

SEQ ID NO: 1921206 - DNA, 23 bp, Homo sapiens
tattagcagctgactttcaaagt

SEQ ID NO: 1921207 - DNA, 19 bp, Homo sapiens
tattaggaaaagatatttt

SEQ ID NO: 1921208 - DNA, 20 bp, Homo sapiens
tattaggaaaagatattttt

SEQ ID NO: 1921209 - DNA, 16 bp, Homo sapiens
tattagtgttatatga

SEQ ID NO: 1921210 - DNA, 17 bp, Homo sapiens
tattagtgttatatgaa

SEQ ID NO: 1921211 - DNA, 21 bp, Homo sapiens
tattagtgttatatgaacata

SEQ ID NO: 1921212 - DNA, 17 bp, Homo sapiens
tattcctctgctgaaca

SEQ ID NO: 1921213 - DNA, 21 bp, Homo sapiens
tattctaaaaaaataaacaaa

SEQ ID NO: 1921214 - DNA, 15 bp, Homo sapiens
tattctattttacaa

SEQ ID NO: 1921215 - DNA, 14 bp, Homo sapiens
tattctcataatac

SEQ ID NO: 1921216 - DNA, 22 bp, Homo sapiens
tattctgtgctgttacagtttt

SEQ ID NO: 1921217 - DNA, 14 bp, Homo sapiens
tattctgtggaaaa

SEQ ID NO: 1921218 - DNA, 12 bp, Homo sapiens
tattgatgaaaa

SEQ ID NO: 1921219 - DNA, 22 bp, Homo sapiens
tattgcatctgggtagctgtaa

SEQ ID NO: 1921220 - DNA, 15 bp, Homo sapiens
tattggttttatgat

SEQ ID NO: 1921221 - DNA, 11 bp, Homo sapiens
tattgtaagaa

SEQ ID NO: 1921222 - DNA, 20 bp, Homo sapiens
tattgtttctttaagaaagt

SEQ ID NO: 1921223 - DNA, 15 bp, Homo sapiens
tatttaagcaataaa

SEQ ID NO: 1921224 - DNA, 14 bp, Homo sapiens
tatttatatgtatg

SEQ ID NO: 1921225 - DNA, 15 bp, Homo sapiens
tatttatatgtatgt

SEQ ID NO: 1921226 - DNA, 17 bp, Homo sapiens
tatttatatgtatgtgt

SEQ ID NO: 1921227 - DNA, 21 bp, Homo sapiens
tatttatatgtatgtgtttag

SEQ ID NO: 1921228 - DNA, 15 bp, Homo sapiens
tatttatatttattg

SEQ ID NO: 1921229 - DNA, 17 bp, Homo sapiens
tatttatatttattgac

SEQ ID NO: 1921230 - DNA, 18 bp, Homo sapiens
tatttatgttttcacagt

SEQ ID NO: 1921231 - DNA, 15 bp, Homo sapiens
tatttattaaatttt

SEQ ID NO: 1921232 - DNA, 17 bp, Homo sapiens
tatttattgactcttga

SEQ ID NO: 1921233 - DNA, 19 bp, Homo sapiens
tatttcatcagaacagctg

SEQ ID NO: 1921234 - DNA, 15 bp, Homo sapiens
tatttgatttattaa

SEQ ID NO: 1921235 - DNA, 13 bp, Homo sapiens
tattttcttaaaa

SEQ ID NO: 1921236 - DNA, 17 bp, Homo sapiens
tattttgaaatggaaat

SEQ ID NO: 1921237 - DNA, 21 bp, Homo sapiens
tatttttactgctttctgaat

SEQ ID NO: 1921238 - DNA, 13 bp, Homo sapiens
tatttttcagaac

SEQ ID NO: 1921239 - DNA, 19 bp, Homo sapiens
tattttttttaattgtatt

SEQ ID NO: 1921240 - DNA, 19 bp, Homo sapiens
tcaaaaaggcttataaaac

SEQ ID NO: 1921241 - DNA, 20 bp, Homo sapiens
tcaaaaaggcttataaaaca

SEQ ID NO: 1921242 - DNA, 15 bp, Homo sapiens
tcaaaatatgtgtat

SEQ ID NO: 1921243 - DNA, 15 bp, Homo sapiens
tcaaacccctgacct

SEQ ID NO: 1921244 - DNA, 13 bp, Homo sapiens
tcaaacctgtgaa

SEQ ID NO: 1921245 - DNA, 23 bp, Homo sapiens
tcaaactgcttttgtagtgtgtt

SEQ ID NO: 1921246 - DNA, 21 bp, Homo sapiens
tcaaagacctggggctgctgt

SEQ ID NO: 1921247 - DNA, 21 bp, Homo sapiens
tcaaatacatttaaaacatta

SEQ ID NO: 1921248 - DNA, 21 bp, Homo sapiens
tcaaatcatgtacatttgaaa

SEQ ID NO: 1921249 - DNA, 16 bp, Homo sapiens
tcaaatccaggaccct

SEQ ID NO: 1921250 - DNA, 21 bp, Homo sapiens
tcaaatccaggaccctgccag

SEQ ID NO: 1921251 - DNA, 19 bp, Homo sapiens
tgaaaacaccagctgtata

SEQ ID NO: 1921252 - DNA, 16 bp, Homo sapiens
tgaaaactttgtagta

SEQ ID NO: 1921253 - DNA, 19 bp, Homo sapiens
tgaaaataagccatgagaa

SEQ ID NO: 1921254 - DNA, 20 bp, Homo sapiens
tgaaaataagccatgagaat

SEQ ID NO: 1921255 - DNA, 12 bp, Homo sapiens
tgaaaataattg

SEQ ID NO: 1921256 - DNA, 22 bp, Homo sapiens
tgaaaatactttggataataaa

SEQ ID NO: 1921257 - DNA, 12 bp, Homo sapiens
tgaaaatgaact

SEQ ID NO: 1921258 - DNA, 13 bp, Homo sapiens
tgaaaatttatat

SEQ ID NO: 1921259 - DNA, 12 bp, Homo sapiens
tgaaactcccac

SEQ ID NO: 1921260 - DNA, 15 bp, Homo sapiens
tgaaagaatgtaaag

SEQ ID NO: 1921261 - DNA, 22 bp, Homo sapiens
tgaaagatatgtatatttttga

SEQ ID NO: 1921262 - DNA, 15 bp, Homo sapiens
tgaaaggcttttcaa

SEQ ID NO: 1921263 - DNA, 13 bp, Homo sapiens
tgaaagtgccttt

SEQ ID NO: 1921264 - DNA, 14 bp, Homo sapiens
tgaaagtgcctttg

SEQ ID NO: 1921265 - DNA, 17 bp, Homo sapiens
tgaaagtgcctttgcag

SEQ ID NO: 1921266 - DNA, 13 bp, Homo sapiens
tgaaagttccttc

SEQ ID NO: 1921267 - DNA, 15 bp, Homo sapiens
tgaaataaaaatgga

SEQ ID NO: 1921268 - DNA, 21 bp, Homo sapiens
tgaaataaaatgattaatgca

SEQ ID NO: 1921269 - DNA, 11 bp, Homo sapiens
tgaaatacaac

SEQ ID NO: 1921270 - DNA, 19 bp, Homo sapiens
tgaaatacacaagtaaaca

SEQ ID NO: 1921271 - DNA, 17 bp, Homo sapiens
tgaaatcatatttggaa

SEQ ID NO: 1921272 - DNA, 17 bp, Homo sapiens
tgaaatgaatttacaga

SEQ ID NO: 1921273 - DNA, 18 bp, Homo sapiens
tgaaatgtggatgtgatt

SEQ ID NO: 1921274 - DNA, 19 bp, Homo sapiens
tgaaattaaagctgccttt

SEQ ID NO: 1921275 - DNA, 12 bp, Homo sapiens
tgaaattaccct

SEQ ID NO: 1921276 - DNA, 20 bp, Homo sapiens
tgaacacagctctttaacat

SEQ ID NO: 1921277 - DNA, 16 bp, Homo sapiens
tgaacataattcttat

SEQ ID NO: 1921278 - DNA, 14 bp, Homo sapiens
tgaacatgcctcct

SEQ ID NO: 1921279 - DNA, 17 bp, Homo sapiens
tgaacatgcctcctcct

SEQ ID NO: 1921280 - DNA, 20 bp, Homo sapiens
tgaacatgcctcctcctgcc

SEQ ID NO: 1921281 - DNA, 20 bp, Homo sapiens
tgaacattggttctttcatt

SEQ ID NO: 1921282 - DNA, 13 bp, Homo sapiens
tgaaccacttgta

SEQ ID NO: 1921283 - DNA, 15 bp, Homo sapiens
tgaaccacttgtaga

SEQ ID NO: 1921284 - DNA, 16 bp, Homo sapiens
tgaaccacttgtagat

SEQ ID NO: 1921285 - DNA, 20 bp, Homo sapiens
tgaaccacttgtagatttga

SEQ ID NO: 1921286 - DNA, 23 bp, Homo sapiens
tgaaccacttgtagatttgattt

SEQ ID NO: 1921287 - DNA, 13 bp, Homo sapiens
tgaaccataaaat

SEQ ID NO: 1921288 - DNA, 13 bp, Homo sapiens
tgaacgcccagag

SEQ ID NO: 1921289 - DNA, 19 bp, Homo sapiens
tgaactcaatataaaaaca

SEQ ID NO: 1921290 - DNA, 14 bp, Homo sapiens
tgaactcttctcat

SEQ ID NO: 1921291 - DNA, 16 bp, Homo sapiens
tgaagaaacagctatg

SEQ ID NO: 1921292 - DNA, 13 bp, Homo sapiens
tgaagaatttaaa

SEQ ID NO: 1921293 - DNA, 20 bp, Homo sapiens
tgaagagtttgtaaatgact

SEQ ID NO: 1921294 - DNA, 14 bp, Homo sapiens
tgaagatactttgt

SEQ ID NO: 1921295 - DNA, 14 bp, Homo sapiens
tgaaggaggccacc

SEQ ID NO: 1921296 - DNA, 16 bp, Homo sapiens
tgaaggaggccacctc

SEQ ID NO: 1921297 - DNA, 18 bp, Homo sapiens
tgaaggtttttgatagca

SEQ ID NO: 1921298 - DNA, 19 bp, Homo sapiens
tgaaggtttttgatagcat

SEQ ID NO: 1921299 - DNA, 18 bp, Homo sapiens
tgaagtgcatgggtcagg

SEQ ID NO: 1921300 - DNA, 21 bp, Homo sapiens
tgaataaagtgcaaacagaag

SEQ ID NO: 1921301 - DNA, 22 bp, Homo sapiens
tgaataagccattctgactcat

SEQ ID NO: 1921302 - DNA, 16 bp, Homo sapiens
tgaatactgcttgaat

SEQ ID NO: 1921303 - DNA, 15 bp, Homo sapiens
tgaatacttgaacca

SEQ ID NO: 1921304 - DNA, 22 bp, Homo sapiens
tgaatatgattaaaaatatcaa

SEQ ID NO: 1921305 - DNA, 18 bp, Homo sapiens
tgaatattgccattatgc

SEQ ID NO: 1921306 - DNA, 14 bp, Homo sapiens
tgaatgctgggccc

SEQ ID NO: 1921307 - DNA, 22 bp, Homo sapiens
tgaatggacggtttaggtgaaa

SEQ ID NO: 1921308 - DNA, 17 bp, Homo sapiens
tgaattcaaatattctt

SEQ ID NO: 1921309 - DNA, 15 bp, Homo sapiens
tgaattggaatgcac

SEQ ID NO: 1921310 - DNA, 15 bp, Homo sapiens
tgaatttatataaag

SEQ ID NO: 1921311 - DNA, 17 bp, Homo sapiens
tgaatttatataaagta

SEQ ID NO: 1921312 - DNA, 19 bp, Homo sapiens
tgaatttatataaagtatt

SEQ ID NO: 1921313 - DNA, 14 bp, Homo sapiens
tgacaacaaatttt

SEQ ID NO: 1921314 - DNA, 17 bp, Homo sapiens
tgacaactgaaagaaaa

SEQ ID NO: 1921315 - DNA, 18 bp, Homo sapiens
tgacaactgaaagaaaaa

SEQ ID NO: 1921316 - DNA, 21 bp, Homo sapiens
tgacaagctggcttacactgg

SEQ ID NO: 1921317 - DNA, 14 bp, Homo sapiens
tgacaatgtttaca

SEQ ID NO: 1921318 - DNA, 17 bp, Homo sapiens
tgacacagaagccccac

SEQ ID NO: 1921319 - DNA, 20 bp, Homo sapiens
tgacagagagagatactctg

SEQ ID NO: 1921320 - DNA, 22 bp, Homo sapiens
tgacagagagagatactctggg

SEQ ID NO: 1921321 - DNA, 22 bp, Homo sapiens
tgacattttagaatgtcaataa

SEQ ID NO: 1921322 - DNA, 20 bp, Homo sapiens
tgaccagaagacaaaggccc

SEQ ID NO: 1921323 - DNA, 21 bp, Homo sapiens
tgaccagaagacaaaggccca

SEQ ID NO: 1921324 - DNA, 16 bp, Homo sapiens
tgacccaacagcctct

SEQ ID NO: 1921325 - DNA, 16 bp, Homo sapiens
tgacccatgggcagga

SEQ ID NO: 1921326 - DNA, 19 bp, Homo sapiens
tgacccatgggcaggagac

SEQ ID NO: 1921327 - DNA, 14 bp, Homo sapiens
tgacccctgtgtga

SEQ ID NO: 1921328 - DNA, 17 bp, Homo sapiens
tgacccctgtgtgacat

SEQ ID NO: 1921329 - DNA, 21 bp, Homo sapiens
tgacctcaaatgatgtgcctg

SEQ ID NO: 1921330 - DNA, 14 bp, Homo sapiens
tgacctcacacacc

SEQ ID NO: 1921331 - DNA, 21 bp, Homo sapiens
tgacctcacacacctctgccc

SEQ ID NO: 1921332 - DNA, 18 bp, Homo sapiens
tgacggttcctacacagg

SEQ ID NO: 1921333 - DNA, 18 bp, Homo sapiens
tgacgtacaagtagttct

SEQ ID NO: 1921334 - DNA, 21 bp, Homo sapiens
tgacgtacaagtagttctgta

SEQ ID NO: 1921335 - DNA, 22 bp, Homo sapiens
tgacttagaatccctgtgttaa

SEQ ID NO: 1921336 - DNA, 15 bp, Homo sapiens
tgactttattattta

SEQ ID NO: 1921337 - DNA, 20 bp, Homo sapiens
tgactttattatttattttt

SEQ ID NO: 1921338 - DNA, 22 bp, Homo sapiens
tgactttcaaagtggatgcaat

SEQ ID NO: 1921339 - DNA, 15 bp, Homo sapiens
tgactttcataataa

SEQ ID NO: 1921340 - DNA, 16 bp, Homo sapiens
tgactttgaatttata

SEQ ID NO: 1921341 - DNA, 17 bp, Homo sapiens
tgactttgaatttatat

SEQ ID NO: 1921342 - DNA, 19 bp, Homo sapiens
tgactttgaatttatataa

SEQ ID NO: 1921343 - DNA, 23 bp, Homo sapiens
tgactttgaatttatataaagta

SEQ ID NO: 1921344 - DNA, 17 bp, Homo sapiens
tgagaacattaggcccc

SEQ ID NO: 1921345 - DNA, 20 bp, Homo sapiens
tgagaacattaggccccagc

SEQ ID NO: 1921346 - DNA, 10 bp, Homo sapiens
tgagaagact

SEQ ID NO: 1921347 - DNA, 22 bp, Homo sapiens
tgagaatagaaatttgcccctg

SEQ ID NO: 1921348 - DNA, 15 bp, Homo sapiens
tgagaatgaacaaag

SEQ ID NO: 1921349 - DNA, 23 bp, Homo sapiens
tgagatcaaaaaaatatatgaca

SEQ ID NO: 1921350 - DNA, 19 bp, Homo sapiens
tgagatggatggacagaca

SEQ ID NO: 1921351 - DNA, 12 bp, Homo sapiens
tgagcagcaccc

SEQ ID NO: 1921352 - DNA, 13 bp, Homo sapiens
tgagcccccagct

SEQ ID NO: 1921353 - DNA, 15 bp, Homo sapiens
tgagcccccagcttc

SEQ ID NO: 1921354 - DNA, 16 bp, Homo sapiens
tgagcccccagcttcc

SEQ ID NO: 1921355 - DNA, 17 bp, Homo sapiens
tgagctgaaagaggcca

SEQ ID NO: 1921356 - DNA, 14 bp, Homo sapiens
tgaggcagtttgag

SEQ ID NO: 1921357 - DNA, 18 bp, Homo sapiens
tgaggcccatggccacat

SEQ ID NO: 1921358 - DNA, 21 bp, Homo sapiens
tgaggccgttgctgacttaga

SEQ ID NO: 1921359 - DNA, 19 bp, Homo sapiens
tgaggcctaaaagtaaaca

SEQ ID NO: 1921360 - DNA, 21 bp, Homo sapiens
tgaggcgagcagggcaggccc

SEQ ID NO: 1921361 - DNA, 16 bp, Homo sapiens
tgaggctgctgccagg

SEQ ID NO: 1921362 - DNA, 17 bp, Homo sapiens
tgaggcttcataatcat

SEQ ID NO: 1921363 - DNA, 22 bp, Homo sapiens
tgagggcatttggcttcctctg

SEQ ID NO: 1921364 - DNA, 13 bp, Homo sapiens
tgagggcttgtag

SEQ ID NO: 1921365 - DNA, 23 bp, Homo sapiens
tgaggggagacagagcaacccct

SEQ ID NO: 1921366 - DNA, 18 bp, Homo sapiens
tgagtctgtgtggccagc

SEQ ID NO: 1921367 - DNA, 16 bp, Homo sapiens
tgagtctgttctggta

SEQ ID NO: 1921368 - DNA, 14 bp, Homo sapiens
tgagtgcaggccca

SEQ ID NO: 1921369 - DNA, 16 bp, Homo sapiens
tgagtgcaggcccacc

SEQ ID NO: 1921370 - DNA, 18 bp, Homo sapiens
tgagtgcaggcccaccct

SEQ ID NO: 1921371 - DNA, 14 bp, Homo sapiens
tgagtgttctggga

SEQ ID NO: 1921372 - DNA, 18 bp, Homo sapiens
tgagttcaacctttagta

SEQ ID NO: 1921373 - DNA, 14 bp, Homo sapiens
tgagttgtttttgt

SEQ ID NO: 1921374 - DNA, 17 bp, Homo sapiens
tgagttgtttttgtata

SEQ ID NO: 1921375 - DNA, 20 bp, Homo sapiens
tgagttgtttttgtatattg

SEQ ID NO: 1921376 - DNA, 21 bp, Homo sapiens
tgataacaatgttttaacaag

SEQ ID NO: 1921377 - DNA, 13 bp, Homo sapiens
tgataattttcct

SEQ ID NO: 1921378 - DNA, 19 bp, Homo sapiens
tgataattttcctttaata

SEQ ID NO: 1921379 - DNA, 21 bp, Homo sapiens
tgataattttcctttaatatg

SEQ ID NO: 1921380 - DNA, 14 bp, Homo sapiens
tgatagcattgtaa

SEQ ID NO: 1921381 - DNA, 13 bp, Homo sapiens
tgatataaacagc

SEQ ID NO: 1921382 - DNA, 17 bp, Homo sapiens
tgatatcagcactggat

SEQ ID NO: 1921383 - DNA, 16 bp, Homo sapiens
tgatcacctcagggca

SEQ ID NO: 1921384 - DNA, 14 bp, Homo sapiens
tgttactcttggga

SEQ ID NO: 1921385 - DNA, 14 bp, Homo sapiens
tgttactgtatcct

SEQ ID NO: 1921386 - DNA, 15 bp, Homo sapiens
tgttatatgaacata

SEQ ID NO: 1921387 - DNA, 17 bp, Homo sapiens
tgttcattgcacaatat

SEQ ID NO: 1921388 - DNA, 15 bp, Homo sapiens
tgttctgggatttct

SEQ ID NO: 1921389 - DNA, 12 bp, Homo sapiens
tgttcttttcaa

SEQ ID NO: 1921390 - DNA, 22 bp, Homo sapiens
tgttgactctagtactgtgaat

SEQ ID NO: 1921391 - DNA, 23 bp, Homo sapiens
tgttgaggcgagcagggcaggcc

SEQ ID NO: 1921392 - DNA, 20 bp, Homo sapiens
tgttgataaggaacatttat

SEQ ID NO: 1921393 - DNA, 21 bp, Homo sapiens
tgttgatgggatgattgaaga

SEQ ID NO: 1921394 - DNA, 18 bp, Homo sapiens
tgttggcaaatttgtgaa

SEQ ID NO: 1921395 - DNA, 20 bp, Homo sapiens
tgttggcaaatttgtgaact

SEQ ID NO: 1921396 - DNA, 13 bp, Homo sapiens
tgttggccaggct

SEQ ID NO: 1921397 - DNA, 16 bp, Homo sapiens
tgttgtcaagaatagc

SEQ ID NO: 1921398 - DNA, 23 bp, Homo sapiens
tgttgttcttggcaataaatttt

SEQ ID NO: 1921399 - DNA, 15 bp, Homo sapiens
tgtttagaattgaag

SEQ ID NO: 1921400 - DNA, 21 bp, Homo sapiens
tgtttcagaggctcagattgt

SEQ ID NO: 1921401 - DNA, 13 bp, Homo sapiens
tgtttccttccct

SEQ ID NO: 1921402 - DNA, 17 bp, Homo sapiens
tgtttgaaaatagttta

SEQ ID NO: 1921403 - DNA, 19 bp, Homo sapiens
tgtttgcagtgttaagata

SEQ ID NO: 1921404 - DNA, 15 bp, Homo sapiens
tgtttgtatgtataa

SEQ ID NO: 1921405 - DNA, 20 bp, Homo sapiens
tgttttaaacatagaaagtt

SEQ ID NO: 1921406 - DNA, 13 bp, Homo sapiens
tgttttatctggt

SEQ ID NO: 1921407 - DNA, 12 bp, Homo sapiens
tgtttttctgct

SEQ ID NO: 1921408 - DNA, 14 bp, Homo sapiens
tgtttttctgcttt

SEQ ID NO: 1921409 - DNA, 18 bp, Homo sapiens
tgtttttctgctttagac

SEQ ID NO: 1921410 - DNA, 14 bp, Homo sapiens
tgtttttgtatatt

SEQ ID NO: 1921411 - DNA, 19 bp, Homo sapiens
ttaaaaaaaatttgctcat

SEQ ID NO: 1921412 - DNA, 11 bp, Homo sapiens
ttaaaaaacaa

SEQ ID NO: 1921413 - DNA, 13 bp, Homo sapiens
ttaaaaagtgttt

SEQ ID NO: 1921414 - DNA, 19 bp, Homo sapiens
ttaaaaatatcaaattaat

SEQ ID NO: 1921415 - DNA, 13 bp, Homo sapiens
ttaaaacacgttt

SEQ ID NO: 1921416 - DNA, 12 bp, Homo sapiens
ttaaaatataat

SEQ ID NO: 1921417 - DNA, 16 bp, Homo sapiens
ttaaacaataaagcaa

SEQ ID NO: 1921418 - DNA, 13 bp, Homo sapiens
ttaaacagaggat

SEQ ID NO: 1921419 - DNA, 20 bp, Homo sapiens
ttaaactgtcgtgtcatact

SEQ ID NO: 1921420 - DNA, 16 bp, Homo sapiens
ttaaaggtggaaaatc

SEQ ID NO: 1921421 - DNA, 20 bp, Homo sapiens
ttaaatgtcaaatgtgaatt

SEQ ID NO: 1921422 - DNA, 17 bp, Homo sapiens
ttaaatttttttgtatg

SEQ ID NO: 1921423 - DNA, 15 bp, Homo sapiens
ttaacttttaaagaa

SEQ ID NO: 1921424 - DNA, 14 bp, Homo sapiens
ttaagcaataaaac

SEQ ID NO: 1921425 - DNA, 15 bp, Homo sapiens
ttaaggactgactga

SEQ ID NO: 1921426 - DNA, 18 bp, Homo sapiens
ttaaggactgactgaggc

SEQ ID NO: 1921427 - DNA, 13 bp, Homo sapiens
ttaaggtggaaag

SEQ ID NO: 1921428 - DNA, 20 bp, Homo sapiens
ttaaggtggaaagtgttcat

SEQ ID NO: 1921429 - DNA, 21 bp, Homo sapiens
ttaaggtggaaagtgttcatt

SEQ ID NO: 1921430 - DNA, 16 bp, Homo sapiens
ttaaggtgtttgaaaa

SEQ ID NO: 1921431 - DNA, 18 bp, Homo sapiens
ttaagtcataatgaataa

SEQ ID NO: 1921432 - DNA, 17 bp, Homo sapiens
ttaagtgaggaaatcaa

SEQ ID NO: 1921433 - DNA, 20 bp, Homo sapiens
ttaagtgaggaaatcaaagt

SEQ ID NO: 1921434 - DNA, 13 bp, Homo sapiens
ttaatatgaaatt

SEQ ID NO: 1921435 - DNA, 14 bp, Homo sapiens
ttaatatgaaattt

SEQ ID NO: 1921436 - DNA, 13 bp, Homo sapiens
ttaatcactgtgt

SEQ ID NO: 1921437 - DNA, 15 bp, Homo sapiens
ttaatcataaagaaa

SEQ ID NO: 1921438 - DNA, 17 bp, Homo sapiens
ttaatctctaacagtgg

SEQ ID NO: 1921439 - DNA, 18 bp, Homo sapiens
ttaatctctaacagtgga

SEQ ID NO: 1921440 - DNA, 22 bp, Homo sapiens
ttaatgctaatcttgtgaaaat

SEQ ID NO: 1921441 - DNA, 12 bp, Homo sapiens
ttaatggatgaa

SEQ ID NO: 1921442 - DNA, 16 bp, Homo sapiens
ttaattgaaagaatgt

SEQ ID NO: 1921443 - DNA, 21 bp, Homo sapiens
ttaattgagaatagaaatttg

SEQ ID NO: 1921444 - DNA, 13 bp, Homo sapiens
ttaattgtatttt

SEQ ID NO: 1921445 - DNA, 21 bp, Homo sapiens
ttaattgtgtgaacttggaag

SEQ ID NO: 1921446 - DNA, 13 bp, Homo sapiens
ttaatttaagttt

SEQ ID NO: 1921447 - DNA, 16 bp, Homo sapiens
ttaatttaagttttga

SEQ ID NO: 1921448 - DNA, 23 bp, Homo sapiens
ttaatttaagttttgacaagctg

SEQ ID NO: 1921449 - DNA, 13 bp, Homo sapiens
ttaatttgaaata

SEQ ID NO: 1921450 - DNA, 14 bp, Homo sapiens
ttacaacactttaa

SEQ ID NO: 1921451 - DNA, 15 bp, Homo sapiens
ttacaccacaagtat

SEQ ID NO: 1921452 - DNA, 17 bp, Homo sapiens
ttacatccatcgtaatt

SEQ ID NO: 1921453 - DNA, 18 bp, Homo sapiens
ttaccagtgccttaaact

SEQ ID NO: 1921454 - DNA, 20 bp, Homo sapiens
ttaccgaggacagcctgcct

SEQ ID NO: 1921455 - DNA, 22 bp, Homo sapiens
ttacctaaaagctacagaacca

SEQ ID NO: 1921456 - DNA, 16 bp, Homo sapiens
ttacctctttggaaaa

SEQ ID NO: 1921457 - DNA, 21 bp, Homo sapiens
ttacctgaaggggttttcttg

SEQ ID NO: 1921458 - DNA, 22 bp, Homo sapiens
ttacctgaaggggttttcttga

SEQ ID NO: 1921459 - DNA, 13 bp, Homo sapiens
ttacgcctgtaaa

SEQ ID NO: 1921460 - DNA, 22 bp, Homo sapiens
ttacgcctgtaaatgtattcat

SEQ ID NO: 1921461 - DNA, 23 bp, Homo sapiens
ttactccatatatatatatgtgt

SEQ ID NO: 1921462 - DNA, 14 bp, Homo sapiens
ttactcttgggaca

SEQ ID NO: 1921463 - DNA, 14 bp, Homo sapiens
ttactgctttctga

SEQ ID NO: 1921464 - DNA, 17 bp, Homo sapiens
ttacttgttgcctataa

SEQ ID NO: 1921465 - DNA, 19 bp, Homo sapiens
ttactttgtaaattctgat

SEQ ID NO: 1921466 - DNA, 13 bp, Homo sapiens
ttagaacaggttt

SEQ ID NO: 1921467 - DNA, 15 bp, Homo sapiens
ttagaacaggttttt

SEQ ID NO: 1921468 - DNA, 17 bp, Homo sapiens
ttagaatccctgtgtta

SEQ ID NO: 1921469 - DNA, 20 bp, Homo sapiens
ttagaatccctgtgttaatt

SEQ ID NO: 1921470 - DNA, 18 bp, Homo sapiens
ttagaatgtcaataaatt

SEQ ID NO: 1921471 - DNA, 17 bp, Homo sapiens
ttagacatgtaatttgt

SEQ ID NO: 1921472 - DNA, 14 bp, Homo sapiens
ttagactgccagct

SEQ ID NO: 1921473 - DNA, 13 bp, Homo sapiens
ttagacttgaaaa

SEQ ID NO: 1921474 - DNA, 11 bp, Homo sapiens
ttagaggggcc

SEQ ID NO: 1921475 - DNA, 16 bp, Homo sapiens
ttagatgcatattact

SEQ ID NO: 1921476 - DNA, 14 bp, Homo sapiens
ttagccggagatcc

SEQ ID NO: 1921477 - DNA, 14 bp, Homo sapiens
ttagggagtattct

SEQ ID NO: 1921478 - DNA, 17 bp, Homo sapiens
ttagggagtattctaat

SEQ ID NO: 1921479 - DNA, 13 bp, Homo sapiens
ttagtattgattc

SEQ ID NO: 1921480 - DNA, 15 bp, Homo sapiens
ttagtgttatatgaa

SEQ ID NO: 1921481 - DNA, 14 bp, Homo sapiens
ttagttctgacttt

SEQ ID NO: 1921482 - DNA, 23 bp, Homo sapiens
ttagttctgactttgaatttata

SEQ ID NO: 1921483 - DNA, 19 bp, Homo sapiens
ttataaaacagagtaatct

SEQ ID NO: 1921484 - DNA, 12 bp, Homo sapiens
ttataaaggaat

SEQ ID NO: 1921485 - DNA, 13 bp, Homo sapiens
ttatataaagtat

SEQ ID NO: 1921486 - DNA, 13 bp, Homo sapiens
ttatatgaacata

SEQ ID NO: 1921487 - DNA, 17 bp, Homo sapiens
ttatatgaacatacaaa

SEQ ID NO: 1921488 - DNA, 21 bp, Homo sapiens
ttatatgaacatacaaatgca

SEQ ID NO: 1921489 - DNA, 16 bp, Homo sapiens
ttatatgtatgtgttt

SEQ ID NO: 1921490 - DNA, 17 bp, Homo sapiens
ttatatgtatgtgttta

SEQ ID NO: 1921491 - DNA, 22 bp, Homo sapiens
ttatattgtaagaaatactgta

SEQ ID NO: 1921492 - DNA, 15 bp, Homo sapiens
ttatatttattgact

SEQ ID NO: 1921493 - DNA, 20 bp, Homo sapiens
ttatatttattgactcttga

SEQ ID NO: 1921494 - DNA, 10 bp, Homo sapiens
ttatatttca

SEQ ID NO: 1921495 - DNA, 15 bp, Homo sapiens
ttatcagtgtgcaat

SEQ ID NO: 1921496 - DNA, 21 bp, Homo sapiens
ttatccaggaattgatacgtt

SEQ ID NO: 1921497 - DNA, 13 bp, Homo sapiens
ttatgactaaaaa

SEQ ID NO: 1921498 - DNA, 13 bp, Homo sapiens
ttatgagccaggc

SEQ ID NO: 1921499 - DNA, 21 bp, Homo sapiens
ttatgtaacaaagtttgctga

SEQ ID NO: 1921500 - DNA, 22 bp, Homo sapiens
ttatgtaaggttttttttgtac

SEQ ID NO: 1921501 - DNA, 16 bp, Homo sapiens
ttattaatcactgtgt

SEQ ID NO: 1921502 - DNA, 18 bp, Homo sapiens
ttattaggaaaagatatt

SEQ ID NO: 1921503 - DNA, 15 bp, Homo sapiens
ttatttatatttatt

SEQ ID NO: 1921504 - DNA, 17 bp, Homo sapiens
ttatttatatttattga

SEQ ID NO: 1921505 - DNA, 15 bp, Homo sapiens
ttatttatgtaacaa

SEQ ID NO: 1921506 - DNA, 16 bp, Homo sapiens
ttattttgatgtaaag

SEQ ID NO: 1921507 - DNA, 20 bp, Homo sapiens
ttatttttagaattttgtga

SEQ ID NO: 1921508 - DNA, 14 bp, Homo sapiens
ttatttttctctct

SEQ ID NO: 1921509 - DNA, 19 bp, Homo sapiens
ttattttttttaattgtat

SEQ ID NO: 1921510 - DNA, 19 bp, Homo sapiens
ttcaaagcaccaaaataag

SEQ ID NO: 1921511 - DNA, 23 bp, Homo sapiens
ttcaaataactgcagaaaaaata

SEQ ID NO: 1921512 - DNA, 21 bp, Homo sapiens
ttcaaatgtgttttggtcctg

SEQ ID NO: 1921513 - DNA, 17 bp, Homo sapiens
ttcaagctgctttttgt

SEQ ID NO: 1921514 - DNA, 15 bp, Homo sapiens
ttcaagtacactgaa

SEQ ID NO: 1921515 - DNA, 15 bp, Homo sapiens
ttcacatttggaatt

SEQ ID NO: 1921516 - DNA, 14 bp, Homo sapiens
ttcaccacagactt

SEQ ID NO: 1921517 - DNA, 15 bp, Homo sapiens
ttcaccacagacttt

SEQ ID NO: 1921518 - DNA, 17 bp, Homo sapiens
aagttcatagtttctgt

SEQ ID NO: 1921519 - DNA, 21 bp, Homo sapiens
aagttcatagtttctgtaatt

SEQ ID NO: 1921520 - DNA, 18 bp, Homo sapiens
aagttccgtctcctctcc

SEQ ID NO: 1921521 - DNA, 21 bp, Homo sapiens
aagttgttagtgatttgctat

SEQ ID NO: 1921522 - DNA, 14 bp, Homo sapiens
aagttgtttaacta

SEQ ID NO: 1921523 - DNA, 20 bp, Homo sapiens
aagtttcactgacttagaac

SEQ ID NO: 1921524 - DNA, 17 bp, Homo sapiens
aataaaaataagtcatt

SEQ ID NO: 1921525 - DNA, 19 bp, Homo sapiens
aataaaaccaaagaatagt

SEQ ID NO: 1921526 - DNA, 13 bp, Homo sapiens
aataaaatattta

SEQ ID NO: 1921527 - DNA, 19 bp, Homo sapiens
aataacttgtgttactaat

SEQ ID NO: 1921528 - DNA, 20 bp, Homo sapiens
aataacttgtgttactaatt

SEQ ID NO: 1921529 - DNA, 17 bp, Homo sapiens
aataagcatcaaactct

SEQ ID NO: 1921530 - DNA, 18 bp, Homo sapiens
aataatacctaagccttc

SEQ ID NO: 1921531 - DNA, 14 bp, Homo sapiens
aataatattttaga

SEQ ID NO: 1921532 - DNA, 21 bp, Homo sapiens
aataatattttagaaaatgtt

SEQ ID NO: 1921533 - DNA, 22 bp, Homo sapiens
aataatgacgtattgtgaaatt

SEQ ID NO: 1921534 - DNA, 22 bp, Homo sapiens
aataattgtggagaggagagaa

SEQ ID NO: 1921535 - DNA, 20 bp, Homo sapiens
aataattttttagttaaaat

SEQ ID NO: 1921536 - DNA, 21 bp, Homo sapiens
aatacagtcttccatttgcaa

SEQ ID NO: 1921537 - DNA, 23 bp, Homo sapiens
aatacatgacatttatttttcat

SEQ ID NO: 1921538 - DNA, 17 bp, Homo sapiens
aatacccttggcactga

SEQ ID NO: 1921539 - DNA, 14 bp, Homo sapiens
aatactaaatatga

SEQ ID NO: 1921540 - DNA, 18 bp, Homo sapiens
aatactaaatatgaaatt

SEQ ID NO: 1921541 - DNA, 17 bp, Homo sapiens
aatacttaaaaatatgt

SEQ ID NO: 1921542 - DNA, 11 bp, Homo sapiens
aatacttttgc

SEQ ID NO: 1921543 - DNA, 22 bp, Homo sapiens
aataggacaaaacgggttacta

SEQ ID NO: 1921544 - DNA, 14 bp, Homo sapiens
aatagttgttgatt

SEQ ID NO: 1921545 - DNA, 14 bp, Homo sapiens
aatataaatatcac

SEQ ID NO: 1921546 - DNA, 15 bp, Homo sapiens
aatataaatatcaca

SEQ ID NO: 1921547 - DNA, 12 bp, Homo sapiens
aatatatatgta

SEQ ID NO: 1921548 - DNA, 19 bp, Homo sapiens
aatatatatgtatataaaa

SEQ ID NO: 1921549 - DNA, 19 bp, Homo sapiens
aatatatttaagataatta

SEQ ID NO: 1921550 - DNA, 22 bp, Homo sapiens
aatatcccagagaacaatcact

SEQ ID NO: 1921551 - DNA, 19 bp, Homo sapiens
aatatctatttatctgtct

SEQ ID NO: 1921552 - DNA, 20 bp, Homo sapiens
aatatgattagtaaagaaat

SEQ ID NO: 1921553 - DNA, 19 bp, Homo sapiens
aatatgattctcctctccc

SEQ ID NO: 1921554 - DNA, 15 bp, Homo sapiens
aatatgcatgtactt

SEQ ID NO: 1921555 - DNA, 15 bp, Homo sapiens
aatattcttgtccac

SEQ ID NO: 1921556 - DNA, 20 bp, Homo sapiens
aatattcttgtccacattct

SEQ ID NO: 1921557 - DNA, 19 bp, Homo sapiens
aatattgtcacaacactga

SEQ ID NO: 1921558 - DNA, 13 bp, Homo sapiens
aatatttctatgt

SEQ ID NO: 1921559 - DNA, 13 bp, Homo sapiens
aatcaaaatatgt

SEQ ID NO: 1921560 - DNA, 21 bp, Homo sapiens
aatcaatacccttggcactga

SEQ ID NO: 1921561 - DNA, 19 bp, Homo sapiens
aatcacattcgagtgtttc

SEQ ID NO: 1921562 - DNA, 14 bp, Homo sapiens
aatcactattctta

SEQ ID NO: 1921563 - DNA, 12 bp, Homo sapiens
aatcactgccta

SEQ ID NO: 1921564 - DNA, 18 bp, Homo sapiens
aatcagcattctcactcc

SEQ ID NO: 1921565 - DNA, 18 bp, Homo sapiens
aatcagggaggtcatttt

SEQ ID NO: 1921566 - DNA, 19 bp, Homo sapiens
aatcagggaggtcattttg

SEQ ID NO: 1921567 - DNA, 18 bp, Homo sapiens
aatcatataataaatgta

SEQ ID NO: 1921568 - DNA, 20 bp, Homo sapiens
aatcatttatctggattttt

SEQ ID NO: 1921569 - DNA, 22 bp, Homo sapiens
aatcattttaattattattctt

SEQ ID NO: 1921570 - DNA, 12 bp, Homo sapiens
aatccaactcca

SEQ ID NO: 1921571 - DNA, 14 bp, Homo sapiens
aatccaactccagg

SEQ ID NO: 1921572 - DNA, 11 bp, Homo sapiens
aatccaagact

SEQ ID NO: 1921573 - DNA, 13 bp, Homo sapiens
aatccacataaaa

SEQ ID NO: 1921574 - DNA, 17 bp, Homo sapiens
aatccatgtatctgtat

SEQ ID NO: 1921575 - DNA, 21 bp, Homo sapiens
aatcctgaggggatatcccta

SEQ ID NO: 1921576 - DNA, 14 bp, Homo sapiens
aatcgcattaatga

SEQ ID NO: 1921577 - DNA, 20 bp, Homo sapiens
aatcgcattaatgaaatacc

SEQ ID NO: 1921578 - DNA, 22 bp, Homo sapiens
aatcggcaacagggcttctctt

SEQ ID NO: 1921579 - DNA, 15 bp, Homo sapiens
aatgaaaatgtcttg

SEQ ID NO: 1921580 - DNA, 22 bp, Homo sapiens
aatgaaggtgtcagaataataa

SEQ ID NO: 1921581 - DNA, 19 bp, Homo sapiens
aatgacgtattgtgaaatt

SEQ ID NO: 1921582 - DNA, 13 bp, Homo sapiens
aatgagctgggcc

SEQ ID NO: 1921583 - DNA, 15 bp, Homo sapiens
aatgagtaaaatcac

SEQ ID NO: 1921584 - DNA, 18 bp, Homo sapiens
aatgatactgtctaagaa

SEQ ID NO: 1921585 - DNA, 21 bp, Homo sapiens
aatgatactgtctaagaataa

SEQ ID NO: 1921586 - DNA, 23 bp, Homo sapiens
aatgattcagtgttaaatgtgat

SEQ ID NO: 1921587 - DNA, 16 bp, Homo sapiens
aatgctgtacctttct

SEQ ID NO: 1921588 - DNA, 23 bp, Homo sapiens
aatgctttgtccatgatgtcctt

SEQ ID NO: 1921589 - DNA, 15 bp, Homo sapiens
aatggctgggtttgg

SEQ ID NO: 1921590 - DNA, 18 bp, Homo sapiens
aatggtgagaattaaaat

SEQ ID NO: 1921591 - DNA, 19 bp, Homo sapiens
aatggtgagaattaaaata

SEQ ID NO: 1921592 - DNA, 17 bp, Homo sapiens
aatggtgggctccagag

SEQ ID NO: 1921593 - DNA, 19 bp, Homo sapiens
aatggtgggctccagagta

SEQ ID NO: 1921594 - DNA, 18 bp, Homo sapiens
aatggttgggacaatggc

SEQ ID NO: 1921595 - DNA, 19 bp, Homo sapiens
aatggttgggacaatggca

SEQ ID NO: 1921596 - DNA, 19 bp, Homo sapiens
aatgtaatcaatgtttctt

SEQ ID NO: 1921597 - DNA, 13 bp, Homo sapiens
aatgtatatgcac

SEQ ID NO: 1921598 - DNA, 11 bp, Homo sapiens
aatgtcttgtg

SEQ ID NO: 1921599 - DNA, 13 bp, Homo sapiens
aatgtcttgtgtt

SEQ ID NO: 1921600 - DNA, 21 bp, Homo sapiens
aatgttattattggcttgcac

SEQ ID NO: 1921601 - DNA, 19 bp, Homo sapiens
aatgttattttttaattat

SEQ ID NO: 1921602 - DNA, 21 bp, Homo sapiens
aatgttattttttaattatta

SEQ ID NO: 1921603 - DNA, 23 bp, Homo sapiens
aatgtttacactctttgtaagag

SEQ ID NO: 1921604 - DNA, 23 bp, Homo sapiens
aatgtttcttctaggttctaaaa

SEQ ID NO: 1921605 - DNA, 12 bp, Homo sapiens
aattaaaaccat

SEQ ID NO: 1921606 - DNA, 13 bp, Homo sapiens
aattaaaaccatt

SEQ ID NO: 1921607 - DNA, 16 bp, Homo sapiens
aattaaggcataagaa

SEQ ID NO: 1921608 - DNA, 13 bp, Homo sapiens
aattattattctt

SEQ ID NO: 1921609 - DNA, 11 bp, Homo sapiens
aattattattt

SEQ ID NO: 1921610 - DNA, 16 bp, Homo sapiens
aattattatttatata

SEQ ID NO: 1921611 - DNA, 13 bp, Homo sapiens
aattattgtaaac

SEQ ID NO: 1921612 - DNA, 15 bp, Homo sapiens
aattattgtaaactt

SEQ ID NO: 1921613 - DNA, 19 bp, Homo sapiens
aattattgtaaactttttc

SEQ ID NO: 1921614 - DNA, 14 bp, Homo sapiens
aattccatctatat

SEQ ID NO: 1921615 - DNA, 13 bp, Homo sapiens
aattcgagacagg

SEQ ID NO: 1921616 - DNA, 15 bp, Homo sapiens
aattcggtgtgcacc

SEQ ID NO: 1921617 - DNA, 22 bp, Homo sapiens
aattctcttttcaaacacacac

SEQ ID NO: 1921618 - DNA, 15 bp, Homo sapiens
aattgatgggtgggc

SEQ ID NO: 1921619 - DNA, 15 bp, Homo sapiens
aattgcttgaaagaa

SEQ ID NO: 1921620 - DNA, 21 bp, Homo sapiens
aattggcttttgaatcaaaga

SEQ ID NO: 1921621 - DNA, 23 bp, Homo sapiens
aattggcttttgaatcaaagaat

SEQ ID NO: 1921622 - DNA, 16 bp, Homo sapiens
aattgtaactgttctt

SEQ ID NO: 1921623 - DNA, 19 bp, Homo sapiens
aattgtggagaggagagaa

SEQ ID NO: 1921624 - DNA, 22 bp, Homo sapiens
aatttataaactaattttgtac

SEQ ID NO: 1921625 - DNA, 21 bp, Homo sapiens
aatttctcccgaatcctgagg

SEQ ID NO: 1921626 - DNA, 21 bp, Homo sapiens
aatttgtataacccatatctg

SEQ ID NO: 1921627 - DNA, 18 bp, Homo sapiens
aatttgttattttgcaac

SEQ ID NO: 1921628 - DNA, 17 bp, Homo sapiens
aattttcattggatgca

SEQ ID NO: 1921629 - DNA, 14 bp, Homo sapiens
acaaaccagaagca

SEQ ID NO: 1921630 - DNA, 16 bp, Homo sapiens
acaacacaatcaaaag

SEQ ID NO: 1921631 - DNA, 20 bp, Homo sapiens
acaactccagccacccagcc

SEQ ID NO: 1921632 - DNA, 15 bp, Homo sapiens
acaagacagcagagc

SEQ ID NO: 1921633 - DNA, 14 bp, Homo sapiens
acaagccaggccct

SEQ ID NO: 1921634 - DNA, 17 bp, Homo sapiens
acaagccaggccctctc

SEQ ID NO: 1921635 - DNA, 23 bp, Homo sapiens
acaagccaggccctctctgcagt

SEQ ID NO: 1921636 - DNA, 16 bp, Homo sapiens
acaaggaaaacagtaa

SEQ ID NO: 1921637 - DNA, 17 bp, Homo sapiens
acaaggctagatcatga

SEQ ID NO: 1921638 - DNA, 13 bp, Homo sapiens
acaatatatgtaa

SEQ ID NO: 1921639 - DNA, 15 bp, Homo sapiens
acaatcactattctt

SEQ ID NO: 1921640 - DNA, 18 bp, Homo sapiens
acaatcagctccttcctg

SEQ ID NO: 1921641 - DNA, 16 bp, Homo sapiens
acaatggctgggtttg

SEQ ID NO: 1921642 - DNA, 18 bp, Homo sapiens
acaatggctgggtttggg

SEQ ID NO: 1921643 - DNA, 15 bp, Homo sapiens
acaatgtgcactgaa

SEQ ID NO: 1921644 - DNA, 22 bp, Homo sapiens
acaattcctctactaacaatca

SEQ ID NO: 1921645 - DNA, 13 bp, Homo sapiens
acacacacacaca

SEQ ID NO: 1921646 - DNA, 14 bp, Homo sapiens
acacacactcttca

SEQ ID NO: 1921647 - DNA, 12 bp, Homo sapiens
acacagcagctg

SEQ ID NO: 1921648 - DNA, 16 bp, Homo sapiens
acacaggggacactga

SEQ ID NO: 1921649 - DNA, 16 bp, Homo sapiens
acacattcaataagca

SEQ ID NO: 1921650 - DNA, 15 bp, Homo sapiens
acaccctctctgtcc

SEQ ID NO: 1921651 - DNA, 11 bp, Homo sapiens
acacccttccc

SEQ ID NO: 1921652 - DNA, 13 bp, Homo sapiens
acacccttcccca

SEQ ID NO: 1921653 - DNA, 17 bp, Homo sapiens
acacccttccccactcc

SEQ ID NO: 1921654 - DNA, 16 bp, Homo sapiens
acaccgggcctggaga

SEQ ID NO: 1921655 - DNA, 18 bp, Homo sapiens
ttgagtgggccccctctc

SEQ ID NO: 1921656 - DNA, 17 bp, Homo sapiens
ttgagttcatcatgagc

SEQ ID NO: 1921657 - DNA, 19 bp, Homo sapiens
ttgatcgcctttcccaggt

SEQ ID NO: 1921658 - DNA, 15 bp, Homo sapiens
ttgattattcagtgt

SEQ ID NO: 1921659 - DNA, 17 bp, Homo sapiens
ttgcaaaaatattttat

SEQ ID NO: 1921660 - DNA, 15 bp, Homo sapiens
ttgcaactttagaaa

SEQ ID NO: 1921661 - DNA, 18 bp, Homo sapiens
ttgcaactttagaaagaa

SEQ ID NO: 1921662 - DNA, 14 bp, Homo sapiens
ttgcagcctagtag

SEQ ID NO: 1921663 - DNA, 17 bp, Homo sapiens
ttgcagcttccttccaa

SEQ ID NO: 1921664 - DNA, 15 bp, Homo sapiens
ttgcatttctttatt

SEQ ID NO: 1921665 - DNA, 22 bp, Homo sapiens
ttgcatttctttatttctgtct

SEQ ID NO: 1921666 - DNA, 14 bp, Homo sapiens
ttgccgctgggaga

SEQ ID NO: 1921667 - DNA, 14 bp, Homo sapiens
ttgcgatgtgtttt

SEQ ID NO: 1921668 - DNA, 15 bp, Homo sapiens
ttgcgatgtgtttta

SEQ ID NO: 1921669 - DNA, 17 bp, Homo sapiens
ttgcgtggatcaagctt

SEQ ID NO: 1921670 - DNA, 20 bp, Homo sapiens
ttgctcctacccctgtcctg

SEQ ID NO: 1921671 - DNA, 15 bp, Homo sapiens
ttgcttgaaagaaaa

SEQ ID NO: 1921672 - DNA, 15 bp, Homo sapiens
ttggaactgctgcca

SEQ ID NO: 1921673 - DNA, 23 bp, Homo sapiens
ttggaagggcgctgagggcaggg

SEQ ID NO: 1921674 - DNA, 23 bp, Homo sapiens
ttggaatattgtccattgtccaa

SEQ ID NO: 1921675 - DNA, 13 bp, Homo sapiens
ttggaatttaaga

SEQ ID NO: 1921676 - DNA, 15 bp, Homo sapiens
ttggagaggaggtgt

SEQ ID NO: 1921677 - DNA, 19 bp, Homo sapiens
ttggagaggaggtgtggag

SEQ ID NO: 1921678 - DNA, 14 bp, Homo sapiens
ttggagtgccacgt

SEQ ID NO: 1921679 - DNA, 20 bp, Homo sapiens
ttggataggagcttccagat

SEQ ID NO: 1921680 - DNA, 16 bp, Homo sapiens
ttggcacaccctctct

SEQ ID NO: 1921681 - DNA, 22 bp, Homo sapiens
ttggcactgatgggcactggaa

SEQ ID NO: 1921682 - DNA, 21 bp, Homo sapiens
ttggccactttgcagacctgg

SEQ ID NO: 1921683 - DNA, 11 bp, Homo sapiens
ttggcccctct

SEQ ID NO: 1921684 - DNA, 16 bp, Homo sapiens
ttggctagtctgtgcc

SEQ ID NO: 1921685 - DNA, 19 bp, Homo sapiens
ttggctagtctgtgcctca

SEQ ID NO: 1921686 - DNA, 18 bp, Homo sapiens
ttggctcgggacttcaaa

SEQ ID NO: 1921687 - DNA, 16 bp, Homo sapiens
ttggcttgcactttgt

SEQ ID NO: 1921688 - DNA, 20 bp, Homo sapiens
ttgggaatggtgcccttgga

SEQ ID NO: 1921689 - DNA, 17 bp, Homo sapiens
ttgggcagtggagaggg

SEQ ID NO: 1921690 - DNA, 23 bp, Homo sapiens
ttgggcagtggagaggggacttg

SEQ ID NO: 1921691 - DNA, 15 bp, Homo sapiens
ttggggtagagagga

SEQ ID NO: 1921692 - DNA, 11 bp, Homo sapiens
ttggggtgggg

SEQ ID NO: 1921693 - DNA, 15 bp, Homo sapiens
ttgggttccagacag

SEQ ID NO: 1921694 - DNA, 20 bp, Homo sapiens
ttttattcacttgtgtttgt

SEQ ID NO: 1921695 - DNA, 18 bp, Homo sapiens
ttttattgcctttagaaa

SEQ ID NO: 1921696 - DNA, 14 bp, Homo sapiens
ttttcaaaatggag

SEQ ID NO: 1921697 - DNA, 20 bp, Homo sapiens
ttttcacagtatgggctaca

SEQ ID NO: 1921698 - DNA, 19 bp, Homo sapiens
ttttcactgctggctgcct

SEQ ID NO: 1921699 - DNA, 23 bp, Homo sapiens
ttttcagtcaagttccgtctcct

SEQ ID NO: 1921700 - DNA, 17 bp, Homo sapiens
ttttcagtgtcaaatat

SEQ ID NO: 1921701 - DNA, 23 bp, Homo sapiens
ttttcatctcattaattcaatta

SEQ ID NO: 1921702 - DNA, 20 bp, Homo sapiens
ttttcctaataaagttctgt

SEQ ID NO: 1921703 - DNA, 18 bp, Homo sapiens
ttttctggaatgtaatca

SEQ ID NO: 1921704 - DNA, 17 bp, Homo sapiens
ttttgcaacctcgctgg

SEQ ID NO: 1921705 - DNA, 19 bp, Homo sapiens
ttttgcagcttccttccaa

SEQ ID NO: 1921706 - DNA, 21 bp, Homo sapiens
ttttgctttcgaactgctagt

SEQ ID NO: 1921707 - DNA, 22 bp, Homo sapiens
ttttggggaactgttgtttgat

SEQ ID NO: 1921708 - DNA, 18 bp, Homo sapiens
ttttgtaaggtactgaat

SEQ ID NO: 1921709 - DNA, 22 bp, Homo sapiens
ttttgtggcttcaatctacgat

SEQ ID NO: 1921710 - DNA, 22 bp, Homo sapiens
tttttatattacttttgtaaat

SEQ ID NO: 1921711 - DNA, 14 bp, Homo sapiens
tttttcctgtcctt

SEQ ID NO: 1921712 - DNA, 15 bp, Homo sapiens
tttttttcaagtgct

SEQ ID NO: 1921713 - DNA, 19 bp, Homo sapiens
tgtgttgccattttgtctg

SEQ ID NO: 1921714 - DNA, 22 bp, Homo sapiens
tgtgttgccattttgtctggct

SEQ ID NO: 1921715 - DNA, 11 bp, Homo sapiens
tgtgtttcagg

SEQ ID NO: 1921716 - DNA, 24 bp, Homo sapiens
tgtgtttcaggacagctgcttctg

SEQ ID NO: 1921717 - DNA, 15 bp, Homo sapiens
tgtgtttgctcccat

SEQ ID NO: 1921718 - DNA, 18 bp, Homo sapiens
tgtgttttggtatgcact

SEQ ID NO: 1921719 - DNA, 17 bp, Homo sapiens
tgttaagtattttcata

SEQ ID NO: 1921720 - DNA, 22 bp, Homo sapiens
tgttaagttgatggtgatgaaa

SEQ ID NO: 1921721 - DNA, 15 bp, Homo sapiens
tgttacctgaaaaca

SEQ ID NO: 1921722 - DNA, 22 bp, Homo sapiens
tgttaggaggccacatgatact

SEQ ID NO: 1921723 - DNA, 15 bp, Homo sapiens
tgttagtcatttgct

SEQ ID NO: 1921724 - DNA, 16 bp, Homo sapiens
tgttagtgatttgcta

SEQ ID NO: 1921725 - DNA, 16 bp, Homo sapiens
tgttatgtcattgtgt

SEQ ID NO: 1921726 - DNA, 17 bp, Homo sapiens
tgttcaaactactgtac

SEQ ID NO: 1921727 - DNA, 19 bp, Homo sapiens
tgttcaaactactgtacat

SEQ ID NO: 1921728 - DNA, 21 bp, Homo sapiens
tgttcaaagaacccccctccc

SEQ ID NO: 1921729 - DNA, 18 bp, Homo sapiens
tgttccatcctgtacaag

SEQ ID NO: 1921730 - DNA, 16 bp, Homo sapiens
tgttccccctgtgcag

SEQ ID NO: 1921731 - DNA, 20 bp, Homo sapiens
tgttccccttccactgaggg

SEQ ID NO: 1921732 - DNA, 10 bp, Homo sapiens
tgttcctgcc

SEQ ID NO: 1921733 - DNA, 13 bp, Homo sapiens
tgttcctgccttc

SEQ ID NO: 1921734 - DNA, 17 bp, Homo sapiens
tgttctaagtctttcca

SEQ ID NO: 1921735 - DNA, 23 bp, Homo sapiens
tgttcttgaatttaataatctgt

SEQ ID NO: 1921736 - DNA, 17 bp, Homo sapiens
tgttgacagttcatatg

SEQ ID NO: 1921737 - DNA, 17 bp, Homo sapiens
tgttgacatccaagctt

SEQ ID NO: 1921738 - DNA, 19 bp, Homo sapiens
tgttgacatccaagcttcc

SEQ ID NO: 1921739 - DNA, 13 bp, Homo sapiens
tgttgctgtctgg

SEQ ID NO: 1921740 - DNA, 18 bp, Homo sapiens
tgttgctgttgttcagaa

SEQ ID NO: 1921741 - DNA, 24 bp, Homo sapiens
tgttgtgggggtgtcacagaggca

SEQ ID NO: 1921742 - DNA, 11 bp, Homo sapiens
tgttgttattt

SEQ ID NO: 1921743 - DNA, 18 bp, Homo sapiens
tgtttaaaataaaagtac

SEQ ID NO: 1921744 - DNA, 17 bp, Homo sapiens
tgtttaatacgcttgag

SEQ ID NO: 1921745 - DNA, 13 bp, Homo sapiens
tgtttaccctccc

SEQ ID NO: 1921746 - DNA, 22 bp, Homo sapiens
tgtttaccctccctgtcccctg

SEQ ID NO: 1921747 - DNA, 13 bp, Homo sapiens
tgtttactaggga

SEQ ID NO: 1921748 - DNA, 19 bp, Homo sapiens
tgtttcaggacagctgctt

SEQ ID NO: 1921749 - DNA, 11 bp, Homo sapiens
tgtttctctgt

SEQ ID NO: 1921750 - DNA, 17 bp, Homo sapiens
tgtttctttccttctga

SEQ ID NO: 1921751 - DNA, 14 bp, Homo sapiens
tgtttgatgtgtat

SEQ ID NO: 1921752 - DNA, 21 bp, Homo sapiens
tgtttgcaactggtatatatt

SEQ ID NO: 1921753 - DNA, 20 bp, Homo sapiens
tgtttgccttctacttttaa

SEQ ID NO: 1921754 - DNA, 13 bp, Homo sapiens
tgtttgtgctgtg

SEQ ID NO: 1921755 - DNA, 19 bp, Homo sapiens
tgttttaacggcctgcatc

SEQ ID NO: 1921756 - DNA, 15 bp, Homo sapiens
tgttttaatatccta

SEQ ID NO: 1921757 - DNA, 22 bp, Homo sapiens
tgttttattcacttgtgtttgt

SEQ ID NO: 1921758 - DNA, 22 bp, Homo sapiens
tgttttattgagttctgaaggt

SEQ ID NO: 1921759 - DNA, 11 bp, Homo sapiens
tgtttttcatt

SEQ ID NO: 1921760 - DNA, 14 bp, Homo sapiens
ttaaaaaaaaacat

SEQ ID NO: 1921761 - DNA, 14 bp, Homo sapiens
ttaaaaacacctaa

SEQ ID NO: 1921762 - DNA, 16 bp, Homo sapiens
ttaaaacaaattaaaa

SEQ ID NO: 1921763 - DNA, 20 bp, Homo sapiens
ttaaaaccattaccttaaaa

SEQ ID NO: 1921764 - DNA, 13 bp, Homo sapiens
ttaaaatcctcaa

SEQ ID NO: 1921765 - DNA, 16 bp, Homo sapiens
ttaaagaaaggcagag

SEQ ID NO: 1921766 - DNA, 22 bp, Homo sapiens
tggtcagccctagggtggagag

SEQ ID NO: 1921767 - DNA, 16 bp, Homo sapiens
tggtccaggagaaggc

SEQ ID NO: 1921768 - DNA, 21 bp, Homo sapiens
tggtcccccatgggctgctgg

SEQ ID NO: 1921769 - DNA, 15 bp, Homo sapiens
tggtcctgttatgtc

SEQ ID NO: 1921770 - DNA, 14 bp, Homo sapiens
tggtctggagcccc

SEQ ID NO: 1921771 - DNA, 11 bp, Homo sapiens
tggtcttggag

SEQ ID NO: 1921772 - DNA, 16 bp, Homo sapiens
tggtcttggagaggag

SEQ ID NO: 1921773 - DNA, 17 bp, Homo sapiens
tggtcttggagaggagg

SEQ ID NO: 1921774 - DNA, 13 bp, Homo sapiens
tggtgctgccaca

SEQ ID NO: 1921775 - DNA, 13 bp, Homo sapiens
tggtggagggcca

SEQ ID NO: 1921776 - DNA, 21 bp, Homo sapiens
tggtggcccgacagcctggca

SEQ ID NO: 1921777 - DNA, 17 bp, Homo sapiens
tggtgggtccatgggca

SEQ ID NO: 1921778 - DNA, 18 bp, Homo sapiens
tggtggtttcagaaaggg

SEQ ID NO: 1921779 - DNA, 15 bp, Homo sapiens
tggtgtgaatgctgt

SEQ ID NO: 1921780 - DNA, 13 bp, Homo sapiens
tggtgttgcagaa

SEQ ID NO: 1921781 - DNA, 23 bp, Homo sapiens
tggttaatcacttaacctgcttt

SEQ ID NO: 1921782 - DNA, 23 bp, Homo sapiens
tggttcccctgttcactctactt

SEQ ID NO: 1921783 - DNA, 24 bp, Homo sapiens
tggttccctctttcctgtgccagg

SEQ ID NO: 1921784 - DNA, 20 bp, Homo sapiens
tggttccggaatcctgtcct

SEQ ID NO: 1921785 - DNA, 21 bp, Homo sapiens
tggttccttaagtggctgtga

SEQ ID NO: 1921786 - DNA, 15 bp, Homo sapiens
tggttcttcaaatct

SEQ ID NO: 1921787 - DNA, 22 bp, Homo sapiens
tggttcttcaaatcttaagaga

SEQ ID NO: 1921788 - DNA, 23 bp, Homo sapiens
tggttggaggcctggtctggagc

SEQ ID NO: 1921789 - DNA, 16 bp, Homo sapiens
tgtaaaaatatatatg

SEQ ID NO: 1921790 - DNA, 15 bp, Homo sapiens
tgtaaactttttcaa

SEQ ID NO: 1921791 - DNA, 19 bp, Homo sapiens
tgtaaactttttcaatggt

SEQ ID NO: 1921792 - DNA, 12 bp, Homo sapiens
tgtaaatattct

SEQ ID NO: 1921793 - DNA, 13 bp, Homo sapiens
tgtaaatattctt

SEQ ID NO: 1921794 - DNA, 15 bp, Homo sapiens
tgtaaatattcttgt

SEQ ID NO: 1921795 - DNA, 17 bp, Homo sapiens
tgtaaatattcttgtcc

SEQ ID NO: 1921796 - DNA, 22 bp, Homo sapiens
tgtaaatattcttgtccacatt

SEQ ID NO: 1921797 - DNA, 13 bp, Homo sapiens
tgtaaattattgt

SEQ ID NO: 1921798 - DNA, 15 bp, Homo sapiens
tgtaaattattgtaa

SEQ ID NO: 1921799 - DNA, 17 bp, Homo sapiens
tgtaaattattgtaaac

SEQ ID NO: 1921800 - DNA, 13 bp, Homo sapiens
tgtaactttgcat

SEQ ID NO: 1921801 - DNA, 18 bp, Homo sapiens
tgtaagaatccaaagtgg

SEQ ID NO: 1921802 - DNA, 18 bp, Homo sapiens
tgtaataatattttagaa

SEQ ID NO: 1921803 - DNA, 14 bp, Homo sapiens
tgtaatcaatgttt

SEQ ID NO: 1921804 - DNA, 15 bp, Homo sapiens
tgtaatcttgaattg

SEQ ID NO: 1921805 - DNA, 13 bp, Homo sapiens
tgtaattctaaat

SEQ ID NO: 1921806 - DNA, 15 bp, Homo sapiens
tgtaattctaaatga

SEQ ID NO: 1921807 - DNA, 16 bp, Homo sapiens
tgtaattctaaatgaa

SEQ ID NO: 1921808 - DNA, 17 bp, Homo sapiens
tgtacagttatttatgc

SEQ ID NO: 1921809 - DNA, 22 bp, Homo sapiens
tgtacatgaagaagctaaatcc

SEQ ID NO: 1921810 - DNA, 17 bp, Homo sapiens
tgtacattttttttcaa

SEQ ID NO: 1921811 - DNA, 17 bp, Homo sapiens
tgtaccagggctctgta

SEQ ID NO: 1921812 - DNA, 22 bp, Homo sapiens
tgtacctgcccccactcagcat

SEQ ID NO: 1921813 - DNA, 17 bp, Homo sapiens
tgtactgagccttgtaa

SEQ ID NO: 1921814 - DNA, 16 bp, Homo sapiens
tgtagaagagggagaa

SEQ ID NO: 1921815 - DNA, 20 bp, Homo sapiens
tgtagacatacttgtacgct

SEQ ID NO: 1921816 - DNA, 16 bp, Homo sapiens
tgtataacccatatct

SEQ ID NO: 1921817 - DNA, 19 bp, Homo sapiens
tgtataccacctgtacata

SEQ ID NO: 1921818 - DNA, 20 bp, Homo sapiens
tgtataccacctgtacatac

SEQ ID NO: 1921819 - DNA, 14 bp, Homo sapiens
tgtataggccatct

SEQ ID NO: 1921820 - DNA, 16 bp, Homo sapiens
tgtataggccatctgt

SEQ ID NO: 1921821 - DNA, 19 bp, Homo sapiens
tgtataggccatctgtaaa

SEQ ID NO: 1921822 - DNA, 20 bp, Homo sapiens
tgtataggccatctgtaaat

SEQ ID NO: 1921823 - DNA, 23 bp, Homo sapiens
tgtatagttttacactctagtgc

SEQ ID NO: 1921824 - DNA, 18 bp, Homo sapiens
tgtatgggtcattctcac

SEQ ID NO: 1921825 - DNA, 20 bp, Homo sapiens
tgtattctctgagctgtgca

SEQ ID NO: 1921826 - DNA, 21 bp, Homo sapiens
tgtattctctgagctgtgcag

SEQ ID NO: 1921827 - DNA, 14 bp, Homo sapiens
tgtatttataaata

SEQ ID NO: 1921828 - DNA, 14 bp, Homo sapiens
tgtcaaaaaccaga

SEQ ID NO: 1921829 - DNA, 17 bp, Homo sapiens
tgtcacaaagtgagaaa

SEQ ID NO: 1921830 - DNA, 19 bp, Homo sapiens
tgtcacaaagtgagaaatt

SEQ ID NO: 1921831 - DNA, 14 bp, Homo sapiens
tgtcacagaggcag

SEQ ID NO: 1921832 - DNA, 13 bp, Homo sapiens
tgtcatctcagct

SEQ ID NO: 1921833 - DNA, 18 bp, Homo sapiens
tgtcatgcccagcttgga

SEQ ID NO: 1921834 - DNA, 19 bp, Homo sapiens
tgtcatgcccagcttggag

SEQ ID NO: 1921835 - DNA, 20 bp, Homo sapiens
tgtcattgtgtttgtgtgct

SEQ ID NO: 1921836 - DNA, 14 bp, Homo sapiens
tgtccaatcctatg

SEQ ID NO: 1921837 - DNA, 14 bp, Homo sapiens
tgtccaatctgcaa

SEQ ID NO: 1921838 - DNA, 18 bp, Homo sapiens
tgtccacacaagacagca

SEQ ID NO: 1921839 - DNA, 19 bp, Homo sapiens
tgtccacattctacttcag

SEQ ID NO: 1921840 - DNA, 21 bp, Homo sapiens
tgtccacattctacttcagct

SEQ ID NO: 1921841 - DNA, 19 bp, Homo sapiens
tgtccatgaaaaacagcag

SEQ ID NO: 1921842 - DNA, 20 bp, Homo sapiens
tgtccatgaaaaacagcaga

SEQ ID NO: 1921843 - DNA, 13 bp, Homo sapiens
tgtcccagcccct

SEQ ID NO: 1921844 - DNA, 18 bp, Homo sapiens
tgtccccctctgtccagg

SEQ ID NO: 1921845 - DNA, 20 bp, Homo sapiens
tgtccctaccgagtctcttc

SEQ ID NO: 1921846 - DNA, 16 bp, Homo sapiens
tgtcccttaaacaaaa

SEQ ID NO: 1921847 - DNA, 15 bp, Homo sapiens
tgtcctcattcttct

SEQ ID NO: 1921848 - DNA, 16 bp, Homo sapiens
tgtcctcattcttctc

SEQ ID NO: 1921849 - DNA, 19 bp, Homo sapiens
tgtccttctctcacctcct

SEQ ID NO: 1921850 - DNA, 14 bp, Homo sapiens
tgtcgttcccttgt

SEQ ID NO: 1921851 - DNA, 18 bp, Homo sapiens
tgtctaatgcattaactt

SEQ ID NO: 1921852 - DNA, 19 bp, Homo sapiens
tgtctcaagagggcactgg

SEQ ID NO: 1921853 - DNA, 11 bp, Homo sapiens
tgtctcatcca

SEQ ID NO: 1921854 - DNA, 16 bp, Homo sapiens
tgtctgaagtcactgc

SEQ ID NO: 1921855 - DNA, 17 bp, Homo sapiens
tgtctgaagtcactgca

SEQ ID NO: 1921856 - DNA, 17 bp, Homo sapiens
tgtctgacttctcagga

SEQ ID NO: 1921857 - DNA, 16 bp, Homo sapiens
tgtctgccgtgagagc

SEQ ID NO: 1921858 - DNA, 14 bp, Homo sapiens
tgtctgcctgcctc

SEQ ID NO: 1921859 - DNA, 17 bp, Homo sapiens
tgtctgcgccgctgtgc

SEQ ID NO: 1921860 - DNA, 18 bp, Homo sapiens
tgtctgcgccgctgtgct

SEQ ID NO: 1921861 - DNA, 15 bp, Homo sapiens
tgtctggctgtggcc

SEQ ID NO: 1921862 - DNA, 20 bp, Homo sapiens
tgtcttgagagcgctggcct

SEQ ID NO: 1921863 - DNA, 13 bp, Homo sapiens
tgtctttgctgtt

SEQ ID NO: 1921864 - DNA, 21 bp, Homo sapiens
tgtctttgctgtttatatata

SEQ ID NO: 1921865 - DNA, 22 bp, Homo sapiens
tgtgaagatcacgttccttccc

SEQ ID NO: 1921866 - DNA, 17 bp, Homo sapiens
tgtgaatgctgtacctt

SEQ ID NO: 1921867 - DNA, 21 bp, Homo sapiens
tgtgacatgcgggctgggcag

SEQ ID NO: 1921868 - DNA, 14 bp, Homo sapiens
tgtgaggccagggc

SEQ ID NO: 1921869 - DNA, 22 bp, Homo sapiens
tgtgagtattctatgtaaaaat

SEQ ID NO: 1921870 - DNA, 18 bp, Homo sapiens
tgtgatgaatactgtatt

SEQ ID NO: 1921871 - DNA, 19 bp, Homo sapiens
tgtgattgccatttcttcc

SEQ ID NO: 1921872 - DNA, 21 bp, Homo sapiens
tgtgcaatggaatataaatat

SEQ ID NO: 1921873 - DNA, 22 bp, Homo sapiens
tgtgcaatggaatataaatatc

SEQ ID NO: 1921874 - DNA, 20 bp, Homo sapiens
tgtgcacatctgtgtcttgt

SEQ ID NO: 1921875 - DNA, 21 bp, Homo sapiens
tgtgcacatctgtgtcttgtt

SEQ ID NO: 1921876 - DNA, 14 bp, Homo sapiens
tgtgcaccagggtt

SEQ ID NO: 1921877 - DNA, 19 bp, Homo sapiens
tgtgcagccgctgagcgag

SEQ ID NO: 1921878 - DNA, 15 bp, Homo sapiens
tgtgcatttgtgtct

SEQ ID NO: 1921879 - DNA, 18 bp, Homo sapiens
tgtgcatttgtgtctgcc

SEQ ID NO: 1921880 - DNA, 22 bp, Homo sapiens
tgtgcatttgtgtctgcctgcc

SEQ ID NO: 1921881 - DNA, 14 bp, Homo sapiens
tgtgccacaggctg

SEQ ID NO: 1921882 - DNA, 17 bp, Homo sapiens
tgtgccaggactctctt

SEQ ID NO: 1921883 - DNA, 19 bp, Homo sapiens
tgtgccccatcagcagctt

SEQ ID NO: 1921884 - DNA, 16 bp, Homo sapiens
tgtgcccccagacgca

SEQ ID NO: 1921885 - DNA, 19 bp, Homo sapiens
tgtgctatagtgtatacca

SEQ ID NO: 1921886 - DNA, 18 bp, Homo sapiens
tgtgctgttgtttaaaat

SEQ ID NO: 1921887 - DNA, 14 bp, Homo sapiens
tgtggagtggaggg

SEQ ID NO: 1921888 - DNA, 17 bp, Homo sapiens
tgtggatactattaaag

SEQ ID NO: 1921889 - DNA, 15 bp, Homo sapiens
tgtggcccctccttc

SEQ ID NO: 1921890 - DNA, 22 bp, Homo sapiens
tgtggcccctccttctcccctc

SEQ ID NO: 1921891 - DNA, 10 bp, Homo sapiens
tgtggctcac

SEQ ID NO: 1921892 - DNA, 16 bp, Homo sapiens
tgtgggggtctgggag

SEQ ID NO: 1921893 - DNA, 20 bp, Homo sapiens
tgtgggggtctgggaggcag

SEQ ID NO: 1921894 - DNA, 22 bp, Homo sapiens
tgtgggggtgtcacagaggcag

SEQ ID NO: 1921895 - DNA, 23 bp, Homo sapiens
tgtggtgtgtccccctctgtcca

SEQ ID NO: 1921896 - DNA, 22 bp, Homo sapiens
tgtggttaccgagtatctgtaa

SEQ ID NO: 1921897 - DNA, 13 bp, Homo sapiens
tgtgtatgtgttt

SEQ ID NO: 1921898 - DNA, 14 bp, Homo sapiens
tgtgtatgtgttta

SEQ ID NO: 1921899 - DNA, 16 bp, Homo sapiens
tgtgtctgcctgcctc

SEQ ID NO: 1921900 - DNA, 19 bp, Homo sapiens
tgtgtgggggtctgggagg

SEQ ID NO: 1921901 - DNA, 21 bp, Homo sapiens
tgtgttcgtggagccacaggc

SEQ ID NO: 1921902 - DNA, 15 bp, Homo sapiens
tgaaacttggtgtgt

SEQ ID NO: 1921903 - DNA, 15 bp, Homo sapiens
tgaaacttgtgctat

SEQ ID NO: 1921904 - DNA, 20 bp, Homo sapiens
tgaaagaaaatatgcatcta

SEQ ID NO: 1921905 - DNA, 16 bp, Homo sapiens
tgaaaggcttctggga

SEQ ID NO: 1921906 - DNA, 15 bp, Homo sapiens
tgaaatatgcatgta

SEQ ID NO: 1921907 - DNA, 15 bp, Homo sapiens
tgaaatttgttaata

SEQ ID NO: 1921908 - DNA, 16 bp, Homo sapiens
tgaaatttgttaatat

SEQ ID NO: 1921909 - DNA, 20 bp, Homo sapiens
tgaaatttgttaatatatat

SEQ ID NO: 1921910 - DNA, 18 bp, Homo sapiens
tgaacataactgtaacat

SEQ ID NO: 1921911 - DNA, 19 bp, Homo sapiens
tgaacataactgtaacata

SEQ ID NO: 1921912 - DNA, 21 bp, Homo sapiens
tgaaccttgttgatgccagct

SEQ ID NO: 1921913 - DNA, 20 bp, Homo sapiens
tgaactaccttggttccccc

SEQ ID NO: 1921914 - DNA, 17 bp, Homo sapiens
tgaactcaactttgaca

SEQ ID NO: 1921915 - DNA, 22 bp, Homo sapiens
tgaagaagctaaatcctttact

SEQ ID NO: 1921916 - DNA, 15 bp, Homo sapiens
tgaagcccaggagga

SEQ ID NO: 1921917 - DNA, 16 bp, Homo sapiens
tgaagcccaggaggac

SEQ ID NO: 1921918 - DNA, 15 bp, Homo sapiens
tgaaggtgtcagaat

SEQ ID NO: 1921919 - DNA, 15 bp, Homo sapiens
tgaagtcactgcaca

SEQ ID NO: 1921920 - DNA, 16 bp, Homo sapiens
tgaagtcactgcacag

SEQ ID NO: 1921921 - DNA, 13 bp, Homo sapiens
tgaagtgaataca

SEQ ID NO: 1921922 - DNA, 15 bp, Homo sapiens
tgaataaagacacct

SEQ ID NO: 1921923 - DNA, 16 bp, Homo sapiens
tgaataaagacaccta

SEQ ID NO: 1921924 - DNA, 21 bp, Homo sapiens
tgaataacaaggaaaacagta

SEQ ID NO: 1921925 - DNA, 20 bp, Homo sapiens
tgaatacttaatatgtggga

SEQ ID NO: 1921926 - DNA, 17 bp, Homo sapiens
tgaatcgtttcatgtaa

SEQ ID NO: 1921927 - DNA, 15 bp, Homo sapiens
tgaatgctgtacctt

SEQ ID NO: 1921928 - DNA, 19 bp, Homo sapiens
tgaatgtttgaattacagg

SEQ ID NO: 1921929 - DNA, 19 bp, Homo sapiens
tgaattacagggaagaaat

SEQ ID NO: 1921930 - DNA, 20 bp, Homo sapiens
tgaattacagggaagaaatc

SEQ ID NO: 1921931 - DNA, 21 bp, Homo sapiens
tgaattacagggaagaaatca

SEQ ID NO: 1921932 - DNA, 16 bp, Homo sapiens
tgaattcgagacaggc

SEQ ID NO: 1921933 - DNA, 23 bp, Homo sapiens
tgaattcgagacaggcagaatca

SEQ ID NO: 1921934 - DNA, 20 bp, Homo sapiens
tgaattcttggttgaggaaa

SEQ ID NO: 1921935 - DNA, 22 bp, Homo sapiens
tgaattcttggttgaggaaaca

SEQ ID NO: 1921936 - DNA, 19 bp, Homo sapiens
tgaattgtaactgttcttg

SEQ ID NO: 1921937 - DNA, 19 bp, Homo sapiens
tgacacaggggacactgaa

SEQ ID NO: 1921938 - DNA, 14 bp, Homo sapiens
tgacactcccttgg

SEQ ID NO: 1921939 - DNA, 18 bp, Homo sapiens
tgacactgcgaactctca

SEQ ID NO: 1921940 - DNA, 17 bp, Homo sapiens
tgacatccaagcttcct

SEQ ID NO: 1921941 - DNA, 18 bp, Homo sapiens
tgacatgcgggctgggca

SEQ ID NO: 1921942 - DNA, 21 bp, Homo sapiens
tgacatttggagtgttcccct

SEQ ID NO: 1921943 - DNA, 13 bp, Homo sapiens
tgaccaatgtctt

SEQ ID NO: 1921944 - DNA, 14 bp, Homo sapiens
tgaccaatgtcttg

SEQ ID NO: 1921945 - DNA, 15 bp, Homo sapiens
tgaccaatgtcttga

SEQ ID NO: 1921946 - DNA, 22 bp, Homo sapiens
tgaccagactgtgggtccctgc

SEQ ID NO: 1921947 - DNA, 14 bp, Homo sapiens
tgacctcaatggag

SEQ ID NO: 1921948 - DNA, 20 bp, Homo sapiens
tgacgcgtggtcacaggacg

SEQ ID NO: 1921949 - DNA, 19 bp, Homo sapiens
tgacgggggttggggtggg

SEQ ID NO: 1921950 - DNA, 20 bp, Homo sapiens
tgacgggggttggggtgggg

SEQ ID NO: 1921951 - DNA, 17 bp, Homo sapiens
tgacgtattgtgaaatt

SEQ ID NO: 1921952 - DNA, 13 bp, Homo sapiens
tgactcagggctc

SEQ ID NO: 1921953 - DNA, 14 bp, Homo sapiens
tgactcagggctcc

SEQ ID NO: 1921954 - DNA, 18 bp, Homo sapiens
tgactcagggctcctggg

SEQ ID NO: 1921955 - DNA, 16 bp, Homo sapiens
tgactggccccaggga

SEQ ID NO: 1921956 - DNA, 19 bp, Homo sapiens
tgactggccccagggactc

SEQ ID NO: 1921957 - DNA, 14 bp, Homo sapiens
tgacttatttgtag

SEQ ID NO: 1921958 - DNA, 20 bp, Homo sapiens
tgacttcagactctctcctc

SEQ ID NO: 1921959 - DNA, 15 bp, Homo sapiens
tgagaattaaaataa

SEQ ID NO: 1921960 - DNA, 14 bp, Homo sapiens
tgagaccactgtta

SEQ ID NO: 1921961 - DNA, 13 bp, Homo sapiens
tgagagagtgtgg

SEQ ID NO: 1921962 - DNA, 15 bp, Homo sapiens
tgagagagtgtggaa

SEQ ID NO: 1921963 - DNA, 16 bp, Homo sapiens
tgagagcgctggcctc

SEQ ID NO: 1921964 - DNA, 20 bp, Homo sapiens
tgagataccagcgaggaggc

SEQ ID NO: 1921965 - DNA, 16 bp, Homo sapiens
tgagcaaggcaagaag

SEQ ID NO: 1921966 - DNA, 22 bp, Homo sapiens
tgagcagggagatcctggttgg

SEQ ID NO: 1921967 - DNA, 22 bp, Homo sapiens
tgagcattgtggctgtcagcag

SEQ ID NO: 1921968 - DNA, 13 bp, Homo sapiens
tgagccttgtaat

SEQ ID NO: 1921969 - DNA, 22 bp, Homo sapiens
tgagcgaggagatgctccttgg

SEQ ID NO: 1921970 - DNA, 20 bp, Homo sapiens
tgagcggccgcctgtccttg

SEQ ID NO: 1921971 - DNA, 14 bp, Homo sapiens
tgagctgagcaggg

SEQ ID NO: 1921972 - DNA, 22 bp, Homo sapiens
tgagctggaaaggatgcttctg

SEQ ID NO: 1921973 - DNA, 16 bp, Homo sapiens
tgagctgggccctggg

SEQ ID NO: 1921974 - DNA, 17 bp, Homo sapiens
tgagctgggccctgggt

SEQ ID NO: 1921975 - DNA, 23 bp, Homo sapiens
tgagcttaagaattttgagcagg

SEQ ID NO: 1921976 - DNA, 21 bp, Homo sapiens
tgagcttgattctaaagggga

SEQ ID NO: 1921977 - DNA, 16 bp, Homo sapiens
tgaggaggaggcagaa

SEQ ID NO: 1921978 - DNA, 14 bp, Homo sapiens
tgaggccagggcag

SEQ ID NO: 1921979 - DNA, 19 bp, Homo sapiens
tgaggcgtgggatccagag

SEQ ID NO: 1921980 - DNA, 16 bp, Homo sapiens
tgagggacgaggtcaa

SEQ ID NO: 1921981 - DNA, 14 bp, Homo sapiens
tgagggagcctggc

SEQ ID NO: 1921982 - DNA, 18 bp, Homo sapiens
tgagggatggggagcagc

SEQ ID NO: 1921983 - DNA, 19 bp, Homo sapiens
tgagggcaaaccaggctgc

SEQ ID NO: 1921984 - DNA, 20 bp, Homo sapiens
tgagggcaaaccaggctgca

SEQ ID NO: 1921985 - DNA, 11 bp, Homo sapiens
tgagggcagtc

SEQ ID NO: 1921986 - DNA, 18 bp, Homo sapiens
tgaggttaaggggatcta

SEQ ID NO: 1921987 - DNA, 20 bp, Homo sapiens
tgagtattctatgtaaaaat

SEQ ID NO: 1921988 - DNA, 21 bp, Homo sapiens
tgagtgtgacgggggttgggg

SEQ ID NO: 1921989 - DNA, 23 bp, Homo sapiens
tgagtgttcaaactactgtacat

SEQ ID NO: 1921990 - DNA, 21 bp, Homo sapiens
tgagtttagtgatctgaacag

SEQ ID NO: 1921991 - DNA, 16 bp, Homo sapiens
tgataaaaccatgtag

SEQ ID NO: 1921992 - DNA, 17 bp, Homo sapiens
tgatactgtctaagaat

SEQ ID NO: 1921993 - DNA, 15 bp, Homo sapiens
tgatacttattcaaa

SEQ ID NO: 1921994 - DNA, 16 bp, Homo sapiens
tgatatcccccagcct

SEQ ID NO: 1921995 - DNA, 19 bp, Homo sapiens
tgatattttcaacgcagcc

SEQ ID NO: 1921996 - DNA, 18 bp, Homo sapiens
tgatcagaccataatgtt

SEQ ID NO: 1921997 - DNA, 22 bp, Homo sapiens
tgatcctaatgaatgcataaaa

SEQ ID NO: 1921998 - DNA, 15 bp, Homo sapiens
tgatcgcctttccca

SEQ ID NO: 1921999 - DNA, 20 bp, Homo sapiens
tgatctgatgcaagcaagaa

SEQ ID NO: 1922000 - DNA, 15 bp, Homo sapiens
tgatctgtgggcaca

SEQ ID NO: 1922001 - DNA, 15 bp, Homo sapiens
tgatgaaaaatagca

SEQ ID NO: 1922002 - DNA, 14 bp, Homo sapiens
tgatgaatactgta

SEQ ID NO: 1922003 - DNA, 20 bp, Homo sapiens
tgatgggcactggaaaacat

SEQ ID NO: 1922004 - DNA, 17 bp, Homo sapiens
tgatggtgatgaaatgt

SEQ ID NO: 1922005 - DNA, 16 bp, Homo sapiens
tgatgtgtatgtgttt

SEQ ID NO: 1922006 - DNA, 16 bp, Homo sapiens
tgattattcagtgtca

SEQ ID NO: 1922007 - DNA, 24 bp, Homo sapiens
tgattcagtgttaaatgtgatgaa

SEQ ID NO: 1922008 - DNA, 15 bp, Homo sapiens
tgattctaaagggga

SEQ ID NO: 1922009 - DNA, 16 bp, Homo sapiens
tgattctaaaggggac

SEQ ID NO: 1922010 - DNA, 13 bp, Homo sapiens
tgattctcctctc

SEQ ID NO: 1922011 - DNA, 15 bp, Homo sapiens
tgattcttgagttta

SEQ ID NO: 1922012 - DNA, 17 bp, Homo sapiens
tgattgccatttcttcc

SEQ ID NO: 1922013 - DNA, 20 bp, Homo sapiens
tgattgccatttcttcccaa

SEQ ID NO: 1922014 - DNA, 14 bp, Homo sapiens
tgatttcaaaatga

SEQ ID NO: 1922015 - DNA, 15 bp, Homo sapiens
tgatttcattaatac

SEQ ID NO: 1922016 - DNA, 13 bp, Homo sapiens
tgatttcatttca

SEQ ID NO: 1922017 - DNA, 14 bp, Homo sapiens
tgatttgaagtgga

SEQ ID NO: 1922018 - DNA, 17 bp, Homo sapiens
tgatttgcaactttaga

SEQ ID NO: 1922019 - DNA, 12 bp, Homo sapiens
tgatttgctatc

SEQ ID NO: 1922020 - DNA, 14 bp, Homo sapiens
tgcaaagaaaagaa

SEQ ID NO: 1922021 - DNA, 13 bp, Homo sapiens
tgcaacaaaattc

SEQ ID NO: 1922022 - DNA, 20 bp, Homo sapiens
tgcaacctcgctggactctc

SEQ ID NO: 1922023 - DNA, 20 bp, Homo sapiens
tgcaactggtatatatttag

SEQ ID NO: 1922024 - DNA, 18 bp, Homo sapiens
tgcaacttgtaaatgtgg

SEQ ID NO: 1922025 - DNA, 14 bp, Homo sapiens
tgcaactttagaaa

SEQ ID NO: 1922026 - DNA, 18 bp, Homo sapiens
tgcaactttagaaagaaa

SEQ ID NO: 1922027 - DNA, 21 bp, Homo sapiens
tgcaactttagaaagaaattg

SEQ ID NO: 1922028 - DNA, 16 bp, Homo sapiens
tgcaaggtgcacctgc

SEQ ID NO: 1922029 - DNA, 17 bp, Homo sapiens
tgcaatccatgtatctg

SEQ ID NO: 1922030 - DNA, 15 bp, Homo sapiens
tgcaatggaatataa

SEQ ID NO: 1922031 - DNA, 22 bp, Homo sapiens
tgcaatggaatataaatatcac

SEQ ID NO: 1922032 - DNA, 15 bp, Homo sapiens
tgcacagtgcatctc

SEQ ID NO: 1922033 - DNA, 17 bp, Homo sapiens
tgcacagtgcatctcag

SEQ ID NO: 1922034 - DNA, 14 bp, Homo sapiens
tgcaccaagcagga

SEQ ID NO: 1922035 - DNA, 22 bp, Homo sapiens
tgcaccaagcaggaaatgaaaa

SEQ ID NO: 1922036 - DNA, 23 bp, Homo sapiens
tgcaccctctgctatgtctgtga

SEQ ID NO: 1922037 - DNA, 16 bp, Homo sapiens
tgcacctgccccaggc

SEQ ID NO: 1922038 - DNA, 22 bp, Homo sapiens
tgcacgtagtagggtcaggcca

SEQ ID NO: 1922039 - DNA, 15 bp, Homo sapiens
tcccgctcagccctc

SEQ ID NO: 1922040 - DNA, 14 bp, Homo sapiens
tcccggctggactt

SEQ ID NO: 1922041 - DNA, 16 bp, Homo sapiens
tccctatgtcccagcc

SEQ ID NO: 1922042 - DNA, 16 bp, Homo sapiens
tccctcatctgtccct

SEQ ID NO: 1922043 - DNA, 15 bp, Homo sapiens
tacagagcttccctg

SEQ ID NO: 1922044 - DNA, 14 bp, Homo sapiens
tacagggaagaaat

SEQ ID NO: 1922045 - DNA, 15 bp, Homo sapiens
tacagtaggagccca

SEQ ID NO: 1922046 - DNA, 24 bp, Homo sapiens
tacagtgtatctcgaagtcttcca

SEQ ID NO: 1922047 - DNA, 21 bp, Homo sapiens
tacatgacatttatttttcat

SEQ ID NO: 1922048 - DNA, 13 bp, Homo sapiens
tacatgtgggagc

SEQ ID NO: 1922049 - DNA, 19 bp, Homo sapiens
tacattagcagtttgcttt

SEQ ID NO: 1922050 - DNA, 22 bp, Homo sapiens
tacattgtataggccatctgta

SEQ ID NO: 1922051 - DNA, 14 bp, Homo sapiens
tacattttttttca

SEQ ID NO: 1922052 - DNA, 20 bp, Homo sapiens
taccaatcattttaattatt

SEQ ID NO: 1922053 - DNA, 15 bp, Homo sapiens
taccacctgtacata

SEQ ID NO: 1922054 - DNA, 17 bp, Homo sapiens
taccacctgtacataca

SEQ ID NO: 1922055 - DNA, 21 bp, Homo sapiens
taccattttgcgatgtgtttt

SEQ ID NO: 1922056 - DNA, 15 bp, Homo sapiens
tacccacttccctgc

SEQ ID NO: 1922057 - DNA, 15 bp, Homo sapiens
taccccgtccctttc

SEQ ID NO: 1922058 - DNA, 18 bp, Homo sapiens
taccccgtccctttccct

SEQ ID NO: 1922059 - DNA, 13 bp, Homo sapiens
tacccctgtcctg

SEQ ID NO: 1922060 - DNA, 18 bp, Homo sapiens
tacccctttggcacaccc

SEQ ID NO: 1922061 - DNA, 18 bp, Homo sapiens
taccctaggtctccaccc

SEQ ID NO: 1922062 - DNA, 21 bp, Homo sapiens
taccctaggtctccacccctc

SEQ ID NO: 1922063 - DNA, 22 bp, Homo sapiens
taccctaggtctccacccctca

SEQ ID NO: 1922064 - DNA, 23 bp, Homo sapiens
taccctaggtctccacccctcaa

SEQ ID NO: 1922065 - DNA, 15 bp, Homo sapiens
taccctccctgtccc

SEQ ID NO: 1922066 - DNA, 19 bp, Homo sapiens
taccctccctgtcccctga

SEQ ID NO: 1922067 - DNA, 16 bp, Homo sapiens
taccctgagctgaggc

SEQ ID NO: 1922068 - DNA, 17 bp, Homo sapiens
taccctgagctgaggca

SEQ ID NO: 1922069 - DNA, 18 bp, Homo sapiens
taccctgagctgaggcag

SEQ ID NO: 1922070 - DNA, 13 bp, Homo sapiens
taccgagtatctg

SEQ ID NO: 1922071 - DNA, 17 bp, Homo sapiens
taccgagtatctgtaac

SEQ ID NO: 1922072 - DNA, 19 bp, Homo sapiens
taccgagtatctgtaaccc

SEQ ID NO: 1922073 - DNA, 17 bp, Homo sapiens
tacctaattagagcaga

SEQ ID NO: 1922074 - DNA, 12 bp, Homo sapiens
tacctctggctc

SEQ ID NO: 1922075 - DNA, 10 bp, Homo sapiens
tacctggaaa

SEQ ID NO: 1922076 - DNA, 13 bp, Homo sapiens
taccttggttccc

SEQ ID NO: 1922077 - DNA, 22 bp, Homo sapiens
taccttggttcccccactgatc

SEQ ID NO: 1922078 - DNA, 14 bp, Homo sapiens
tacgaatacttttg

SEQ ID NO: 1922079 - DNA, 15 bp, Homo sapiens
tacgatgttaaaaca

SEQ ID NO: 1922080 - DNA, 17 bp, Homo sapiens
tacgcagaagagaaagt

SEQ ID NO: 1922081 - DNA, 22 bp, Homo sapiens
tacgcagcgtgctttaaaaaat

SEQ ID NO: 1922082 - DNA, 14 bp, Homo sapiens
tacgttaccaggca

SEQ ID NO: 1922083 - DNA, 12 bp, Homo sapiens
tactaaatatga

SEQ ID NO: 1922084 - DNA, 14 bp, Homo sapiens
tactaaatatgaaa

SEQ ID NO: 1922085 - DNA, 16 bp, Homo sapiens
tactaagatgaaattg

SEQ ID NO: 1922086 - DNA, 14 bp, Homo sapiens
tactatatttatgg

SEQ ID NO: 1922087 - DNA, 21 bp, Homo sapiens
tactcagtcagcccagtggga

SEQ ID NO: 1922088 - DNA, 14 bp, Homo sapiens
tactcattcaggga

SEQ ID NO: 1922089 - DNA, 15 bp, Homo sapiens
tactcccccagccct

SEQ ID NO: 1922090 - DNA, 19 bp, Homo sapiens
tactcccccagccctcagt

SEQ ID NO: 1922091 - DNA, 12 bp, Homo sapiens
tactcctcccag

SEQ ID NO: 1922092 - DNA, 15 bp, Homo sapiens
tactgagccttgtaa

SEQ ID NO: 1922093 - DNA, 18 bp, Homo sapiens
tactgagccttgtaattc

SEQ ID NO: 1922094 - DNA, 19 bp, Homo sapiens
tactgagccttgtaattct

SEQ ID NO: 1922095 - DNA, 23 bp, Homo sapiens
tactgagccttgtaattctaaat

SEQ ID NO: 1922096 - DNA, 17 bp, Homo sapiens
tacttaaaaatatgtga

SEQ ID NO: 1922097 - DNA, 21 bp, Homo sapiens
tacttaaaaatatgtgagcat

SEQ ID NO: 1922098 - DNA, 15 bp, Homo sapiens
tacttcagctttgga

SEQ ID NO: 1922099 - DNA, 21 bp, Homo sapiens
tacttcctcctcctcctcctg

SEQ ID NO: 1922100 - DNA, 14 bp, Homo sapiens
tacttgacctccta

SEQ ID NO: 1922101 - DNA, 17 bp, Homo sapiens
tactttatattttctat

SEQ ID NO: 1922102 - DNA, 20 bp, Homo sapiens
tacttttctgcaatgttatt

SEQ ID NO: 1922103 - DNA, 13 bp, Homo sapiens
tacttttgtaaat

SEQ ID NO: 1922104 - DNA, 15 bp, Homo sapiens
tacttttgtaaatat

SEQ ID NO: 1922105 - DNA, 22 bp, Homo sapiens
tagaaaatttgttattttgcaa

SEQ ID NO: 1922106 - DNA, 15 bp, Homo sapiens
tagaaactgagtcct

SEQ ID NO: 1922107 - DNA, 17 bp, Homo sapiens
tagaagagggagaagga

SEQ ID NO: 1922108 - DNA, 15 bp, Homo sapiens
tagacactgaaggca

SEQ ID NO: 1922109 - DNA, 15 bp, Homo sapiens
tagacagtattgcca

SEQ ID NO: 1922110 - DNA, 18 bp, Homo sapiens
tagacagtattgccacct

SEQ ID NO: 1922111 - DNA, 20 bp, Homo sapiens
tagacagtattgccacctct

SEQ ID NO: 1922112 - DNA, 21 bp, Homo sapiens
tagacagtattgccacctctg

SEQ ID NO: 1922113 - DNA, 18 bp, Homo sapiens
tagacatccccctccttg

SEQ ID NO: 1922114 - DNA, 13 bp, Homo sapiens
tagagaaggaccc

SEQ ID NO: 1922115 - DNA, 17 bp, Homo sapiens
tagagaataatcatata

SEQ ID NO: 1922116 - DNA, 10 bp, Homo sapiens
tagagaggac

SEQ ID NO: 1922117 - DNA, 19 bp, Homo sapiens
tagagattacctcctgaga

SEQ ID NO: 1922118 - DNA, 21 bp, Homo sapiens
tagagcagttaacatctgaag

SEQ ID NO: 1922119 - DNA, 20 bp, Homo sapiens
tagagcattctggggtgggg

SEQ ID NO: 1922120 - DNA, 19 bp, Homo sapiens
tagagtccaacgtggggca

SEQ ID NO: 1922121 - DNA, 15 bp, Homo sapiens
tagatgaactcaact

SEQ ID NO: 1922122 - DNA, 15 bp, Homo sapiens
tagatgagtcctgtt

SEQ ID NO: 1922123 - DNA, 14 bp, Homo sapiens
tagatgctgactgt

SEQ ID NO: 1922124 - DNA, 23 bp, Homo sapiens
tagatgctgactgtactcctccc

SEQ ID NO: 1922125 - DNA, 21 bp, Homo sapiens
tagatgttctaagtctttcca

SEQ ID NO: 1922126 - DNA, 13 bp, Homo sapiens
tagcactgagcaa

SEQ ID NO: 1922127 - DNA, 15 bp, Homo sapiens
tagccatttgaagaa

SEQ ID NO: 1922128 - DNA, 17 bp, Homo sapiens
taggagcttccagatgg

SEQ ID NO: 1922129 - DNA, 18 bp, Homo sapiens
taggagcttccagatggg

SEQ ID NO: 1922130 - DNA, 21 bp, Homo sapiens
taggatttgtgttttacagta

SEQ ID NO: 1922131 - DNA, 15 bp, Homo sapiens
taggccatctgtaaa

SEQ ID NO: 1922132 - DNA, 22 bp, Homo sapiens
taggctaatcaatacccttggc

SEQ ID NO: 1922133 - DNA, 17 bp, Homo sapiens
tagggaaatccaactcc

SEQ ID NO: 1922134 - DNA, 20 bp, Homo sapiens
tagggaaatccaactccagg

SEQ ID NO: 1922135 - DNA, 14 bp, Homo sapiens
taggggtgggggag

SEQ ID NO: 1922136 - DNA, 14 bp, Homo sapiens
tagggtgaggcgtg

SEQ ID NO: 1922137 - DNA, 18 bp, Homo sapiens
tagggttgccagtcctgc

SEQ ID NO: 1922138 - DNA, 12 bp, Homo sapiens
taggtctccacc

SEQ ID NO: 1922139 - DNA, 13 bp, Homo sapiens
taggtctccaccc

SEQ ID NO: 1922140 - DNA, 23 bp, Homo sapiens
taggtctccacccctcaagccag

SEQ ID NO: 1922141 - DNA, 23 bp, Homo sapiens
taggtgtcttttaatgatactgt

SEQ ID NO: 1922142 - DNA, 16 bp, Homo sapiens
taggttaataggagga

SEQ ID NO: 1922143 - DNA, 17 bp, Homo sapiens
taggttaataggaggac

SEQ ID NO: 1922144 - DNA, 23 bp, Homo sapiens
taggttggagatgacagaaatat

SEQ ID NO: 1922145 - DNA, 13 bp, Homo sapiens
tagtaaaaataaa

SEQ ID NO: 1922146 - DNA, 23 bp, Homo sapiens
tagtacaggtaaggtgagggaat

SEQ ID NO: 1922147 - DNA, 20 bp, Homo sapiens
tagtagagatttcatagcta

SEQ ID NO: 1922148 - DNA, 17 bp, Homo sapiens
tagtcttcaagcagatt

SEQ ID NO: 1922149 - DNA, 21 bp, Homo sapiens
tagtgaaggcttctctctgtg

SEQ ID NO: 1922150 - DNA, 18 bp, Homo sapiens
tagtgatggttcccctgt

SEQ ID NO: 1922151 - DNA, 22 bp, Homo sapiens
tagtgtataccacctgtacata

SEQ ID NO: 1922152 - DNA, 23 bp, Homo sapiens
tataaatactaaatatgaaattt

SEQ ID NO: 1922153 - DNA, 14 bp, Homo sapiens
tataaatatcacaa

SEQ ID NO: 1922154 - DNA, 13 bp, Homo sapiens
tataaatggtgag

SEQ ID NO: 1922155 - DNA, 14 bp, Homo sapiens
tataacagcaaata

SEQ ID NO: 1922156 - DNA, 19 bp, Homo sapiens
tataactgccttaaaactt

SEQ ID NO: 1922157 - DNA, 20 bp, Homo sapiens
tataactgccttaaaacttt

SEQ ID NO: 1922158 - DNA, 16 bp, Homo sapiens
tataagcaacatgaat

SEQ ID NO: 1922159 - DNA, 23 bp, Homo sapiens
tataagcaacatgaattaagaac

SEQ ID NO: 1922160 - DNA, 22 bp, Homo sapiens
tataagtaacttgtcaaggaat

SEQ ID NO: 1922161 - DNA, 17 bp, Homo sapiens
tataatatactatattt

SEQ ID NO: 1922162 - DNA, 20 bp, Homo sapiens
tataatatactatatttatg

SEQ ID NO: 1922163 - DNA, 17 bp, Homo sapiens
tataattgttatacatt

SEQ ID NO: 1922164 - DNA, 16 bp, Homo sapiens
tatactatatttatgg

SEQ ID NO: 1922165 - DNA, 14 bp, Homo sapiens
tataggccatctgt

SEQ ID NO: 1922166 - DNA, 18 bp, Homo sapiens
tataggccatctgtaaat

SEQ ID NO: 1922167 - DNA, 20 bp, Homo sapiens
tataggccatctgtaaatat

SEQ ID NO: 1922168 - DNA, 14 bp, Homo sapiens
tatatataatactt

SEQ ID NO: 1922169 - DNA, 20 bp, Homo sapiens
tatattacttttgtaaatat

SEQ ID NO: 1922170 - DNA, 13 bp, Homo sapiens
tatattatatata

SEQ ID NO: 1922171 - DNA, 19 bp, Homo sapiens
tatatttaggatttgtgtt

SEQ ID NO: 1922172 - DNA, 14 bp, Homo sapiens
tatatttttaagac

SEQ ID NO: 1922173 - DNA, 20 bp, Homo sapiens
tatcacaaagttgtttaact

SEQ ID NO: 1922174 - DNA, 21 bp, Homo sapiens
tatcccagagaacaatcacta

SEQ ID NO: 1922175 - DNA, 21 bp, Homo sapiens
tatcctaggcatctgctgtaa

SEQ ID NO: 1922176 - DNA, 14 bp, Homo sapiens
tatcctgcaccctc

SEQ ID NO: 1922177 - DNA, 12 bp, Homo sapiens
tatctagagaat

SEQ ID NO: 1922178 - DNA, 15 bp, Homo sapiens
tatctatttatctgt

SEQ ID NO: 1922179 - DNA, 14 bp, Homo sapiens
tatctcgaagtctt

SEQ ID NO: 1922180 - DNA, 12 bp, Homo sapiens
tccctccacacc

SEQ ID NO: 1922181 - DNA, 19 bp, Homo sapiens
tccctccacacctccaccc

SEQ ID NO: 1922182 - DNA, 21 bp, Homo sapiens
tccctccacgcttagggtctg

SEQ ID NO: 1922183 - DNA, 14 bp, Homo sapiens
tccctccctgcagg

SEQ ID NO: 1922184 - DNA, 15 bp, Homo sapiens
tccctccctttgaaa

SEQ ID NO: 1922185 - DNA, 15 bp, Homo sapiens
tccctccgggacctg

SEQ ID NO: 1922186 - DNA, 21 bp, Homo sapiens
tccctcgcatccgcctctgag

SEQ ID NO: 1922187 - DNA, 13 bp, Homo sapiens
tccctctgctcca

SEQ ID NO: 1922188 - DNA, 12 bp, Homo sapiens
tccctctttcct

SEQ ID NO: 1922189 - DNA, 11 bp, Homo sapiens
tccctgcaggg

SEQ ID NO: 1922190 - DNA, 14 bp, Homo sapiens
tccctgcagggtag

SEQ ID NO: 1922191 - DNA, 14 bp, Homo sapiens
tccctgcccctccc

SEQ ID NO: 1922192 - DNA, 17 bp, Homo sapiens
tccctgcgtctcctgcc

SEQ ID NO: 1922193 - DNA, 13 bp, Homo sapiens
tccctggtccctt

SEQ ID NO: 1922194 - DNA, 19 bp, Homo sapiens
tccctggtcccttggagac

SEQ ID NO: 1922195 - DNA, 14 bp, Homo sapiens
tccctgtaacctct

SEQ ID NO: 1922196 - DNA, 18 bp, Homo sapiens
tccctgtaacctcttcag

SEQ ID NO: 1922197 - DNA, 23 bp, Homo sapiens
tccctgtaacctcttcagaggcc

SEQ ID NO: 1922198 - DNA, 22 bp, Homo sapiens
tccctgtgtgtcgttcccttgt

SEQ ID NO: 1922199 - DNA, 16 bp, Homo sapiens
tcccttggcccctctc

SEQ ID NO: 1922200 - DNA, 13 bp, Homo sapiens
tcccttgtgtctg

SEQ ID NO: 1922201 - DNA, 17 bp, Homo sapiens
tcccttgtgtctgttgc

SEQ ID NO: 1922202 - DNA, 18 bp, Homo sapiens
tcccttgtgtctgttgct

SEQ ID NO: 1922203 - DNA, 18 bp, Homo sapiens
tccctttcactgaagtga

SEQ ID NO: 1922204 - DNA, 14 bp, Homo sapiens
tccctttccctgca

SEQ ID NO: 1922205 - DNA, 15 bp, Homo sapiens
tccctttgaaatgaa

SEQ ID NO: 1922206 - DNA, 14 bp, Homo sapiens
tccctttgttgctg

SEQ ID NO: 1922207 - DNA, 14 bp, Homo sapiens
tccgaaatcagcag

SEQ ID NO: 1922208 - DNA, 16 bp, Homo sapiens
tccgagccagctctgg

SEQ ID NO: 1922209 - DNA, 15 bp, Homo sapiens
tccgcctctgagcca

SEQ ID NO: 1922210 - DNA, 21 bp, Homo sapiens
tccgcctctgagccaggagcc

SEQ ID NO: 1922211 - DNA, 19 bp, Homo sapiens
tccggcatgagggctgaga

SEQ ID NO: 1922212 - DNA, 21 bp, Homo sapiens
tccgggacctggtgctgcctc

SEQ ID NO: 1922213 - DNA, 15 bp, Homo sapiens
tccgtatttcagact

SEQ ID NO: 1922214 - DNA, 20 bp, Homo sapiens
tccgtctaagtcatgagctg

SEQ ID NO: 1922215 - DNA, 20 bp, Homo sapiens
tccgtctcctctccagccct

SEQ ID NO: 1922216 - DNA, 21 bp, Homo sapiens
tcctagaggggacaagccagg

SEQ ID NO: 1922217 - DNA, 18 bp, Homo sapiens
tcctatacgcagcgtgct

SEQ ID NO: 1922218 - DNA, 18 bp, Homo sapiens
tcctatgtttttgttcaa

SEQ ID NO: 1922219 - DNA, 13 bp, Homo sapiens
tcctcaatccagc

SEQ ID NO: 1922220 - DNA, 14 bp, Homo sapiens
tcctcaatccagct

SEQ ID NO: 1922221 - DNA, 20 bp, Homo sapiens
tcctcactgagaaggcccca

SEQ ID NO: 1922222 - DNA, 23 bp, Homo sapiens
tcctccacgttctgctcatcatt

SEQ ID NO: 1922223 - DNA, 14 bp, Homo sapiens
tcctccagagcctg

SEQ ID NO: 1922224 - DNA, 17 bp, Homo sapiens
tcctccagagcctgggc

SEQ ID NO: 1922225 - DNA, 17 bp, Homo sapiens
tcctcccaactctggcc

SEQ ID NO: 1922226 - DNA, 16 bp, Homo sapiens
tcctcctcctcctcct

SEQ ID NO: 1922227 - DNA, 14 bp, Homo sapiens
tcctcctcctcctg

SEQ ID NO: 1922228 - DNA, 11 bp, Homo sapiens
tcctcctctgt

SEQ ID NO: 1922229 - DNA, 16 bp, Homo sapiens
tcctcctgggccctct

SEQ ID NO: 1922230 - DNA, 20 bp, Homo sapiens
tcctcctgttcctgccttct

SEQ ID NO: 1922231 - DNA, 21 bp, Homo sapiens
tcctcctgttcctgccttctc

SEQ ID NO: 1922232 - DNA, 17 bp, Homo sapiens
tcctctccactgccttc

SEQ ID NO: 1922233 - DNA, 18 bp, Homo sapiens
tcctctccactgccttcg

SEQ ID NO: 1922234 - DNA, 16 bp, Homo sapiens
tcctctcggctggaag

SEQ ID NO: 1922235 - DNA, 17 bp, Homo sapiens
tcctctcggctggaaga

SEQ ID NO: 1922236 - DNA, 18 bp, Homo sapiens
tcctctcggctggaagaa

SEQ ID NO: 1922237 - DNA, 20 bp, Homo sapiens
tcctctcggctggaagaaca

SEQ ID NO: 1922238 - DNA, 13 bp, Homo sapiens
tcctctctctccc

SEQ ID NO: 1922239 - DNA, 18 bp, Homo sapiens
tcctctctctccctccac

SEQ ID NO: 1922240 - DNA, 18 bp, Homo sapiens
tcctctgactcagggctc

SEQ ID NO: 1922241 - DNA, 17 bp, Homo sapiens
tcctcttcctgcctctc

SEQ ID NO: 1922242 - DNA, 21 bp, Homo sapiens
tcctgaggggatatccctatg

SEQ ID NO: 1922243 - DNA, 14 bp, Homo sapiens
tcctgatcagagcc

SEQ ID NO: 1922244 - DNA, 15 bp, Homo sapiens
tcctgcaccctctgc

SEQ ID NO: 1922245 - DNA, 22 bp, Homo sapiens
tcctgccttcctcctgggccct

SEQ ID NO: 1922246 - DNA, 21 bp, Homo sapiens
tcctgccttttaccttcagta

SEQ ID NO: 1922247 - DNA, 21 bp, Homo sapiens
tcctgggaaatattccctaga

SEQ ID NO: 1922248 - DNA, 21 bp, Homo sapiens
tcctgggccctctctgctctg

SEQ ID NO: 1922249 - DNA, 23 bp, Homo sapiens
tcctggggctgggtgtgtttcag

SEQ ID NO: 1922250 - DNA, 21 bp, Homo sapiens
tcctgggttttgtattctctg

SEQ ID NO: 1922251 - DNA, 22 bp, Homo sapiens
tcctgggttttgtattctctga

SEQ ID NO: 1922252 - DNA, 12 bp, Homo sapiens
tcctgtacaagt

SEQ ID NO: 1922253 - DNA, 19 bp, Homo sapiens
tcctgtcaatgtttgcttt

SEQ ID NO: 1922254 - DNA, 21 bp, Homo sapiens
tcctgttcctgccttctcttc

SEQ ID NO: 1922255 - DNA, 20 bp, Homo sapiens
tccttagaaaagactgacct

SEQ ID NO: 1922256 - DNA, 21 bp, Homo sapiens
tccttcagcagctagagctca

SEQ ID NO: 1922257 - DNA, 19 bp, Homo sapiens
tccttccaagtcttcctga

SEQ ID NO: 1922258 - DNA, 12 bp, Homo sapiens
tccttctcccct

SEQ ID NO: 1922259 - DNA, 14 bp, Homo sapiens
tccttctcccctcc

SEQ ID NO: 1922260 - DNA, 16 bp, Homo sapiens
tccttctcccctccag

SEQ ID NO: 1922261 - DNA, 21 bp, Homo sapiens
tccttctcccctccagacccc

SEQ ID NO: 1922262 - DNA, 18 bp, Homo sapiens
tccttctcgtcttcctct

SEQ ID NO: 1922263 - DNA, 24 bp, Homo sapiens
tccttctcgtcttcctctctctca

SEQ ID NO: 1922264 - DNA, 16 bp, Homo sapiens
tccttgccgctgggag

SEQ ID NO: 1922265 - DNA, 13 bp, Homo sapiens
tccttgggccctt

SEQ ID NO: 1922266 - DNA, 19 bp, Homo sapiens
tcctttcacaaccttctgt

SEQ ID NO: 1922267 - DNA, 22 bp, Homo sapiens
tcctttccttctcgtcttcctc

SEQ ID NO: 1922268 - DNA, 19 bp, Homo sapiens
tcctttgtttttttttcct

SEQ ID NO: 1922269 - DNA, 20 bp, Homo sapiens
tcgaagtcttccatcagcag

SEQ ID NO: 1922270 - DNA, 18 bp, Homo sapiens
tcgcatccgcctctgagc

SEQ ID NO: 1922271 - DNA, 23 bp, Homo sapiens
tcgcatccgcctctgagccagga

SEQ ID NO: 1922272 - DNA, 18 bp, Homo sapiens
tcggaatggtaaccgagc

SEQ ID NO: 1922273 - DNA, 20 bp, Homo sapiens
tcggcaacagggcttctctt

SEQ ID NO: 1922274 - DNA, 20 bp, Homo sapiens
tcggcctcttgagagcccca

SEQ ID NO: 1922275 - DNA, 16 bp, Homo sapiens
tcgtaacagcaggagc

SEQ ID NO: 1922276 - DNA, 16 bp, Homo sapiens
tcgtgaacataactga

SEQ ID NO: 1922277 - DNA, 19 bp, Homo sapiens
tcgtgcagcatatgaggat

SEQ ID NO: 1922278 - DNA, 18 bp, Homo sapiens
tcgtggagccacaggcag

SEQ ID NO: 1922279 - DNA, 17 bp, Homo sapiens
tcgtttgaatcacagta

SEQ ID NO: 1922280 - DNA, 14 bp, Homo sapiens
tctaaaggactggt

SEQ ID NO: 1922281 - DNA, 13 bp, Homo sapiens
tctaacctcatct

SEQ ID NO: 1922282 - DNA, 13 bp, Homo sapiens
tctaagtctttcc

SEQ ID NO: 1922283 - DNA, 14 bp, Homo sapiens
tctaagtctttcca

SEQ ID NO: 1922284 - DNA, 12 bp, Homo sapiens
tctaattaaaat

SEQ ID NO: 1922285 - DNA, 19 bp, Homo sapiens
tctaattaaaatgtgcagt

SEQ ID NO: 1922286 - DNA, 20 bp, Homo sapiens
tctaattaaaatgtgcagta

SEQ ID NO: 1922287 - DNA, 16 bp, Homo sapiens
tctacagagcttccct

SEQ ID NO: 1922288 - DNA, 14 bp, Homo sapiens
tctacatttttgtt

SEQ ID NO: 1922289 - DNA, 15 bp, Homo sapiens
tctacccatattaca

SEQ ID NO: 1922290 - DNA, 14 bp, Homo sapiens
tctaccttcatttt

SEQ ID NO: 1922291 - DNA, 17 bp, Homo sapiens
tctacttcagctttgga

SEQ ID NO: 1922292 - DNA, 12 bp, Homo sapiens
tctactttgaag

SEQ ID NO: 1922293 - DNA, 20 bp, Homo sapiens
tctactttgaagtcatacca

SEQ ID NO: 1922294 - DNA, 17 bp, Homo sapiens
tctagacactgaaggca

SEQ ID NO: 1922295 - DNA, 13 bp, Homo sapiens
tctagacagtatt

SEQ ID NO: 1922296 - DNA, 17 bp, Homo sapiens
tctagacagtattgcca

SEQ ID NO: 1922297 - DNA, 22 bp, Homo sapiens
tctagacagtattgccacctct

SEQ ID NO: 1922298 - DNA, 23 bp, Homo sapiens
tctagacagtattgccacctctg

SEQ ID NO: 1922299 - DNA, 14 bp, Homo sapiens
tctaggttctaaaa

SEQ ID NO: 1922300 - DNA, 22 bp, Homo sapiens
tctagtacttgggagacctgta

SEQ ID NO: 1922301 - DNA, 15 bp, Homo sapiens
tctatatttgtaact

SEQ ID NO: 1922302 - DNA, 13 bp, Homo sapiens
tctatgtaaaaat

SEQ ID NO: 1922303 - DNA, 15 bp, Homo sapiens
tctatgtaaattatt

SEQ ID NO: 1922304 - DNA, 18 bp, Homo sapiens
tctatgtaaattattgta

SEQ ID NO: 1922305 - DNA, 20 bp, Homo sapiens
tctcattaattcaattaaaa

SEQ ID NO: 1922306 - DNA, 14 bp, Homo sapiens
tctccactgccttc

SEQ ID NO: 1922307 - DNA, 13 bp, Homo sapiens
tctccagccctat

SEQ ID NO: 1922308 - DNA, 14 bp, Homo sapiens
tctccatcagaagg

SEQ ID NO: 1922309 - DNA, 14 bp, Homo sapiens
tctccatctccgct

SEQ ID NO: 1922310 - DNA, 18 bp, Homo sapiens
tctcccagataatgtgaa

SEQ ID NO: 1922311 - DNA, 13 bp, Homo sapiens
tctcccaggtgaa

SEQ ID NO: 1922312 - DNA, 13 bp, Homo sapiens
tctcccctccaga

SEQ ID NO: 1922313 - DNA, 14 bp, Homo sapiens
tctcccctccagac

SEQ ID NO: 1922314 - DNA, 16 bp, Homo sapiens
tctcccctccagaccc

SEQ ID NO: 1922315 - DNA, 19 bp, Homo sapiens
tctccctccactcctccca

SEQ ID NO: 1922316 - DNA, 14 bp, Homo sapiens
tctccctggcccca

SEQ ID NO: 1922317 - DNA, 16 bp, Homo sapiens
tctcctccatgggaga

SEQ ID NO: 1922318 - DNA, 20 bp, Homo sapiens
tctcctccatgggagaaaat

SEQ ID NO: 1922319 - DNA, 16 bp, Homo sapiens
tctcctctccagccct

SEQ ID NO: 1922320 - DNA, 17 bp, Homo sapiens
tctcctctccagcccta

SEQ ID NO: 1922321 - DNA, 12 bp, Homo sapiens
tctcctctccca

SEQ ID NO: 1922322 - DNA, 18 bp, Homo sapiens
tctcctctctctccctcc

SEQ ID NO: 1922323 - DNA, 16 bp, Homo sapiens
tctcctgccttcctcc

SEQ ID NO: 1922324 - DNA, 18 bp, Homo sapiens
tctcctgccttcctcctg

SEQ ID NO: 1922325 - DNA, 20 bp, Homo sapiens
tctcctgccttcctcctggg

SEQ ID NO: 1922326 - DNA, 19 bp, Homo sapiens
tctcggctggaagaacatc

SEQ ID NO: 1922327 - DNA, 22 bp, Homo sapiens
tctcggctggaagaacatcaag

SEQ ID NO: 1922328 - DNA, 22 bp, Homo sapiens
tctctcacctacttcctcctcc

SEQ ID NO: 1922329 - DNA, 23 bp, Homo sapiens
tctctcatggcttgggctggagt

SEQ ID NO: 1922330 - DNA, 11 bp, Homo sapiens
tctctccctcc

SEQ ID NO: 1922331 - DNA, 13 bp, Homo sapiens
tctctccctccac

SEQ ID NO: 1922332 - DNA, 20 bp, Homo sapiens
tctctccctccctttgaaat

SEQ ID NO: 1922333 - DNA, 11 bp, Homo sapiens
tctctctccct

SEQ ID NO: 1922334 - DNA, 12 bp, Homo sapiens
tctctctccctc

SEQ ID NO: 1922335 - DNA, 17 bp, Homo sapiens
tctctggacctgaccag

SEQ ID NO: 1922336 - DNA, 16 bp, Homo sapiens
tctctgtaaaatgaac

SEQ ID NO: 1922337 - DNA, 12 bp, Homo sapiens
tctctgtctcat

SEQ ID NO: 1922338 - DNA, 20 bp, Homo sapiens
tctcttaccccgtccctttc

SEQ ID NO: 1922339 - DNA, 18 bp, Homo sapiens
tctcttctatcctgcaat

SEQ ID NO: 1922340 - DNA, 15 bp, Homo sapiens
tctctttttcttcct

SEQ ID NO: 1922341 - DNA, 20 bp, Homo sapiens
tctgaaaccagtgttaggga

SEQ ID NO: 1922342 - DNA, 20 bp, Homo sapiens
tctgaaagctgcttctgggg

SEQ ID NO: 1922343 - DNA, 18 bp, Homo sapiens
tctgaaatacctttgcct

SEQ ID NO: 1922344 - DNA, 13 bp, Homo sapiens
tctgactcagggc

SEQ ID NO: 1922345 - DNA, 20 bp, Homo sapiens
tctgactcagggctcctggg

SEQ ID NO: 1922346 - DNA, 17 bp, Homo sapiens
tctgacttctcaggaag

SEQ ID NO: 1922347 - DNA, 20 bp, Homo sapiens
tctgagccctgccctcactc

SEQ ID NO: 1922348 - DNA, 18 bp, Homo sapiens
tctgagcggccgcctgtc

SEQ ID NO: 1922349 - DNA, 16 bp, Homo sapiens
tctgatgcaagcaaga

SEQ ID NO: 1922350 - DNA, 14 bp, Homo sapiens
tctgcagggcagcc

SEQ ID NO: 1922351 - DNA, 22 bp, Homo sapiens
tctgcagtcctcggcagctccg

SEQ ID NO: 1922352 - DNA, 14 bp, Homo sapiens
tctgcccccagctg

SEQ ID NO: 1922353 - DNA, 15 bp, Homo sapiens
tctgcccccagctgc

SEQ ID NO: 1922354 - DNA, 20 bp, Homo sapiens
tctgcccccagctgctcctc

SEQ ID NO: 1922355 - DNA, 17 bp, Homo sapiens
tctgcctcttctgggag

SEQ ID NO: 1922356 - DNA, 19 bp, Homo sapiens
tctgcctcttctgggaggg

SEQ ID NO: 1922357 - DNA, 13 bp, Homo sapiens
tctgcctgcctca

SEQ ID NO: 1922358 - DNA, 17 bp, Homo sapiens
tctgcctgcctcatgct

SEQ ID NO: 1922359 - DNA, 19 bp, Homo sapiens
tctgcctgcctcatgctct

SEQ ID NO: 1922360 - DNA, 21 bp, Homo sapiens
tctgcctgcctcatgctctct

SEQ ID NO: 1922361 - DNA, 19 bp, Homo sapiens
tctgcgtgtcacctgtgct

SEQ ID NO: 1922362 - DNA, 20 bp, Homo sapiens
tctgctcacattccctctca

SEQ ID NO: 1922363 - DNA, 15 bp, Homo sapiens
tctgctcatcattct

SEQ ID NO: 1922364 - DNA, 23 bp, Homo sapiens
tctgctcatcattctctgtctca

SEQ ID NO: 1922365 - DNA, 21 bp, Homo sapiens
tctgctctgcgtgtcacctgt

SEQ ID NO: 1922366 - DNA, 19 bp, Homo sapiens
tctgcttgttattagagat

SEQ ID NO: 1922367 - DNA, 16 bp, Homo sapiens
tctggaatgtaatcaa

SEQ ID NO: 1922368 - DNA, 18 bp, Homo sapiens
tctggaatgtaatcaatg

SEQ ID NO: 1922369 - DNA, 15 bp, Homo sapiens
tctggacctgaccag

SEQ ID NO: 1922370 - DNA, 12 bp, Homo sapiens
tctggagcccct

SEQ ID NO: 1922371 - DNA, 23 bp, Homo sapiens
tctggagcccctatcctgcaccc

SEQ ID NO: 1922372 - DNA, 23 bp, Homo sapiens
tctggagtctgaaggagaggagt

SEQ ID NO: 1922373 - DNA, 21 bp, Homo sapiens
tctggccaaatatgcactttc

SEQ ID NO: 1922374 - DNA, 21 bp, Homo sapiens
tctggccctgttgtgggggtg

SEQ ID NO: 1922375 - DNA, 16 bp, Homo sapiens
tctggctgtggcccct

SEQ ID NO: 1922376 - DNA, 18 bp, Homo sapiens
tctggctgtggcccctcc

SEQ ID NO: 1922377 - DNA, 16 bp, Homo sapiens
tctgggacctcagttt

SEQ ID NO: 1922378 - DNA, 19 bp, Homo sapiens
tctgtaaatatcccagaga

SEQ ID NO: 1922379 - DNA, 16 bp, Homo sapiens
tctgtccaatctgcaa

SEQ ID NO: 1922380 - DNA, 15 bp, Homo sapiens
tctgtctcatatgat

SEQ ID NO: 1922381 - DNA, 21 bp, Homo sapiens
tctgtctcatccatcatcatg

SEQ ID NO: 1922382 - DNA, 14 bp, Homo sapiens
tctgtctgagccct

SEQ ID NO: 1922383 - DNA, 15 bp, Homo sapiens
tctgtctgagccctg

SEQ ID NO: 1922384 - DNA, 17 bp, Homo sapiens
tctgtgcaatggaatat

SEQ ID NO: 1922385 - DNA, 19 bp, Homo sapiens
tctgtgcatttgtgtctgc

SEQ ID NO: 1922386 - DNA, 21 bp, Homo sapiens
tctgtgggactggcccacccc

SEQ ID NO: 1922387 - DNA, 23 bp, Homo sapiens
tctgtgggatgggatggtggagg

SEQ ID NO: 1922388 - DNA, 20 bp, Homo sapiens
tctgttaatgttaattaaag

SEQ ID NO: 1922389 - DNA, 20 bp, Homo sapiens
tctgttccccatggccactt

SEQ ID NO: 1922390 - DNA, 21 bp, Homo sapiens
tcttaagataatatttaaaat

SEQ ID NO: 1922391 - DNA, 14 bp, Homo sapiens
tcttaagcactttg

SEQ ID NO: 1922392 - DNA, 15 bp, Homo sapiens
tcttaagcactttga

SEQ ID NO: 1922393 - DNA, 22 bp, Homo sapiens
tcttaagcactttgaaaatatt

SEQ ID NO: 1922394 - DNA, 15 bp, Homo sapiens
tcttaatataactgc

SEQ ID NO: 1922395 - DNA, 14 bp, Homo sapiens
tcttacccacttcc

SEQ ID NO: 1922396 - DNA, 13 bp, Homo sapiens
tcttagctcttgg

SEQ ID NO: 1922397 - DNA, 18 bp, Homo sapiens
tcttatgtatgtgaaagt

SEQ ID NO: 1922398 - DNA, 21 bp, Homo sapiens
tcttatttaaattttcagaaa

SEQ ID NO: 1922399 - DNA, 22 bp, Homo sapiens
tcttcaggtgaaaaaggcaagc

SEQ ID NO: 1922400 - DNA, 15 bp, Homo sapiens
tcttccatcagcagt

SEQ ID NO: 1922401 - DNA, 17 bp, Homo sapiens
tcttccatcagcagtga

SEQ ID NO: 1922402 - DNA, 18 bp, Homo sapiens
tcttccatcagcagtgat

SEQ ID NO: 1922403 - DNA, 20 bp, Homo sapiens
tcttcccaaggccagtctga

SEQ ID NO: 1922404 - DNA, 13 bp, Homo sapiens
tcttcctccctcc

SEQ ID NO: 1922405 - DNA, 16 bp, Homo sapiens
tcttcctctctctcac

SEQ ID NO: 1922406 - DNA, 15 bp, Homo sapiens
tcttctatcctgcaa

SEQ ID NO: 1922407 - DNA, 16 bp, Homo sapiens
tcttctccactggatg

SEQ ID NO: 1922408 - DNA, 22 bp, Homo sapiens
tcttctgggagggcagcagggc

SEQ ID NO: 1922409 - DNA, 12 bp, Homo sapiens
tcttcttctcaa

SEQ ID NO: 1922410 - DNA, 15 bp, Homo sapiens
tcttcttctcaagca

SEQ ID NO: 1922411 - DNA, 19 bp, Homo sapiens
tcttctttgactataacaa

SEQ ID NO: 1922412 - DNA, 20 bp, Homo sapiens
tcttgagagcgctggcctct

SEQ ID NO: 1922413 - DNA, 22 bp, Homo sapiens
tcttgagcaaggcaagaagtgg

SEQ ID NO: 1922414 - DNA, 17 bp, Homo sapiens
tcttgagtgggccccct

SEQ ID NO: 1922415 - DNA, 19 bp, Homo sapiens
tcttgagtgggccccctct

SEQ ID NO: 1922416 - DNA, 21 bp, Homo sapiens
tcttgatgcatgcactgttcc

SEQ ID NO: 1922417 - DNA, 13 bp, Homo sapiens
tcttggagaggag

SEQ ID NO: 1922418 - DNA, 19 bp, Homo sapiens
tcttggagaggaggtgtgg

SEQ ID NO: 1922419 - DNA, 22 bp, Homo sapiens
tcttgggggtggggctgcatcc

SEQ ID NO: 1922420 - DNA, 19 bp, Homo sapiens
tcttgtccacattctactt

SEQ ID NO: 1922421 - DNA, 23 bp, Homo sapiens
tcttgtccacattctacttcagc

SEQ ID NO: 1922422 - DNA, 14 bp, Homo sapiens
gtctgtgcctcagt

SEQ ID NO: 1922423 - DNA, 12 bp, Homo sapiens
gtctgtgggact

SEQ ID NO: 1922424 - DNA, 20 bp, Homo sapiens
gtcttagggtacagcccagg

SEQ ID NO: 1922425 - DNA, 19 bp, Homo sapiens
gtcttccatcagcagtgat

SEQ ID NO: 1922426 - DNA, 12 bp, Homo sapiens
gtcttctccatc

SEQ ID NO: 1922427 - DNA, 18 bp, Homo sapiens
gtcttgagagcgctggcc

SEQ ID NO: 1922428 - DNA, 16 bp, Homo sapiens
gtcttgagtgggcccc

SEQ ID NO: 1922429 - DNA, 22 bp, Homo sapiens
gtcttgagtgggccccctctct

SEQ ID NO: 1922430 - DNA, 20 bp, Homo sapiens
gtctttccattggatctcat

SEQ ID NO: 1922431 - DNA, 19 bp, Homo sapiens
gtctttgctgtttatatat

SEQ ID NO: 1922432 - DNA, 15 bp, Homo sapiens
gtctttgtgtgctgt

SEQ ID NO: 1922433 - DNA, 17 bp, Homo sapiens
gtgaaaatggtccagga

SEQ ID NO: 1922434 - DNA, 18 bp, Homo sapiens
gtgaaacttgtgctatag

SEQ ID NO: 1922435 - DNA, 16 bp, Homo sapiens
gtgaagcccaggagga

SEQ ID NO: 1922436 - DNA, 14 bp, Homo sapiens
gtgaaggcttctct

SEQ ID NO: 1922437 - DNA, 12 bp, Homo sapiens
gtgaatacatgg

SEQ ID NO: 1922438 - DNA, 21 bp, Homo sapiens
gtgacatgcgggctgggcagc

SEQ ID NO: 1922439 - DNA, 16 bp, Homo sapiens
gtgaccaatgtcttga

SEQ ID NO: 1922440 - DNA, 20 bp, Homo sapiens
gtgaccgggggaagctgagc

SEQ ID NO: 1922441 - DNA, 21 bp, Homo sapiens
gtgactaccacttatttctaa

SEQ ID NO: 1922442 - DNA, 22 bp, Homo sapiens
gtgactaccacttatttctaaa

SEQ ID NO: 1922443 - DNA, 15 bp, Homo sapiens
gtgactctggctgcc

SEQ ID NO: 1922444 - DNA, 23 bp, Homo sapiens
gtgacttcagactctctcctctc

SEQ ID NO: 1922445 - DNA, 16 bp, Homo sapiens
gtgagaattaaaataa

SEQ ID NO: 1922446 - DNA, 14 bp, Homo sapiens
gtgaggaggaggca

SEQ ID NO: 1922447 - DNA, 16 bp, Homo sapiens
gtgaggaggaggcaga

SEQ ID NO: 1922448 - DNA, 20 bp, Homo sapiens
gtgaggaggaggcagaacca

SEQ ID NO: 1922449 - DNA, 14 bp, Homo sapiens
gtgaggccagggca

SEQ ID NO: 1922450 - DNA, 20 bp, Homo sapiens
gtgagggcaaaccaggctgc

SEQ ID NO: 1922451 - DNA, 18 bp, Homo sapiens
gtgagggtcagagaggag

SEQ ID NO: 1922452 - DNA, 18 bp, Homo sapiens
gttagtgatttgctatca

SEQ ID NO: 1922453 - DNA, 22 bp, Homo sapiens
gttatagagggtctaagattca

SEQ ID NO: 1922454 - DNA, 20 bp, Homo sapiens
gttattaatagccatttgaa

SEQ ID NO: 1922455 - DNA, 14 bp, Homo sapiens
gttattattggctt

SEQ ID NO: 1922456 - DNA, 13 bp, Homo sapiens
gttatttttgtct

SEQ ID NO: 1922457 - DNA, 19 bp, Homo sapiens
gttatttttgtctcgaaat

SEQ ID NO: 1922458 - DNA, 20 bp, Homo sapiens
gttcacttttgacaaaggca

SEQ ID NO: 1922459 - DNA, 17 bp, Homo sapiens
gttcatagtttctgtaa

SEQ ID NO: 1922460 - DNA, 22 bp, Homo sapiens
gttcatcatgagccgttgctaa

SEQ ID NO: 1922461 - DNA, 12 bp, Homo sapiens
gttccagacaga

SEQ ID NO: 1922462 - DNA, 13 bp, Homo sapiens
gttccagacagag

SEQ ID NO: 1922463 - DNA, 22 bp, Homo sapiens
gttccagacagagtggatctgg

SEQ ID NO: 1922464 - DNA, 14 bp, Homo sapiens
gttccagataaaaa

SEQ ID NO: 1922465 - DNA, 15 bp, Homo sapiens
gttcccctgttcact

SEQ ID NO: 1922466 - DNA, 22 bp, Homo sapiens
gttccccttccactgagggcag

SEQ ID NO: 1922467 - DNA, 20 bp, Homo sapiens
gttccctctttcctgtgcca

SEQ ID NO: 1922468 - DNA, 20 bp, Homo sapiens
gttcccttgtgtctgttgct

SEQ ID NO: 1922469 - DNA, 16 bp, Homo sapiens
gttccgtctcctctcc

SEQ ID NO: 1922470 - DNA, 19 bp, Homo sapiens
gttcctccagcaatgcctg

SEQ ID NO: 1922471 - DNA, 11 bp, Homo sapiens
gttcctgcctt

SEQ ID NO: 1922472 - DNA, 16 bp, Homo sapiens
gttcgtggagccacag

SEQ ID NO: 1922473 - DNA, 16 bp, Homo sapiens
gttctaagtctttcca

SEQ ID NO: 1922474 - DNA, 14 bp, Homo sapiens
gcacctgccccagg

SEQ ID NO: 1922475 - DNA, 17 bp, Homo sapiens
gcacctgggtgctctgg

SEQ ID NO: 1922476 - DNA, 21 bp, Homo sapiens
gcacctgggtgctctggctgg

SEQ ID NO: 1922477 - DNA, 14 bp, Homo sapiens
gcactaccgggggc

SEQ ID NO: 1922478 - DNA, 15 bp, Homo sapiens
gcactattggacttt

SEQ ID NO: 1922479 - DNA, 19 bp, Homo sapiens
gcactgaatcgtttcatgt

SEQ ID NO: 1922480 - DNA, 16 bp, Homo sapiens
gcactggaaaacatag

SEQ ID NO: 1922481 - DNA, 19 bp, Homo sapiens
gcactggtggcccgacagc

SEQ ID NO: 1922482 - DNA, 23 bp, Homo sapiens
gcactggtggcccgacagcctgg

SEQ ID NO: 1922483 - DNA, 17 bp, Homo sapiens
gcactgtcatgcccagc

SEQ ID NO: 1922484 - DNA, 19 bp, Homo sapiens
gcactgtcatgcccagctt

SEQ ID NO: 1922485 - DNA, 20 bp, Homo sapiens
gcactgtcatgcccagcttg

SEQ ID NO: 1922486 - DNA, 22 bp, Homo sapiens
gcactgtcatgcccagcttgga

SEQ ID NO: 1922487 - DNA, 18 bp, Homo sapiens
gcactgttccccctgtgc

SEQ ID NO: 1922488 - DNA, 19 bp, Homo sapiens
gcactgttccccctgtgca

SEQ ID NO: 1922489 - DNA, 20 bp, Homo sapiens
gcactgttccccctgtgcag

SEQ ID NO: 1922490 - DNA, 23 bp, Homo sapiens
gcacttggagcgtttttgctggc

SEQ ID NO: 1922491 - DNA, 12 bp, Homo sapiens
gcactttgaaaa

SEQ ID NO: 1922492 - DNA, 23 bp, Homo sapiens
gcactttgaaaatatttctatgt

SEQ ID NO: 1922493 - DNA, 15 bp, Homo sapiens
gcagaagagaaagta

SEQ ID NO: 1922494 - DNA, 21 bp, Homo sapiens
gcagaatggtgggctccagag

SEQ ID NO: 1922495 - DNA, 15 bp, Homo sapiens
gcagacagcaagggc

SEQ ID NO: 1922496 - DNA, 19 bp, Homo sapiens
gcagaggggagaggaagca

SEQ ID NO: 1922497 - DNA, 18 bp, Homo sapiens
gcagatgtccttgatgct

SEQ ID NO: 1922498 - DNA, 19 bp, Homo sapiens
gcagattggagaaaccctt

SEQ ID NO: 1922499 - DNA, 13 bp, Homo sapiens
gcagccctgcttt

SEQ ID NO: 1922500 - DNA, 14 bp, Homo sapiens
gcagccctgctttg

SEQ ID NO: 1922501 - DNA, 17 bp, Homo sapiens
gcagcctgtgggagaag

SEQ ID NO: 1922502 - DNA, 19 bp, Homo sapiens
gcagcctgtgggagaaggg

SEQ ID NO: 1922503 - DNA, 17 bp, Homo sapiens
gcagcgcccagcctggc

SEQ ID NO: 1922504 - DNA, 21 bp, Homo sapiens
gcagcgtctgagcggccgcct

SEQ ID NO: 1922505 - DNA, 22 bp, Homo sapiens
gcagctcaagttagcatttcaa

SEQ ID NO: 1922506 - DNA, 15 bp, Homo sapiens
gcagctgaaaagtaa

SEQ ID NO: 1922507 - DNA, 23 bp, Homo sapiens
gcagctttgaggctggcggggtc

SEQ ID NO: 1922508 - DNA, 21 bp, Homo sapiens
gcaggaaatgaaaatgtcttg

SEQ ID NO: 1922509 - DNA, 20 bp, Homo sapiens
gcaggaaggctgagaggaga

SEQ ID NO: 1922510 - DNA, 19 bp, Homo sapiens
gcaggacactgcagaacag

SEQ ID NO: 1922511 - DNA, 13 bp, Homo sapiens
gcaggagggtggc

SEQ ID NO: 1922512 - DNA, 22 bp, Homo sapiens
gcaggcaagacaccttcccagc

SEQ ID NO: 1922513 - DNA, 15 bp, Homo sapiens
gcagggcagcctgtg

SEQ ID NO: 1922514 - DNA, 21 bp, Homo sapiens
gcagggccccaggcattgcca

SEQ ID NO: 1922515 - DNA, 13 bp, Homo sapiens
gcagggcctggcc

SEQ ID NO: 1922516 - DNA, 14 bp, Homo sapiens
gcagggctgggcgc

SEQ ID NO: 1922517 - DNA, 12 bp, Homo sapiens
gcaggggctggg

SEQ ID NO: 1922518 - DNA, 15 bp, Homo sapiens
gcaggggctgggcag

SEQ ID NO: 1922519 - DNA, 16 bp, Homo sapiens
gcaggggctgggcaga

SEQ ID NO: 1922520 - DNA, 17 bp, Homo sapiens
gcaggggctgggcagag

SEQ ID NO: 1922521 - DNA, 21 bp, Homo sapiens
gcaggggggttgggttccaga

SEQ ID NO: 1922522 - DNA, 17 bp, Homo sapiens
gcagggttctagaaggg

SEQ ID NO: 1922523 - DNA, 18 bp, Homo sapiens
gcagggttctagaagggg

SEQ ID NO: 1922524 - DNA, 23 bp, Homo sapiens
gcagggttctagaaggggcgagg

SEQ ID NO: 1922525 - DNA, 23 bp, Homo sapiens
gcaggtcccgagccccctgtcct

SEQ ID NO: 1922526 - DNA, 22 bp, Homo sapiens
gcagtcacactgctgggaagtg

SEQ ID NO: 1922527 - DNA, 17 bp, Homo sapiens
gcagtcacccctgtctg

SEQ ID NO: 1922528 - DNA, 16 bp, Homo sapiens
gcagtgaaacttgtgc

SEQ ID NO: 1922529 - DNA, 20 bp, Homo sapiens
gcagtgattgaagtatctgt

SEQ ID NO: 1922530 - DNA, 18 bp, Homo sapiens
gcagtggactgtgtccct

SEQ ID NO: 1922531 - DNA, 13 bp, Homo sapiens
gcagtggagaggg

SEQ ID NO: 1922532 - DNA, 24 bp, Homo sapiens
gcagtggagaggggacttggatag

SEQ ID NO: 1922533 - DNA, 19 bp, Homo sapiens
gcagtgtgaggccagggca

SEQ ID NO: 1922534 - DNA, 17 bp, Homo sapiens
gcataacaattcctcta

SEQ ID NO: 1922535 - DNA, 20 bp, Homo sapiens
gcatagtaccaatcatttta

SEQ ID NO: 1922536 - DNA, 16 bp, Homo sapiens
gcatcccttggcccct

SEQ ID NO: 1922537 - DNA, 17 bp, Homo sapiens
gcatccgcctctgagcc

SEQ ID NO: 1922538 - DNA, 12 bp, Homo sapiens
gcatctcagccc

SEQ ID NO: 1922539 - DNA, 12 bp, Homo sapiens
gcatctcccaga

SEQ ID NO: 1922540 - DNA, 13 bp, Homo sapiens
gcatctctggagt

SEQ ID NO: 1922541 - DNA, 17 bp, Homo sapiens
gcatctgtggcctgggg

SEQ ID NO: 1922542 - DNA, 22 bp, Homo sapiens
gcatgaaactatgcacctataa

SEQ ID NO: 1922543 - DNA, 23 bp, Homo sapiens
gcatgcactgttccccctgtgca

SEQ ID NO: 1922544 - DNA, 14 bp, Homo sapiens
gcatggccaggtgg

SEQ ID NO: 1922545 - DNA, 19 bp, Homo sapiens
gcatggcccagcctggagc

SEQ ID NO: 1922546 - DNA, 23 bp, Homo sapiens
gcatgtccctaccgagtctcttc

SEQ ID NO: 1922547 - DNA, 21 bp, Homo sapiens
gcatgttcttgttttgttata

SEQ ID NO: 1922548 - DNA, 23 bp, Homo sapiens
gggactggcccacccctcttccc

SEQ ID NO: 1922549 - DNA, 15 bp, Homo sapiens
gggacttcaaaatca

SEQ ID NO: 1922550 - DNA, 24 bp, Homo sapiens
gggacttcaaaatcagtgatggga

SEQ ID NO: 1922551 - DNA, 15 bp, Homo sapiens
gggagaaaagacatg

SEQ ID NO: 1922552 - DNA, 15 bp, Homo sapiens
gggagaagggacagc

SEQ ID NO: 1922553 - DNA, 18 bp, Homo sapiens
gggagaatggctctggct

SEQ ID NO: 1922554 - DNA, 19 bp, Homo sapiens
gggagactgggctgaggga

SEQ ID NO: 1922555 - DNA, 20 bp, Homo sapiens
gggagactgggctgagggag

SEQ ID NO: 1922556 - DNA, 13 bp, Homo sapiens
gggagaggaagca

SEQ ID NO: 1922557 - DNA, 14 bp, Homo sapiens
gggagaggaagcca

SEQ ID NO: 1922558 - DNA, 13 bp, Homo sapiens
gggagcagctggg

SEQ ID NO: 1922559 - DNA, 15 bp, Homo sapiens
gggaggccgaggcag

SEQ ID NO: 1922560 - DNA, 16 bp, Homo sapiens
gggaggggcctggcct

SEQ ID NO: 1922561 - DNA, 14 bp, Homo sapiens
gggaggtcattttg

SEQ ID NO: 1922562 - DNA, 16 bp, Homo sapiens
gggagtgggagaggaa

SEQ ID NO: 1922563 - DNA, 23 bp, Homo sapiens
gggatatccctatgtcccagccc

SEQ ID NO: 1922564 - DNA, 17 bp, Homo sapiens
gggatctaaaaggagga

SEQ ID NO: 1922565 - DNA, 16 bp, Homo sapiens
gggatcttacccactt

SEQ ID NO: 1922566 - DNA, 22 bp, Homo sapiens
gggcactgggccggcagcctgg

SEQ ID NO: 1922567 - DNA, 16 bp, Homo sapiens
gggcagaccagagagc

SEQ ID NO: 1922568 - DNA, 16 bp, Homo sapiens
gggcagaggggagagg

SEQ ID NO: 1922569 - DNA, 19 bp, Homo sapiens
gggcagaggggagaggaag

SEQ ID NO: 1922570 - DNA, 23 bp, Homo sapiens
gggcagaggggagaggaagcaca

SEQ ID NO: 1922571 - DNA, 20 bp, Homo sapiens
gggcagcctgtgggagaagg

SEQ ID NO: 1922572 - DNA, 19 bp, Homo sapiens
gggcagctgttagagtcca

SEQ ID NO: 1922573 - DNA, 16 bp, Homo sapiens
gggcagtggagagggg

SEQ ID NO: 1922574 - DNA, 17 bp, Homo sapiens
gggcagtggagagggga

SEQ ID NO: 1922575 - DNA, 13 bp, Homo sapiens
gggccaagcccag

SEQ ID NO: 1922576 - DNA, 19 bp, Homo sapiens
gggccacatgggaggctca

SEQ ID NO: 1922577 - DNA, 19 bp, Homo sapiens
gggccacctccccaggccg

SEQ ID NO: 1922578 - DNA, 22 bp, Homo sapiens
gggccacctccccaggccgtgg

SEQ ID NO: 1922579 - DNA, 23 bp, Homo sapiens
gggccactggcatctctggagtg

SEQ ID NO: 1922580 - DNA, 16 bp, Homo sapiens
gggccctctctgctct

SEQ ID NO: 1922581 - DNA, 14 bp, Homo sapiens
gggcctggcctggg

SEQ ID NO: 1922582 - DNA, 13 bp, Homo sapiens
gggcgcctgggtc

SEQ ID NO: 1922583 - DNA, 21 bp, Homo sapiens
gggctaccctgagctgaggca

SEQ ID NO: 1922584 - DNA, 12 bp, Homo sapiens
gggctgagggag

SEQ ID NO: 1922585 - DNA, 14 bp, Homo sapiens
gggctgccctggtg

SEQ ID NO: 1922586 - DNA, 21 bp, Homo sapiens
gggctgccctggtgctgccac

SEQ ID NO: 1922587 - DNA, 17 bp, Homo sapiens
gggctgggcgcctctgt

SEQ ID NO: 1922588 - DNA, 12 bp, Homo sapiens
gggcttccctag

SEQ ID NO: 1922589 - DNA, 20 bp, Homo sapiens
gggcttccctagatggttcc

SEQ ID NO: 1922590 - DNA, 15 bp, Homo sapiens
gggcttccctctgct

SEQ ID NO: 1922591 - DNA, 19 bp, Homo sapiens
gggcttggggtagagagga

SEQ ID NO: 1922592 - DNA, 18 bp, Homo sapiens
ccctaccgagtctcttct

SEQ ID NO: 1922593 - DNA, 14 bp, Homo sapiens
ccctagaaagccat

SEQ ID NO: 1922594 - DNA, 23 bp, Homo sapiens
ccctagaaagccatattccagca

SEQ ID NO: 1922595 - DNA, 23 bp, Homo sapiens
ccctagatggttccctttgttgc

SEQ ID NO: 1922596 - DNA, 21 bp, Homo sapiens
ccctataccctaggtctccac

SEQ ID NO: 1922597 - DNA, 17 bp, Homo sapiens
ccctatcctgcaccctc

SEQ ID NO: 1922598 - DNA, 20 bp, Homo sapiens
ccctatcctgcaccctctgc

SEQ ID NO: 1922599 - DNA, 17 bp, Homo sapiens
ccctatgtcccagcccc

SEQ ID NO: 1922600 - DNA, 22 bp, Homo sapiens
ccctcaagccaggagaccctgt

SEQ ID NO: 1922601 - DNA, 15 bp, Homo sapiens
ccctcactccactcc

SEQ ID NO: 1922602 - DNA, 18 bp, Homo sapiens
ccctcatcacacgtcaca

SEQ ID NO: 1922603 - DNA, 12 bp, Homo sapiens
ccctccactcct

SEQ ID NO: 1922604 - DNA, 22 bp, Homo sapiens
ccctccactcctcccaactctg

SEQ ID NO: 1922605 - DNA, 13 bp, Homo sapiens
ccctccagacccc

SEQ ID NO: 1922606 - DNA, 17 bp, Homo sapiens
ccctccctgcagggtag

SEQ ID NO: 1922607 - DNA, 14 bp, Homo sapiens
ccctcccttcaacc

SEQ ID NO: 1922608 - DNA, 12 bp, Homo sapiens
ccctcctccaga

SEQ ID NO: 1922609 - DNA, 15 bp, Homo sapiens
ccctccttctcccct

SEQ ID NO: 1922610 - DNA, 16 bp, Homo sapiens
ccctccttctcccctc

SEQ ID NO: 1922611 - DNA, 22 bp, Homo sapiens
ccctccttctcccctccagacc

SEQ ID NO: 1922612 - DNA, 23 bp, Homo sapiens
ccctccttctcccctccagaccc

SEQ ID NO: 1922613 - DNA, 20 bp, Homo sapiens
ccctccttgccgctgggaga

SEQ ID NO: 1922614 - DNA, 21 bp, Homo sapiens
ccctcgcatccgcctctgagc

SEQ ID NO: 1922615 - DNA, 18 bp, Homo sapiens
ccctctacagagcttccc

SEQ ID NO: 1922616 - DNA, 14 bp, Homo sapiens
ccctctctgtccaa

SEQ ID NO: 1922617 - DNA, 17 bp, Homo sapiens
ccctctcttaccccgtc

SEQ ID NO: 1922618 - DNA, 12 bp, Homo sapiens
ccctctgcaggg

SEQ ID NO: 1922619 - DNA, 21 bp, Homo sapiens
ccctctgcagggcagcctgtg

SEQ ID NO: 1922620 - DNA, 20 bp, Homo sapiens
ccctctgtccaggcactgag

SEQ ID NO: 1922621 - DNA, 24 bp, Homo sapiens
ccctctgtccaggcactgagatac

SEQ ID NO: 1922622 - DNA, 15 bp, Homo sapiens
ccctcttcccccttc

SEQ ID NO: 1922623 - DNA, 15 bp, Homo sapiens
ccctctttcctgtgc

SEQ ID NO: 1922624 - DNA, 17 bp, Homo sapiens
ccctctttcctgtgcca

SEQ ID NO: 1922625 - DNA, 18 bp, Homo sapiens
ccctctttcctgtgccag

SEQ ID NO: 1922626 - DNA, 19 bp, Homo sapiens
ccctctttcctgtgccagg

SEQ ID NO: 1922627 - DNA, 21 bp, Homo sapiens
ccctgactcattctgaaggag

SEQ ID NO: 1922628 - DNA, 17 bp, Homo sapiens
ccctgagctgaggcagc

SEQ ID NO: 1922629 - DNA, 15 bp, Homo sapiens
ccctgcagctttgag

SEQ ID NO: 1922630 - DNA, 13 bp, Homo sapiens
ccctgcatccctt

SEQ ID NO: 1922631 - DNA, 23 bp, Homo sapiens
ccctgcccctcccttcaaccatt

SEQ ID NO: 1922632 - DNA, 16 bp, Homo sapiens
ccctgcgccctccctc

SEQ ID NO: 1922633 - DNA, 18 bp, Homo sapiens
ccctgcgtctcctcgtcc

SEQ ID NO: 1922634 - DNA, 18 bp, Homo sapiens
ccctgctttgggctgccc

SEQ ID NO: 1922635 - DNA, 20 bp, Homo sapiens
ccctggccccagtgaccggg

SEQ ID NO: 1922636 - DNA, 14 bp, Homo sapiens
ccctggtgctgcca

SEQ ID NO: 1922637 - DNA, 15 bp, Homo sapiens
ccctggtgctgccac

SEQ ID NO: 1922638 - DNA, 22 bp, Homo sapiens
ccctgtccttcccacggccact

SEQ ID NO: 1922639 - DNA, 14 bp, Homo sapiens
ccctgtgatgcctg

SEQ ID NO: 1922640 - DNA, 22 bp, Homo sapiens
ccctgtgcagccgctgagcgag

SEQ ID NO: 1922641 - DNA, 14 bp, Homo sapiens
ccctgttcactcta

SEQ ID NO: 1922642 - DNA, 14 bp, Homo sapiens
cccttacagtagga

SEQ ID NO: 1922643 - DNA, 13 bp, Homo sapiens
cccttccactgag

SEQ ID NO: 1922644 - DNA, 23 bp, Homo sapiens
cccttcccacaggacatttctct

SEQ ID NO: 1922645 - DNA, 13 bp, Homo sapiens
cccttcccacccc

SEQ ID NO: 1922646 - DNA, 14 bp, Homo sapiens
cccttcccacccct

SEQ ID NO: 1922647 - DNA, 14 bp, Homo sapiens
cccttccccactcc

SEQ ID NO: 1922648 - DNA, 14 bp, Homo sapiens
cccttcccctgcgc

SEQ ID NO: 1922649 - DNA, 20 bp, Homo sapiens
cccttcccctgcgccctccc

SEQ ID NO: 1922650 - DNA, 21 bp, Homo sapiens
cccttcccctgcgccctccct

SEQ ID NO: 1922651 - DNA, 22 bp, Homo sapiens
cccttcccctgcgccctccctc

SEQ ID NO: 1922652 - DNA, 16 bp, Homo sapiens
cccttcctctccactg

SEQ ID NO: 1922653 - DNA, 21 bp, Homo sapiens
cccttcctctccactgccttc

SEQ ID NO: 1922654 - DNA, 18 bp, Homo sapiens
cccttggcactgatgggc

SEQ ID NO: 1922655 - DNA, 14 bp, Homo sapiens
cccttggcccctct

SEQ ID NO: 1922656 - DNA, 12 bp, Homo sapiens
cccttgtgtctg

SEQ ID NO: 1922657 - DNA, 12 bp, Homo sapiens
ccctttgagtgc

SEQ ID NO: 1922658 - DNA, 14 bp, Homo sapiens
ccctttgagtgcag

SEQ ID NO: 1922659 - DNA, 17 bp, Homo sapiens
ccctttgttgctgtctg

SEQ ID NO: 1922660 - DNA, 22 bp, Homo sapiens
ccgacagcctggcacagggcag

SEQ ID NO: 1922661 - DNA, 16 bp, Homo sapiens
ccgagccccctgtcct

SEQ ID NO: 1922662 - DNA, 12 bp, Homo sapiens
ccgaggcagggg

SEQ ID NO: 1922663 - DNA, 17 bp, Homo sapiens
ccgagggcgcctgggtc

SEQ ID NO: 1922664 - DNA, 14 bp, Homo sapiens
ccgagtctcttctc

SEQ ID NO: 1922665 - DNA, 16 bp, Homo sapiens
ccgagtctcttctcca

SEQ ID NO: 1922666 - DNA, 20 bp, Homo sapiens
ccgagtctcttctccactgg

SEQ ID NO: 1922667 - DNA, 17 bp, Homo sapiens
ccgcaacttcccaggcc

SEQ ID NO: 1922668 - DNA, 21 bp, Homo sapiens
ccgcaatgtgcccccagacgc

SEQ ID NO: 1922669 - DNA, 14 bp, Homo sapiens
ccgcaggggcccct

SEQ ID NO: 1922670 - DNA, 18 bp, Homo sapiens
ccgcaggggcccctcctc

SEQ ID NO: 1922671 - DNA, 21 bp, Homo sapiens
ccgcatgctcttacccacact

SEQ ID NO: 1922672 - DNA, 12 bp, Homo sapiens
ccgcctctgagc

SEQ ID NO: 1922673 - DNA, 13 bp, Homo sapiens
ccgcctgtccttg

SEQ ID NO: 1922674 - DNA, 13 bp, Homo sapiens
ccgcgagggcctg

SEQ ID NO: 1922675 - DNA, 12 bp, Homo sapiens
ccgctcagccct

SEQ ID NO: 1922676 - DNA, 21 bp, Homo sapiens
ccgctcagccctccctgcccc

SEQ ID NO: 1922677 - DNA, 14 bp, Homo sapiens
ccgctgctgtgaca

SEQ ID NO: 1922678 - DNA, 17 bp, Homo sapiens
ccgctgctgtgacaggc

SEQ ID NO: 1922679 - DNA, 14 bp, Homo sapiens
ccgctggagcatga

SEQ ID NO: 1922680 - DNA, 17 bp, Homo sapiens
ccgcttggagcagaggg

SEQ ID NO: 1922681 - DNA, 20 bp, Homo sapiens
ccggaatcctgtcctcagct

SEQ ID NO: 1922682 - DNA, 15 bp, Homo sapiens
ccggagatgcatctg

SEQ ID NO: 1922683 - DNA, 15 bp, Homo sapiens
ccggaggggcctggc

SEQ ID NO: 1922684 - DNA, 12 bp, Homo sapiens
ccggcagcctgg

SEQ ID NO: 1922685 - DNA, 13 bp, Homo sapiens
ccggcagcctggt

SEQ ID NO: 1922686 - DNA, 19 bp, Homo sapiens
ccggcccacgtcctgggtg

SEQ ID NO: 1922687 - DNA, 19 bp, Homo sapiens
ccggcccccgccctctgcc

SEQ ID NO: 1922688 - DNA, 21 bp, Homo sapiens
ccgggcactgtcatgcccagc

SEQ ID NO: 1922689 - DNA, 17 bp, Homo sapiens
ccgtataataaaaccaa

SEQ ID NO: 1922690 - DNA, 24 bp, Homo sapiens
ccgtcctggggtggttggaggcct

SEQ ID NO: 1922691 - DNA, 16 bp, Homo sapiens
ccgtgccttcagctct

SEQ ID NO: 1922692 - DNA, 17 bp, Homo sapiens
ccgtgccttcagctcta

SEQ ID NO: 1922693 - DNA, 14 bp, Homo sapiens
ccgtggcttcccgc

SEQ ID NO: 1922694 - DNA, 21 bp, Homo sapiens
cctaataaagttctgtactca

SEQ ID NO: 1922695 - DNA, 14 bp, Homo sapiens
cctaccctttccca

SEQ ID NO: 1922696 - DNA, 16 bp, Homo sapiens
cctaccgagtctcttc

SEQ ID NO: 1922697 - DNA, 12 bp, Homo sapiens
cctacctggtaa

SEQ ID NO: 1922698 - DNA, 17 bp, Homo sapiens
cctacttcctcctcctc

SEQ ID NO: 1922699 - DNA, 21 bp, Homo sapiens
cctaggcatctgctgtaataa

SEQ ID NO: 1922700 - DNA, 14 bp, Homo sapiens
cctagtggggaggg

SEQ ID NO: 1922701 - DNA, 18 bp, Homo sapiens
cctagtggggaggggcct

SEQ ID NO: 1922702 - DNA, 16 bp, Homo sapiens
cctataaaggaaacac

SEQ ID NO: 1922703 - DNA, 17 bp, Homo sapiens
cctataaaggaaacacg

SEQ ID NO: 1922704 - DNA, 23 bp, Homo sapiens
cctataaaggaaacacgtttaga

SEQ ID NO: 1922705 - DNA, 22 bp, Homo sapiens
cctatacgcagcgtgctttaaa

SEQ ID NO: 1922706 - DNA, 20 bp, Homo sapiens
cctatgccacctgcagcgtc

SEQ ID NO: 1922707 - DNA, 22 bp, Homo sapiens
cctatgtttttgttcaaagcca

SEQ ID NO: 1922708 - DNA, 13 bp, Homo sapiens
cctcaagccagga

SEQ ID NO: 1922709 - DNA, 15 bp, Homo sapiens
cctcaagccaggaga

SEQ ID NO: 1922710 - DNA, 19 bp, Homo sapiens
cctcaagccaggagaccct

SEQ ID NO: 1922711 - DNA, 23 bp, Homo sapiens
cctcactatttttttgttgctgt

SEQ ID NO: 1922712 - DNA, 18 bp, Homo sapiens
cctcactccactcccctc

SEQ ID NO: 1922713 - DNA, 20 bp, Homo sapiens
cctcactgagaaggccccag

SEQ ID NO: 1922714 - DNA, 16 bp, Homo sapiens
cctcagagccacccct

SEQ ID NO: 1922715 - DNA, 19 bp, Homo sapiens
cctcaggtcagggtgagga

SEQ ID NO: 1922716 - DNA, 20 bp, Homo sapiens
cctcaggtcagggtgaggat

SEQ ID NO: 1922717 - DNA, 19 bp, Homo sapiens
cctcagttttatcattttc

SEQ ID NO: 1922718 - DNA, 15 bp, Homo sapiens
cctcatcttcttcac

SEQ ID NO: 1922719 - DNA, 14 bp, Homo sapiens
cctcattcttctct

SEQ ID NO: 1922720 - DNA, 14 bp, Homo sapiens
cctgtgggagaagg

SEQ ID NO: 1922721 - DNA, 12 bp, Homo sapiens
cctgtgtccaca

SEQ ID NO: 1922722 - DNA, 22 bp, Homo sapiens
cctgtgtgtcgttcccttgtgt

SEQ ID NO: 1922723 - DNA, 14 bp, Homo sapiens
cctgttcctgcctt

SEQ ID NO: 1922724 - DNA, 18 bp, Homo sapiens
cctgtttgggaggctgga

SEQ ID NO: 1922725 - DNA, 20 bp, Homo sapiens
cctgtttgggaggctggagt

SEQ ID NO: 1922726 - DNA, 19 bp, Homo sapiens
cctgttttattgagttctg

SEQ ID NO: 1922727 - DNA, 21 bp, Homo sapiens
cctgttttcaccatctttcta

SEQ ID NO: 1922728 - DNA, 15 bp, Homo sapiens
ccttaaaaaataaag

SEQ ID NO: 1922729 - DNA, 10 bp, Homo sapiens
ccttaaaatt

SEQ ID NO: 1922730 - DNA, 17 bp, Homo sapiens
ccttacagtaggagccc

SEQ ID NO: 1922731 - DNA, 21 bp, Homo sapiens
ccttacagtaggagcccagct

SEQ ID NO: 1922732 - DNA, 18 bp, Homo sapiens
ccttagaacctttcttac

SEQ ID NO: 1922733 - DNA, 16 bp, Homo sapiens
ccttattagagtgtct

SEQ ID NO: 1922734 - DNA, 14 bp, Homo sapiens
ccttcaaccattcc

SEQ ID NO: 1922735 - DNA, 17 bp, Homo sapiens
ccttcagcagctagagc

SEQ ID NO: 1922736 - DNA, 17 bp, Homo sapiens
ccttccactgagggcag

SEQ ID NO: 1922737 - DNA, 23 bp, Homo sapiens
ccttccatggtgtgatcgtctga

SEQ ID NO: 1922738 - DNA, 13 bp, Homo sapiens
ccttcccacccct

SEQ ID NO: 1922739 - DNA, 15 bp, Homo sapiens
ccttcccacccctat

SEQ ID NO: 1922740 - DNA, 19 bp, Homo sapiens
ccttcccacggccactgca

SEQ ID NO: 1922741 - DNA, 14 bp, Homo sapiens
ccttccccactccc

SEQ ID NO: 1922742 - DNA, 16 bp, Homo sapiens
ccttcccctgcgccct

SEQ ID NO: 1922743 - DNA, 21 bp, Homo sapiens
ccttcccctgcgccctccctc

SEQ ID NO: 1922744 - DNA, 12 bp, Homo sapiens
ccttcctcctgg

SEQ ID NO: 1922745 - DNA, 15 bp, Homo sapiens
ccttcctctccactg

SEQ ID NO: 1922746 - DNA, 16 bp, Homo sapiens
ccttcctctccactgc

SEQ ID NO: 1922747 - DNA, 20 bp, Homo sapiens
ccttcctggagactgcccag

SEQ ID NO: 1922748 - DNA, 18 bp, Homo sapiens
ccttctcccctccagacc

SEQ ID NO: 1922749 - DNA, 22 bp, Homo sapiens
ccttctcccctccagaccccta

SEQ ID NO: 1922750 - DNA, 23 bp, Homo sapiens
ccttctcgtcttcctctctctca

SEQ ID NO: 1922751 - DNA, 16 bp, Homo sapiens
ccttctctcacctcct

SEQ ID NO: 1922752 - DNA, 17 bp, Homo sapiens
ccttctctcacctccta

SEQ ID NO: 1922753 - DNA, 18 bp, Homo sapiens
ccttcttccacagcaaat

SEQ ID NO: 1922754 - DNA, 19 bp, Homo sapiens
ccttgatggagatatttac

SEQ ID NO: 1922755 - DNA, 20 bp, Homo sapiens
ccttgatgtcttgagagcgc

SEQ ID NO: 1922756 - DNA, 22 bp, Homo sapiens
ccttgatgtcttgagagcgctg

SEQ ID NO: 1922757 - DNA, 18 bp, Homo sapiens
ccttgccgctgggagagc

SEQ ID NO: 1922758 - DNA, 17 bp, Homo sapiens
ccttggcactgatgggc

SEQ ID NO: 1922759 - DNA, 14 bp, Homo sapiens
ccttggcccctctc

SEQ ID NO: 1922760 - DNA, 17 bp, Homo sapiens
ccttggcccctctctgt

SEQ ID NO: 1922761 - DNA, 17 bp, Homo sapiens
ccttgggccctttgagt

SEQ ID NO: 1922762 - DNA, 16 bp, Homo sapiens
ccttggttcctccagc

SEQ ID NO: 1922763 - DNA, 18 bp, Homo sapiens
ccttggttcctccagcaa

SEQ ID NO: 1922764 - DNA, 21 bp, Homo sapiens
cctttagaaactgagtcctgt

SEQ ID NO: 1922765 - DNA, 13 bp, Homo sapiens
cctttccctgcat

SEQ ID NO: 1922766 - DNA, 12 bp, Homo sapiens
cctttccttctc

SEQ ID NO: 1922767 - DNA, 14 bp, Homo sapiens
cctttccttctcgt

SEQ ID NO: 1922768 - DNA, 18 bp, Homo sapiens
cctttctgacaataaata

SEQ ID NO: 1922769 - DNA, 22 bp, Homo sapiens
cctttgaggtctaaacaaataa

SEQ ID NO: 1922770 - DNA, 20 bp, Homo sapiens
cctttgcgtggatcaagctt

SEQ ID NO: 1922771 - DNA, 20 bp, Homo sapiens
ccttttattaacatatattg

SEQ ID NO: 1922772 - DNA, 13 bp, Homo sapiens
cgaaatgttattt

SEQ ID NO: 1922773 - DNA, 20 bp, Homo sapiens
cgaatcatgacagtcagcaa

SEQ ID NO: 1922774 - DNA, 15 bp, Homo sapiens
cgacacaggctgccg

SEQ ID NO: 1922775 - DNA, 16 bp, Homo sapiens
cgacacaggctgccgc

SEQ ID NO: 1922776 - DNA, 11 bp, Homo sapiens
cgactgtctcc

SEQ ID NO: 1922777 - DNA, 20 bp, Homo sapiens
cgacttgggacggaagtggc

SEQ ID NO: 1922778 - DNA, 12 bp, Homo sapiens
cgagacaggcag

SEQ ID NO: 1922779 - DNA, 13 bp, Homo sapiens
cgagcacctccac

SEQ ID NO: 1922780 - DNA, 19 bp, Homo sapiens
cgaggaggctccagagggc

SEQ ID NO: 1922781 - DNA, 19 bp, Homo sapiens
cgaggcagaatggtgggct

SEQ ID NO: 1922782 - DNA, 19 bp, Homo sapiens
cgaggcaggggctgggcag

SEQ ID NO: 1922783 - DNA, 16 bp, Homo sapiens
cgaggtatgaggtcta

SEQ ID NO: 1922784 - DNA, 14 bp, Homo sapiens
cgagtatctgtaac

SEQ ID NO: 1922785 - DNA, 18 bp, Homo sapiens
cgagtatctgtaaccctt

SEQ ID NO: 1922786 - DNA, 21 bp, Homo sapiens
cgatacaccgggcctggagaa

SEQ ID NO: 1922787 - DNA, 21 bp, Homo sapiens
cgcaagcgacacaggctgccg

SEQ ID NO: 1922788 - DNA, 21 bp, Homo sapiens
cgcaatccgagccagctctgg

SEQ ID NO: 1922789 - DNA, 18 bp, Homo sapiens
cgcaatgtgcccccagac

SEQ ID NO: 1922790 - DNA, 20 bp, Homo sapiens
cgcaatgtgcccccagacgc

SEQ ID NO: 1922791 - DNA, 10 bp, Homo sapiens
cgcacacaca

SEQ ID NO: 1922792 - DNA, 13 bp, Homo sapiens
cgcacacacactc

SEQ ID NO: 1922793 - DNA, 15 bp, Homo sapiens
cgcagccctgctttg

SEQ ID NO: 1922794 - DNA, 20 bp, Homo sapiens
cgcatccgcctctgagccag

SEQ ID NO: 1922795 - DNA, 22 bp, Homo sapiens
cgcatccgcctctgagccagga

SEQ ID NO: 1922796 - DNA, 16 bp, Homo sapiens
cgcccagcctggcccc

SEQ ID NO: 1922797 - DNA, 18 bp, Homo sapiens
cgccctccctccctccac

SEQ ID NO: 1922798 - DNA, 16 bp, Homo sapiens
cgcctctgagccagga

SEQ ID NO: 1922799 - DNA, 13 bp, Homo sapiens
cgcgcgcacacac

SEQ ID NO: 1922800 - DNA, 22 bp, Homo sapiens
cgctagagcattctggggtggg

SEQ ID NO: 1922801 - DNA, 15 bp, Homo sapiens
cgctgccagctctgt

SEQ ID NO: 1922802 - DNA, 14 bp, Homo sapiens
cgctgctctcccag

SEQ ID NO: 1922803 - DNA, 20 bp, Homo sapiens
cgctggagcatgagctctgt

SEQ ID NO: 1922804 - DNA, 13 bp, Homo sapiens
cgctgggagagcc

SEQ ID NO: 1922805 - DNA, 14 bp, Homo sapiens
cgctgggagagcca

SEQ ID NO: 1922806 - DNA, 17 bp, Homo sapiens
cggaaggacacagtcag

SEQ ID NO: 1922807 - DNA, 13 bp, Homo sapiens
cggaatggtaacc

SEQ ID NO: 1922808 - DNA, 13 bp, Homo sapiens
cggagccactcct

SEQ ID NO: 1922809 - DNA, 18 bp, Homo sapiens
cggagccactcctctgac

SEQ ID NO: 1922810 - DNA, 21 bp, Homo sapiens
cggagccactcctctgactca

SEQ ID NO: 1922811 - DNA, 16 bp, Homo sapiens
cggcaatttccggcca

SEQ ID NO: 1922812 - DNA, 12 bp, Homo sapiens
cggcagcctggt

SEQ ID NO: 1922813 - DNA, 13 bp, Homo sapiens
cggcagcctggtt

SEQ ID NO: 1922814 - DNA, 20 bp, Homo sapiens
cggcagcctggttccctctt

SEQ ID NO: 1922815 - DNA, 11 bp, Homo sapiens
cggccactgca

SEQ ID NO: 1922816 - DNA, 14 bp, Homo sapiens
cggccactgcagtc

SEQ ID NO: 1922817 - DNA, 17 bp, Homo sapiens
cggcccacgtcctgggt

SEQ ID NO: 1922818 - DNA, 14 bp, Homo sapiens
cggccgcctgtcct

SEQ ID NO: 1922819 - DNA, 13 bp, Homo sapiens
cggcctcttgaga

SEQ ID NO: 1922820 - DNA, 14 bp, Homo sapiens
cggcctgcagaccc

SEQ ID NO: 1922821 - DNA, 21 bp, Homo sapiens
cggcctgcagaccctgccagg

SEQ ID NO: 1922822 - DNA, 10 bp, Homo sapiens
cggcctgctt

SEQ ID NO: 1922823 - DNA, 24 bp, Homo sapiens
cggctcggcctcttgagagcccca

SEQ ID NO: 1922824 - DNA, 15 bp, Homo sapiens
cggctggaagaacat

SEQ ID NO: 1922825 - DNA, 21 bp, Homo sapiens
cgggcactgtcatgcccagct

SEQ ID NO: 1922826 - DNA, 15 bp, Homo sapiens
cgggctgggcagctg

SEQ ID NO: 1922827 - DNA, 17 bp, Homo sapiens
cgggtggcagcgcccag

SEQ ID NO: 1922828 - DNA, 17 bp, Homo sapiens
cggtatccacctgcagc

SEQ ID NO: 1922829 - DNA, 23 bp, Homo sapiens
cggtcactgcccacctgccaggc

SEQ ID NO: 1922830 - DNA, 16 bp, Homo sapiens
cggtgtgcaccagggt

SEQ ID NO: 1922831 - DNA, 21 bp, Homo sapiens
cggttaattggttaatcactt

SEQ ID NO: 1922832 - DNA, 19 bp, Homo sapiens
cgtaacagcaggagcatgg

SEQ ID NO: 1922833 - DNA, 15 bp, Homo sapiens
cgtattgtgaaattt

SEQ ID NO: 1922834 - DNA, 23 bp, Homo sapiens
cgtccctttccctgcatcccttg

SEQ ID NO: 1922835 - DNA, 23 bp, Homo sapiens
cgtcctggggtggttggaggcct

SEQ ID NO: 1922836 - DNA, 22 bp, Homo sapiens
cgtcctgggtgctgtcatgccc

SEQ ID NO: 1922837 - DNA, 14 bp, Homo sapiens
cgtcggaatggtaa

SEQ ID NO: 1922838 - DNA, 16 bp, Homo sapiens
cgtctccctggcccca

SEQ ID NO: 1922839 - DNA, 16 bp, Homo sapiens
cgtctcctctccagcc

SEQ ID NO: 1922840 - DNA, 22 bp, Homo sapiens
cgtctctccctccctttgaaat

SEQ ID NO: 1922841 - DNA, 13 bp, Homo sapiens
cgtctgagcggcc

SEQ ID NO: 1922842 - DNA, 17 bp, Homo sapiens
cgtctgagcggccgcct

SEQ ID NO: 1922843 - DNA, 23 bp, Homo sapiens
cgtctgagcggccgcctgtcctt

SEQ ID NO: 1922844 - DNA, 15 bp, Homo sapiens
cgtgccttcagctct

SEQ ID NO: 1922845 - DNA, 12 bp, Homo sapiens
cgtgctggagag

SEQ ID NO: 1922846 - DNA, 13 bp, Homo sapiens
cgtgctggagagt

SEQ ID NO: 1922847 - DNA, 15 bp, Homo sapiens
cgtgctggagagtag

SEQ ID NO: 1922848 - DNA, 17 bp, Homo sapiens
cgtggagccacaggcag

SEQ ID NO: 1922849 - DNA, 21 bp, Homo sapiens
cgtggccgctgcccacgtccc

SEQ ID NO: 1922850 - DNA, 21 bp, Homo sapiens
cgtggcttcccgctcagccct

SEQ ID NO: 1922851 - DNA, 15 bp, Homo sapiens
cgtgggatccagaga

SEQ ID NO: 1922852 - DNA, 17 bp, Homo sapiens
cgtgggctccctgactg

SEQ ID NO: 1922853 - DNA, 12 bp, Homo sapiens
cgtggggcagca

SEQ ID NO: 1922854 - DNA, 16 bp, Homo sapiens
cgtgtcacctgtgctt

SEQ ID NO: 1922855 - DNA, 23 bp, Homo sapiens
cgtgtgttgccattttgtctggc

SEQ ID NO: 1922856 - DNA, 14 bp, Homo sapiens
cgttaccaggcagg

SEQ ID NO: 1922857 - DNA, 13 bp, Homo sapiens
ctccactggatgg

SEQ ID NO: 1922858 - DNA, 12 bp, Homo sapiens
ctccagacccct

SEQ ID NO: 1922859 - DNA, 15 bp, Homo sapiens
ctccagacccctacc

SEQ ID NO: 1922860 - DNA, 14 bp, Homo sapiens
ctccagacccctgg

SEQ ID NO: 1922861 - DNA, 15 bp, Homo sapiens
ctccagacccctggc

SEQ ID NO: 1922862 - DNA, 18 bp, Homo sapiens
ctccagagcctgggcgca

SEQ ID NO: 1922863 - DNA, 20 bp, Homo sapiens
ctccagagggcactctgctt

SEQ ID NO: 1922864 - DNA, 21 bp, Homo sapiens
ctccagagggcactctgcttg

SEQ ID NO: 1922865 - DNA, 21 bp, Homo sapiens
ctccagagtaggtgggtcttg

SEQ ID NO: 1922866 - DNA, 23 bp, Homo sapiens
ctccagagtaggtgggtcttgga

SEQ ID NO: 1922867 - DNA, 20 bp, Homo sapiens
ctccagccacccagccagga

SEQ ID NO: 1922868 - DNA, 19 bp, Homo sapiens
ctccagctgggttggaaaa

SEQ ID NO: 1922869 - DNA, 17 bp, Homo sapiens
ctccagggccagggtgt

SEQ ID NO: 1922870 - DNA, 22 bp, Homo sapiens
ctccattcccatcactgctgtc

SEQ ID NO: 1922871 - DNA, 14 bp, Homo sapiens
ctcccacaggccct

SEQ ID NO: 1922872 - DNA, 20 bp, Homo sapiens
ctcccaggcgccccttcccc

SEQ ID NO: 1922873 - DNA, 22 bp, Homo sapiens
ctcccaggcgccccttccccct

SEQ ID NO: 1922874 - DNA, 23 bp, Homo sapiens
ctcccaggtgaaatccacaccag

SEQ ID NO: 1922875 - DNA, 19 bp, Homo sapiens
ctcccaggtttcccactgc

SEQ ID NO: 1922876 - DNA, 14 bp, Homo sapiens
ctccccaaggaaga

SEQ ID NO: 1922877 - DNA, 21 bp, Homo sapiens
ctccccatggtgcagtgaaga

SEQ ID NO: 1922878 - DNA, 13 bp, Homo sapiens
ctcccgaatcctg

SEQ ID NO: 1922879 - DNA, 18 bp, Homo sapiens
ctccctacttagacccag

SEQ ID NO: 1922880 - DNA, 14 bp, Homo sapiens
ctccctccacacct

SEQ ID NO: 1922881 - DNA, 15 bp, Homo sapiens
ctccctccacacctc

SEQ ID NO: 1922882 - DNA, 14 bp, Homo sapiens
ctccctccactcct

SEQ ID NO: 1922883 - DNA, 13 bp, Homo sapiens
ctccctccctgca

SEQ ID NO: 1922884 - DNA, 14 bp, Homo sapiens
ctccctccctgcag

SEQ ID NO: 1922885 - DNA, 22 bp, Homo sapiens
ctccctcgcatccgcctctgag

SEQ ID NO: 1922886 - DNA, 18 bp, Homo sapiens
ctccctgcccctcccttc

SEQ ID NO: 1922887 - DNA, 17 bp, Homo sapiens
ctccctggccccagtga

SEQ ID NO: 1922888 - DNA, 19 bp, Homo sapiens
ctccctgtaacctcttcag

SEQ ID NO: 1922889 - DNA, 21 bp, Homo sapiens
ctcccttcaaccattccccat

SEQ ID NO: 1922890 - DNA, 18 bp, Homo sapiens
ctcccttgggctccctgt

SEQ ID NO: 1922891 - DNA, 15 bp, Homo sapiens
ctccgggacctggtg

SEQ ID NO: 1922892 - DNA, 14 bp, Homo sapiens
ctccgtatttcaga

SEQ ID NO: 1922893 - DNA, 13 bp, Homo sapiens
ctcctacccctgt

SEQ ID NO: 1922894 - DNA, 21 bp, Homo sapiens
ctcctacccctgtcctggggc

SEQ ID NO: 1922895 - DNA, 23 bp, Homo sapiens
ctcctacccctgtcctggggctg

SEQ ID NO: 1922896 - DNA, 23 bp, Homo sapiens
ctcctagaggggacaagccaggc

SEQ ID NO: 1922897 - DNA, 15 bp, Homo sapiens
ctcctccagagcctg

SEQ ID NO: 1922898 - DNA, 18 bp, Homo sapiens
ctcctccagagcctgggc

SEQ ID NO: 1922899 - DNA, 15 bp, Homo sapiens
ctcctccatgggaga

SEQ ID NO: 1922900 - DNA, 18 bp, Homo sapiens
ctcctccatgggagaaaa

SEQ ID NO: 1922901 - DNA, 18 bp, Homo sapiens
ctcctcccaactctggcc

SEQ ID NO: 1922902 - DNA, 17 bp, Homo sapiens
ctcctcccaggcgcccc

SEQ ID NO: 1922903 - DNA, 15 bp, Homo sapiens
ctcctcccggtgccc

SEQ ID NO: 1922904 - DNA, 17 bp, Homo sapiens
ctcctcccggtgcccaa

SEQ ID NO: 1922905 - DNA, 15 bp, Homo sapiens
ctcctcctcctgttc

SEQ ID NO: 1922906 - DNA, 13 bp, Homo sapiens
ctcctctccagcc

SEQ ID NO: 1922907 - DNA, 16 bp, Homo sapiens
ctcctctctctccctc

SEQ ID NO: 1922908 - DNA, 17 bp, Homo sapiens
ctcctgaatccctttca

SEQ ID NO: 1922909 - DNA, 15 bp, Homo sapiens
ctcctgaggtctgga

SEQ ID NO: 1922910 - DNA, 13 bp, Homo sapiens
ctcctgcccactc

SEQ ID NO: 1922911 - DNA, 17 bp, Homo sapiens
ctcctggatccctttca

SEQ ID NO: 1922912 - DNA, 17 bp, Homo sapiens
ctcctgggccctctctg

SEQ ID NO: 1922913 - DNA, 21 bp, Homo sapiens
ctcctgggttttgtattctct

SEQ ID NO: 1922914 - DNA, 23 bp, Homo sapiens
ctcctgggttttgtattctctga

SEQ ID NO: 1922915 - DNA, 14 bp, Homo sapiens
ctcctgttcctgcc

SEQ ID NO: 1922916 - DNA, 10 bp, Homo sapiens
ctccttctcc

SEQ ID NO: 1922917 - DNA, 12 bp, Homo sapiens
ctccttctcccc

SEQ ID NO: 1922918 - DNA, 20 bp, Homo sapiens
ctccttctcccctccagacc

SEQ ID NO: 1922919 - DNA, 18 bp, Homo sapiens
ctccttgccgctgggaga

SEQ ID NO: 1922920 - DNA, 12 bp, Homo sapiens
ctccttgggccc

SEQ ID NO: 1922921 - DNA, 17 bp, Homo sapiens
ctccttgggccctttga

SEQ ID NO: 1922922 - DNA, 18 bp, Homo sapiens
ctccttgggccctttgag

SEQ ID NO: 1922923 - DNA, 21 bp, Homo sapiens
ctcgaagtcttccatcagcag

SEQ ID NO: 1922924 - DNA, 23 bp, Homo sapiens
ctcgcatccgcctctgagccagg

SEQ ID NO: 1922925 - DNA, 13 bp, Homo sapiens
ctcgctgccagct

SEQ ID NO: 1922926 - DNA, 19 bp, Homo sapiens
ctcgctggactctcagtct

SEQ ID NO: 1922927 - DNA, 23 bp, Homo sapiens
ctcgcttcacggacaggaagcac

SEQ ID NO: 1922928 - DNA, 18 bp, Homo sapiens
ctcggcctcttgagagcc

SEQ ID NO: 1922929 - DNA, 15 bp, Homo sapiens
ctcgtcttcctctct

SEQ ID NO: 1922930 - DNA, 23 bp, Homo sapiens
ctcgttgactggctgtgtgttgg

SEQ ID NO: 1922931 - DNA, 15 bp, Homo sapiens
ctctaaaagggggct

SEQ ID NO: 1922932 - DNA, 22 bp, Homo sapiens
ctctaaaagggggctattccct

SEQ ID NO: 1922933 - DNA, 13 bp, Homo sapiens
ctctaattaaaat

SEQ ID NO: 1922934 - DNA, 21 bp, Homo sapiens
ctctaattaaaatgtgcagta

SEQ ID NO: 1922935 - DNA, 18 bp, Homo sapiens
ctctacagagcttccctg

SEQ ID NO: 1922936 - DNA, 20 bp, Homo sapiens
ctctacagagcttccctgac

SEQ ID NO: 1922937 - DNA, 22 bp, Homo sapiens
ctctacagagcttccctgactc

SEQ ID NO: 1922938 - DNA, 16 bp, Homo sapiens
ctctacccatattaca

SEQ ID NO: 1922939 - DNA, 12 bp, Homo sapiens
ctctacctgaca

SEQ ID NO: 1922940 - DNA, 16 bp, Homo sapiens
ctctacttagcatgtc

SEQ ID NO: 1922941 - DNA, 13 bp, Homo sapiens
ctctcagtctctg

SEQ ID NO: 1922942 - DNA, 16 bp, Homo sapiens
ctctcagtctctgagc

SEQ ID NO: 1922943 - DNA, 17 bp, Homo sapiens
ctctcagtctctgagca

SEQ ID NO: 1922944 - DNA, 14 bp, Homo sapiens
ctctcatccaggtc

SEQ ID NO: 1922945 - DNA, 16 bp, Homo sapiens
ctctcatggcttgggc

SEQ ID NO: 1922946 - DNA, 15 bp, Homo sapiens
ctctccactgccttc

SEQ ID NO: 1922947 - DNA, 14 bp, Homo sapiens
ctctccctccactc

SEQ ID NO: 1922948 - DNA, 15 bp, Homo sapiens
ctctccctccactcc

SEQ ID NO: 1922949 - DNA, 19 bp, Homo sapiens
ctctccctccactcctccc

SEQ ID NO: 1922950 - DNA, 15 bp, Homo sapiens
ctctcctctctctcc

SEQ ID NO: 1922951 - DNA, 15 bp, Homo sapiens
ctctcggctggaaga

SEQ ID NO: 1922952 - DNA, 19 bp, Homo sapiens
ctctctcacctacttcctc

SEQ ID NO: 1922953 - DNA, 17 bp, Homo sapiens
ctctctccctccactcc

SEQ ID NO: 1922954 - DNA, 22 bp, Homo sapiens
ctctctgctctgcgtgtcacct

SEQ ID NO: 1922955 - DNA, 15 bp, Homo sapiens
ctctctgtttaccct

SEQ ID NO: 1922956 - DNA, 22 bp, Homo sapiens
ctctcttaccccgtccctttcc

SEQ ID NO: 1922957 - DNA, 17 bp, Homo sapiens
ctctgaaaccagtgtta

SEQ ID NO: 1922958 - DNA, 15 bp, Homo sapiens
ctctgactcagggct

SEQ ID NO: 1922959 - DNA, 20 bp, Homo sapiens
ctctgactcagggctcctgg

SEQ ID NO: 1922960 - DNA, 21 bp, Homo sapiens
ctctgagccaccgcgagggcc

SEQ ID NO: 1922961 - DNA, 15 bp, Homo sapiens
ctctgagctgtgcag

SEQ ID NO: 1922962 - DNA, 21 bp, Homo sapiens
ctctgatccctctacagagct

SEQ ID NO: 1922963 - DNA, 22 bp, Homo sapiens
ctctgatccctctacagagctt

SEQ ID NO: 1922964 - DNA, 18 bp, Homo sapiens
ctctgcagggcagcctgt

SEQ ID NO: 1922965 - DNA, 15 bp, Homo sapiens
ctctgcataccaggg

SEQ ID NO: 1922966 - DNA, 15 bp, Homo sapiens
ctctgcattctagta

SEQ ID NO: 1922967 - DNA, 17 bp, Homo sapiens
ctctgcccccagctgct

SEQ ID NO: 1922968 - DNA, 19 bp, Homo sapiens
ctctgcccccagctgctcc

SEQ ID NO: 1922969 - DNA, 17 bp, Homo sapiens
ctctgctatgtctgtga

SEQ ID NO: 1922970 - DNA, 15 bp, Homo sapiens
ctctgctttggaaat

SEQ ID NO: 1922971 - DNA, 20 bp, Homo sapiens
ctctggacctgaccagactg

SEQ ID NO: 1922972 - DNA, 16 bp, Homo sapiens
ctctggccaaatatgc

SEQ ID NO: 1922973 - DNA, 19 bp, Homo sapiens
ctctggccaaatatgcact

SEQ ID NO: 1922974 - DNA, 21 bp, Homo sapiens
ctctggccaaatatgcacttt

SEQ ID NO: 1922975 - DNA, 14 bp, Homo sapiens
ctctggccctgttg

SEQ ID NO: 1922976 - DNA, 22 bp, Homo sapiens
ctctggccttggttcctccagc

SEQ ID NO: 1922977 - DNA, 23 bp, Homo sapiens
ctctggccttggttcctccagca

SEQ ID NO: 1922978 - DNA, 14 bp, Homo sapiens
ctctgtaaaatgaa

SEQ ID NO: 1922979 - DNA, 19 bp, Homo sapiens
ctctgtccaggcactgaga

SEQ ID NO: 1922980 - DNA, 14 bp, Homo sapiens
ctctgtcctggccc

SEQ ID NO: 1922981 - DNA, 21 bp, Homo sapiens
ctctgtcctggcccgggagcc

SEQ ID NO: 1922982 - DNA, 14 bp, Homo sapiens
ctctgtgaccaatg

SEQ ID NO: 1922983 - DNA, 15 bp, Homo sapiens
ctctgtgaccaatgt

SEQ ID NO: 1922984 - DNA, 19 bp, Homo sapiens
ctctgtgaccaatgtcttg

SEQ ID NO: 1922985 - DNA, 17 bp, Homo sapiens
ctctgtttaccctccct

SEQ ID NO: 1922986 - DNA, 18 bp, Homo sapiens
ctctgtttaccctccctg

SEQ ID NO: 1922987 - DNA, 13 bp, Homo sapiens
ctcttaccccgtc

SEQ ID NO: 1922988 - DNA, 20 bp, Homo sapiens
ctcttaccccgtccctttcc

SEQ ID NO: 1922989 - DNA, 16 bp, Homo sapiens
ctggaaaacatagagt

SEQ ID NO: 1922990 - DNA, 18 bp, Homo sapiens
ctggaaaacatagagtag

SEQ ID NO: 1922991 - DNA, 21 bp, Homo sapiens
ctggaaaggatgcttctgctc

SEQ ID NO: 1922992 - DNA, 15 bp, Homo sapiens
ctggaaaggcccgga

SEQ ID NO: 1922993 - DNA, 15 bp, Homo sapiens
ctggaagaacatcaa

SEQ ID NO: 1922994 - DNA, 20 bp, Homo sapiens
ctggaccacgtctccctggc

SEQ ID NO: 1922995 - DNA, 14 bp, Homo sapiens
ctggacctgaccag

SEQ ID NO: 1922996 - DNA, 23 bp, Homo sapiens
ctggacctgaccagactgtgggt

SEQ ID NO: 1922997 - DNA, 14 bp, Homo sapiens
ctggactctcagtc

SEQ ID NO: 1922998 - DNA, 18 bp, Homo sapiens
ctggactctcagtctctg

SEQ ID NO: 1922999 - DNA, 14 bp, Homo sapiens
ctggagaactagag

SEQ ID NO: 1923000 - DNA, 15 bp, Homo sapiens
ctggagaactagaga

SEQ ID NO: 1923001 - DNA, 12 bp, Homo sapiens
ctggagccccta

SEQ ID NO: 1923002 - DNA, 19 bp, Homo sapiens
ctggagcccctatcctgca

SEQ ID NO: 1923003 - DNA, 23 bp, Homo sapiens
ctggagcccctatcctgcaccct

SEQ ID NO: 1923004 - DNA, 18 bp, Homo sapiens
ctggagtctgaaggagag

SEQ ID NO: 1923005 - DNA, 17 bp, Homo sapiens
ctggagtgggctctctg

SEQ ID NO: 1923006 - DNA, 20 bp, Homo sapiens
ctggatctccattctctcag

SEQ ID NO: 1923007 - DNA, 20 bp, Homo sapiens
ctggatggggcggcctgcag

SEQ ID NO: 1923008 - DNA, 22 bp, Homo sapiens
ctggattgatcggagcctcctc

SEQ ID NO: 1923009 - DNA, 16 bp, Homo sapiens
ctggcacagggcagtg

SEQ ID NO: 1923010 - DNA, 17 bp, Homo sapiens
ctggcagccgtgccttc

SEQ ID NO: 1923011 - DNA, 18 bp, Homo sapiens
ctggcagccgtgccttca

SEQ ID NO: 1923012 - DNA, 20 bp, Homo sapiens
ctggcagccgtgccttcagc

SEQ ID NO: 1923013 - DNA, 21 bp, Homo sapiens
ctggcagccgtgccttcagct

SEQ ID NO: 1923014 - DNA, 16 bp, Homo sapiens
ctggcatctctggagt

SEQ ID NO: 1923015 - DNA, 21 bp, Homo sapiens
ctggccaaatatgcactttcc

SEQ ID NO: 1923016 - DNA, 14 bp, Homo sapiens
ctggccccagctcc

SEQ ID NO: 1923017 - DNA, 13 bp, Homo sapiens
ctggccccagtga

SEQ ID NO: 1923018 - DNA, 18 bp, Homo sapiens
ctggccccagtgaccggg

SEQ ID NO: 1923019 - DNA, 17 bp, Homo sapiens
ctggcccgggagccgca

SEQ ID NO: 1923020 - DNA, 20 bp, Homo sapiens
ctggcctgggtggggcaggg

SEQ ID NO: 1923021 - DNA, 22 bp, Homo sapiens
ctggcctgggtggggcagggcc

SEQ ID NO: 1923022 - DNA, 22 bp, Homo sapiens
ctggcgacacgtagcagcttag

SEQ ID NO: 1923023 - DNA, 19 bp, Homo sapiens
ctggctcccacaggccctt

SEQ ID NO: 1923024 - DNA, 14 bp, Homo sapiens
ctggctgccttaga

SEQ ID NO: 1923025 - DNA, 21 bp, Homo sapiens
ctggctgtggcccctccttct

SEQ ID NO: 1923026 - DNA, 13 bp, Homo sapiens
ctggcttgcactt

SEQ ID NO: 1923027 - DNA, 24 bp, Homo sapiens
ctgggaatggggtgggagccacag

SEQ ID NO: 1923028 - DNA, 12 bp, Homo sapiens
ctgggagagcca

SEQ ID NO: 1923029 - DNA, 19 bp, Homo sapiens
ctgggagagccaaggccta

SEQ ID NO: 1923030 - DNA, 15 bp, Homo sapiens
ctgggagatgcagct

SEQ ID NO: 1923031 - DNA, 13 bp, Homo sapiens
ctgggaggcaggt

SEQ ID NO: 1923032 - DNA, 15 bp, Homo sapiens
ctgggagggcagcag

SEQ ID NO: 1923033 - DNA, 20 bp, Homo sapiens
ctgggagggcagcagggcta

SEQ ID NO: 1923034 - DNA, 15 bp, Homo sapiens
ctgggcaaagcctag

SEQ ID NO: 1923035 - DNA, 15 bp, Homo sapiens
ctgggcactgggccg

SEQ ID NO: 1923036 - DNA, 14 bp, Homo sapiens
ctgggcagagggga

SEQ ID NO: 1923037 - DNA, 22 bp, Homo sapiens
ctgggcagaggggagaggaagc

SEQ ID NO: 1923038 - DNA, 23 bp, Homo sapiens
ctgggcagaggggagaggaagca

SEQ ID NO: 1923039 - DNA, 21 bp, Homo sapiens
ctgggcagctgttagagtcca

SEQ ID NO: 1923040 - DNA, 13 bp, Homo sapiens
ctgggccctctct

SEQ ID NO: 1923041 - DNA, 14 bp, Homo sapiens
ctgggccctctctg

SEQ ID NO: 1923042 - DNA, 15 bp, Homo sapiens
ctgggccctctctgc

SEQ ID NO: 1923043 - DNA, 16 bp, Homo sapiens
ctgggccctgggtgag

SEQ ID NO: 1923044 - DNA, 19 bp, Homo sapiens
ctgggccggcagcctggtt

SEQ ID NO: 1923045 - DNA, 16 bp, Homo sapiens
ctgggcgcctctgtcc

SEQ ID NO: 1923046 - DNA, 13 bp, Homo sapiens
ctgggctgaggga

SEQ ID NO: 1923047 - DNA, 15 bp, Homo sapiens
ctgggggtgccagga

SEQ ID NO: 1923048 - DNA, 20 bp, Homo sapiens
ctggggtgatgttttacttt

SEQ ID NO: 1923049 - DNA, 15 bp, Homo sapiens
ctggggtggggcttg

SEQ ID NO: 1923050 - DNA, 18 bp, Homo sapiens
ctggggtggggcttggaa

SEQ ID NO: 1923051 - DNA, 21 bp, Homo sapiens
ctggggtggttggaggcctgg

SEQ ID NO: 1923052 - DNA, 19 bp, Homo sapiens
ctgggtcctcccagctgac

SEQ ID NO: 1923053 - DNA, 21 bp, Homo sapiens
ctgggtgctctggctggagag

SEQ ID NO: 1923054 - DNA, 20 bp, Homo sapiens
ctgggtggggcagggcctgg

SEQ ID NO: 1923055 - DNA, 13 bp, Homo sapiens
ctgggttggaaaa

SEQ ID NO: 1923056 - DNA, 19 bp, Homo sapiens
ctgggtttgggcagtggag

SEQ ID NO: 1923057 - DNA, 22 bp, Homo sapiens
ctggtatatatttaggatttgt

SEQ ID NO: 1923058 - DNA, 19 bp, Homo sapiens
ctggtcaagccccctttga

SEQ ID NO: 1923059 - DNA, 22 bp, Homo sapiens
ctggtcactgccatggaggcac

SEQ ID NO: 1923060 - DNA, 14 bp, Homo sapiens
ctggtccaggcttg

SEQ ID NO: 1923061 - DNA, 14 bp, Homo sapiens
ctggtctggagccc

SEQ ID NO: 1923062 - DNA, 20 bp, Homo sapiens
ctggtgctgccacacttcag

SEQ ID NO: 1923063 - DNA, 22 bp, Homo sapiens
ctggttccctctttcctgtgcc

SEQ ID NO: 1923064 - DNA, 15 bp, Homo sapiens
ctgtaaatatcccag

SEQ ID NO: 1923065 - DNA, 22 bp, Homo sapiens
ctgtaaatatcccagagaacaa

SEQ ID NO: 1923066 - DNA, 16 bp, Homo sapiens
ctgtaacatatatgaa

SEQ ID NO: 1923067 - DNA, 22 bp, Homo sapiens
ctgtaacccttgaatttctaga

SEQ ID NO: 1923068 - DNA, 19 bp, Homo sapiens
ctgtaacctcttcagaggc

SEQ ID NO: 1923069 - DNA, 22 bp, Homo sapiens
ctgtaacctcttcagaggccct

SEQ ID NO: 1923070 - DNA, 13 bp, Homo sapiens
ctgtacatacatt

SEQ ID NO: 1923071 - DNA, 23 bp, Homo sapiens
ctgtacctttctgacaataaata

SEQ ID NO: 1923072 - DNA, 15 bp, Homo sapiens
ctgtactcctcccag

SEQ ID NO: 1923073 - DNA, 19 bp, Homo sapiens
ctgtactcctcccaggcgc

SEQ ID NO: 1923074 - DNA, 21 bp, Homo sapiens
ctgtactcctcccaggcgccc

SEQ ID NO: 1923075 - DNA, 15 bp, Homo sapiens
ctgtattaagccact

SEQ ID NO: 1923076 - DNA, 21 bp, Homo sapiens
ctgtattctgcaacagcctgt

SEQ ID NO: 1923077 - DNA, 21 bp, Homo sapiens
ctgtcatgcccagcttggagt

SEQ ID NO: 1923078 - DNA, 19 bp, Homo sapiens
ctgtccaggcactgagata

SEQ ID NO: 1923079 - DNA, 12 bp, Homo sapiens
ctgtccctccgg

SEQ ID NO: 1923080 - DNA, 17 bp, Homo sapiens
ctgtccctccgggacct

SEQ ID NO: 1923081 - DNA, 14 bp, Homo sapiens
ctgtccctcctgag

SEQ ID NO: 1923082 - DNA, 20 bp, Homo sapiens
ctgtccttcccacggccact

SEQ ID NO: 1923083 - DNA, 15 bp, Homo sapiens
ctgtccttctctcac

SEQ ID NO: 1923084 - DNA, 23 bp, Homo sapiens
ctgtccttctctcacctcctaaa

SEQ ID NO: 1923085 - DNA, 14 bp, Homo sapiens
ctgtctaagaataa

SEQ ID NO: 1923086 - DNA, 19 bp, Homo sapiens
ctgtctcaagagggcactg

SEQ ID NO: 1923087 - DNA, 21 bp, Homo sapiens
ctgtctcaagagggcactggt

SEQ ID NO: 1923088 - DNA, 22 bp, Homo sapiens
ctgtctcaagagggcactggtg

SEQ ID NO: 1923089 - DNA, 23 bp, Homo sapiens
ctgtctcaagagggcactggtgg

SEQ ID NO: 1923090 - DNA, 13 bp, Homo sapiens
ctgtctcataatt

SEQ ID NO: 1923091 - DNA, 15 bp, Homo sapiens
ctgtctcatccatca

SEQ ID NO: 1923092 - DNA, 16 bp, Homo sapiens
ctgtctcatccatcat

SEQ ID NO: 1923093 - DNA, 18 bp, Homo sapiens
ctgtctgagccctgccct

SEQ ID NO: 1923094 - DNA, 20 bp, Homo sapiens
ctgtctgagccctgccctca

SEQ ID NO: 1923095 - DNA, 18 bp, Homo sapiens
ctgtctgcgccgctgtgc

SEQ ID NO: 1923096 - DNA, 20 bp, Homo sapiens
ctgtctgcgccgctgtgctg

SEQ ID NO: 1923097 - DNA, 23 bp, Homo sapiens
ctgtctttgctgtttatatatat

SEQ ID NO: 1923098 - DNA, 15 bp, Homo sapiens
ctgtgaccaatgtct

SEQ ID NO: 1923099 - DNA, 23 bp, Homo sapiens
ctgtgatgtcagtagtgcctgtg

SEQ ID NO: 1923100 - DNA, 15 bp, Homo sapiens
ctgtgattaattatt

SEQ ID NO: 1923101 - DNA, 19 bp, Homo sapiens
ctgtgattaattattgaaa

SEQ ID NO: 1923102 - DNA, 18 bp, Homo sapiens
ctgtgcacatctgtgtct

SEQ ID NO: 1923103 - DNA, 20 bp, Homo sapiens
ctgtgcacatctgtgtcttg

SEQ ID NO: 1923104 - DNA, 21 bp, Homo sapiens
ctgtgcacatctgtgtcttgt

SEQ ID NO: 1923105 - DNA, 14 bp, Homo sapiens
ctgtgcaccaagca

SEQ ID NO: 1923106 - DNA, 17 bp, Homo sapiens
ctgtgcagccgctgagc

SEQ ID NO: 1923107 - DNA, 19 bp, Homo sapiens
ctgtgcagccgctgagcga

SEQ ID NO: 1923108 - DNA, 17 bp, Homo sapiens
ctgtgcatttgtgtctg

SEQ ID NO: 1923109 - DNA, 23 bp, Homo sapiens
ctgtgccccatcagcagcttgac

SEQ ID NO: 1923110 - DNA, 17 bp, Homo sapiens
ctgtgcttcgggccctt

SEQ ID NO: 1923111 - DNA, 22 bp, Homo sapiens
ctgtggattttgtggcttcaat

SEQ ID NO: 1923112 - DNA, 23 bp, Homo sapiens
ctgtggcccctccttctcccctc

SEQ ID NO: 1923113 - DNA, 14 bp, Homo sapiens
ctgtggcctggggc

SEQ ID NO: 1923114 - DNA, 12 bp, Homo sapiens
ctgtgggactgg

SEQ ID NO: 1923115 - DNA, 22 bp, Homo sapiens
ctgtgggactggcccacccctc

SEQ ID NO: 1923116 - DNA, 16 bp, Homo sapiens
ctgtgggagaagggac

SEQ ID NO: 1923117 - DNA, 18 bp, Homo sapiens
ctgtgggagaagggacag

SEQ ID NO: 1923118 - DNA, 17 bp, Homo sapiens
ctgtgggtccctgcgtc

SEQ ID NO: 1923119 - DNA, 15 bp, Homo sapiens
ctgtggtgtgtcccc

SEQ ID NO: 1923120 - DNA, 16 bp, Homo sapiens
ctttatattttctata

SEQ ID NO: 1923121 - DNA, 18 bp, Homo sapiens
ctttatattttctatatt

SEQ ID NO: 1923122 - DNA, 16 bp, Homo sapiens
ctttatgttttaatat

SEQ ID NO: 1923123 - DNA, 13 bp, Homo sapiens
ctttatttctgtc

SEQ ID NO: 1923124 - DNA, 21 bp, Homo sapiens
ctttcactatgtccatgaaaa

SEQ ID NO: 1923125 - DNA, 20 bp, Homo sapiens
ctttcagtttgtccacacaa

SEQ ID NO: 1923126 - DNA, 17 bp, Homo sapiens
ctttcatgatttgcaac

SEQ ID NO: 1923127 - DNA, 20 bp, Homo sapiens
ctttcatgtaaactgtgcac

SEQ ID NO: 1923128 - DNA, 21 bp, Homo sapiens
ctttcatgtaaactgtgcacc

SEQ ID NO: 1923129 - DNA, 16 bp, Homo sapiens
ctttcattccctttca

SEQ ID NO: 1923130 - DNA, 21 bp, Homo sapiens
ctttccacggagccactcctc

SEQ ID NO: 1923131 - DNA, 14 bp, Homo sapiens
ctttccagccgtgt

SEQ ID NO: 1923132 - DNA, 18 bp, Homo sapiens
ctttccattggatctcat

SEQ ID NO: 1923133 - DNA, 14 bp, Homo sapiens
ctttcccaaaccct

SEQ ID NO: 1923134 - DNA, 14 bp, Homo sapiens
ctttccctagaaag

SEQ ID NO: 1923135 - DNA, 15 bp, Homo sapiens
ctttccctagaaagc

SEQ ID NO: 1923136 - DNA, 22 bp, Homo sapiens
ctttccctagaaagccatattc

SEQ ID NO: 1923137 - DNA, 23 bp, Homo sapiens
ctttccctagaaagccatattcc

SEQ ID NO: 1923138 - DNA, 14 bp, Homo sapiens
ctttccctgcatcc

SEQ ID NO: 1923139 - DNA, 14 bp, Homo sapiens
ctttccttctcgtc

SEQ ID NO: 1923140 - DNA, 15 bp, Homo sapiens
ctttctgacaataaa

SEQ ID NO: 1923141 - DNA, 17 bp, Homo sapiens
ctaaagtagacttcatt

SEQ ID NO: 1923142 - DNA, 23 bp, Homo sapiens
ctaaataaagcttgcaacaaaat

SEQ ID NO: 1923143 - DNA, 15 bp, Homo sapiens
ctaaatatgaaattt

SEQ ID NO: 1923144 - DNA, 12 bp, Homo sapiens
ctaaatgaatgt

SEQ ID NO: 1923145 - DNA, 16 bp, Homo sapiens
ctaaatgaatgtttac

SEQ ID NO: 1923146 - DNA, 14 bp, Homo sapiens
ctaacacccagtct

SEQ ID NO: 1923147 - DNA, 12 bp, Homo sapiens
ctaacctcatct

SEQ ID NO: 1923148 - DNA, 12 bp, Homo sapiens
ctaagatgaaat

SEQ ID NO: 1923149 - DNA, 16 bp, Homo sapiens
ctaatcagagtggcca

SEQ ID NO: 1923150 - DNA, 19 bp, Homo sapiens
ctaatcagcattctcactc

SEQ ID NO: 1923151 - DNA, 16 bp, Homo sapiens
ctaatcgccctgagct

SEQ ID NO: 1923152 - DNA, 22 bp, Homo sapiens
ctaatgaatgcataaaatgtta

SEQ ID NO: 1923153 - DNA, 23 bp, Homo sapiens
ctaattttgtacgtatgaatgat

SEQ ID NO: 1923154 - DNA, 18 bp, Homo sapiens
ctacagagcttccctgac

SEQ ID NO: 1923155 - DNA, 20 bp, Homo sapiens
ctacagagcttccctgactc

SEQ ID NO: 1923156 - DNA, 16 bp, Homo sapiens
ctacatttttgtttaa

SEQ ID NO: 1923157 - DNA, 19 bp, Homo sapiens
ctaccacttatttctaaat

SEQ ID NO: 1923158 - DNA, 14 bp, Homo sapiens
ctacccctgtcctg

SEQ ID NO: 1923159 - DNA, 16 bp, Homo sapiens
ctacccctgtcctggg

SEQ ID NO: 1923160 - DNA, 12 bp, Homo sapiens
ctaccctgagct

SEQ ID NO: 1923161 - DNA, 17 bp, Homo sapiens
ctaccgagtctcttctc

SEQ ID NO: 1923162 - DNA, 19 bp, Homo sapiens
ctaccgagtctcttctcca

SEQ ID NO: 1923163 - DNA, 22 bp, Homo sapiens
ctaccgagtctcttctccactg

SEQ ID NO: 1923164 - DNA, 19 bp, Homo sapiens
ctacctgacactcccttgg

SEQ ID NO: 1923165 - DNA, 18 bp, Homo sapiens
ctaccttccagttcctca

SEQ ID NO: 1923166 - DNA, 13 bp, Homo sapiens
ctacgcagaagag

SEQ ID NO: 1923167 - DNA, 17 bp, Homo sapiens
ctacgttaccaggcagg

SEQ ID NO: 1923168 - DNA, 17 bp, Homo sapiens
ctactgactttctcagc

SEQ ID NO: 1923169 - DNA, 13 bp, Homo sapiens
ctactgtacattt

SEQ ID NO: 1923170 - DNA, 15 bp, Homo sapiens
ctacttagacccagt

SEQ ID NO: 1923171 - DNA, 22 bp, Homo sapiens
ctacttagcatgtccctaccga

SEQ ID NO: 1923172 - DNA, 20 bp, Homo sapiens
ctagaaagccatattccagc

SEQ ID NO: 1923173 - DNA, 16 bp, Homo sapiens
ctagacactgaaggca

SEQ ID NO: 1923174 - DNA, 16 bp, Homo sapiens
ctagacagtattgcca

SEQ ID NO: 1923175 - DNA, 13 bp, Homo sapiens
ctagagattctta

SEQ ID NO: 1923176 - DNA, 19 bp, Homo sapiens
ctagagattcttagctctt

SEQ ID NO: 1923177 - DNA, 21 bp, Homo sapiens
ctagagattcttagctcttgg

SEQ ID NO: 1923178 - DNA, 22 bp, Homo sapiens
ctagagattcttagctcttggg

SEQ ID NO: 1923179 - DNA, 13 bp, Homo sapiens
ctagagcattctg

SEQ ID NO: 1923180 - DNA, 20 bp, Homo sapiens
ctagagcattctggggtggg

SEQ ID NO: 1923181 - DNA, 23 bp, Homo sapiens
ctagaggggacaagccaggccct

SEQ ID NO: 1923182 - DNA, 18 bp, Homo sapiens
ctagatcatgaagaacct

SEQ ID NO: 1923183 - DNA, 12 bp, Homo sapiens
ctagatggttcc

SEQ ID NO: 1923184 - DNA, 15 bp, Homo sapiens
ctagatggttccctt

SEQ ID NO: 1923185 - DNA, 21 bp, Homo sapiens
ctagattcatggctttaacag

SEQ ID NO: 1923186 - DNA, 17 bp, Homo sapiens
ctagggatccctcatct

SEQ ID NO: 1923187 - DNA, 23 bp, Homo sapiens
ctagggatccctcatctgtccct

SEQ ID NO: 1923188 - DNA, 17 bp, Homo sapiens
ctagggccaagcccagc

SEQ ID NO: 1923189 - DNA, 13 bp, Homo sapiens
ctaggttctaaaa

SEQ ID NO: 1923190 - DNA, 18 bp, Homo sapiens
ctagtaggagctgagctt

SEQ ID NO: 1923191 - DNA, 17 bp, Homo sapiens
ctagtgaaggcttctct

SEQ ID NO: 1923192 - DNA, 17 bp, Homo sapiens
ctagtgccatatatttt

SEQ ID NO: 1923193 - DNA, 18 bp, Homo sapiens
ctataggtaattaaggca

SEQ ID NO: 1923194 - DNA, 19 bp, Homo sapiens
ctataggtaattaaggcag

SEQ ID NO: 1923195 - DNA, 22 bp, Homo sapiens
ctatagtgtataccacctgtac

SEQ ID NO: 1923196 - DNA, 15 bp, Homo sapiens
ctatagtttgattct

SEQ ID NO: 1923197 - DNA, 13 bp, Homo sapiens
ctatatatacaat

SEQ ID NO: 1923198 - DNA, 16 bp, Homo sapiens
ctatatttgtaacttt

SEQ ID NO: 1923199 - DNA, 20 bp, Homo sapiens
ctatatttgtaactttgcat

SEQ ID NO: 1923200 - DNA, 21 bp, Homo sapiens
ctatatttgtaactttgcatg

SEQ ID NO: 1923201 - DNA, 13 bp, Homo sapiens
ctatgccacctgc

SEQ ID NO: 1923202 - DNA, 16 bp, Homo sapiens
ctatgcgtaaatcaac

SEQ ID NO: 1923203 - DNA, 14 bp, Homo sapiens
ctatgtaaaaatat

SEQ ID NO: 1923204 - DNA, 16 bp, Homo sapiens
ctatgtaaattattgt

SEQ ID NO: 1923205 - DNA, 19 bp, Homo sapiens
ctatgtaaattattgtaaa

SEQ ID NO: 1923206 - DNA, 22 bp, Homo sapiens
ctatgtccatgaaaaacagcag

SEQ ID NO: 1923207 - DNA, 13 bp, Homo sapiens
ctattcagaataa

SEQ ID NO: 1923208 - DNA, 15 bp, Homo sapiens
ctattcttaagcact

SEQ ID NO: 1923209 - DNA, 18 bp, Homo sapiens
ctattcttaagcactttg

SEQ ID NO: 1923210 - DNA, 11 bp, Homo sapiens
ctatttagaga

SEQ ID NO: 1923211 - DNA, 14 bp, Homo sapiens
ctatttagagatat

SEQ ID NO: 1923212 - DNA, 17 bp, Homo sapiens
ctatttctcccttcaat

SEQ ID NO: 1923213 - DNA, 19 bp, Homo sapiens
ctcaaagtttttacagtgt

SEQ ID NO: 1923214 - DNA, 18 bp, Homo sapiens
ctcaacgttgctccccat

SEQ ID NO: 1923215 - DNA, 16 bp, Homo sapiens
ctcaagatgaaggcaa

SEQ ID NO: 1923216 - DNA, 12 bp, Homo sapiens
ctcaagccagga

SEQ ID NO: 1923217 - DNA, 15 bp, Homo sapiens
ctcaagccaggagac

SEQ ID NO: 1923218 - DNA, 19 bp, Homo sapiens
ctcaagccaggagaccctg

SEQ ID NO: 1923219 - DNA, 20 bp, Homo sapiens
ctcaatggaggtttgcaaag

SEQ ID NO: 1923220 - DNA, 17 bp, Homo sapiens
ctcacagaacccttgga

SEQ ID NO: 1923221 - DNA, 17 bp, Homo sapiens
ctcacattccctctcat

SEQ ID NO: 1923222 - DNA, 15 bp, Homo sapiens
ctcacccccttctcc

SEQ ID NO: 1923223 - DNA, 17 bp, Homo sapiens
ctcactataccagtata

SEQ ID NO: 1923224 - DNA, 14 bp, Homo sapiens
ctcactccactccc

SEQ ID NO: 1923225 - DNA, 17 bp, Homo sapiens
ctcactccactcccctc

SEQ ID NO: 1923226 - DNA, 15 bp, Homo sapiens
ctcactcctacctgg

SEQ ID NO: 1923227 - DNA, 13 bp, Homo sapiens
ctcactctttctt

SEQ ID NO: 1923228 - DNA, 14 bp, Homo sapiens
ctcagaacagtctg

SEQ ID NO: 1923229 - DNA, 15 bp, Homo sapiens
ctcagagccacccct

SEQ ID NO: 1923230 - DNA, 19 bp, Homo sapiens
ctcagccctccctgcccct

SEQ ID NO: 1923231 - DNA, 21 bp, Homo sapiens
ctcagccctccctgcccctcc

SEQ ID NO: 1923232 - DNA, 20 bp, Homo sapiens
ctcaggaccaaagctttcat

SEQ ID NO: 1923233 - DNA, 13 bp, Homo sapiens
ctcaggagaaggc

SEQ ID NO: 1923234 - DNA, 19 bp, Homo sapiens
ctcaggagaaggcctgccc

SEQ ID NO: 1923235 - DNA, 18 bp, Homo sapiens
ctcaggcaattccttttg

SEQ ID NO: 1923236 - DNA, 13 bp, Homo sapiens
ctcaggctgccca

SEQ ID NO: 1923237 - DNA, 13 bp, Homo sapiens
ctcagggctcctg

SEQ ID NO: 1923238 - DNA, 14 bp, Homo sapiens
ctcagggctcctgg

SEQ ID NO: 1923239 - DNA, 15 bp, Homo sapiens
ctcagggctcctggg

SEQ ID NO: 1923240 - DNA, 22 bp, Homo sapiens
ctcaggttgtctgaagtcactg

SEQ ID NO: 1923241 - DNA, 14 bp, Homo sapiens
ctcagtctctgagc

SEQ ID NO: 1923242 - DNA, 20 bp, Homo sapiens
ctcagtctctgagcagtgaa

SEQ ID NO: 1923243 - DNA, 17 bp, Homo sapiens
ctcatcattctctgtct

SEQ ID NO: 1923244 - DNA, 18 bp, Homo sapiens
ctcatcattctctgtctc

SEQ ID NO: 1923245 - DNA, 20 bp, Homo sapiens
ctcatcattctctgtctcat

SEQ ID NO: 1923246 - DNA, 23 bp, Homo sapiens
ctcatcattctctgtctcatcca

SEQ ID NO: 1923247 - DNA, 15 bp, Homo sapiens
ctcatccacagaggc

SEQ ID NO: 1923248 - DNA, 21 bp, Homo sapiens
ctcatccactaggtgcccagt

SEQ ID NO: 1923249 - DNA, 22 bp, Homo sapiens
ctcatccactaggtgcccagtc

SEQ ID NO: 1923250 - DNA, 23 bp, Homo sapiens
ctcatccactaggtgcccagtct

SEQ ID NO: 1923251 - DNA, 22 bp, Homo sapiens
ctcatccaggtcctttccttct

SEQ ID NO: 1923252 - DNA, 23 bp, Homo sapiens
ctcatccaggtcctttccttctc

SEQ ID NO: 1923253 - DNA, 16 bp, Homo sapiens
ctcatccatcatcatg

SEQ ID NO: 1923254 - DNA, 19 bp, Homo sapiens
ctcatccatcatcatgtgt

SEQ ID NO: 1923255 - DNA, 20 bp, Homo sapiens
ctcatccatgcagataacag

SEQ ID NO: 1923256 - DNA, 22 bp, Homo sapiens
ctcatcccgagcacctccacat

SEQ ID NO: 1923257 - DNA, 13 bp, Homo sapiens
ctcatctgtccct

SEQ ID NO: 1923258 - DNA, 14 bp, Homo sapiens
ctcatgctctctat

SEQ ID NO: 1923259 - DNA, 17 bp, Homo sapiens
ctcattaattcaattaa

SEQ ID NO: 1923260 - DNA, 19 bp, Homo sapiens
ctcattaattcaattaaaa

SEQ ID NO: 1923261 - DNA, 13 bp, Homo sapiens
ctcattggaccct

SEQ ID NO: 1923262 - DNA, 22 bp, Homo sapiens
ctccaatcccaccaaccctcag

SEQ ID NO: 1923263 - DNA, 13 bp, Homo sapiens
ctccacacctcca

SEQ ID NO: 1923264 - DNA, 16 bp, Homo sapiens
ctccacacctccaccc

SEQ ID NO: 1923265 - DNA, 15 bp, Homo sapiens
ctccacccctcaagc

SEQ ID NO: 1923266 - DNA, 18 bp, Homo sapiens
ctccacccctcaagccag

SEQ ID NO: 1923267 - DNA, 21 bp, Homo sapiens
ctccacccctcaagccaggag

SEQ ID NO: 1923268 - DNA, 16 bp, Homo sapiens
ctccacccgtcctggg

SEQ ID NO: 1923269 - DNA, 13 bp, Homo sapiens
ctccactcctccc

SEQ ID NO: 1923270 - DNA, 17 bp, Homo sapiens
gaatggtgggctccaga

SEQ ID NO: 1923271 - DNA, 11 bp, Homo sapiens
gaatgtaatca

SEQ ID NO: 1923272 - DNA, 15 bp, Homo sapiens
gaatgttatcagtat

SEQ ID NO: 1923273 - DNA, 11 bp, Homo sapiens
gaattaaaata

SEQ ID NO: 1923274 - DNA, 16 bp, Homo sapiens
gaattgtaactgttct

SEQ ID NO: 1923275 - DNA, 22 bp, Homo sapiens
gaatttctagacagtattgcca

SEQ ID NO: 1923276 - DNA, 18 bp, Homo sapiens
gacaaaacgggttactaa

SEQ ID NO: 1923277 - DNA, 15 bp, Homo sapiens
gacaaaccagaagca

SEQ ID NO: 1923278 - DNA, 13 bp, Homo sapiens
gacaaaggcaagc

SEQ ID NO: 1923279 - DNA, 12 bp, Homo sapiens
gacaacttctga

SEQ ID NO: 1923280 - DNA, 19 bp, Homo sapiens
gacaatctaaaaaatatct

SEQ ID NO: 1923281 - DNA, 15 bp, Homo sapiens
gacaatggcaatagg

SEQ ID NO: 1923282 - DNA, 16 bp, Homo sapiens
gacaatggcaatagga

SEQ ID NO: 1923283 - DNA, 15 bp, Homo sapiens
gacacaggctgccgc

SEQ ID NO: 1923284 - DNA, 16 bp, Homo sapiens
gacacagtcaggggcc

SEQ ID NO: 1923285 - DNA, 17 bp, Homo sapiens
gacacctactgagtggc

SEQ ID NO: 1923286 - DNA, 15 bp, Homo sapiens
gacaccttcccagct

SEQ ID NO: 1923287 - DNA, 16 bp, Homo sapiens
gacaccttcccagctg

SEQ ID NO: 1923288 - DNA, 21 bp, Homo sapiens
gacacgcccgactctctccat

SEQ ID NO: 1923289 - DNA, 18 bp, Homo sapiens
gacactcattaccgtctg

SEQ ID NO: 1923290 - DNA, 22 bp, Homo sapiens
gacagaaccaacgggtctgtgg

SEQ ID NO: 1923291 - DNA, 17 bp, Homo sapiens
gacagcagagccatctg

SEQ ID NO: 1923292 - DNA, 18 bp, Homo sapiens
gacagcgggtaaaaagag

SEQ ID NO: 1923293 - DNA, 21 bp, Homo sapiens
gacagcgggtaaaaagagaag

SEQ ID NO: 1923294 - DNA, 14 bp, Homo sapiens
gacagctgcttctg

SEQ ID NO: 1923295 - DNA, 18 bp, Homo sapiens
gacaggaagcacagcagg

SEQ ID NO: 1923296 - DNA, 13 bp, Homo sapiens
gacagggagggaa

SEQ ID NO: 1923297 - DNA, 16 bp, Homo sapiens
gacagtattgccacct

SEQ ID NO: 1923298 - DNA, 17 bp, Homo sapiens
gacagtcaaggagtggc

SEQ ID NO: 1923299 - DNA, 19 bp, Homo sapiens
gacagtcaaggagtggctt

SEQ ID NO: 1923300 - DNA, 22 bp, Homo sapiens
gacagtcaaggagtggcttact

SEQ ID NO: 1923301 - DNA, 16 bp, Homo sapiens
gacagtcagcaacatg

SEQ ID NO: 1923302 - DNA, 14 bp, Homo sapiens
gacagttgggtgtg

SEQ ID NO: 1923303 - DNA, 20 bp, Homo sapiens
gacatattcatttggaaata

SEQ ID NO: 1923304 - DNA, 19 bp, Homo sapiens
gacatccccctccttgccg

SEQ ID NO: 1923305 - DNA, 22 bp, Homo sapiens
gacatgaacgttttctcttcac

SEQ ID NO: 1923306 - DNA, 14 bp, Homo sapiens
cacccttccccact

SEQ ID NO: 1923307 - DNA, 22 bp, Homo sapiens
caccctttacattttgtgcagt

SEQ ID NO: 1923308 - DNA, 12 bp, Homo sapiens
cacctaagtgac

SEQ ID NO: 1923309 - DNA, 12 bp, Homo sapiens
cacctataaata

SEQ ID NO: 1923310 - DNA, 11 bp, Homo sapiens
cacctccaccc

SEQ ID NO: 1923311 - DNA, 14 bp, Homo sapiens
cacctccccaggcc

SEQ ID NO: 1923312 - DNA, 15 bp, Homo sapiens
cacctccccaggccg

SEQ ID NO: 1923313 - DNA, 15 bp, Homo sapiens
cacctccctgcagct

SEQ ID NO: 1923314 - DNA, 23 bp, Homo sapiens
cacctctggccaaatatgcactt

SEQ ID NO: 1923315 - DNA, 21 bp, Homo sapiens
cacctgaattcgagacaggca

SEQ ID NO: 1923316 - DNA, 22 bp, Homo sapiens
cacctgaattcgagacaggcag

SEQ ID NO: 1923317 - DNA, 17 bp, Homo sapiens
cacctgcagcgtctgag

SEQ ID NO: 1923318 - DNA, 14 bp, Homo sapiens
cacctgccaggctg

SEQ ID NO: 1923319 - DNA, 17 bp, Homo sapiens
cacctgccaggctgcag

SEQ ID NO: 1923320 - DNA, 14 bp, Homo sapiens
cacctgccccaggc

SEQ ID NO: 1923321 - DNA, 18 bp, Homo sapiens
cacctgccccaggctcag

SEQ ID NO: 1923322 - DNA, 22 bp, Homo sapiens
cacctgccccaggctcaggctg

SEQ ID NO: 1923323 - DNA, 21 bp, Homo sapiens
cacctggttccggaatcctgt

SEQ ID NO: 1923324 - DNA, 23 bp, Homo sapiens
cacctggttccggaatcctgtcc

SEQ ID NO: 1923325 - DNA, 20 bp, Homo sapiens
caccttgcactattggactt

SEQ ID NO: 1923326 - DNA, 15 bp, Homo sapiens
cacctttatgtttta

SEQ ID NO: 1923327 - DNA, 22 bp, Homo sapiens
cacgcccgactctctccatcag

SEQ ID NO: 1923328 - DNA, 21 bp, Homo sapiens
cacggagccactcctctgact

SEQ ID NO: 1923329 - DNA, 14 bp, Homo sapiens
cacggccactgcag

SEQ ID NO: 1923330 - DNA, 19 bp, Homo sapiens
cacgtagtagggtcaggcc

SEQ ID NO: 1923331 - DNA, 21 bp, Homo sapiens
cacgtagtagggtcaggccac

SEQ ID NO: 1923332 - DNA, 14 bp, Homo sapiens
cacgtcccgggcac

SEQ ID NO: 1923333 - DNA, 14 bp, Homo sapiens
cacgtcctgggtgc

SEQ ID NO: 1923334 - DNA, 15 bp, Homo sapiens
cacgtgctggagagt

SEQ ID NO: 1923335 - DNA, 23 bp, Homo sapiens
cactatgtccatgaaaaacagca

SEQ ID NO: 1923336 - DNA, 14 bp, Homo sapiens
cactattggacttt

SEQ ID NO: 1923337 - DNA, 14 bp, Homo sapiens
cactccactcccct

SEQ ID NO: 1923338 - DNA, 14 bp, Homo sapiens
cactccagacccct

SEQ ID NO: 1923339 - DNA, 12 bp, Homo sapiens
cactcccctcat

SEQ ID NO: 1923340 - DNA, 13 bp, Homo sapiens
cactcctacctgg

SEQ ID NO: 1923341 - DNA, 12 bp, Homo sapiens
cactcctctgac

SEQ ID NO: 1923342 - DNA, 13 bp, Homo sapiens
cactcctctgact

SEQ ID NO: 1923343 - DNA, 13 bp, Homo sapiens
cactgaacctctg

SEQ ID NO: 1923344 - DNA, 20 bp, Homo sapiens
cactgaacctctggctagag

SEQ ID NO: 1923345 - DNA, 23 bp, Homo sapiens
cactgaaccttgttgatgccagc

SEQ ID NO: 1923346 - DNA, 16 bp, Homo sapiens
cactgaagtgaataca

SEQ ID NO: 1923347 - DNA, 19 bp, Homo sapiens
cactgaatcgtttcatgta

SEQ ID NO: 1923348 - DNA, 18 bp, Homo sapiens
cactgagataccagcgag

SEQ ID NO: 1923349 - DNA, 21 bp, Homo sapiens
cactgcacagtgcatctcagc

SEQ ID NO: 1923350 - DNA, 18 bp, Homo sapiens
cactgcagtcacccctgt

SEQ ID NO: 1923351 - DNA, 20 bp, Homo sapiens
cactgccagaagtgtgtttt

SEQ ID NO: 1923352 - DNA, 17 bp, Homo sapiens
cactgccatggaggcac

SEQ ID NO: 1923353 - DNA, 16 bp, Homo sapiens
cactgcccacctgcca

SEQ ID NO: 1923354 - DNA, 17 bp, Homo sapiens
cactgcccacctgccag

SEQ ID NO: 1923355 - DNA, 19 bp, Homo sapiens
cactgcccacctgccaggc

SEQ ID NO: 1923356 - DNA, 22 bp, Homo sapiens
cactgcccacctgccaggctgc

SEQ ID NO: 1923357 - DNA, 20 bp, Homo sapiens
cactgccttcgatacaccgg

SEQ ID NO: 1923358 - DNA, 14 bp, Homo sapiens
cactgcgaactctc

SEQ ID NO: 1923359 - DNA, 18 bp, Homo sapiens
cactgcggaacaggagtg

SEQ ID NO: 1923360 - DNA, 12 bp, Homo sapiens
cactgctggctg

SEQ ID NO: 1923361 - DNA, 13 bp, Homo sapiens
cactgctggctgc

SEQ ID NO: 1923362 - DNA, 16 bp, Homo sapiens
cactgctggctgcctt

SEQ ID NO: 1923363 - DNA, 21 bp, Homo sapiens
cactgctggctgccttagaac

SEQ ID NO: 1923364 - DNA, 15 bp, Homo sapiens
cactgcttgaggaaa

SEQ ID NO: 1923365 - DNA, 13 bp, Homo sapiens
cactggaaaacat

SEQ ID NO: 1923366 - DNA, 14 bp, Homo sapiens
cactggccggccca

SEQ ID NO: 1923367 - DNA, 21 bp, Homo sapiens
cactggctttgggtagtgcca

SEQ ID NO: 1923368 - DNA, 13 bp, Homo sapiens
cactgggcttcta

SEQ ID NO: 1923369 - DNA, 13 bp, Homo sapiens
cactggtggcccg

SEQ ID NO: 1923370 - DNA, 17 bp, Homo sapiens
cactgtaaatttaatag

SEQ ID NO: 1923371 - DNA, 22 bp, Homo sapiens
cactgtgcacatctgtgtcttg

SEQ ID NO: 1923372 - DNA, 19 bp, Homo sapiens
cactgttccccctgtgcag

SEQ ID NO: 1923373 - DNA, 12 bp, Homo sapiens
cacttatttcta

SEQ ID NO: 1923374 - DNA, 14 bp, Homo sapiens
cacttcaggctctt

SEQ ID NO: 1923375 - DNA, 15 bp, Homo sapiens
cacttcaggctcttc

SEQ ID NO: 1923376 - DNA, 19 bp, Homo sapiens
cacttcccatttgtgtttc

SEQ ID NO: 1923377 - DNA, 13 bp, Homo sapiens
cacttccctgcaa

SEQ ID NO: 1923378 - DNA, 19 bp, Homo sapiens
cacttctatatatacaatg

SEQ ID NO: 1923379 - DNA, 23 bp, Homo sapiens
cacttggagcgtttttgctggct

SEQ ID NO: 1923380 - DNA, 18 bp, Homo sapiens
cacttggccaccaggact

SEQ ID NO: 1923381 - DNA, 12 bp, Homo sapiens
cacttgtgtttg

SEQ ID NO: 1923382 - DNA, 23 bp, Homo sapiens
cacttgtgtttgtatataaatgg

SEQ ID NO: 1923383 - DNA, 17 bp, Homo sapiens
cactttaataataaaaa

SEQ ID NO: 1923384 - DNA, 13 bp, Homo sapiens
cactttccctaga

SEQ ID NO: 1923385 - DNA, 20 bp, Homo sapiens
cactttccctagaaagccat

SEQ ID NO: 1923386 - DNA, 18 bp, Homo sapiens
cactttgaaaatatttct

SEQ ID NO: 1923387 - DNA, 14 bp, Homo sapiens
cactttgcagacct

SEQ ID NO: 1923388 - DNA, 13 bp, Homo sapiens
cactttggccaca

SEQ ID NO: 1923389 - DNA, 16 bp, Homo sapiens
cactttgtgagtattc

SEQ ID NO: 1923390 - DNA, 18 bp, Homo sapiens
cacttttgacaaaggcaa

SEQ ID NO: 1923391 - DNA, 22 bp, Homo sapiens
cagaaagcatctattcccaaag

SEQ ID NO: 1923392 - DNA, 16 bp, Homo sapiens
cagaaagggcagcccc

SEQ ID NO: 1923393 - DNA, 17 bp, Homo sapiens
cagaaagggcagcccct

SEQ ID NO: 1923394 - DNA, 22 bp, Homo sapiens
cagaaagggcagcccctcccca

SEQ ID NO: 1923395 - DNA, 15 bp, Homo sapiens
cagaactaccaaaat

SEQ ID NO: 1923396 - DNA, 18 bp, Homo sapiens
cagaagaagctcctgaat

SEQ ID NO: 1923397 - DNA, 16 bp, Homo sapiens
cagaagagaaagtaca

SEQ ID NO: 1923398 - DNA, 13 bp, Homo sapiens
cagaaggaggagg

SEQ ID NO: 1923399 - DNA, 19 bp, Homo sapiens
cagaatggtgggctccaga

SEQ ID NO: 1923400 - DNA, 12 bp, Homo sapiens
cagacagagtgg

SEQ ID NO: 1923401 - DNA, 15 bp, Homo sapiens
cagacagcaagggct

SEQ ID NO: 1923402 - DNA, 18 bp, Homo sapiens
cagacccctaccctttcc

SEQ ID NO: 1923403 - DNA, 18 bp, Homo sapiens
cagacccctggcttttca

SEQ ID NO: 1923404 - DNA, 21 bp, Homo sapiens
cagacccctggcttttcactg

SEQ ID NO: 1923405 - DNA, 16 bp, Homo sapiens
cagaccctgccagggg

SEQ ID NO: 1923406 - DNA, 14 bp, Homo sapiens
cagacctgggactt

SEQ ID NO: 1923407 - DNA, 20 bp, Homo sapiens
cagacgcggaaaccgggtgg

SEQ ID NO: 1923408 - DNA, 22 bp, Homo sapiens
cagactctctcctctctctccc

SEQ ID NO: 1923409 - DNA, 23 bp, Homo sapiens
cagactctctcctctctctccct

SEQ ID NO: 1923410 - DNA, 20 bp, Homo sapiens
cagactttttttaaatagta

SEQ ID NO: 1923411 - DNA, 20 bp, Homo sapiens
cagagaacaatcactattct

SEQ ID NO: 1923412 - DNA, 22 bp, Homo sapiens
cagagaacaatcactattctta

SEQ ID NO: 1923413 - DNA, 21 bp, Homo sapiens
cagagaattgctgattcttga

SEQ ID NO: 1923414 - DNA, 17 bp, Homo sapiens
cagagaggacgtgggcg

SEQ ID NO: 1923415 - DNA, 21 bp, Homo sapiens
cagagaggacgtgggcggcag

SEQ ID NO: 1923416 - DNA, 20 bp, Homo sapiens
cagagaggagtcagagagaa

SEQ ID NO: 1923417 - DNA, 15 bp, Homo sapiens
cagagagggggccac

SEQ ID NO: 1923418 - DNA, 20 bp, Homo sapiens
cagagagggggccacctccc

SEQ ID NO: 1923419 - DNA, 21 bp, Homo sapiens
cagagattgggggggcttggg

SEQ ID NO: 1923420 - DNA, 15 bp, Homo sapiens
cagagcacagattca

SEQ ID NO: 1923421 - DNA, 20 bp, Homo sapiens
cagagccgtggtcctttggg

SEQ ID NO: 1923422 - DNA, 12 bp, Homo sapiens
cagagcctgggc

SEQ ID NO: 1923423 - DNA, 23 bp, Homo sapiens
cagagcttccctgactcattctg

SEQ ID NO: 1923424 - DNA, 16 bp, Homo sapiens
cagaggaaggggccag

SEQ ID NO: 1923425 - DNA, 19 bp, Homo sapiens
cagaggaaggggccagagg

SEQ ID NO: 1923426 - DNA, 20 bp, Homo sapiens
cagaggaaggggccagaggc

SEQ ID NO: 1923427 - DNA, 14 bp, Homo sapiens
cagaggcagtggca

SEQ ID NO: 1923428 - DNA, 19 bp, Homo sapiens
cagaggccctcgctgccag

SEQ ID NO: 1923429 - DNA, 14 bp, Homo sapiens
cagaggggagagga

SEQ ID NO: 1923430 - DNA, 17 bp, Homo sapiens
cagaggggagaggaagc

SEQ ID NO: 1923431 - DNA, 13 bp, Homo sapiens
cagagtcagcaga

SEQ ID NO: 1923432 - DNA, 14 bp, Homo sapiens
cagagtcagcagaa

SEQ ID NO: 1923433 - DNA, 15 bp, Homo sapiens
cagagtgagacccag

SEQ ID NO: 1923434 - DNA, 15 bp, Homo sapiens
cagagtgccatccct

SEQ ID NO: 1923435 - DNA, 17 bp, Homo sapiens
cagagtgccatccctga

SEQ ID NO: 1923436 - DNA, 19 bp, Homo sapiens
cagagtgccatccctgaga

SEQ ID NO: 1923437 - DNA, 20 bp, Homo sapiens
cagagtggccaatccctgtg

SEQ ID NO: 1923438 - DNA, 13 bp, Homo sapiens
cagataatgtgaa

SEQ ID NO: 1923439 - DNA, 13 bp, Homo sapiens
cagatgacccctc

SEQ ID NO: 1923440 - DNA, 17 bp, Homo sapiens
cagcacagagagggggc

SEQ ID NO: 1923441 - DNA, 14 bp, Homo sapiens
cagcagcagctcaa

SEQ ID NO: 1923442 - DNA, 13 bp, Homo sapiens
cagcagctgaagt

SEQ ID NO: 1923443 - DNA, 19 bp, Homo sapiens
cagcaggggggttgggttc

SEQ ID NO: 1923444 - DNA, 17 bp, Homo sapiens
cagcagtgtgaggccag

SEQ ID NO: 1923445 - DNA, 20 bp, Homo sapiens
cagcagtgtgaggccagggc

SEQ ID NO: 1923446 - DNA, 23 bp, Homo sapiens
cagcataaccccaccctttacat

SEQ ID NO: 1923447 - DNA, 14 bp, Homo sapiens
cagcattctcactc

SEQ ID NO: 1923448 - DNA, 14 bp, Homo sapiens
cagccaaattgcag

SEQ ID NO: 1923449 - DNA, 17 bp, Homo sapiens
cagccacccagccagga

SEQ ID NO: 1923450 - DNA, 20 bp, Homo sapiens
cagccaggaggggctgtcca

SEQ ID NO: 1923451 - DNA, 13 bp, Homo sapiens
cagcccagcctgc

SEQ ID NO: 1923452 - DNA, 14 bp, Homo sapiens
cagcccagcctgca

SEQ ID NO: 1923453 - DNA, 14 bp, Homo sapiens
cagccctcatcccg

SEQ ID NO: 1923454 - DNA, 17 bp, Homo sapiens
cagccctccctgcccct

SEQ ID NO: 1923455 - DNA, 20 bp, Homo sapiens
cagccctgctttgggctgcc

SEQ ID NO: 1923456 - DNA, 21 bp, Homo sapiens
cagccctgctttgggctgccc

SEQ ID NO: 1923457 - DNA, 9 bp, Homo sapiens
cagccgtgc

SEQ ID NO: 1923458 - DNA, 16 bp, Homo sapiens
cagccgtgccttcagc

SEQ ID NO: 1923459 - DNA, 17 bp, Homo sapiens
cagcctcccctgccagg

SEQ ID NO: 1923460 - DNA, 19 bp, Homo sapiens
cagcctcccctgccagggc

SEQ ID NO: 1923461 - DNA, 20 bp, Homo sapiens
cagcctcccctgccagggca

SEQ ID NO: 1923462 - DNA, 22 bp, Homo sapiens
cagcctcccctgccagggcagg

SEQ ID NO: 1923463 - DNA, 10 bp, Homo sapiens
cagcctggca

SEQ ID NO: 1923464 - DNA, 16 bp, Homo sapiens
cagcctggttccctct

SEQ ID NO: 1923465 - DNA, 18 bp, Homo sapiens
cagcctggttccctcttt

SEQ ID NO: 1923466 - DNA, 19 bp, Homo sapiens
cagcctggttccctctttc

SEQ ID NO: 1923467 - DNA, 14 bp, Homo sapiens
cagcctgtgggaga

SEQ ID NO: 1923468 - DNA, 16 bp, Homo sapiens
cagcctgtgggagaag

SEQ ID NO: 1923469 - DNA, 19 bp, Homo sapiens
cagcctgtttgggaggctg

SEQ ID NO: 1923470 - DNA, 20 bp, Homo sapiens
cagcctgtttgggaggctgg

SEQ ID NO: 1923471 - DNA, 16 bp, Homo sapiens
cagcgcccagcctggc

SEQ ID NO: 1923472 - DNA, 19 bp, Homo sapiens
cagcgcccagcctggcccc

SEQ ID NO: 1923473 - DNA, 21 bp, Homo sapiens
cagcgtctgagcggccgcctg

SEQ ID NO: 1923474 - DNA, 17 bp, Homo sapiens
cagcgtggcctccgtga

SEQ ID NO: 1923475 - DNA, 19 bp, Homo sapiens
cagctaatcagcattctca

SEQ ID NO: 1923476 - DNA, 21 bp, Homo sapiens
cagctatgttatattgaaaaa

SEQ ID NO: 1923477 - DNA, 15 bp, Homo sapiens
cagctcctcttcctg

SEQ ID NO: 1923478 - DNA, 16 bp, Homo sapiens
cagctcctcttcctgc

SEQ ID NO: 1923479 - DNA, 17 bp, Homo sapiens
cagctcctcttcctgcc

SEQ ID NO: 1923480 - DNA, 13 bp, Homo sapiens
cagctccttcctg

SEQ ID NO: 1923481 - DNA, 18 bp, Homo sapiens
cagctctgaaaccagtgt

SEQ ID NO: 1923482 - DNA, 19 bp, Homo sapiens
cagctctgaaaccagtgtt

SEQ ID NO: 1923483 - DNA, 19 bp, Homo sapiens
cagctgaagtctctttttc

SEQ ID NO: 1923484 - DNA, 15 bp, Homo sapiens
cagctgcagagacag

SEQ ID NO: 1923485 - DNA, 14 bp, Homo sapiens
cagctgctcctaga

SEQ ID NO: 1923486 - DNA, 15 bp, Homo sapiens
cagctgctcctcgca

SEQ ID NO: 1923487 - DNA, 20 bp, Homo sapiens
cagctgctcctcgcagttcg

SEQ ID NO: 1923488 - DNA, 13 bp, Homo sapiens
cagctgcttctgt

SEQ ID NO: 1923489 - DNA, 22 bp, Homo sapiens
cagctgcttctgtgcatttgtg

SEQ ID NO: 1923490 - DNA, 22 bp, Homo sapiens
cagctgtactgagttctcatcc

SEQ ID NO: 1923491 - DNA, 22 bp, Homo sapiens
cagctgttcaacaagagtaaat

SEQ ID NO: 1923492 - DNA, 18 bp, Homo sapiens
caggaaggatgagcattt

SEQ ID NO: 1923493 - DNA, 19 bp, Homo sapiens
caggaaggctgagaggaga

SEQ ID NO: 1923494 - DNA, 20 bp, Homo sapiens
caggaatgggccaagccagg

SEQ ID NO: 1923495 - DNA, 24 bp, Homo sapiens
caggacagatcaggtcagagccca

SEQ ID NO: 1923496 - DNA, 12 bp, Homo sapiens
caggacagctgc

SEQ ID NO: 1923497 - DNA, 18 bp, Homo sapiens
caggacatttctctaaga

SEQ ID NO: 1923498 - DNA, 14 bp, Homo sapiens
caggacccagagga

SEQ ID NO: 1923499 - DNA, 23 bp, Homo sapiens
caggacgactgttttcccaacac

SEQ ID NO: 1923500 - DNA, 21 bp, Homo sapiens
caggagaaggccaattcctat

SEQ ID NO: 1923501 - DNA, 22 bp, Homo sapiens
caggagaaggccaattcctata

SEQ ID NO: 1923502 - DNA, 14 bp, Homo sapiens
caggagaaggcctg

SEQ ID NO: 1923503 - DNA, 19 bp, Homo sapiens
caggagaaggcctgccccc

SEQ ID NO: 1923504 - DNA, 23 bp, Homo sapiens
caggaggacctggggggggcaag

SEQ ID NO: 1923505 - DNA, 21 bp, Homo sapiens
caggagtgactctggctgcca

SEQ ID NO: 1923506 - DNA, 16 bp, Homo sapiens
caggagttggaagtgt

SEQ ID NO: 1923507 - DNA, 19 bp, Homo sapiens
caggatccttgcctccaac

SEQ ID NO: 1923508 - DNA, 23 bp, Homo sapiens
caggcactgagataccagcgagg

SEQ ID NO: 1923509 - DNA, 19 bp, Homo sapiens
caggcatggcccagcctgg

SEQ ID NO: 1923510 - DNA, 22 bp, Homo sapiens
caggcatggcccagcctggagc

SEQ ID NO: 1923511 - DNA, 15 bp, Homo sapiens
caggcccttcctctc

SEQ ID NO: 1923512 - DNA, 16 bp, Homo sapiens
caggcccttcctctcc

SEQ ID NO: 1923513 - DNA, 21 bp, Homo sapiens
caggcccttcctctccactgc

SEQ ID NO: 1923514 - DNA, 17 bp, Homo sapiens
caggccgtggctgccca

SEQ ID NO: 1923515 - DNA, 19 bp, Homo sapiens
caggccgtggctgcccaca

SEQ ID NO: 1923516 - DNA, 20 bp, Homo sapiens
caggcctggcaagtgggtga

SEQ ID NO: 1923517 - DNA, 17 bp, Homo sapiens
caggcgccccttccccc

SEQ ID NO: 1923518 - DNA, 12 bp, Homo sapiens
caggctcttctc

SEQ ID NO: 1923519 - DNA, 13 bp, Homo sapiens
caggctgcaggga

SEQ ID NO: 1923520 - DNA, 22 bp, Homo sapiens
caggctgccgctgctctcccag

SEQ ID NO: 1923521 - DNA, 23 bp, Homo sapiens
caggctgccgctgctctcccagg

SEQ ID NO: 1923522 - DNA, 17 bp, Homo sapiens
caggcttgggctccatt

SEQ ID NO: 1923523 - DNA, 23 bp, Homo sapiens
caggcttgggctccattcccatc

SEQ ID NO: 1923524 - DNA, 23 bp, Homo sapiens
cagggaattttcattggatgcag

SEQ ID NO: 1923525 - DNA, 21 bp, Homo sapiens
cagggacagttgggtgtgaga

SEQ ID NO: 1923526 - DNA, 13 bp, Homo sapiens
cagggcagcctgt

SEQ ID NO: 1923527 - DNA, 15 bp, Homo sapiens
cagggcagcctgtgg

SEQ ID NO: 1923528 - DNA, 22 bp, Homo sapiens
cagggcagcctgtgggagaagg

SEQ ID NO: 1923529 - DNA, 14 bp, Homo sapiens
cagggcctggcctg

SEQ ID NO: 1923530 - DNA, 17 bp, Homo sapiens
cagggcctggcctggtc

SEQ ID NO: 1923531 - DNA, 22 bp, Homo sapiens
cagggcctggggagatggagga

SEQ ID NO: 1923532 - DNA, 14 bp, Homo sapiens
cagggctaccctga

SEQ ID NO: 1923533 - DNA, 19 bp, Homo sapiens
cagggctaccctgagctga

SEQ ID NO: 1923534 - DNA, 13 bp, Homo sapiens
caggggctgggca

SEQ ID NO: 1923535 - DNA, 17 bp, Homo sapiens
caggggctgggcagagg

SEQ ID NO: 1923536 - DNA, 21 bp, Homo sapiens
caggggggttgggttccagac

SEQ ID NO: 1923537 - DNA, 22 bp, Homo sapiens
caggggggttgggttccagaca

SEQ ID NO: 1923538 - DNA, 23 bp, Homo sapiens
caggggggttgggttccagacag

SEQ ID NO: 1923539 - DNA, 18 bp, Homo sapiens
caggggttccagcttccc

SEQ ID NO: 1923540 - DNA, 18 bp, Homo sapiens
cagggtagggggcctgag

SEQ ID NO: 1923541 - DNA, 13 bp, Homo sapiens
cagggtggggctt

SEQ ID NO: 1923542 - DNA, 21 bp, Homo sapiens
cagggttaaagaaaggcagag

SEQ ID NO: 1923543 - DNA, 18 bp, Homo sapiens
cagggttccagacagggt

SEQ ID NO: 1923544 - DNA, 17 bp, Homo sapiens
cagggttctagaagggg

SEQ ID NO: 1923545 - DNA, 20 bp, Homo sapiens
caggtcccgagccccctgtc

SEQ ID NO: 1923546 - DNA, 23 bp, Homo sapiens
caggtcccgagccccctgtcctt

SEQ ID NO: 1923547 - DNA, 18 bp, Homo sapiens
caggtcctttccttctcg

SEQ ID NO: 1923548 - DNA, 13 bp, Homo sapiens
caggtctcagtga

SEQ ID NO: 1923549 - DNA, 13 bp, Homo sapiens
caggtctttgaaa

SEQ ID NO: 1923550 - DNA, 22 bp, Homo sapiens
caggtctttgaaatatgcatgt

SEQ ID NO: 1923551 - DNA, 16 bp, Homo sapiens
aaattgcttgaaagaa

SEQ ID NO: 1923552 - DNA, 21 bp, Homo sapiens
aaattgtcccttaaacaaaaa

SEQ ID NO: 1923553 - DNA, 21 bp, Homo sapiens
aaatttataaactaattttgt

SEQ ID NO: 1923554 - DNA, 22 bp, Homo sapiens
aaatttataaactaattttgta

SEQ ID NO: 1923555 - DNA, 17 bp, Homo sapiens
aaatttgttaatatata

SEQ ID NO: 1923556 - DNA, 16 bp, Homo sapiens
aacaaggaaaacagta

SEQ ID NO: 1923557 - DNA, 12 bp, Homo sapiens
aacacaatcaaa

SEQ ID NO: 1923558 - DNA, 15 bp, Homo sapiens
aacacctaagtgact

SEQ ID NO: 1923559 - DNA, 18 bp, Homo sapiens
aacacgtttagaaatgat

SEQ ID NO: 1923560 - DNA, 23 bp, Homo sapiens
aacagctaggttaataggaggac

SEQ ID NO: 1923561 - DNA, 22 bp, Homo sapiens
aacagcttcatgttcccaaaat

SEQ ID NO: 1923562 - DNA, 16 bp, Homo sapiens
aacaggattagacagt

SEQ ID NO: 1923563 - DNA, 19 bp, Homo sapiens
aacaggtctttgaaatatg

SEQ ID NO: 1923564 - DNA, 18 bp, Homo sapiens
aacatagagtagacctga

SEQ ID NO: 1923565 - DNA, 21 bp, Homo sapiens
aacatataatgttgttattta

SEQ ID NO: 1923566 - DNA, 20 bp, Homo sapiens
aacatgaccctaaatcttga

SEQ ID NO: 1923567 - DNA, 12 bp, Homo sapiens
aacatggccaca

SEQ ID NO: 1923568 - DNA, 18 bp, Homo sapiens
aaccaagccgtggcttcc

SEQ ID NO: 1923569 - DNA, 22 bp, Homo sapiens
aaccagaagcaacagaaaaaat

SEQ ID NO: 1923570 - DNA, 17 bp, Homo sapiens
aaccaggaggcctggga

SEQ ID NO: 1923571 - DNA, 18 bp, Homo sapiens
aaccattggttaatctgg

SEQ ID NO: 1923572 - DNA, 13 bp, Homo sapiens
aacccaatagttg

SEQ ID NO: 1923573 - DNA, 17 bp, Homo sapiens
aaccccaccctttacat

SEQ ID NO: 1923574 - DNA, 22 bp, Homo sapiens
aacccccctccccaaggaagaa

SEQ ID NO: 1923575 - DNA, 16 bp, Homo sapiens
aacccttgaatttcta

SEQ ID NO: 1923576 - DNA, 21 bp, Homo sapiens
aacccttgaatttctagacag

SEQ ID NO: 1923577 - DNA, 15 bp, Homo sapiens
aaccgagccagcagc

SEQ ID NO: 1923578 - DNA, 15 bp, Homo sapiens
aaccgtcaataggca

SEQ ID NO: 1923579 - DNA, 19 bp, Homo sapiens
aacctcgctggactctcag

SEQ ID NO: 1923580 - DNA, 18 bp, Homo sapiens
aacctcttcagaggccct

SEQ ID NO: 1923581 - DNA, 19 bp, Homo sapiens
aacctgcctgacatttgga

SEQ ID NO: 1923582 - DNA, 23 bp, Homo sapiens
aaccttagatgttctaagtcttt

SEQ ID NO: 1923583 - DNA, 16 bp, Homo sapiens
aacgctgacttgcaga

SEQ ID NO: 1923584 - DNA, 14 bp, Homo sapiens
aacggaactcttca

SEQ ID NO: 1923585 - DNA, 20 bp, Homo sapiens
aacgggtctgtgggactggc

SEQ ID NO: 1923586 - DNA, 13 bp, Homo sapiens
aacggttaaaact

SEQ ID NO: 1923587 - DNA, 23 bp, Homo sapiens
aactaagaaatatgcacaatagc

SEQ ID NO: 1923588 - DNA, 12 bp, Homo sapiens
aactaattttgt

SEQ ID NO: 1923589 - DNA, 23 bp, Homo sapiens
aactacagccaaattgcagaaga

SEQ ID NO: 1923590 - DNA, 17 bp, Homo sapiens
aactactcagggaatga

SEQ ID NO: 1923591 - DNA, 20 bp, Homo sapiens
aactagactcccaagctgga

SEQ ID NO: 1923592 - DNA, 23 bp, Homo sapiens
aactagactcccaagctggacta

SEQ ID NO: 1923593 - DNA, 10 bp, Homo sapiens
aactctggcc

SEQ ID NO: 1923594 - DNA, 13 bp, Homo sapiens
aactcttcatctt

SEQ ID NO: 1923595 - DNA, 21 bp, Homo sapiens
aactgagggcatgagtctcac

SEQ ID NO: 1923596 - DNA, 14 bp, Homo sapiens
aactggccccagct

SEQ ID NO: 1923597 - DNA, 18 bp, Homo sapiens
aactggggtgatgtttta

SEQ ID NO: 1923598 - DNA, 23 bp, Homo sapiens
aactggggtgatgttttactttt

SEQ ID NO: 1923599 - DNA, 22 bp, Homo sapiens
aactgtatgaagtcatagataa

SEQ ID NO: 1923600 - DNA, 13 bp, Homo sapiens
aactgttgtttga

SEQ ID NO: 1923601 - DNA, 20 bp, Homo sapiens
aacttgtgctatagtgtata

SEQ ID NO: 1923602 - DNA, 16 bp, Homo sapiens
aactttttcaatggtt

SEQ ID NO: 1923603 - DNA, 14 bp, Homo sapiens
aagaaatcaagtta

SEQ ID NO: 1923604 - DNA, 22 bp, Homo sapiens
aagaacacctgacaacttctga

SEQ ID NO: 1923605 - DNA, 17 bp, Homo sapiens
aagaacccccctcccca

SEQ ID NO: 1923606 - DNA, 22 bp, Homo sapiens
aagaacccccctccccaaggaa

SEQ ID NO: 1923607 - DNA, 19 bp, Homo sapiens
aagaagccacagacctagg

SEQ ID NO: 1923608 - DNA, 22 bp, Homo sapiens
aagaagtgggagtgggagagga

SEQ ID NO: 1923609 - DNA, 20 bp, Homo sapiens
aagaatagggagacaatcta

SEQ ID NO: 1923610 - DNA, 18 bp, Homo sapiens
aagaattacaatttcttt

SEQ ID NO: 1923611 - DNA, 19 bp, Homo sapiens
aagaattacaatttcttta

SEQ ID NO: 1923612 - DNA, 20 bp, Homo sapiens
aagacacgcccgactctctc

SEQ ID NO: 1923613 - DNA, 21 bp, Homo sapiens
aagacggattatctagagaat

SEQ ID NO: 1923614 - DNA, 13 bp, Homo sapiens
aagaggagccttt

SEQ ID NO: 1923615 - DNA, 16 bp, Homo sapiens
aagagggacgcctggg

SEQ ID NO: 1923616 - DNA, 18 bp, Homo sapiens
aagagggagaaggagagg

SEQ ID NO: 1923617 - DNA, 14 bp, Homo sapiens
aagagtaaatattg

SEQ ID NO: 1923618 - DNA, 20 bp, Homo sapiens
aagatacagaactctttcaa

SEQ ID NO: 1923619 - DNA, 22 bp, Homo sapiens
aagatacagaactctttcaaaa

SEQ ID NO: 1923620 - DNA, 17 bp, Homo sapiens
aagattcatccatttat

SEQ ID NO: 1923621 - DNA, 16 bp, Homo sapiens
aagattctttcccaat

SEQ ID NO: 1923622 - DNA, 13 bp, Homo sapiens
aagcaatatgcat

SEQ ID NO: 1923623 - DNA, 13 bp, Homo sapiens
aagcactgacact

SEQ ID NO: 1923624 - DNA, 23 bp, Homo sapiens
aagcactttgaaaatatttctat

SEQ ID NO: 1923625 - DNA, 14 bp, Homo sapiens
aagcatcaaactct

SEQ ID NO: 1923626 - DNA, 14 bp, Homo sapiens
aagccacgtgctgg

SEQ ID NO: 1923627 - DNA, 19 bp, Homo sapiens
aagccaggagaccctgtct

SEQ ID NO: 1923628 - DNA, 13 bp, Homo sapiens
aagcccaccctgc

SEQ ID NO: 1923629 - DNA, 23 bp, Homo sapiens
aagcccagcactgcttgaggaaa

SEQ ID NO: 1923630 - DNA, 14 bp, Homo sapiens
aagcccaggagaag

SEQ ID NO: 1923631 - DNA, 19 bp, Homo sapiens
aagcccaggagaagtccca

SEQ ID NO: 1923632 - DNA, 12 bp, Homo sapiens
aagcccaggagg

SEQ ID NO: 1923633 - DNA, 13 bp, Homo sapiens
aagcccaggagga

SEQ ID NO: 1923634 - DNA, 15 bp, Homo sapiens
aagccccctttgatt

SEQ ID NO: 1923635 - DNA, 18 bp, Homo sapiens
aagccccctttgattgag

SEQ ID NO: 1923636 - DNA, 13 bp, Homo sapiens
aagccgtggcttc

SEQ ID NO: 1923637 - DNA, 16 bp, Homo sapiens
aagcctgggccactgg

SEQ ID NO: 1923638 - DNA, 18 bp, Homo sapiens
aagcgacacaggctgccg

SEQ ID NO: 1923639 - DNA, 21 bp, Homo sapiens
aagctgagcccctccctcctg

SEQ ID NO: 1923640 - DNA, 23 bp, Homo sapiens
aagcttcctttgtttttttttcc

SEQ ID NO: 1923641 - DNA, 22 bp, Homo sapiens
aagcttcttaaatgagaaggaa

SEQ ID NO: 1923642 - DNA, 22 bp, Homo sapiens
aaggaagttactgttatagagg

SEQ ID NO: 1923643 - DNA, 13 bp, Homo sapiens
aaggaatgttatc

SEQ ID NO: 1923644 - DNA, 16 bp, Homo sapiens
aaggaatgttatcagt

SEQ ID NO: 1923645 - DNA, 21 bp, Homo sapiens
aaggagaggctctgaaagctg

SEQ ID NO: 1923646 - DNA, 19 bp, Homo sapiens
aaggagccccattcctggg

SEQ ID NO: 1923647 - DNA, 18 bp, Homo sapiens
acacctgacaacttctga

SEQ ID NO: 1923648 - DNA, 22 bp, Homo sapiens
acaccttcccagctgctcctag

SEQ ID NO: 1923649 - DNA, 16 bp, Homo sapiens
acacgtttagaaatga

SEQ ID NO: 1923650 - DNA, 15 bp, Homo sapiens
acactacgcagaaga

SEQ ID NO: 1923651 - DNA, 12 bp, Homo sapiens
acactcttcaag

SEQ ID NO: 1923652 - DNA, 16 bp, Homo sapiens
acactgccagaagtgt

SEQ ID NO: 1923653 - DNA, 19 bp, Homo sapiens
acacttcaggctcttctcc

SEQ ID NO: 1923654 - DNA, 15 bp, Homo sapiens
acactttggccacag

SEQ ID NO: 1923655 - DNA, 18 bp, Homo sapiens
acagaactctttcaaaac

SEQ ID NO: 1923656 - DNA, 23 bp, Homo sapiens
acagacctcggctgtgtggggag

SEQ ID NO: 1923657 - DNA, 15 bp, Homo sapiens
acagacgtccctcca

SEQ ID NO: 1923658 - DNA, 15 bp, Homo sapiens
acagagaggacgtgg

SEQ ID NO: 1923659 - DNA, 14 bp, Homo sapiens
acagagcttccctg

SEQ ID NO: 1923660 - DNA, 15 bp, Homo sapiens
acagagcttccctga

SEQ ID NO: 1923661 - DNA, 20 bp, Homo sapiens
acagagtgccatccctgaga

SEQ ID NO: 1923662 - DNA, 18 bp, Homo sapiens
acagagtggatctggagt

SEQ ID NO: 1923663 - DNA, 20 bp, Homo sapiens
acagagtggatctggagtct

SEQ ID NO: 1923664 - DNA, 22 bp, Homo sapiens
acagatctctgctttggaaatc

SEQ ID NO: 1923665 - DNA, 16 bp, Homo sapiens
acagcagagccatctg

SEQ ID NO: 1923666 - DNA, 16 bp, Homo sapiens
acagccaaattgcaga

SEQ ID NO: 1923667 - DNA, 20 bp, Homo sapiens
acagccccaaacaagcgcca

SEQ ID NO: 1923668 - DNA, 17 bp, Homo sapiens
acagcctcccctgccag

SEQ ID NO: 1923669 - DNA, 22 bp, Homo sapiens
acagcctcccctgccagggcag

SEQ ID NO: 1923670 - DNA, 15 bp, Homo sapiens
acagctgcagagaca

SEQ ID NO: 1923671 - DNA, 17 bp, Homo sapiens
acagctgcagagacaga

SEQ ID NO: 1923672 - DNA, 17 bp, Homo sapiens
acagctgcttctgtgca

SEQ ID NO: 1923673 - DNA, 22 bp, Homo sapiens
acaggagtgactctggctgcca

SEQ ID NO: 1923674 - DNA, 23 bp, Homo sapiens
acaggagtgactctggctgccaa

SEQ ID NO: 1923675 - DNA, 15 bp, Homo sapiens
acaggattagacagt

SEQ ID NO: 1923676 - DNA, 15 bp, Homo sapiens
acaggcgttctcagc

SEQ ID NO: 1923677 - DNA, 15 bp, Homo sapiens
acagggaagaaatca

SEQ ID NO: 1923678 - DNA, 20 bp, Homo sapiens
acagggagggaacagacctc

SEQ ID NO: 1923679 - DNA, 21 bp, Homo sapiens
acagggtggggcttagaatgg

SEQ ID NO: 1923680 - DNA, 22 bp, Homo sapiens
acagtaactaagcacattatgt

SEQ ID NO: 1923681 - DNA, 22 bp, Homo sapiens
acagtaggagcccagctctgaa

SEQ ID NO: 1923682 - DNA, 13 bp, Homo sapiens
acagtattgccac

SEQ ID NO: 1923683 - DNA, 15 bp, Homo sapiens
acagtattgccacct

SEQ ID NO: 1923684 - DNA, 17 bp, Homo sapiens
acagtcaaggagtggct

SEQ ID NO: 1923685 - DNA, 21 bp, Homo sapiens
acagtgagagcagggctgggc

SEQ ID NO: 1923686 - DNA, 21 bp, Homo sapiens
acagttaaatgagaacatgaa

SEQ ID NO: 1923687 - DNA, 17 bp, Homo sapiens
acataaaagaagaaact

SEQ ID NO: 1923688 - DNA, 14 bp, Homo sapiens
acataactgtaaca

SEQ ID NO: 1923689 - DNA, 15 bp, Homo sapiens
acataactgtaacat

SEQ ID NO: 1923690 - DNA, 23 bp, Homo sapiens
acatacttcatcgcagtggactg

SEQ ID NO: 1923691 - DNA, 12 bp, Homo sapiens
acatcaagatac

SEQ ID NO: 1923692 - DNA, 22 bp, Homo sapiens
acatcctgggggagcataccca

SEQ ID NO: 1923693 - DNA, 18 bp, Homo sapiens
acatcttagtatttgcat

SEQ ID NO: 1923694 - DNA, 13 bp, Homo sapiens
acatgaagaagct

SEQ ID NO: 1923695 - DNA, 15 bp, Homo sapiens
acatgaagattcttt

SEQ ID NO: 1923696 - DNA, 22 bp, Homo sapiens
acatgaagattctttcccaatt

SEQ ID NO: 1923697 - DNA, 21 bp, Homo sapiens
acatgaccctaaatcttgact

SEQ ID NO: 1923698 - DNA, 23 bp, Homo sapiens
acatgcggcttccgagggcacta

SEQ ID NO: 1923699 - DNA, 14 bp, Homo sapiens
acatgcgggctggg

SEQ ID NO: 1923700 - DNA, 17 bp, Homo sapiens
acatgcgggctgggcag

SEQ ID NO: 1923701 - DNA, 22 bp, Homo sapiens
acatgcgggctgggcagctgtt

SEQ ID NO: 1923702 - DNA, 23 bp, Homo sapiens
acatgggagccgggtctgcctct

SEQ ID NO: 1923703 - DNA, 16 bp, Homo sapiens
acatggggaggaagga

SEQ ID NO: 1923704 - DNA, 15 bp, Homo sapiens
acatggtagcagggt

SEQ ID NO: 1923705 - DNA, 18 bp, Homo sapiens
acatgtcagtaccttcaa

SEQ ID NO: 1923706 - DNA, 20 bp, Homo sapiens
acatgtgttaagtattttca

SEQ ID NO: 1923707 - DNA, 19 bp, Homo sapiens
acattattgaggaaaatta

SEQ ID NO: 1923708 - DNA, 23 bp, Homo sapiens
acattcaataagcatcaaactct

SEQ ID NO: 1923709 - DNA, 14 bp, Homo sapiens
acattcaggcatgc

SEQ ID NO: 1923710 - DNA, 18 bp, Homo sapiens
acatttaatatcctgcct

SEQ ID NO: 1923711 - DNA, 14 bp, Homo sapiens
acatttcctcaggc

SEQ ID NO: 1923712 - DNA, 23 bp, Homo sapiens
acatttctctaagagaacaatgt

SEQ ID NO: 1923713 - DNA, 15 bp, Homo sapiens
acatttggagtgttc

SEQ ID NO: 1923714 - DNA, 20 bp, Homo sapiens
acatttggagtgttcccctt

SEQ ID NO: 1923715 - DNA, 14 bp, Homo sapiens
acattttgtgcagt

SEQ ID NO: 1923716 - DNA, 16 bp, Homo sapiens
accaaacggaactctt

SEQ ID NO: 1923717 - DNA, 13 bp, Homo sapiens
accaaagaatagt

SEQ ID NO: 1923718 - DNA, 16 bp, Homo sapiens
accaacgggtctgtgg

SEQ ID NO: 1923719 - DNA, 22 bp, Homo sapiens
accaacgggtctgtgggactgg

SEQ ID NO: 1923720 - DNA, 18 bp, Homo sapiens
accaagccgtggcttccc

SEQ ID NO: 1923721 - DNA, 17 bp, Homo sapiens
accaatgaaaaaatgta

SEQ ID NO: 1923722 - DNA, 13 bp, Homo sapiens
accaatgtcttga

SEQ ID NO: 1923723 - DNA, 15 bp, Homo sapiens
accaccaacaggcgt

SEQ ID NO: 1923724 - DNA, 21 bp, Homo sapiens
accacgtctccctggccccag

SEQ ID NO: 1923725 - DNA, 15 bp, Homo sapiens
accacttatttctaa

SEQ ID NO: 1923726 - DNA, 16 bp, Homo sapiens
accacttatttctaaa

SEQ ID NO: 1923727 - DNA, 16 bp, Homo sapiens
accagaatgattttga

SEQ ID NO: 1923728 - DNA, 18 bp, Homo sapiens
accagactgtgggtccct

SEQ ID NO: 1923729 - DNA, 13 bp, Homo sapiens
accagagcacaga

SEQ ID NO: 1923730 - DNA, 19 bp, Homo sapiens
acccttacagtaggagccc

SEQ ID NO: 1923731 - DNA, 14 bp, Homo sapiens
acccttccccactc

SEQ ID NO: 1923732 - DNA, 16 bp, Homo sapiens
acccttgaaaagacat

SEQ ID NO: 1923733 - DNA, 23 bp, Homo sapiens
acccttgaatttctagacagtat

SEQ ID NO: 1923734 - DNA, 21 bp, Homo sapiens
accctttacattttgtgcagt

SEQ ID NO: 1923735 - DNA, 15 bp, Homo sapiens
accgagtatctgtaa

SEQ ID NO: 1923736 - DNA, 16 bp, Homo sapiens
accgagtatctgtaac

SEQ ID NO: 1923737 - DNA, 23 bp, Homo sapiens
accgagtatctgtaacccttgaa

SEQ ID NO: 1923738 - DNA, 18 bp, Homo sapiens
accgagtctcttctccac

SEQ ID NO: 1923739 - DNA, 20 bp, Homo sapiens
accgggtggcagcgcccagc

SEQ ID NO: 1923740 - DNA, 14 bp, Homo sapiens
acctaagtgactac

SEQ ID NO: 1923741 - DNA, 16 bp, Homo sapiens
acctaattagagcaga

SEQ ID NO: 1923742 - DNA, 15 bp, Homo sapiens
acctacttcctcctc

SEQ ID NO: 1923743 - DNA, 15 bp, Homo sapiens
acctagtagtcattt

SEQ ID NO: 1923744 - DNA, 23 bp, Homo sapiens
acctataaatactaaatatgaaa

SEQ ID NO: 1923745 - DNA, 17 bp, Homo sapiens
acctcaatggaggtttg

SEQ ID NO: 1923746 - DNA, 15 bp, Homo sapiens
acctcaggttccaaa

SEQ ID NO: 1923747 - DNA, 14 bp, Homo sapiens
acctccacatcctc

SEQ ID NO: 1923748 - DNA, 16 bp, Homo sapiens
acctccacatcctcca

SEQ ID NO: 1923749 - DNA, 11 bp, Homo sapiens
acctccacccg

SEQ ID NO: 1923750 - DNA, 19 bp, Homo sapiens
acctccccaggccgtggct

SEQ ID NO: 1923751 - DNA, 14 bp, Homo sapiens
acctccctgcagct

SEQ ID NO: 1923752 - DNA, 18 bp, Homo sapiens
acctcgctggactctcag

SEQ ID NO: 1923753 - DNA, 13 bp, Homo sapiens
acctcggctgtgt

SEQ ID NO: 1923754 - DNA, 15 bp, Homo sapiens
acctctggccctgtt

SEQ ID NO: 1923755 - DNA, 16 bp, Homo sapiens
acctctggctccttca

SEQ ID NO: 1923756 - DNA, 23 bp, Homo sapiens
acctctggctccttcagcagcta

SEQ ID NO: 1923757 - DNA, 21 bp, Homo sapiens
acctgaaaacactgtgcacat

SEQ ID NO: 1923758 - DNA, 21 bp, Homo sapiens
acctgaattcgagacaggcag

SEQ ID NO: 1923759 - DNA, 11 bp, Homo sapiens
acctgccaggc

SEQ ID NO: 1923760 - DNA, 13 bp, Homo sapiens
acctgccaggctg

SEQ ID NO: 1923761 - DNA, 14 bp, Homo sapiens
acctgccccaggct

SEQ ID NO: 1923762 - DNA, 15 bp, Homo sapiens
acctgccccaggctc

SEQ ID NO: 1923763 - DNA, 16 bp, Homo sapiens
acctgccccaggctca

SEQ ID NO: 1923764 - DNA, 18 bp, Homo sapiens
acctgcccccactcagca

SEQ ID NO: 1923765 - DNA, 18 bp, Homo sapiens
acctgtacatacattgta

SEQ ID NO: 1923766 - DNA, 20 bp, Homo sapiens
accttaggtagtaggaagaa

SEQ ID NO: 1923767 - DNA, 19 bp, Homo sapiens
accttcagtaaacaccatg

SEQ ID NO: 1923768 - DNA, 14 bp, Homo sapiens
accttcccagctgc

SEQ ID NO: 1923769 - DNA, 21 bp, Homo sapiens
accttcccagctgctcctaga

SEQ ID NO: 1923770 - DNA, 12 bp, Homo sapiens
accttctgtggc

SEQ ID NO: 1923771 - DNA, 13 bp, Homo sapiens
accttctgtggct

SEQ ID NO: 1923772 - DNA, 16 bp, Homo sapiens
accttgatgtcttgag

SEQ ID NO: 1923773 - DNA, 20 bp, Homo sapiens
accttgcactattggacttt

SEQ ID NO: 1923774 - DNA, 17 bp, Homo sapiens
accttgtgtgagtgtga

SEQ ID NO: 1923775 - DNA, 21 bp, Homo sapiens
accttgttgatgccagctgta

SEQ ID NO: 1923776 - DNA, 22 bp, Homo sapiens
acctttgcgtggatcaagcttg

SEQ ID NO: 1923777 - DNA, 14 bp, Homo sapiens
acctttttatctcc

SEQ ID NO: 1923778 - DNA, 17 bp, Homo sapiens
acgaagggaaatgtctt

SEQ ID NO: 1923779 - DNA, 14 bp, Homo sapiens
acgaatacttttgc

SEQ ID NO: 1923780 - DNA, 23 bp, Homo sapiens
acgactcttttccaaacacaggc

SEQ ID NO: 1923781 - DNA, 12 bp, Homo sapiens
acgactgtctcc

SEQ ID NO: 1923782 - DNA, 17 bp, Homo sapiens
acgatttcactgacact

SEQ ID NO: 1923783 - DNA, 23 bp, Homo sapiens
acgcagccctgctttgggctgcc

SEQ ID NO: 1923784 - DNA, 18 bp, Homo sapiens
acgcctgggggtgccagg

SEQ ID NO: 1923785 - DNA, 14 bp, Homo sapiens
acggacaggaagca

SEQ ID NO: 1923786 - DNA, 21 bp, Homo sapiens
acggagccactcctctgactc

SEQ ID NO: 1923787 - DNA, 22 bp, Homo sapiens
acgggtctgtgggactggccca

SEQ ID NO: 1923788 - DNA, 19 bp, Homo sapiens
acgtatgaatgatatcttt

SEQ ID NO: 1923789 - DNA, 12 bp, Homo sapiens
acgtccctccac

SEQ ID NO: 1923790 - DNA, 15 bp, Homo sapiens
acgtggccgctgccc

SEQ ID NO: 1923791 - DNA, 16 bp, Homo sapiens
acgtggccgctgccca

SEQ ID NO: 1923792 - DNA, 15 bp, Homo sapiens
acgtgggcggcagag

SEQ ID NO: 1923793 - DNA, 20 bp, Homo sapiens
acgtgggcggcagagaggac

SEQ ID NO: 1923794 - DNA, 20 bp, Homo sapiens
acgtggggcagcacagagag

SEQ ID NO: 1923795 - DNA, 16 bp, Homo sapiens
acgtgtttgtgctgtg

SEQ ID NO: 1923796 - DNA, 14 bp, Homo sapiens
acgttatctcattg

SEQ ID NO: 1923797 - DNA, 23 bp, Homo sapiens
acgttatctcattgcaaaaatat

SEQ ID NO: 1923798 - DNA, 17 bp, Homo sapiens
actaacatataatgttg

SEQ ID NO: 1923799 - DNA, 15 bp, Homo sapiens
actaagatgaaattg

SEQ ID NO: 1923800 - DNA, 19 bp, Homo sapiens
actaagatgaaattgccaa

SEQ ID NO: 1923801 - DNA, 20 bp, Homo sapiens
actaatgccctatcttagta

SEQ ID NO: 1923802 - DNA, 15 bp, Homo sapiens
actacacattcaata

SEQ ID NO: 1923803 - DNA, 19 bp, Homo sapiens
actacacattcaataagca

SEQ ID NO: 1923804 - DNA, 18 bp, Homo sapiens
actaccttggttccccca

SEQ ID NO: 1923805 - DNA, 19 bp, Homo sapiens
actagggatccctcatctg

SEQ ID NO: 1923806 - DNA, 21 bp, Homo sapiens
cactcctctgactcagggctc

SEQ ID NO: 1923807 - DNA, 14 bp, Homo sapiens
cactctacttagca

SEQ ID NO: 1923808 - DNA, 13 bp, Homo sapiens
cactctgaccggg

SEQ ID NO: 1923809 - DNA, 22 bp, Homo sapiens
cactgaaccttgttgatgccag

SEQ ID NO: 1923810 - DNA, 19 bp, Homo sapiens
cactgaagtgaatacatgg

SEQ ID NO: 1923811 - DNA, 18 bp, Homo sapiens
cactgaatcgtttcatgt

SEQ ID NO: 1923812 - DNA, 19 bp, Homo sapiens
cactgagaaggccccaggg

SEQ ID NO: 1923813 - DNA, 21 bp, Homo sapiens
cactgagaaggccccagggca

SEQ ID NO: 1923814 - DNA, 14 bp, Homo sapiens
cactgagggcagtc

SEQ ID NO: 1923815 - DNA, 19 bp, Homo sapiens
cactgcacagtgcatctca

SEQ ID NO: 1923816 - DNA, 22 bp, Homo sapiens
cactgcacagtgcatctcagcc

SEQ ID NO: 1923817 - DNA, 21 bp, Homo sapiens
cactgcagaacagcttcatgt

SEQ ID NO: 1923818 - DNA, 20 bp, Homo sapiens
cactgcatgcggcaaaccgc

SEQ ID NO: 1923819 - DNA, 19 bp, Homo sapiens
cactgccatggaggcacac

SEQ ID NO: 1923820 - DNA, 22 bp, Homo sapiens
cactgccatggaggcacacagc

SEQ ID NO: 1923821 - DNA, 20 bp, Homo sapiens
cactgcccacctgccaggct

SEQ ID NO: 1923822 - DNA, 21 bp, Homo sapiens
cactgcgaactctcaggacta

SEQ ID NO: 1923823 - DNA, 13 bp, Homo sapiens
cactgctgggaag

SEQ ID NO: 1923824 - DNA, 19 bp, Homo sapiens
cactgctgtccctcctgag

SEQ ID NO: 1923825 - DNA, 14 bp, Homo sapiens
cactgcttgaggaa

SEQ ID NO: 1923826 - DNA, 20 bp, Homo sapiens
cactgcttgaggaaaacaag

SEQ ID NO: 1923827 - DNA, 19 bp, Homo sapiens
cactggcatctctggagtg

SEQ ID NO: 1923828 - DNA, 23 bp, Homo sapiens
cactggccggcccacgtcctggg

SEQ ID NO: 1923829 - DNA, 13 bp, Homo sapiens
cactggctttggg

SEQ ID NO: 1923830 - DNA, 12 bp, Homo sapiens
caggacatttct

SEQ ID NO: 1923831 - DNA, 14 bp, Homo sapiens
caggacatttctct

SEQ ID NO: 1923832 - DNA, 15 bp, Homo sapiens
caggacccagaggaa

SEQ ID NO: 1923833 - DNA, 16 bp, Homo sapiens
caggacccagaggaag

SEQ ID NO: 1923834 - DNA, 13 bp, Homo sapiens
caggactctcttt

SEQ ID NO: 1923835 - DNA, 16 bp, Homo sapiens
caggactctctttctt

SEQ ID NO: 1923836 - DNA, 19 bp, Homo sapiens
caggagaaggccaattcct

SEQ ID NO: 1923837 - DNA, 15 bp, Homo sapiens
caggagaccctgtct

SEQ ID NO: 1923838 - DNA, 14 bp, Homo sapiens
caggaggcctggga

SEQ ID NO: 1923839 - DNA, 16 bp, Homo sapiens
caggaggcctgggaga

SEQ ID NO: 1923840 - DNA, 14 bp, Homo sapiens
caggagtgactctg

SEQ ID NO: 1923841 - DNA, 15 bp, Homo sapiens
caggagtgactctgg

SEQ ID NO: 1923842 - DNA, 23 bp, Homo sapiens
caggagtgactctggctgccaag

SEQ ID NO: 1923843 - DNA, 17 bp, Homo sapiens
caggcaagacaccttcc

SEQ ID NO: 1923844 - DNA, 23 bp, Homo sapiens
caggcaagacaccttcccagctg

SEQ ID NO: 1923845 - DNA, 18 bp, Homo sapiens
caggcaccagcagcagaa

SEQ ID NO: 1923846 - DNA, 13 bp, Homo sapiens
caggcagcattta

SEQ ID NO: 1923847 - DNA, 20 bp, Homo sapiens
caggcaggaaggctgagagg

SEQ ID NO: 1923848 - DNA, 12 bp, Homo sapiens
caggcatcctcc

SEQ ID NO: 1923849 - DNA, 18 bp, Homo sapiens
caggcatggcccagcctg

SEQ ID NO: 1923850 - DNA, 18 bp, Homo sapiens
caggccacccccacctcc

SEQ ID NO: 1923851 - DNA, 17 bp, Homo sapiens
caggccacggcagccta

SEQ ID NO: 1923852 - DNA, 20 bp, Homo sapiens
caggcccttcctctccactg

SEQ ID NO: 1923853 - DNA, 19 bp, Homo sapiens
caggccgaggaagggcccc

SEQ ID NO: 1923854 - DNA, 17 bp, Homo sapiens
caggcctggcaagtggg

SEQ ID NO: 1923855 - DNA, 16 bp, Homo sapiens
caggcggtcactgccc

SEQ ID NO: 1923856 - DNA, 18 bp, Homo sapiens
caggcggtcactgcccac

SEQ ID NO: 1923857 - DNA, 14 bp, Homo sapiens
caggctcaggctgc

SEQ ID NO: 1923858 - DNA, 16 bp, Homo sapiens
caggctcaggctgccc

SEQ ID NO: 1923859 - DNA, 17 bp, Homo sapiens
caggctcaggctgccca

SEQ ID NO: 1923860 - DNA, 15 bp, Homo sapiens
caggctcttctcctt

SEQ ID NO: 1923861 - DNA, 18 bp, Homo sapiens
caggctcttctcctttca

SEQ ID NO: 1923862 - DNA, 17 bp, Homo sapiens
cagggaccagcccagcc

SEQ ID NO: 1923863 - DNA, 11 bp, Homo sapiens
cagggcagcct

SEQ ID NO: 1923864 - DNA, 23 bp, Homo sapiens
cagggcagcctgtgggagaaggg

SEQ ID NO: 1923865 - DNA, 13 bp, Homo sapiens
cagggcagggccc

SEQ ID NO: 1923866 - DNA, 12 bp, Homo sapiens
cagggcctggcc

SEQ ID NO: 1923867 - DNA, 13 bp, Homo sapiens
cagggcctggcct

SEQ ID NO: 1923868 - DNA, 23 bp, Homo sapiens
cagggctaccctgagctgaggca

SEQ ID NO: 1923869 - DNA, 12 bp, Homo sapiens
cagggctcctgg

SEQ ID NO: 1923870 - DNA, 23 bp, Homo sapiens
cagggctgggcgcctctgtcctg

SEQ ID NO: 1923871 - DNA, 11 bp, Homo sapiens
cagggggccag

SEQ ID NO: 1923872 - DNA, 17 bp, Homo sapiens
caggggttccagcttcc

SEQ ID NO: 1923873 - DNA, 17 bp, Homo sapiens
cagggtagggggcctga

SEQ ID NO: 1923874 - DNA, 22 bp, Homo sapiens
cagggttaaagaaaggcagaga

SEQ ID NO: 1923875 - DNA, 15 bp, Homo sapiens
cagggttccagacag

SEQ ID NO: 1923876 - DNA, 17 bp, Homo sapiens
cagggttccagacaggg

SEQ ID NO: 1923877 - DNA, 14 bp, Homo sapiens
caggtcagagccca

SEQ ID NO: 1923878 - DNA, 15 bp, Homo sapiens
caggtcagagcccag

SEQ ID NO: 1923879 - DNA, 16 bp, Homo sapiens
caggtcagagcccagg

SEQ ID NO: 1923880 - DNA, 17 bp, Homo sapiens
caggtcagagcccagga

SEQ ID NO: 1923881 - DNA, 12 bp, Homo sapiens
caggtcctttcc

SEQ ID NO: 1923882 - DNA, 17 bp, Homo sapiens
caggtgaaatccacacc

SEQ ID NO: 1923883 - DNA, 21 bp, Homo sapiens
caggtgaaatccacaccagtc

SEQ ID NO: 1923884 - DNA, 15 bp, Homo sapiens
caggtggccactcca

SEQ ID NO: 1923885 - DNA, 19 bp, Homo sapiens
caggtggccactccagacc

SEQ ID NO: 1923886 - DNA, 19 bp, Homo sapiens
caggtggggagactgggct

SEQ ID NO: 1923887 - DNA, 20 bp, Homo sapiens
caggtggggagactgggctg

SEQ ID NO: 1923888 - DNA, 23 bp, Homo sapiens
caggtggggagactgggctgagg

SEQ ID NO: 1923889 - DNA, 21 bp, Homo sapiens
caggtggggttttcacttcct

SEQ ID NO: 1923890 - DNA, 18 bp, Homo sapiens
cagtaactaagcacatta

SEQ ID NO: 1923891 - DNA, 18 bp, Homo sapiens
cagtagctggagagagag

SEQ ID NO: 1923892 - DNA, 18 bp, Homo sapiens
cagtaggttgaggacagg

SEQ ID NO: 1923893 - DNA, 15 bp, Homo sapiens
cagtagtgcctgtga

SEQ ID NO: 1923894 - DNA, 17 bp, Homo sapiens
cagtagtgcctgtgatc

SEQ ID NO: 1923895 - DNA, 18 bp, Homo sapiens
cagtagtgcctgtgatcg

SEQ ID NO: 1923896 - DNA, 21 bp, Homo sapiens
cagtatgggctacacagcagc

SEQ ID NO: 1923897 - DNA, 15 bp, Homo sapiens
cagtattaagctaat

SEQ ID NO: 1923898 - DNA, 17 bp, Homo sapiens
cagtattgccacctctg

SEQ ID NO: 1923899 - DNA, 14 bp, Homo sapiens
cagtcaacctgggc

SEQ ID NO: 1923900 - DNA, 21 bp, Homo sapiens
cagtcaacctgggcaaagcct

SEQ ID NO: 1923901 - DNA, 22 bp, Homo sapiens
cagtcaacctgggcaaagccta

SEQ ID NO: 1923902 - DNA, 19 bp, Homo sapiens
cagtcacactgctgggaag

SEQ ID NO: 1923903 - DNA, 16 bp, Homo sapiens
cagtcacccctgtctg

SEQ ID NO: 1923904 - DNA, 17 bp, Homo sapiens
cagtcacccctgtctgc

SEQ ID NO: 1923905 - DNA, 18 bp, Homo sapiens
cagtcacccctgtctgcg

SEQ ID NO: 1923906 - DNA, 14 bp, Homo sapiens
cagtcagcccagtg

SEQ ID NO: 1923907 - DNA, 12 bp, Homo sapiens
cagtcaggggcc

SEQ ID NO: 1923908 - DNA, 15 bp, Homo sapiens
cagtcataactaaat

SEQ ID NO: 1923909 - DNA, 11 bp, Homo sapiens
cagtcctgcaa

SEQ ID NO: 1923910 - DNA, 17 bp, Homo sapiens
cagtctcacccagactc

SEQ ID NO: 1923911 - DNA, 12 bp, Homo sapiens
cagtctctgagc

SEQ ID NO: 1923912 - DNA, 21 bp, Homo sapiens
cagtctgttccccatggccac

SEQ ID NO: 1923913 - DNA, 15 bp, Homo sapiens
cagtcttccatttgc

SEQ ID NO: 1923914 - DNA, 17 bp, Homo sapiens
cagtcttccatttgcaa

SEQ ID NO: 1923915 - DNA, 22 bp, Homo sapiens
cagtcttgagtgggccccctct

SEQ ID NO: 1923916 - DNA, 15 bp, Homo sapiens
cagtgaaacttgtgc

SEQ ID NO: 1923917 - DNA, 17 bp, Homo sapiens
cagtgaatgattcagtg

SEQ ID NO: 1923918 - DNA, 18 bp, Homo sapiens
cagtgaatgattcagtgt

SEQ ID NO: 1923919 - DNA, 20 bp, Homo sapiens
cagtgagagcagggctgggc

SEQ ID NO: 1923920 - DNA, 14 bp, Homo sapiens
cagtgatgggagta

SEQ ID NO: 1923921 - DNA, 21 bp, Homo sapiens
cagtgatgggagtaagagcaa

SEQ ID NO: 1923922 - DNA, 23 bp, Homo sapiens
cagtgattgaagtatctgtacct

SEQ ID NO: 1923923 - DNA, 12 bp, Homo sapiens
cagtgcatctca

SEQ ID NO: 1923924 - DNA, 15 bp, Homo sapiens
cagtgcatctcagcc

SEQ ID NO: 1923925 - DNA, 18 bp, Homo sapiens
cagtgcatctcagcccac

SEQ ID NO: 1923926 - DNA, 15 bp, Homo sapiens
cagtggactgtgtcc

SEQ ID NO: 1923927 - DNA, 12 bp, Homo sapiens
cagtggagaggg

SEQ ID NO: 1923928 - DNA, 22 bp, Homo sapiens
cagtggcagcaacaaaggattt

SEQ ID NO: 1923929 - DNA, 19 bp, Homo sapiens
cagtgggacagggcatggc

SEQ ID NO: 1923930 - DNA, 19 bp, Homo sapiens
cactgggccggcagcctgg

SEQ ID NO: 1923931 - DNA, 20 bp, Homo sapiens
cactgggccggcagcctggt

SEQ ID NO: 1923932 - DNA, 21 bp, Homo sapiens
cactggtggcccgacagcctg

SEQ ID NO: 1923933 - DNA, 23 bp, Homo sapiens
cactggtggcccgacagcctggc

SEQ ID NO: 1923934 - DNA, 18 bp, Homo sapiens
cactgtaaatttaataga

SEQ ID NO: 1923935 - DNA, 20 bp, Homo sapiens
cactgtcatgcccagcttgg

SEQ ID NO: 1923936 - DNA, 15 bp, Homo sapiens
cactgtgtatttaac

SEQ ID NO: 1923937 - DNA, 13 bp, Homo sapiens
cacttaacctgct

SEQ ID NO: 1923938 - DNA, 14 bp, Homo sapiens
cacttaacctgctt

SEQ ID NO: 1923939 - DNA, 17 bp, Homo sapiens
cacttagaaattgcatt

SEQ ID NO: 1923940 - DNA, 19 bp, Homo sapiens
cacttagaaattgcatttc

SEQ ID NO: 1923941 - DNA, 15 bp, Homo sapiens
cacttatttctaaat

SEQ ID NO: 1923942 - DNA, 16 bp, Homo sapiens
cacttcaggctcttct

SEQ ID NO: 1923943 - DNA, 20 bp, Homo sapiens
cacttcaggctcttctcctt

SEQ ID NO: 1923944 - DNA, 18 bp, Homo sapiens
cacttgcccctgttacct

SEQ ID NO: 1923945 - DNA, 22 bp, Homo sapiens
cacttgtgtttgtatataaatg

SEQ ID NO: 1923946 - DNA, 14 bp, Homo sapiens
cactttccctagaa

SEQ ID NO: 1923947 - DNA, 16 bp, Homo sapiens
cactttgaaaatattt

SEQ ID NO: 1923948 - DNA, 22 bp, Homo sapiens
cactttgaaaatatttctatgt

SEQ ID NO: 1923949 - DNA, 20 bp, Homo sapiens
cactttgcagacctgggact

SEQ ID NO: 1923950 - DNA, 20 bp, Homo sapiens
cagaaaacggttaaaactgt

SEQ ID NO: 1923951 - DNA, 23 bp, Homo sapiens
cagaaacttttttctctaaagga

SEQ ID NO: 1923952 - DNA, 24 bp, Homo sapiens
cagaaagaagtggggacagagcag

SEQ ID NO: 1923953 - DNA, 18 bp, Homo sapiens
cagaaatatgattgattt

SEQ ID NO: 1923954 - DNA, 14 bp, Homo sapiens
cagaacagcttcat

SEQ ID NO: 1923955 - DNA, 16 bp, Homo sapiens
cagaaccaacgggtct

SEQ ID NO: 1923956 - DNA, 13 bp, Homo sapiens
cagaaccagctct

SEQ ID NO: 1923957 - DNA, 16 bp, Homo sapiens
cagaactaccaaaatg

SEQ ID NO: 1923958 - DNA, 14 bp, Homo sapiens
cagaactctttcaa

SEQ ID NO: 1923959 - DNA, 16 bp, Homo sapiens
cagaagaagctcctga

SEQ ID NO: 1923960 - DNA, 20 bp, Homo sapiens
cagaagagaaagtacaacca

SEQ ID NO: 1923961 - DNA, 20 bp, Homo sapiens
cagaagcctcactgcaagca

SEQ ID NO: 1923962 - DNA, 18 bp, Homo sapiens
cagaaggcaaacccatca

SEQ ID NO: 1923963 - DNA, 18 bp, Homo sapiens
cagaagttgttagtgatt

SEQ ID NO: 1923964 - DNA, 22 bp, Homo sapiens
cagaataaatgggtaacactga

SEQ ID NO: 1923965 - DNA, 15 bp, Homo sapiens
cagaatctttaaaga

SEQ ID NO: 1923966 - DNA, 13 bp, Homo sapiens
cagacagagtgga

SEQ ID NO: 1923967 - DNA, 14 bp, Homo sapiens
cagacagagtggat

SEQ ID NO: 1923968 - DNA, 17 bp, Homo sapiens
cagacagggtggggctt

SEQ ID NO: 1923969 - DNA, 19 bp, Homo sapiens
cagacagggtggggcttag

SEQ ID NO: 1923970 - DNA, 19 bp, Homo sapiens
cagacagtgttttctggga

SEQ ID NO: 1923971 - DNA, 16 bp, Homo sapiens
cagaccataatgttac

SEQ ID NO: 1923972 - DNA, 15 bp, Homo sapiens
cagacccctaccctt

SEQ ID NO: 1923973 - DNA, 14 bp, Homo sapiens
cagacccctggctt

SEQ ID NO: 1923974 - DNA, 15 bp, Homo sapiens
cagacccctggcttt

SEQ ID NO: 1923975 - DNA, 23 bp, Homo sapiens
cagacccctggcttttcactgct

SEQ ID NO: 1923976 - DNA, 13 bp, Homo sapiens
cagaccctgccag

SEQ ID NO: 1923977 - DNA, 22 bp, Homo sapiens
cagacctaggatttcatgattt

SEQ ID NO: 1923978 - DNA, 15 bp, Homo sapiens
cagacgtccctccac

SEQ ID NO: 1923979 - DNA, 18 bp, Homo sapiens
cagagaacaatcactatt

SEQ ID NO: 1923980 - DNA, 14 bp, Homo sapiens
cagagacagagagg

SEQ ID NO: 1923981 - DNA, 16 bp, Homo sapiens
cagagacagagaggac

SEQ ID NO: 1923982 - DNA, 19 bp, Homo sapiens
cagagagaagcaccccacc

SEQ ID NO: 1923983 - DNA, 16 bp, Homo sapiens
cagagaggacgtgggc

SEQ ID NO: 1923984 - DNA, 18 bp, Homo sapiens
cagagagtggctcctccc

SEQ ID NO: 1923985 - DNA, 14 bp, Homo sapiens
cagagccatctgcg

SEQ ID NO: 1923986 - DNA, 12 bp, Homo sapiens
cagagcccagga

SEQ ID NO: 1923987 - DNA, 14 bp, Homo sapiens
cagagcttccctga

SEQ ID NO: 1923988 - DNA, 21 bp, Homo sapiens
cagaggattgctgccccatca

SEQ ID NO: 1923989 - DNA, 15 bp, Homo sapiens
cagaggcagtggcag

SEQ ID NO: 1923990 - DNA, 17 bp, Homo sapiens
cagaggcagtggcagca

SEQ ID NO: 1923991 - DNA, 20 bp, Homo sapiens
cagagtaaaattacagaaga

SEQ ID NO: 1923992 - DNA, 15 bp, Homo sapiens
cagagtaggtgggtc

SEQ ID NO: 1923993 - DNA, 16 bp, Homo sapiens
cagagtaggtgggtct

SEQ ID NO: 1923994 - DNA, 21 bp, Homo sapiens
cagagtaggtgggtcttggat

SEQ ID NO: 1923995 - DNA, 14 bp, Homo sapiens
cagagtgagaccca

SEQ ID NO: 1923996 - DNA, 14 bp, Homo sapiens
cagagtggatctgg

SEQ ID NO: 1923997 - DNA, 20 bp, Homo sapiens
cagagtggatctggagtctg

SEQ ID NO: 1923998 - DNA, 14 bp, Homo sapiens
cagataaaaacaat

SEQ ID NO: 1923999 - DNA, 14 bp, Homo sapiens
cagataatgtgaaa

SEQ ID NO: 1924000 - DNA, 16 bp, Homo sapiens
cagataatgtgaaaat

SEQ ID NO: 1924001 - DNA, 12 bp, Homo sapiens
cagatcttgagc

SEQ ID NO: 1924002 - DNA, 16 bp, Homo sapiens
cagatgaactgagaag

SEQ ID NO: 1924003 - DNA, 20 bp, Homo sapiens
cagatgcctcctctgtcctc

SEQ ID NO: 1924004 - DNA, 23 bp, Homo sapiens
cagatgggttttgttaggggtgg

SEQ ID NO: 1924005 - DNA, 21 bp, Homo sapiens
cagattttttctttaaataaa

SEQ ID NO: 1924006 - DNA, 22 bp, Homo sapiens
cagattttttctttaaataaaa

SEQ ID NO: 1924007 - DNA, 12 bp, Homo sapiens
cagcaagggctt

SEQ ID NO: 1924008 - DNA, 16 bp, Homo sapiens
cagcactgcttgagga

SEQ ID NO: 1924009 - DNA, 19 bp, Homo sapiens
cagcactgcttgaggaaaa

SEQ ID NO: 1924010 - DNA, 16 bp, Homo sapiens
cagcagagccatctgc

SEQ ID NO: 1924011 - DNA, 16 bp, Homo sapiens
cagcaggagcatggcc

SEQ ID NO: 1924012 - DNA, 11 bp, Homo sapiens
cagcagggcta

SEQ ID NO: 1924013 - DNA, 19 bp, Homo sapiens
cagcagggctaccctgagc

SEQ ID NO: 1924014 - DNA, 15 bp, Homo sapiens
cagcaggggggttgg

SEQ ID NO: 1924015 - DNA, 22 bp, Homo sapiens
cagcaggggggttgggttccag

SEQ ID NO: 1924016 - DNA, 22 bp, Homo sapiens
cagcagtgtgaggccagggcag

SEQ ID NO: 1924017 - DNA, 19 bp, Homo sapiens
cagccaaacctttcctgta

SEQ ID NO: 1924018 - DNA, 15 bp, Homo sapiens
cagccacccagccag

SEQ ID NO: 1924019 - DNA, 19 bp, Homo sapiens
cagccacccagccaggagg

SEQ ID NO: 1924020 - DNA, 11 bp, Homo sapiens
cagccaggagg

SEQ ID NO: 1924021 - DNA, 13 bp, Homo sapiens
cagccaggagggg

SEQ ID NO: 1924022 - DNA, 16 bp, Homo sapiens
cagccagtaaggcagc

SEQ ID NO: 1924023 - DNA, 14 bp, Homo sapiens
cagcccctccccat

SEQ ID NO: 1924024 - DNA, 13 bp, Homo sapiens
cagccctcagttt

SEQ ID NO: 1924025 - DNA, 16 bp, Homo sapiens
cagccctccctgcccc

SEQ ID NO: 1924026 - DNA, 22 bp, Homo sapiens
cagccctccctgcccctccctt

SEQ ID NO: 1924027 - DNA, 19 bp, Homo sapiens
cagccctgctttgggctgc

SEQ ID NO: 1924028 - DNA, 23 bp, Homo sapiens
cagccctgctttgggctgccctg

SEQ ID NO: 1924029 - DNA, 20 bp, Homo sapiens
cagccgctgagcgaggagat

SEQ ID NO: 1924030 - DNA, 18 bp, Homo sapiens
cagccgtgccttcagctc

SEQ ID NO: 1924031 - DNA, 17 bp, Homo sapiens
cagcctagtaggagctg

SEQ ID NO: 1924032 - DNA, 20 bp, Homo sapiens
cagcctagtaggagctgagc

SEQ ID NO: 1924033 - DNA, 19 bp, Homo sapiens
cagcctccgtatttcagac

SEQ ID NO: 1924034 - DNA, 11 bp, Homo sapiens
cagcctggagc

SEQ ID NO: 1924035 - DNA, 13 bp, Homo sapiens
cagcctggagccg

SEQ ID NO: 1924036 - DNA, 17 bp, Homo sapiens
cgtagtagggtcaggcc

SEQ ID NO: 1924037 - DNA, 13 bp, Homo sapiens
cgtataataaaac

SEQ ID NO: 1924038 - DNA, 14 bp, Homo sapiens
cgtatgaatgatat

SEQ ID NO: 1924039 - DNA, 17 bp, Homo sapiens
cgtcccgagggcgcctg

SEQ ID NO: 1924040 - DNA, 21 bp, Homo sapiens
cgtcccgagggcgcctgggtc

SEQ ID NO: 1924041 - DNA, 18 bp, Homo sapiens
cgtcccgggcactgtcat

SEQ ID NO: 1924042 - DNA, 24 bp, Homo sapiens
cgtcccgggcactgtcatgcccag

SEQ ID NO: 1924043 - DNA, 17 bp, Homo sapiens
cgtccctttccctgcat

SEQ ID NO: 1924044 - DNA, 12 bp, Homo sapiens
cgtcctcctctg

SEQ ID NO: 1924045 - DNA, 16 bp, Homo sapiens
cgtgacttcagactct

SEQ ID NO: 1924046 - DNA, 17 bp, Homo sapiens
cgtgacttcagactctc

SEQ ID NO: 1924047 - DNA, 16 bp, Homo sapiens
cgtgccttcagctcta

SEQ ID NO: 1924048 - DNA, 18 bp, Homo sapiens
cgtgccttcagctctaca

SEQ ID NO: 1924049 - DNA, 12 bp, Homo sapiens
cgtggagccaca

SEQ ID NO: 1924050 - DNA, 13 bp, Homo sapiens
cgtggagccacag

SEQ ID NO: 1924051 - DNA, 19 bp, Homo sapiens
cgtggagccacaggcagac

SEQ ID NO: 1924052 - DNA, 14 bp, Homo sapiens
cgtggccgctgccc

SEQ ID NO: 1924053 - DNA, 16 bp, Homo sapiens
cgtggccgctgcccac

SEQ ID NO: 1924054 - DNA, 19 bp, Homo sapiens
cgtggccgctgctgtgaca

SEQ ID NO: 1924055 - DNA, 21 bp, Homo sapiens
cgtggctgcccacacacccca

SEQ ID NO: 1924056 - DNA, 19 bp, Homo sapiens
cgtggctgcggcacccttg

SEQ ID NO: 1924057 - DNA, 18 bp, Homo sapiens
cgtggcttcccgctcagc

SEQ ID NO: 1924058 - DNA, 20 bp, Homo sapiens
cgtggcttcccgctcagccc

SEQ ID NO: 1924059 - DNA, 14 bp, Homo sapiens
cgtgggatccagag

SEQ ID NO: 1924060 - DNA, 21 bp, Homo sapiens
cgtgggatccagagagaagca

SEQ ID NO: 1924061 - DNA, 13 bp, Homo sapiens
cgtgggctccctg

SEQ ID NO: 1924062 - DNA, 20 bp, Homo sapiens
cgttcacccctccacccttg

SEQ ID NO: 1924063 - DNA, 14 bp, Homo sapiens
cgttctgctcatca

SEQ ID NO: 1924064 - DNA, 21 bp, Homo sapiens
cgtttttatattacttttgta

SEQ ID NO: 1924065 - DNA, 23 bp, Homo sapiens
cgtttttatattacttttgtaaa

SEQ ID NO: 1924066 - DNA, 19 bp, Homo sapiens
cgtttttgctggcttgcac

SEQ ID NO: 1924067 - DNA, 18 bp, Homo sapiens
ctaaaaggaggacaggga

SEQ ID NO: 1924068 - DNA, 21 bp, Homo sapiens
ctaaagaaggtttcagaaaga

SEQ ID NO: 1924069 - DNA, 22 bp, Homo sapiens
ctaacatataatgttgttattt

SEQ ID NO: 1924070 - DNA, 15 bp, Homo sapiens
ctaacctcatcttct

SEQ ID NO: 1924071 - DNA, 13 bp, Homo sapiens
ctaagaataatga

SEQ ID NO: 1924072 - DNA, 13 bp, Homo sapiens
ctaagatgaaatt

SEQ ID NO: 1924073 - DNA, 17 bp, Homo sapiens
ctaagatgaaattgcca

SEQ ID NO: 1924074 - DNA, 14 bp, Homo sapiens
ctaagtgactacca

SEQ ID NO: 1924075 - DNA, 21 bp, Homo sapiens
ctaatcagcattctcactcct

SEQ ID NO: 1924076 - DNA, 17 bp, Homo sapiens
ctaatcgccctgagcta

SEQ ID NO: 1924077 - DNA, 19 bp, Homo sapiens
ctaatgaatgcataaaatg

SEQ ID NO: 1924078 - DNA, 16 bp, Homo sapiens
ctaatgcattaacttt

SEQ ID NO: 1924079 - DNA, 19 bp, Homo sapiens
ctaattaaaatgtgcagta

SEQ ID NO: 1924080 - DNA, 16 bp, Homo sapiens
ctacagagcttccctg

SEQ ID NO: 1924081 - DNA, 18 bp, Homo sapiens
ctacagccagtaaggcag

SEQ ID NO: 1924082 - DNA, 22 bp, Homo sapiens
ctacagccagtaaggcagctct

SEQ ID NO: 1924083 - DNA, 18 bp, Homo sapiens
ctacagctaatcagcatt

SEQ ID NO: 1924084 - DNA, 19 bp, Homo sapiens
ctacagctaatcagcattc

SEQ ID NO: 1924085 - DNA, 16 bp, Homo sapiens
ctacatgtgggagctt

SEQ ID NO: 1924086 - DNA, 16 bp, Homo sapiens
ctaccacttatttcta

SEQ ID NO: 1924087 - DNA, 18 bp, Homo sapiens
ctaccctgagctgaggca

SEQ ID NO: 1924088 - DNA, 21 bp, Homo sapiens
ctaccgagtctcttctccact

SEQ ID NO: 1924089 - DNA, 20 bp, Homo sapiens
ctacctgacactcccttggg

SEQ ID NO: 1924090 - DNA, 12 bp, Homo sapiens
ctactctgcctg

SEQ ID NO: 1924091 - DNA, 16 bp, Homo sapiens
ctacttcctcctcctc

SEQ ID NO: 1924092 - DNA, 14 bp, Homo sapiens
ctagaaacttccaa

SEQ ID NO: 1924093 - DNA, 15 bp, Homo sapiens
ctagaaagccatatt

SEQ ID NO: 1924094 - DNA, 18 bp, Homo sapiens
ctagactcccaagctgga

SEQ ID NO: 1924095 - DNA, 13 bp, Homo sapiens
ctagggatccctc

SEQ ID NO: 1924096 - DNA, 14 bp, Homo sapiens
ctaggtctccaccc

SEQ ID NO: 1924097 - DNA, 18 bp, Homo sapiens
ctaggtgcccagtcttga

SEQ ID NO: 1924098 - DNA, 17 bp, Homo sapiens
cctggcacagggcagtg

SEQ ID NO: 1924099 - DNA, 18 bp, Homo sapiens
cctggcacagggcagtgg

SEQ ID NO: 1924100 - DNA, 18 bp, Homo sapiens
cctggcagccgtgccttc

SEQ ID NO: 1924101 - DNA, 14 bp, Homo sapiens
cctggccccagtga

SEQ ID NO: 1924102 - DNA, 16 bp, Homo sapiens
cctggccccagtgacc

SEQ ID NO: 1924103 - DNA, 12 bp, Homo sapiens
cctggcctggtc

SEQ ID NO: 1924104 - DNA, 17 bp, Homo sapiens
cctggcttttcactgct

SEQ ID NO: 1924105 - DNA, 18 bp, Homo sapiens
cctgggaaatattcccta

SEQ ID NO: 1924106 - DNA, 16 bp, Homo sapiens
cctgggagatgcagct

SEQ ID NO: 1924107 - DNA, 18 bp, Homo sapiens
cctgggagatgcagctgg

SEQ ID NO: 1924108 - DNA, 22 bp, Homo sapiens
cctgggcgcaagcgacacaggc

SEQ ID NO: 1924109 - DNA, 13 bp, Homo sapiens
cctggggggggca

SEQ ID NO: 1924110 - DNA, 15 bp, Homo sapiens
cctggggggggcaag

SEQ ID NO: 1924111 - DNA, 22 bp, Homo sapiens
cctggggtggttggaggcctgg

SEQ ID NO: 1924112 - DNA, 19 bp, Homo sapiens
cctgggtcctcccagctga

SEQ ID NO: 1924113 - DNA, 22 bp, Homo sapiens
cctgggttttgtattctctgag

SEQ ID NO: 1924114 - DNA, 14 bp, Homo sapiens
cctggtccaggctt

SEQ ID NO: 1924115 - DNA, 14 bp, Homo sapiens
cctggtctggagcc

SEQ ID NO: 1924116 - DNA, 15 bp, Homo sapiens
cctggtctggagccc

SEQ ID NO: 1924117 - DNA, 17 bp, Homo sapiens
cctggtctggagcccct

SEQ ID NO: 1924118 - DNA, 21 bp, Homo sapiens
cctggtctggagcccctatcc

SEQ ID NO: 1924119 - DNA, 20 bp, Homo sapiens
cctggtgctgcctctacctg

SEQ ID NO: 1924120 - DNA, 20 bp, Homo sapiens
cctggttccctctttcctgt

SEQ ID NO: 1924121 - DNA, 17 bp, Homo sapiens
cctgtacatacattgta

SEQ ID NO: 1924122 - DNA, 13 bp, Homo sapiens
cctgtctgcaggc

SEQ ID NO: 1924123 - DNA, 15 bp, Homo sapiens
cctgtgatcgtgtgt

SEQ ID NO: 1924124 - DNA, 17 bp, Homo sapiens
cctgtgatcgtgtgttg

SEQ ID NO: 1924125 - DNA, 18 bp, Homo sapiens
cctgtgcagccgctgagc

SEQ ID NO: 1924126 - DNA, 21 bp, Homo sapiens
cctgtgccaggactctctttc

SEQ ID NO: 1924127 - DNA, 23 bp, Homo sapiens
cctgttacctaattagagcagat

SEQ ID NO: 1924128 - DNA, 17 bp, Homo sapiens
cctgttcctgccttctc

SEQ ID NO: 1924129 - DNA, 13 bp, Homo sapiens
cctgtttgggagg

SEQ ID NO: 1924130 - DNA, 23 bp, Homo sapiens
ccttaaaactttaatcccacttg

SEQ ID NO: 1924131 - DNA, 20 bp, Homo sapiens
ccttaaacaaaaattaaaat

SEQ ID NO: 1924132 - DNA, 19 bp, Homo sapiens
ccttagaaaagactgacct

SEQ ID NO: 1924133 - DNA, 15 bp, Homo sapiens
ccttagaacctttct

SEQ ID NO: 1924134 - DNA, 15 bp, Homo sapiens
ccttccactgagggc

SEQ ID NO: 1924135 - DNA, 14 bp, Homo sapiens
ccttcccaccccta

SEQ ID NO: 1924136 - DNA, 13 bp, Homo sapiens
ccttcccacggcc

SEQ ID NO: 1924137 - DNA, 18 bp, Homo sapiens
ccttcccacggccactgc

SEQ ID NO: 1924138 - DNA, 11 bp, Homo sapiens
ccttccccact

SEQ ID NO: 1924139 - DNA, 12 bp, Homo sapiens
ccttccccactc

SEQ ID NO: 1924140 - DNA, 22 bp, Homo sapiens
ccttcccctgcgccctccctcc

SEQ ID NO: 1924141 - DNA, 13 bp, Homo sapiens
ccttcctcctggg

SEQ ID NO: 1924142 - DNA, 20 bp, Homo sapiens
ccttcctctccactgccttc

SEQ ID NO: 1924143 - DNA, 21 bp, Homo sapiens
ccttcctctccactgccttcg

SEQ ID NO: 1924144 - DNA, 23 bp, Homo sapiens
ccttctagacactgaaggcaaat

SEQ ID NO: 1924145 - DNA, 16 bp, Homo sapiens
ccttctccatccacat

SEQ ID NO: 1924146 - DNA, 13 bp, Homo sapiens
ccttctcccctcc

SEQ ID NO: 1924147 - DNA, 15 bp, Homo sapiens
ccttctcccctccag

SEQ ID NO: 1924148 - DNA, 17 bp, Homo sapiens
ccttctcccctccagac

SEQ ID NO: 1924149 - DNA, 20 bp, Homo sapiens
ccttctcccctccagacccc

SEQ ID NO: 1924150 - DNA, 16 bp, Homo sapiens
ccttctcgtcttcctc

SEQ ID NO: 1924151 - DNA, 18 bp, Homo sapiens
ccttctcgtcttcctctc

SEQ ID NO: 1924152 - DNA, 21 bp, Homo sapiens
ccttctgatctgagaagacat

SEQ ID NO: 1924153 - DNA, 21 bp, Homo sapiens
ccttctgtggctcacagaacc

SEQ ID NO: 1924154 - DNA, 15 bp, Homo sapiens
ccttcttccacagca

SEQ ID NO: 1924155 - DNA, 14 bp, Homo sapiens
ccttgaatttctag

SEQ ID NO: 1924156 - DNA, 14 bp, Homo sapiens
ccttgatgtcttga

SEQ ID NO: 1924157 - DNA, 20 bp, Homo sapiens
ccttgcactattggactttg

SEQ ID NO: 1924158 - DNA, 16 bp, Homo sapiens
ccttgccgctgggaga

SEQ ID NO: 1924159 - DNA, 23 bp, Homo sapiens
ccttgccgctgggagagccaagg

SEQ ID NO: 1924160 - DNA, 13 bp, Homo sapiens
ccttggcccctct

SEQ ID NO: 1924161 - DNA, 18 bp, Homo sapiens
ccttggcccctctctgtt

SEQ ID NO: 1924162 - DNA, 12 bp, Homo sapiens
ccttgggccctt

SEQ ID NO: 1924163 - DNA, 14 bp, Homo sapiens
ccttgggccctttg

SEQ ID NO: 1924164 - DNA, 12 bp, Homo sapiens
ccttgggctccc

SEQ ID NO: 1924165 - DNA, 13 bp, Homo sapiens
ccttggttcctcc

SEQ ID NO: 1924166 - DNA, 14 bp, Homo sapiens
ccgtgccttcagct

SEQ ID NO: 1924167 - DNA, 14 bp, Homo sapiens
ccgtggctgcggca

SEQ ID NO: 1924168 - DNA, 15 bp, Homo sapiens
ccgtggcttcccgct

SEQ ID NO: 1924169 - DNA, 14 bp, Homo sapiens
ccgtgggctccctg

SEQ ID NO: 1924170 - DNA, 14 bp, Homo sapiens
ccgtggtcctttgg

SEQ ID NO: 1924171 - DNA, 14 bp, Homo sapiens
ccgtttccaagcct

SEQ ID NO: 1924172 - DNA, 16 bp, Homo sapiens
ccgtttccaagcctgg

SEQ ID NO: 1924173 - DNA, 16 bp, Homo sapiens
cctaataaagttctgt

SEQ ID NO: 1924174 - DNA, 17 bp, Homo sapiens
cctaccgagtctcttct

SEQ ID NO: 1924175 - DNA, 21 bp, Homo sapiens
cctaccgagtctcttctccac

SEQ ID NO: 1924176 - DNA, 13 bp, Homo sapiens
cctagaaagccat

SEQ ID NO: 1924177 - DNA, 17 bp, Homo sapiens
cctagaaagccatattc

SEQ ID NO: 1924178 - DNA, 19 bp, Homo sapiens
cctagaaagccatattcca

SEQ ID NO: 1924179 - DNA, 20 bp, Homo sapiens
cctagagattcttagctctt

SEQ ID NO: 1924180 - DNA, 18 bp, Homo sapiens
cctagatggttccctttg

SEQ ID NO: 1924181 - DNA, 16 bp, Homo sapiens
cctaggtctccacccc

SEQ ID NO: 1924182 - DNA, 21 bp, Homo sapiens
cctaggtctccacccctcaag

SEQ ID NO: 1924183 - DNA, 22 bp, Homo sapiens
cctagtgaaggcttctctctgt

SEQ ID NO: 1924184 - DNA, 17 bp, Homo sapiens
cctagtggggaggggcc

SEQ ID NO: 1924185 - DNA, 20 bp, Homo sapiens
cctagtggggaggggcctgg

SEQ ID NO: 1924186 - DNA, 22 bp, Homo sapiens
cctagtggggaggggcctggcc

SEQ ID NO: 1924187 - DNA, 23 bp, Homo sapiens
cctagtggggaggggcctggcct

SEQ ID NO: 1924188 - DNA, 22 bp, Homo sapiens
cctatatgtggcattcctttct

SEQ ID NO: 1924189 - DNA, 16 bp, Homo sapiens
cctatcctgcaccctc

SEQ ID NO: 1924190 - DNA, 16 bp, Homo sapiens
cctcaagccaggagac

SEQ ID NO: 1924191 - DNA, 23 bp, Homo sapiens
cctcaagccaggagaccctgtct

SEQ ID NO: 1924192 - DNA, 23 bp, Homo sapiens
cctcactccactcccctcatcca

SEQ ID NO: 1924193 - DNA, 14 bp, Homo sapiens
cctcactgagaagg

SEQ ID NO: 1924194 - DNA, 19 bp, Homo sapiens
cctcagtgagatcagtcag

SEQ ID NO: 1924195 - DNA, 14 bp, Homo sapiens
cctcatcccgagca

SEQ ID NO: 1924196 - DNA, 15 bp, Homo sapiens
cctcatctgtccctc

SEQ ID NO: 1924197 - DNA, 17 bp, Homo sapiens
cctcatcttcttcacca

SEQ ID NO: 1924198 - DNA, 13 bp, Homo sapiens
cctcatgctctct

SEQ ID NO: 1924199 - DNA, 23 bp, Homo sapiens
cctcatttttgaatacaggcata

SEQ ID NO: 1924200 - DNA, 13 bp, Homo sapiens
cctccacacctcc

SEQ ID NO: 1924201 - DNA, 18 bp, Homo sapiens
cctccacacctccacccg

SEQ ID NO: 1924202 - DNA, 17 bp, Homo sapiens
cctccacgttcacccct

SEQ ID NO: 1924203 - DNA, 18 bp, Homo sapiens
cctccacgttcacccctc

SEQ ID NO: 1924204 - DNA, 17 bp, Homo sapiens
cctccacgttctgctca

SEQ ID NO: 1924205 - DNA, 21 bp, Homo sapiens
cctccacgttctgctcatcat

SEQ ID NO: 1924206 - DNA, 16 bp, Homo sapiens
cctccactcctcccaa

SEQ ID NO: 1924207 - DNA, 14 bp, Homo sapiens
cctccagaccccta

SEQ ID NO: 1924208 - DNA, 17 bp, Homo sapiens
cctccagacccctaccc

SEQ ID NO: 1924209 - DNA, 16 bp, Homo sapiens
cctccagagcctgggc

SEQ ID NO: 1924210 - DNA, 17 bp, Homo sapiens
cctccagagcctgggcg

SEQ ID NO: 1924211 - DNA, 18 bp, Homo sapiens
cctccagagcctgggcgc

SEQ ID NO: 1924212 - DNA, 11 bp, Homo sapiens
cctccatggga

SEQ ID NO: 1924213 - DNA, 17 bp, Homo sapiens
cctccatgtagaagagg

SEQ ID NO: 1924214 - DNA, 23 bp, Homo sapiens
cctccatgtagaagagggagaag

SEQ ID NO: 1924215 - DNA, 21 bp, Homo sapiens
cctcccaactctggccttggt

SEQ ID NO: 1924216 - DNA, 12 bp, Homo sapiens
cctcccctgcca

SEQ ID NO: 1924217 - DNA, 18 bp, Homo sapiens
cctcccctgccagggcag

SEQ ID NO: 1924218 - DNA, 19 bp, Homo sapiens
cctccctccacacctccac

SEQ ID NO: 1924219 - DNA, 16 bp, Homo sapiens
cctccctccctccaca

SEQ ID NO: 1924220 - DNA, 13 bp, Homo sapiens
cctccctgcagct

SEQ ID NO: 1924221 - DNA, 19 bp, Homo sapiens
cctccctgcagctttgagg

SEQ ID NO: 1924222 - DNA, 18 bp, Homo sapiens
cctccctgcccctccctt

SEQ ID NO: 1924223 - DNA, 21 bp, Homo sapiens
cctccctgcccctcccttcaa

SEQ ID NO: 1924224 - DNA, 12 bp, Homo sapiens
cctccctgtccc

SEQ ID NO: 1924225 - DNA, 16 bp, Homo sapiens
cctcctccagagcctg

SEQ ID NO: 1924226 - DNA, 19 bp, Homo sapiens
cctcctccagagcctgggc

SEQ ID NO: 1924227 - DNA, 13 bp, Homo sapiens
cctcctcctcctc

SEQ ID NO: 1924228 - DNA, 12 bp, Homo sapiens
cctcctctgtga

SEQ ID NO: 1924229 - DNA, 22 bp, Homo sapiens
cctcctctgtgaccaatgtctt

SEQ ID NO: 1924230 - DNA, 19 bp, Homo sapiens
cctcctgttcctgccttct

SEQ ID NO: 1924231 - DNA, 12 bp, Homo sapiens
cctccttctccc

SEQ ID NO: 1924232 - DNA, 20 bp, Homo sapiens
cctccttctcccctccagac

SEQ ID NO: 1924233 - DNA, 14 bp, Homo sapiens
cctccttgccgctg

SEQ ID NO: 1924234 - DNA, 19 bp, Homo sapiens
cctccttgccgctgggaga

SEQ ID NO: 1924235 - DNA, 20 bp, Homo sapiens
cctcgcatccgcctctgagc

SEQ ID NO: 1924236 - DNA, 19 bp, Homo sapiens
cctcgctgccagctctgta

SEQ ID NO: 1924237 - DNA, 18 bp, Homo sapiens
cctcggcagctccggaag

SEQ ID NO: 1924238 - DNA, 13 bp, Homo sapiens
cctctaattaaaa

SEQ ID NO: 1924239 - DNA, 24 bp, Homo sapiens
cctctacagagcttccctgactca

SEQ ID NO: 1924240 - DNA, 17 bp, Homo sapiens
catcccttggcccctct

SEQ ID NO: 1924241 - DNA, 18 bp, Homo sapiens
catcccttggcccctctc

SEQ ID NO: 1924242 - DNA, 17 bp, Homo sapiens
catccgcctctgagcca

SEQ ID NO: 1924243 - DNA, 19 bp, Homo sapiens
catccgcctctgagccagg

SEQ ID NO: 1924244 - DNA, 18 bp, Homo sapiens
catcctccacgttctgct

SEQ ID NO: 1924245 - DNA, 20 bp, Homo sapiens
catcctccacgttctgctca

SEQ ID NO: 1924246 - DNA, 16 bp, Homo sapiens
catctattcccaaaga

SEQ ID NO: 1924247 - DNA, 18 bp, Homo sapiens
catctattcccaaagaac

SEQ ID NO: 1924248 - DNA, 13 bp, Homo sapiens
catctcagcccac

SEQ ID NO: 1924249 - DNA, 22 bp, Homo sapiens
catctcccagataatgtgaaaa

SEQ ID NO: 1924250 - DNA, 19 bp, Homo sapiens
catctcctgccttcctcct

SEQ ID NO: 1924251 - DNA, 12 bp, Homo sapiens
catctgtaaata

SEQ ID NO: 1924252 - DNA, 14 bp, Homo sapiens
catctgtaaatatc

SEQ ID NO: 1924253 - DNA, 18 bp, Homo sapiens
catctgtccctccgggac

SEQ ID NO: 1924254 - DNA, 20 bp, Homo sapiens
catcttagtatttgcatatt

SEQ ID NO: 1924255 - DNA, 19 bp, Homo sapiens
catcttcttcaccatttgg

SEQ ID NO: 1924256 - DNA, 20 bp, Homo sapiens
catctttccaaattgatggg

SEQ ID NO: 1924257 - DNA, 12 bp, Homo sapiens
catgacaagtgg

SEQ ID NO: 1924258 - DNA, 22 bp, Homo sapiens
catgacatttctcaaagttttt

SEQ ID NO: 1924259 - DNA, 19 bp, Homo sapiens
catgcactgttccccctgt

SEQ ID NO: 1924260 - DNA, 13 bp, Homo sapiens
catgcccagcttg

SEQ ID NO: 1924261 - DNA, 18 bp, Homo sapiens
catgcgaatgagctgggc

SEQ ID NO: 1924262 - DNA, 20 bp, Homo sapiens
catggaggcacacagctgca

SEQ ID NO: 1924263 - DNA, 22 bp, Homo sapiens
catggccacttgggtcttccct

SEQ ID NO: 1924264 - DNA, 15 bp, Homo sapiens
catggcttgggctgg

SEQ ID NO: 1924265 - DNA, 14 bp, Homo sapiens
catgggaggctcac

SEQ ID NO: 1924266 - DNA, 21 bp, Homo sapiens
catggtgggtccatgggcaga

SEQ ID NO: 1924267 - DNA, 22 bp, Homo sapiens
catggtgggtccatgggcagag

SEQ ID NO: 1924268 - DNA, 15 bp, Homo sapiens
catgtaaactgtgca

SEQ ID NO: 1924269 - DNA, 20 bp, Homo sapiens
catgtacatgaagaagctaa

SEQ ID NO: 1924270 - DNA, 20 bp, Homo sapiens
catgtagaaaatttgttatt

SEQ ID NO: 1924271 - DNA, 23 bp, Homo sapiens
catgtagaagagggagaaggaga

SEQ ID NO: 1924272 - DNA, 23 bp, Homo sapiens
catgtgtgtccacgactgtctcc

SEQ ID NO: 1924273 - DNA, 15 bp, Homo sapiens
cattaacaggtcttt

SEQ ID NO: 1924274 - DNA, 18 bp, Homo sapiens
cattaacaggtctttgaa

SEQ ID NO: 1924275 - DNA, 14 bp, Homo sapiens
cattaatgaaatac

SEQ ID NO: 1924276 - DNA, 16 bp, Homo sapiens
cattaattcaattaaa

SEQ ID NO: 1924277 - DNA, 17 bp, Homo sapiens
cattaattcaattaaaa

SEQ ID NO: 1924278 - DNA, 21 bp, Homo sapiens
cattaattcaattaaaaccat

SEQ ID NO: 1924279 - DNA, 21 bp, Homo sapiens
cattactcaaaatgcaggaca

SEQ ID NO: 1924280 - DNA, 22 bp, Homo sapiens
cattattgaggaaaattaatat

SEQ ID NO: 1924281 - DNA, 21 bp, Homo sapiens
cattcaataagcatcaaactc

SEQ ID NO: 1924282 - DNA, 20 bp, Homo sapiens
cattcacaacacaatcaaaa

SEQ ID NO: 1924283 - DNA, 15 bp, Homo sapiens
cattccaactcctac

SEQ ID NO: 1924284 - DNA, 18 bp, Homo sapiens
cattcccatcactgctgt

SEQ ID NO: 1924285 - DNA, 21 bp, Homo sapiens
cattcctgggaaatattccct

SEQ ID NO: 1924286 - DNA, 14 bp, Homo sapiens
cattctacttcagc

SEQ ID NO: 1924287 - DNA, 16 bp, Homo sapiens
cattctcactcctacc

SEQ ID NO: 1924288 - DNA, 17 bp, Homo sapiens
cattctcactcctacct

SEQ ID NO: 1924289 - DNA, 23 bp, Homo sapiens
cattctctgtctcatccatcatc

SEQ ID NO: 1924290 - DNA, 21 bp, Homo sapiens
cattgaattcttggttgagga

SEQ ID NO: 1924291 - DNA, 22 bp, Homo sapiens
cattgaattcttggttgaggaa

SEQ ID NO: 1924292 - DNA, 18 bp, Homo sapiens
catttaaatacagtcttc

SEQ ID NO: 1924293 - DNA, 17 bp, Homo sapiens
catttagtttgattatt

SEQ ID NO: 1924294 - DNA, 23 bp, Homo sapiens
catttagtttgattattcagtgt

SEQ ID NO: 1924295 - DNA, 19 bp, Homo sapiens
catttcctcaggcaattcc

SEQ ID NO: 1924296 - DNA, 16 bp, Homo sapiens
catttctcaaagtttt

SEQ ID NO: 1924297 - DNA, 18 bp, Homo sapiens
catttctttatttctgtc

SEQ ID NO: 1924298 - DNA, 20 bp, Homo sapiens
catttggcaatgccatcatc

SEQ ID NO: 1924299 - DNA, 18 bp, Homo sapiens
catttgggagactgagct

SEQ ID NO: 1924300 - DNA, 20 bp, Homo sapiens
catttgtgtctgcctgcctc

SEQ ID NO: 1924301 - DNA, 22 bp, Homo sapiens
catttgtgtttcagaaaggagt

SEQ ID NO: 1924302 - DNA, 12 bp, Homo sapiens
cattttaataac

SEQ ID NO: 1924303 - DNA, 16 bp, Homo sapiens
cattttgcgatgtgtt

SEQ ID NO: 1924304 - DNA, 18 bp, Homo sapiens
cattttgcgatgtgtttt

SEQ ID NO: 1924305 - DNA, 19 bp, Homo sapiens
cattttgcgatgtgtttta

SEQ ID NO: 1924306 - DNA, 14 bp, Homo sapiens
cattttgtctggct

SEQ ID NO: 1924307 - DNA, 18 bp, Homo sapiens
cattttgtctggctgtgg

SEQ ID NO: 1924308 - DNA, 13 bp, Homo sapiens
cattttgtgcagt

SEQ ID NO: 1924309 - DNA, 18 bp, Homo sapiens
cattttgtgcagtgatta

SEQ ID NO: 1924310 - DNA, 14 bp, Homo sapiens
cattttttttcaag

SEQ ID NO: 1924311 - DNA, 13 bp, Homo sapiens
ccaaacacaggca

SEQ ID NO: 1924312 - DNA, 14 bp, Homo sapiens
ccaaatatgcactt

SEQ ID NO: 1924313 - DNA, 15 bp, Homo sapiens
ccaaatatgcacttt

SEQ ID NO: 1924314 - DNA, 15 bp, Homo sapiens
ccaaatcaaaatatg

SEQ ID NO: 1924315 - DNA, 14 bp, Homo sapiens
ccaaattgatgggt

SEQ ID NO: 1924316 - DNA, 18 bp, Homo sapiens
ccaaattgatgggtgggc

SEQ ID NO: 1924317 - DNA, 15 bp, Homo sapiens
ccaacgggtctgtgg

SEQ ID NO: 1924318 - DNA, 20 bp, Homo sapiens
ccaacgtggggcagcacaga

SEQ ID NO: 1924319 - DNA, 13 bp, Homo sapiens
ccaactcctaccg

SEQ ID NO: 1924320 - DNA, 18 bp, Homo sapiens
ccaactctggccttggtt

SEQ ID NO: 1924321 - DNA, 22 bp, Homo sapiens
ccaagccagggttccagacagg

SEQ ID NO: 1924322 - DNA, 23 bp, Homo sapiens
ccaagccagggttccagacaggg

SEQ ID NO: 1924323 - DNA, 16 bp, Homo sapiens
ccaagcctgggccact

SEQ ID NO: 1924324 - DNA, 18 bp, Homo sapiens
ccaaggaagaacaaatat

SEQ ID NO: 1924325 - DNA, 19 bp, Homo sapiens
ccaaggcctatgccacctg

SEQ ID NO: 1924326 - DNA, 21 bp, Homo sapiens
ccaaggtggtcttggagagga

SEQ ID NO: 1924327 - DNA, 22 bp, Homo sapiens
ccaaggtggtcttggagaggag

SEQ ID NO: 1924328 - DNA, 23 bp, Homo sapiens
ccaaggtggtcttggagaggagg

SEQ ID NO: 1924329 - DNA, 24 bp, Homo sapiens
ccaaggtggtcttggagaggaggt

SEQ ID NO: 1924330 - DNA, 22 bp, Homo sapiens
ccaatagttgttgattggcagg

SEQ ID NO: 1924331 - DNA, 13 bp, Homo sapiens
ccaatcactgcct

SEQ ID NO: 1924332 - DNA, 9 bp, Homo sapiens
ctccactcc

SEQ ID NO: 1924333 - DNA, 14 bp, Homo sapiens
ctccactcccctca

SEQ ID NO: 1924334 - DNA, 16 bp, Homo sapiens
ctccactcccctcatc

SEQ ID NO: 1924335 - DNA, 16 bp, Homo sapiens
ctccactcctcccaac

SEQ ID NO: 1924336 - DNA, 20 bp, Homo sapiens
ctccagacaaaccagaagca

SEQ ID NO: 1924337 - DNA, 9 bp, Homo sapiens
ctccagacc

SEQ ID NO: 1924338 - DNA, 13 bp, Homo sapiens
ctccatcagaagg

SEQ ID NO: 1924339 - DNA, 20 bp, Homo sapiens
ctccatcgctgtcatctcag

SEQ ID NO: 1924340 - DNA, 18 bp, Homo sapiens
ctccattcccatcactgc

SEQ ID NO: 1924341 - DNA, 23 bp, Homo sapiens
ctcccaaataaactccttaacca

SEQ ID NO: 1924342 - DNA, 15 bp, Homo sapiens
ctcccaactctggcc

SEQ ID NO: 1924343 - DNA, 20 bp, Homo sapiens
ctcccacaggcccttcctct

SEQ ID NO: 1924344 - DNA, 14 bp, Homo sapiens
ctcccaggcgcccc

SEQ ID NO: 1924345 - DNA, 21 bp, Homo sapiens
ctccccaggccgtggctgccc

SEQ ID NO: 1924346 - DNA, 15 bp, Homo sapiens
ctccccatggtgcag

SEQ ID NO: 1924347 - DNA, 15 bp, Homo sapiens
ctcccctaatgcctg

SEQ ID NO: 1924348 - DNA, 12 bp, Homo sapiens
ctcccctccaga

SEQ ID NO: 1924349 - DNA, 17 bp, Homo sapiens
ctcccctccagacccct

SEQ ID NO: 1924350 - DNA, 20 bp, Homo sapiens
ctcccctccagacccctacc

SEQ ID NO: 1924351 - DNA, 21 bp, Homo sapiens
ctcccctgccagggcagggcc

SEQ ID NO: 1924352 - DNA, 14 bp, Homo sapiens
ctcccgaatcctga

SEQ ID NO: 1924353 - DNA, 21 bp, Homo sapiens
ctccctacttagacccagtca

SEQ ID NO: 1924354 - DNA, 19 bp, Homo sapiens
ctccctccacacctccacc

SEQ ID NO: 1924355 - DNA, 15 bp, Homo sapiens
ctccctccactcctc

SEQ ID NO: 1924356 - DNA, 16 bp, Homo sapiens
ctccctccctccacac

SEQ ID NO: 1924357 - DNA, 13 bp, Homo sapiens
ctccctcctgtgt

SEQ ID NO: 1924358 - DNA, 14 bp, Homo sapiens
ctccctcgcatccg

SEQ ID NO: 1924359 - DNA, 20 bp, Homo sapiens
ctccctgaagtaagcaaaga

SEQ ID NO: 1924360 - DNA, 12 bp, Homo sapiens
ctccctgcagct

SEQ ID NO: 1924361 - DNA, 13 bp, Homo sapiens
ctccctgcagggt

SEQ ID NO: 1924362 - DNA, 13 bp, Homo sapiens
ctccctgcccctc

SEQ ID NO: 1924363 - DNA, 17 bp, Homo sapiens
ctccctgcccctccctt

SEQ ID NO: 1924364 - DNA, 14 bp, Homo sapiens
ctccctggccccag

SEQ ID NO: 1924365 - DNA, 22 bp, Homo sapiens
ctcccttcaaccattccccatg

SEQ ID NO: 1924366 - DNA, 23 bp, Homo sapiens
ctcccttcaaccattccccatgg

SEQ ID NO: 1924367 - DNA, 18 bp, Homo sapiens
ctcccttcaatcctgtca

SEQ ID NO: 1924368 - DNA, 13 bp, Homo sapiens
ctcccttgggctc

SEQ ID NO: 1924369 - DNA, 14 bp, Homo sapiens
ctccctttgaaatg

SEQ ID NO: 1924370 - DNA, 15 bp, Homo sapiens
ctccgtatttcagac

SEQ ID NO: 1924371 - DNA, 17 bp, Homo sapiens
ctcctaaagtagacttc

SEQ ID NO: 1924372 - DNA, 15 bp, Homo sapiens
ctcctacccctgtcc

SEQ ID NO: 1924373 - DNA, 13 bp, Homo sapiens
ctcctccagagcc

SEQ ID NO: 1924374 - DNA, 17 bp, Homo sapiens
ctcctcccaactctggc

SEQ ID NO: 1924375 - DNA, 19 bp, Homo sapiens
ctcctcccaactctggcct

SEQ ID NO: 1924376 - DNA, 22 bp, Homo sapiens
ctcctcccaggcgccccttccc

SEQ ID NO: 1924377 - DNA, 14 bp, Homo sapiens
ctcctcctcctcct

SEQ ID NO: 1924378 - DNA, 15 bp, Homo sapiens
ctcctcctcctcctg

SEQ ID NO: 1924379 - DNA, 16 bp, Homo sapiens
ctcctcctcctcctgt

SEQ ID NO: 1924380 - DNA, 13 bp, Homo sapiens
ctcctcctcctgt

SEQ ID NO: 1924381 - DNA, 12 bp, Homo sapiens
ctcctcctgttc

SEQ ID NO: 1924382 - DNA, 15 bp, Homo sapiens
ctcctcctgttcctg

SEQ ID NO: 1924383 - DNA, 20 bp, Homo sapiens
ctcctcctgttcctgccttc

SEQ ID NO: 1924384 - DNA, 12 bp, Homo sapiens
ctcctctccagc

SEQ ID NO: 1924385 - DNA, 15 bp, Homo sapiens
ctcctctccagccct

SEQ ID NO: 1924386 - DNA, 11 bp, Homo sapiens
ctcctctccca

SEQ ID NO: 1924387 - DNA, 19 bp, Homo sapiens
ctcctctctctccctccac

SEQ ID NO: 1924388 - DNA, 23 bp, Homo sapiens
cttacgaatacttttgccctttg

SEQ ID NO: 1924389 - DNA, 18 bp, Homo sapiens
cttaggtacttattccag

SEQ ID NO: 1924390 - DNA, 18 bp, Homo sapiens
cttaggttggagatgaca

SEQ ID NO: 1924391 - DNA, 17 bp, Homo sapiens
cttattagagtgtcttt

SEQ ID NO: 1924392 - DNA, 13 bp, Homo sapiens
cttatttctaaat

SEQ ID NO: 1924393 - DNA, 15 bp, Homo sapiens
cttatttttggactt

SEQ ID NO: 1924394 - DNA, 23 bp, Homo sapiens
cttcaaactagggccaagcccag

SEQ ID NO: 1924395 - DNA, 20 bp, Homo sapiens
cttcaaccattccccatggg

SEQ ID NO: 1924396 - DNA, 20 bp, Homo sapiens
cttcaatctacgatgttaaa

SEQ ID NO: 1924397 - DNA, 17 bp, Homo sapiens
cttcaccatttggcaat

SEQ ID NO: 1924398 - DNA, 20 bp, Homo sapiens
cttcagactctctcctctct

SEQ ID NO: 1924399 - DNA, 19 bp, Homo sapiens
cttcaggctcttctccttt

SEQ ID NO: 1924400 - DNA, 22 bp, Homo sapiens
cttcaggctcttctcctttcac

SEQ ID NO: 1924401 - DNA, 14 bp, Homo sapiens
cttcagggggccag

SEQ ID NO: 1924402 - DNA, 21 bp, Homo sapiens
cttcatggcagaaggcaaacc

SEQ ID NO: 1924403 - DNA, 17 bp, Homo sapiens
cttcatttttcctaaca

SEQ ID NO: 1924404 - DNA, 13 bp, Homo sapiens
cttccatcagcag

SEQ ID NO: 1924405 - DNA, 14 bp, Homo sapiens
cttccatcagcagt

SEQ ID NO: 1924406 - DNA, 13 bp, Homo sapiens
cttccatggtggt

SEQ ID NO: 1924407 - DNA, 20 bp, Homo sapiens
cttccatggtggtttcagaa

SEQ ID NO: 1924408 - DNA, 21 bp, Homo sapiens
cttccatggtggtttcagaaa

SEQ ID NO: 1924409 - DNA, 14 bp, Homo sapiens
cttccatttgcaag

SEQ ID NO: 1924410 - DNA, 13 bp, Homo sapiens
cttcccaccccta

SEQ ID NO: 1924411 - DNA, 20 bp, Homo sapiens
cttcccacggccactgcagt

SEQ ID NO: 1924412 - DNA, 15 bp, Homo sapiens
cttccccctccaatc

SEQ ID NO: 1924413 - DNA, 20 bp, Homo sapiens
cttcccccttcccctgcgcc

SEQ ID NO: 1924414 - DNA, 17 bp, Homo sapiens
cttcccctgcgccctcc

SEQ ID NO: 1924415 - DNA, 15 bp, Homo sapiens
cttcccgctcagccc

SEQ ID NO: 1924416 - DNA, 19 bp, Homo sapiens
cttccctagatggttccct

SEQ ID NO: 1924417 - DNA, 12 bp, Homo sapiens
cttccctctgct

SEQ ID NO: 1924418 - DNA, 14 bp, Homo sapiens
cttccctctgctcc

SEQ ID NO: 1924419 - DNA, 18 bp, Homo sapiens
cttccctctgctccacag

SEQ ID NO: 1924420 - DNA, 16 bp, Homo sapiens
cttcctccctccctgc

SEQ ID NO: 1924421 - DNA, 21 bp, Homo sapiens
cttcctccctccctgcagggt

SEQ ID NO: 1924422 - DNA, 15 bp, Homo sapiens
cttcctcctcctcct

SEQ ID NO: 1924423 - DNA, 12 bp, Homo sapiens
cttcctcctggg

SEQ ID NO: 1924424 - DNA, 14 bp, Homo sapiens
cttcctcctgggcc

SEQ ID NO: 1924425 - DNA, 22 bp, Homo sapiens
gaggcagcagtgtgaggccagg

SEQ ID NO: 1924426 - DNA, 16 bp, Homo sapiens
gaggcaggggctgggc

SEQ ID NO: 1924427 - DNA, 18 bp, Homo sapiens
gaggcaggggctgggcag

SEQ ID NO: 1924428 - DNA, 14 bp, Homo sapiens
gaggcagtggcagc

SEQ ID NO: 1924429 - DNA, 20 bp, Homo sapiens
gaggccacgggggaggccga

SEQ ID NO: 1924430 - DNA, 13 bp, Homo sapiens
gaggccagggcag

SEQ ID NO: 1924431 - DNA, 19 bp, Homo sapiens
gaggccgaggcaggggctg

SEQ ID NO: 1924432 - DNA, 16 bp, Homo sapiens
gaggcgtgggatccag

SEQ ID NO: 1924433 - DNA, 20 bp, Homo sapiens
gaggcgtgggatccagagag

SEQ ID NO: 1924434 - DNA, 22 bp, Homo sapiens
gaggcgtgggatccagagagaa

SEQ ID NO: 1924435 - DNA, 20 bp, Homo sapiens
gaggctttaagcgaggcaga

SEQ ID NO: 1924436 - DNA, 14 bp, Homo sapiens
gagggacgcctggg

SEQ ID NO: 1924437 - DNA, 16 bp, Homo sapiens
gagggacgcctggggg

SEQ ID NO: 1924438 - DNA, 23 bp, Homo sapiens
gagggacgcctgggggtgccagg

SEQ ID NO: 1924439 - DNA, 16 bp, Homo sapiens
gagggcaaaccaggct

SEQ ID NO: 1924440 - DNA, 15 bp, Homo sapiens
gagggcagcagggct

SEQ ID NO: 1924441 - DNA, 15 bp, Homo sapiens
gagggcgcctgggtc

SEQ ID NO: 1924442 - DNA, 20 bp, Homo sapiens
gaggggcctggcagccgtgc

SEQ ID NO: 1924443 - DNA, 22 bp, Homo sapiens
ctttgatattttcaacgcagcc

SEQ ID NO: 1924444 - DNA, 11 bp, Homo sapiens
ctttgattgag

SEQ ID NO: 1924445 - DNA, 16 bp, Homo sapiens
ctttgcagacctggga

SEQ ID NO: 1924446 - DNA, 16 bp, Homo sapiens
ctttgcgtggatcaag

SEQ ID NO: 1924447 - DNA, 23 bp, Homo sapiens
ctttggcaattcttcttctcaag

SEQ ID NO: 1924448 - DNA, 18 bp, Homo sapiens
ctttggcacaccctctct

SEQ ID NO: 1924449 - DNA, 20 bp, Homo sapiens
ctttggctcgggacttcaaa

SEQ ID NO: 1924450 - DNA, 14 bp, Homo sapiens
ctttgggctgccct

SEQ ID NO: 1924451 - DNA, 15 bp, Homo sapiens
ctttgggctgccctg

SEQ ID NO: 1924452 - DNA, 20 bp, Homo sapiens
ctttgggctgccctggtgct

SEQ ID NO: 1924453 - DNA, 21 bp, Homo sapiens
ctttgggctgccctggtgctg

SEQ ID NO: 1924454 - DNA, 21 bp, Homo sapiens
ctttgtaaggacttgtgcctc

SEQ ID NO: 1924455 - DNA, 23 bp, Homo sapiens
ctttgtatgatgaaaagaatgtg

SEQ ID NO: 1924456 - DNA, 15 bp, Homo sapiens
ctttgtccatttacc

SEQ ID NO: 1924457 - DNA, 19 bp, Homo sapiens
ctttgtgagtattctatgt

SEQ ID NO: 1924458 - DNA, 23 bp, Homo sapiens
ctttgtggatactattaaagtaa

SEQ ID NO: 1924459 - DNA, 12 bp, Homo sapiens
ctttgtgtgctg

SEQ ID NO: 1924460 - DNA, 23 bp, Homo sapiens
ctttgttttgcacactttgccat

SEQ ID NO: 1924461 - DNA, 23 bp, Homo sapiens
ctttgtttttttttcctgtcctt

SEQ ID NO: 1924462 - DNA, 21 bp, Homo sapiens
cttttagtggtggtgtctcac

SEQ ID NO: 1924463 - DNA, 22 bp, Homo sapiens
cttttattaacatatattgtta

SEQ ID NO: 1924464 - DNA, 13 bp, Homo sapiens
cttttcaaacaca

SEQ ID NO: 1924465 - DNA, 16 bp, Homo sapiens
cttttcactgctggct

SEQ ID NO: 1924466 - DNA, 18 bp, Homo sapiens
cttttcactgctggctgc

SEQ ID NO: 1924467 - DNA, 14 bp, Homo sapiens
cttttcccttgtgt

SEQ ID NO: 1924468 - DNA, 12 bp, Homo sapiens
cttttgcagctt

SEQ ID NO: 1924469 - DNA, 21 bp, Homo sapiens
cttttgcagcttccttccaag

SEQ ID NO: 1924470 - DNA, 17 bp, Homo sapiens
cttttgccattaaactt

SEQ ID NO: 1924471 - DNA, 15 bp, Homo sapiens
cttttgccctttgat

SEQ ID NO: 1924472 - DNA, 13 bp, Homo sapiens
cttttgtaaatat

SEQ ID NO: 1924473 - DNA, 14 bp, Homo sapiens
tgacagatgttcca

SEQ ID NO: 1924474 - DNA, 15 bp, Homo sapiens
tgacatatttttgct

SEQ ID NO: 1924475 - DNA, 13 bp, Homo sapiens
tgacatccaagct

SEQ ID NO: 1924476 - DNA, 21 bp, Homo sapiens
tgacatttatttttcatttag

SEQ ID NO: 1924477 - DNA, 16 bp, Homo sapiens
tgaccagactgtgggt

SEQ ID NO: 1924478 - DNA, 22 bp, Homo sapiens
tgacccggcccccgccctctgc

SEQ ID NO: 1924479 - DNA, 23 bp, Homo sapiens
tgacccggcccccgccctctgcc

SEQ ID NO: 1924480 - DNA, 18 bp, Homo sapiens
tgaccctgtgatgcctga

SEQ ID NO: 1924481 - DNA, 20 bp, Homo sapiens
tgaccctgtgatgcctgaca

SEQ ID NO: 1924482 - DNA, 18 bp, Homo sapiens
tgacgcgtggtcacagga

SEQ ID NO: 1924483 - DNA, 17 bp, Homo sapiens
tgactacagtcaggaaa

SEQ ID NO: 1924484 - DNA, 15 bp, Homo sapiens
tgactataacaaaat

SEQ ID NO: 1924485 - DNA, 19 bp, Homo sapiens
tgactataacaaaatctgg

SEQ ID NO: 1924486 - DNA, 20 bp, Homo sapiens
tgactcattctgaaggagcc

SEQ ID NO: 1924487 - DNA, 17 bp, Homo sapiens
tgactgtactcctccca

SEQ ID NO: 1924488 - DNA, 19 bp, Homo sapiens
tgacttcagactctctcct

SEQ ID NO: 1924489 - DNA, 14 bp, Homo sapiens
tgagaaggccccag

SEQ ID NO: 1924490 - DNA, 14 bp, Homo sapiens
tgagaattaaaata

SEQ ID NO: 1924491 - DNA, 18 bp, Homo sapiens
tgagaattaaaataaaac

SEQ ID NO: 1924492 - DNA, 20 bp, Homo sapiens
tgagaatttgagtgctctga

SEQ ID NO: 1924493 - DNA, 19 bp, Homo sapiens
tgagcaaggcaagaagtgg

SEQ ID NO: 1924494 - DNA, 20 bp, Homo sapiens
tgagcaaggcaagaagtggg

SEQ ID NO: 1924495 - DNA, 21 bp, Homo sapiens
tgagcaaggcaagaagtggga

SEQ ID NO: 1924496 - DNA, 21 bp, Homo sapiens
tgagcattgtggctgtcagca

SEQ ID NO: 1924497 - DNA, 18 bp, Homo sapiens
tgagccaccgcgagggcc

SEQ ID NO: 1924498 - DNA, 13 bp, Homo sapiens
tgagccaggagcc

SEQ ID NO: 1924499 - DNA, 20 bp, Homo sapiens
tgagcccctccctcctgtgt

SEQ ID NO: 1924500 - DNA, 15 bp, Homo sapiens
tgagccctgccctca

SEQ ID NO: 1924501 - DNA, 17 bp, Homo sapiens
tgagccctgccctcact

SEQ ID NO: 1924502 - DNA, 22 bp, Homo sapiens
tgagccctgccctcactccact

SEQ ID NO: 1924503 - DNA, 23 bp, Homo sapiens
tgagcgaggagatgctccttggg

SEQ ID NO: 1924504 - DNA, 18 bp, Homo sapiens
tgagcggccgcctgtcct

SEQ ID NO: 1924505 - DNA, 22 bp, Homo sapiens
tgagcttgattctaaaggggac

SEQ ID NO: 1924506 - DNA, 14 bp, Homo sapiens
tgaggacaggagag

SEQ ID NO: 1924507 - DNA, 17 bp, Homo sapiens
tgaggaccctcccaggt

SEQ ID NO: 1924508 - DNA, 19 bp, Homo sapiens
tgaggaggaggcagaacca

SEQ ID NO: 1924509 - DNA, 16 bp, Homo sapiens
tgaggccagggcagag

SEQ ID NO: 1924510 - DNA, 14 bp, Homo sapiens
tgagggagtgggga

SEQ ID NO: 1924511 - DNA, 21 bp, Homo sapiens
tgagggatggggagcagctgg

SEQ ID NO: 1924512 - DNA, 18 bp, Homo sapiens
tgaggggcttccctctgc

SEQ ID NO: 1924513 - DNA, 21 bp, Homo sapiens
tgaggtgggggtctggcctag

SEQ ID NO: 1924514 - DNA, 22 bp, Homo sapiens
tgagtattcattttgcaacttg

SEQ ID NO: 1924515 - DNA, 15 bp, Homo sapiens
tgagtattctatgta

SEQ ID NO: 1924516 - DNA, 12 bp, Homo sapiens
tgagtgctctga

SEQ ID NO: 1924517 - DNA, 13 bp, Homo sapiens
tgagtgctctgat

SEQ ID NO: 1924518 - DNA, 16 bp, Homo sapiens
tgagtgggccccctct

SEQ ID NO: 1924519 - DNA, 20 bp, Homo sapiens
tgatactgtctaagaataat

SEQ ID NO: 1924520 - DNA, 14 bp, Homo sapiens
tgatattggtgtga

SEQ ID NO: 1924521 - DNA, 17 bp, Homo sapiens
tgatattggtgtgaatg

SEQ ID NO: 1924522 - DNA, 21 bp, Homo sapiens
tgatattttcaacgcagccct

SEQ ID NO: 1924523 - DNA, 23 bp, Homo sapiens
tgatcagagccgtggtcctttgg

SEQ ID NO: 1924524 - DNA, 18 bp, Homo sapiens
tgatgaaatgtaaatact

SEQ ID NO: 1924525 - DNA, 23 bp, Homo sapiens
tgatgcatgcactgttccccctg

SEQ ID NO: 1924526 - DNA, 12 bp, Homo sapiens
tgatgggtgggc

SEQ ID NO: 1924527 - DNA, 22 bp, Homo sapiens
tgatgtaatcttgaattgtaac

SEQ ID NO: 1924528 - DNA, 17 bp, Homo sapiens
tgatgtaattaaaaaat

SEQ ID NO: 1924529 - DNA, 14 bp, Homo sapiens
tgatgtgtatgtgt

SEQ ID NO: 1924530 - DNA, 16 bp, Homo sapiens
tgattagtaaagaaat

SEQ ID NO: 1924531 - DNA, 21 bp, Homo sapiens
tgattcagtgttaaatgtgat

SEQ ID NO: 1924532 - DNA, 11 bp, Homo sapiens
tgattctcctc

SEQ ID NO: 1924533 - DNA, 15 bp, Homo sapiens
tgattctcctctccc

SEQ ID NO: 1924534 - DNA, 16 bp, Homo sapiens
tgattctcctctccca

SEQ ID NO: 1924535 - DNA, 12 bp, Homo sapiens
tgatttggaaaa

SEQ ID NO: 1924536 - DNA, 13 bp, Homo sapiens
tgcaaagaaaaga

SEQ ID NO: 1924537 - DNA, 13 bp, Homo sapiens
tgcaacagcctgt

SEQ ID NO: 1924538 - DNA, 20 bp, Homo sapiens
tgcaacaggttgaggctaaa

SEQ ID NO: 1924539 - DNA, 16 bp, Homo sapiens
tgcaactggtatatat

SEQ ID NO: 1924540 - DNA, 17 bp, Homo sapiens
tgcaactggtatatatt

SEQ ID NO: 1924541 - DNA, 16 bp, Homo sapiens
tgcaacttgtaaatgt

SEQ ID NO: 1924542 - DNA, 20 bp, Homo sapiens
tgcaactttagaaagaaatt

SEQ ID NO: 1924543 - DNA, 23 bp, Homo sapiens
tgcaagtccatagctgagctgga

SEQ ID NO: 1924544 - DNA, 15 bp, Homo sapiens
tgcaatttctcccga

SEQ ID NO: 1924545 - DNA, 19 bp, Homo sapiens
tgcacagtgcatctcagcc

SEQ ID NO: 1924546 - DNA, 15 bp, Homo sapiens
tgcacatctgtgtct

SEQ ID NO: 1924547 - DNA, 16 bp, Homo sapiens
tgcacatctgtgtctt

SEQ ID NO: 1924548 - DNA, 18 bp, Homo sapiens
tgcacatctgtgtcttgt

SEQ ID NO: 1924549 - DNA, 19 bp, Homo sapiens
tgcacatctgtgtcttgtt

SEQ ID NO: 1924550 - DNA, 20 bp, Homo sapiens
tgcaccctctgctatgtctg

SEQ ID NO: 1924551 - DNA, 24 bp, Homo sapiens
tgcaccctctgctatgtctgtgat

SEQ ID NO: 1924552 - DNA, 14 bp, Homo sapiens
tgcacctataaata

SEQ ID NO: 1924553 - DNA, 19 bp, Homo sapiens
tgcacgtagtagggtcagg

SEQ ID NO: 1924554 - DNA, 23 bp, Homo sapiens
tgcactgaatcgtttcatgtaag

SEQ ID NO: 1924555 - DNA, 20 bp, Homo sapiens
tgcactgttccccctgtgca

SEQ ID NO: 1924556 - DNA, 17 bp, Homo sapiens
tgcagaagaaactcctg

SEQ ID NO: 1924557 - DNA, 18 bp, Homo sapiens
tgcagaagaaactcctgg

SEQ ID NO: 1924558 - DNA, 15 bp, Homo sapiens
tgcagaccctgccag

SEQ ID NO: 1924559 - DNA, 14 bp, Homo sapiens
tgcagacctgggac

SEQ ID NO: 1924560 - DNA, 15 bp, Homo sapiens
tctacttcagctttg

SEQ ID NO: 1924561 - DNA, 13 bp, Homo sapiens
tctagaaggggcg

SEQ ID NO: 1924562 - DNA, 16 bp, Homo sapiens
tctagaaggggcgagg

SEQ ID NO: 1924563 - DNA, 20 bp, Homo sapiens
tctagacactgaaggcaaat

SEQ ID NO: 1924564 - DNA, 21 bp, Homo sapiens
tctagacagtattgccacctc

SEQ ID NO: 1924565 - DNA, 23 bp, Homo sapiens
tctaggttctaaaaattgtgatc

SEQ ID NO: 1924566 - DNA, 16 bp, Homo sapiens
tctatatatacaatga

SEQ ID NO: 1924567 - DNA, 16 bp, Homo sapiens
tctatatttgtaactt

SEQ ID NO: 1924568 - DNA, 13 bp, Homo sapiens
tctatgtaaatta

SEQ ID NO: 1924569 - DNA, 20 bp, Homo sapiens
tctatttctcctccatggga

SEQ ID NO: 1924570 - DNA, 20 bp, Homo sapiens
tctcaaagtttttacagtgt

SEQ ID NO: 1924571 - DNA, 14 bp, Homo sapiens
tctcaagcactgac

SEQ ID NO: 1924572 - DNA, 18 bp, Homo sapiens
tctcacaggttcacccag

SEQ ID NO: 1924573 - DNA, 18 bp, Homo sapiens
tctcacctacttcctcct

SEQ ID NO: 1924574 - DNA, 21 bp, Homo sapiens
tctcacctacttcctcctcct

SEQ ID NO: 1924575 - DNA, 22 bp, Homo sapiens
tctcacctgaattcgagacagg

SEQ ID NO: 1924576 - DNA, 21 bp, Homo sapiens
tctcagcctccggatgacaca

SEQ ID NO: 1924577 - DNA, 23 bp, Homo sapiens
tctcatccaggtcctttccttct

SEQ ID NO: 1924578 - DNA, 12 bp, Homo sapiens
tctccacccctc

SEQ ID NO: 1924579 - DNA, 17 bp, Homo sapiens
tctccacccctcaagcc

SEQ ID NO: 1924580 - DNA, 20 bp, Homo sapiens
tctccacccctcaagccagg

SEQ ID NO: 1924581 - DNA, 13 bp, Homo sapiens
tctccatccacat

SEQ ID NO: 1924582 - DNA, 19 bp, Homo sapiens
tctccatccacatgggagc

SEQ ID NO: 1924583 - DNA, 14 bp, Homo sapiens
tctccatggccctg

SEQ ID NO: 1924584 - DNA, 18 bp, Homo sapiens
tctccatggccctgcaaa

SEQ ID NO: 1924585 - DNA, 21 bp, Homo sapiens
tctcccaaataaactccttaa

SEQ ID NO: 1924586 - DNA, 23 bp, Homo sapiens
tctcccaaataaactccttaacc

SEQ ID NO: 1924587 - DNA, 12 bp, Homo sapiens
tctcccctccag

SEQ ID NO: 1924588 - DNA, 12 bp, Homo sapiens
tctccctccact

SEQ ID NO: 1924589 - DNA, 15 bp, Homo sapiens
tctcctctctctccc

SEQ ID NO: 1924590 - DNA, 17 bp, Homo sapiens
tctcctgccttcctcct

SEQ ID NO: 1924591 - DNA, 16 bp, Homo sapiens
tctcctttcacaacct

SEQ ID NO: 1924592 - DNA, 14 bp, Homo sapiens
tctcctttgtccat

SEQ ID NO: 1924593 - DNA, 15 bp, Homo sapiens
tctcctttgtccatt

SEQ ID NO: 1924594 - DNA, 22 bp, Homo sapiens
tctcgaagtcttccatcagcag

SEQ ID NO: 1924595 - DNA, 13 bp, Homo sapiens
tctctccatcaga

SEQ ID NO: 1924596 - DNA, 15 bp, Homo sapiens
tctctccatcagaag

SEQ ID NO: 1924597 - DNA, 18 bp, Homo sapiens
tctctcccacacaagcag

SEQ ID NO: 1924598 - DNA, 21 bp, Homo sapiens
tctctcccacacaagcagtct

SEQ ID NO: 1924599 - DNA, 17 bp, Homo sapiens
tctctcctctctctccc

SEQ ID NO: 1924600 - DNA, 11 bp, Homo sapiens
tctctctcacc

SEQ ID NO: 1924601 - DNA, 15 bp, Homo sapiens
tctctctccctccac

SEQ ID NO: 1924602 - DNA, 14 bp, Homo sapiens
tctctgagcagtga

SEQ ID NO: 1924603 - DNA, 21 bp, Homo sapiens
tctctgctctgcgtgtcacct

SEQ ID NO: 1924604 - DNA, 23 bp, Homo sapiens
tctctgctctgcgtgtcacctgt

SEQ ID NO: 1924605 - DNA, 14 bp, Homo sapiens
tctctgtccaatct

SEQ ID NO: 1924606 - DNA, 14 bp, Homo sapiens
tctcttaccccgtc

SEQ ID NO: 1924607 - DNA, 21 bp, Homo sapiens
tctcttaccccgtccctttcc

SEQ ID NO: 1924608 - DNA, 17 bp, Homo sapiens
tctcttctatcctgcaa

SEQ ID NO: 1924609 - DNA, 13 bp, Homo sapiens
tctcttctccact

SEQ ID NO: 1924610 - DNA, 14 bp, Homo sapiens
tctcttctccactg

SEQ ID NO: 1924611 - DNA, 22 bp, Homo sapiens
tctctttgtaaggacttgtgcc

SEQ ID NO: 1924612 - DNA, 20 bp, Homo sapiens
tctcttttcaaacacacaca

SEQ ID NO: 1924613 - DNA, 18 bp, Homo sapiens
tctctttttgctttcgaa

SEQ ID NO: 1924614 - DNA, 16 bp, Homo sapiens
tctgaaggagaggagt

SEQ ID NO: 1924615 - DNA, 20 bp, Homo sapiens
tctgaaggagccccattcct

SEQ ID NO: 1924616 - DNA, 18 bp, Homo sapiens
tctgaagtcactgcacag

SEQ ID NO: 1924617 - DNA, 14 bp, Homo sapiens
tctgactcagggct

SEQ ID NO: 1924618 - DNA, 19 bp, Homo sapiens
tctgagcagtgaatgattc

SEQ ID NO: 1924619 - DNA, 17 bp, Homo sapiens
tctgagccctgccctca

SEQ ID NO: 1924620 - DNA, 18 bp, Homo sapiens
tctgagccctgccctcac

SEQ ID NO: 1924621 - DNA, 22 bp, Homo sapiens
tctgagccctgccctcactcca

SEQ ID NO: 1924622 - DNA, 21 bp, Homo sapiens
tctgagcggccgcctgtcctt

SEQ ID NO: 1924623 - DNA, 23 bp, Homo sapiens
tctgatgcaagcaagaaacactg

SEQ ID NO: 1924624 - DNA, 23 bp, Homo sapiens
tctgcaggccacccccacctccc

SEQ ID NO: 1924625 - DNA, 21 bp, Homo sapiens
tctgcagtcctcggcagctcc

SEQ ID NO: 1924626 - DNA, 17 bp, Homo sapiens
tctgccgtgagagccca

SEQ ID NO: 1924627 - DNA, 15 bp, Homo sapiens
tctgcctcttctggg

SEQ ID NO: 1924628 - DNA, 13 bp, Homo sapiens
tctgcgccgctgt

SEQ ID NO: 1924629 - DNA, 15 bp, Homo sapiens
tctgcgccgctgtgc

SEQ ID NO: 1924630 - DNA, 15 bp, Homo sapiens
tctgcgtgtcacctg

SEQ ID NO: 1924631 - DNA, 20 bp, Homo sapiens
tctgcgtgtcacctgtgctt

SEQ ID NO: 1924632 - DNA, 13 bp, Homo sapiens
tctgctatgtctg

SEQ ID NO: 1924633 - DNA, 17 bp, Homo sapiens
tctgctatgtctgtgat

SEQ ID NO: 1924634 - DNA, 12 bp, Homo sapiens
tctgctcatcat

SEQ ID NO: 1924635 - DNA, 22 bp, Homo sapiens
tctgctcatcattctctgtctc

SEQ ID NO: 1924636 - DNA, 16 bp, Homo sapiens
tctgctctgcgtgtca

SEQ ID NO: 1924637 - DNA, 19 bp, Homo sapiens
tctgctgacagatgttcca

SEQ ID NO: 1924638 - DNA, 20 bp, Homo sapiens
tctggacttatttttggact

SEQ ID NO: 1924639 - DNA, 13 bp, Homo sapiens
tctggagccccta

SEQ ID NO: 1924640 - DNA, 21 bp, Homo sapiens
tctggagtctcacttgtctca

SEQ ID NO: 1924641 - DNA, 15 bp, Homo sapiens
tctggagtctgaagg

SEQ ID NO: 1924642 - DNA, 20 bp, Homo sapiens
tctggagtctgaaggagagg

SEQ ID NO: 1924643 - DNA, 15 bp, Homo sapiens
tctggagtgtgtggg

SEQ ID NO: 1924644 - DNA, 23 bp, Homo sapiens
tctggcaagagactactctgcct

SEQ ID NO: 1924645 - DNA, 19 bp, Homo sapiens
tctggccttggttcctcca

SEQ ID NO: 1924646 - DNA, 21 bp, Homo sapiens
tctggccttggttcctccagc

SEQ ID NO: 1924647 - DNA, 21 bp, Homo sapiens
tctggctacgacttgggacgg

SEQ ID NO: 1924648 - DNA, 12 bp, Homo sapiens
tctggctgccaa

SEQ ID NO: 1924649 - DNA, 17 bp, Homo sapiens
tctgggacttgaaatca

SEQ ID NO: 1924650 - DNA, 21 bp, Homo sapiens
tctgggagggcagcagggcta

SEQ ID NO: 1924651 - DNA, 18 bp, Homo sapiens
tctgggataagtaagttt

SEQ ID NO: 1924652 - DNA, 23 bp, Homo sapiens
tctggtcagtgaagcccaggagg

SEQ ID NO: 1924653 - DNA, 15 bp, Homo sapiens
tctgtaaatatccca

SEQ ID NO: 1924654 - DNA, 14 bp, Homo sapiens
tctgtaacccttga

SEQ ID NO: 1924655 - DNA, 23 bp, Homo sapiens
tctgtaattggcttttgaatcaa

SEQ ID NO: 1924656 - DNA, 20 bp, Homo sapiens
tctgtatcaggacccagagg

SEQ ID NO: 1924657 - DNA, 20 bp, Homo sapiens
tctgtatgggtcattctcac

SEQ ID NO: 1924658 - DNA, 17 bp, Homo sapiens
tctgtctcataattgtc

SEQ ID NO: 1924659 - DNA, 17 bp, Homo sapiens
tctgtctgagccctgcc

SEQ ID NO: 1924660 - DNA, 20 bp, Homo sapiens
tctgtctgagccctgccctc

SEQ ID NO: 1924661 - DNA, 19 bp, Homo sapiens
tctgtgaccaatgtcttga

SEQ ID NO: 1924662 - DNA, 18 bp, Homo sapiens
tctgtgcatttgtgtctg

SEQ ID NO: 1924663 - DNA, 22 bp, Homo sapiens
tctgtgcatttgtgtctgcctg

SEQ ID NO: 1924664 - DNA, 23 bp, Homo sapiens
tctgtgcatttgtgtctgcctgc

SEQ ID NO: 1924665 - DNA, 13 bp, Homo sapiens
tctgtgcctcagt

SEQ ID NO: 1924666 - DNA, 14 bp, Homo sapiens
tctgtgcctcagtg

SEQ ID NO: 1924667 - DNA, 13 bp, Homo sapiens
tctgtgggactgg

SEQ ID NO: 1924668 - DNA, 12 bp, Homo sapiens
tctgtgtcttgt

SEQ ID NO: 1924669 - DNA, 23 bp, Homo sapiens
tctgtttaccctccctgtcccct

SEQ ID NO: 1924670 - DNA, 17 bp, Homo sapiens
tcttaacaaaagtgaac

SEQ ID NO: 1924671 - DNA, 22 bp, Homo sapiens
tcttaagagaatccacataaaa

SEQ ID NO: 1924672 - DNA, 19 bp, Homo sapiens
tcttaatataactgcctta

SEQ ID NO: 1924673 - DNA, 23 bp, Homo sapiens
tcttacccacactacgcagaaga

SEQ ID NO: 1924674 - DNA, 15 bp, Homo sapiens
tcttacccacttccc

SEQ ID NO: 1924675 - DNA, 20 bp, Homo sapiens
tcttacccacttccctgcaa

SEQ ID NO: 1924676 - DNA, 22 bp, Homo sapiens
tcttaccccgtccctttccctg

SEQ ID NO: 1924677 - DNA, 19 bp, Homo sapiens
tcttagggtacagcccagg

SEQ ID NO: 1924678 - DNA, 18 bp, Homo sapiens
tcttatttaaattttcag

SEQ ID NO: 1924679 - DNA, 17 bp, Homo sapiens
tcttcaccatttggcaa

SEQ ID NO: 1924680 - DNA, 13 bp, Homo sapiens
tcttccatcagca

SEQ ID NO: 1924681 - DNA, 14 bp, Homo sapiens
tcttccatcagcag

SEQ ID NO: 1924682 - DNA, 13 bp, Homo sapiens
tcttccatttgca

SEQ ID NO: 1924683 - DNA, 19 bp, Homo sapiens
tcttcccaaggccagtctg

SEQ ID NO: 1924684 - DNA, 21 bp, Homo sapiens
tcttcctccctccctgcaggg

SEQ ID NO: 1924685 - DNA, 15 bp, Homo sapiens
tcttcctctctctca

SEQ ID NO: 1924686 - DNA, 17 bp, Homo sapiens
tcttcctgcctctctca

SEQ ID NO: 1924687 - DNA, 18 bp, Homo sapiens
tcttcctggacagtgaga

SEQ ID NO: 1924688 - DNA, 23 bp, Homo sapiens
tcttcctggacagtgagagcagg

SEQ ID NO: 1924689 - DNA, 13 bp, Homo sapiens
tcttctccactgg

SEQ ID NO: 1924690 - DNA, 20 bp, Homo sapiens
tcttctgggagggcagcagg

SEQ ID NO: 1924691 - DNA, 23 bp, Homo sapiens
tcttctgggagggcagcagggct

SEQ ID NO: 1924692 - DNA, 16 bp, Homo sapiens
tcttgactacagtcag

SEQ ID NO: 1924693 - DNA, 17 bp, Homo sapiens
tcttgggggcagaccag

SEQ ID NO: 1924694 - DNA, 20 bp, Homo sapiens
tcttgggggtggggctgcat

SEQ ID NO: 1924695 - DNA, 13 bp, Homo sapiens
tcttggttgagga

SEQ ID NO: 1924696 - DNA, 16 bp, Homo sapiens
tcccatcccagctgaa

SEQ ID NO: 1924697 - DNA, 17 bp, Homo sapiens
tcccatttgtgtttcag

SEQ ID NO: 1924698 - DNA, 18 bp, Homo sapiens
tcccattttagatgttta

SEQ ID NO: 1924699 - DNA, 13 bp, Homo sapiens
tccccaaggaaga

SEQ ID NO: 1924700 - DNA, 12 bp, Homo sapiens
tccccactcccg

SEQ ID NO: 1924701 - DNA, 23 bp, Homo sapiens
tccccaggagagaccttctctta

SEQ ID NO: 1924702 - DNA, 14 bp, Homo sapiens
tccccctccttgcc

SEQ ID NO: 1924703 - DNA, 12 bp, Homo sapiens
tccccctctgtc

SEQ ID NO: 1924704 - DNA, 15 bp, Homo sapiens
tcccccttcccctgc

SEQ ID NO: 1924705 - DNA, 13 bp, Homo sapiens
tcccctaatgcct

SEQ ID NO: 1924706 - DNA, 16 bp, Homo sapiens
tcccctccaaggtatg

SEQ ID NO: 1924707 - DNA, 14 bp, Homo sapiens
tcccctccagaccc

SEQ ID NO: 1924708 - DNA, 21 bp, Homo sapiens
tcccctccagacccctaccct

SEQ ID NO: 1924709 - DNA, 17 bp, Homo sapiens
tcccctgcgccctccct

SEQ ID NO: 1924710 - DNA, 15 bp, Homo sapiens
tcccctgttcactct

SEQ ID NO: 1924711 - DNA, 17 bp, Homo sapiens
tccccttccactgaggg

SEQ ID NO: 1924712 - DNA, 18 bp, Homo sapiens
tccccttccactgagggc

SEQ ID NO: 1924713 - DNA, 18 bp, Homo sapiens
tcccgagggcgcctgggt

SEQ ID NO: 1924714 - DNA, 20 bp, Homo sapiens
tcccgctcagccctccctgc

SEQ ID NO: 1924715 - DNA, 16 bp, Homo sapiens
tcccggataggctaat

SEQ ID NO: 1924716 - DNA, 12 bp, Homo sapiens
tcccgggcactg

SEQ ID NO: 1924717 - DNA, 20 bp, Homo sapiens
tcccgtgtcgtaacagcagg

SEQ ID NO: 1924718 - DNA, 19 bp, Homo sapiens
tccctaccgagtctcttct

SEQ ID NO: 1924719 - DNA, 21 bp, Homo sapiens
tccctaccgagtctcttctcc

SEQ ID NO: 1924720 - DNA, 22 bp, Homo sapiens
tccctaccgagtctcttctcca

SEQ ID NO: 1924721 - DNA, 20 bp, Homo sapiens
tccctacttagacccagtca

SEQ ID NO: 1924722 - DNA, 19 bp, Homo sapiens
tccctagaaacttccaaat

SEQ ID NO: 1924723 - DNA, 22 bp, Homo sapiens
tccctagaaagccatattccag

SEQ ID NO: 1924724 - DNA, 21 bp, Homo sapiens
tccctagatggttccctttgt

SEQ ID NO: 1924725 - DNA, 20 bp, Homo sapiens
tccctccacacctccacccg

SEQ ID NO: 1924726 - DNA, 13 bp, Homo sapiens
tccctccactcct

SEQ ID NO: 1924727 - DNA, 13 bp, Homo sapiens
tccctccctccac

SEQ ID NO: 1924728 - DNA, 13 bp, Homo sapiens
tccctccctgcag

SEQ ID NO: 1924729 - DNA, 15 bp, Homo sapiens
tccctccctgcaggg

SEQ ID NO: 1924730 - DNA, 14 bp, Homo sapiens
tccctccgggacct

SEQ ID NO: 1924731 - DNA, 23 bp, Homo sapiens
tccctcgcatccgcctctgagcc

SEQ ID NO: 1924732 - DNA, 22 bp, Homo sapiens
tccctctacagagcttccctga

SEQ ID NO: 1924733 - DNA, 13 bp, Homo sapiens
tccctctttcctg

SEQ ID NO: 1924734 - DNA, 14 bp, Homo sapiens
tccctctttcctgt

SEQ ID NO: 1924735 - DNA, 16 bp, Homo sapiens
tccctctttcctgtgc

SEQ ID NO: 1924736 - DNA, 17 bp, Homo sapiens
tccctctttcctgtgcc

SEQ ID NO: 1924737 - DNA, 16 bp, Homo sapiens
tccctgactcattctg

SEQ ID NO: 1924738 - DNA, 19 bp, Homo sapiens
tccctgactcattctgaag

SEQ ID NO: 1924739 - DNA, 22 bp, Homo sapiens
tccctgactcattctgaaggag

SEQ ID NO: 1924740 - DNA, 15 bp, Homo sapiens
tccctgactgggagt

SEQ ID NO: 1924741 - DNA, 18 bp, Homo sapiens
tccctgcccctcccttca

SEQ ID NO: 1924742 - DNA, 19 bp, Homo sapiens
tccctgcccctcccttcaa

SEQ ID NO: 1924743 - DNA, 11 bp, Homo sapiens
tccctggagac

SEQ ID NO: 1924744 - DNA, 12 bp, Homo sapiens
tccctggcccca

SEQ ID NO: 1924745 - DNA, 15 bp, Homo sapiens
tccctggccccagtg

SEQ ID NO: 1924746 - DNA, 11 bp, Homo sapiens
tccctgtcccc

SEQ ID NO: 1924747 - DNA, 15 bp, Homo sapiens
tcccttaaacaaaaa

SEQ ID NO: 1924748 - DNA, 11 bp, Homo sapiens
tcccttcaacc

SEQ ID NO: 1924749 - DNA, 21 bp, Homo sapiens
tcccttcaaccattccccatg

SEQ ID NO: 1924750 - DNA, 17 bp, Homo sapiens
tcccttggcccctctct

SEQ ID NO: 1924751 - DNA, 12 bp, Homo sapiens
tcccttgggctc

SEQ ID NO: 1924752 - DNA, 21 bp, Homo sapiens
tccctttcatgatttgcaact

SEQ ID NO: 1924753 - DNA, 20 bp, Homo sapiens
tccctttccctgcatccctt

SEQ ID NO: 1924754 - DNA, 15 bp, Homo sapiens
tccctttgttgctgt

SEQ ID NO: 1924755 - DNA, 15 bp, Homo sapiens
tccggaatcctgtcc

SEQ ID NO: 1924756 - DNA, 22 bp, Homo sapiens
tccgtctaagtcatgagctgag

SEQ ID NO: 1924757 - DNA, 17 bp, Homo sapiens
tccgtctcctctccagc

SEQ ID NO: 1924758 - DNA, 15 bp, Homo sapiens
tcctacccctgtcct

SEQ ID NO: 1924759 - DNA, 16 bp, Homo sapiens
tcctacccctgtcctg

SEQ ID NO: 1924760 - DNA, 20 bp, Homo sapiens
tcctacccctgtcctggggc

SEQ ID NO: 1924761 - DNA, 19 bp, Homo sapiens
tcctaggcatctgctgtaa

SEQ ID NO: 1924762 - DNA, 12 bp, Homo sapiens
tcctcaatccag

SEQ ID NO: 1924763 - DNA, 21 bp, Homo sapiens
tcctcattcttctctcccaca

SEQ ID NO: 1924764 - DNA, 19 bp, Homo sapiens
tcctccacgttctgctcat

SEQ ID NO: 1924765 - DNA, 21 bp, Homo sapiens
tcctccacgttctgctcatca

SEQ ID NO: 1924766 - DNA, 19 bp, Homo sapiens
tcctcccaactctggcctt

SEQ ID NO: 1924767 - DNA, 22 bp, Homo sapiens
tcctcccaactctggccttggt

SEQ ID NO: 1924768 - DNA, 21 bp, Homo sapiens
tcctcccaggcgccccttccc

SEQ ID NO: 1924769 - DNA, 18 bp, Homo sapiens
tcctccctccctgcaggg

SEQ ID NO: 1924770 - DNA, 14 bp, Homo sapiens
tcctcctcctcctc

SEQ ID NO: 1924771 - DNA, 12 bp, Homo sapiens
tcctcctctgtg

SEQ ID NO: 1924772 - DNA, 20 bp, Homo sapiens
tcctcctgggccctctctgc

SEQ ID NO: 1924773 - DNA, 22 bp, Homo sapiens
tcctcctgggccctctctgctc

SEQ ID NO: 1924774 - DNA, 15 bp, Homo sapiens
tcctcctgttcctgc

SEQ ID NO: 1924775 - DNA, 14 bp, Homo sapiens
tcctctaattaaaa

SEQ ID NO: 1924776 - DNA, 17 bp, Homo sapiens
tcctctactaacaatca

SEQ ID NO: 1924777 - DNA, 13 bp, Homo sapiens
tcctctccactgc

SEQ ID NO: 1924778 - DNA, 15 bp, Homo sapiens
tcctctccactgcct

SEQ ID NO: 1924779 - DNA, 21 bp, Homo sapiens
tcctctcggctggaagaacat

SEQ ID NO: 1924780 - DNA, 21 bp, Homo sapiens
tcctctctctcacctacttcc

SEQ ID NO: 1924781 - DNA, 15 bp, Homo sapiens
tcctctctctccctc

SEQ ID NO: 1924782 - DNA, 15 bp, Homo sapiens
tcctctgactcaggg

SEQ ID NO: 1924783 - DNA, 19 bp, Homo sapiens
tcctctgtgaccaatgtct

SEQ ID NO: 1924784 - DNA, 14 bp, Homo sapiens
tcctgaatcccttt

SEQ ID NO: 1924785 - DNA, 18 bp, Homo sapiens
tcctgaatccctttcagt

SEQ ID NO: 1924786 - DNA, 19 bp, Homo sapiens
tcctgagaaaaaaggttcc

SEQ ID NO: 1924787 - DNA, 24 bp, Homo sapiens
tcctgagaaaaaaggttccgcttg

SEQ ID NO: 1924788 - DNA, 16 bp, Homo sapiens
tcctgcaatttctccc

SEQ ID NO: 1924789 - DNA, 13 bp, Homo sapiens
tcctgcaccctct

SEQ ID NO: 1924790 - DNA, 16 bp, Homo sapiens
tcctgcaccctctgct

SEQ ID NO: 1924791 - DNA, 21 bp, Homo sapiens
tcctgcaccctctgctatgtc

SEQ ID NO: 1924792 - DNA, 14 bp, Homo sapiens
tcctgcccactctg

SEQ ID NO: 1924793 - DNA, 22 bp, Homo sapiens
tcctgcccactctgaccgggct

SEQ ID NO: 1924794 - DNA, 16 bp, Homo sapiens
tcctgccttcctcctg

SEQ ID NO: 1924795 - DNA, 15 bp, Homo sapiens
tcctgccttctcttc

SEQ ID NO: 1924796 - DNA, 19 bp, Homo sapiens
tcctggacagtgagagcag

SEQ ID NO: 1924797 - DNA, 22 bp, Homo sapiens
tcctggacagtgagagcagggc

SEQ ID NO: 1924798 - DNA, 18 bp, Homo sapiens
tcctggcccgggagccgc

SEQ ID NO: 1924799 - DNA, 16 bp, Homo sapiens
tcctgggccctctctg

SEQ ID NO: 1924800 - DNA, 17 bp, Homo sapiens
tcctgggccctctctgc

SEQ ID NO: 1924801 - DNA, 18 bp, Homo sapiens
tcctggggtggttggagg

SEQ ID NO: 1924802 - DNA, 19 bp, Homo sapiens
tcctggggtggttggaggc

SEQ ID NO: 1924803 - DNA, 22 bp, Homo sapiens
tcctggggtggttggaggcctg

SEQ ID NO: 1924804 - DNA, 17 bp, Homo sapiens
tcctgggttttgtattc

SEQ ID NO: 1924805 - DNA, 20 bp, Homo sapiens
tcctgggttttgtattctct

SEQ ID NO: 1924806 - DNA, 18 bp, Homo sapiens
tcctgtcaatgtttgctt

SEQ ID NO: 1924807 - DNA, 16 bp, Homo sapiens
tcctgttcctgccttc

SEQ ID NO: 1924808 - DNA, 14 bp, Homo sapiens
tccttaggcttaca

SEQ ID NO: 1924809 - DNA, 24 bp, Homo sapiens
tccttaggcttacaatgtgcactg

SEQ ID NO: 1924810 - DNA, 14 bp, Homo sapiens
tccttctcgtcttc

SEQ ID NO: 1924811 - DNA, 23 bp, Homo sapiens
tccttctcgtcttcctctctctc

SEQ ID NO: 1924812 - DNA, 20 bp, Homo sapiens
tccttgccgctgggagagcc

SEQ ID NO: 1924813 - DNA, 14 bp, Homo sapiens
tccttgggcccttt

SEQ ID NO: 1924814 - DNA, 21 bp, Homo sapiens
tccttggtggccgggggtggg

SEQ ID NO: 1924815 - DNA, 20 bp, Homo sapiens
tcctttcacaaccttctgtg

SEQ ID NO: 1924816 - DNA, 13 bp, Homo sapiens
tcctttccttctc

SEQ ID NO: 1924817 - DNA, 16 bp, Homo sapiens
tcctttttaaatgaga

SEQ ID NO: 1924818 - DNA, 14 bp, Homo sapiens
tcgccgtggctgcg

SEQ ID NO: 1924819 - DNA, 23 bp, Homo sapiens
tcgcctttcccaggtgctacacc

SEQ ID NO: 1924820 - DNA, 19 bp, Homo sapiens
tcgctgccagctctgtatc

SEQ ID NO: 1924821 - DNA, 13 bp, Homo sapiens
tcggaatggtaac

SEQ ID NO: 1924822 - DNA, 13 bp, Homo sapiens
tcgggacttcaaa

SEQ ID NO: 1924823 - DNA, 13 bp, Homo sapiens
tcgggcccttccc

SEQ ID NO: 1924824 - DNA, 12 bp, Homo sapiens
tcgtcttcctct

SEQ ID NO: 1924825 - DNA, 18 bp, Homo sapiens
tcgtcttcctctctctca

SEQ ID NO: 1924826 - DNA, 18 bp, Homo sapiens
tcgttcccttgtgtctgt

SEQ ID NO: 1924827 - DNA, 18 bp, Homo sapiens
tctaacctcatcttcttc

SEQ ID NO: 1924828 - DNA, 20 bp, Homo sapiens
tctaacctcatcttcttcac

SEQ ID NO: 1924829 - DNA, 20 bp, Homo sapiens
tctaagagaacaatgtgcta

SEQ ID NO: 1924830 - DNA, 22 bp, Homo sapiens
tctaatgcattaacttttgtaa

SEQ ID NO: 1924831 - DNA, 16 bp, Homo sapiens
tctaattctcttttca

SEQ ID NO: 1924832 - DNA, 23 bp, Homo sapiens
tctacagctaatcagcattctca

SEQ ID NO: 1924833 - DNA, 13 bp, Homo sapiens
tcagaatctttaa

SEQ ID NO: 1924834 - DNA, 15 bp, Homo sapiens
tcagaccataatgtt

SEQ ID NO: 1924835 - DNA, 16 bp, Homo sapiens
tcagacgcctgaggaa

SEQ ID NO: 1924836 - DNA, 17 bp, Homo sapiens
tcagactctctcctctc

SEQ ID NO: 1924837 - DNA, 13 bp, Homo sapiens
tcagagcccagga

SEQ ID NO: 1924838 - DNA, 16 bp, Homo sapiens
tcagagccgtggtcct

SEQ ID NO: 1924839 - DNA, 20 bp, Homo sapiens
tcagagccgtggtcctttgg

SEQ ID NO: 1924840 - DNA, 18 bp, Homo sapiens
tcagaggccctcgctgcc

SEQ ID NO: 1924841 - DNA, 19 bp, Homo sapiens
tcagcaacatgatacctgg

SEQ ID NO: 1924842 - DNA, 17 bp, Homo sapiens
tcagcaggaagcaacga

SEQ ID NO: 1924843 - DNA, 20 bp, Homo sapiens
tcagcccgctggagcatgag

SEQ ID NO: 1924844 - DNA, 13 bp, Homo sapiens
tcagccctccctg

SEQ ID NO: 1924845 - DNA, 15 bp, Homo sapiens
tcagccctccctgcc

SEQ ID NO: 1924846 - DNA, 15 bp, Homo sapiens
tcagctccttcctgg

SEQ ID NO: 1924847 - DNA, 17 bp, Homo sapiens
tcagctccttcctggag

SEQ ID NO: 1924848 - DNA, 16 bp, Homo sapiens
tcaggaaggatgagca

SEQ ID NO: 1924849 - DNA, 18 bp, Homo sapiens
tcaggaaggatgagcatt

SEQ ID NO: 1924850 - DNA, 21 bp, Homo sapiens
tcaggaatgggccaagccagg

SEQ ID NO: 1924851 - DNA, 12 bp, Homo sapiens
tcaggacagctg

SEQ ID NO: 1924852 - DNA, 13 bp, Homo sapiens
tcaggacagctgc

SEQ ID NO: 1924853 - DNA, 20 bp, Homo sapiens
tcaggaccaaagctttcatg

SEQ ID NO: 1924854 - DNA, 21 bp, Homo sapiens
tcaggagaaggcctgcccccc

SEQ ID NO: 1924855 - DNA, 22 bp, Homo sapiens
tcaggagaaggcctgcccccct

SEQ ID NO: 1924856 - DNA, 18 bp, Homo sapiens
tcaggaggtactgtgagg

SEQ ID NO: 1924857 - DNA, 14 bp, Homo sapiens
tcaggccacggcag

SEQ ID NO: 1924858 - DNA, 16 bp, Homo sapiens
tcaggccacggcagcc

SEQ ID NO: 1924859 - DNA, 15 bp, Homo sapiens
tcaggctcttctcct

SEQ ID NO: 1924860 - DNA, 21 bp, Homo sapiens
tcaggctcttctcctttcaca

SEQ ID NO: 1924861 - DNA, 13 bp, Homo sapiens
tcaggctgcccag

SEQ ID NO: 1924862 - DNA, 14 bp, Homo sapiens
tcaggctgcccagc

SEQ ID NO: 1924863 - DNA, 21 bp, Homo sapiens
tcaggctgcccagcggctctt

SEQ ID NO: 1924864 - DNA, 15 bp, Homo sapiens
tcaggtcagggtgag

SEQ ID NO: 1924865 - DNA, 13 bp, Homo sapiens
tcaggttccaaat

SEQ ID NO: 1924866 - DNA, 18 bp, Homo sapiens
tcagtagtgcctgtgatc

SEQ ID NO: 1924867 - DNA, 22 bp, Homo sapiens
tcagtcaagttccgtctcctct

SEQ ID NO: 1924868 - DNA, 23 bp, Homo sapiens
tcagtcaagttccgtctcctctc

SEQ ID NO: 1924869 - DNA, 13 bp, Homo sapiens
tcagtcagctccg

SEQ ID NO: 1924870 - DNA, 23 bp, Homo sapiens
tcagtgaagcccaggaggacctg

SEQ ID NO: 1924871 - DNA, 14 bp, Homo sapiens
tcagtgatgggagt

SEQ ID NO: 1924872 - DNA, 12 bp, Homo sapiens
tcagtgctccct

SEQ ID NO: 1924873 - DNA, 23 bp, Homo sapiens
tcagtgtcaaatatatttaacta

SEQ ID NO: 1924874 - DNA, 19 bp, Homo sapiens
tcagtgtgccaccctctgc

SEQ ID NO: 1924875 - DNA, 23 bp, Homo sapiens
tcagtgtgccaccctctgcaggg

SEQ ID NO: 1924876 - DNA, 22 bp, Homo sapiens
tcagttcaatcaaactttcagc

SEQ ID NO: 1924877 - DNA, 18 bp, Homo sapiens
tcagtttgtccacacaag

SEQ ID NO: 1924878 - DNA, 16 bp, Homo sapiens
tcagttttatcatttt

SEQ ID NO: 1924879 - DNA, 13 bp, Homo sapiens
tcataattgtcaa

SEQ ID NO: 1924880 - DNA, 21 bp, Homo sapiens
tcataattgtcaaaaaccaga

SEQ ID NO: 1924881 - DNA, 15 bp, Homo sapiens
tcataccaatgaaaa

SEQ ID NO: 1924882 - DNA, 17 bp, Homo sapiens
tcatagtttctgtaatt

SEQ ID NO: 1924883 - DNA, 22 bp, Homo sapiens
tcatagtttctgtaattggctt

SEQ ID NO: 1924884 - DNA, 17 bp, Homo sapiens
tcatcaattctctatca

SEQ ID NO: 1924885 - DNA, 19 bp, Homo sapiens
tcatcattctctgtctcat

SEQ ID NO: 1924886 - DNA, 20 bp, Homo sapiens
tcatcattctctgtctcatc

SEQ ID NO: 1924887 - DNA, 15 bp, Homo sapiens
tcatccacagaggcc

SEQ ID NO: 1924888 - DNA, 21 bp, Homo sapiens
tcatccactaggtgcccagtc

SEQ ID NO: 1924889 - DNA, 11 bp, Homo sapiens
tcatccatcat

SEQ ID NO: 1924890 - DNA, 14 bp, Homo sapiens
tcatccatcatcat

SEQ ID NO: 1924891 - DNA, 17 bp, Homo sapiens
tcatccatcatcatgtg

SEQ ID NO: 1924892 - DNA, 18 bp, Homo sapiens
tcatctcctgccttcctc

SEQ ID NO: 1924893 - DNA, 21 bp, Homo sapiens
tcatctcctgccttcctcctg

SEQ ID NO: 1924894 - DNA, 13 bp, Homo sapiens
tcatctttccaaa

SEQ ID NO: 1924895 - DNA, 15 bp, Homo sapiens
tcatgacatttctca

SEQ ID NO: 1924896 - DNA, 16 bp, Homo sapiens
tcatgacatttctcaa

SEQ ID NO: 1924897 - DNA, 16 bp, Homo sapiens
tcatgagctgagcagg

SEQ ID NO: 1924898 - DNA, 21 bp, Homo sapiens
tcatgcccagcttggagtgcc

SEQ ID NO: 1924899 - DNA, 15 bp, Homo sapiens
tcatgcttataagca

SEQ ID NO: 1924900 - DNA, 12 bp, Homo sapiens
tcatgtgtgtcc

SEQ ID NO: 1924901 - DNA, 14 bp, Homo sapiens
tcattctctgtctc

SEQ ID NO: 1924902 - DNA, 16 bp, Homo sapiens
tcattctctgtctcat

SEQ ID NO: 1924903 - DNA, 18 bp, Homo sapiens
tcattctctgtctcatcc

SEQ ID NO: 1924904 - DNA, 22 bp, Homo sapiens
tcattttggtaaaatacttctt

SEQ ID NO: 1924905 - DNA, 14 bp, Homo sapiens
tcatttttgaatac

SEQ ID NO: 1924906 - DNA, 18 bp, Homo sapiens
tccaaattgatgggtggg

SEQ ID NO: 1924907 - DNA, 17 bp, Homo sapiens
tccaacgtggggcagca

SEQ ID NO: 1924908 - DNA, 20 bp, Homo sapiens
tccaagcctgggccactggc

SEQ ID NO: 1924909 - DNA, 21 bp, Homo sapiens
tccaagcctgggccactggca

SEQ ID NO: 1924910 - DNA, 17 bp, Homo sapiens
tccaatgtgcccagtca

SEQ ID NO: 1924911 - DNA, 12 bp, Homo sapiens
tccacaaaataa

SEQ ID NO: 1924912 - DNA, 20 bp, Homo sapiens
tccacaaaataaccaatcct

SEQ ID NO: 1924913 - DNA, 16 bp, Homo sapiens
tccacacctccacccg

SEQ ID NO: 1924914 - DNA, 19 bp, Homo sapiens
tccacacctccacccgtcc

SEQ ID NO: 1924915 - DNA, 13 bp, Homo sapiens
tccacatcctcca

SEQ ID NO: 1924916 - DNA, 15 bp, Homo sapiens
tccacatgggagccg

SEQ ID NO: 1924917 - DNA, 12 bp, Homo sapiens
tccacattctac

SEQ ID NO: 1924918 - DNA, 14 bp, Homo sapiens
tccacattctactt

SEQ ID NO: 1924919 - DNA, 15 bp, Homo sapiens
tccacattctacttc

SEQ ID NO: 1924920 - DNA, 21 bp, Homo sapiens
tccacctttatgttttaatat

SEQ ID NO: 1924921 - DNA, 14 bp, Homo sapiens
tccacgactgtctc

SEQ ID NO: 1924922 - DNA, 15 bp, Homo sapiens
tccacgactgtctcc

SEQ ID NO: 1924923 - DNA, 18 bp, Homo sapiens
tccacgactgtctccatg

SEQ ID NO: 1924924 - DNA, 19 bp, Homo sapiens
tccacgactgtctccatgg

SEQ ID NO: 1924925 - DNA, 22 bp, Homo sapiens
tccacgagctgtttactaggga

SEQ ID NO: 1924926 - DNA, 14 bp, Homo sapiens
tccacggagccact

SEQ ID NO: 1924927 - DNA, 21 bp, Homo sapiens
tccacggagccactcctctga

SEQ ID NO: 1924928 - DNA, 20 bp, Homo sapiens
tccacgttctgctcatcatt

SEQ ID NO: 1924929 - DNA, 14 bp, Homo sapiens
tccactaccctccc

SEQ ID NO: 1924930 - DNA, 9 bp, Homo sapiens
tccactcct

SEQ ID NO: 1924931 - DNA, 23 bp, Homo sapiens
tccactcctcccaactctggcct

SEQ ID NO: 1924932 - DNA, 22 bp, Homo sapiens
tccactgccttcgatacaccgg

SEQ ID NO: 1924933 - DNA, 19 bp, Homo sapiens
tccagaactaccaaaatga

SEQ ID NO: 1924934 - DNA, 20 bp, Homo sapiens
tccagacagagtggatctgg

SEQ ID NO: 1924935 - DNA, 18 bp, Homo sapiens
tccagacagggtggggct

SEQ ID NO: 1924936 - DNA, 13 bp, Homo sapiens
tccagacccctgg

SEQ ID NO: 1924937 - DNA, 16 bp, Homo sapiens
tccagacccctggctt

SEQ ID NO: 1924938 - DNA, 20 bp, Homo sapiens
tccagagagaagcaccccac

SEQ ID NO: 1924939 - DNA, 19 bp, Homo sapiens
tccagagagtggctcctcc

SEQ ID NO: 1924940 - DNA, 15 bp, Homo sapiens
tccagagcctgggcg

SEQ ID NO: 1924941 - DNA, 15 bp, Homo sapiens
tccagcagtgaaact

SEQ ID NO: 1924942 - DNA, 20 bp, Homo sapiens
tccagcagtgaaacttgtgc

SEQ ID NO: 1924943 - DNA, 17 bp, Homo sapiens
tccagccacccagccag

SEQ ID NO: 1924944 - DNA, 23 bp, Homo sapiens
tccaggcttgggctccattccca

SEQ ID NO: 1924945 - DNA, 18 bp, Homo sapiens
tccaggtcctttccttct

SEQ ID NO: 1924946 - DNA, 12 bp, Homo sapiens
tccatcagcagt

SEQ ID NO: 1924947 - DNA, 16 bp, Homo sapiens
tccatcagcagtgatt

SEQ ID NO: 1924948 - DNA, 15 bp, Homo sapiens
tccatccacatggga

SEQ ID NO: 1924949 - DNA, 16 bp, Homo sapiens
tccatcctgtacaagt

SEQ ID NO: 1924950 - DNA, 17 bp, Homo sapiens
tccatcctgtacaagtg

SEQ ID NO: 1924951 - DNA, 23 bp, Homo sapiens
tccatcctgtacaagtgctcagt

SEQ ID NO: 1924952 - DNA, 17 bp, Homo sapiens
tccatgaaaaacagcag

SEQ ID NO: 1924953 - DNA, 23 bp, Homo sapiens
tccatgcagataacagctggttg

SEQ ID NO: 1924954 - DNA, 13 bp, Homo sapiens
tccatggtggttt

SEQ ID NO: 1924955 - DNA, 19 bp, Homo sapiens
tccattcccatcactgctg

SEQ ID NO: 1924956 - DNA, 14 bp, Homo sapiens
tcccaaacccttcg

SEQ ID NO: 1924957 - DNA, 14 bp, Homo sapiens
tcccaactctggcc

SEQ ID NO: 1924958 - DNA, 15 bp, Homo sapiens
tcccaactctggcct

SEQ ID NO: 1924959 - DNA, 15 bp, Homo sapiens
tcccaattcacatct

SEQ ID NO: 1924960 - DNA, 18 bp, Homo sapiens
tcccacaggacatttctc

SEQ ID NO: 1924961 - DNA, 22 bp, Homo sapiens
tcccacaggcccttcctctcca

SEQ ID NO: 1924962 - DNA, 15 bp, Homo sapiens
tcccacggccactgc

SEQ ID NO: 1924963 - DNA, 16 bp, Homo sapiens
tcccacggccactgca

SEQ ID NO: 1924964 - DNA, 15 bp, Homo sapiens
tcccagcccctggta

SEQ ID NO: 1924965 - DNA, 22 bp, Homo sapiens
tcccagcccctggtactccccc

SEQ ID NO: 1924966 - DNA, 23 bp, Homo sapiens
tcccagcccctggtactccccca

SEQ ID NO: 1924967 - DNA, 21 bp, Homo sapiens
tcccaggcgccccttccccct

SEQ ID NO: 1924968 - DNA, 12 bp, Homo sapiens
tcccatcactgc

SEQ ID NO: 1924969 - DNA, 22 bp, Homo sapiens
tcccatcactgctgtccctcct

SEQ ID NO: 1924970 - DNA, 18 bp, Homo sapiens
tatattacttttgtaaat

SEQ ID NO: 1924971 - DNA, 23 bp, Homo sapiens
tatattaggcctgtgtgtaagct

SEQ ID NO: 1924972 - DNA, 14 bp, Homo sapiens
tatattataagatt

SEQ ID NO: 1924973 - DNA, 20 bp, Homo sapiens
tatatttgaattagtaactg

SEQ ID NO: 1924974 - DNA, 14 bp, Homo sapiens
tatatttgtaactt

SEQ ID NO: 1924975 - DNA, 23 bp, Homo sapiens
tatcaccgtgggctccctgactg

SEQ ID NO: 1924976 - DNA, 14 bp, Homo sapiens
tatcattttctgca

SEQ ID NO: 1924977 - DNA, 18 bp, Homo sapiens
tatccaggtaatccaaga

SEQ ID NO: 1924978 - DNA, 21 bp, Homo sapiens
tatccaggtaatccaagatat

SEQ ID NO: 1924979 - DNA, 18 bp, Homo sapiens
tatcctaggcatctgctg

SEQ ID NO: 1924980 - DNA, 13 bp, Homo sapiens
tatcctgcaccct

SEQ ID NO: 1924981 - DNA, 15 bp, Homo sapiens
tatcctgcaccctct

SEQ ID NO: 1924982 - DNA, 16 bp, Homo sapiens
tatcctgcaccctctg

SEQ ID NO: 1924983 - DNA, 13 bp, Homo sapiens
tatctcattgcaa

SEQ ID NO: 1924984 - DNA, 15 bp, Homo sapiens
tatctcgaagtcttc

SEQ ID NO: 1924985 - DNA, 23 bp, Homo sapiens
tatctgtaacccttgaatttcta

SEQ ID NO: 1924986 - DNA, 12 bp, Homo sapiens
tatctgtctgag

SEQ ID NO: 1924987 - DNA, 19 bp, Homo sapiens
tatctgtctgagccctgcc

SEQ ID NO: 1924988 - DNA, 22 bp, Homo sapiens
tatctgtctgagccctgccctc

SEQ ID NO: 1924989 - DNA, 23 bp, Homo sapiens
tatctgtgcaatggaatataaat

SEQ ID NO: 1924990 - DNA, 14 bp, Homo sapiens
tatgaggatgcaga

SEQ ID NO: 1924991 - DNA, 15 bp, Homo sapiens
tatgatttggaaaat

SEQ ID NO: 1924992 - DNA, 17 bp, Homo sapiens
tatgatttggaaaataa

SEQ ID NO: 1924993 - DNA, 22 bp, Homo sapiens
tatgcacttataattttcctaa

SEQ ID NO: 1924994 - DNA, 11 bp, Homo sapiens
tatgcactttc

SEQ ID NO: 1924995 - DNA, 20 bp, Homo sapiens
tatgcactttccctagaaag

SEQ ID NO: 1924996 - DNA, 14 bp, Homo sapiens
tatgtaaattataa

SEQ ID NO: 1924997 - DNA, 18 bp, Homo sapiens
tatgtaaattattgtaaa

SEQ ID NO: 1924998 - DNA, 20 bp, Homo sapiens
tatgtaaattattgtaaact

SEQ ID NO: 1924999 - DNA, 15 bp, Homo sapiens
tatgtcattgtgttt

SEQ ID NO: 1925000 - DNA, 15 bp, Homo sapiens
tatgttgatgaaaaa

SEQ ID NO: 1925001 - DNA, 14 bp, Homo sapiens
tattaaatcagaat

SEQ ID NO: 1925002 - DNA, 21 bp, Homo sapiens
tattaaatcggcaacagggct

SEQ ID NO: 1925003 - DNA, 16 bp, Homo sapiens
tattacttttgtaaat

SEQ ID NO: 1925004 - DNA, 17 bp, Homo sapiens
tattagcattttcaaga

SEQ ID NO: 1925005 - DNA, 15 bp, Homo sapiens
tattcagtgtcactg

SEQ ID NO: 1925006 - DNA, 22 bp, Homo sapiens
tattccctgaattgtttgatat

SEQ ID NO: 1925007 - DNA, 23 bp, Homo sapiens
tattccctgaattgtttgatatt

SEQ ID NO: 1925008 - DNA, 18 bp, Homo sapiens
tattctctgagctgtgca

SEQ ID NO: 1925009 - DNA, 17 bp, Homo sapiens
tattctgcaacagcctg

SEQ ID NO: 1925010 - DNA, 19 bp, Homo sapiens
tattctgcaacagcctgtt

SEQ ID NO: 1925011 - DNA, 19 bp, Homo sapiens
tattcttaagcactttgaa

SEQ ID NO: 1925012 - DNA, 14 bp, Homo sapiens
tattcttcataaca

SEQ ID NO: 1925013 - DNA, 18 bp, Homo sapiens
tattgaggaaaattaata

SEQ ID NO: 1925014 - DNA, 16 bp, Homo sapiens
tattgtaaactttttc

SEQ ID NO: 1925015 - DNA, 20 bp, Homo sapiens
tattgtaaactttttcaatg

SEQ ID NO: 1925016 - DNA, 21 bp, Homo sapiens
tattgtaaactttttcaatgg

SEQ ID NO: 1925017 - DNA, 15 bp, Homo sapiens
tattgtccattgtcc

SEQ ID NO: 1925018 - DNA, 17 bp, Homo sapiens
tattgtgaaatttgtta

SEQ ID NO: 1925019 - DNA, 21 bp, Homo sapiens
tatttaaaatagttccagata

SEQ ID NO: 1925020 - DNA, 18 bp, Homo sapiens
tatttaaattttcagaaa

SEQ ID NO: 1925021 - DNA, 17 bp, Homo sapiens
tatttaagataattata

SEQ ID NO: 1925022 - DNA, 20 bp, Homo sapiens
tatttaagataattataata

SEQ ID NO: 1925023 - DNA, 23 bp, Homo sapiens
tatttatatatgtatttataaat

SEQ ID NO: 1925024 - DNA, 14 bp, Homo sapiens
tatttatctgtctg

SEQ ID NO: 1925025 - DNA, 14 bp, Homo sapiens
tatttctatgtaaa

SEQ ID NO: 1925026 - DNA, 17 bp, Homo sapiens
tatttctatgtaaatta

SEQ ID NO: 1925027 - DNA, 22 bp, Homo sapiens
tatttctatgtaaattattgta

SEQ ID NO: 1925028 - DNA, 21 bp, Homo sapiens
tatttctcccttcaatcctgt

SEQ ID NO: 1925029 - DNA, 17 bp, Homo sapiens
tatttgtaactttgcat

SEQ ID NO: 1925030 - DNA, 14 bp, Homo sapiens
tattttcaccattt

SEQ ID NO: 1925031 - DNA, 17 bp, Homo sapiens
tatttttttgttgctgt

SEQ ID NO: 1925032 - DNA, 17 bp, Homo sapiens
tcaaaagattaacaaca

SEQ ID NO: 1925033 - DNA, 17 bp, Homo sapiens
tcaaactactgtacatt

SEQ ID NO: 1925034 - DNA, 19 bp, Homo sapiens
tcaaactactgtacatttt

SEQ ID NO: 1925035 - DNA, 18 bp, Homo sapiens
tcaaagaacccccctccc

SEQ ID NO: 1925036 - DNA, 23 bp, Homo sapiens
tcaaagccagcgtcctcctctgt

SEQ ID NO: 1925037 - DNA, 18 bp, Homo sapiens
tcaaagtttttacagtgt

SEQ ID NO: 1925038 - DNA, 22 bp, Homo sapiens
tcaaagtttttacagtgtatct

SEQ ID NO: 1925039 - DNA, 14 bp, Homo sapiens
tcaaatatatttaa

SEQ ID NO: 1925040 - DNA, 15 bp, Homo sapiens
tcaacaaaaattgtc

SEQ ID NO: 1925041 - DNA, 13 bp, Homo sapiens
tcaacctgcctga

SEQ ID NO: 1925042 - DNA, 17 bp, Homo sapiens
tcaacctgggcaaagcc

SEQ ID NO: 1925043 - DNA, 23 bp, Homo sapiens
tcaagaagaagatggattggtgt

SEQ ID NO: 1925044 - DNA, 15 bp, Homo sapiens
tcaagatacctttgc

SEQ ID NO: 1925045 - DNA, 21 bp, Homo sapiens
tcaagatacctttgcgtggat

SEQ ID NO: 1925046 - DNA, 15 bp, Homo sapiens
tcaagccaggagacc

SEQ ID NO: 1925047 - DNA, 15 bp, Homo sapiens
tcaagccccctttga

SEQ ID NO: 1925048 - DNA, 21 bp, Homo sapiens
tcaagttcatagtttctgtaa

SEQ ID NO: 1925049 - DNA, 18 bp, Homo sapiens
tcaagttccgtctcctct

SEQ ID NO: 1925050 - DNA, 20 bp, Homo sapiens
tcaataagcatcaaactctt

SEQ ID NO: 1925051 - DNA, 19 bp, Homo sapiens
tcaataattgtggagagga

SEQ ID NO: 1925052 - DNA, 20 bp, Homo sapiens
tcaataattgtggagaggag

SEQ ID NO: 1925053 - DNA, 16 bp, Homo sapiens
tcaatacccttggcac

SEQ ID NO: 1925054 - DNA, 14 bp, Homo sapiens
tcaatcaaactttc

SEQ ID NO: 1925055 - DNA, 15 bp, Homo sapiens
tcaatccagctatgt

SEQ ID NO: 1925056 - DNA, 13 bp, Homo sapiens
tcaatcctgtcaa

SEQ ID NO: 1925057 - DNA, 17 bp, Homo sapiens
tcaatgctataactatg

SEQ ID NO: 1925058 - DNA, 14 bp, Homo sapiens
tcaattaaaaccat

SEQ ID NO: 1925059 - DNA, 20 bp, Homo sapiens
tcaattctgatacagcctta

SEQ ID NO: 1925060 - DNA, 22 bp, Homo sapiens
tcaattgcatctcccagataat

SEQ ID NO: 1925061 - DNA, 22 bp, Homo sapiens
tcacacgtctggcttcacagat

SEQ ID NO: 1925062 - DNA, 19 bp, Homo sapiens
tcacactgctgggaagtgg

SEQ ID NO: 1925063 - DNA, 16 bp, Homo sapiens
tcacagaggcagtggc

SEQ ID NO: 1925064 - DNA, 20 bp, Homo sapiens
tcacagaggcagtggcagca

SEQ ID NO: 1925065 - DNA, 21 bp, Homo sapiens
tcacagatgtgtgattcacag

SEQ ID NO: 1925066 - DNA, 16 bp, Homo sapiens
tcacattccctctcat

SEQ ID NO: 1925067 - DNA, 19 bp, Homo sapiens
tcacattccctctcatcca

SEQ ID NO: 1925068 - DNA, 23 bp, Homo sapiens
tcacatttaatatcctgcctttt

SEQ ID NO: 1925069 - DNA, 15 bp, Homo sapiens
tcaccatctttctaa

SEQ ID NO: 1925070 - DNA, 17 bp, Homo sapiens
tcaccatttgattatgt

SEQ ID NO: 1925071 - DNA, 13 bp, Homo sapiens
tcacccccttctc

SEQ ID NO: 1925072 - DNA, 12 bp, Homo sapiens
tcacccctccac

SEQ ID NO: 1925073 - DNA, 13 bp, Homo sapiens
tcacccctgtctg

SEQ ID NO: 1925074 - DNA, 16 bp, Homo sapiens
tcaccgccgtggggtg

SEQ ID NO: 1925075 - DNA, 13 bp, Homo sapiens
tcaccgtgggctc

SEQ ID NO: 1925076 - DNA, 16 bp, Homo sapiens
tcaccgtgggctccct

SEQ ID NO: 1925077 - DNA, 18 bp, Homo sapiens
tcaccgtgggctccctga

SEQ ID NO: 1925078 - DNA, 15 bp, Homo sapiens
tcacctacttcctcc

SEQ ID NO: 1925079 - DNA, 17 bp, Homo sapiens
tcacctacttcctcctc

SEQ ID NO: 1925080 - DNA, 18 bp, Homo sapiens
tcacctacttcctcctcc

SEQ ID NO: 1925081 - DNA, 19 bp, Homo sapiens
tcacctacttcctcctcct

SEQ ID NO: 1925082 - DNA, 14 bp, Homo sapiens
tcacctgtgcttcg

SEQ ID NO: 1925083 - DNA, 16 bp, Homo sapiens
tcacggacaggaagca

SEQ ID NO: 1925084 - DNA, 19 bp, Homo sapiens
tcacggacaggaagcacag

SEQ ID NO: 1925085 - DNA, 13 bp, Homo sapiens
tcactatgtccat

SEQ ID NO: 1925086 - DNA, 12 bp, Homo sapiens
tcactattctta

SEQ ID NO: 1925087 - DNA, 18 bp, Homo sapiens
tcactattcttaagcact

SEQ ID NO: 1925088 - DNA, 18 bp, Homo sapiens
tcactccactcccctcat

SEQ ID NO: 1925089 - DNA, 20 bp, Homo sapiens
tcactccactcccctcatcc

SEQ ID NO: 1925090 - DNA, 23 bp, Homo sapiens
tcactcggctttggctcgggact

SEQ ID NO: 1925091 - DNA, 21 bp, Homo sapiens
tcactgaagtgaatacatggt

SEQ ID NO: 1925092 - DNA, 23 bp, Homo sapiens
tcactgaatgcttctgacttcat

SEQ ID NO: 1925093 - DNA, 20 bp, Homo sapiens
tcactgagaaggccccaggg

SEQ ID NO: 1925094 - DNA, 15 bp, Homo sapiens
tcactgcacagtgca

SEQ ID NO: 1925095 - DNA, 20 bp, Homo sapiens
tcactgcacagtgcatctca

SEQ ID NO: 1925096 - DNA, 11 bp, Homo sapiens
tcactgcccac

SEQ ID NO: 1925097 - DNA, 17 bp, Homo sapiens
tcactgcctatacccct

SEQ ID NO: 1925098 - DNA, 13 bp, Homo sapiens
tcactgctggctg

SEQ ID NO: 1925099 - DNA, 14 bp, Homo sapiens
tcactgctggctgc

SEQ ID NO: 1925100 - DNA, 16 bp, Homo sapiens
tcactgctggctgcct

SEQ ID NO: 1925101 - DNA, 17 bp, Homo sapiens
tcactgctgtccctcct

SEQ ID NO: 1925102 - DNA, 21 bp, Homo sapiens
tcactgctgtccctcctgagg

SEQ ID NO: 1925103 - DNA, 16 bp, Homo sapiens
tcacttaacctgcttt

SEQ ID NO: 1925104 - DNA, 19 bp, Homo sapiens
tcagaaagggcagcccctc

SEQ ID NO: 1925105 - DNA, 23 bp, Homo sapiens
tcagaataaatgggtaacactga

SEQ ID NO: 1925106 - DNA, 15 bp, Homo sapiens
taatatttaaaatag

SEQ ID NO: 1925107 - DNA, 19 bp, Homo sapiens
taatccgaatctctttttg

SEQ ID NO: 1925108 - DNA, 16 bp, Homo sapiens
taatgaagaaagtgga

SEQ ID NO: 1925109 - DNA, 17 bp, Homo sapiens
taatgaagaaagtggaa

SEQ ID NO: 1925110 - DNA, 16 bp, Homo sapiens
taatgacgtattgtga

SEQ ID NO: 1925111 - DNA, 19 bp, Homo sapiens
taatgatactgtctaagaa

SEQ ID NO: 1925112 - DNA, 18 bp, Homo sapiens
taatgttgttatttaaag

SEQ ID NO: 1925113 - DNA, 22 bp, Homo sapiens
taattagagcagatgacccctc

SEQ ID NO: 1925114 - DNA, 12 bp, Homo sapiens
taattattattc

SEQ ID NO: 1925115 - DNA, 12 bp, Homo sapiens
taattattattt

SEQ ID NO: 1925116 - DNA, 17 bp, Homo sapiens
taattattatttatata

SEQ ID NO: 1925117 - DNA, 20 bp, Homo sapiens
taattctcttttcaaacaca

SEQ ID NO: 1925118 - DNA, 23 bp, Homo sapiens
taattctcttttcaaacacacac

SEQ ID NO: 1925119 - DNA, 18 bp, Homo sapiens
taattgttatacattttt

SEQ ID NO: 1925120 - DNA, 22 bp, Homo sapiens
taattgttatacatttttaatt

SEQ ID NO: 1925121 - DNA, 17 bp, Homo sapiens
taattttcctaataaag

SEQ ID NO: 1925122 - DNA, 16 bp, Homo sapiens
tacaaattgcttgaaa

SEQ ID NO: 1925123 - DNA, 20 bp, Homo sapiens
tacaatgagtaaaatcacag

SEQ ID NO: 1925124 - DNA, 22 bp, Homo sapiens
tacaatggctgggtttgggcag

SEQ ID NO: 1925125 - DNA, 19 bp, Homo sapiens
tacaatttctttaaatcat

SEQ ID NO: 1925126 - DNA, 18 bp, Homo sapiens
tacacattcaataagcat

SEQ ID NO: 1925127 - DNA, 15 bp, Homo sapiens
tacacccttttccag

SEQ ID NO: 1925128 - DNA, 16 bp, Homo sapiens
tacagaactctttcaa

SEQ ID NO: 1925129 - DNA, 19 bp, Homo sapiens
tacagaactctttcaaaac

SEQ ID NO: 1925130 - DNA, 18 bp, Homo sapiens
tacagtatatcttaagat

SEQ ID NO: 1925131 - DNA, 20 bp, Homo sapiens
tacagtcttccatttgcaag

SEQ ID NO: 1925132 - DNA, 22 bp, Homo sapiens
tacagtcttccatttgcaaggg

SEQ ID NO: 1925133 - DNA, 15 bp, Homo sapiens
tacatacattgtata

SEQ ID NO: 1925134 - DNA, 21 bp, Homo sapiens
tacattgtataggccatctgt

SEQ ID NO: 1925135 - DNA, 17 bp, Homo sapiens
taccaaaattatttcag

SEQ ID NO: 1925136 - DNA, 13 bp, Homo sapiens
taccaatgaaaaa

SEQ ID NO: 1925137 - DNA, 14 bp, Homo sapiens
taccacctgtacat

SEQ ID NO: 1925138 - DNA, 22 bp, Homo sapiens
taccattttgcgatgtgtttta

SEQ ID NO: 1925139 - DNA, 20 bp, Homo sapiens
tacccacactacgcagaaga

SEQ ID NO: 1925140 - DNA, 17 bp, Homo sapiens
taccctaggtctccacc

SEQ ID NO: 1925141 - DNA, 20 bp, Homo sapiens
taccctaggtctccacccct

SEQ ID NO: 1925142 - DNA, 13 bp, Homo sapiens
taccctccctgtc

SEQ ID NO: 1925143 - DNA, 15 bp, Homo sapiens
taccgagtatctgta

SEQ ID NO: 1925144 - DNA, 15 bp, Homo sapiens
tacctaattagagca

SEQ ID NO: 1925145 - DNA, 16 bp, Homo sapiens
tacctattgaacatgt

SEQ ID NO: 1925146 - DNA, 13 bp, Homo sapiens
tacctcctgagaa

SEQ ID NO: 1925147 - DNA, 14 bp, Homo sapiens
tacctcctgagaaa

SEQ ID NO: 1925148 - DNA, 20 bp, Homo sapiens
tacctgcccccactcagcat

SEQ ID NO: 1925149 - DNA, 16 bp, Homo sapiens
tacctggaaaccagaa

SEQ ID NO: 1925150 - DNA, 22 bp, Homo sapiens
tacctggatccagccattcctg

SEQ ID NO: 1925151 - DNA, 16 bp, Homo sapiens
tacctgtattgtctga

SEQ ID NO: 1925152 - DNA, 12 bp, Homo sapiens
tacctttctgac

SEQ ID NO: 1925153 - DNA, 14 bp, Homo sapiens
tacgtaaaaatgga

SEQ ID NO: 1925154 - DNA, 22 bp, Homo sapiens
tacgtatgaatgatatctttga

SEQ ID NO: 1925155 - DNA, 21 bp, Homo sapiens
tacgtgtttacttggtgagga

SEQ ID NO: 1925156 - DNA, 18 bp, Homo sapiens
tactacacattcaataag

SEQ ID NO: 1925157 - DNA, 14 bp, Homo sapiens
tactatcttttcat

SEQ ID NO: 1925158 - DNA, 18 bp, Homo sapiens
tactcaaaatgcaggaca

SEQ ID NO: 1925159 - DNA, 16 bp, Homo sapiens
tactcagtcagcccag

SEQ ID NO: 1925160 - DNA, 23 bp, Homo sapiens
tactgtattttgtattgtttcaa

SEQ ID NO: 1925161 - DNA, 12 bp, Homo sapiens
tacttattcaaa

SEQ ID NO: 1925162 - DNA, 16 bp, Homo sapiens
tacttcagctttggat

SEQ ID NO: 1925163 - DNA, 19 bp, Homo sapiens
tacttcatcgcagtggact

SEQ ID NO: 1925164 - DNA, 14 bp, Homo sapiens
tacttcctcctcct

SEQ ID NO: 1925165 - DNA, 24 bp, Homo sapiens
tacttcctcctcctcctcctgttc

SEQ ID NO: 1925166 - DNA, 22 bp, Homo sapiens
tacttgaccgtttttatattac

SEQ ID NO: 1925167 - DNA, 23 bp, Homo sapiens
tacttgaccgtttttatattact

SEQ ID NO: 1925168 - DNA, 18 bp, Homo sapiens
tacttggtgaggaggagg

SEQ ID NO: 1925169 - DNA, 19 bp, Homo sapiens
tactttatttgaataacaa

SEQ ID NO: 1925170 - DNA, 21 bp, Homo sapiens
tagaaaatgtttggaatttaa

SEQ ID NO: 1925171 - DNA, 23 bp, Homo sapiens
tagaaaatttgttattttgcaac

SEQ ID NO: 1925172 - DNA, 12 bp, Homo sapiens
tagaaagaaatt

SEQ ID NO: 1925173 - DNA, 16 bp, Homo sapiens
tagaaatgatttcaaa

SEQ ID NO: 1925174 - DNA, 12 bp, Homo sapiens
tagaaccaggca

SEQ ID NO: 1925175 - DNA, 22 bp, Homo sapiens
tagaacttggatgtacctgccc

SEQ ID NO: 1925176 - DNA, 18 bp, Homo sapiens
tagaagagggagaaggag

SEQ ID NO: 1925177 - DNA, 17 bp, Homo sapiens
tagaaggagacagagct

SEQ ID NO: 1925178 - DNA, 17 bp, Homo sapiens
tagacctgagatgctgg

SEQ ID NO: 1925179 - DNA, 17 bp, Homo sapiens
tagagattacctcctga

SEQ ID NO: 1925180 - DNA, 21 bp, Homo sapiens
tagagattacctcctgagaaa

SEQ ID NO: 1925181 - DNA, 17 bp, Homo sapiens
tagagcattctggggtg

SEQ ID NO: 1925182 - DNA, 23 bp, Homo sapiens
tagagcattctggggtggggctt

SEQ ID NO: 1925183 - DNA, 20 bp, Homo sapiens
tagaggggacaagccaggcc

SEQ ID NO: 1925184 - DNA, 21 bp, Homo sapiens
tagaggggacaagccaggccc

SEQ ID NO: 1925185 - DNA, 22 bp, Homo sapiens
tagagtccaacgtggggcagca

SEQ ID NO: 1925186 - DNA, 15 bp, Homo sapiens
tagagtgtctttcca

SEQ ID NO: 1925187 - DNA, 14 bp, Homo sapiens
tagatcatgaagaa

SEQ ID NO: 1925188 - DNA, 15 bp, Homo sapiens
tagcagacagtgttt

SEQ ID NO: 1925189 - DNA, 16 bp, Homo sapiens
tagccatttgaagaag

SEQ ID NO: 1925190 - DNA, 13 bp, Homo sapiens
tagctgagctgga

SEQ ID NO: 1925191 - DNA, 14 bp, Homo sapiens
gtgtccccctctgt

SEQ ID NO: 1925192 - DNA, 18 bp, Homo sapiens
gtgtccccctctgtccag

SEQ ID NO: 1925193 - DNA, 14 bp, Homo sapiens
gtgtcgttcccttg

SEQ ID NO: 1925194 - DNA, 16 bp, Homo sapiens
gtgtctaatgcattaa

SEQ ID NO: 1925195 - DNA, 17 bp, Homo sapiens
gtgtgacgggggttggg

SEQ ID NO: 1925196 - DNA, 12 bp, Homo sapiens
gtgtgaggccag

SEQ ID NO: 1925197 - DNA, 15 bp, Homo sapiens
gtgtgaggccagggc

SEQ ID NO: 1925198 - DNA, 13 bp, Homo sapiens
gtgtgagtgtgac

SEQ ID NO: 1925199 - DNA, 23 bp, Homo sapiens
gtgtgagtgtgacgggggttggg

SEQ ID NO: 1925200 - DNA, 13 bp, Homo sapiens
gtgtgccaccctc

SEQ ID NO: 1925201 - DNA, 17 bp, Homo sapiens
gtgtgctgttgtttaaa

SEQ ID NO: 1925202 - DNA, 21 bp, Homo sapiens
gtgtgctgttgtttaaaataa

SEQ ID NO: 1925203 - DNA, 12 bp, Homo sapiens
gtgtggcttgga

SEQ ID NO: 1925204 - DNA, 14 bp, Homo sapiens
gtgtggcttggaac

SEQ ID NO: 1925205 - DNA, 15 bp, Homo sapiens
gtgtggcttggaaca

SEQ ID NO: 1925206 - DNA, 14 bp, Homo sapiens
gtgtggggagggtg

SEQ ID NO: 1925207 - DNA, 15 bp, Homo sapiens
gtgtggggagggtgg

SEQ ID NO: 1925208 - DNA, 21 bp, Homo sapiens
gtgtgggggtctgggaggcag

SEQ ID NO: 1925209 - DNA, 23 bp, Homo sapiens
gtgtgggggtctgggaggcaggt

SEQ ID NO: 1925210 - DNA, 20 bp, Homo sapiens
gtgtgtccacgactgtctcc

SEQ ID NO: 1925211 - DNA, 18 bp, Homo sapiens
gtgtgtccccctctgtcc

SEQ ID NO: 1925212 - DNA, 19 bp, Homo sapiens
gtgtgtttcaggacagctg

SEQ ID NO: 1925213 - DNA, 20 bp, Homo sapiens
gtgttcaaactactgtacat

SEQ ID NO: 1925214 - DNA, 19 bp, Homo sapiens
gtgttccccttccactgag

SEQ ID NO: 1925215 - DNA, 23 bp, Homo sapiens
gtgttccccttccactgagggca

SEQ ID NO: 1925216 - DNA, 18 bp, Homo sapiens
gtgttcgtggagccacag

SEQ ID NO: 1925217 - DNA, 21 bp, Homo sapiens
gtgttcgtggagccacaggca

SEQ ID NO: 1925218 - DNA, 16 bp, Homo sapiens
gtgttttacagtatat

SEQ ID NO: 1925219 - DNA, 12 bp, Homo sapiens
gttaaaactgtc

SEQ ID NO: 1925220 - DNA, 15 bp, Homo sapiens
gttaaggggatctaa

SEQ ID NO: 1925221 - DNA, 19 bp, Homo sapiens
gttaaggggatctaaaagg

SEQ ID NO: 1925222 - DNA, 19 bp, Homo sapiens
gttaattggttaatcactt

SEQ ID NO: 1925223 - DNA, 17 bp, Homo sapiens
gttaccgagtatctgta

SEQ ID NO: 1925224 - DNA, 19 bp, Homo sapiens
gttacctaattagagcaga

SEQ ID NO: 1925225 - DNA, 21 bp, Homo sapiens
gttacggcagtcacactgctg

SEQ ID NO: 1925226 - DNA, 16 bp, Homo sapiens
gttactaagatgaaat

SEQ ID NO: 1925227 - DNA, 22 bp, Homo sapiens
gttagagtccaacgtggggcag

SEQ ID NO: 1925228 - DNA, 23 bp, Homo sapiens
gttagggaaatccaactccaggg

SEQ ID NO: 1925229 - DNA, 15 bp, Homo sapiens
gttagtgatttgcta

SEQ ID NO: 1925230 - DNA, 16 bp, Homo sapiens
gttatataaaaaaatt

SEQ ID NO: 1925231 - DNA, 20 bp, Homo sapiens
gttatcaccgtgggctccct

SEQ ID NO: 1925232 - DNA, 22 bp, Homo sapiens
gttattagagattacctcctga

SEQ ID NO: 1925233 - DNA, 19 bp, Homo sapiens
gttattattggcttgcact

SEQ ID NO: 1925234 - DNA, 21 bp, Homo sapiens
gttattttttaattattattt

SEQ ID NO: 1925235 - DNA, 15 bp, Homo sapiens
gttcaaactactgta

SEQ ID NO: 1925236 - DNA, 17 bp, Homo sapiens
gttcaaactactgtaca

SEQ ID NO: 1925237 - DNA, 21 bp, Homo sapiens
gttcaacaagagtaaatattg

SEQ ID NO: 1925238 - DNA, 19 bp, Homo sapiens
gttcacccagcgccctcta

SEQ ID NO: 1925239 - DNA, 14 bp, Homo sapiens
gttcacccctccac

SEQ ID NO: 1925240 - DNA, 16 bp, Homo sapiens
gttcacccctccaccc

SEQ ID NO: 1925241 - DNA, 16 bp, Homo sapiens
gttccagacagggtgg

SEQ ID NO: 1925242 - DNA, 21 bp, Homo sapiens
gttccagacagggtggggctt

SEQ ID NO: 1925243 - DNA, 22 bp, Homo sapiens
gttccagataaaaacaatatat

SEQ ID NO: 1925244 - DNA, 21 bp, Homo sapiens
gttccatcctgtacaagtgct

SEQ ID NO: 1925245 - DNA, 18 bp, Homo sapiens
gttcccctgttcactcta

SEQ ID NO: 1925246 - DNA, 13 bp, Homo sapiens
gttccccttccac

SEQ ID NO: 1925247 - DNA, 15 bp, Homo sapiens
gttccccttccactg

SEQ ID NO: 1925248 - DNA, 12 bp, Homo sapiens
gttccctctttc

SEQ ID NO: 1925249 - DNA, 20 bp, Homo sapiens
gttccctttgttgctgtctg

SEQ ID NO: 1925250 - DNA, 19 bp, Homo sapiens
gttccggaatcctgtcctc

SEQ ID NO: 1925251 - DNA, 17 bp, Homo sapiens
gttcctcatccatgcag

SEQ ID NO: 1925252 - DNA, 13 bp, Homo sapiens
gttcctccagcaa

SEQ ID NO: 1925253 - DNA, 13 bp, Homo sapiens
gttcctgccttct

SEQ ID NO: 1925254 - DNA, 16 bp, Homo sapiens
gttcctgccttctctt

SEQ ID NO: 1925255 - DNA, 17 bp, Homo sapiens
gttcctgccttctcttc

SEQ ID NO: 1925256 - DNA, 19 bp, Homo sapiens
gttctaagtctttccattg

SEQ ID NO: 1925257 - DNA, 23 bp, Homo sapiens
gttctcatccacagaggccaggc

SEQ ID NO: 1925258 - DNA, 15 bp, Homo sapiens
gttctgctcatcatt

SEQ ID NO: 1925259 - DNA, 18 bp, Homo sapiens
gttctgctcatcattctc

SEQ ID NO: 1925260 - DNA, 23 bp, Homo sapiens
gttctgctcatcattctctgtct

SEQ ID NO: 1925261 - DNA, 16 bp, Homo sapiens
gttcttgttttgttat

SEQ ID NO: 1925262 - DNA, 18 bp, Homo sapiens
gttgacagttcatatgta

SEQ ID NO: 1925263 - DNA, 18 bp, Homo sapiens
gttgaggacaggagaggg

SEQ ID NO: 1925264 - DNA, 16 bp, Homo sapiens
gttgagggagtgggga

SEQ ID NO: 1925265 - DNA, 23 bp, Homo sapiens
gttgctgatgaactcttaatcaa

SEQ ID NO: 1925266 - DNA, 14 bp, Homo sapiens
gttggaactgctgc

SEQ ID NO: 1925267 - DNA, 21 bp, Homo sapiens
gttggagatgacagaaatatg

SEQ ID NO: 1925268 - DNA, 18 bp, Homo sapiens
gttggctagtctgtgcct

SEQ ID NO: 1925269 - DNA, 19 bp, Homo sapiens
gttggctagtctgtgcctc

SEQ ID NO: 1925270 - DNA, 19 bp, Homo sapiens
gttgggttccagacagagt

SEQ ID NO: 1925271 - DNA, 22 bp, Homo sapiens
gttgtctgaagtcactgcacag

SEQ ID NO: 1925272 - DNA, 21 bp, Homo sapiens
gttgttcagaagttgttagtg

SEQ ID NO: 1925273 - DNA, 14 bp, Homo sapiens
gttgtttgatgtgt

SEQ ID NO: 1925274 - DNA, 15 bp, Homo sapiens
gttgtttgatgtgta

SEQ ID NO: 1925275 - DNA, 23 bp, Homo sapiens
gtttaccctccctgtcccctgag

SEQ ID NO: 1925276 - DNA, 22 bp, Homo sapiens
gtttcaattgcatctcccagat

SEQ ID NO: 1925277 - DNA, 15 bp, Homo sapiens
gtttccaagcctggg

SEQ ID NO: 1925278 - DNA, 16 bp, Homo sapiens
gtttccaagcctgggc

SEQ ID NO: 1925279 - DNA, 24 bp, Homo sapiens
gtttccaagcctgggccactggca

SEQ ID NO: 1925280 - DNA, 23 bp, Homo sapiens
gtttgaattacagggaagaaatc

SEQ ID NO: 1925281 - DNA, 16 bp, Homo sapiens
gtttgatattgtcacc

SEQ ID NO: 1925282 - DNA, 20 bp, Homo sapiens
gtttgcagagcttgaacaca

SEQ ID NO: 1925283 - DNA, 18 bp, Homo sapiens
gtttgccttctactttta

SEQ ID NO: 1925284 - DNA, 16 bp, Homo sapiens
gtttggaatttaagaa

SEQ ID NO: 1925285 - DNA, 16 bp, Homo sapiens
gtttgggcagtggaga

SEQ ID NO: 1925286 - DNA, 16 bp, Homo sapiens
gtttgggtatattcat

SEQ ID NO: 1925287 - DNA, 15 bp, Homo sapiens
gtttgtatataaatg

SEQ ID NO: 1925288 - DNA, 16 bp, Homo sapiens
gtttgtatataaatgg

SEQ ID NO: 1925289 - DNA, 15 bp, Homo sapiens
gtttgtgtgctgttg

SEQ ID NO: 1925290 - DNA, 17 bp, Homo sapiens
gttttaacggcctgcat

SEQ ID NO: 1925291 - DNA, 18 bp, Homo sapiens
gttttacaatggctgggt

SEQ ID NO: 1925292 - DNA, 18 bp, Homo sapiens
gttttcaccatctttcta

SEQ ID NO: 1925293 - DNA, 20 bp, Homo sapiens
gtttttatattacttttgta

SEQ ID NO: 1925294 - DNA, 13 bp, Homo sapiens
gtttttgctggct

SEQ ID NO: 1925295 - DNA, 20 bp, Homo sapiens
taaaaaataaagtacgtgtt

SEQ ID NO: 1925296 - DNA, 23 bp, Homo sapiens
taaaaacaatatatgtaaattat

SEQ ID NO: 1925297 - DNA, 14 bp, Homo sapiens
taaaaagagaaggc

SEQ ID NO: 1925298 - DNA, 20 bp, Homo sapiens
taaaaatatgtgagcatgaa

SEQ ID NO: 1925299 - DNA, 13 bp, Homo sapiens
taaaactgtccct

SEQ ID NO: 1925300 - DNA, 21 bp, Homo sapiens
taaaagaaagcctcagagaat

SEQ ID NO: 1925301 - DNA, 22 bp, Homo sapiens
taaaagaaagcctcagagaatt

SEQ ID NO: 1925302 - DNA, 18 bp, Homo sapiens
taaaagaagaaactattt

SEQ ID NO: 1925303 - DNA, 15 bp, Homo sapiens
taaaaggaggacagg

SEQ ID NO: 1925304 - DNA, 23 bp, Homo sapiens
taaaagggggctattccctggag

SEQ ID NO: 1925305 - DNA, 21 bp, Homo sapiens
taaaatagttccagataaaaa

SEQ ID NO: 1925306 - DNA, 13 bp, Homo sapiens
taaaatctgtcac

SEQ ID NO: 1925307 - DNA, 15 bp, Homo sapiens
taaaattacagaaga

SEQ ID NO: 1925308 - DNA, 16 bp, Homo sapiens
taaaattacagaagaa

SEQ ID NO: 1925309 - DNA, 19 bp, Homo sapiens
taaaattattccctgaatt

SEQ ID NO: 1925310 - DNA, 20 bp, Homo sapiens
taaacaccatgaagatgcca

SEQ ID NO: 1925311 - DNA, 19 bp, Homo sapiens
taaactaattttgtacgta

SEQ ID NO: 1925312 - DNA, 14 bp, Homo sapiens
taaactgtgcacca

SEQ ID NO: 1925313 - DNA, 21 bp, Homo sapiens
taaactttttcaatggttggg

SEQ ID NO: 1925314 - DNA, 15 bp, Homo sapiens
taaagaaaggcagag

SEQ ID NO: 1925315 - DNA, 20 bp, Homo sapiens
taaagaaaggcagagattgg

SEQ ID NO: 1925316 - DNA, 14 bp, Homo sapiens
taaagctgaaaact

SEQ ID NO: 1925317 - DNA, 19 bp, Homo sapiens
taaagcttgcaacaaaatt

SEQ ID NO: 1925318 - DNA, 20 bp, Homo sapiens
taaaggggacagatcttgag

SEQ ID NO: 1925319 - DNA, 13 bp, Homo sapiens
taaagtaacattt

SEQ ID NO: 1925320 - DNA, 19 bp, Homo sapiens
taaagtaacatttaagcct

SEQ ID NO: 1925321 - DNA, 14 bp, Homo sapiens
gcactattggactt

SEQ ID NO: 1925322 - DNA, 21 bp, Homo sapiens
gcactgaatcgtttcatgtaa

SEQ ID NO: 1925323 - DNA, 21 bp, Homo sapiens
gcactgagataccagcgagga

SEQ ID NO: 1925324 - DNA, 16 bp, Homo sapiens
gcactgcttgaggaaa

SEQ ID NO: 1925325 - DNA, 16 bp, Homo sapiens
gcactgggccggcagc

SEQ ID NO: 1925326 - DNA, 19 bp, Homo sapiens
gcactgggccggcagcctg

SEQ ID NO: 1925327 - DNA, 20 bp, Homo sapiens
gcactgggccggcagcctgg

SEQ ID NO: 1925328 - DNA, 22 bp, Homo sapiens
gcactggtggcccgacagcctg

SEQ ID NO: 1925329 - DNA, 16 bp, Homo sapiens
gcactgtcatgcccag

SEQ ID NO: 1925330 - DNA, 22 bp, Homo sapiens
gcactttccctagaaagccata

SEQ ID NO: 1925331 - DNA, 22 bp, Homo sapiens
gcactttgaaaatatttctatg

SEQ ID NO: 1925332 - DNA, 20 bp, Homo sapiens
gtccttcccacggccactgc

SEQ ID NO: 1925333 - DNA, 23 bp, Homo sapiens
gtccttggtggccgggggtgggg

SEQ ID NO: 1925334 - DNA, 14 bp, Homo sapiens
gtcgtaacagcagg

SEQ ID NO: 1925335 - DNA, 15 bp, Homo sapiens
gtcgtagttactctc

SEQ ID NO: 1925336 - DNA, 16 bp, Homo sapiens
gtctcactctttcttc

SEQ ID NO: 1925337 - DNA, 16 bp, Homo sapiens
gtctcataattgtcaa

SEQ ID NO: 1925338 - DNA, 16 bp, Homo sapiens
gtctcatccatcatca

SEQ ID NO: 1925339 - DNA, 15 bp, Homo sapiens
gtctcctctccagcc

SEQ ID NO: 1925340 - DNA, 18 bp, Homo sapiens
gtctcctctccagcccta

SEQ ID NO: 1925341 - DNA, 15 bp, Homo sapiens
gtctcctgcccactc

SEQ ID NO: 1925342 - DNA, 16 bp, Homo sapiens
gtctcttctccactgg

SEQ ID NO: 1925343 - DNA, 17 bp, Homo sapiens
gtctcttctccactgga

SEQ ID NO: 1925344 - DNA, 13 bp, Homo sapiens
gtctcttgtaatc

SEQ ID NO: 1925345 - DNA, 16 bp, Homo sapiens
gtctgaaggagaggag

SEQ ID NO: 1925346 - DNA, 12 bp, Homo sapiens
gtctgagccctg

SEQ ID NO: 1925347 - DNA, 20 bp, Homo sapiens
gtctgagccctgccctcact

SEQ ID NO: 1925348 - DNA, 23 bp, Homo sapiens
gtctgcctgcctcatgctctcta

SEQ ID NO: 1925349 - DNA, 15 bp, Homo sapiens
gtctggcttcacaga

SEQ ID NO: 1925350 - DNA, 14 bp, Homo sapiens
gtctgggaggcagg

SEQ ID NO: 1925351 - DNA, 15 bp, Homo sapiens
gtctgtgcctcagtg

SEQ ID NO: 1925352 - DNA, 18 bp, Homo sapiens
gtcttcagggggccaggt

SEQ ID NO: 1925353 - DNA, 13 bp, Homo sapiens
gtcttccatcagc

SEQ ID NO: 1925354 - DNA, 16 bp, Homo sapiens
gtcttccatcagcagt

SEQ ID NO: 1925355 - DNA, 15 bp, Homo sapiens
gtcttccatttgcaa

SEQ ID NO: 1925356 - DNA, 19 bp, Homo sapiens
gtcttgagagcgctggcct

SEQ ID NO: 1925357 - DNA, 21 bp, Homo sapiens
gtcttgagagcgctggcctct

SEQ ID NO: 1925358 - DNA, 18 bp, Homo sapiens
gtcttgagtgggccccct

SEQ ID NO: 1925359 - DNA, 15 bp, Homo sapiens
gtcttggagaggagg

SEQ ID NO: 1925360 - DNA, 20 bp, Homo sapiens
gtcttggagaggaggtgtgg

SEQ ID NO: 1925361 - DNA, 22 bp, Homo sapiens
gtcttgttttttttttccactt

SEQ ID NO: 1925362 - DNA, 18 bp, Homo sapiens
gtctttccacggagccac

SEQ ID NO: 1925363 - DNA, 16 bp, Homo sapiens
gtctttgaaatatgca

SEQ ID NO: 1925364 - DNA, 19 bp, Homo sapiens
gtctttgaaatatgcatgt

SEQ ID NO: 1925365 - DNA, 13 bp, Homo sapiens
tggaatttaagaa

SEQ ID NO: 1925366 - DNA, 21 bp, Homo sapiens
tggacagtgagagcagggctg

SEQ ID NO: 1925367 - DNA, 21 bp, Homo sapiens
tggacatgaagattctttccc

SEQ ID NO: 1925368 - DNA, 13 bp, Homo sapiens
tggacctgaccag

SEQ ID NO: 1925369 - DNA, 17 bp, Homo sapiens
tggacctgaccagactg

SEQ ID NO: 1925370 - DNA, 15 bp, Homo sapiens
tggactctcagtctc

SEQ ID NO: 1925371 - DNA, 22 bp, Homo sapiens
tggactctcagtctctgagcag

SEQ ID NO: 1925372 - DNA, 14 bp, Homo sapiens
tggagaactagaga

SEQ ID NO: 1925373 - DNA, 21 bp, Homo sapiens
tggagaggaggtgtggagtgg

SEQ ID NO: 1925374 - DNA, 23 bp, Homo sapiens
tggagaggaggtgtggagtggag

SEQ ID NO: 1925375 - DNA, 17 bp, Homo sapiens
tggagagtgcaacagta

SEQ ID NO: 1925376 - DNA, 12 bp, Homo sapiens
tggagcagaggg

SEQ ID NO: 1925377 - DNA, 14 bp, Homo sapiens
tggagccacaggca

SEQ ID NO: 1925378 - DNA, 15 bp, Homo sapiens
tggagcccctatcct

SEQ ID NO: 1925379 - DNA, 21 bp, Homo sapiens
tggaggaaaaccaagccgtgg

SEQ ID NO: 1925380 - DNA, 19 bp, Homo sapiens
tggaggcacacagctgcag

SEQ ID NO: 1925381 - DNA, 22 bp, Homo sapiens
tggaggcacacagctgcagaga

SEQ ID NO: 1925382 - DNA, 19 bp, Homo sapiens
tggaggcctggtctggagc

SEQ ID NO: 1925383 - DNA, 16 bp, Homo sapiens
tggaggggtcagcagg

SEQ ID NO: 1925384 - DNA, 16 bp, Homo sapiens
tggagtctgaaggaga

SEQ ID NO: 1925385 - DNA, 17 bp, Homo sapiens
tggagtctgaaggagag

SEQ ID NO: 1925386 - DNA, 23 bp, Homo sapiens
tggagtctgaaggagaggagtgc

SEQ ID NO: 1925387 - DNA, 20 bp, Homo sapiens
tggagtggaggggtcagcag

SEQ ID NO: 1925388 - DNA, 20 bp, Homo sapiens
tggagtgtgtgggggtctgg

SEQ ID NO: 1925389 - DNA, 18 bp, Homo sapiens
tggataggagcttccaga

SEQ ID NO: 1925390 - DNA, 19 bp, Homo sapiens
tggataggagcttccagat

SEQ ID NO: 1925391 - DNA, 12 bp, Homo sapiens
tggatcaagctt

SEQ ID NO: 1925392 - DNA, 18 bp, Homo sapiens
tggatccagccattcctg

SEQ ID NO: 1925393 - DNA, 18 bp, Homo sapiens
tggatctggagtctgaag

SEQ ID NO: 1925394 - DNA, 19 bp, Homo sapiens
tggatggggcggcctgcag

SEQ ID NO: 1925395 - DNA, 17 bp, Homo sapiens
tggcaaagacagaagcc

SEQ ID NO: 1925396 - DNA, 15 bp, Homo sapiens
tggcaataggacaaa

SEQ ID NO: 1925397 - DNA, 21 bp, Homo sapiens
tggcacctgggtgctctggct

SEQ ID NO: 1925398 - DNA, 14 bp, Homo sapiens
tggcacttcgtgga

SEQ ID NO: 1925399 - DNA, 21 bp, Homo sapiens
tggcagccgtgccttcagctc

SEQ ID NO: 1925400 - DNA, 18 bp, Homo sapiens
tggcattcctttctttaa

SEQ ID NO: 1925401 - DNA, 12 bp, Homo sapiens
tggccaaatatg

SEQ ID NO: 1925402 - DNA, 17 bp, Homo sapiens
tggccactccagacccc

SEQ ID NO: 1925403 - DNA, 23 bp, Homo sapiens
tatagtgtataccacctgtacat

SEQ ID NO: 1925404 - DNA, 19 bp, Homo sapiens
tatataaatatctatttat

SEQ ID NO: 1925405 - DNA, 13 bp, Homo sapiens
tatataaatggtg

SEQ ID NO: 1925406 - DNA, 15 bp, Homo sapiens
tatataatacttaaa

SEQ ID NO: 1925407 - DNA, 21 bp, Homo sapiens
tatataatacttaaaaatatg

SEQ ID NO: 1925408 - DNA, 14 bp, Homo sapiens
tatatataaatatc

SEQ ID NO: 1925409 - DNA, 23 bp, Homo sapiens
tatatgaaaggcttctgggactt

SEQ ID NO: 1925410 - DNA, 15 bp, Homo sapiens
tatatgtatataaaa

SEQ ID NO: 1925411 - DNA, 17 bp, Homo sapiens
tatattacttttgtaaa

SEQ ID NO: 1925412 - DNA, 19 bp, Homo sapiens
tatattacttttgtaaata

SEQ ID NO: 1925413 - DNA, 15 bp, Homo sapiens
tatattataagattt

SEQ ID NO: 1925414 - DNA, 12 bp, Homo sapiens
tatattatatat

SEQ ID NO: 1925415 - DNA, 14 bp, Homo sapiens
tatatttaggattt

SEQ ID NO: 1925416 - DNA, 19 bp, Homo sapiens
tatcaaaactttcttttct

SEQ ID NO: 1925417 - DNA, 21 bp, Homo sapiens
tatcacaaagttgtttaacta

SEQ ID NO: 1925418 - DNA, 20 bp, Homo sapiens
tatcaggacccagaggaagg

SEQ ID NO: 1925419 - DNA, 22 bp, Homo sapiens
tatcagtcataactaaataaag

SEQ ID NO: 1925420 - DNA, 20 bp, Homo sapiens
tatcctgcaccctctgctat

SEQ ID NO: 1925421 - DNA, 17 bp, Homo sapiens
tatctatttatctgtct

SEQ ID NO: 1925422 - DNA, 19 bp, Homo sapiens
tatctatttatctgtctga

SEQ ID NO: 1925423 - DNA, 22 bp, Homo sapiens
tatctcgaagtcttccatcagc

SEQ ID NO: 1925424 - DNA, 12 bp, Homo sapiens
tatctgactgaa

SEQ ID NO: 1925425 - DNA, 12 bp, Homo sapiens
tatctgtacctg

SEQ ID NO: 1925426 - DNA, 17 bp, Homo sapiens
tatcttaagataatatt

SEQ ID NO: 1925427 - DNA, 15 bp, Homo sapiens
tatgaggtctaggaa

SEQ ID NO: 1925428 - DNA, 19 bp, Homo sapiens
tatgaggtctaggaacata

SEQ ID NO: 1925429 - DNA, 18 bp, Homo sapiens
tatgattctcctctccca

SEQ ID NO: 1925430 - DNA, 15 bp, Homo sapiens
tatgattgatttgaa

SEQ ID NO: 1925431 - DNA, 17 bp, Homo sapiens
tatgcacctataaatac

SEQ ID NO: 1925432 - DNA, 17 bp, Homo sapiens
tatgcactttccctaga

SEQ ID NO: 1925433 - DNA, 16 bp, Homo sapiens
tatgcatctaataaaa

SEQ ID NO: 1925434 - DNA, 14 bp, Homo sapiens
tatgccacctgcag

SEQ ID NO: 1925435 - DNA, 16 bp, Homo sapiens
tatgccacctgcagcg

SEQ ID NO: 1925436 - DNA, 20 bp, Homo sapiens
tatgccacctgcagcgtctg

SEQ ID NO: 1925437 - DNA, 19 bp, Homo sapiens
tatggcttgtagggtgagg

SEQ ID NO: 1925438 - DNA, 18 bp, Homo sapiens
tatgggtcattctcacct

SEQ ID NO: 1925439 - DNA, 14 bp, Homo sapiens
tatgtaaattattg

SEQ ID NO: 1925440 - DNA, 17 bp, Homo sapiens
tatgtaaattattgtaa

SEQ ID NO: 1925441 - DNA, 11 bp, Homo sapiens
tatgtaacatg

SEQ ID NO: 1925442 - DNA, 14 bp, Homo sapiens
tatgtagattgcct

SEQ ID NO: 1925443 - DNA, 15 bp, Homo sapiens
tatgtagcaaaatac

SEQ ID NO: 1925444 - DNA, 19 bp, Homo sapiens
tatgtatatttaaaagaaa

SEQ ID NO: 1925445 - DNA, 16 bp, Homo sapiens
tatgtatgtgaaagtt

SEQ ID NO: 1925446 - DNA, 11 bp, Homo sapiens
tatgtctgtga

SEQ ID NO: 1925447 - DNA, 15 bp, Homo sapiens
tatgtttttgttcaa

SEQ ID NO: 1925448 - DNA, 16 bp, Homo sapiens
tatgtttttgttcaaa

SEQ ID NO: 1925449 - DNA, 12 bp, Homo sapiens
tattaaatcaga

SEQ ID NO: 1925450 - DNA, 20 bp, Homo sapiens
tattaacatatattgttatt

SEQ ID NO: 1925451 - DNA, 19 bp, Homo sapiens
tattacttttgtaaatatt

SEQ ID NO: 1925452 - DNA, 23 bp, Homo sapiens
tattacttttgtaaatattcttg

SEQ ID NO: 1925453 - DNA, 15 bp, Homo sapiens
tattagagtgtcttt

SEQ ID NO: 1925454 - DNA, 13 bp, Homo sapiens
tattatttatata

SEQ ID NO: 1925455 - DNA, 13 bp, Homo sapiens
tattccctggaga

SEQ ID NO: 1925456 - DNA, 18 bp, Homo sapiens
tattctgcaacagcctgt

SEQ ID NO: 1925457 - DNA, 14 bp, Homo sapiens
tattcttaagcact

SEQ ID NO: 1925458 - DNA, 16 bp, Homo sapiens
tattcttaagcacttt

SEQ ID NO: 1925459 - DNA, 21 bp, Homo sapiens
tattcttaagcactttgaaaa

SEQ ID NO: 1925460 - DNA, 16 bp, Homo sapiens
tattcttgtccacatt

SEQ ID NO: 1925461 - DNA, 14 bp, Homo sapiens
tattgacaaactct

SEQ ID NO: 1925462 - DNA, 23 bp, Homo sapiens
tattgaggaaaattaatatcaca

SEQ ID NO: 1925463 - DNA, 14 bp, Homo sapiens
tattgccacctctg

SEQ ID NO: 1925464 - DNA, 14 bp, Homo sapiens
tattgtgaaatttg

SEQ ID NO: 1925465 - DNA, 19 bp, Homo sapiens
tattgtgaaatttgttaat

SEQ ID NO: 1925466 - DNA, 22 bp, Homo sapiens
tatttaaaaaaaaacattcaaa

SEQ ID NO: 1925467 - DNA, 17 bp, Homo sapiens
tatttaactatttagag

SEQ ID NO: 1925468 - DNA, 21 bp, Homo sapiens
tatttaactgccttgtgtaca

SEQ ID NO: 1925469 - DNA, 19 bp, Homo sapiens
tatttataaatatatttaa

SEQ ID NO: 1925470 - DNA, 16 bp, Homo sapiens
tatttatatatgtatt

SEQ ID NO: 1925471 - DNA, 14 bp, Homo sapiens
tatttcaaattgga

SEQ ID NO: 1925472 - DNA, 15 bp, Homo sapiens
tatttgaattagtaa

SEQ ID NO: 1925473 - DNA, 22 bp, Homo sapiens
tatttgcataacaattcctcta

SEQ ID NO: 1925474 - DNA, 20 bp, Homo sapiens
tatttgtaactttgcatgtt

SEQ ID NO: 1925475 - DNA, 13 bp, Homo sapiens
tattttagaaaat

SEQ ID NO: 1925476 - DNA, 22 bp, Homo sapiens
tattttagaaaatgtttggaat

SEQ ID NO: 1925477 - DNA, 21 bp, Homo sapiens
tattttcaacgcagccctgct

SEQ ID NO: 1925478 - DNA, 13 bp, Homo sapiens
tattttctatatt

SEQ ID NO: 1925479 - DNA, 18 bp, Homo sapiens
tattttctatatttgtaa

SEQ ID NO: 1925480 - DNA, 20 bp, Homo sapiens
tatttttttgttgctgttgt

SEQ ID NO: 1925481 - DNA, 14 bp, Homo sapiens
tcaaaaacatttgt

SEQ ID NO: 1925482 - DNA, 19 bp, Homo sapiens
tcaaaagattaacaacact

SEQ ID NO: 1925483 - DNA, 23 bp, Homo sapiens
tcaaaatgatattcaatcttaac

SEQ ID NO: 1925484 - DNA, 12 bp, Homo sapiens
tcaaacacacac

SEQ ID NO: 1925485 - DNA, 15 bp, Homo sapiens
tcaaacacacacaca

SEQ ID NO: 1925486 - DNA, 15 bp, Homo sapiens
tcaaagaacccccct

SEQ ID NO: 1925487 - DNA, 12 bp, Homo sapiens
tcaaagccagcg

SEQ ID NO: 1925488 - DNA, 22 bp, Homo sapiens
tcaaagccagcgtcctcctctg

SEQ ID NO: 1925489 - DNA, 19 bp, Homo sapiens
tcaaagtttttacagtgta

SEQ ID NO: 1925490 - DNA, 17 bp, Homo sapiens
tcaaatatatttaacta

SEQ ID NO: 1925491 - DNA, 18 bp, Homo sapiens
tcaaatatatttaactat

SEQ ID NO: 1925492 - DNA, 18 bp, Homo sapiens
tcaacctgggcaaagcct

SEQ ID NO: 1925493 - DNA, 15 bp, Homo sapiens
tcaacgcagccctgc

SEQ ID NO: 1925494 - DNA, 18 bp, Homo sapiens
tcaacgcagccctgcttt

SEQ ID NO: 1925495 - DNA, 13 bp, Homo sapiens
tcaagcactgaca

SEQ ID NO: 1925496 - DNA, 21 bp, Homo sapiens
tcaagccaggagaccctgtct

SEQ ID NO: 1925497 - DNA, 18 bp, Homo sapiens
tcaagcttgtgtacttga

SEQ ID NO: 1925498 - DNA, 18 bp, Homo sapiens
tcaaggcgtgaggatggg

SEQ ID NO: 1925499 - DNA, 22 bp, Homo sapiens
tcaagggactgggggtgccaac

SEQ ID NO: 1925500 - DNA, 20 bp, Homo sapiens
tcaagttcatagtttctgta

SEQ ID NO: 1925501 - DNA, 22 bp, Homo sapiens
tcaataaatagatgagtcctgt

SEQ ID NO: 1925502 - DNA, 21 bp, Homo sapiens
tcaataattgtggagaggaga

SEQ ID NO: 1925503 - DNA, 22 bp, Homo sapiens
tcaataattgtggagaggagag

SEQ ID NO: 1925504 - DNA, 14 bp, Homo sapiens
tcaatacccttggc

SEQ ID NO: 1925505 - DNA, 17 bp, Homo sapiens
tcaatcaaactttcagc

SEQ ID NO: 1925506 - DNA, 20 bp, Homo sapiens
tcaatggttgggacaatggc

SEQ ID NO: 1925507 - DNA, 16 bp, Homo sapiens
tcaattaaaaccatta

SEQ ID NO: 1925508 - DNA, 14 bp, Homo sapiens
tcaattccacctgc

SEQ ID NO: 1925509 - DNA, 20 bp, Homo sapiens
tcacaaagttgtttaactag

SEQ ID NO: 1925510 - DNA, 14 bp, Homo sapiens
tcacaacacaatca

SEQ ID NO: 1925511 - DNA, 23 bp, Homo sapiens
tcacaacactgaacctctggcta

SEQ ID NO: 1925512 - DNA, 14 bp, Homo sapiens
tcacactgctggga

SEQ ID NO: 1925513 - DNA, 12 bp, Homo sapiens
tcacagaggcag

SEQ ID NO: 1925514 - DNA, 13 bp, Homo sapiens
tcacagaggcagt

SEQ ID NO: 1925515 - DNA, 21 bp, Homo sapiens
tcacagattttttctttaaat

SEQ ID NO: 1925516 - DNA, 21 bp, Homo sapiens
tcacagtgaacataactgtaa

SEQ ID NO: 1925517 - DNA, 15 bp, Homo sapiens
tcacattcaggcatg

SEQ ID NO: 1925518 - DNA, 17 bp, Homo sapiens
tcacattccctctcatc

SEQ ID NO: 1925519 - DNA, 13 bp, Homo sapiens
tcaccaaaaaatc

SEQ ID NO: 1925520 - DNA, 12 bp, Homo sapiens
tcacccctgtct

SEQ ID NO: 1925521 - DNA, 15 bp, Homo sapiens
tcaccgccgtggggt

SEQ ID NO: 1925522 - DNA, 17 bp, Homo sapiens
tcaccgtgggctccctg

SEQ ID NO: 1925523 - DNA, 17 bp, Homo sapiens
tcacggacaggaagcac

SEQ ID NO: 1925524 - DNA, 21 bp, Homo sapiens
tcactatttttttgttgctgt

SEQ ID NO: 1925525 - DNA, 12 bp, Homo sapiens
tcactccactcc

SEQ ID NO: 1925526 - DNA, 16 bp, Homo sapiens
tcactccactcccctc

SEQ ID NO: 1925527 - DNA, 20 bp, Homo sapiens
tcactctacttagcatgtcc

SEQ ID NO: 1925528 - DNA, 23 bp, Homo sapiens
tcactctttcttctctctttgtc

SEQ ID NO: 1925529 - DNA, 15 bp, Homo sapiens
tcactgaagtgaata

SEQ ID NO: 1925530 - DNA, 16 bp, Homo sapiens
tcactgaagtgaatac

SEQ ID NO: 1925531 - DNA, 19 bp, Homo sapiens
tcactgaagtgaatacatg

SEQ ID NO: 1925532 - DNA, 22 bp, Homo sapiens
tcactgagaaggccccagggca

SEQ ID NO: 1925533 - DNA, 24 bp, Homo sapiens
tcactgcacagtgcatctcagccc

SEQ ID NO: 1925534 - DNA, 19 bp, Homo sapiens
tcactgcccacctgccagg

SEQ ID NO: 1925535 - DNA, 22 bp, Homo sapiens
tcactgcccacctgccaggctg

SEQ ID NO: 1925536 - DNA, 13 bp, Homo sapiens
tgaaacttgtgct

SEQ ID NO: 1925537 - DNA, 18 bp, Homo sapiens
tgaaacttgtgctatagt

SEQ ID NO: 1925538 - DNA, 22 bp, Homo sapiens
tgaaagtggggtgttgaagacc

SEQ ID NO: 1925539 - DNA, 21 bp, Homo sapiens
tgaaatacctttgcctggata

SEQ ID NO: 1925540 - DNA, 16 bp, Homo sapiens
tgaaatatgcatgtac

SEQ ID NO: 1925541 - DNA, 13 bp, Homo sapiens
tgaaatcaaatgt

SEQ ID NO: 1925542 - DNA, 17 bp, Homo sapiens
tgaaattaacctctcac

SEQ ID NO: 1925543 - DNA, 23 bp, Homo sapiens
tgaacattattaaatcagaatct

SEQ ID NO: 1925544 - DNA, 15 bp, Homo sapiens
tgaacggtgagcatt

SEQ ID NO: 1925545 - DNA, 12 bp, Homo sapiens
tgaactgagaag

SEQ ID NO: 1925546 - DNA, 14 bp, Homo sapiens
tgaactggccccag

SEQ ID NO: 1925547 - DNA, 21 bp, Homo sapiens
tgaagaaggaggaattttaga

SEQ ID NO: 1925548 - DNA, 22 bp, Homo sapiens
tgaagacacgcccgactctctc

SEQ ID NO: 1925549 - DNA, 16 bp, Homo sapiens
tgaagattctttccca

SEQ ID NO: 1925550 - DNA, 14 bp, Homo sapiens
tgaagcccaggagg

SEQ ID NO: 1925551 - DNA, 15 bp, Homo sapiens
tgaaggcttctctct

SEQ ID NO: 1925552 - DNA, 22 bp, Homo sapiens
tgaaggttggaactgctgccat

SEQ ID NO: 1925553 - DNA, 23 bp, Homo sapiens
tgaaggttggaactgctgccatg

SEQ ID NO: 1925554 - DNA, 15 bp, Homo sapiens
tgaagtaagcaaaga

SEQ ID NO: 1925555 - DNA, 14 bp, Homo sapiens
tgaagtgaatacat

SEQ ID NO: 1925556 - DNA, 17 bp, Homo sapiens
tgaagtgaatacatggt

SEQ ID NO: 1925557 - DNA, 18 bp, Homo sapiens
tgaagtggaaaaagaaat

SEQ ID NO: 1925558 - DNA, 14 bp, Homo sapiens
tgaataaagacacc

SEQ ID NO: 1925559 - DNA, 16 bp, Homo sapiens
tgaatactgtattttg

SEQ ID NO: 1925560 - DNA, 15 bp, Homo sapiens
tgaatccctttcagt

SEQ ID NO: 1925561 - DNA, 16 bp, Homo sapiens
tgaatcttggtgtcta

SEQ ID NO: 1925562 - DNA, 16 bp, Homo sapiens
tgaatgattcagtgtt

SEQ ID NO: 1925563 - DNA, 14 bp, Homo sapiens
tgaatgcataaaat

SEQ ID NO: 1925564 - DNA, 15 bp, Homo sapiens
tgaatgcataaaatg

SEQ ID NO: 1925565 - DNA, 14 bp, Homo sapiens
tgaatgctgtacct

SEQ ID NO: 1925566 - DNA, 22 bp, Homo sapiens
tgaatgtttacactctttgtaa

SEQ ID NO: 1925567 - DNA, 21 bp, Homo sapiens
tgaattcttggttgaggaaac

SEQ ID NO: 1925568 - DNA, 15 bp, Homo sapiens
tgaattgtttgatat

SEQ ID NO: 1925569 - DNA, 20 bp, Homo sapiens
tgaatttctagacagtattg

SEQ ID NO: 1925570 - DNA, 17 bp, Homo sapiens
tgacaaaggcaagcact

SEQ ID NO: 1925571 - DNA, 19 bp, Homo sapiens
tgacaaccatgagaccact

SEQ ID NO: 1925572 - DNA, 13 bp, Homo sapiens
tgacaacttctga

SEQ ID NO: 1925573 - DNA, 20 bp, Homo sapiens
tgacaaggtgtttctctgta

SEQ ID NO: 1925574 - DNA, 14 bp, Homo sapiens
tgacaataaataat

SEQ ID NO: 1925575 - DNA, 23 bp, Homo sapiens
tgacacaaaggacaaaaatataa

SEQ ID NO: 1925576 - DNA, 20 bp, Homo sapiens
tgacacaaataccagagcac

SEQ ID NO: 1925577 - DNA, 22 bp, Homo sapiens
tgacactcccttgggctccctg

SEQ ID NO: 1925578 - DNA, 19 bp, Homo sapiens
tgacatgcgggctgggcag

SEQ ID NO: 1925579 - DNA, 20 bp, Homo sapiens
tgacatgcgggctgggcagc

SEQ ID NO: 1925580 - DNA, 21 bp, Homo sapiens
tgacatgcgggctgggcagct

SEQ ID NO: 1925581 - DNA, 21 bp, Homo sapiens
tgacatggattggatttcagt

SEQ ID NO: 1925582 - DNA, 18 bp, Homo sapiens
tgacatttatttttcatt

SEQ ID NO: 1925583 - DNA, 14 bp, Homo sapiens
tgacatttctcaaa

SEQ ID NO: 1925584 - DNA, 21 bp, Homo sapiens
tgaccagactgtgggtccctg

SEQ ID NO: 1925585 - DNA, 13 bp, Homo sapiens
tgaccccagagga

SEQ ID NO: 1925586 - DNA, 20 bp, Homo sapiens
tgacctttgaggtctaaaca

SEQ ID NO: 1925587 - DNA, 15 bp, Homo sapiens
tgacgtattgtgaaa

SEQ ID NO: 1925588 - DNA, 18 bp, Homo sapiens
tgacgtattgtgaaattt

SEQ ID NO: 1925589 - DNA, 20 bp, Homo sapiens
tgacgtattgtgaaatttgt

SEQ ID NO: 1925590 - DNA, 20 bp, Homo sapiens
tgactaccacttatttctaa

SEQ ID NO: 1925591 - DNA, 17 bp, Homo sapiens
tgactcagggctcctgg

SEQ ID NO: 1925592 - DNA, 19 bp, Homo sapiens
tgactcagggctcctgggt

SEQ ID NO: 1925593 - DNA, 16 bp, Homo sapiens
tgactctggctgccaa

SEQ ID NO: 1925594 - DNA, 17 bp, Homo sapiens
tgactctggctgccaag

SEQ ID NO: 1925595 - DNA, 22 bp, Homo sapiens
tgactgtactcctcccaggcgc

SEQ ID NO: 1925596 - DNA, 17 bp, Homo sapiens
tgacttcagactctctc

SEQ ID NO: 1925597 - DNA, 16 bp, Homo sapiens
tgacttctcaggaaga

SEQ ID NO: 1925598 - DNA, 19 bp, Homo sapiens
tgagaactactcagggaat

SEQ ID NO: 1925599 - DNA, 19 bp, Homo sapiens
tgagaagccaaagccccta

SEQ ID NO: 1925600 - DNA, 20 bp, Homo sapiens
tgagacccagccctcatccc

SEQ ID NO: 1925601 - DNA, 11 bp, Homo sapiens
tgagagagtgt

SEQ ID NO: 1925602 - DNA, 14 bp, Homo sapiens
tgagagcagggctg

SEQ ID NO: 1925603 - DNA, 19 bp, Homo sapiens
tgagagcagggctgggcgc

SEQ ID NO: 1925604 - DNA, 14 bp, Homo sapiens
tgagagcgctggcc

SEQ ID NO: 1925605 - DNA, 21 bp, Homo sapiens
tgagataccagcgaggaggct

SEQ ID NO: 1925606 - DNA, 20 bp, Homo sapiens
tgagccaccgcgagggcctg

SEQ ID NO: 1925607 - DNA, 12 bp, Homo sapiens
tgagccaggagc

SEQ ID NO: 1925608 - DNA, 14 bp, Homo sapiens
tgagccaggagcct

SEQ ID NO: 1925609 - DNA, 18 bp, Homo sapiens
tgagccaggagcctcctg

SEQ ID NO: 1925610 - DNA, 20 bp, Homo sapiens
tgagccaggagcctcctgac

SEQ ID NO: 1925611 - DNA, 21 bp, Homo sapiens
tgagcccctccctcctgtgtt

SEQ ID NO: 1925612 - DNA, 19 bp, Homo sapiens
tgagcggccgcctgtcctt

SEQ ID NO: 1925613 - DNA, 21 bp, Homo sapiens
tgagcggccgcctgtccttgg

SEQ ID NO: 1925614 - DNA, 14 bp, Homo sapiens
tgagctgaggcagc

SEQ ID NO: 1925615 - DNA, 23 bp, Homo sapiens
tgagctggaaaggatgcttctgc

SEQ ID NO: 1925616 - DNA, 16 bp, Homo sapiens
tgaggaccctcccagg

SEQ ID NO: 1925617 - DNA, 14 bp, Homo sapiens
tgaggaggaggcag

SEQ ID NO: 1925618 - DNA, 20 bp, Homo sapiens
tgaggaggaggcagaaccag

SEQ ID NO: 1925619 - DNA, 18 bp, Homo sapiens
tgaggatgcagagtcagc

SEQ ID NO: 1925620 - DNA, 16 bp, Homo sapiens
tgaggatgggaaggag

SEQ ID NO: 1925621 - DNA, 20 bp, Homo sapiens
tgaggcaaccacaggcagca

SEQ ID NO: 1925622 - DNA, 21 bp, Homo sapiens
tgaggcagcagtgtgaggcca

SEQ ID NO: 1925623 - DNA, 20 bp, Homo sapiens
tgaggcgtgggatccagaga

SEQ ID NO: 1925624 - DNA, 19 bp, Homo sapiens
tgaggctggcggggtctgc

SEQ ID NO: 1925625 - DNA, 16 bp, Homo sapiens
tgagggcagggttcta

SEQ ID NO: 1925626 - DNA, 21 bp, Homo sapiens
tgagggcagggttctagaagg

SEQ ID NO: 1925627 - DNA, 22 bp, Homo sapiens
tgaggggcttccctctgctcca

SEQ ID NO: 1925628 - DNA, 20 bp, Homo sapiens
tgaggggtctccaggaggag

SEQ ID NO: 1925629 - DNA, 22 bp, Homo sapiens
tgagggtcagagaggagtcaga

SEQ ID NO: 1925630 - DNA, 13 bp, Homo sapiens
tgaggtctggatt

SEQ ID NO: 1925631 - DNA, 16 bp, Homo sapiens
tgagtaaaatcacaga

SEQ ID NO: 1925632 - DNA, 12 bp, Homo sapiens
tgagtcctgtta

SEQ ID NO: 1925633 - DNA, 12 bp, Homo sapiens
tgagtcctgttc

SEQ ID NO: 1925634 - DNA, 15 bp, Homo sapiens
tgagtgcagtcctga

SEQ ID NO: 1925635 - DNA, 19 bp, Homo sapiens
tgagtgctctgatccctct

SEQ ID NO: 1925636 - DNA, 12 bp, Homo sapiens
tgagtgggcccc

SEQ ID NO: 1925637 - DNA, 15 bp, Homo sapiens
tgagtgggccccctc

SEQ ID NO: 1925638 - DNA, 14 bp, Homo sapiens
tgatactgtctaag

SEQ ID NO: 1925639 - DNA, 16 bp, Homo sapiens
tgatactgtctaagaa

SEQ ID NO: 1925640 - DNA, 22 bp, Homo sapiens
tgatattgtcacctagcagata

SEQ ID NO: 1925641 - DNA, 23 bp, Homo sapiens
tgatattttcaacgcagccctgc

SEQ ID NO: 1925642 - DNA, 21 bp, Homo sapiens
tgatcagagccgtggtccttt

SEQ ID NO: 1925643 - DNA, 17 bp, Homo sapiens
tgatcgcctttcccagg

SEQ ID NO: 1925644 - DNA, 21 bp, Homo sapiens
tgatctgatgcaagcaagaaa

SEQ ID NO: 1925645 - DNA, 18 bp, Homo sapiens
tgatgaactcttaatcaa

SEQ ID NO: 1925646 - DNA, 15 bp, Homo sapiens
tgatgcctgacacag

SEQ ID NO: 1925647 - DNA, 20 bp, Homo sapiens
tgatgcctgacacaggggac

SEQ ID NO: 1925648 - DNA, 21 bp, Homo sapiens
tgatgcctgacacaggggaca

SEQ ID NO: 1925649 - DNA, 15 bp, Homo sapiens
tgatgtcttgagagc

SEQ ID NO: 1925650 - DNA, 19 bp, Homo sapiens
tgatgtcttgagagcgctg

SEQ ID NO: 1925651 - DNA, 20 bp, Homo sapiens
tgatgtcttgagagcgctgg

SEQ ID NO: 1925652 - DNA, 14 bp, Homo sapiens
tgattattcagtgt

SEQ ID NO: 1925653 - DNA, 12 bp, Homo sapiens
tgattcacagtg

SEQ ID NO: 1925654 - DNA, 12 bp, Homo sapiens
tgattcagtgtt

SEQ ID NO: 1925655 - DNA, 22 bp, Homo sapiens
tgattccttgatggagatattt

SEQ ID NO: 1925656 - DNA, 14 bp, Homo sapiens
tgattctcctctcc

SEQ ID NO: 1925657 - DNA, 19 bp, Homo sapiens
tgattgaagtatctgtacc

SEQ ID NO: 1925658 - DNA, 20 bp, Homo sapiens
tgattgaagtatctgtacct

SEQ ID NO: 1925659 - DNA, 15 bp, Homo sapiens
tgattgatttgaagt

SEQ ID NO: 1925660 - DNA, 18 bp, Homo sapiens
tgattgccatttcttccc

SEQ ID NO: 1925661 - DNA, 20 bp, Homo sapiens
tgattggcaggagttggaag

SEQ ID NO: 1925662 - DNA, 21 bp, Homo sapiens
tgatttcccctccaaggtatg

SEQ ID NO: 1925663 - DNA, 13 bp, Homo sapiens
tgattttcctgtg

SEQ ID NO: 1925664 - DNA, 21 bp, Homo sapiens
tgattttggccactttgcaga

SEQ ID NO: 1925665 - DNA, 19 bp, Homo sapiens
tgcaaaaggactctcagga

SEQ ID NO: 1925666 - DNA, 14 bp, Homo sapiens
tgcaacagtagcat

SEQ ID NO: 1925667 - DNA, 13 bp, Homo sapiens
tgcaactttagaa

SEQ ID NO: 1925668 - DNA, 21 bp, Homo sapiens
ggtggggctgcatccaaggct

SEQ ID NO: 1925669 - DNA, 20 bp, Homo sapiens
ggtggggcttagaatggggc

SEQ ID NO: 1925670 - DNA, 21 bp, Homo sapiens
ggtgggggcctgctgtgggtc

SEQ ID NO: 1925671 - DNA, 17 bp, Homo sapiens
ggtgggtccatgggcag

SEQ ID NO: 1925672 - DNA, 22 bp, Homo sapiens
ggtgtgagaataacactggctt

SEQ ID NO: 1925673 - DNA, 18 bp, Homo sapiens
ggtgtgatcgtctgactg

SEQ ID NO: 1925674 - DNA, 16 bp, Homo sapiens
ggtgtgcaccagggtt

SEQ ID NO: 1925675 - DNA, 23 bp, Homo sapiens
ggtgtgccacaggctgcaagctg

SEQ ID NO: 1925676 - DNA, 16 bp, Homo sapiens
ggtgtgttcgtggagc

SEQ ID NO: 1925677 - DNA, 20 bp, Homo sapiens
ggtgttcatgacaagtggaa

SEQ ID NO: 1925678 - DNA, 22 bp, Homo sapiens
ggtgttttccttcacaatggtt

SEQ ID NO: 1925679 - DNA, 13 bp, Homo sapiens
ggttaaaactgtc

SEQ ID NO: 1925680 - DNA, 12 bp, Homo sapiens
ggttaaggggat

SEQ ID NO: 1925681 - DNA, 19 bp, Homo sapiens
ggttaaggggatctaaaag

SEQ ID NO: 1925682 - DNA, 19 bp, Homo sapiens
ggttaataggaggacagaa

SEQ ID NO: 1925683 - DNA, 19 bp, Homo sapiens
ggttaccgagtatctgtaa

SEQ ID NO: 1925684 - DNA, 12 bp, Homo sapiens
ggttccagacag

SEQ ID NO: 1925685 - DNA, 14 bp, Homo sapiens
ggttccagcttccc

SEQ ID NO: 1925686 - DNA, 21 bp, Homo sapiens
ggttccgcttggagcagaggg

SEQ ID NO: 1925687 - DNA, 23 bp, Homo sapiens
ggttccgcttggagcagaggggc

SEQ ID NO: 1925688 - DNA, 15 bp, Homo sapiens
ggttgaccccagagg

SEQ ID NO: 1925689 - DNA, 11 bp, Homo sapiens
ggttgaggaaa

SEQ ID NO: 1925690 - DNA, 22 bp, Homo sapiens
ggttggaagtgagggtcagaga

SEQ ID NO: 1925691 - DNA, 17 bp, Homo sapiens
ggttgggacaatggcaa

SEQ ID NO: 1925692 - DNA, 20 bp, Homo sapiens
ggttgggacaatggcaatag

SEQ ID NO: 1925693 - DNA, 14 bp, Homo sapiens
ggttttcacttcct

SEQ ID NO: 1925694 - DNA, 14 bp, Homo sapiens
gtaaaaataaaatt

SEQ ID NO: 1925695 - DNA, 18 bp, Homo sapiens
gtaaaaatggaccacagt

SEQ ID NO: 1925696 - DNA, 15 bp, Homo sapiens
gtaaatatcccagag

SEQ ID NO: 1925697 - DNA, 14 bp, Homo sapiens
gtaaatattcttgt

SEQ ID NO: 1925698 - DNA, 17 bp, Homo sapiens
gtaaatgtttaatatct

SEQ ID NO: 1925699 - DNA, 15 bp, Homo sapiens
gtaactttgcatgtt

SEQ ID NO: 1925700 - DNA, 18 bp, Homo sapiens
gtaactttgcatgttctt

SEQ ID NO: 1925701 - DNA, 17 bp, Homo sapiens
gtaataatattttagaa

SEQ ID NO: 1925702 - DNA, 22 bp, Homo sapiens
gtaataatattttagaaaatgt

SEQ ID NO: 1925703 - DNA, 15 bp, Homo sapiens
gtaattagtaacatg

SEQ ID NO: 1925704 - DNA, 15 bp, Homo sapiens
gtaattctaaatgaa

SEQ ID NO: 1925705 - DNA, 20 bp, Homo sapiens
ttcacatctaacctcatctt

SEQ ID NO: 1925706 - DNA, 18 bp, Homo sapiens
ttcacatgcatcaagtta

SEQ ID NO: 1925707 - DNA, 16 bp, Homo sapiens
ttcactgctggctgcc

SEQ ID NO: 1925708 - DNA, 18 bp, Homo sapiens
ttcactgctggctgcctt

SEQ ID NO: 1925709 - DNA, 15 bp, Homo sapiens
ttcagaaagaagtgg

SEQ ID NO: 1925710 - DNA, 22 bp, Homo sapiens
ttcagaaagggcagcccctccc

SEQ ID NO: 1925711 - DNA, 13 bp, Homo sapiens
ttcagaagttgtt

SEQ ID NO: 1925712 - DNA, 17 bp, Homo sapiens
ttcagactctctcctct

SEQ ID NO: 1925713 - DNA, 20 bp, Homo sapiens
ttcagactctctcctctctc

SEQ ID NO: 1925714 - DNA, 22 bp, Homo sapiens
ttcagaggccctcgctgccagc

SEQ ID NO: 1925715 - DNA, 15 bp, Homo sapiens
ttcaggctcttctcc

SEQ ID NO: 1925716 - DNA, 16 bp, Homo sapiens
ttcaggctcttctcct

SEQ ID NO: 1925717 - DNA, 13 bp, Homo sapiens
ttcagggggccag

SEQ ID NO: 1925718 - DNA, 18 bp, Homo sapiens
ttcagtgttaaatgtgat

SEQ ID NO: 1925719 - DNA, 18 bp, Homo sapiens
ttcatacacagcctgggc

SEQ ID NO: 1925720 - DNA, 15 bp, Homo sapiens
ttcatagtttctgta

SEQ ID NO: 1925721 - DNA, 16 bp, Homo sapiens
ttcatagtttctgtaa

SEQ ID NO: 1925722 - DNA, 17 bp, Homo sapiens
ttcatagtttctgtaat

SEQ ID NO: 1925723 - DNA, 14 bp, Homo sapiens
ttcatctttccaaa

SEQ ID NO: 1925724 - DNA, 16 bp, Homo sapiens
ttcatctttccaaatt

SEQ ID NO: 1925725 - DNA, 17 bp, Homo sapiens
ttcatggcagaaggcaa

SEQ ID NO: 1925726 - DNA, 14 bp, Homo sapiens
ttcatgtaaactgt

SEQ ID NO: 1925727 - DNA, 19 bp, Homo sapiens
ttcatgtaaactgtgcacc

SEQ ID NO: 1925728 - DNA, 23 bp, Homo sapiens
ttcatgtaagtagcaaacagggc

SEQ ID NO: 1925729 - DNA, 9 bp, Homo sapiens
ttcattcag

SEQ ID NO: 1925730 - DNA, 19 bp, Homo sapiens
ttcatttggaaataagctg

SEQ ID NO: 1925731 - DNA, 16 bp, Homo sapiens
ttccaaattgatgggt

SEQ ID NO: 1925732 - DNA, 14 bp, Homo sapiens
ttccaagcctgggc

SEQ ID NO: 1925733 - DNA, 22 bp, Homo sapiens
ttccaagcctgggccactggca

SEQ ID NO: 1925734 - DNA, 12 bp, Homo sapiens
ttccaatgtgcc

SEQ ID NO: 1925735 - DNA, 14 bp, Homo sapiens
ttccaatgtgccca

SEQ ID NO: 1925736 - DNA, 20 bp, Homo sapiens
ttccaatgtgcccagtcatg

SEQ ID NO: 1925737 - DNA, 22 bp, Homo sapiens
ttccacggagccactcctctga

SEQ ID NO: 1925738 - DNA, 18 bp, Homo sapiens
ttccactaccctccctcg

SEQ ID NO: 1925739 - DNA, 16 bp, Homo sapiens
ttccactgagggcagt

SEQ ID NO: 1925740 - DNA, 20 bp, Homo sapiens
ttccagagagtggctcctcc

SEQ ID NO: 1925741 - DNA, 21 bp, Homo sapiens
ttccagcagtgaaacttgtgc

SEQ ID NO: 1925742 - DNA, 15 bp, Homo sapiens
ttccatcagcagtga

SEQ ID NO: 1925743 - DNA, 20 bp, Homo sapiens
ttccatcctgtacaagtgct

SEQ ID NO: 1925744 - DNA, 22 bp, Homo sapiens
ttcccactgcggaacaggagtg

SEQ ID NO: 1925745 - DNA, 18 bp, Homo sapiens
ttcccagctgctcctaga

SEQ ID NO: 1925746 - DNA, 13 bp, Homo sapiens
ttcccccttcccc

SEQ ID NO: 1925747 - DNA, 15 bp, Homo sapiens
ttcccccttcccctg

SEQ ID NO: 1925748 - DNA, 17 bp, Homo sapiens
ttcccctgcgccctccc

SEQ ID NO: 1925749 - DNA, 14 bp, Homo sapiens
ttcccctgttcact

SEQ ID NO: 1925750 - DNA, 12 bp, Homo sapiens
ttcccgctcagc

SEQ ID NO: 1925751 - DNA, 15 bp, Homo sapiens
aaaccaggctgcagg

SEQ ID NO: 1925752 - DNA, 20 bp, Homo sapiens
aaacccgacaacatttctgc

SEQ ID NO: 1925753 - DNA, 21 bp, Homo sapiens
aaacccgacaacatttctgcc

SEQ ID NO: 1925754 - DNA, 14 bp, Homo sapiens
aaactactgtacat

SEQ ID NO: 1925755 - DNA, 15 bp, Homo sapiens
aaactactgtacatt

SEQ ID NO: 1925756 - DNA, 14 bp, Homo sapiens
aaactgagtcctgt

SEQ ID NO: 1925757 - DNA, 21 bp, Homo sapiens
aaacttgtgctatagtgtata

SEQ ID NO: 1925758 - DNA, 11 bp, Homo sapiens
aaactttcagc

SEQ ID NO: 1925759 - DNA, 18 bp, Homo sapiens
aaagaaagcctcagagaa

SEQ ID NO: 1925760 - DNA, 21 bp, Homo sapiens
aaagaaccaggaggcctggga

SEQ ID NO: 1925761 - DNA, 16 bp, Homo sapiens
aaagaacccccctccc

SEQ ID NO: 1925762 - DNA, 18 bp, Homo sapiens
aaagaacccccctcccca

SEQ ID NO: 1925763 - DNA, 13 bp, Homo sapiens
aaagacacctact

SEQ ID NO: 1925764 - DNA, 19 bp, Homo sapiens
aaagacattctgacatctt

SEQ ID NO: 1925765 - DNA, 20 bp, Homo sapiens
aaagcaaggaaactatgtaa

SEQ ID NO: 1925766 - DNA, 14 bp, Homo sapiens
aaagcaatatgcat

SEQ ID NO: 1925767 - DNA, 21 bp, Homo sapiens
aaagcaccatcatcatagagg

SEQ ID NO: 1925768 - DNA, 18 bp, Homo sapiens
aaagcatctattcccaaa

SEQ ID NO: 1925769 - DNA, 20 bp, Homo sapiens
aaagccaaatcaaaatatgt

SEQ ID NO: 1925770 - DNA, 15 bp, Homo sapiens
aaagccatattccag

SEQ ID NO: 1925771 - DNA, 16 bp, Homo sapiens
aaaggcagagattggg

SEQ ID NO: 1925772 - DNA, 13 bp, Homo sapiens
aaagtaaaattat

SEQ ID NO: 1925773 - DNA, 18 bp, Homo sapiens
aaagtacctattgaacat

SEQ ID NO: 1925774 - DNA, 15 bp, Homo sapiens
aaagtcttctttcat

SEQ ID NO: 1925775 - DNA, 14 bp, Homo sapiens
aaagtgagaaatta

SEQ ID NO: 1925776 - DNA, 16 bp, Homo sapiens
aaagttttaacctcag

SEQ ID NO: 1925777 - DNA, 17 bp, Homo sapiens
aaataaaaataagtcat

SEQ ID NO: 1925778 - DNA, 22 bp, Homo sapiens
aaatacagtcttccatttgcaa

SEQ ID NO: 1925779 - DNA, 15 bp, Homo sapiens
aaatatatttaacta

SEQ ID NO: 1925780 - DNA, 13 bp, Homo sapiens
aaatatcccagag

SEQ ID NO: 1925781 - DNA, 15 bp, Homo sapiens
aaatatctatttatc

SEQ ID NO: 1925782 - DNA, 21 bp, Homo sapiens
aaatatctatttatctgtctg

SEQ ID NO: 1925783 - DNA, 19 bp, Homo sapiens
aaatatgcactttccctag

SEQ ID NO: 1925784 - DNA, 20 bp, Homo sapiens
aaatatgtgagcatgaaact

SEQ ID NO: 1925785 - DNA, 21 bp, Homo sapiens
aaatatttctatgtaaattat

SEQ ID NO: 1925786 - DNA, 19 bp, Homo sapiens
aaatcaatgctataactat

SEQ ID NO: 1925787 - DNA, 12 bp, Homo sapiens
aaatcagaatct

SEQ ID NO: 1925788 - DNA, 14 bp, Homo sapiens
aaatcagaatcttt

SEQ ID NO: 1925789 - DNA, 12 bp, Homo sapiens
aaatccaagact

SEQ ID NO: 1925790 - DNA, 18 bp, Homo sapiens
aaatccacaccagtccac

SEQ ID NO: 1925791 - DNA, 22 bp, Homo sapiens
aaatcctagagattcttagctc

SEQ ID NO: 1925792 - DNA, 20 bp, Homo sapiens
aaatggtcagtgtgcaaaga

SEQ ID NO: 1925793 - DNA, 22 bp, Homo sapiens
aaatgtctttccttttgctctt

SEQ ID NO: 1925794 - DNA, 13 bp, Homo sapiens
aaatgtgatgaat

SEQ ID NO: 1925795 - DNA, 21 bp, Homo sapiens
aaatgtgatgaatactgtatt

SEQ ID NO: 1925796 - DNA, 16 bp, Homo sapiens
aaatgtgtttaaaaca

SEQ ID NO: 1925797 - DNA, 21 bp, Homo sapiens
aaatgttattttttaattatt

SEQ ID NO: 1925798 - DNA, 16 bp, Homo sapiens
aaatgttcacttttga

SEQ ID NO: 1925799 - DNA, 12 bp, Homo sapiens
aaatgtttggaa

SEQ ID NO: 1925800 - DNA, 20 bp, Homo sapiens
aaatgtttggaatttaagaa

SEQ ID NO: 1925801 - DNA, 21 bp, Homo sapiens
aaattacagaagaagctcctg

SEQ ID NO: 1925802 - DNA, 16 bp, Homo sapiens
aaattattgtaaactt

SEQ ID NO: 1925803 - DNA, 17 bp, Homo sapiens
aaattattgtaaacttt

SEQ ID NO: 1925804 - DNA, 23 bp, Homo sapiens
aaattattgtaaactttttcaat

SEQ ID NO: 1925805 - DNA, 17 bp, Homo sapiens
aaattcacttctatata

SEQ ID NO: 1925806 - DNA, 16 bp, Homo sapiens
aaattgatgggtgggc

SEQ ID NO: 1925807 - DNA, 20 bp, Homo sapiens
aaattgcagaagaaactcct

SEQ ID NO: 1925808 - DNA, 18 bp, Homo sapiens
aaattgcatttcctgaca

SEQ ID NO: 1925809 - DNA, 21 bp, Homo sapiens
aaattgccttctagacactga

SEQ ID NO: 1925810 - DNA, 13 bp, Homo sapiens
aacaaaaattgtc

SEQ ID NO: 1925811 - DNA, 18 bp, Homo sapiens
aacaaagtcaagattccc

SEQ ID NO: 1925812 - DNA, 14 bp, Homo sapiens
aacaaattaaaaac

SEQ ID NO: 1925813 - DNA, 12 bp, Homo sapiens
aacaacagaaac

SEQ ID NO: 1925814 - DNA, 14 bp, Homo sapiens
aacaatatatgtaa

SEQ ID NO: 1925815 - DNA, 23 bp, Homo sapiens
aacaattttaggaggaccagagc

SEQ ID NO: 1925816 - DNA, 20 bp, Homo sapiens
aacacccagtctgttcccca

SEQ ID NO: 1925817 - DNA, 13 bp, Homo sapiens
aacacgtttagaa

SEQ ID NO: 1925818 - DNA, 16 bp, Homo sapiens
aacactgaacctctgg

SEQ ID NO: 1925819 - DNA, 22 bp, Homo sapiens
aacactgtgcacatctgtgtct

SEQ ID NO: 1925820 - DNA, 14 bp, Homo sapiens
aacagcaaataacc

SEQ ID NO: 1925821 - DNA, 22 bp, Homo sapiens
aacagcctgtttgggaggctgg

SEQ ID NO: 1925822 - DNA, 24 bp, Homo sapiens
aacagctaggttaataggaggaca

SEQ ID NO: 1925823 - DNA, 15 bp, Homo sapiens
aacaggagtgactct

SEQ ID NO: 1925824 - DNA, 19 bp, Homo sapiens
aacaggattagacagtcaa

SEQ ID NO: 1925825 - DNA, 23 bp, Homo sapiens
aacaggttgaggctaaaacaaat

SEQ ID NO: 1925826 - DNA, 21 bp, Homo sapiens
aacagttttttatgctaatca

SEQ ID NO: 1925827 - DNA, 15 bp, Homo sapiens
aacataactgtaaca

SEQ ID NO: 1925828 - DNA, 20 bp, Homo sapiens
aacataactgtaacatatat

SEQ ID NO: 1925829 - DNA, 13 bp, Homo sapiens
aacatataatgtt

SEQ ID NO: 1925830 - DNA, 17 bp, Homo sapiens
aacatcaagataccttt

SEQ ID NO: 1925831 - DNA, 23 bp, Homo sapiens
aacatggccacatccaacatttc

SEQ ID NO: 1925832 - DNA, 17 bp, Homo sapiens
aaccaacgggtctgtgg

SEQ ID NO: 1925833 - DNA, 17 bp, Homo sapiens
aaccacctctggccctg

SEQ ID NO: 1925834 - DNA, 21 bp, Homo sapiens
aaccagaagcaacagaaaaaa

SEQ ID NO: 1925835 - DNA, 17 bp, Homo sapiens
aaccagaatgattttga

SEQ ID NO: 1925836 - DNA, 16 bp, Homo sapiens
aaccattaccttaaaa

SEQ ID NO: 1925837 - DNA, 21 bp, Homo sapiens
aacccctaatcgccctgagct

SEQ ID NO: 1925838 - DNA, 16 bp, Homo sapiens
aaccctacactcggaa

SEQ ID NO: 1925839 - DNA, 12 bp, Homo sapiens
aaccctcagagc

SEQ ID NO: 1925840 - DNA, 19 bp, Homo sapiens
aaccctcagagccacccct

SEQ ID NO: 1925841 - DNA, 14 bp, Homo sapiens
aacccttgaaaaga

SEQ ID NO: 1925842 - DNA, 15 bp, Homo sapiens
aacccttgaaaagac

SEQ ID NO: 1925843 - DNA, 16 bp, Homo sapiens
aacctcaggttccaaa

SEQ ID NO: 1925844 - DNA, 15 bp, Homo sapiens
aacgctcagcgctgg

SEQ ID NO: 1925845 - DNA, 13 bp, Homo sapiens
aacgggtctgtgg

SEQ ID NO: 1925846 - DNA, 16 bp, Homo sapiens
aactaagcacattatg

SEQ ID NO: 1925847 - DNA, 19 bp, Homo sapiens
aactaagcacattatgttt

SEQ ID NO: 1925848 - DNA, 15 bp, Homo sapiens
aactatgcacctata

SEQ ID NO: 1925849 - DNA, 24 bp, Homo sapiens
aactatgcacctataaatactaaa

SEQ ID NO: 1925850 - DNA, 19 bp, Homo sapiens
aactatgcgtaaatcaact

SEQ ID NO: 1925851 - DNA, 15 bp, Homo sapiens
aactatgttgataaa

SEQ ID NO: 1925852 - DNA, 19 bp, Homo sapiens
aactatttagagaatgatt

SEQ ID NO: 1925853 - DNA, 20 bp, Homo sapiens
aactatttagagaatgattt

SEQ ID NO: 1925854 - DNA, 20 bp, Homo sapiens
aactcctggatccctttcac

SEQ ID NO: 1925855 - DNA, 12 bp, Homo sapiens
aactctttcaaa

SEQ ID NO: 1925856 - DNA, 13 bp, Homo sapiens
aactctttcaaaa

SEQ ID NO: 1925857 - DNA, 14 bp, Homo sapiens
aactgcagggaaaa

SEQ ID NO: 1925858 - DNA, 14 bp, Homo sapiens
aactgcttgcattt

SEQ ID NO: 1925859 - DNA, 20 bp, Homo sapiens
aacttctgaatattggacat

SEQ ID NO: 1925860 - DNA, 16 bp, Homo sapiens
aacttgtcacaaagtg

SEQ ID NO: 1925861 - DNA, 23 bp, Homo sapiens
aacttgtgttactaatttgtata

SEQ ID NO: 1925862 - DNA, 17 bp, Homo sapiens
aactttgcatgttcttg

SEQ ID NO: 1925863 - DNA, 19 bp, Homo sapiens
aagaaacaactctttgaga

SEQ ID NO: 1925864 - DNA, 21 bp, Homo sapiens
aagaaactattttttaaaaat

SEQ ID NO: 1925865 - DNA, 22 bp, Homo sapiens
aagaagacggattatctagaga

SEQ ID NO: 1925866 - DNA, 14 bp, Homo sapiens
aagaaggaggaatt

SEQ ID NO: 1925867 - DNA, 23 bp, Homo sapiens
aagaaggtttcagaaagaagtgg

SEQ ID NO: 1925868 - DNA, 13 bp, Homo sapiens
aagaagtgggagt

SEQ ID NO: 1925869 - DNA, 20 bp, Homo sapiens
aagaagtgggagtgggagag

SEQ ID NO: 1925870 - DNA, 23 bp, Homo sapiens
aagaatagggagacaatctaaaa

SEQ ID NO: 1925871 - DNA, 17 bp, Homo sapiens
aagacaccttcccagct

SEQ ID NO: 1925872 - DNA, 13 bp, Homo sapiens
aagacagaagcct

SEQ ID NO: 1925873 - DNA, 19 bp, Homo sapiens
aagacagcagagccatctg

SEQ ID NO: 1925874 - DNA, 18 bp, Homo sapiens
aagagaaagtacaaccac

SEQ ID NO: 1925875 - DNA, 15 bp, Homo sapiens
aagagaatccacata

SEQ ID NO: 1925876 - DNA, 14 bp, Homo sapiens
aagagctcaggaga

SEQ ID NO: 1925877 - DNA, 17 bp, Homo sapiens
aagagctcaggagaagg

SEQ ID NO: 1925878 - DNA, 19 bp, Homo sapiens
aagagctcaggagaaggcc

SEQ ID NO: 1925879 - DNA, 17 bp, Homo sapiens
aagagggagaaggagag

SEQ ID NO: 1925880 - DNA, 20 bp, Homo sapiens
aagagtagaaactgcaggga

SEQ ID NO: 1925881 - DNA, 15 bp, Homo sapiens
aagataatatttaaa

SEQ ID NO: 1925882 - DNA, 19 bp, Homo sapiens
aagatattttaaaatctgt

SEQ ID NO: 1925883 - DNA, 21 bp, Homo sapiens
agaaggcctgccccccttccc

SEQ ID NO: 1925884 - DNA, 22 bp, Homo sapiens
agaaggcctgccccccttccca

SEQ ID NO: 1925885 - DNA, 20 bp, Homo sapiens
agaagtgggagtgggagagg

SEQ ID NO: 1925886 - DNA, 22 bp, Homo sapiens
agaagtgggattcaggaatggg

SEQ ID NO: 1925887 - DNA, 14 bp, Homo sapiens
agaataataagagg

SEQ ID NO: 1925888 - DNA, 16 bp, Homo sapiens
agaatagatgctgact

SEQ ID NO: 1925889 - DNA, 17 bp, Homo sapiens
agaatataaacacataa

SEQ ID NO: 1925890 - DNA, 21 bp, Homo sapiens
agaatccacataaaagaagaa

SEQ ID NO: 1925891 - DNA, 23 bp, Homo sapiens
agaatcccatggatgtttcttct

SEQ ID NO: 1925892 - DNA, 14 bp, Homo sapiens
agaatgagagagtg

SEQ ID NO: 1925893 - DNA, 15 bp, Homo sapiens
agaatgagagagtgt

SEQ ID NO: 1925894 - DNA, 23 bp, Homo sapiens
agaatggtgggctccagagtagg

SEQ ID NO: 1925895 - DNA, 17 bp, Homo sapiens
agaatttgagtgctctg

SEQ ID NO: 1925896 - DNA, 20 bp, Homo sapiens
agacaatctaaaaaatatct

SEQ ID NO: 1925897 - DNA, 14 bp, Homo sapiens
agacactgaaggca

SEQ ID NO: 1925898 - DNA, 16 bp, Homo sapiens
agacactgaaggcaaa

SEQ ID NO: 1925899 - DNA, 14 bp, Homo sapiens
agacagagtggatc

SEQ ID NO: 1925900 - DNA, 17 bp, Homo sapiens
agacagcagagccatct

SEQ ID NO: 1925901 - DNA, 13 bp, Homo sapiens
agacagtattgcc

SEQ ID NO: 1925902 - DNA, 14 bp, Homo sapiens
agacagtattgcca

SEQ ID NO: 1925903 - DNA, 21 bp, Homo sapiens
agacagtattgccacctctgg

SEQ ID NO: 1925904 - DNA, 17 bp, Homo sapiens
agacagtcaaggagtgg

SEQ ID NO: 1925905 - DNA, 17 bp, Homo sapiens
agacatcaagcacagaa

SEQ ID NO: 1925906 - DNA, 16 bp, Homo sapiens
agacatggggaggaag

SEQ ID NO: 1925907 - DNA, 18 bp, Homo sapiens
agacatggggaggaagga

SEQ ID NO: 1925908 - DNA, 17 bp, Homo sapiens
agacccagccctcatcc

SEQ ID NO: 1925909 - DNA, 19 bp, Homo sapiens
agacccagccctcatcccg

SEQ ID NO: 1925910 - DNA, 12 bp, Homo sapiens
agaccctgtctt

SEQ ID NO: 1925911 - DNA, 13 bp, Homo sapiens
agaccctgtcttt

SEQ ID NO: 1925912 - DNA, 13 bp, Homo sapiens
agacctgtaatca

SEQ ID NO: 1925913 - DNA, 12 bp, Homo sapiens
agaccttctctt

SEQ ID NO: 1925914 - DNA, 15 bp, Homo sapiens
agaccttcttccaca

SEQ ID NO: 1925915 - DNA, 22 bp, Homo sapiens
agacggattatctagagaataa

SEQ ID NO: 1925916 - DNA, 21 bp, Homo sapiens
agacggtagaattaaagaaga

SEQ ID NO: 1925917 - DNA, 17 bp, Homo sapiens
agactctctcctctctc

SEQ ID NO: 1925918 - DNA, 21 bp, Homo sapiens
agactgagcttgattctaaag

SEQ ID NO: 1925919 - DNA, 12 bp, Homo sapiens
agactgggctga

SEQ ID NO: 1925920 - DNA, 15 bp, Homo sapiens
agactgggctgaggg

SEQ ID NO: 1925921 - DNA, 20 bp, Homo sapiens
agactgggctgagggagcct

SEQ ID NO: 1925922 - DNA, 19 bp, Homo sapiens
agactttttttaaatagta

SEQ ID NO: 1925923 - DNA, 23 bp, Homo sapiens
agagaatccctagtcttcaagca

SEQ ID NO: 1925924 - DNA, 17 bp, Homo sapiens
agagaatgagagagtgt

SEQ ID NO: 1925925 - DNA, 14 bp, Homo sapiens
agagaccttctctt

SEQ ID NO: 1925926 - DNA, 16 bp, Homo sapiens
agagagtggctcctcc

SEQ ID NO: 1925927 - DNA, 12 bp, Homo sapiens
agagattcttag

SEQ ID NO: 1925928 - DNA, 13 bp, Homo sapiens
agagatttcatag

SEQ ID NO: 1925929 - DNA, 22 bp, Homo sapiens
agagcaggcaccagcagcagaa

SEQ ID NO: 1925930 - DNA, 19 bp, Homo sapiens
agagccaaggcctatgcca

SEQ ID NO: 1925931 - DNA, 24 bp, Homo sapiens
agagccaaggcctatgccacctgc

SEQ ID NO: 1925932 - DNA, 15 bp, Homo sapiens
agagccaccaagagg

SEQ ID NO: 1925933 - DNA, 15 bp, Homo sapiens
agagcccaatcactg

SEQ ID NO: 1925934 - DNA, 19 bp, Homo sapiens
agagcccaatcactgccta

SEQ ID NO: 1925935 - DNA, 21 bp, Homo sapiens
agagcctatggaaagggtgtg

SEQ ID NO: 1925936 - DNA, 11 bp, Homo sapiens
agagcctgagg

SEQ ID NO: 1925937 - DNA, 13 bp, Homo sapiens
agagcctgaggga

SEQ ID NO: 1925938 - DNA, 15 bp, Homo sapiens
agagcgctggcctct

SEQ ID NO: 1925939 - DNA, 16 bp, Homo sapiens
agagcgctggcctctt

SEQ ID NO: 1925940 - DNA, 19 bp, Homo sapiens
agagctgtattaagccact

SEQ ID NO: 1925941 - DNA, 12 bp, Homo sapiens
agagcttccctg

SEQ ID NO: 1925942 - DNA, 20 bp, Homo sapiens
agagcttccctgactcattc

SEQ ID NO: 1925943 - DNA, 18 bp, Homo sapiens
agaggaaggggccagagg

SEQ ID NO: 1925944 - DNA, 14 bp, Homo sapiens
agaggacgtgggcg

SEQ ID NO: 1925945 - DNA, 18 bp, Homo sapiens
agaggaggtgtggagtgg

SEQ ID NO: 1925946 - DNA, 14 bp, Homo sapiens
agaggagtcagaga

SEQ ID NO: 1925947 - DNA, 16 bp, Homo sapiens
agaggatgatgtaatt

SEQ ID NO: 1925948 - DNA, 16 bp, Homo sapiens
agaggcagtggcagca

SEQ ID NO: 1925949 - DNA, 22 bp, Homo sapiens
agaggctcgttgactggctgtg

SEQ ID NO: 1925950 - DNA, 13 bp, Homo sapiens
agaggctgctgtc

SEQ ID NO: 1925951 - DNA, 15 bp, Homo sapiens
agaggctgctgtcac

SEQ ID NO: 1925952 - DNA, 23 bp, Homo sapiens
agagggatccaccgccacactgg

SEQ ID NO: 1925953 - DNA, 19 bp, Homo sapiens
agaggggacaagccaggcc

SEQ ID NO: 1925954 - DNA, 19 bp, Homo sapiens
agagtaaatattgtcacaa

SEQ ID NO: 1925955 - DNA, 20 bp, Homo sapiens
agagtagacctgagatgctg

SEQ ID NO: 1925956 - DNA, 16 bp, Homo sapiens
agagtcagcagaactg

SEQ ID NO: 1925957 - DNA, 22 bp, Homo sapiens
agagtcgagtgatatggcttgt

SEQ ID NO: 1925958 - DNA, 16 bp, Homo sapiens
agagtgccatccctga

SEQ ID NO: 1925959 - DNA, 19 bp, Homo sapiens
agagtggctcctcccggtg

SEQ ID NO: 1925960 - DNA, 22 bp, Homo sapiens
agataaaaacaatatatgtaaa

SEQ ID NO: 1925961 - DNA, 23 bp, Homo sapiens
agataatatttaaaatagttcca

SEQ ID NO: 1925962 - DNA, 18 bp, Homo sapiens
agataatgtgaaaatggt

SEQ ID NO: 1925963 - DNA, 20 bp, Homo sapiens
agatacagaactctttcaaa

SEQ ID NO: 1925964 - DNA, 16 bp, Homo sapiens
agatatgtattacttt

SEQ ID NO: 1925965 - DNA, 23 bp, Homo sapiens
agatatttacatgaattgcattt

SEQ ID NO: 1925966 - DNA, 18 bp, Homo sapiens
agatcacgttccttcccc

SEQ ID NO: 1925967 - DNA, 21 bp, Homo sapiens
agatcaggtcagagcccagga

SEQ ID NO: 1925968 - DNA, 19 bp, Homo sapiens
agatctaggtgaggattga

SEQ ID NO: 1925969 - DNA, 14 bp, Homo sapiens
agatgaaattgcca

SEQ ID NO: 1925970 - DNA, 14 bp, Homo sapiens
agatgacagaaata

SEQ ID NO: 1925971 - DNA, 14 bp, Homo sapiens
agatgagtcctgtt

SEQ ID NO: 1925972 - DNA, 13 bp, Homo sapiens
agatgcatctgtg

SEQ ID NO: 1925973 - DNA, 21 bp, Homo sapiens
agatgttctaagtctttccat

SEQ ID NO: 1925974 - DNA, 15 bp, Homo sapiens
agattagatctttta

SEQ ID NO: 1925975 - DNA, 19 bp, Homo sapiens
agattccagagagtggctc

SEQ ID NO: 1925976 - DNA, 16 bp, Homo sapiens
agattgggggggcttg

SEQ ID NO: 1925977 - DNA, 15 bp, Homo sapiens
agcaaataaccattg

SEQ ID NO: 1925978 - DNA, 21 bp, Homo sapiens
agcaaatgagatgtatgccca

SEQ ID NO: 1925979 - DNA, 19 bp, Homo sapiens
agcaacaaaggatttgaaa

SEQ ID NO: 1925980 - DNA, 14 bp, Homo sapiens
agcaagagatgaga

SEQ ID NO: 1925981 - DNA, 13 bp, Homo sapiens
agcacagaaggag

SEQ ID NO: 1925982 - DNA, 12 bp, Homo sapiens
agcacagagagg

SEQ ID NO: 1925983 - DNA, 23 bp, Homo sapiens
agcacagagagggggccacctcc

SEQ ID NO: 1925984 - DNA, 16 bp, Homo sapiens
agcactgagcaaagca

SEQ ID NO: 1925985 - DNA, 17 bp, Homo sapiens
agcactgcttgaggaaa

SEQ ID NO: 1925986 - DNA, 22 bp, Homo sapiens
agcactttgaaaatatttctat

SEQ ID NO: 1925987 - DNA, 16 bp, Homo sapiens
agcagagccatctgcg

SEQ ID NO: 1925988 - DNA, 23 bp, Homo sapiens
agcagagtaaaattacagaagaa

SEQ ID NO: 1925989 - DNA, 18 bp, Homo sapiens
agcagcttagactaaggc

SEQ ID NO: 1925990 - DNA, 16 bp, Homo sapiens
agcaggagcatggccg

SEQ ID NO: 1925991 - DNA, 20 bp, Homo sapiens
agcaggcaccagcagcagaa

SEQ ID NO: 1925992 - DNA, 23 bp, Homo sapiens
agcagggctaccctgagctgagg

SEQ ID NO: 1925993 - DNA, 15 bp, Homo sapiens
agcagggctgggcgc

SEQ ID NO: 1925994 - DNA, 20 bp, Homo sapiens
agcaggggggttgggttcca

SEQ ID NO: 1925995 - DNA, 22 bp, Homo sapiens
agcaggggggttgggttccaga

SEQ ID NO: 1925996 - DNA, 23 bp, Homo sapiens
agcaggggggttgggttccagac

SEQ ID NO: 1925997 - DNA, 20 bp, Homo sapiens
agcagtgaatgattcagtgt

SEQ ID NO: 1925998 - DNA, 21 bp, Homo sapiens
agcagtgaatgattcagtgtt

SEQ ID NO: 1925999 - DNA, 21 bp, Homo sapiens
agcagtgattgaagtatctgt

SEQ ID NO: 1926000 - DNA, 23 bp, Homo sapiens
agcataagtttctgggacctcag

SEQ ID NO: 1926001 - DNA, 23 bp, Homo sapiens
agcatatgaggatgcagagtcag

SEQ ID NO: 1926002 - DNA, 17 bp, Homo sapiens
agcattatttgaaaaca

SEQ ID NO: 1926003 - DNA, 18 bp, Homo sapiens
agcattctcactcctacc

SEQ ID NO: 1926004 - DNA, 20 bp, Homo sapiens
agcattctcactcctacctg

SEQ ID NO: 1926005 - DNA, 16 bp, Homo sapiens
agcattctggggtggg

SEQ ID NO: 1926006 - DNA, 20 bp, Homo sapiens
agcattctggggtggggctt

SEQ ID NO: 1926007 - DNA, 13 bp, Homo sapiens
agccacaggcaga

SEQ ID NO: 1926008 - DNA, 14 bp, Homo sapiens
agccacaggcagac

SEQ ID NO: 1926009 - DNA, 19 bp, Homo sapiens
agccacccagccaggaggg

SEQ ID NO: 1926010 - DNA, 18 bp, Homo sapiens
agccacgtgctggagagt

SEQ ID NO: 1926011 - DNA, 13 bp, Homo sapiens
agccactcctctg

SEQ ID NO: 1926012 - DNA, 14 bp, Homo sapiens
agccactcctctga

SEQ ID NO: 1926013 - DNA, 16 bp, Homo sapiens
agccagcagctgaagt

SEQ ID NO: 1926014 - DNA, 17 bp, Homo sapiens
agccagcgtcctcctct

SEQ ID NO: 1926015 - DNA, 21 bp, Homo sapiens
atgagatgtatgcccaaagac

SEQ ID NO: 1926016 - DNA, 12 bp, Homo sapiens
atgagctgggcc

SEQ ID NO: 1926017 - DNA, 18 bp, Homo sapiens
atgagctgggccctgggt

SEQ ID NO: 1926018 - DNA, 22 bp, Homo sapiens
atgaggatgcagagtcagcaga

SEQ ID NO: 1926019 - DNA, 13 bp, Homo sapiens
atgagtcctgtta

SEQ ID NO: 1926020 - DNA, 17 bp, Homo sapiens
atgatactgtctaagaa

SEQ ID NO: 1926021 - DNA, 17 bp, Homo sapiens
atgatgtccttgttatt

SEQ ID NO: 1926022 - DNA, 15 bp, Homo sapiens
atgattctcctctcc

SEQ ID NO: 1926023 - DNA, 15 bp, Homo sapiens
atgcacctataaata

SEQ ID NO: 1926024 - DNA, 22 bp, Homo sapiens
atgcactgttccccctgtgcag

SEQ ID NO: 1926025 - DNA, 16 bp, Homo sapiens
atgcactttccctaga

SEQ ID NO: 1926026 - DNA, 15 bp, Homo sapiens
atgcagagtcagcag

SEQ ID NO: 1926027 - DNA, 16 bp, Homo sapiens
atgcagagtcagcaga

SEQ ID NO: 1926028 - DNA, 19 bp, Homo sapiens
atgcccagcttggagtgcc

SEQ ID NO: 1926029 - DNA, 23 bp, Homo sapiens
atgcctcctctgtcctcattctt

SEQ ID NO: 1926030 - DNA, 18 bp, Homo sapiens
atgcctgacacaggggac

SEQ ID NO: 1926031 - DNA, 12 bp, Homo sapiens
atgcctgcctga

SEQ ID NO: 1926032 - DNA, 16 bp, Homo sapiens
atgctctctatagagg

SEQ ID NO: 1926033 - DNA, 20 bp, Homo sapiens
atgctgactgtactcctccc

SEQ ID NO: 1926034 - DNA, 14 bp, Homo sapiens
atgcttctgctcac

SEQ ID NO: 1926035 - DNA, 22 bp, Homo sapiens
atgcttctgctcacattccctc

SEQ ID NO: 1926036 - DNA, 18 bp, Homo sapiens
atggagactgtctcaaga

SEQ ID NO: 1926037 - DNA, 22 bp, Homo sapiens
atggaggaaaaccaagccgtgg

SEQ ID NO: 1926038 - DNA, 12 bp, Homo sapiens
atggaggcacac

SEQ ID NO: 1926039 - DNA, 16 bp, Homo sapiens
atggatgtttcttctt

SEQ ID NO: 1926040 - DNA, 15 bp, Homo sapiens
atggcagaaggcaaa

SEQ ID NO: 1926041 - DNA, 17 bp, Homo sapiens
atggccacatccaacat

SEQ ID NO: 1926042 - DNA, 16 bp, Homo sapiens
atggccaggtggccac

SEQ ID NO: 1926043 - DNA, 18 bp, Homo sapiens
atggcccagcctggagcc

SEQ ID NO: 1926044 - DNA, 15 bp, Homo sapiens
atggccgctgcccac

SEQ ID NO: 1926045 - DNA, 19 bp, Homo sapiens
atggcttgtagggtgaggc

SEQ ID NO: 1926046 - DNA, 19 bp, Homo sapiens
atggctttaacagtaatgt

SEQ ID NO: 1926047 - DNA, 14 bp, Homo sapiens
atgggaaggaggga

SEQ ID NO: 1926048 - DNA, 20 bp, Homo sapiens
atgggagccgggtctgcctc

SEQ ID NO: 1926049 - DNA, 20 bp, Homo sapiens
atgggaggaaaagcccagga

SEQ ID NO: 1926050 - DNA, 18 bp, Homo sapiens
atgggagtaagagcaaat

SEQ ID NO: 1926051 - DNA, 15 bp, Homo sapiens
atgggccaagccagg

SEQ ID NO: 1926052 - DNA, 23 bp, Homo sapiens
atgggccaagccagggttccaga

SEQ ID NO: 1926053 - DNA, 15 bp, Homo sapiens
atggggagaaaagac

SEQ ID NO: 1926054 - DNA, 18 bp, Homo sapiens
atggggtgggagccacag

SEQ ID NO: 1926055 - DNA, 18 bp, Homo sapiens
atggtccaggagaaggcc

SEQ ID NO: 1926056 - DNA, 14 bp, Homo sapiens
atggtgatgaaatg

SEQ ID NO: 1926057 - DNA, 13 bp, Homo sapiens
atggtgcccttgg

SEQ ID NO: 1926058 - DNA, 14 bp, Homo sapiens
atggtggagggcca

SEQ ID NO: 1926059 - DNA, 20 bp, Homo sapiens
atggtgggctccagagtagg

SEQ ID NO: 1926060 - DNA, 14 bp, Homo sapiens
atggtggtttcaga

SEQ ID NO: 1926061 - DNA, 15 bp, Homo sapiens
atggttgggacaatg

SEQ ID NO: 1926062 - DNA, 14 bp, Homo sapiens
atgtaaactgtgca

SEQ ID NO: 1926063 - DNA, 19 bp, Homo sapiens
atgtaaattattgtaaact

SEQ ID NO: 1926064 - DNA, 21 bp, Homo sapiens
atgtaaattattgtaaacttt

SEQ ID NO: 1926065 - DNA, 19 bp, Homo sapiens
atgtaatcttgaattgtaa

SEQ ID NO: 1926066 - DNA, 14 bp, Homo sapiens
atgtacattaatta

SEQ ID NO: 1926067 - DNA, 22 bp, Homo sapiens
atgtactttcattccctttcat

SEQ ID NO: 1926068 - DNA, 19 bp, Homo sapiens
atgtagaagagggagaagg

SEQ ID NO: 1926069 - DNA, 22 bp, Homo sapiens
atgtcgtagttactctcaggca

SEQ ID NO: 1926070 - DNA, 16 bp, Homo sapiens
atgtcttcttgggggc

SEQ ID NO: 1926071 - DNA, 11 bp, Homo sapiens
atgtcttgtgt

SEQ ID NO: 1926072 - DNA, 16 bp, Homo sapiens
atgtgcccagtcatga

SEQ ID NO: 1926073 - DNA, 21 bp, Homo sapiens
atgtggttaccgagtatctgt

SEQ ID NO: 1926074 - DNA, 21 bp, Homo sapiens
atgtgtgtccacgactgtctc

SEQ ID NO: 1926075 - DNA, 23 bp, Homo sapiens
atgtgtgtccacgactgtctcca

SEQ ID NO: 1926076 - DNA, 16 bp, Homo sapiens
atgttaattaaagtaa

SEQ ID NO: 1926077 - DNA, 14 bp, Homo sapiens
atgttatagctgca

SEQ ID NO: 1926078 - DNA, 13 bp, Homo sapiens
atgttatcagtat

SEQ ID NO: 1926079 - DNA, 14 bp, Homo sapiens
atgttatcagtatt

SEQ ID NO: 1926080 - DNA, 20 bp, Homo sapiens
atgttattttttaattatta

SEQ ID NO: 1926081 - DNA, 18 bp, Homo sapiens
atgttcacttttgacaaa

SEQ ID NO: 1926082 - DNA, 19 bp, Homo sapiens
atgttctaagtctttccat

SEQ ID NO: 1926083 - DNA, 23 bp, Homo sapiens
atgttcttatttaaattttcaga

SEQ ID NO: 1926084 - DNA, 13 bp, Homo sapiens
atgttgttattta

SEQ ID NO: 1926085 - DNA, 21 bp, Homo sapiens
atgtttacactctttgtaaga

SEQ ID NO: 1926086 - DNA, 15 bp, Homo sapiens
atgtttcttctaggt

SEQ ID NO: 1926087 - DNA, 12 bp, Homo sapiens
atgtttgaatta

SEQ ID NO: 1926088 - DNA, 23 bp, Homo sapiens
atgtttgggagactgctgagtca

SEQ ID NO: 1926089 - DNA, 19 bp, Homo sapiens
attaaatcagaatctttaa

SEQ ID NO: 1926090 - DNA, 19 bp, Homo sapiens
attaactgaattctgaact

SEQ ID NO: 1926091 - DNA, 18 bp, Homo sapiens
attaagctaatggtcctg

SEQ ID NO: 1926092 - DNA, 14 bp, Homo sapiens
attaatgaaatacc

SEQ ID NO: 1926093 - DNA, 16 bp, Homo sapiens
attaattcaattaaaa

SEQ ID NO: 1926094 - DNA, 21 bp, Homo sapiens
attacagatgggcaaattaag

SEQ ID NO: 1926095 - DNA, 12 bp, Homo sapiens
attacctcctga

SEQ ID NO: 1926096 - DNA, 19 bp, Homo sapiens
attacttttctgcaatgtt

SEQ ID NO: 1926097 - DNA, 19 bp, Homo sapiens
attacttttgtaaatattc

SEQ ID NO: 1926098 - DNA, 21 bp, Homo sapiens
attacttttgtaaatattctt

SEQ ID NO: 1926099 - DNA, 20 bp, Homo sapiens
attagagattacctcctgag

SEQ ID NO: 1926100 - DNA, 14 bp, Homo sapiens
attagtaaagaaat

SEQ ID NO: 1926101 - DNA, 16 bp, Homo sapiens
attagtaacatgtgtt

SEQ ID NO: 1926102 - DNA, 17 bp, Homo sapiens
attagtaacatgtgtta

SEQ ID NO: 1926103 - DNA, 15 bp, Homo sapiens
attataagtaacttg

SEQ ID NO: 1926104 - DNA, 22 bp, Homo sapiens
attataatatactatatttatg

SEQ ID NO: 1926105 - DNA, 11 bp, Homo sapiens
attatatataa

SEQ ID NO: 1926106 - DNA, 13 bp, Homo sapiens
attattcagtgtc

SEQ ID NO: 1926107 - DNA, 16 bp, Homo sapiens
attattccctgaattg

SEQ ID NO: 1926108 - DNA, 20 bp, Homo sapiens
attattccctgaattgtttg

SEQ ID NO: 1926109 - DNA, 12 bp, Homo sapiens
attattgtaaac

SEQ ID NO: 1926110 - DNA, 14 bp, Homo sapiens
attattgtaaactt

SEQ ID NO: 1926111 - DNA, 15 bp, Homo sapiens
attattgtaaacttt

SEQ ID NO: 1926112 - DNA, 17 bp, Homo sapiens
attattttttaaagtct

SEQ ID NO: 1926113 - DNA, 23 bp, Homo sapiens
attattttttaaagtcttctttc

SEQ ID NO: 1926114 - DNA, 22 bp, Homo sapiens
attcaaaaaaatcctagagatt

SEQ ID NO: 1926115 - DNA, 16 bp, Homo sapiens
attcaattaaaaccat

SEQ ID NO: 1926116 - DNA, 16 bp, Homo sapiens
attcacaacacaatca

SEQ ID NO: 1926117 - DNA, 23 bp, Homo sapiens
attcacttctatatatacaatga

SEQ ID NO: 1926118 - DNA, 18 bp, Homo sapiens
attcacttgtgtttgtat

SEQ ID NO: 1926119 - DNA, 20 bp, Homo sapiens
attcacttgtgtttgtatat

SEQ ID NO: 1926120 - DNA, 21 bp, Homo sapiens
attcatggctttaacagtaat

SEQ ID NO: 1926121 - DNA, 22 bp, Homo sapiens
attcatttcaaagggagagaga

SEQ ID NO: 1926122 - DNA, 19 bp, Homo sapiens
attccagagagtggctcct

SEQ ID NO: 1926123 - DNA, 22 bp, Homo sapiens
attcccatcactgctgtccctc

SEQ ID NO: 1926124 - DNA, 16 bp, Homo sapiens
attcccggctggactt

SEQ ID NO: 1926125 - DNA, 20 bp, Homo sapiens
attccctagaaacttccaaa

SEQ ID NO: 1926126 - DNA, 21 bp, Homo sapiens
attccctagaaacttccaaat

SEQ ID NO: 1926127 - DNA, 14 bp, Homo sapiens
attccctctcatcc

SEQ ID NO: 1926128 - DNA, 12 bp, Homo sapiens
attccctggaga

SEQ ID NO: 1926129 - DNA, 21 bp, Homo sapiens
attcctatacgcagcgtgctt

SEQ ID NO: 1926130 - DNA, 14 bp, Homo sapiens
attcctttctttaa

SEQ ID NO: 1926131 - DNA, 15 bp, Homo sapiens
attcctttctttaaa

SEQ ID NO: 1926132 - DNA, 21 bp, Homo sapiens
attcggtgtgcaccagggttg

SEQ ID NO: 1926133 - DNA, 21 bp, Homo sapiens
attcgtgcagcatatgaggat

SEQ ID NO: 1926134 - DNA, 15 bp, Homo sapiens
attctaaatgaatgt

SEQ ID NO: 1926135 - DNA, 17 bp, Homo sapiens
attctaaatgaatgttt

SEQ ID NO: 1926136 - DNA, 16 bp, Homo sapiens
attctacttcagcttt

SEQ ID NO: 1926137 - DNA, 22 bp, Homo sapiens
attctagagggatccaccgcca

SEQ ID NO: 1926138 - DNA, 14 bp, Homo sapiens
attctcctctccca

SEQ ID NO: 1926139 - DNA, 12 bp, Homo sapiens
attctctgtctc

SEQ ID NO: 1926140 - DNA, 17 bp, Homo sapiens
attctgatacagcctta

SEQ ID NO: 1926141 - DNA, 17 bp, Homo sapiens
attctgcaacagcctgt

SEQ ID NO: 1926142 - DNA, 16 bp, Homo sapiens
attctggggtggggct

SEQ ID NO: 1926143 - DNA, 21 bp, Homo sapiens
attctgttaatgttaattaaa

SEQ ID NO: 1926144 - DNA, 22 bp, Homo sapiens
attcttaagcactttgaaaata

SEQ ID NO: 1926145 - DNA, 22 bp, Homo sapiens
attcttgtccacattctacttc

SEQ ID NO: 1926146 - DNA, 14 bp, Homo sapiens
attgaaaaaataga

SEQ ID NO: 1926147 - DNA, 21 bp, Homo sapiens
caaggtggtcttggagaggag

SEQ ID NO: 1926148 - DNA, 19 bp, Homo sapiens
caagtcccagggagctctg

SEQ ID NO: 1926149 - DNA, 16 bp, Homo sapiens
caagtgcaatccatgt

SEQ ID NO: 1926150 - DNA, 20 bp, Homo sapiens
caagtgctcagttccaatgt

SEQ ID NO: 1926151 - DNA, 17 bp, Homo sapiens
caagttccgtctcctct

SEQ ID NO: 1926152 - DNA, 21 bp, Homo sapiens
caataaacgctgacttgcaga

SEQ ID NO: 1926153 - DNA, 22 bp, Homo sapiens
caataaatagatgagtcctgtt

SEQ ID NO: 1926154 - DNA, 18 bp, Homo sapiens
caataattgtggagagga

SEQ ID NO: 1926155 - DNA, 19 bp, Homo sapiens
caataattgtggagaggag

SEQ ID NO: 1926156 - DNA, 13 bp, Homo sapiens
caatacccttggc

SEQ ID NO: 1926157 - DNA, 17 bp, Homo sapiens
caatacccttggcactg

SEQ ID NO: 1926158 - DNA, 22 bp, Homo sapiens
caatatatgtaaattataagta

SEQ ID NO: 1926159 - DNA, 14 bp, Homo sapiens
caatcaaactttca

SEQ ID NO: 1926160 - DNA, 14 bp, Homo sapiens
caatcactattctt

SEQ ID NO: 1926161 - DNA, 15 bp, Homo sapiens
caatcactattctta

SEQ ID NO: 1926162 - DNA, 18 bp, Homo sapiens
caatcactattcttaagc

SEQ ID NO: 1926163 - DNA, 19 bp, Homo sapiens
caatcactattcttaagca

SEQ ID NO: 1926164 - DNA, 22 bp, Homo sapiens
caatcactattcttaagcactt

SEQ ID NO: 1926165 - DNA, 23 bp, Homo sapiens
caatcactattcttaagcacttt

SEQ ID NO: 1926166 - DNA, 18 bp, Homo sapiens
caatcagctccttcctgg

SEQ ID NO: 1926167 - DNA, 17 bp, Homo sapiens
caatcccaccaaccctc

SEQ ID NO: 1926168 - DNA, 13 bp, Homo sapiens
caatgagtaaaat

SEQ ID NO: 1926169 - DNA, 15 bp, Homo sapiens
caatgagtaaaatca

SEQ ID NO: 1926170 - DNA, 15 bp, Homo sapiens
caatgcctgcctgaa

SEQ ID NO: 1926171 - DNA, 20 bp, Homo sapiens
caatggagactgtctcaaga

SEQ ID NO: 1926172 - DNA, 22 bp, Homo sapiens
caatggctgggtttgggcagtg

SEQ ID NO: 1926173 - DNA, 23 bp, Homo sapiens
caatgtcttgatgcatgcactgt

SEQ ID NO: 1926174 - DNA, 17 bp, Homo sapiens
caatgtttcttctaggt

SEQ ID NO: 1926175 - DNA, 15 bp, Homo sapiens
caattcttcttctca

SEQ ID NO: 1926176 - DNA, 16 bp, Homo sapiens
caatttctactttgaa

SEQ ID NO: 1926177 - DNA, 21 bp, Homo sapiens
caatttctactttgaagtcat

SEQ ID NO: 1926178 - DNA, 22 bp, Homo sapiens
cacaaaataaccaatcctggac

SEQ ID NO: 1926179 - DNA, 20 bp, Homo sapiens
cacaaagtgagaaattatga

SEQ ID NO: 1926180 - DNA, 18 bp, Homo sapiens
cacaaagttgtttaacta

SEQ ID NO: 1926181 - DNA, 17 bp, Homo sapiens
cacaaataccagagcac

SEQ ID NO: 1926182 - DNA, 17 bp, Homo sapiens
cacaaccttctgtggct

SEQ ID NO: 1926183 - DNA, 18 bp, Homo sapiens
cacaaccttctgtggctc

SEQ ID NO: 1926184 - DNA, 12 bp, Homo sapiens
cacaacttgttt

SEQ ID NO: 1926185 - DNA, 22 bp, Homo sapiens
cacaagacagcagagccatctg

SEQ ID NO: 1926186 - DNA, 14 bp, Homo sapiens
cacacacacccttc

SEQ ID NO: 1926187 - DNA, 12 bp, Homo sapiens
cacacacactct

SEQ ID NO: 1926188 - DNA, 15 bp, Homo sapiens
cacacagctgcagag

SEQ ID NO: 1926189 - DNA, 15 bp, Homo sapiens
cacaccctctctgtc

SEQ ID NO: 1926190 - DNA, 11 bp, Homo sapiens
cacacccttcc

SEQ ID NO: 1926191 - DNA, 12 bp, Homo sapiens
cacacccttccc

SEQ ID NO: 1926192 - DNA, 16 bp, Homo sapiens
cacacccttccccact

SEQ ID NO: 1926193 - DNA, 13 bp, Homo sapiens
cacactgctggga

SEQ ID NO: 1926194 - DNA, 15 bp, Homo sapiens
cacactgctgggaag

SEQ ID NO: 1926195 - DNA, 18 bp, Homo sapiens
cacagaggcagtggcagc

SEQ ID NO: 1926196 - DNA, 14 bp, Homo sapiens
cacagaggccaggc

SEQ ID NO: 1926197 - DNA, 16 bp, Homo sapiens
cacagattcaagtgca

SEQ ID NO: 1926198 - DNA, 23 bp, Homo sapiens
cacagcaggtttatccagatgaa

SEQ ID NO: 1926199 - DNA, 14 bp, Homo sapiens
cacagcctcccctg

SEQ ID NO: 1926200 - DNA, 23 bp, Homo sapiens
cacagcctcccctgccagggcag

SEQ ID NO: 1926201 - DNA, 19 bp, Homo sapiens
cacagctgcagagacagag

SEQ ID NO: 1926202 - DNA, 19 bp, Homo sapiens
cacaggcccttcctctcca

SEQ ID NO: 1926203 - DNA, 21 bp, Homo sapiens
cacaggcccttcctctccact

SEQ ID NO: 1926204 - DNA, 19 bp, Homo sapiens
cacaggctgccgctgctct

SEQ ID NO: 1926205 - DNA, 15 bp, Homo sapiens
cacaggggacactga

SEQ ID NO: 1926206 - DNA, 16 bp, Homo sapiens
cacaggggacactgaa

SEQ ID NO: 1926207 - DNA, 16 bp, Homo sapiens
cacaggttcacccagc

SEQ ID NO: 1926208 - DNA, 15 bp, Homo sapiens
cacagtatgggctac

SEQ ID NO: 1926209 - DNA, 17 bp, Homo sapiens
cacagtgcatctcagcc

SEQ ID NO: 1926210 - DNA, 18 bp, Homo sapiens
cacagtgcatctcagccc

SEQ ID NO: 1926211 - DNA, 21 bp, Homo sapiens
cacatccaacatttcctcagg

SEQ ID NO: 1926212 - DNA, 17 bp, Homo sapiens
cacatctaacctcatct

SEQ ID NO: 1926213 - DNA, 21 bp, Homo sapiens
cacatgagatctaggtgagga

SEQ ID NO: 1926214 - DNA, 16 bp, Homo sapiens
cacattcaataagcat

SEQ ID NO: 1926215 - DNA, 13 bp, Homo sapiens
cacattccctctc

SEQ ID NO: 1926216 - DNA, 16 bp, Homo sapiens
cacattccctctcatc

SEQ ID NO: 1926217 - DNA, 21 bp, Homo sapiens
caccaagcaggaaatgaaaat

SEQ ID NO: 1926218 - DNA, 14 bp, Homo sapiens
caccagcagcagaa

SEQ ID NO: 1926219 - DNA, 14 bp, Homo sapiens
cacccctaaagaga

SEQ ID NO: 1926220 - DNA, 15 bp, Homo sapiens
cacccctaaagagat

SEQ ID NO: 1926221 - DNA, 13 bp, Homo sapiens
cacccctcttccc

SEQ ID NO: 1926222 - DNA, 18 bp, Homo sapiens
cacccctcttcccccttc

SEQ ID NO: 1926223 - DNA, 21 bp, Homo sapiens
cacccctcttcccccttcccc

SEQ ID NO: 1926224 - DNA, 20 bp, Homo sapiens
cacccctgtctgcgccgctg

SEQ ID NO: 1926225 - DNA, 22 bp, Homo sapiens
cacccgtttccaagcctgggcc

SEQ ID NO: 1926226 - DNA, 23 bp, Homo sapiens
cacccgtttccaagcctgggcca

SEQ ID NO: 1926227 - DNA, 18 bp, Homo sapiens
caccctctctgtccaatc

SEQ ID NO: 1926228 - DNA, 13 bp, Homo sapiens
caccctctgcagg

SEQ ID NO: 1926229 - DNA, 12 bp, Homo sapiens
cacccttcccca

SEQ ID NO: 1926230 - DNA, 15 bp, Homo sapiens
cacccttttccagct

SEQ ID NO: 1926231 - DNA, 21 bp, Homo sapiens
cacccttttccagctggatga

SEQ ID NO: 1926232 - DNA, 13 bp, Homo sapiens
caccgtgggctcc

SEQ ID NO: 1926233 - DNA, 13 bp, Homo sapiens
cacctacttcctc

SEQ ID NO: 1926234 - DNA, 15 bp, Homo sapiens
cacctacttcctcct

SEQ ID NO: 1926235 - DNA, 22 bp, Homo sapiens
cacctataaatactaaatatga

SEQ ID NO: 1926236 - DNA, 16 bp, Homo sapiens
cacctccacatcctcc

SEQ ID NO: 1926237 - DNA, 15 bp, Homo sapiens
cacctccacccgtcc

SEQ ID NO: 1926238 - DNA, 13 bp, Homo sapiens
cacctctggccaa

SEQ ID NO: 1926239 - DNA, 24 bp, Homo sapiens
cacctctggccaaatatgcacttt

SEQ ID NO: 1926240 - DNA, 18 bp, Homo sapiens
cacctctggccctgttgt

SEQ ID NO: 1926241 - DNA, 16 bp, Homo sapiens
cacctgacaacttctg

SEQ ID NO: 1926242 - DNA, 14 bp, Homo sapiens
cacctgcagcgtct

SEQ ID NO: 1926243 - DNA, 18 bp, Homo sapiens
cacctgcagcgtctgagc

SEQ ID NO: 1926244 - DNA, 21 bp, Homo sapiens
cacctgccaggctgcagggac

SEQ ID NO: 1926245 - DNA, 12 bp, Homo sapiens
cacctgccccag

SEQ ID NO: 1926246 - DNA, 13 bp, Homo sapiens
cacctgccccagg

SEQ ID NO: 1926247 - DNA, 15 bp, Homo sapiens
cacctgccccaggct

SEQ ID NO: 1926248 - DNA, 17 bp, Homo sapiens
cacctgccccaggctca

SEQ ID NO: 1926249 - DNA, 20 bp, Homo sapiens
cacctggttccggaatcctg

SEQ ID NO: 1926250 - DNA, 12 bp, Homo sapiens
cacctgtacata

SEQ ID NO: 1926251 - DNA, 13 bp, Homo sapiens
cacgactgtctcc

SEQ ID NO: 1926252 - DNA, 16 bp, Homo sapiens
cacgactgtctccatg

SEQ ID NO: 1926253 - DNA, 19 bp, Homo sapiens
cacgccgggtcgcctgccc

SEQ ID NO: 1926254 - DNA, 14 bp, Homo sapiens
cacggacaggaagc

SEQ ID NO: 1926255 - DNA, 15 bp, Homo sapiens
cacggagccactcct

SEQ ID NO: 1926256 - DNA, 18 bp, Homo sapiens
cacggagccactcctctg

SEQ ID NO: 1926257 - DNA, 16 bp, Homo sapiens
cacggccactgcagtc

SEQ ID NO: 1926258 - DNA, 19 bp, Homo sapiens
cacggccactgcagtcacc

SEQ ID NO: 1926259 - DNA, 21 bp, Homo sapiens
cacgggtaaatctagtaccat

SEQ ID NO: 1926260 - DNA, 14 bp, Homo sapiens
cacgtgctggagag

SEQ ID NO: 1926261 - DNA, 18 bp, Homo sapiens
cacgtgctggagagtaga

SEQ ID NO: 1926262 - DNA, 20 bp, Homo sapiens
cacgttccttcccccgcaat

SEQ ID NO: 1926263 - DNA, 19 bp, Homo sapiens
cacgtttagaaatgatttc

SEQ ID NO: 1926264 - DNA, 14 bp, Homo sapiens
cactacgcagaaga

SEQ ID NO: 1926265 - DNA, 20 bp, Homo sapiens
cactaggtgcccagtcttga

SEQ ID NO: 1926266 - DNA, 16 bp, Homo sapiens
cactattcttaagcac

SEQ ID NO: 1926267 - DNA, 19 bp, Homo sapiens
cactattcttaagcacttt

SEQ ID NO: 1926268 - DNA, 13 bp, Homo sapiens
cactcccttgggc

SEQ ID NO: 1926269 - DNA, 14 bp, Homo sapiens
cactcctacctggt

SEQ ID NO: 1926270 - DNA, 14 bp, Homo sapiens
cactcctcccaact

SEQ ID NO: 1926271 - DNA, 23 bp, Homo sapiens
cactcctctgactcagggctcct

SEQ ID NO: 1926272 - DNA, 14 bp, Homo sapiens
cactctgaccgggc

SEQ ID NO: 1926273 - DNA, 14 bp, Homo sapiens
cactcttcaagttt

SEQ ID NO: 1926274 - DNA, 12 bp, Homo sapiens
cactctttgtaa

SEQ ID NO: 1926275 - DNA, 15 bp, Homo sapiens
cactctttgtaagag

SEQ ID NO: 1926276 - DNA, 14 bp, Homo sapiens
cactgaaggcaaat

SEQ ID NO: 1926277 - DNA, 21 bp, Homo sapiens
cactgaagtgaatacatggta

SEQ ID NO: 1926278 - DNA, 15 bp, Homo sapiens
cactgaatcgtttca

SEQ ID NO: 1926279 - DNA, 18 bp, Homo sapiens
cactgagaaggccccagg

SEQ ID NO: 1926280 - DNA, 15 bp, Homo sapiens
ccagacagagtggat

SEQ ID NO: 1926281 - DNA, 14 bp, Homo sapiens
ccagacagggtggg

SEQ ID NO: 1926282 - DNA, 9 bp, Homo sapiens
ccagacccc

SEQ ID NO: 1926283 - DNA, 21 bp, Homo sapiens
ccagacccctaccctttccca

SEQ ID NO: 1926284 - DNA, 19 bp, Homo sapiens
ccagagaacaatcactatt

SEQ ID NO: 1926285 - DNA, 19 bp, Homo sapiens
ccagagagaagcaccccac

SEQ ID NO: 1926286 - DNA, 14 bp, Homo sapiens
ccagagagtggctc

SEQ ID NO: 1926287 - DNA, 15 bp, Homo sapiens
ccagagagtggctcc

SEQ ID NO: 1926288 - DNA, 18 bp, Homo sapiens
ccagagagtggctcctcc

SEQ ID NO: 1926289 - DNA, 22 bp, Homo sapiens
ccagagagtggctcctcccggt

SEQ ID NO: 1926290 - DNA, 14 bp, Homo sapiens
ccagagcctgggcg

SEQ ID NO: 1926291 - DNA, 17 bp, Homo sapiens
ccagaggaaggggccag

SEQ ID NO: 1926292 - DNA, 19 bp, Homo sapiens
ccagaggaaggggccagag

SEQ ID NO: 1926293 - DNA, 21 bp, Homo sapiens
ccagaggattgctgccccatc

SEQ ID NO: 1926294 - DNA, 11 bp, Homo sapiens
ccagaggctcg

SEQ ID NO: 1926295 - DNA, 24 bp, Homo sapiens
ccagagtagggttgccagtcctgc

SEQ ID NO: 1926296 - DNA, 22 bp, Homo sapiens
ccagcactgcttgaggaaaaca

SEQ ID NO: 1926297 - DNA, 17 bp, Homo sapiens
ccagccacccagccagg

SEQ ID NO: 1926298 - DNA, 16 bp, Homo sapiens
ccagcgaggaggctcc

SEQ ID NO: 1926299 - DNA, 18 bp, Homo sapiens
ccagcggctcttcctgga

SEQ ID NO: 1926300 - DNA, 15 bp, Homo sapiens
ccagctctgaaacca

SEQ ID NO: 1926301 - DNA, 20 bp, Homo sapiens
ccagctctgaaaccagtgtt

SEQ ID NO: 1926302 - DNA, 18 bp, Homo sapiens
ccagctctgtatcaggac

SEQ ID NO: 1926303 - DNA, 19 bp, Homo sapiens
ccagcttggagtgccacgt

SEQ ID NO: 1926304 - DNA, 23 bp, Homo sapiens
ccaggaaactctgcattctagta

SEQ ID NO: 1926305 - DNA, 16 bp, Homo sapiens
ccaggaattctcacag

SEQ ID NO: 1926306 - DNA, 23 bp, Homo sapiens
ccaggaccagtcaacctgggcaa

SEQ ID NO: 1926307 - DNA, 22 bp, Homo sapiens
ccaggactccttgttctgctct

SEQ ID NO: 1926308 - DNA, 13 bp, Homo sapiens
ccaggactctctt

SEQ ID NO: 1926309 - DNA, 13 bp, Homo sapiens
ccaggagaccctg

SEQ ID NO: 1926310 - DNA, 19 bp, Homo sapiens
ccaggagcctcctgaccct

SEQ ID NO: 1926311 - DNA, 14 bp, Homo sapiens
ccaggaggacctgg

SEQ ID NO: 1926312 - DNA, 14 bp, Homo sapiens
ccaggaggcctggg

SEQ ID NO: 1926313 - DNA, 15 bp, Homo sapiens
ccaggaggcctggga

SEQ ID NO: 1926314 - DNA, 17 bp, Homo sapiens
ccaggaggcctgggaga

SEQ ID NO: 1926315 - DNA, 17 bp, Homo sapiens
ccaggcaacttgggaac

SEQ ID NO: 1926316 - DNA, 21 bp, Homo sapiens
ccaggcatggcccagcctgga

SEQ ID NO: 1926317 - DNA, 22 bp, Homo sapiens
ccaggcgagagacttgtggcct

SEQ ID NO: 1926318 - DNA, 14 bp, Homo sapiens
ccaggctcaggctg

SEQ ID NO: 1926319 - DNA, 15 bp, Homo sapiens
ccaggctcaggctgc

SEQ ID NO: 1926320 - DNA, 16 bp, Homo sapiens
ccaggctcaggctgcc

SEQ ID NO: 1926321 - DNA, 11 bp, Homo sapiens
ccaggctgcag

SEQ ID NO: 1926322 - DNA, 12 bp, Homo sapiens
ccaggctgcagg

SEQ ID NO: 1926323 - DNA, 19 bp, Homo sapiens
ccagggaccagcccagcct

SEQ ID NO: 1926324 - DNA, 17 bp, Homo sapiens
ccagggagctctgcata

SEQ ID NO: 1926325 - DNA, 18 bp, Homo sapiens
ccagggtgtgagggatgg

SEQ ID NO: 1926326 - DNA, 15 bp, Homo sapiens
ccagggttccagaca

SEQ ID NO: 1926327 - DNA, 22 bp, Homo sapiens
ccagggttccagacagggtggg

SEQ ID NO: 1926328 - DNA, 21 bp, Homo sapiens
ccagggttgaccccagaggat

SEQ ID NO: 1926329 - DNA, 21 bp, Homo sapiens
ccaggtgaacgctcagcgctg

SEQ ID NO: 1926330 - DNA, 18 bp, Homo sapiens
ccaggtttcccactgcgg

SEQ ID NO: 1926331 - DNA, 20 bp, Homo sapiens
ccagtaaggcagctctgtcg

SEQ ID NO: 1926332 - DNA, 19 bp, Homo sapiens
ccagtaggttgaggacagg

SEQ ID NO: 1926333 - DNA, 23 bp, Homo sapiens
ccagtcttgagtgggccccctct

SEQ ID NO: 1926334 - DNA, 16 bp, Homo sapiens
ccatatctgtgcaatg

SEQ ID NO: 1926335 - DNA, 22 bp, Homo sapiens
ccatatctgtgcaatggaatat

SEQ ID NO: 1926336 - DNA, 13 bp, Homo sapiens
ccatcatcataga

SEQ ID NO: 1926337 - DNA, 16 bp, Homo sapiens
ccatcgctgtcatctc

SEQ ID NO: 1926338 - DNA, 20 bp, Homo sapiens
ccatctgtaaatatcccaga

SEQ ID NO: 1926339 - DNA, 15 bp, Homo sapiens
ccatgaaccaagacc

SEQ ID NO: 1926340 - DNA, 17 bp, Homo sapiens
ccatgattttggccact

SEQ ID NO: 1926341 - DNA, 18 bp, Homo sapiens
ccatgattttggccactt

SEQ ID NO: 1926342 - DNA, 20 bp, Homo sapiens
ccatggaggcacacagctgc

SEQ ID NO: 1926343 - DNA, 14 bp, Homo sapiens
ccatggccaggagt

SEQ ID NO: 1926344 - DNA, 17 bp, Homo sapiens
ccatgggcagagcccaa

SEQ ID NO: 1926345 - DNA, 13 bp, Homo sapiens
ccatggtgcagtg

SEQ ID NO: 1926346 - DNA, 22 bp, Homo sapiens
ccatggtgcagtgaagaaaatg

SEQ ID NO: 1926347 - DNA, 17 bp, Homo sapiens
ccatggtggtttcagaa

SEQ ID NO: 1926348 - DNA, 22 bp, Homo sapiens
ccatggtggtttcagaaagggc

SEQ ID NO: 1926349 - DNA, 19 bp, Homo sapiens
ccatggtgtgatcgtctga

SEQ ID NO: 1926350 - DNA, 22 bp, Homo sapiens
ccattcctgggaaatattccct

SEQ ID NO: 1926351 - DNA, 21 bp, Homo sapiens
ccattgaagggggatgcaggc

SEQ ID NO: 1926352 - DNA, 22 bp, Homo sapiens
ccattgaattcttggttgagga

SEQ ID NO: 1926353 - DNA, 23 bp, Homo sapiens
ccattgacaaggtgtttctctgt

SEQ ID NO: 1926354 - DNA, 15 bp, Homo sapiens
ccattggatctcatt

SEQ ID NO: 1926355 - DNA, 12 bp, Homo sapiens
cccaaacccttc

SEQ ID NO: 1926356 - DNA, 23 bp, Homo sapiens
cccaactactattgtagagtggt

SEQ ID NO: 1926357 - DNA, 14 bp, Homo sapiens
cccaactctggcct

SEQ ID NO: 1926358 - DNA, 11 bp, Homo sapiens
cccaatcactg

SEQ ID NO: 1926359 - DNA, 18 bp, Homo sapiens
cccacactacgcagaaga

SEQ ID NO: 1926360 - DNA, 21 bp, Homo sapiens
cccacagagtgccatccctga

SEQ ID NO: 1926361 - DNA, 18 bp, Homo sapiens
cccaccctgtctgcaggc

SEQ ID NO: 1926362 - DNA, 16 bp, Homo sapiens
cccacctccctgcagc

SEQ ID NO: 1926363 - DNA, 17 bp, Homo sapiens
cccacctccctgcagct

SEQ ID NO: 1926364 - DNA, 15 bp, Homo sapiens
cccacctgccaggct

SEQ ID NO: 1926365 - DNA, 12 bp, Homo sapiens
cccactcccgtg

SEQ ID NO: 1926366 - DNA, 17 bp, Homo sapiens
cccacttccctgcaagg

SEQ ID NO: 1926367 - DNA, 13 bp, Homo sapiens
cccagagaacaat

SEQ ID NO: 1926368 - DNA, 16 bp, Homo sapiens
cccagagaacaatcac

SEQ ID NO: 1926369 - DNA, 22 bp, Homo sapiens
cccagaggaaggggccagaggc

SEQ ID NO: 1926370 - DNA, 24 bp, Homo sapiens
cccagaggaaggggccagaggctc

SEQ ID NO: 1926371 - DNA, 21 bp, Homo sapiens
cccagatgcctcctctgtcct

SEQ ID NO: 1926372 - DNA, 21 bp, Homo sapiens
cccagcactgcttgaggaaaa

SEQ ID NO: 1926373 - DNA, 15 bp, Homo sapiens
cccagcctgcatact

SEQ ID NO: 1926374 - DNA, 19 bp, Homo sapiens
cccagcctggccccaagca

SEQ ID NO: 1926375 - DNA, 18 bp, Homo sapiens
cccagctcctcttcctgc

SEQ ID NO: 1926376 - DNA, 22 bp, Homo sapiens
cccagctctgaaaccagtgtta

SEQ ID NO: 1926377 - DNA, 20 bp, Homo sapiens
cccaggagagaccttctctt

SEQ ID NO: 1926378 - DNA, 22 bp, Homo sapiens
cccaggccgaggaagggccccc

SEQ ID NO: 1926379 - DNA, 20 bp, Homo sapiens
cccaggctcaggctgcccag

SEQ ID NO: 1926380 - DNA, 21 bp, Homo sapiens
cccagtgaccgggggaagctg

SEQ ID NO: 1926381 - DNA, 14 bp, Homo sapiens
cccatggtgcagtg

SEQ ID NO: 1926382 - DNA, 17 bp, Homo sapiens
ccccaaggaagaacaaa

SEQ ID NO: 1926383 - DNA, 19 bp, Homo sapiens
ccccacctccctgcagctt

SEQ ID NO: 1926384 - DNA, 14 bp, Homo sapiens
ccccagctgctcct

SEQ ID NO: 1926385 - DNA, 13 bp, Homo sapiens
cccccatgggctg

SEQ ID NO: 1926386 - DNA, 13 bp, Homo sapiens
cccccgccctctg

SEQ ID NO: 1926387 - DNA, 21 bp, Homo sapiens
ccccctctcttaccccgtccc

SEQ ID NO: 1926388 - DNA, 12 bp, Homo sapiens
ccccctgtcctt

SEQ ID NO: 1926389 - DNA, 21 bp, Homo sapiens
ccccctgtgcagccgctgagc

SEQ ID NO: 1926390 - DNA, 16 bp, Homo sapiens
ccccgtccctttccct

SEQ ID NO: 1926391 - DNA, 17 bp, Homo sapiens
cccctacaactccagcc

SEQ ID NO: 1926392 - DNA, 13 bp, Homo sapiens
cccctccagaccc

SEQ ID NO: 1926393 - DNA, 12 bp, Homo sapiens
cccctccccaag

SEQ ID NO: 1926394 - DNA, 19 bp, Homo sapiens
cccctcccctaatgcctgc

SEQ ID NO: 1926395 - DNA, 13 bp, Homo sapiens
cccctcctccaga

SEQ ID NO: 1926396 - DNA, 22 bp, Homo sapiens
cccctcctccagagcctgggcg

SEQ ID NO: 1926397 - DNA, 19 bp, Homo sapiens
cccctccttctcccctcca

SEQ ID NO: 1926398 - DNA, 20 bp, Homo sapiens
cccctccttctcccctccag

SEQ ID NO: 1926399 - DNA, 22 bp, Homo sapiens
cccctccttctcccctccagac

SEQ ID NO: 1926400 - DNA, 17 bp, Homo sapiens
cccctgcgccctccctc

SEQ ID NO: 1926401 - DNA, 18 bp, Homo sapiens
cccctggcttttcactgc

SEQ ID NO: 1926402 - DNA, 19 bp, Homo sapiens
cccctgtgcagccgctgag

SEQ ID NO: 1926403 - DNA, 20 bp, Homo sapiens
cccctgtgcagccgctgagc

SEQ ID NO: 1926404 - DNA, 12 bp, Homo sapiens
ccccttccccct

SEQ ID NO: 1926405 - DNA, 13 bp, Homo sapiens
ccccttcccctgc

SEQ ID NO: 1926406 - DNA, 15 bp, Homo sapiens
ccccttcccctgcgc

SEQ ID NO: 1926407 - DNA, 15 bp, Homo sapiens
cccctttggcacacc

SEQ ID NO: 1926408 - DNA, 13 bp, Homo sapiens
cccgaatcctgag

SEQ ID NO: 1926409 - DNA, 15 bp, Homo sapiens
cccgacagcctggca

SEQ ID NO: 1926410 - DNA, 18 bp, Homo sapiens
cccgacagcctggcacag

SEQ ID NO: 1926411 - DNA, 14 bp, Homo sapiens
cccgactctctcca

SEQ ID NO: 1926412 - DNA, 19 bp, Homo sapiens
cggcctgcagaccctgcca

SEQ ID NO: 1926413 - DNA, 16 bp, Homo sapiens
cggctggaagaacatc

SEQ ID NO: 1926414 - DNA, 23 bp, Homo sapiens
cggctggacttttgcagcttcct

SEQ ID NO: 1926415 - DNA, 22 bp, Homo sapiens
cgggaggccacgggggaggccg

SEQ ID NO: 1926416 - DNA, 23 bp, Homo sapiens
cgggaggccacgggggaggccga

SEQ ID NO: 1926417 - DNA, 20 bp, Homo sapiens
cgggcctggagaactagaga

SEQ ID NO: 1926418 - DNA, 14 bp, Homo sapiens
cgggctgggcagct

SEQ ID NO: 1926419 - DNA, 16 bp, Homo sapiens
cgggggaagctgagcc

SEQ ID NO: 1926420 - DNA, 17 bp, Homo sapiens
cgggtaaaaagagaagg

SEQ ID NO: 1926421 - DNA, 11 bp, Homo sapiens
cgggtctgtgg

SEQ ID NO: 1926422 - DNA, 13 bp, Homo sapiens
cgggtctgtggga

SEQ ID NO: 1926423 - DNA, 22 bp, Homo sapiens
cgggtctgtgggactggcccac

SEQ ID NO: 1926424 - DNA, 20 bp, Homo sapiens
cggtcactgcccacctgcca

SEQ ID NO: 1926425 - DNA, 23 bp, Homo sapiens
cggtgcttccctttcactgaagt

SEQ ID NO: 1926426 - DNA, 15 bp, Homo sapiens
cggtgtgcaccaggg

SEQ ID NO: 1926427 - DNA, 17 bp, Homo sapiens
cggtgtggccctgcaag

SEQ ID NO: 1926428 - DNA, 15 bp, Homo sapiens
cgtataataaaacca

SEQ ID NO: 1926429 - DNA, 17 bp, Homo sapiens
cgtatgaatgatatctt

SEQ ID NO: 1926430 - DNA, 19 bp, Homo sapiens
cgtattgtgaaatttgtta

SEQ ID NO: 1926431 - DNA, 18 bp, Homo sapiens
cgtccacccgtttccaag

SEQ ID NO: 1926432 - DNA, 16 bp, Homo sapiens
cgtccctttccctgca

SEQ ID NO: 1926433 - DNA, 19 bp, Homo sapiens
cgtccctttccctgcatcc

SEQ ID NO: 1926434 - DNA, 22 bp, Homo sapiens
cgtccctttccctgcatccctt

SEQ ID NO: 1926435 - DNA, 13 bp, Homo sapiens
cgtcctcctctgt

SEQ ID NO: 1926436 - DNA, 14 bp, Homo sapiens
cgtcctcctctgtg

SEQ ID NO: 1926437 - DNA, 22 bp, Homo sapiens
cgtcctggggtggttggaggcc

SEQ ID NO: 1926438 - DNA, 12 bp, Homo sapiens
cgtcctgggtgc

SEQ ID NO: 1926439 - DNA, 22 bp, Homo sapiens
cgtctgagcggccgcctgtcct

SEQ ID NO: 1926440 - DNA, 23 bp, Homo sapiens
cgtctgtgattgccatttcttcc

SEQ ID NO: 1926441 - DNA, 17 bp, Homo sapiens
cgtcttcctctctctca

SEQ ID NO: 1926442 - DNA, 21 bp, Homo sapiens
cgtgagagcccaatcactgcc

SEQ ID NO: 1926443 - DNA, 20 bp, Homo sapiens
cgtggagccacaggcagacg

SEQ ID NO: 1926444 - DNA, 15 bp, Homo sapiens
cgtggccgctgccca

SEQ ID NO: 1926445 - DNA, 19 bp, Homo sapiens
cgtggcttcccgctcagcc

SEQ ID NO: 1926446 - DNA, 21 bp, Homo sapiens
cgtgggagaggagaggctgct

SEQ ID NO: 1926447 - DNA, 17 bp, Homo sapiens
cgtgggatccagagaga

SEQ ID NO: 1926448 - DNA, 17 bp, Homo sapiens
cgtgggcggcagagagg

SEQ ID NO: 1926449 - DNA, 22 bp, Homo sapiens
cgttatctcattgcaaaaatat

SEQ ID NO: 1926450 - DNA, 15 bp, Homo sapiens
cgttcacccctccac

SEQ ID NO: 1926451 - DNA, 21 bp, Homo sapiens
cgttcccttgtgtctgttgct

SEQ ID NO: 1926452 - DNA, 23 bp, Homo sapiens
ctaaatcctcactatttttttgt

SEQ ID NO: 1926453 - DNA, 21 bp, Homo sapiens
ctaaatcctttactgttagtc

SEQ ID NO: 1926454 - DNA, 22 bp, Homo sapiens
ctaacaatcagctccttcctgg

SEQ ID NO: 1926455 - DNA, 12 bp, Homo sapiens
ctaacatataat

SEQ ID NO: 1926456 - DNA, 23 bp, Homo sapiens
ctaacatataatgttgttattta

SEQ ID NO: 1926457 - DNA, 19 bp, Homo sapiens
ctaaccagttctctttgta

SEQ ID NO: 1926458 - DNA, 15 bp, Homo sapiens
ctaagatgaaattgc

SEQ ID NO: 1926459 - DNA, 22 bp, Homo sapiens
ctaagctcaaggcgtgaggatg

SEQ ID NO: 1926460 - DNA, 14 bp, Homo sapiens
ctaagtctttccat

SEQ ID NO: 1926461 - DNA, 10 bp, Homo sapiens
ctaagtgact

SEQ ID NO: 1926462 - DNA, 21 bp, Homo sapiens
ctaagtgactaccacttattt

SEQ ID NO: 1926463 - DNA, 20 bp, Homo sapiens
ctaatcagcattctcactcc

SEQ ID NO: 1926464 - DNA, 20 bp, Homo sapiens
ctaatcagggaggtcatttt

SEQ ID NO: 1926465 - DNA, 21 bp, Homo sapiens
ctaatggtcctgttatgtcat

SEQ ID NO: 1926466 - DNA, 15 bp, Homo sapiens
ctaattttgtacgta

SEQ ID NO: 1926467 - DNA, 14 bp, Homo sapiens
ctacaactccagcc

SEQ ID NO: 1926468 - DNA, 22 bp, Homo sapiens
ctacagccaaattgcagaagaa

SEQ ID NO: 1926469 - DNA, 22 bp, Homo sapiens
ctacagctaatcagcattctca

SEQ ID NO: 1926470 - DNA, 21 bp, Homo sapiens
ctacagtcaggaaaggaatca

SEQ ID NO: 1926471 - DNA, 15 bp, Homo sapiens
ctacccctgtcctgg

SEQ ID NO: 1926472 - DNA, 17 bp, Homo sapiens
ctaccctgagctgaggc

SEQ ID NO: 1926473 - DNA, 13 bp, Homo sapiens
ctaccctttccca

SEQ ID NO: 1926474 - DNA, 23 bp, Homo sapiens
ctaccgagtctcttctccactgg

SEQ ID NO: 1926475 - DNA, 16 bp, Homo sapiens
ctaccgcgatacagac

SEQ ID NO: 1926476 - DNA, 23 bp, Homo sapiens
ctactaacaatcagctccttcct

SEQ ID NO: 1926477 - DNA, 16 bp, Homo sapiens
ctacttagacccagtc

SEQ ID NO: 1926478 - DNA, 14 bp, Homo sapiens
ctacttcctcctcc

SEQ ID NO: 1926479 - DNA, 15 bp, Homo sapiens
ctacttcctcctcct

SEQ ID NO: 1926480 - DNA, 16 bp, Homo sapiens
ctagaaacttccaaat

SEQ ID NO: 1926481 - DNA, 16 bp, Homo sapiens
ctagaaagccatattc

SEQ ID NO: 1926482 - DNA, 21 bp, Homo sapiens
ctagaaagccatattccagca

SEQ ID NO: 1926483 - DNA, 11 bp, Homo sapiens
ctagacactga

SEQ ID NO: 1926484 - DNA, 19 bp, Homo sapiens
ctagacactgaaggcaaat

SEQ ID NO: 1926485 - DNA, 20 bp, Homo sapiens
ctagacagtattgccacctc

SEQ ID NO: 1926486 - DNA, 22 bp, Homo sapiens
ctagacagtattgccacctctg

SEQ ID NO: 1926487 - DNA, 23 bp, Homo sapiens
ctagagcattctggggtggggct

SEQ ID NO: 1926488 - DNA, 19 bp, Homo sapiens
ctagagctcagtatactaa

SEQ ID NO: 1926489 - DNA, 13 bp, Homo sapiens
ctaggatttcatg

SEQ ID NO: 1926490 - DNA, 18 bp, Homo sapiens
ctagggccaagcccagca

SEQ ID NO: 1926491 - DNA, 16 bp, Homo sapiens
ctaggtctccacccct

SEQ ID NO: 1926492 - DNA, 17 bp, Homo sapiens
ctaggtctccacccctc

SEQ ID NO: 1926493 - DNA, 15 bp, Homo sapiens
ctaggtgcccagtct

SEQ ID NO: 1926494 - DNA, 22 bp, Homo sapiens
ctagtacttgggagacctgtaa

SEQ ID NO: 1926495 - DNA, 12 bp, Homo sapiens
ctagtctgtgcc

SEQ ID NO: 1926496 - DNA, 15 bp, Homo sapiens
ctagtctgtgcctca

SEQ ID NO: 1926497 - DNA, 16 bp, Homo sapiens
ctagtctgtgcctcag

SEQ ID NO: 1926498 - DNA, 16 bp, Homo sapiens
ctagtgccatatattt

SEQ ID NO: 1926499 - DNA, 18 bp, Homo sapiens
ctagtggggaggggcctg

SEQ ID NO: 1926500 - DNA, 21 bp, Homo sapiens
ctagtggggaggggcctggcc

SEQ ID NO: 1926501 - DNA, 23 bp, Homo sapiens
ctagtggggaggggcctggcctg

SEQ ID NO: 1926502 - DNA, 19 bp, Homo sapiens
ctagtttgttagtgcattt

SEQ ID NO: 1926503 - DNA, 19 bp, Homo sapiens
ctatagtgtataccacctg

SEQ ID NO: 1926504 - DNA, 19 bp, Homo sapiens
ctatcctgcaatttctccc

SEQ ID NO: 1926505 - DNA, 20 bp, Homo sapiens
ctatcctgcaatttctcccg

SEQ ID NO: 1926506 - DNA, 14 bp, Homo sapiens
ctatcctgcaccct

SEQ ID NO: 1926507 - DNA, 16 bp, Homo sapiens
ctatgcacctataaat

SEQ ID NO: 1926508 - DNA, 15 bp, Homo sapiens
ctatgccacctgcag

SEQ ID NO: 1926509 - DNA, 16 bp, Homo sapiens
ctatgccacctgcagc

SEQ ID NO: 1926510 - DNA, 20 bp, Homo sapiens
ctatgccacctgcagcgtct

SEQ ID NO: 1926511 - DNA, 21 bp, Homo sapiens
ctatggaaagggtgtggcttg

SEQ ID NO: 1926512 - DNA, 11 bp, Homo sapiens
ctatgtaaatt

SEQ ID NO: 1926513 - DNA, 13 bp, Homo sapiens
ctatgtaaattat

SEQ ID NO: 1926514 - DNA, 20 bp, Homo sapiens
ctatgtaaattattgtaaac

SEQ ID NO: 1926515 - DNA, 23 bp, Homo sapiens
ctatgtaaattattgtaaacttt

SEQ ID NO: 1926516 - DNA, 22 bp, Homo sapiens
ctatgtaacatgtaggaagtag

SEQ ID NO: 1926517 - DNA, 13 bp, Homo sapiens
ctatgtcccagcc

SEQ ID NO: 1926518 - DNA, 20 bp, Homo sapiens
ctatgtcccagcccctggta

SEQ ID NO: 1926519 - DNA, 13 bp, Homo sapiens
ctatgtctgtgat

SEQ ID NO: 1926520 - DNA, 14 bp, Homo sapiens
ctattccctggaga

SEQ ID NO: 1926521 - DNA, 16 bp, Homo sapiens
ctattcttaagcactt

SEQ ID NO: 1926522 - DNA, 15 bp, Homo sapiens
ctatttctcctccat

SEQ ID NO: 1926523 - DNA, 17 bp, Homo sapiens
ctcaagagggcactggt

SEQ ID NO: 1926524 - DNA, 14 bp, Homo sapiens
ctcaagccaggaga

SEQ ID NO: 1926525 - DNA, 22 bp, Homo sapiens
ctcaagccaggagaccctgtct

SEQ ID NO: 1926526 - DNA, 16 bp, Homo sapiens
ctcaaggcgtgaggat

SEQ ID NO: 1926527 - DNA, 18 bp, Homo sapiens
ctcaagtttcagagtcag

SEQ ID NO: 1926528 - DNA, 15 bp, Homo sapiens
ctcaatggaggtttg

SEQ ID NO: 1926529 - DNA, 22 bp, Homo sapiens
ctcacatgtcagtaccttcaaa

SEQ ID NO: 1926530 - DNA, 23 bp, Homo sapiens
ctcacattccctctcatccaggt

SEQ ID NO: 1926531 - DNA, 21 bp, Homo sapiens
ctcacccccttctccatccac

SEQ ID NO: 1926532 - DNA, 17 bp, Homo sapiens
ctcacctacttcctcct

SEQ ID NO: 1926533 - DNA, 17 bp, Homo sapiens
ctcactcctacctggta

SEQ ID NO: 1926534 - DNA, 19 bp, Homo sapiens
ctcactctttcttctctct

SEQ ID NO: 1926535 - DNA, 20 bp, Homo sapiens
ctcactgagaaggccccagg

SEQ ID NO: 1926536 - DNA, 22 bp, Homo sapiens
ctcaggaagatcgtgaacataa

SEQ ID NO: 1926537 - DNA, 17 bp, Homo sapiens
ctcaggagaaggcctgc

SEQ ID NO: 1926538 - DNA, 22 bp, Homo sapiens
ctcaggcatggatgaataaatg

SEQ ID NO: 1926539 - DNA, 12 bp, Homo sapiens
ctcaggctgccc

SEQ ID NO: 1926540 - DNA, 19 bp, Homo sapiens
ctcaggtcagggtgaggat

SEQ ID NO: 1926541 - DNA, 13 bp, Homo sapiens
ctcaggttccaaa

SEQ ID NO: 1926542 - DNA, 15 bp, Homo sapiens
ctcagtcagcccagt

SEQ ID NO: 1926543 - DNA, 15 bp, Homo sapiens
ctgtttatatatata

SEQ ID NO: 1926544 - DNA, 19 bp, Homo sapiens
ctgtttgggaggctggagt

SEQ ID NO: 1926545 - DNA, 20 bp, Homo sapiens
ctgtttgggaggctggagtg

SEQ ID NO: 1926546 - DNA, 19 bp, Homo sapiens
ctgttttattgagttctga

SEQ ID NO: 1926547 - DNA, 22 bp, Homo sapiens
ctgttttattgagttctgaagg

SEQ ID NO: 1926548 - DNA, 21 bp, Homo sapiens
ctgttttcaccatctttctaa

SEQ ID NO: 1926549 - DNA, 12 bp, Homo sapiens
ctgttttgaatt

SEQ ID NO: 1926550 - DNA, 12 bp, Homo sapiens
cttaaaaatatg

SEQ ID NO: 1926551 - DNA, 19 bp, Homo sapiens
cttaaacaaaaattaaaat

SEQ ID NO: 1926552 - DNA, 16 bp, Homo sapiens
cttaaatgagaaggaa

SEQ ID NO: 1926553 - DNA, 13 bp, Homo sapiens
cttaagataatat

SEQ ID NO: 1926554 - DNA, 24 bp, Homo sapiens
cttaatagtaatatcaataaatag

SEQ ID NO: 1926555 - DNA, 20 bp, Homo sapiens
cttacaatgtgcactgaatc

SEQ ID NO: 1926556 - DNA, 22 bp, Homo sapiens
cttacccacactacgcagaaga

SEQ ID NO: 1926557 - DNA, 18 bp, Homo sapiens
cttaccccgtccctttcc

SEQ ID NO: 1926558 - DNA, 20 bp, Homo sapiens
cttaccccgtccctttccct

SEQ ID NO: 1926559 - DNA, 16 bp, Homo sapiens
cttagaaattgcattt

SEQ ID NO: 1926560 - DNA, 17 bp, Homo sapiens
cttagaaattgcatttc

SEQ ID NO: 1926561 - DNA, 15 bp, Homo sapiens
cttagaacctttctt

SEQ ID NO: 1926562 - DNA, 12 bp, Homo sapiens
cttagaatgggg

SEQ ID NO: 1926563 - DNA, 16 bp, Homo sapiens
cttaggagttttgttt

SEQ ID NO: 1926564 - DNA, 17 bp, Homo sapiens
cttagggtacagcccag

SEQ ID NO: 1926565 - DNA, 18 bp, Homo sapiens
cttagggtacagcccagg

SEQ ID NO: 1926566 - DNA, 21 bp, Homo sapiens
cttattagagtgtctttccac

SEQ ID NO: 1926567 - DNA, 14 bp, Homo sapiens
cttcaaaatcagtg

SEQ ID NO: 1926568 - DNA, 19 bp, Homo sapiens
cttcaaaatcagtgatggg

SEQ ID NO: 1926569 - DNA, 18 bp, Homo sapiens
cttcaatcctgtcaatgt

SEQ ID NO: 1926570 - DNA, 17 bp, Homo sapiens
cttcaccgccgtggggt

SEQ ID NO: 1926571 - DNA, 12 bp, Homo sapiens
cttcagactctc

SEQ ID NO: 1926572 - DNA, 14 bp, Homo sapiens
cttcagactctctc

SEQ ID NO: 1926573 - DNA, 17 bp, Homo sapiens
cttcagactctctcctc

SEQ ID NO: 1926574 - DNA, 15 bp, Homo sapiens
cttcagcagctagag

SEQ ID NO: 1926575 - DNA, 15 bp, Homo sapiens
cttcaggctcttctc

SEQ ID NO: 1926576 - DNA, 15 bp, Homo sapiens
cttcagggggccagg

SEQ ID NO: 1926577 - DNA, 19 bp, Homo sapiens
cttcataacaattttagga

SEQ ID NO: 1926578 - DNA, 14 bp, Homo sapiens
cttcatttttccta

SEQ ID NO: 1926579 - DNA, 16 bp, Homo sapiens
cttcatttttcctaac

SEQ ID NO: 1926580 - DNA, 19 bp, Homo sapiens
cttccaaatcccctaagca

SEQ ID NO: 1926581 - DNA, 14 bp, Homo sapiens
cttccactgagggc

SEQ ID NO: 1926582 - DNA, 18 bp, Homo sapiens
cttccactgagggcagtc

SEQ ID NO: 1926583 - DNA, 15 bp, Homo sapiens
cttccatcagcagtg

SEQ ID NO: 1926584 - DNA, 18 bp, Homo sapiens
cttccatcagcagtgatt

SEQ ID NO: 1926585 - DNA, 12 bp, Homo sapiens
cttcccacccct

SEQ ID NO: 1926586 - DNA, 17 bp, Homo sapiens
cttcccacggccactgc

SEQ ID NO: 1926587 - DNA, 18 bp, Homo sapiens
cttcccacggccactgca

SEQ ID NO: 1926588 - DNA, 21 bp, Homo sapiens
cttcccacggccactgcagtc

SEQ ID NO: 1926589 - DNA, 15 bp, Homo sapiens
cttcccagctgctcc

SEQ ID NO: 1926590 - DNA, 11 bp, Homo sapiens
cttcccaggcc

SEQ ID NO: 1926591 - DNA, 11 bp, Homo sapiens
cttccccactc

SEQ ID NO: 1926592 - DNA, 12 bp, Homo sapiens
cttccccactcc

SEQ ID NO: 1926593 - DNA, 20 bp, Homo sapiens
cttcccccgcaatgtgcccc

SEQ ID NO: 1926594 - DNA, 12 bp, Homo sapiens
cttccccctcca

SEQ ID NO: 1926595 - DNA, 12 bp, Homo sapiens
cttcccccttcc

SEQ ID NO: 1926596 - DNA, 13 bp, Homo sapiens
cttcccccttccc

SEQ ID NO: 1926597 - DNA, 17 bp, Homo sapiens
cttcccgctcagccctc

SEQ ID NO: 1926598 - DNA, 13 bp, Homo sapiens
cttccctgactca

SEQ ID NO: 1926599 - DNA, 14 bp, Homo sapiens
cttccctgactcat

SEQ ID NO: 1926600 - DNA, 19 bp, Homo sapiens
cttcctccctccctgcagg

SEQ ID NO: 1926601 - DNA, 15 bp, Homo sapiens
cttcctcctgggccc

SEQ ID NO: 1926602 - DNA, 19 bp, Homo sapiens
cttcctctccactgccttc

SEQ ID NO: 1926603 - DNA, 22 bp, Homo sapiens
cttcctctcggctggaagaaca

SEQ ID NO: 1926604 - DNA, 16 bp, Homo sapiens
cttcgatacaccgggc

SEQ ID NO: 1926605 - DNA, 17 bp, Homo sapiens
cttctagaaccaggcaa

SEQ ID NO: 1926606 - DNA, 14 bp, Homo sapiens
cttctatcctgcaa

SEQ ID NO: 1926607 - DNA, 21 bp, Homo sapiens
cttctatcctgcaatttctcc

SEQ ID NO: 1926608 - DNA, 15 bp, Homo sapiens
cttctcccctccaga

SEQ ID NO: 1926609 - DNA, 14 bp, Homo sapiens
cttctcctttcaca

SEQ ID NO: 1926610 - DNA, 14 bp, Homo sapiens
cttctctcacctcc

SEQ ID NO: 1926611 - DNA, 16 bp, Homo sapiens
cttctctcacctccta

SEQ ID NO: 1926612 - DNA, 13 bp, Homo sapiens
cttctctctgtgg

SEQ ID NO: 1926613 - DNA, 16 bp, Homo sapiens
cttctctctgtgggat

SEQ ID NO: 1926614 - DNA, 13 bp, Homo sapiens
cttctgctcacat

SEQ ID NO: 1926615 - DNA, 16 bp, Homo sapiens
cttctgctcacattcc

SEQ ID NO: 1926616 - DNA, 19 bp, Homo sapiens
cttctgggagggcagcagg

SEQ ID NO: 1926617 - DNA, 23 bp, Homo sapiens
cttctgggagggcagcagggcta

SEQ ID NO: 1926618 - DNA, 18 bp, Homo sapiens
cttcttaatataactgcc

SEQ ID NO: 1926619 - DNA, 22 bp, Homo sapiens
cttctttgactataacaaaatc

SEQ ID NO: 1926620 - DNA, 17 bp, Homo sapiens
cttgaattgtaactgtt

SEQ ID NO: 1926621 - DNA, 13 bp, Homo sapiens
cttgaatttctag

SEQ ID NO: 1926622 - DNA, 21 bp, Homo sapiens
cttgaatttctagacagtatt

SEQ ID NO: 1926623 - DNA, 21 bp, Homo sapiens
cttgaccgtttttatattact

SEQ ID NO: 1926624 - DNA, 22 bp, Homo sapiens
cttgaccgtttttatattactt

SEQ ID NO: 1926625 - DNA, 22 bp, Homo sapiens
cttgagactgttttgaatttgg

SEQ ID NO: 1926626 - DNA, 17 bp, Homo sapiens
cttgagagccccacccc

SEQ ID NO: 1926627 - DNA, 14 bp, Homo sapiens
cttgagagcgctgg

SEQ ID NO: 1926628 - DNA, 17 bp, Homo sapiens
cttgagtgggccccctc

SEQ ID NO: 1926629 - DNA, 20 bp, Homo sapiens
cttgagtgggccccctctct

SEQ ID NO: 1926630 - DNA, 21 bp, Homo sapiens
cttgatgcatgcactgttccc

SEQ ID NO: 1926631 - DNA, 21 bp, Homo sapiens
cttgatgtcttgagagcgctg

SEQ ID NO: 1926632 - DNA, 17 bp, Homo sapiens
cttgcatttctttattt

SEQ ID NO: 1926633 - DNA, 18 bp, Homo sapiens
cttgccttattagagtgt

SEQ ID NO: 1926634 - DNA, 11 bp, Homo sapiens
cttggagagga

SEQ ID NO: 1926635 - DNA, 19 bp, Homo sapiens
cttggagaggaggtgtgga

SEQ ID NO: 1926636 - DNA, 22 bp, Homo sapiens
cttggagcgtttttgctggctt

SEQ ID NO: 1926637 - DNA, 22 bp, Homo sapiens
cttggattggtaccagagccta

SEQ ID NO: 1926638 - DNA, 14 bp, Homo sapiens
cttgggccctttga

SEQ ID NO: 1926639 - DNA, 16 bp, Homo sapiens
cttgggccctttgagt

SEQ ID NO: 1926640 - DNA, 17 bp, Homo sapiens
cttgggccctttgagtg

SEQ ID NO: 1926641 - DNA, 16 bp, Homo sapiens
cttgggggtggggctg

SEQ ID NO: 1926642 - DNA, 14 bp, Homo sapiens
cttggtgaggagga

SEQ ID NO: 1926643 - DNA, 19 bp, Homo sapiens
cttggttcccccactgatc

SEQ ID NO: 1926644 - DNA, 23 bp, Homo sapiens
cttgtaattctaaatgaatgttt

SEQ ID NO: 1926645 - DNA, 14 bp, Homo sapiens
cttgtccacattct

SEQ ID NO: 1926646 - DNA, 21 bp, Homo sapiens
cttgttttttttttccactta

SEQ ID NO: 1926647 - DNA, 15 bp, Homo sapiens
ctttagaaagaaatt

SEQ ID NO: 1926648 - DNA, 20 bp, Homo sapiens
ctttagaaagaaattgtttt

SEQ ID NO: 1926649 - DNA, 17 bp, Homo sapiens
ctttatttctgtctcat

SEQ ID NO: 1926650 - DNA, 14 bp, Homo sapiens
ctttcacaaccttc

SEQ ID NO: 1926651 - DNA, 16 bp, Homo sapiens
ctttcactgaagtgaa

SEQ ID NO: 1926652 - DNA, 21 bp, Homo sapiens
ctttcagtttgtccacacaag

SEQ ID NO: 1926653 - DNA, 20 bp, Homo sapiens
ctttcatgtaagtagcaaac

SEQ ID NO: 1926654 - DNA, 22 bp, Homo sapiens
ctttccacggagccactcctct

SEQ ID NO: 1926655 - DNA, 19 bp, Homo sapiens
ctttccagaactaccaaaa

SEQ ID NO: 1926656 - DNA, 15 bp, Homo sapiens
ctttccctgcatccc

SEQ ID NO: 1926657 - DNA, 17 bp, Homo sapiens
ctttccctgcatccctt

SEQ ID NO: 1926658 - DNA, 17 bp, Homo sapiens
ctttcctgtgccaggac

SEQ ID NO: 1926659 - DNA, 16 bp, Homo sapiens
ctttgaaaatatttct

SEQ ID NO: 1926660 - DNA, 20 bp, Homo sapiens
ctttgaaatatgcatgtact

SEQ ID NO: 1926661 - DNA, 21 bp, Homo sapiens
ctttgacctcaatggaggttt

SEQ ID NO: 1926662 - DNA, 18 bp, Homo sapiens
ctttgactataacaaaat

SEQ ID NO: 1926663 - DNA, 12 bp, Homo sapiens
ctttgaggtcta

SEQ ID NO: 1926664 - DNA, 15 bp, Homo sapiens
ctttgcagacctggg

SEQ ID NO: 1926665 - DNA, 22 bp, Homo sapiens
ctttgcagacctgggactttag

SEQ ID NO: 1926666 - DNA, 11 bp, Homo sapiens
ctttgcatgtt

SEQ ID NO: 1926667 - DNA, 14 bp, Homo sapiens
ctttgcatgttctt

SEQ ID NO: 1926668 - DNA, 18 bp, Homo sapiens
ctttgcgtggatcaagct

SEQ ID NO: 1926669 - DNA, 19 bp, Homo sapiens
ctttgcgtggatcaagctt

SEQ ID NO: 1926670 - DNA, 15 bp, Homo sapiens
ctttgctgtttatat

SEQ ID NO: 1926671 - DNA, 20 bp, Homo sapiens
ctttggcacaccctctctgt

SEQ ID NO: 1926672 - DNA, 12 bp, Homo sapiens
ctttggccacag

SEQ ID NO: 1926673 - DNA, 13 bp, Homo sapiens
ctttggccacagc

SEQ ID NO: 1926674 - DNA, 15 bp, Homo sapiens
ctttggctcccgctt

SEQ ID NO: 1926675 - DNA, 15 bp, Homo sapiens
ctttggctcgggact

SEQ ID NO: 1926676 - DNA, 17 bp, Homo sapiens
gagggcttccctagatg

SEQ ID NO: 1926677 - DNA, 13 bp, Homo sapiens
gaggggacttgga

SEQ ID NO: 1926678 - DNA, 13 bp, Homo sapiens
gaggggcctggca

SEQ ID NO: 1926679 - DNA, 17 bp, Homo sapiens
gaggggcttccctctgc

SEQ ID NO: 1926680 - DNA, 13 bp, Homo sapiens
gagggtcaggaag

SEQ ID NO: 1926681 - DNA, 15 bp, Homo sapiens
gagggtcaggaagga

SEQ ID NO: 1926682 - DNA, 14 bp, Homo sapiens
gaggtgtggagtgg

SEQ ID NO: 1926683 - DNA, 17 bp, Homo sapiens
gaggtgtggagtggagg

SEQ ID NO: 1926684 - DNA, 17 bp, Homo sapiens
gagtaaatattgtcaca

SEQ ID NO: 1926685 - DNA, 12 bp, Homo sapiens
gagtatctgtaa

SEQ ID NO: 1926686 - DNA, 19 bp, Homo sapiens
gagtatctgtaacccttga

SEQ ID NO: 1926687 - DNA, 20 bp, Homo sapiens
gagtccaacgtggggcagca

SEQ ID NO: 1926688 - DNA, 17 bp, Homo sapiens
gagtctgaaggagagga

SEQ ID NO: 1926689 - DNA, 16 bp, Homo sapiens
gagtgactctggctgc

SEQ ID NO: 1926690 - DNA, 19 bp, Homo sapiens
gagtgactctggctgccaa

SEQ ID NO: 1926691 - DNA, 22 bp, Homo sapiens
gagtgagacccagccctcatcc

SEQ ID NO: 1926692 - DNA, 19 bp, Homo sapiens
gagtgccacatggccgctg

SEQ ID NO: 1926693 - DNA, 14 bp, Homo sapiens
gagtggctcccgtg

SEQ ID NO: 1926694 - DNA, 17 bp, Homo sapiens
gagtgggctctctggac

SEQ ID NO: 1926695 - DNA, 15 bp, Homo sapiens
gagtgtctttccacg

SEQ ID NO: 1926696 - DNA, 14 bp, Homo sapiens
gagtgtgctcggga

SEQ ID NO: 1926697 - DNA, 12 bp, Homo sapiens
gagtgtgtgggg

SEQ ID NO: 1926698 - DNA, 14 bp, Homo sapiens
gagtgttcaaacta

SEQ ID NO: 1926699 - DNA, 22 bp, Homo sapiens
gagtgttcaaactactgtacat

SEQ ID NO: 1926700 - DNA, 19 bp, Homo sapiens
gagttctcatccacagagg

SEQ ID NO: 1926701 - DNA, 21 bp, Homo sapiens
gagtttagtgatctgaacaga

SEQ ID NO: 1926702 - DNA, 19 bp, Homo sapiens
gataaaaacaatatatgta

SEQ ID NO: 1926703 - DNA, 16 bp, Homo sapiens
gataatatttaaaata

SEQ ID NO: 1926704 - DNA, 15 bp, Homo sapiens
gataccagcgaggag

SEQ ID NO: 1926705 - DNA, 17 bp, Homo sapiens
gatactgtctaagaata

SEQ ID NO: 1926706 - DNA, 19 bp, Homo sapiens
gatagcactgagcaaagca

SEQ ID NO: 1926707 - DNA, 11 bp, Homo sapiens
gataggctaat

SEQ ID NO: 1926708 - DNA, 22 bp, Homo sapiens
gatatccctatgtcccagcccc

SEQ ID NO: 1926709 - DNA, 20 bp, Homo sapiens
gatattggtgtgaatgctgt

SEQ ID NO: 1926710 - DNA, 13 bp, Homo sapiens
gatcacaaaaaca

SEQ ID NO: 1926711 - DNA, 20 bp, Homo sapiens
gatcaggtcagagcccagga

SEQ ID NO: 1926712 - DNA, 16 bp, Homo sapiens
gatccagagagaagca

SEQ ID NO: 1926713 - DNA, 23 bp, Homo sapiens
gatccagagagaagcaccccacc

SEQ ID NO: 1926714 - DNA, 14 bp, Homo sapiens
gatccctcatctgt

SEQ ID NO: 1926715 - DNA, 20 bp, Homo sapiens
gatcggagcctcctctctca

SEQ ID NO: 1926716 - DNA, 17 bp, Homo sapiens
gatctggagtctgaagg

SEQ ID NO: 1926717 - DNA, 14 bp, Homo sapiens
gatgaaaaatagca

SEQ ID NO: 1926718 - DNA, 18 bp, Homo sapiens
gatgaactgagaaggtca

SEQ ID NO: 1926719 - DNA, 15 bp, Homo sapiens
gatgacacaaatacc

SEQ ID NO: 1926720 - DNA, 12 bp, Homo sapiens
gatgacccctcc

SEQ ID NO: 1926721 - DNA, 17 bp, Homo sapiens
gatgacccctcccctaa

SEQ ID NO: 1926722 - DNA, 20 bp, Homo sapiens
gatgacctccttagaaaaga

SEQ ID NO: 1926723 - DNA, 12 bp, Homo sapiens
gatgagcattta

SEQ ID NO: 1926724 - DNA, 21 bp, Homo sapiens
gatgagcatttagggcaagga

SEQ ID NO: 1926725 - DNA, 22 bp, Homo sapiens
gatgcaggcaagacaccttccc

SEQ ID NO: 1926726 - DNA, 17 bp, Homo sapiens
gatgcatctgtggcctg

SEQ ID NO: 1926727 - DNA, 12 bp, Homo sapiens
gatgccagctgt

SEQ ID NO: 1926728 - DNA, 17 bp, Homo sapiens
gatgctgactgtactcc

SEQ ID NO: 1926729 - DNA, 11 bp, Homo sapiens
gatgcttctgc

SEQ ID NO: 1926730 - DNA, 21 bp, Homo sapiens
gatggctaaaaccatcatagt

SEQ ID NO: 1926731 - DNA, 20 bp, Homo sapiens
gatgggatggtggagggcca

SEQ ID NO: 1926732 - DNA, 20 bp, Homo sapiens
gatgggcactggaaaacata

SEQ ID NO: 1926733 - DNA, 14 bp, Homo sapiens
gatggggacaaaga

SEQ ID NO: 1926734 - DNA, 16 bp, Homo sapiens
gatggggagcagctgg

SEQ ID NO: 1926735 - DNA, 22 bp, Homo sapiens
gatgggtctggtttgcagagct

SEQ ID NO: 1926736 - DNA, 10 bp, Homo sapiens
gatgggtggg

SEQ ID NO: 1926737 - DNA, 21 bp, Homo sapiens
gatgggttttgttaggggtgg

SEQ ID NO: 1926738 - DNA, 22 bp, Homo sapiens
gatgggttttgttaggggtggg

SEQ ID NO: 1926739 - DNA, 15 bp, Homo sapiens
gatggtggagggcca

SEQ ID NO: 1926740 - DNA, 14 bp, Homo sapiens
gatgtcaaccttgt

SEQ ID NO: 1926741 - DNA, 23 bp, Homo sapiens
gatgtcaaccttgtgtgagtgtg

SEQ ID NO: 1926742 - DNA, 22 bp, Homo sapiens
gatgtcttgagagcgctggcct

SEQ ID NO: 1926743 - DNA, 15 bp, Homo sapiens
gatgtgtatgtgttt

SEQ ID NO: 1926744 - DNA, 14 bp, Homo sapiens
gattacctcctgag

SEQ ID NO: 1926745 - DNA, 19 bp, Homo sapiens
gattccagagagtggctcc

SEQ ID NO: 1926746 - DNA, 24 bp, Homo sapiens
gattctaaaggggacagatcttga

SEQ ID NO: 1926747 - DNA, 21 bp, Homo sapiens
gattcttttttcttccccctc

SEQ ID NO: 1926748 - DNA, 17 bp, Homo sapiens
gattgggggggcttggg

SEQ ID NO: 1926749 - DNA, 22 bp, Homo sapiens
gattgggggggcttggggtaga

SEQ ID NO: 1926750 - DNA, 17 bp, Homo sapiens
gatttcaagggactggg

SEQ ID NO: 1926751 - DNA, 20 bp, Homo sapiens
gatttcatttcaactgtttg

SEQ ID NO: 1926752 - DNA, 13 bp, Homo sapiens
gatttgcaacttt

SEQ ID NO: 1926753 - DNA, 18 bp, Homo sapiens
gatttgtgttttacagta

SEQ ID NO: 1926754 - DNA, 16 bp, Homo sapiens
gcaaaccaggctgcag

SEQ ID NO: 1926755 - DNA, 21 bp, Homo sapiens
gcaaaccgcatgctcttaccc

SEQ ID NO: 1926756 - DNA, 23 bp, Homo sapiens
gcaaaggggtcccatagaggtga

SEQ ID NO: 1926757 - DNA, 16 bp, Homo sapiens
gcaaatttcatctttc

SEQ ID NO: 1926758 - DNA, 22 bp, Homo sapiens
gcaacactgccagaagtgtgtt

SEQ ID NO: 1926759 - DNA, 13 bp, Homo sapiens
gcaacagaaaaaa

SEQ ID NO: 1926760 - DNA, 19 bp, Homo sapiens
gcaactggtatatatttag

SEQ ID NO: 1926761 - DNA, 15 bp, Homo sapiens
gcaacttcccaggcc

SEQ ID NO: 1926762 - DNA, 19 bp, Homo sapiens
gcaactttagaaagaaatt

SEQ ID NO: 1926763 - DNA, 13 bp, Homo sapiens
gcaagaagtggga

SEQ ID NO: 1926764 - DNA, 16 bp, Homo sapiens
gcaagcgacacaggct

SEQ ID NO: 1926765 - DNA, 22 bp, Homo sapiens
gcaagcgacacaggctgccgct

SEQ ID NO: 1926766 - DNA, 17 bp, Homo sapiens
gcaagcttggctgtaga

SEQ ID NO: 1926767 - DNA, 21 bp, Homo sapiens
gcaaggtgcacctgccccagg

SEQ ID NO: 1926768 - DNA, 23 bp, Homo sapiens
gcaaggtgcacctgccccaggct

SEQ ID NO: 1926769 - DNA, 22 bp, Homo sapiens
gcaagtccatagctgagctgga

SEQ ID NO: 1926770 - DNA, 19 bp, Homo sapiens
gcaatccgagccagctctg

SEQ ID NO: 1926771 - DNA, 17 bp, Homo sapiens
gcacacacactcttcaa

SEQ ID NO: 1926772 - DNA, 19 bp, Homo sapiens
gcacacagctgcagagaca

SEQ ID NO: 1926773 - DNA, 13 bp, Homo sapiens
gcacactttgcca

SEQ ID NO: 1926774 - DNA, 19 bp, Homo sapiens
gcacagagagggggccacc

SEQ ID NO: 1926775 - DNA, 18 bp, Homo sapiens
gcacagtgcatctcagcc

SEQ ID NO: 1926776 - DNA, 21 bp, Homo sapiens
gcacagtgcatctcagcccac

SEQ ID NO: 1926777 - DNA, 18 bp, Homo sapiens
gcacatctgtgtcttgtt

SEQ ID NO: 1926778 - DNA, 18 bp, Homo sapiens
gcaccactgtgtatttaa

SEQ ID NO: 1926779 - DNA, 13 bp, Homo sapiens
gcacctataaata

SEQ ID NO: 1926780 - DNA, 18 bp, Homo sapiens
gcacctccacatcctcca

SEQ ID NO: 1926781 - DNA, 15 bp, Homo sapiens
gcacgaaatgttatt

SEQ ID NO: 1926782 - DNA, 16 bp, Homo sapiens
gcactattggactttg

SEQ ID NO: 1926783 - DNA, 17 bp, Homo sapiens
gcactgcttgaggaaaa

SEQ ID NO: 1926784 - DNA, 22 bp, Homo sapiens
gcactggaaaacatagagtaga

SEQ ID NO: 1926785 - DNA, 14 bp, Homo sapiens
gcactggtggcccg

SEQ ID NO: 1926786 - DNA, 24 bp, Homo sapiens
gcactggtggcccgacagcctggc

SEQ ID NO: 1926787 - DNA, 18 bp, Homo sapiens
gcactgtcatgcccagct

SEQ ID NO: 1926788 - DNA, 21 bp, Homo sapiens
gcactgtcatgcccagcttgg

SEQ ID NO: 1926789 - DNA, 19 bp, Homo sapiens
gcactttgaaaatatttct

SEQ ID NO: 1926790 - DNA, 23 bp, Homo sapiens
gcagaccccaccctgtctgcagg

SEQ ID NO: 1926791 - DNA, 14 bp, Homo sapiens
gcagaccctgccag

SEQ ID NO: 1926792 - DNA, 16 bp, Homo sapiens
gcagaccctgccaggg

SEQ ID NO: 1926793 - DNA, 17 bp, Homo sapiens
gcagaccctgccagggg

SEQ ID NO: 1926794 - DNA, 19 bp, Homo sapiens
gcagagtaaaattacagaa

SEQ ID NO: 1926795 - DNA, 12 bp, Homo sapiens
gcagagtcagca

SEQ ID NO: 1926796 - DNA, 14 bp, Homo sapiens
gcagagtcagcaga

SEQ ID NO: 1926797 - DNA, 14 bp, Homo sapiens
gcagcacagagagg

SEQ ID NO: 1926798 - DNA, 19 bp, Homo sapiens
gcagcagtgtgaggccagg

SEQ ID NO: 1926799 - DNA, 20 bp, Homo sapiens
gcagcagtgtgaggccaggg

SEQ ID NO: 1926800 - DNA, 21 bp, Homo sapiens
gcagcagtgtgaggccagggc

SEQ ID NO: 1926801 - DNA, 23 bp, Homo sapiens
gcagcagtgtgaggccagggcag

SEQ ID NO: 1926802 - DNA, 14 bp, Homo sapiens
gcagcatatgagga

SEQ ID NO: 1926803 - DNA, 12 bp, Homo sapiens
gcagcccctccc

SEQ ID NO: 1926804 - DNA, 16 bp, Homo sapiens
gcagccgctgagcgag

SEQ ID NO: 1926805 - DNA, 14 bp, Homo sapiens
gcagccgtgccttc

SEQ ID NO: 1926806 - DNA, 17 bp, Homo sapiens
gcagccgtgccttcagc

SEQ ID NO: 1926807 - DNA, 18 bp, Homo sapiens
gcagccgtgccttcagct

SEQ ID NO: 1926808 - DNA, 21 bp, Homo sapiens
gggacgacccggggcgggctg

SEQ ID NO: 1926809 - DNA, 22 bp, Homo sapiens
gggacgcctgggggtgccagga

SEQ ID NO: 1926810 - DNA, 16 bp, Homo sapiens
gggactggcccacccc

SEQ ID NO: 1926811 - DNA, 19 bp, Homo sapiens
gggactggcccacccctct

SEQ ID NO: 1926812 - DNA, 21 bp, Homo sapiens
gggactggcccacccctcttc

SEQ ID NO: 1926813 - DNA, 22 bp, Homo sapiens
gggactggcccacccctcttcc

SEQ ID NO: 1926814 - DNA, 21 bp, Homo sapiens
gggacttcaaaatcagtgatg

SEQ ID NO: 1926815 - DNA, 13 bp, Homo sapiens
gggagactgagct

SEQ ID NO: 1926816 - DNA, 14 bp, Homo sapiens
gggagactgggctg

SEQ ID NO: 1926817 - DNA, 16 bp, Homo sapiens
gggagactgggctgag

SEQ ID NO: 1926818 - DNA, 12 bp, Homo sapiens
gggagagagaga

SEQ ID NO: 1926819 - DNA, 22 bp, Homo sapiens
gggagagccaaggcctatgcca

SEQ ID NO: 1926820 - DNA, 15 bp, Homo sapiens
gggagcagctgggca

SEQ ID NO: 1926821 - DNA, 13 bp, Homo sapiens
gggagggcagcag

SEQ ID NO: 1926822 - DNA, 13 bp, Homo sapiens
gggaggggcctgg

SEQ ID NO: 1926823 - DNA, 19 bp, Homo sapiens
gggaggggcctggcctggg

SEQ ID NO: 1926824 - DNA, 13 bp, Homo sapiens
gggatccagagag

SEQ ID NO: 1926825 - DNA, 20 bp, Homo sapiens
gggatctaaaaggaggacag

SEQ ID NO: 1926826 - DNA, 17 bp, Homo sapiens
gggatggtggagggcca

SEQ ID NO: 1926827 - DNA, 14 bp, Homo sapiens
gggcaaaccaggct

SEQ ID NO: 1926828 - DNA, 13 bp, Homo sapiens
gggcaaggagacc

SEQ ID NO: 1926829 - DNA, 16 bp, Homo sapiens
gggcactggaaaacat

SEQ ID NO: 1926830 - DNA, 21 bp, Homo sapiens
gggcactgtcatgcccagctt

SEQ ID NO: 1926831 - DNA, 19 bp, Homo sapiens
gggcagaccagagagctca

SEQ ID NO: 1926832 - DNA, 12 bp, Homo sapiens
gggcagagccca

SEQ ID NO: 1926833 - DNA, 20 bp, Homo sapiens
gggcagaggggagaggaagc

SEQ ID NO: 1926834 - DNA, 17 bp, Homo sapiens
gggcagagtgagaccca

SEQ ID NO: 1926835 - DNA, 14 bp, Homo sapiens
gggcagcagggcta

SEQ ID NO: 1926836 - DNA, 12 bp, Homo sapiens
gggcagcccctc

SEQ ID NO: 1926837 - DNA, 14 bp, Homo sapiens
gggcagcccctccc

SEQ ID NO: 1926838 - DNA, 17 bp, Homo sapiens
gggcagggttctagaag

SEQ ID NO: 1926839 - DNA, 17 bp, Homo sapiens
gggcagtcattatccag

SEQ ID NO: 1926840 - DNA, 14 bp, Homo sapiens
gggcagtggagagg

SEQ ID NO: 1926841 - DNA, 15 bp, Homo sapiens
gggcatggccaggtg

SEQ ID NO: 1926842 - DNA, 20 bp, Homo sapiens
gggcatggccaggtggccac

SEQ ID NO: 1926843 - DNA, 20 bp, Homo sapiens
gggccaagccagggttccag

SEQ ID NO: 1926844 - DNA, 22 bp, Homo sapiens
gggccaagccagggttccagac

SEQ ID NO: 1926845 - DNA, 17 bp, Homo sapiens
gggccacctccccaggc

SEQ ID NO: 1926846 - DNA, 13 bp, Homo sapiens
gggccactggcat

SEQ ID NO: 1926847 - DNA, 23 bp, Homo sapiens
gggccccctctcttaccccgtcc

SEQ ID NO: 1926848 - DNA, 15 bp, Homo sapiens
gggcccctcctccag

SEQ ID NO: 1926849 - DNA, 10 bp, Homo sapiens
gggcctggca

SEQ ID NO: 1926850 - DNA, 13 bp, Homo sapiens
gggcgactgtgaa

SEQ ID NO: 1926851 - DNA, 22 bp, Homo sapiens
gggcgcaagcgacacaggctgc

SEQ ID NO: 1926852 - DNA, 15 bp, Homo sapiens
gggcgcctctgtcct

SEQ ID NO: 1926853 - DNA, 16 bp, Homo sapiens
gggcgcctctgtcctg

SEQ ID NO: 1926854 - DNA, 20 bp, Homo sapiens
gggcgcctgggtcctcccag

SEQ ID NO: 1926855 - DNA, 15 bp, Homo sapiens
gggcggcctgcagac

SEQ ID NO: 1926856 - DNA, 13 bp, Homo sapiens
gggcgggaggcca

SEQ ID NO: 1926857 - DNA, 14 bp, Homo sapiens
gggcggggagaaga

SEQ ID NO: 1926858 - DNA, 13 bp, Homo sapiens
gggctgagggagc

SEQ ID NO: 1926859 - DNA, 21 bp, Homo sapiens
gggctgggcagaggggagagg

SEQ ID NO: 1926860 - DNA, 23 bp, Homo sapiens
gggctgggcagaggggagaggaa

SEQ ID NO: 1926861 - DNA, 14 bp, Homo sapiens
gggctgggcagctg

SEQ ID NO: 1926862 - DNA, 15 bp, Homo sapiens
gggctgggcgcctct

SEQ ID NO: 1926863 - DNA, 14 bp, Homo sapiens
gggcttggaagggc

SEQ ID NO: 1926864 - DNA, 16 bp, Homo sapiens
gggcttggaagggcgc

SEQ ID NO: 1926865 - DNA, 22 bp, Homo sapiens
gggcttggggtagagaggacag

SEQ ID NO: 1926866 - DNA, 15 bp, Homo sapiens
ggggacttggatagg

SEQ ID NO: 1926867 - DNA, 14 bp, Homo sapiens
ggggagaatggctc

SEQ ID NO: 1926868 - DNA, 16 bp, Homo sapiens
ggggagaatggctctg

SEQ ID NO: 1926869 - DNA, 17 bp, Homo sapiens
ggggagactgggctgag

SEQ ID NO: 1926870 - DNA, 18 bp, Homo sapiens
ggggaggccgaggcaggg

SEQ ID NO: 1926871 - DNA, 23 bp, Homo sapiens
ggggcaagagctcaggagaaggc

SEQ ID NO: 1926872 - DNA, 21 bp, Homo sapiens
ggggcttggggtagagaggac

SEQ ID NO: 1926873 - DNA, 23 bp, Homo sapiens
ggggcttggggtagagaggacag

SEQ ID NO: 1926874 - DNA, 18 bp, Homo sapiens
gggggaggccgaggcagg

SEQ ID NO: 1926875 - DNA, 20 bp, Homo sapiens
gggggcttggggtagagagg

SEQ ID NO: 1926876 - DNA, 13 bp, Homo sapiens
ggggtagagagga

SEQ ID NO: 1926877 - DNA, 12 bp, Homo sapiens
ggggtctgggag

SEQ ID NO: 1926878 - DNA, 17 bp, Homo sapiens
ggggtctgggaggcagg

SEQ ID NO: 1926879 - DNA, 14 bp, Homo sapiens
ggggtgggggcctg

SEQ ID NO: 1926880 - DNA, 13 bp, Homo sapiens
gggtaacactgat

SEQ ID NO: 1926881 - DNA, 16 bp, Homo sapiens
gggtacagcccaggcg

SEQ ID NO: 1926882 - DNA, 17 bp, Homo sapiens
gggtactcagtcagccc

SEQ ID NO: 1926883 - DNA, 21 bp, Homo sapiens
gggtcaggccacggcagccta

SEQ ID NO: 1926884 - DNA, 19 bp, Homo sapiens
gggtcagtgtgccaccctc

SEQ ID NO: 1926885 - DNA, 13 bp, Homo sapiens
gggtcctcccagc

SEQ ID NO: 1926886 - DNA, 16 bp, Homo sapiens
gggtcctcccagctga

SEQ ID NO: 1926887 - DNA, 15 bp, Homo sapiens
gggtcgcctgccctg

SEQ ID NO: 1926888 - DNA, 16 bp, Homo sapiens
gggtctgctcctggga

SEQ ID NO: 1926889 - DNA, 16 bp, Homo sapiens
gggtctgggaggcagg

SEQ ID NO: 1926890 - DNA, 15 bp, Homo sapiens
gggtctgtcccgggt

SEQ ID NO: 1926891 - DNA, 20 bp, Homo sapiens
gggtgctctggctggagagg

SEQ ID NO: 1926892 - DNA, 16 bp, Homo sapiens
gggtggcagcgcccag

SEQ ID NO: 1926893 - DNA, 15 bp, Homo sapiens
gggtgggagccacag

SEQ ID NO: 1926894 - DNA, 14 bp, Homo sapiens
gggtgggggcctgc

SEQ ID NO: 1926895 - DNA, 12 bp, Homo sapiens
gggttccagaca

SEQ ID NO: 1926896 - DNA, 15 bp, Homo sapiens
gggttggggtggggc

SEQ ID NO: 1926897 - DNA, 14 bp, Homo sapiens
gggtttgggcagtg

SEQ ID NO: 1926898 - DNA, 13 bp, Homo sapiens
ggtaaaatacttc

SEQ ID NO: 1926899 - DNA, 14 bp, Homo sapiens
ggtacagcccaggc

SEQ ID NO: 1926900 - DNA, 18 bp, Homo sapiens
ggtactcagtcagcccag

SEQ ID NO: 1926901 - DNA, 13 bp, Homo sapiens
ggtatattcattt

SEQ ID NO: 1926902 - DNA, 19 bp, Homo sapiens
ggtatcattttctgcattt

SEQ ID NO: 1926903 - DNA, 18 bp, Homo sapiens
ggtcaataattgtggaga

SEQ ID NO: 1926904 - DNA, 19 bp, Homo sapiens
ggtcaataattgtggagag

SEQ ID NO: 1926905 - DNA, 20 bp, Homo sapiens
ggtcaataattgtggagagg

SEQ ID NO: 1926906 - DNA, 21 bp, Homo sapiens
ggtcaataattgtggagagga

SEQ ID NO: 1926907 - DNA, 22 bp, Homo sapiens
ggtcaataattgtggagaggag

SEQ ID NO: 1926908 - DNA, 22 bp, Homo sapiens
ggtcactgcccacctgccaggc

SEQ ID NO: 1926909 - DNA, 23 bp, Homo sapiens
ggtcagattagggcggggagaag

SEQ ID NO: 1926910 - DNA, 21 bp, Homo sapiens
ggtcagtgaagcccaggagga

SEQ ID NO: 1926911 - DNA, 15 bp, Homo sapiens
ggtcagtgtgccacc

SEQ ID NO: 1926912 - DNA, 23 bp, Homo sapiens
ggtcagtgtgccaccctctgcag

SEQ ID NO: 1926913 - DNA, 11 bp, Homo sapiens
ggtccaggaga

SEQ ID NO: 1926914 - DNA, 13 bp, Homo sapiens
ggtccatgggcag

SEQ ID NO: 1926915 - DNA, 16 bp, Homo sapiens
ggtcccccatgggctg

SEQ ID NO: 1926916 - DNA, 22 bp, Homo sapiens
ggtcctgggatggggcatgtgg

SEQ ID NO: 1926917 - DNA, 12 bp, Homo sapiens
ggtcctttcctt

SEQ ID NO: 1926918 - DNA, 12 bp, Homo sapiens
ggtctatttctc

SEQ ID NO: 1926919 - DNA, 15 bp, Homo sapiens
ggtctgctcctggga

SEQ ID NO: 1926920 - DNA, 16 bp, Homo sapiens
ggtctggagcccctat

SEQ ID NO: 1926921 - DNA, 13 bp, Homo sapiens
ggtcttggagagg

SEQ ID NO: 1926922 - DNA, 15 bp, Homo sapiens
ggtgaggaggaggca

SEQ ID NO: 1926923 - DNA, 20 bp, Homo sapiens
ggtgaggcgtgggatccaga

SEQ ID NO: 1926924 - DNA, 18 bp, Homo sapiens
ggtgattttcctgtgtcc

SEQ ID NO: 1926925 - DNA, 13 bp, Homo sapiens
ggtgcagtgaaga

SEQ ID NO: 1926926 - DNA, 22 bp, Homo sapiens
ggtgctacacccttttccagct

SEQ ID NO: 1926927 - DNA, 19 bp, Homo sapiens
ggtgctctggctggagagg

SEQ ID NO: 1926928 - DNA, 18 bp, Homo sapiens
ggtgctgtcatgcccagc

SEQ ID NO: 1926929 - DNA, 15 bp, Homo sapiens
ggtgcttccctttca

SEQ ID NO: 1926930 - DNA, 23 bp, Homo sapiens
ggtggagggccacatgggaggct

SEQ ID NO: 1926931 - DNA, 15 bp, Homo sapiens
ggtggcagcgcccag

SEQ ID NO: 1926932 - DNA, 15 bp, Homo sapiens
ggtgggctccagagt

SEQ ID NO: 1926933 - DNA, 13 bp, Homo sapiens
ggtgggggcctgc

SEQ ID NO: 1926934 - DNA, 14 bp, Homo sapiens
ggtgggggcctgct

SEQ ID NO: 1926935 - DNA, 15 bp, Homo sapiens
ggtgggggcctgctg

SEQ ID NO: 1926936 - DNA, 10 bp, Homo sapiens
ggtgggtcca

SEQ ID NO: 1926937 - DNA, 17 bp, Homo sapiens
ggtggtcttggagagga

SEQ ID NO: 1926938 - DNA, 22 bp, Homo sapiens
ggtggtcttggagaggaggtgt

SEQ ID NO: 1926939 - DNA, 16 bp, Homo sapiens
ggtggttggaggcctg

SEQ ID NO: 1926940 - DNA, 19 bp, Homo sapiens
ggtgtcacagaggcagtgg

SEQ ID NO: 1926941 - DNA, 15 bp, Homo sapiens
ggtgtggagtggagg

SEQ ID NO: 1926942 - DNA, 12 bp, Homo sapiens
tgtctttgctgt

SEQ ID NO: 1926943 - DNA, 22 bp, Homo sapiens
tgtgaaaatggtccaggagaag

SEQ ID NO: 1926944 - DNA, 21 bp, Homo sapiens
tgtgaaatttgttaatatata

SEQ ID NO: 1926945 - DNA, 16 bp, Homo sapiens
tgtgaatgctgtacct

SEQ ID NO: 1926946 - DNA, 17 bp, Homo sapiens
tgtgacatgcgggctgg

SEQ ID NO: 1926947 - DNA, 16 bp, Homo sapiens
tgtgaccaatgtcttg

SEQ ID NO: 1926948 - DNA, 22 bp, Homo sapiens
tgtgacgggggttggggtgggg

SEQ ID NO: 1926949 - DNA, 17 bp, Homo sapiens
tgtgagcatgaaactat

SEQ ID NO: 1926950 - DNA, 16 bp, Homo sapiens
tgtgaggccagggcag

SEQ ID NO: 1926951 - DNA, 17 bp, Homo sapiens
tgtgaggccagggcaga

SEQ ID NO: 1926952 - DNA, 16 bp, Homo sapiens
tgtgagggcaaaccag

SEQ ID NO: 1926953 - DNA, 21 bp, Homo sapiens
tgtgagtattctatgtaaaaa

SEQ ID NO: 1926954 - DNA, 15 bp, Homo sapiens
tgtgatcagaccata

SEQ ID NO: 1926955 - DNA, 16 bp, Homo sapiens
tgtgatcgtgtgttgc

SEQ ID NO: 1926956 - DNA, 19 bp, Homo sapiens
tgtgcaaagaaaagaactg

SEQ ID NO: 1926957 - DNA, 19 bp, Homo sapiens
tgtgcatttgtgtctgcct

SEQ ID NO: 1926958 - DNA, 17 bp, Homo sapiens
tgtgccaccctctgcag

SEQ ID NO: 1926959 - DNA, 21 bp, Homo sapiens
tgtgccaggactctctttctt

SEQ ID NO: 1926960 - DNA, 20 bp, Homo sapiens
tgtgcccagtcatgacattt

SEQ ID NO: 1926961 - DNA, 18 bp, Homo sapiens
tgtgcctcttgggagacg

SEQ ID NO: 1926962 - DNA, 13 bp, Homo sapiens
tgtgctatagtgt

SEQ ID NO: 1926963 - DNA, 16 bp, Homo sapiens
tgtggagaggagagaa

SEQ ID NO: 1926964 - DNA, 19 bp, Homo sapiens
tgtggagtggaggggtcag

SEQ ID NO: 1926965 - DNA, 23 bp, Homo sapiens
tgtggccaagggctccagggcca

SEQ ID NO: 1926966 - DNA, 17 bp, Homo sapiens
tgtggccctgcaagggc

SEQ ID NO: 1926967 - DNA, 12 bp, Homo sapiens
tgtggcttggaa

SEQ ID NO: 1926968 - DNA, 14 bp, Homo sapiens
tgtggcttggaaca

SEQ ID NO: 1926969 - DNA, 14 bp, Homo sapiens
tgtgggactggccc

SEQ ID NO: 1926970 - DNA, 15 bp, Homo sapiens
tgtgggactggccca

SEQ ID NO: 1926971 - DNA, 20 bp, Homo sapiens
tgtgggactggcccacccct

SEQ ID NO: 1926972 - DNA, 12 bp, Homo sapiens
tgtgggagaagg

SEQ ID NO: 1926973 - DNA, 17 bp, Homo sapiens
tgtgggggtctgggagg

SEQ ID NO: 1926974 - DNA, 21 bp, Homo sapiens
tgtgggtcagtgtgccaccct

SEQ ID NO: 1926975 - DNA, 19 bp, Homo sapiens
tgtggttaccgagtatctg

SEQ ID NO: 1926976 - DNA, 19 bp, Homo sapiens
tgtgtatgtgtttataatt

SEQ ID NO: 1926977 - DNA, 18 bp, Homo sapiens
tgtgtccccctctgtcca

SEQ ID NO: 1926978 - DNA, 13 bp, Homo sapiens
tgtgtctgcctgc

SEQ ID NO: 1926979 - DNA, 13 bp, Homo sapiens
tgtgtgagtgtga

SEQ ID NO: 1926980 - DNA, 23 bp, Homo sapiens
tgtgttacctgaaaacactgtgc

SEQ ID NO: 1926981 - DNA, 22 bp, Homo sapiens
tgtgttgggattgagtctgtgc

SEQ ID NO: 1926982 - DNA, 17 bp, Homo sapiens
tgtgtttataattgtta

SEQ ID NO: 1926983 - DNA, 16 bp, Homo sapiens
tgtgtttcaggacagc

SEQ ID NO: 1926984 - DNA, 17 bp, Homo sapiens
tgttaaaacaaattaaa

SEQ ID NO: 1926985 - DNA, 21 bp, Homo sapiens
tgttaaaacaaattaaaaaca

SEQ ID NO: 1926986 - DNA, 16 bp, Homo sapiens
tgttaatatatataat

SEQ ID NO: 1926987 - DNA, 23 bp, Homo sapiens
tgttaatatatataatacttaaa

SEQ ID NO: 1926988 - DNA, 20 bp, Homo sapiens
tgttacctaattagagcaga

SEQ ID NO: 1926989 - DNA, 16 bp, Homo sapiens
tgttacctgaaaacac

SEQ ID NO: 1926990 - DNA, 23 bp, Homo sapiens
tgttacctgaaaacactgtgcac

SEQ ID NO: 1926991 - DNA, 21 bp, Homo sapiens
tgttacggcagtcacactgct

SEQ ID NO: 1926992 - DNA, 23 bp, Homo sapiens
tgttagagtccaacgtggggcag

SEQ ID NO: 1926993 - DNA, 17 bp, Homo sapiens
tgttagtgatttgctat

SEQ ID NO: 1926994 - DNA, 20 bp, Homo sapiens
tgttatcaaaactttctttt

SEQ ID NO: 1926995 - DNA, 14 bp, Homo sapiens
tgttatttaaagaa

SEQ ID NO: 1926996 - DNA, 18 bp, Homo sapiens
tgttattttttaattatt

SEQ ID NO: 1926997 - DNA, 20 bp, Homo sapiens
tgttcaaactactgtacatt

SEQ ID NO: 1926998 - DNA, 20 bp, Homo sapiens
tgttcaaagaacccccctcc

SEQ ID NO: 1926999 - DNA, 22 bp, Homo sapiens
tgttcaaagaacccccctcccc

SEQ ID NO: 1927000 - DNA, 23 bp, Homo sapiens
tgttcaaagaacccccctcccca

SEQ ID NO: 1927001 - DNA, 18 bp, Homo sapiens
tgttccccatggccactt

SEQ ID NO: 1927002 - DNA, 14 bp, Homo sapiens
tgttccccttccac

SEQ ID NO: 1927003 - DNA, 21 bp, Homo sapiens
tgttccccttccactgagggc

SEQ ID NO: 1927004 - DNA, 23 bp, Homo sapiens
tgttccccttccactgagggcag

SEQ ID NO: 1927005 - DNA, 15 bp, Homo sapiens
tgttcctgccttctc

SEQ ID NO: 1927006 - DNA, 16 bp, Homo sapiens
tgttcctgccttctct

SEQ ID NO: 1927007 - DNA, 17 bp, Homo sapiens
tgttcctgccttctctt

SEQ ID NO: 1927008 - DNA, 20 bp, Homo sapiens
tgttcctgccttctcttcta

SEQ ID NO: 1927009 - DNA, 13 bp, Homo sapiens
tgttcttgaattt

SEQ ID NO: 1927010 - DNA, 18 bp, Homo sapiens
tgttgccattttgtctgg

SEQ ID NO: 1927011 - DNA, 15 bp, Homo sapiens
tgttgttcagaagtt

SEQ ID NO: 1927012 - DNA, 20 bp, Homo sapiens
tgttgtttaaaataaaagta

SEQ ID NO: 1927013 - DNA, 15 bp, Homo sapiens
tgttgtttgatgtgt

SEQ ID NO: 1927014 - DNA, 17 bp, Homo sapiens
tgtttaaaataaaagta

SEQ ID NO: 1927015 - DNA, 16 bp, Homo sapiens
tgtttacactctttgt

SEQ ID NO: 1927016 - DNA, 18 bp, Homo sapiens
tgtttacactctttgtaa

SEQ ID NO: 1927017 - DNA, 19 bp, Homo sapiens
tgtttacactctttgtaag

SEQ ID NO: 1927018 - DNA, 16 bp, Homo sapiens
tgtttcaattgcatct

SEQ ID NO: 1927019 - DNA, 15 bp, Homo sapiens
tgtttgtatataaat

SEQ ID NO: 1927020 - DNA, 14 bp, Homo sapiens
tgttttacagtata

SEQ ID NO: 1927021 - DNA, 21 bp, Homo sapiens
tgttttattgagttctgaagg

SEQ ID NO: 1927022 - DNA, 14 bp, Homo sapiens
tgttttccttcaca

SEQ ID NO: 1927023 - DNA, 21 bp, Homo sapiens
tgtttttcccgtataataaaa

SEQ ID NO: 1927024 - DNA, 22 bp, Homo sapiens
ttaaaaccattaccttaaaatt

SEQ ID NO: 1927025 - DNA, 14 bp, Homo sapiens
ttaaaactttaatc

SEQ ID NO: 1927026 - DNA, 20 bp, Homo sapiens
ttaaaagaaagcctcagaga

SEQ ID NO: 1927027 - DNA, 21 bp, Homo sapiens
ttaaaataaaacgttatctca

SEQ ID NO: 1927028 - DNA, 12 bp, Homo sapiens
ttaaaatcctca

SEQ ID NO: 1927029 - DNA, 13 bp, Homo sapiens
ttaaaatgttcac

SEQ ID NO: 1927030 - DNA, 16 bp, Homo sapiens
ttaaactataggtaat

SEQ ID NO: 1927031 - DNA, 12 bp, Homo sapiens
ttaaagaaaggc

SEQ ID NO: 1927032 - DNA, 17 bp, Homo sapiens
ttaaagaggagcctttc

SEQ ID NO: 1927033 - DNA, 13 bp, Homo sapiens
ttaaatacagtct

SEQ ID NO: 1927034 - DNA, 18 bp, Homo sapiens
ttaaatagtaaaaataaa

SEQ ID NO: 1927035 - DNA, 13 bp, Homo sapiens
ttaaatcagaatc

SEQ ID NO: 1927036 - DNA, 15 bp, Homo sapiens
ttaaatcatttatct

SEQ ID NO: 1927037 - DNA, 21 bp, Homo sapiens
ttaacaggtctttgaaatatg

SEQ ID NO: 1927038 - DNA, 19 bp, Homo sapiens
ttaacatatattgttattt

SEQ ID NO: 1927039 - DNA, 13 bp, Homo sapiens
ttaacttttgtaa

SEQ ID NO: 1927040 - DNA, 21 bp, Homo sapiens
ttaagaaaacccgacaacatt

SEQ ID NO: 1927041 - DNA, 14 bp, Homo sapiens
ttaagataattata

SEQ ID NO: 1927042 - DNA, 14 bp, Homo sapiens
ttaagcactttgaa

SEQ ID NO: 1927043 - DNA, 17 bp, Homo sapiens
ttaagcactttgaaaat

SEQ ID NO: 1927044 - DNA, 18 bp, Homo sapiens
ttaagcactttgaaaata

SEQ ID NO: 1927045 - DNA, 23 bp, Homo sapiens
ttaagctaatggtcctgttatgt

SEQ ID NO: 1927046 - DNA, 16 bp, Homo sapiens
ttaaggggatctaaaa

SEQ ID NO: 1927047 - DNA, 17 bp, Homo sapiens
ttaataagtttcactga

SEQ ID NO: 1927048 - DNA, 18 bp, Homo sapiens
ttaatgaagaaagtggaa

SEQ ID NO: 1927049 - DNA, 23 bp, Homo sapiens
ttaatgaagaaagtggaaaacaa

SEQ ID NO: 1927050 - DNA, 13 bp, Homo sapiens
ttaattcaattaa

SEQ ID NO: 1927051 - DNA, 14 bp, Homo sapiens
ttacaatgtgcact

SEQ ID NO: 1927052 - DNA, 14 bp, Homo sapiens
ttacactctttgta

SEQ ID NO: 1927053 - DNA, 21 bp, Homo sapiens
ttaccattttgcgatgtgttt

SEQ ID NO: 1927054 - DNA, 13 bp, Homo sapiens
ttacctaattaga

SEQ ID NO: 1927055 - DNA, 20 bp, Homo sapiens
ttacctagtagtcatttcat

SEQ ID NO: 1927056 - DNA, 18 bp, Homo sapiens
ttacctgaaaacactgtg

SEQ ID NO: 1927057 - DNA, 18 bp, Homo sapiens
ttacctgggcattcttgt

SEQ ID NO: 1927058 - DNA, 16 bp, Homo sapiens
ttactaagatgaaatt

SEQ ID NO: 1927059 - DNA, 22 bp, Homo sapiens
ttactaagatgaaattgccaaa

SEQ ID NO: 1927060 - DNA, 15 bp, Homo sapiens
ttactaatttgtata

SEQ ID NO: 1927061 - DNA, 23 bp, Homo sapiens
ttactagggatccctcatctgtc

SEQ ID NO: 1927062 - DNA, 21 bp, Homo sapiens
ttactatcttttcatctcatt

SEQ ID NO: 1927063 - DNA, 13 bp, Homo sapiens
ttacttttctgca

SEQ ID NO: 1927064 - DNA, 14 bp, Homo sapiens
ttacttttgtaaat

SEQ ID NO: 1927065 - DNA, 23 bp, Homo sapiens
ttagaaaatgtttggaatttaag

SEQ ID NO: 1927066 - DNA, 18 bp, Homo sapiens
ttagactaaggccattat

SEQ ID NO: 1927067 - DNA, 16 bp, Homo sapiens
ttagagtgtctttcca

SEQ ID NO: 1927068 - DNA, 17 bp, Homo sapiens
ttagagtgtctttccac

SEQ ID NO: 1927069 - DNA, 20 bp, Homo sapiens
ttagggctaaccagttctct

SEQ ID NO: 1927070 - DNA, 15 bp, Homo sapiens
ttataaatatattta

SEQ ID NO: 1927071 - DNA, 16 bp, Homo sapiens
ttataattttcctaat

SEQ ID NO: 1927072 - DNA, 18 bp, Homo sapiens
ttatattacttttgtaaa

SEQ ID NO: 1927073 - DNA, 20 bp, Homo sapiens
ttatattacttttgtaaata

SEQ ID NO: 1927074 - DNA, 17 bp, Homo sapiens
agacatgaatatgatta

SEQ ID NO: 1927075 - DNA, 12 bp, Homo sapiens
agacatggggag

SEQ ID NO: 1927076 - DNA, 21 bp, Homo sapiens
agaccccaccctgtctgcagg

SEQ ID NO: 1927077 - DNA, 16 bp, Homo sapiens
agaccccagagtaggg

SEQ ID NO: 1927078 - DNA, 19 bp, Homo sapiens
agacccctaccctttccca

SEQ ID NO: 1927079 - DNA, 13 bp, Homo sapiens
agaccctgccagg

SEQ ID NO: 1927080 - DNA, 16 bp, Homo sapiens
agaccctgtctttgct

SEQ ID NO: 1927081 - DNA, 21 bp, Homo sapiens
agaccctgtctttgctgttta

SEQ ID NO: 1927082 - DNA, 16 bp, Homo sapiens
agacctcggctgtgtg

SEQ ID NO: 1927083 - DNA, 13 bp, Homo sapiens
agacctgggactt

SEQ ID NO: 1927084 - DNA, 13 bp, Homo sapiens
agaccttctctta

SEQ ID NO: 1927085 - DNA, 14 bp, Homo sapiens
agacgtccctccac

SEQ ID NO: 1927086 - DNA, 19 bp, Homo sapiens
agactctacccatattaca

SEQ ID NO: 1927087 - DNA, 21 bp, Homo sapiens
agactctctcctctctctccc

SEQ ID NO: 1927088 - DNA, 20 bp, Homo sapiens
agactgcgtgttgtttttcc

SEQ ID NO: 1927089 - DNA, 17 bp, Homo sapiens
agacttcatttttccta

SEQ ID NO: 1927090 - DNA, 13 bp, Homo sapiens
agagaacaatcac

SEQ ID NO: 1927091 - DNA, 14 bp, Homo sapiens
agagaagcacccca

SEQ ID NO: 1927092 - DNA, 16 bp, Homo sapiens
agagactccagctggg

SEQ ID NO: 1927093 - DNA, 12 bp, Homo sapiens
agagagctcaag

SEQ ID NO: 1927094 - DNA, 18 bp, Homo sapiens
agagaggacgtgggcggc

SEQ ID NO: 1927095 - DNA, 13 bp, Homo sapiens
agagaggagtcag

SEQ ID NO: 1927096 - DNA, 20 bp, Homo sapiens
agagaggagtcagagagaat

SEQ ID NO: 1927097 - DNA, 14 bp, Homo sapiens
agagagggggccac

SEQ ID NO: 1927098 - DNA, 19 bp, Homo sapiens
agagagggggccacctccc

SEQ ID NO: 1927099 - DNA, 16 bp, Homo sapiens
agagattacctcctga

SEQ ID NO: 1927100 - DNA, 20 bp, Homo sapiens
agagattacctcctgagaaa

SEQ ID NO: 1927101 - DNA, 20 bp, Homo sapiens
agagcattctggggtggggc

SEQ ID NO: 1927102 - DNA, 11 bp, Homo sapiens
agagccaaggc

SEQ ID NO: 1927103 - DNA, 22 bp, Homo sapiens
agagccaaggcctatgccacct

SEQ ID NO: 1927104 - DNA, 11 bp, Homo sapiens
agagcctgggc

SEQ ID NO: 1927105 - DNA, 16 bp, Homo sapiens
agagcctgggcgcaag

SEQ ID NO: 1927106 - DNA, 17 bp, Homo sapiens
agagctcaggagaaggc

SEQ ID NO: 1927107 - DNA, 18 bp, Homo sapiens
agagctcaggagaaggcc

SEQ ID NO: 1927108 - DNA, 20 bp, Homo sapiens
agagctcaggagaaggcctg

SEQ ID NO: 1927109 - DNA, 17 bp, Homo sapiens
agagctgtattaagcca

SEQ ID NO: 1927110 - DNA, 15 bp, Homo sapiens
agaggaaaagccagt

SEQ ID NO: 1927111 - DNA, 22 bp, Homo sapiens
agaggaagccacgtgctggaga

SEQ ID NO: 1927112 - DNA, 16 bp, Homo sapiens
agaggaaggggccaga

SEQ ID NO: 1927113 - DNA, 20 bp, Homo sapiens
agaggaaggggccagaggct

SEQ ID NO: 1927114 - DNA, 23 bp, Homo sapiens
agaggaaggggccagaggctcgt

SEQ ID NO: 1927115 - DNA, 23 bp, Homo sapiens
agaggacagtttaggacccaagg

SEQ ID NO: 1927116 - DNA, 20 bp, Homo sapiens
agaggagagaatgagagagt

SEQ ID NO: 1927117 - DNA, 21 bp, Homo sapiens
agaggaggtgtggagtggagg

SEQ ID NO: 1927118 - DNA, 14 bp, Homo sapiens
agaggccctcgctg

SEQ ID NO: 1927119 - DNA, 21 bp, Homo sapiens
agagggacgcctgggggtgcc

SEQ ID NO: 1927120 - DNA, 14 bp, Homo sapiens
agaggggagaggaa

SEQ ID NO: 1927121 - DNA, 12 bp, Homo sapiens
agagggggccac

SEQ ID NO: 1927122 - DNA, 19 bp, Homo sapiens
agaggtcttttttaaaagg

SEQ ID NO: 1927123 - DNA, 18 bp, Homo sapiens
agagtaaaattacagaag

SEQ ID NO: 1927124 - DNA, 21 bp, Homo sapiens
agagtagggttgccagtcctg

SEQ ID NO: 1927125 - DNA, 17 bp, Homo sapiens
agagtgcaacagtagca

SEQ ID NO: 1927126 - DNA, 16 bp, Homo sapiens
agagtggatctggagt

SEQ ID NO: 1927127 - DNA, 18 bp, Homo sapiens
agagtggtctatttctcc

SEQ ID NO: 1927128 - DNA, 14 bp, Homo sapiens
agagtgtctttcca

SEQ ID NO: 1927129 - DNA, 17 bp, Homo sapiens
agagtgtgctcgggagt

SEQ ID NO: 1927130 - DNA, 17 bp, Homo sapiens
actctacccatattaca

SEQ ID NO: 1927131 - DNA, 14 bp, Homo sapiens
actctcagtctctg

SEQ ID NO: 1927132 - DNA, 14 bp, Homo sapiens
actctctccatcag

SEQ ID NO: 1927133 - DNA, 15 bp, Homo sapiens
actctctcctctctc

SEQ ID NO: 1927134 - DNA, 16 bp, Homo sapiens
actctgcattctagta

SEQ ID NO: 1927135 - DNA, 13 bp, Homo sapiens
actctgcttgtta

SEQ ID NO: 1927136 - DNA, 21 bp, Homo sapiens
actctggccttggttcctcca

SEQ ID NO: 1927137 - DNA, 14 bp, Homo sapiens
actctggctgccaa

SEQ ID NO: 1927138 - DNA, 15 bp, Homo sapiens
actctggctgccaag

SEQ ID NO: 1927139 - DNA, 15 bp, Homo sapiens
actctgtggccaaag

SEQ ID NO: 1927140 - DNA, 22 bp, Homo sapiens
actctttcttctctctttgtcc

SEQ ID NO: 1927141 - DNA, 21 bp, Homo sapiens
actgaaccttgttgatgccag

SEQ ID NO: 1927142 - DNA, 19 bp, Homo sapiens
actgagataccagcgagga

SEQ ID NO: 1927143 - DNA, 14 bp, Homo sapiens
actgagccttgtaa

SEQ ID NO: 1927144 - DNA, 21 bp, Homo sapiens
actgaggggtctccaggagga

SEQ ID NO: 1927145 - DNA, 18 bp, Homo sapiens
actgcacagtgcatctca

SEQ ID NO: 1927146 - DNA, 22 bp, Homo sapiens
actgcacagtgcatctcagccc

SEQ ID NO: 1927147 - DNA, 23 bp, Homo sapiens
actgcacagtgcatctcagccca

SEQ ID NO: 1927148 - DNA, 23 bp, Homo sapiens
actgcagggaaaattatttgcat

SEQ ID NO: 1927149 - DNA, 16 bp, Homo sapiens
actgcccacctgccag

SEQ ID NO: 1927150 - DNA, 19 bp, Homo sapiens
actgcccacctgccaggct

SEQ ID NO: 1927151 - DNA, 14 bp, Homo sapiens
actgccttaaaact

SEQ ID NO: 1927152 - DNA, 16 bp, Homo sapiens
actgccttaaaacttt

SEQ ID NO: 1927153 - DNA, 17 bp, Homo sapiens
actgctgggaagtggct

SEQ ID NO: 1927154 - DNA, 19 bp, Homo sapiens
actgctgtccctcctgagg

SEQ ID NO: 1927155 - DNA, 15 bp, Homo sapiens
actgcttgaggaaaa

SEQ ID NO: 1927156 - DNA, 17 bp, Homo sapiens
actggcatctctggagt

SEQ ID NO: 1927157 - DNA, 20 bp, Homo sapiens
actggcccacccctcttccc

SEQ ID NO: 1927158 - DNA, 19 bp, Homo sapiens
actggcgacacgtagcagc

SEQ ID NO: 1927159 - DNA, 21 bp, Homo sapiens
actggctttgggtagtgccat

SEQ ID NO: 1927160 - DNA, 12 bp, Homo sapiens
actgggccggca

SEQ ID NO: 1927161 - DNA, 19 bp, Homo sapiens
actgggccggcagcctggt

SEQ ID NO: 1927162 - DNA, 16 bp, Homo sapiens
actggggtgatgtttt

SEQ ID NO: 1927163 - DNA, 21 bp, Homo sapiens
actggtggcccgacagcctgg

SEQ ID NO: 1927164 - DNA, 22 bp, Homo sapiens
actggtgttatcaccgtgggct

SEQ ID NO: 1927165 - DNA, 20 bp, Homo sapiens
actgtactcctcccaggcgc

SEQ ID NO: 1927166 - DNA, 21 bp, Homo sapiens
actgtattttgtattgtttca

SEQ ID NO: 1927167 - DNA, 19 bp, Homo sapiens
actgtcatgcccagcttgg

SEQ ID NO: 1927168 - DNA, 22 bp, Homo sapiens
actgtctaagaataatgacgta

SEQ ID NO: 1927169 - DNA, 21 bp, Homo sapiens
actgtctcaagagggcactgg

SEQ ID NO: 1927170 - DNA, 20 bp, Homo sapiens
actgtgcacatctgtgtctt

SEQ ID NO: 1927171 - DNA, 21 bp, Homo sapiens
actgtgcacatctgtgtcttg

SEQ ID NO: 1927172 - DNA, 18 bp, Homo sapiens
actgttccccctgtgcag

SEQ ID NO: 1927173 - DNA, 15 bp, Homo sapiens
acttcaaaatcagtg

SEQ ID NO: 1927174 - DNA, 18 bp, Homo sapiens
acttcagactctctcctc

SEQ ID NO: 1927175 - DNA, 16 bp, Homo sapiens
acttcaggctcttctc

SEQ ID NO: 1927176 - DNA, 17 bp, Homo sapiens
agataatatttaaaata

SEQ ID NO: 1927177 - DNA, 18 bp, Homo sapiens
agataatatttaaaatag

SEQ ID NO: 1927178 - DNA, 12 bp, Homo sapiens
agataatgtgaa

SEQ ID NO: 1927179 - DNA, 12 bp, Homo sapiens
agataattataa

SEQ ID NO: 1927180 - DNA, 19 bp, Homo sapiens
agataccagcgaggaggct

SEQ ID NO: 1927181 - DNA, 21 bp, Homo sapiens
agataccagcgaggaggctcc

SEQ ID NO: 1927182 - DNA, 23 bp, Homo sapiens
agataccagcgaggaggctccag

SEQ ID NO: 1927183 - DNA, 18 bp, Homo sapiens
agatctctgctttggaaa

SEQ ID NO: 1927184 - DNA, 20 bp, Homo sapiens
agatcttgagcaaggcaaga

SEQ ID NO: 1927185 - DNA, 16 bp, Homo sapiens
agatgacagaaatatg

SEQ ID NO: 1927186 - DNA, 18 bp, Homo sapiens
agatgcatctgtggcctg

SEQ ID NO: 1927187 - DNA, 20 bp, Homo sapiens
agatgcatctgtggcctggg

SEQ ID NO: 1927188 - DNA, 21 bp, Homo sapiens
agatgcatctgtggcctgggg

SEQ ID NO: 1927189 - DNA, 14 bp, Homo sapiens
agatgcgcaaagag

SEQ ID NO: 1927190 - DNA, 22 bp, Homo sapiens
agatgggttttgttaggggtgg

SEQ ID NO: 1927191 - DNA, 15 bp, Homo sapiens
agatggttccctttg

SEQ ID NO: 1927192 - DNA, 17 bp, Homo sapiens
agatgttctaagtcttt

SEQ ID NO: 1927193 - DNA, 22 bp, Homo sapiens
agatgttctaagtctttccatt

SEQ ID NO: 1927194 - DNA, 14 bp, Homo sapiens
agattaacaacact

SEQ ID NO: 1927195 - DNA, 18 bp, Homo sapiens
agattccagagagtggct

SEQ ID NO: 1927196 - DNA, 12 bp, Homo sapiens
agattctttccc

SEQ ID NO: 1927197 - DNA, 22 bp, Homo sapiens
agattttttctttaaataaaaa

SEQ ID NO: 1927198 - DNA, 19 bp, Homo sapiens
agcaaatgagatgtatgcc

SEQ ID NO: 1927199 - DNA, 19 bp, Homo sapiens
agcaaatttcatctttcca

SEQ ID NO: 1927200 - DNA, 20 bp, Homo sapiens
agcaaatttcatctttccaa

SEQ ID NO: 1927201 - DNA, 16 bp, Homo sapiens
agcaagagatgagaaa

SEQ ID NO: 1927202 - DNA, 24 bp, Homo sapiens
agcaagagatgagaaacaacagaa

SEQ ID NO: 1927203 - DNA, 20 bp, Homo sapiens
agcaaggcaagaagtgggat

SEQ ID NO: 1927204 - DNA, 22 bp, Homo sapiens
agcaaggcaagaagtgggattc

SEQ ID NO: 1927205 - DNA, 12 bp, Homo sapiens
agcaatatgcat

SEQ ID NO: 1927206 - DNA, 18 bp, Homo sapiens
agcacaagaagtgggagt

SEQ ID NO: 1927207 - DNA, 20 bp, Homo sapiens
agcacagagagggggccacc

SEQ ID NO: 1927208 - DNA, 21 bp, Homo sapiens
agcacagagagggggccacct

SEQ ID NO: 1927209 - DNA, 19 bp, Homo sapiens
agcacatggaggccctttt

SEQ ID NO: 1927210 - DNA, 13 bp, Homo sapiens
agcacattatgtt

SEQ ID NO: 1927211 - DNA, 17 bp, Homo sapiens
agcaccccaccacacac

SEQ ID NO: 1927212 - DNA, 23 bp, Homo sapiens
agcactttgaaaatatttctatg

SEQ ID NO: 1927213 - DNA, 17 bp, Homo sapiens
agcagacagcaagggct

SEQ ID NO: 1927214 - DNA, 13 bp, Homo sapiens
agcagagccatct

SEQ ID NO: 1927215 - DNA, 14 bp, Homo sapiens
agcagaggggctga

SEQ ID NO: 1927216 - DNA, 14 bp, Homo sapiens
agcagatggtccca

SEQ ID NO: 1927217 - DNA, 15 bp, Homo sapiens
agcagctgggcactg

SEQ ID NO: 1927218 - DNA, 24 bp, Homo sapiens
agcagctgttcaacaagagtaaat

SEQ ID NO: 1927219 - DNA, 15 bp, Homo sapiens
agcaggaaatgaaaa

SEQ ID NO: 1927220 - DNA, 18 bp, Homo sapiens
agcaggcaccagcagcag

SEQ ID NO: 1927221 - DNA, 16 bp, Homo sapiens
agcatatgaggatgca

SEQ ID NO: 1927222 - DNA, 20 bp, Homo sapiens
agcatccggcatgagggctg

SEQ ID NO: 1927223 - DNA, 21 bp, Homo sapiens
agcatgtactgagccttgtaa

SEQ ID NO: 1927224 - DNA, 22 bp, Homo sapiens
agcattctcactcctacctggt

SEQ ID NO: 1927225 - DNA, 16 bp, Homo sapiens
agcatttcggtgcttc

SEQ ID NO: 1927226 - DNA, 17 bp, Homo sapiens
agcattttcaagaagac

SEQ ID NO: 1927227 - DNA, 17 bp, Homo sapiens
agccaaattgcagaaga

SEQ ID NO: 1927228 - DNA, 20 bp, Homo sapiens
agccaaggcctatgccacct

SEQ ID NO: 1927229 - DNA, 16 bp, Homo sapiens
agccacagaaatgtgt

SEQ ID NO: 1927230 - DNA, 14 bp, Homo sapiens
agccacccagccag

SEQ ID NO: 1927231 - DNA, 16 bp, Homo sapiens
agccacccagccagga

SEQ ID NO: 1927232 - DNA, 17 bp, Homo sapiens
agccaccgcgagggcct

SEQ ID NO: 1927233 - DNA, 17 bp, Homo sapiens
agccacgtgctggagag

SEQ ID NO: 1927234 - DNA, 19 bp, Homo sapiens
agccacgtgctggagagta

SEQ ID NO: 1927235 - DNA, 17 bp, Homo sapiens
agccacttaaaatgttc

SEQ ID NO: 1927236 - DNA, 19 bp, Homo sapiens
agccagcgtcctcctctgt

SEQ ID NO: 1927237 - DNA, 17 bp, Homo sapiens
agccaggagaccctgtc

SEQ ID NO: 1927238 - DNA, 19 bp, Homo sapiens
agccaggagaccctgtctt

SEQ ID NO: 1927239 - DNA, 20 bp, Homo sapiens
agccaggagcctcctgaccc

SEQ ID NO: 1927240 - DNA, 13 bp, Homo sapiens
agccagggttcca

SEQ ID NO: 1927241 - DNA, 14 bp, Homo sapiens
agccagggttccag

SEQ ID NO: 1927242 - DNA, 13 bp, Homo sapiens
agccatattccag

SEQ ID NO: 1927243 - DNA, 18 bp, Homo sapiens
agccatattccagcagtg

SEQ ID NO: 1927244 - DNA, 18 bp, Homo sapiens
agccatctgcgacaccac

SEQ ID NO: 1927245 - DNA, 15 bp, Homo sapiens
agccattcacaacac

SEQ ID NO: 1927246 - DNA, 15 bp, Homo sapiens
agcccagcactgctt

SEQ ID NO: 1927247 - DNA, 20 bp, Homo sapiens
agtcaagtgcgtccacgagc

SEQ ID NO: 1927248 - DNA, 13 bp, Homo sapiens
agtcactgcacag

SEQ ID NO: 1927249 - DNA, 12 bp, Homo sapiens
agtcaggaaagg

SEQ ID NO: 1927250 - DNA, 13 bp, Homo sapiens
agtcatgacattt

SEQ ID NO: 1927251 - DNA, 14 bp, Homo sapiens
agtcatgagctgag

SEQ ID NO: 1927252 - DNA, 19 bp, Homo sapiens
agtcatgcgtttaatcaca

SEQ ID NO: 1927253 - DNA, 16 bp, Homo sapiens
agtcattctagaggga

SEQ ID NO: 1927254 - DNA, 17 bp, Homo sapiens
agtcattctagagggat

SEQ ID NO: 1927255 - DNA, 23 bp, Homo sapiens
agtccaacgtggggcagcacaga

SEQ ID NO: 1927256 - DNA, 14 bp, Homo sapiens
agtccacaaaataa

SEQ ID NO: 1927257 - DNA, 20 bp, Homo sapiens
agtcctacaagctaaaatta

SEQ ID NO: 1927258 - DNA, 19 bp, Homo sapiens
agtcgatagagctgtatta

SEQ ID NO: 1927259 - DNA, 19 bp, Homo sapiens
agtctcactagcacatgga

SEQ ID NO: 1927260 - DNA, 11 bp, Homo sapiens
agtctctgagc

SEQ ID NO: 1927261 - DNA, 13 bp, Homo sapiens
agtctcttctcca

SEQ ID NO: 1927262 - DNA, 15 bp, Homo sapiens
agtctcttctccact

SEQ ID NO: 1927263 - DNA, 19 bp, Homo sapiens
agtctcttctccactggat

SEQ ID NO: 1927264 - DNA, 16 bp, Homo sapiens
agtctgaaggagagga

SEQ ID NO: 1927265 - DNA, 17 bp, Homo sapiens
agtctgaaggagaggag

SEQ ID NO: 1927266 - DNA, 16 bp, Homo sapiens
agtcttacgaatactt

SEQ ID NO: 1927267 - DNA, 14 bp, Homo sapiens
agtcttccatcagc

SEQ ID NO: 1927268 - DNA, 18 bp, Homo sapiens
agtcttccatcagcagtg

SEQ ID NO: 1927269 - DNA, 17 bp, Homo sapiens
agtcttctttcatgtaa

SEQ ID NO: 1927270 - DNA, 14 bp, Homo sapiens
agtcttgagtgggc

SEQ ID NO: 1927271 - DNA, 15 bp, Homo sapiens
agtcttgagtgggcc

SEQ ID NO: 1927272 - DNA, 16 bp, Homo sapiens
agtgaagcccaggagg

SEQ ID NO: 1927273 - DNA, 20 bp, Homo sapiens
agtgaagcccaggaggacct

SEQ ID NO: 1927274 - DNA, 15 bp, Homo sapiens
agtgaaggcttctct

SEQ ID NO: 1927275 - DNA, 19 bp, Homo sapiens
agtgaatgattcagtgtta

SEQ ID NO: 1927276 - DNA, 22 bp, Homo sapiens
agtgactaccacttatttctaa

SEQ ID NO: 1927277 - DNA, 16 bp, Homo sapiens
agtgactctggctgcc

SEQ ID NO: 1927278 - DNA, 19 bp, Homo sapiens
agtgagagcagggctgggc

SEQ ID NO: 1927279 - DNA, 20 bp, Homo sapiens
agtgagagcagggctgggcg

SEQ ID NO: 1927280 - DNA, 12 bp, Homo sapiens
agtgatgggagt

SEQ ID NO: 1927281 - DNA, 17 bp, Homo sapiens
agtgattattttttaaa

SEQ ID NO: 1927282 - DNA, 23 bp, Homo sapiens
agtgattgaagtatctgtacctg

SEQ ID NO: 1927283 - DNA, 12 bp, Homo sapiens
agtgatttgcta

SEQ ID NO: 1927284 - DNA, 13 bp, Homo sapiens
agtgatttgctat

SEQ ID NO: 1927285 - DNA, 16 bp, Homo sapiens
agtgatttgctatcat

SEQ ID NO: 1927286 - DNA, 22 bp, Homo sapiens
agtgatttgctatcatatatta

SEQ ID NO: 1927287 - DNA, 22 bp, Homo sapiens
agtgcagtcctgatcagagccg

SEQ ID NO: 1927288 - DNA, 17 bp, Homo sapiens
agtgccacgtggccgct

SEQ ID NO: 1927289 - DNA, 18 bp, Homo sapiens
agtgccacgtggccgctg

SEQ ID NO: 1927290 - DNA, 23 bp, Homo sapiens
agtgccacgtggccgctgcccac

SEQ ID NO: 1927291 - DNA, 16 bp, Homo sapiens
agtgccatggccagga

SEQ ID NO: 1927292 - DNA, 14 bp, Homo sapiens
agtgctcagttcca

SEQ ID NO: 1927293 - DNA, 16 bp, Homo sapiens
agtggaaaaagaaatt

SEQ ID NO: 1927294 - DNA, 18 bp, Homo sapiens
agtggaggggtcagcagg

SEQ ID NO: 1927295 - DNA, 17 bp, Homo sapiens
agtggctcctcccggtg

SEQ ID NO: 1927296 - DNA, 21 bp, Homo sapiens
agtggctcctcccggtgccca

SEQ ID NO: 1927297 - DNA, 19 bp, Homo sapiens
agtgggacagggcatggcc

SEQ ID NO: 1927298 - DNA, 15 bp, Homo sapiens
agtgggagaggaagc

SEQ ID NO: 1927299 - DNA, 22 bp, Homo sapiens
agtgggatcttacccacttccc

SEQ ID NO: 1927300 - DNA, 18 bp, Homo sapiens
agtgggattcaggaatgg

SEQ ID NO: 1927301 - DNA, 16 bp, Homo sapiens
agtgggccccctctct

SEQ ID NO: 1927302 - DNA, 15 bp, Homo sapiens
agtggggacagagca

SEQ ID NO: 1927303 - DNA, 19 bp, Homo sapiens
agtgtataccacctgtaca

SEQ ID NO: 1927304 - DNA, 23 bp, Homo sapiens
agtgtctttccacggagccactc

SEQ ID NO: 1927305 - DNA, 21 bp, Homo sapiens
agtgtgacgggggttggggtg

SEQ ID NO: 1927306 - DNA, 18 bp, Homo sapiens
agtgtgaggccagggcag

SEQ ID NO: 1927307 - DNA, 21 bp, Homo sapiens
agtgtgccaccctctgcaggg

SEQ ID NO: 1927308 - DNA, 21 bp, Homo sapiens
agtgtgtgggggtctgggagg

SEQ ID NO: 1927309 - DNA, 19 bp, Homo sapiens
agtgttagggaagggcctg

SEQ ID NO: 1927310 - DNA, 22 bp, Homo sapiens
agtgttcaaactactgtacatt

SEQ ID NO: 1927311 - DNA, 16 bp, Homo sapiens
agtgttccccttccac

SEQ ID NO: 1927312 - DNA, 21 bp, Homo sapiens
agtgttccccttccactgagg

SEQ ID NO: 1927313 - DNA, 20 bp, Homo sapiens
agtgttcttgggggtggggc

SEQ ID NO: 1927314 - DNA, 21 bp, Homo sapiens
agttaatgtactttcattccc

SEQ ID NO: 1927315 - DNA, 17 bp, Homo sapiens
agttactgttatagagg

SEQ ID NO: 1927316 - DNA, 12 bp, Homo sapiens
agttattaatag

SEQ ID NO: 1927317 - DNA, 22 bp, Homo sapiens
agttatttatgcctctgtattt

SEQ ID NO: 1927318 - DNA, 15 bp, Homo sapiens
agttccgtctcctct

SEQ ID NO: 1927319 - DNA, 13 bp, Homo sapiens
agttctcatccac

SEQ ID NO: 1927320 - DNA, 14 bp, Homo sapiens
agttctcatccaca

SEQ ID NO: 1927321 - DNA, 23 bp, Homo sapiens
agttctcatccacagaggccagg

SEQ ID NO: 1927322 - DNA, 20 bp, Homo sapiens
agttctgaaggttggaactg

SEQ ID NO: 1927323 - DNA, 18 bp, Homo sapiens
agttgtgcacatggctta

SEQ ID NO: 1927324 - DNA, 17 bp, Homo sapiens
agtttctgggacctcag

SEQ ID NO: 1927325 - DNA, 13 bp, Homo sapiens
agtttctgtaatt

SEQ ID NO: 1927326 - DNA, 14 bp, Homo sapiens
agtttgattattca

SEQ ID NO: 1927327 - DNA, 15 bp, Homo sapiens
agttttatcattttc

SEQ ID NO: 1927328 - DNA, 20 bp, Homo sapiens
agttttatcattttcaaaat

SEQ ID NO: 1927329 - DNA, 21 bp, Homo sapiens
ataaaaaaattgtaaatgttt

SEQ ID NO: 1927330 - DNA, 18 bp, Homo sapiens
ataaaacgttatctcatt

SEQ ID NO: 1927331 - DNA, 13 bp, Homo sapiens
ataaactccttaa

SEQ ID NO: 1927332 - DNA, 12 bp, Homo sapiens
ataaagacacct

SEQ ID NO: 1927333 - DNA, 18 bp, Homo sapiens
ataaagcgtgcaccgtgc

SEQ ID NO: 1927334 - DNA, 22 bp, Homo sapiens
ataaaggaaacacgtttagaaa

SEQ ID NO: 1927335 - DNA, 15 bp, Homo sapiens
ataaagttctgtact

SEQ ID NO: 1927336 - DNA, 14 bp, Homo sapiens
ataaatatcacaaa

SEQ ID NO: 1927337 - DNA, 24 bp, Homo sapiens
ataaatatctatttatctgtctga

SEQ ID NO: 1927338 - DNA, 22 bp, Homo sapiens
ataaatcgcattaatgaaatac

SEQ ID NO: 1927339 - DNA, 18 bp, Homo sapiens
ataaatgggtaacactga

SEQ ID NO: 1927340 - DNA, 21 bp, Homo sapiens
ataaatggtgagaattaaaat

SEQ ID NO: 1927341 - DNA, 15 bp, Homo sapiens
ataaatgtacattaa

SEQ ID NO: 1927342 - DNA, 18 bp, Homo sapiens
ataactgccttaaaactt

SEQ ID NO: 1927343 - DNA, 16 bp, Homo sapiens
ataagagtagaaactg

SEQ ID NO: 1927344 - DNA, 16 bp, Homo sapiens
ataagcatcaaactct

SEQ ID NO: 1927345 - DNA, 17 bp, Homo sapiens
ataagcatcaaactctt

SEQ ID NO: 1927346 - DNA, 13 bp, Homo sapiens
ataagtaagtttg

SEQ ID NO: 1927347 - DNA, 18 bp, Homo sapiens
ataagtatttcaaattgg

SEQ ID NO: 1927348 - DNA, 20 bp, Homo sapiens
ataataaaaatcatgcttat

SEQ ID NO: 1927349 - DNA, 13 bp, Homo sapiens
ataataaaaccaa

SEQ ID NO: 1927350 - DNA, 21 bp, Homo sapiens
ataatacttaaaaatatgtga

SEQ ID NO: 1927351 - DNA, 22 bp, Homo sapiens
ataatacttaaaaatatgtgag

SEQ ID NO: 1927352 - DNA, 18 bp, Homo sapiens
ataatatttaaaatagtt

SEQ ID NO: 1927353 - DNA, 14 bp, Homo sapiens
ataatattttagaa

SEQ ID NO: 1927354 - DNA, 17 bp, Homo sapiens
ataatattttagaaaat

SEQ ID NO: 1927355 - DNA, 16 bp, Homo sapiens
ataattataatatact

SEQ ID NO: 1927356 - DNA, 19 bp, Homo sapiens
ataattgagttttcagtgg

SEQ ID NO: 1927357 - DNA, 20 bp, Homo sapiens
ataattttttagttaaaatc

SEQ ID NO: 1927358 - DNA, 23 bp, Homo sapiens
ataattttttagttaaaatctat

SEQ ID NO: 1927359 - DNA, 23 bp, Homo sapiens
atacagaactctttcaaaacctt

SEQ ID NO: 1927360 - DNA, 18 bp, Homo sapiens
ataccaaaattatttcag

SEQ ID NO: 1927361 - DNA, 22 bp, Homo sapiens
ataccagcgaggaggctccaga

SEQ ID NO: 1927362 - DNA, 19 bp, Homo sapiens
ataccaggggttccccagg

SEQ ID NO: 1927363 - DNA, 22 bp, Homo sapiens
atacccccgtcggaatggtaac

SEQ ID NO: 1927364 - DNA, 15 bp, Homo sapiens
atacccctcatcaca

SEQ ID NO: 1927365 - DNA, 16 bp, Homo sapiens
ataccctaggtctcca

SEQ ID NO: 1927366 - DNA, 19 bp, Homo sapiens
ataccctaggtctccaccc

SEQ ID NO: 1927367 - DNA, 21 bp, Homo sapiens
ataccctaggtctccacccct

SEQ ID NO: 1927368 - DNA, 23 bp, Homo sapiens
ataccctaggtctccacccctca

SEQ ID NO: 1927369 - DNA, 22 bp, Homo sapiens
atacctttgcgtggatcaagct

SEQ ID NO: 1927370 - DNA, 13 bp, Homo sapiens
atactaaatatga

SEQ ID NO: 1927371 - DNA, 20 bp, Homo sapiens
atactgtctaagaataatga

SEQ ID NO: 1927372 - DNA, 18 bp, Homo sapiens
atacttaaaaatatgtga

SEQ ID NO: 1927373 - DNA, 15 bp, Homo sapiens
atacttaatatgtgg

SEQ ID NO: 1927374 - DNA, 21 bp, Homo sapiens
attaaatcagaatctttaaag

SEQ ID NO: 1927375 - DNA, 16 bp, Homo sapiens
attaacaggtctttga

SEQ ID NO: 1927376 - DNA, 17 bp, Homo sapiens
attaagccacttaaaat

SEQ ID NO: 1927377 - DNA, 13 bp, Homo sapiens
attaattcaatta

SEQ ID NO: 1927378 - DNA, 15 bp, Homo sapiens
attacaatttcttta

SEQ ID NO: 1927379 - DNA, 18 bp, Homo sapiens
attacagggaagaaatca

SEQ ID NO: 1927380 - DNA, 21 bp, Homo sapiens
attacctagtagtcatttcat

SEQ ID NO: 1927381 - DNA, 20 bp, Homo sapiens
attacttttgtaaatattct

SEQ ID NO: 1927382 - DNA, 23 bp, Homo sapiens
attacttttgtaaatattcttgt

SEQ ID NO: 1927383 - DNA, 16 bp, Homo sapiens
attagagtgtctttcc

SEQ ID NO: 1927384 - DNA, 17 bp, Homo sapiens
attagcagtttgctttg

SEQ ID NO: 1927385 - DNA, 13 bp, Homo sapiens
attagtaacatgt

SEQ ID NO: 1927386 - DNA, 16 bp, Homo sapiens
attatctagagaataa

SEQ ID NO: 1927387 - DNA, 16 bp, Homo sapiens
attattattcttcata

SEQ ID NO: 1927388 - DNA, 17 bp, Homo sapiens
attattggcttgcactt

SEQ ID NO: 1927389 - DNA, 20 bp, Homo sapiens
attattgtaaactttttcaa

SEQ ID NO: 1927390 - DNA, 22 bp, Homo sapiens
attattgtaaactttttcaatg

SEQ ID NO: 1927391 - DNA, 11 bp, Homo sapiens
attatttgcat

SEQ ID NO: 1927392 - DNA, 18 bp, Homo sapiens
attcaaaataaacaataa

SEQ ID NO: 1927393 - DNA, 15 bp, Homo sapiens
attcaattaaaacca

SEQ ID NO: 1927394 - DNA, 21 bp, Homo sapiens
attcaattaaaaccattacct

SEQ ID NO: 1927395 - DNA, 14 bp, Homo sapiens
attcacaacacaat

SEQ ID NO: 1927396 - DNA, 20 bp, Homo sapiens
attcacatctaacctcatct

SEQ ID NO: 1927397 - DNA, 14 bp, Homo sapiens
attcagtgtcactg

SEQ ID NO: 1927398 - DNA, 16 bp, Homo sapiens
attccacctgcaatca

SEQ ID NO: 1927399 - DNA, 21 bp, Homo sapiens
attccagagagtggctcctcc

SEQ ID NO: 1927400 - DNA, 23 bp, Homo sapiens
attccagcagtgaaacttgtgct

SEQ ID NO: 1927401 - DNA, 21 bp, Homo sapiens
attccatctatataaatcgca

SEQ ID NO: 1927402 - DNA, 20 bp, Homo sapiens
attccctctcatccaggtcc

SEQ ID NO: 1927403 - DNA, 13 bp, Homo sapiens
attccctggagac

SEQ ID NO: 1927404 - DNA, 20 bp, Homo sapiens
attcctctactaacaatcag

SEQ ID NO: 1927405 - DNA, 17 bp, Homo sapiens
attctacttcagctttg

SEQ ID NO: 1927406 - DNA, 11 bp, Homo sapiens
attctctgagc

SEQ ID NO: 1927407 - DNA, 18 bp, Homo sapiens
attctctgagctgtgcag

SEQ ID NO: 1927408 - DNA, 19 bp, Homo sapiens
attctctgtctcatccatc

SEQ ID NO: 1927409 - DNA, 15 bp, Homo sapiens
attctgaaggagccc

SEQ ID NO: 1927410 - DNA, 16 bp, Homo sapiens
attctgaaggagcccc

SEQ ID NO: 1927411 - DNA, 16 bp, Homo sapiens
attctgatacagcctt

SEQ ID NO: 1927412 - DNA, 16 bp, Homo sapiens
attcttagctcttggg

SEQ ID NO: 1927413 - DNA, 13 bp, Homo sapiens
attcttgagttta

SEQ ID NO: 1927414 - DNA, 17 bp, Homo sapiens
attcttggttgaggaaa

SEQ ID NO: 1927415 - DNA, 14 bp, Homo sapiens
attcttgtccacat

SEQ ID NO: 1927416 - DNA, 18 bp, Homo sapiens
attcttgtccacattcta

SEQ ID NO: 1927417 - DNA, 13 bp, Homo sapiens
attctttctgcta

SEQ ID NO: 1927418 - DNA, 21 bp, Homo sapiens
attcttttttcttccccctcc

SEQ ID NO: 1927419 - DNA, 19 bp, Homo sapiens
attgactggtcccccatgg

SEQ ID NO: 1927420 - DNA, 22 bp, Homo sapiens
attgaggaaaattaatatcaca

SEQ ID NO: 1927421 - DNA, 18 bp, Homo sapiens
attgagttctgaaggttg

SEQ ID NO: 1927422 - DNA, 14 bp, Homo sapiens
attgatgggtgggc

SEQ ID NO: 1927423 - DNA, 14 bp, Homo sapiens
attgatttgaagtg

SEQ ID NO: 1927424 - DNA, 15 bp, Homo sapiens
attgatttgaagtgg

SEQ ID NO: 1927425 - DNA, 15 bp, Homo sapiens
attgcatctcccaga

SEQ ID NO: 1927426 - DNA, 22 bp, Homo sapiens
attgcatctcccagataatgtg

SEQ ID NO: 1927427 - DNA, 16 bp, Homo sapiens
attgcatttcctgaca

SEQ ID NO: 1927428 - DNA, 17 bp, Homo sapiens
attgcatttcctgacag

SEQ ID NO: 1927429 - DNA, 17 bp, Homo sapiens
attgccacctctggcca

SEQ ID NO: 1927430 - DNA, 15 bp, Homo sapiens
attgccatttcttcc

SEQ ID NO: 1927431 - DNA, 21 bp, Homo sapiens
attgcctttagaaactgagtc

SEQ ID NO: 1927432 - DNA, 20 bp, Homo sapiens
attgctgccccatcagtgct

SEQ ID NO: 1927433 - DNA, 21 bp, Homo sapiens
attgctgccccatcagtgctc

SEQ ID NO: 1927434 - DNA, 22 bp, Homo sapiens
attgctggcaaagacagaagcc

SEQ ID NO: 1927435 - DNA, 16 bp, Homo sapiens
attgggggggcttggg

SEQ ID NO: 1927436 - DNA, 15 bp, Homo sapiens
attggttaatcactt

SEQ ID NO: 1927437 - DNA, 15 bp, Homo sapiens
attgtaaatgtttaa

SEQ ID NO: 1927438 - DNA, 20 bp, Homo sapiens
attgtaaatgtttaatatct

SEQ ID NO: 1927439 - DNA, 21 bp, Homo sapiens
attgtaaatgtttaatatctg

SEQ ID NO: 1927440 - DNA, 16 bp, Homo sapiens
attgtataggccatct

SEQ ID NO: 1927441 - DNA, 18 bp, Homo sapiens
attgtataggccatctgt

SEQ ID NO: 1927442 - DNA, 23 bp, Homo sapiens
attgtataggccatctgtaaata

SEQ ID NO: 1927443 - DNA, 15 bp, Homo sapiens
attgtgaaatttgtt

SEQ ID NO: 1927444 - DNA, 19 bp, Homo sapiens
attgtgcacatacttgaga

SEQ ID NO: 1927445 - DNA, 18 bp, Homo sapiens
attgtggagaggagagaa

SEQ ID NO: 1927446 - DNA, 18 bp, Homo sapiens
attgtggctgtcagcagg

SEQ ID NO: 1927447 - DNA, 20 bp, Homo sapiens
attgtttgatattgtcacct

SEQ ID NO: 1927448 - DNA, 13 bp, Homo sapiens
atttaaaatagtt

SEQ ID NO: 1927449 - DNA, 20 bp, Homo sapiens
atttaaaatagttccagata

SEQ ID NO: 1927450 - DNA, 21 bp, Homo sapiens
atttaaatacagtcttccatt

SEQ ID NO: 1927451 - DNA, 18 bp, Homo sapiens
atttacatgaattgcatt

SEQ ID NO: 1927452 - DNA, 23 bp, Homo sapiens
atttagcacatactacacattca

SEQ ID NO: 1927453 - DNA, 22 bp, Homo sapiens
atttagtttgattattcagtgt

SEQ ID NO: 1927454 - DNA, 17 bp, Homo sapiens
atttataaactaatttt

SEQ ID NO: 1927455 - DNA, 14 bp, Homo sapiens
atttatatatgtat

SEQ ID NO: 1927456 - DNA, 18 bp, Homo sapiens
atttatctggatttttat

SEQ ID NO: 1927457 - DNA, 20 bp, Homo sapiens
atttatgcctctgtatttaa

SEQ ID NO: 1927458 - DNA, 17 bp, Homo sapiens
atttcaaattggagctt

SEQ ID NO: 1927459 - DNA, 15 bp, Homo sapiens
atttcatgatttcat

SEQ ID NO: 1927460 - DNA, 18 bp, Homo sapiens
atttcatttcaactgttt

SEQ ID NO: 1927461 - DNA, 16 bp, Homo sapiens
atttcggtgcttccct

SEQ ID NO: 1927462 - DNA, 14 bp, Homo sapiens
atttctatgtaaat

SEQ ID NO: 1927463 - DNA, 18 bp, Homo sapiens
atttctatgtaaattatt

SEQ ID NO: 1927464 - DNA, 22 bp, Homo sapiens
atttctatgtaaattattgtaa

SEQ ID NO: 1927465 - DNA, 14 bp, Homo sapiens
atttctcaaagttt

SEQ ID NO: 1927466 - DNA, 15 bp, Homo sapiens
atttctcaaagtttt

SEQ ID NO: 1927467 - DNA, 22 bp, Homo sapiens
atttctcatcaattctctatca

SEQ ID NO: 1927468 - DNA, 15 bp, Homo sapiens
atttctcccttcaat

SEQ ID NO: 1927469 - DNA, 21 bp, Homo sapiens
atttctgtctcataattgtca

SEQ ID NO: 1927470 - DNA, 12 bp, Homo sapiens
atttcttcccaa

SEQ ID NO: 1927471 - DNA, 18 bp, Homo sapiens
atttctttaaatcattta

SEQ ID NO: 1927472 - DNA, 22 bp, Homo sapiens
atttgaagaaggaggaatttta

SEQ ID NO: 1927473 - DNA, 20 bp, Homo sapiens
atttgaagtggaaaaagaaa

SEQ ID NO: 1927474 - DNA, 23 bp, Homo sapiens
atttgcaactttagaaagaaatt

SEQ ID NO: 1927475 - DNA, 19 bp, Homo sapiens
atttggcaatgccatcatc

SEQ ID NO: 1927476 - DNA, 18 bp, Homo sapiens
atttgggggtgcaatgat

SEQ ID NO: 1927477 - DNA, 14 bp, Homo sapiens
atttgtaactttgc

SEQ ID NO: 1927478 - DNA, 18 bp, Homo sapiens
atttgtaactttgcatgt

SEQ ID NO: 1927479 - DNA, 22 bp, Homo sapiens
atttgtgttttacagtatatct

SEQ ID NO: 1927480 - DNA, 13 bp, Homo sapiens
atttgttaatata

SEQ ID NO: 1927481 - DNA, 16 bp, Homo sapiens
atttgttattttgcaa

SEQ ID NO: 1927482 - DNA, 23 bp, Homo sapiens
attttaatgaagaaagtggaaaa

SEQ ID NO: 1927483 - DNA, 22 bp, Homo sapiens
attttagaaaatgtttggaatt

SEQ ID NO: 1927484 - DNA, 21 bp, Homo sapiens
attttcataagtatttcaaat

SEQ ID NO: 1927485 - DNA, 22 bp, Homo sapiens
attttcataagtatttcaaatt

SEQ ID NO: 1927486 - DNA, 18 bp, Homo sapiens
attttcattggatgcagt

SEQ ID NO: 1927487 - DNA, 18 bp, Homo sapiens
attttcctctaattaaaa

SEQ ID NO: 1927488 - DNA, 14 bp, Homo sapiens
attttcctgtgtcc

SEQ ID NO: 1927489 - DNA, 17 bp, Homo sapiens
attttcctgtgtccaca

SEQ ID NO: 1927490 - DNA, 17 bp, Homo sapiens
attttctaattctcttt

SEQ ID NO: 1927491 - DNA, 19 bp, Homo sapiens
attttctatatttgtaact

SEQ ID NO: 1927492 - DNA, 15 bp, Homo sapiens
attttgcaacttgga

SEQ ID NO: 1927493 - DNA, 15 bp, Homo sapiens
attttgcgatgtgtt

SEQ ID NO: 1927494 - DNA, 16 bp, Homo sapiens
attttgcgatgtgttt

SEQ ID NO: 1927495 - DNA, 12 bp, Homo sapiens
attttgtctggc

SEQ ID NO: 1927496 - DNA, 16 bp, Homo sapiens
attttgtggcttcaat

SEQ ID NO: 1927497 - DNA, 17 bp, Homo sapiens
attttttctttaaataa

SEQ ID NO: 1927498 - DNA, 21 bp, Homo sapiens
attttttttcaagtgctaaaa

SEQ ID NO: 1927499 - DNA, 14 bp, Homo sapiens
caaaaacatttgtt

SEQ ID NO: 1927500 - DNA, 14 bp, Homo sapiens
caaaatgcaggaca

SEQ ID NO: 1927501 - DNA, 16 bp, Homo sapiens
caaaattatttcagaa

SEQ ID NO: 1927502 - DNA, 13 bp, Homo sapiens
caaaccagaagca

SEQ ID NO: 1927503 - DNA, 14 bp, Homo sapiens
caaaccaggctgca

SEQ ID NO: 1927504 - DNA, 15 bp, Homo sapiens
caaactactgtacat

SEQ ID NO: 1927505 - DNA, 16 bp, Homo sapiens
caaactactgtacatt

SEQ ID NO: 1927506 - DNA, 15 bp, Homo sapiens
caaagaacccccctc

SEQ ID NO: 1927507 - DNA, 19 bp, Homo sapiens
caaagactgagtgttcaaa

SEQ ID NO: 1927508 - DNA, 20 bp, Homo sapiens
caaagcacgaaatgttattt

SEQ ID NO: 1927509 - DNA, 17 bp, Homo sapiens
caaagcattgagcaaag

SEQ ID NO: 1927510 - DNA, 22 bp, Homo sapiens
caaagccagcgtcctcctctgt

SEQ ID NO: 1927511 - DNA, 23 bp, Homo sapiens
caaagccagcgtcctcctctgtg

SEQ ID NO: 1927512 - DNA, 20 bp, Homo sapiens
caaaggagggtcaggaagga

SEQ ID NO: 1927513 - DNA, 16 bp, Homo sapiens
caaaggtgattttcct

SEQ ID NO: 1927514 - DNA, 20 bp, Homo sapiens
caaagtgagaaattatgaaa

SEQ ID NO: 1927515 - DNA, 15 bp, Homo sapiens
caaagttgtttaact

SEQ ID NO: 1927516 - DNA, 14 bp, Homo sapiens
caaataccagagca

SEQ ID NO: 1927517 - DNA, 15 bp, Homo sapiens
caaataccagagcac

SEQ ID NO: 1927518 - DNA, 18 bp, Homo sapiens
caaataccagagcacaga

SEQ ID NO: 1927519 - DNA, 21 bp, Homo sapiens
caaatatgcactttccctaga

SEQ ID NO: 1927520 - DNA, 14 bp, Homo sapiens
caaattgcagaaga

SEQ ID NO: 1927521 - DNA, 20 bp, Homo sapiens
caacaatttctactttgaag

SEQ ID NO: 1927522 - DNA, 17 bp, Homo sapiens
caacacaatcaaaagat

SEQ ID NO: 1927523 - DNA, 21 bp, Homo sapiens
caacactgccagaagtgtgtt

SEQ ID NO: 1927524 - DNA, 21 bp, Homo sapiens
caacaggttgaggctaaaaca

SEQ ID NO: 1927525 - DNA, 20 bp, Homo sapiens
caacagtagcataggaccct

SEQ ID NO: 1927526 - DNA, 14 bp, Homo sapiens
caaccattccccat

SEQ ID NO: 1927527 - DNA, 14 bp, Homo sapiens
caaccattgaaggg

SEQ ID NO: 1927528 - DNA, 22 bp, Homo sapiens
caacccctaatcgccctgagct

SEQ ID NO: 1927529 - DNA, 18 bp, Homo sapiens
caaccctcagagccaccc

SEQ ID NO: 1927530 - DNA, 21 bp, Homo sapiens
caacctgcctgacatttggag

SEQ ID NO: 1927531 - DNA, 13 bp, Homo sapiens
caacgcagccctg

SEQ ID NO: 1927532 - DNA, 18 bp, Homo sapiens
caacgtggggcagcacag

SEQ ID NO: 1927533 - DNA, 17 bp, Homo sapiens
caactatgatttggaaa

SEQ ID NO: 1927534 - DNA, 13 bp, Homo sapiens
caactccatcaga

SEQ ID NO: 1927535 - DNA, 11 bp, Homo sapiens
caactctggcc

SEQ ID NO: 1927536 - DNA, 15 bp, Homo sapiens
caactctttgagaaa

SEQ ID NO: 1927537 - DNA, 18 bp, Homo sapiens
caactggtatatatttag

SEQ ID NO: 1927538 - DNA, 14 bp, Homo sapiens
caacttcccaggcc

SEQ ID NO: 1927539 - DNA, 16 bp, Homo sapiens
caacttcccaggccga

SEQ ID NO: 1927540 - DNA, 19 bp, Homo sapiens
caacttctgaatattggac

SEQ ID NO: 1927541 - DNA, 21 bp, Homo sapiens
caacttctgaatattggacat

SEQ ID NO: 1927542 - DNA, 12 bp, Homo sapiens
caactttagaaa

SEQ ID NO: 1927543 - DNA, 14 bp, Homo sapiens
caagaagtgggagt

SEQ ID NO: 1927544 - DNA, 14 bp, Homo sapiens
caagaagtgggatt

SEQ ID NO: 1927545 - DNA, 18 bp, Homo sapiens
caagaatagatgctgact

SEQ ID NO: 1927546 - DNA, 20 bp, Homo sapiens
caagacaccttcccagctgc

SEQ ID NO: 1927547 - DNA, 15 bp, Homo sapiens
caagagctcaggaga

SEQ ID NO: 1927548 - DNA, 22 bp, Homo sapiens
caagagctcaggagaaggcctg

SEQ ID NO: 1927549 - DNA, 17 bp, Homo sapiens
caagagggacgcctggg

SEQ ID NO: 1927550 - DNA, 13 bp, Homo sapiens
caagagggcactg

SEQ ID NO: 1927551 - DNA, 14 bp, Homo sapiens
caagagggcactgg

SEQ ID NO: 1927552 - DNA, 20 bp, Homo sapiens
caagagggcactggtggccc

SEQ ID NO: 1927553 - DNA, 19 bp, Homo sapiens
caagagtaaatattgtcac

SEQ ID NO: 1927554 - DNA, 23 bp, Homo sapiens
caagatattttaaaatctgtcac

SEQ ID NO: 1927555 - DNA, 18 bp, Homo sapiens
caagccacagaaatgtgt

SEQ ID NO: 1927556 - DNA, 12 bp, Homo sapiens
caagccaggaga

SEQ ID NO: 1927557 - DNA, 20 bp, Homo sapiens
caagccaggagaccctgtct

SEQ ID NO: 1927558 - DNA, 14 bp, Homo sapiens
caagccgtggcttc

SEQ ID NO: 1927559 - DNA, 18 bp, Homo sapiens
caagccgtggcttcccgc

SEQ ID NO: 1927560 - DNA, 16 bp, Homo sapiens
caagcctgggccactg

SEQ ID NO: 1927561 - DNA, 17 bp, Homo sapiens
caagcctgggccactgg

SEQ ID NO: 1927562 - DNA, 17 bp, Homo sapiens
caagcgacacaggctgc

SEQ ID NO: 1927563 - DNA, 18 bp, Homo sapiens
caagcgacacaggctgcc

SEQ ID NO: 1927564 - DNA, 14 bp, Homo sapiens
caagctgcagggaa

SEQ ID NO: 1927565 - DNA, 13 bp, Homo sapiens
caagcttgtgtac

SEQ ID NO: 1927566 - DNA, 15 bp, Homo sapiens
caagcttgtgtactt

SEQ ID NO: 1927567 - DNA, 21 bp, Homo sapiens
caaggaatgttatcagtatta

SEQ ID NO: 1927568 - DNA, 16 bp, Homo sapiens
caaggcaagaagtggg

SEQ ID NO: 1927569 - DNA, 13 bp, Homo sapiens
caaggcctatgcc

SEQ ID NO: 1927570 - DNA, 14 bp, Homo sapiens
caaggcctatgcca

SEQ ID NO: 1927571 - DNA, 21 bp, Homo sapiens
caaggcctatgccacctgcag

SEQ ID NO: 1927572 - DNA, 23 bp, Homo sapiens
caaggcctatgccacctgcagcg

SEQ ID NO: 1927573 - DNA, 16 bp, Homo sapiens
caagggaaaagtctct

SEQ ID NO: 1927574 - DNA, 18 bp, Homo sapiens
caagggctccagggccag

SEQ ID NO: 1927575 - DNA, 22 bp, Homo sapiens
caaggtgcacctgccccaggct

SEQ ID NO: 1927576 - DNA, 16 bp, Homo sapiens
caaggtgtttctctgt

SEQ ID NO: 1927577 - DNA, 16 bp, Homo sapiens
caagtatgaataaaga

SEQ ID NO: 1927578 - DNA, 19 bp, Homo sapiens
caagttattgacaaactct

SEQ ID NO: 1927579 - DNA, 23 bp, Homo sapiens
caagttccgtctcctctccagcc

SEQ ID NO: 1927580 - DNA, 17 bp, Homo sapiens
caataattgtggagagg

SEQ ID NO: 1927581 - DNA, 23 bp, Homo sapiens
caataattgtggagaggagagaa

SEQ ID NO: 1927582 - DNA, 23 bp, Homo sapiens
caatacccttggcactgatgggc

SEQ ID NO: 1927583 - DNA, 23 bp, Homo sapiens
caataggcaaaggggggaaggga

SEQ ID NO: 1927584 - DNA, 15 bp, Homo sapiens
caatcaaactttcag

SEQ ID NO: 1927585 - DNA, 16 bp, Homo sapiens
caatcagctccttcct

SEQ ID NO: 1927586 - DNA, 19 bp, Homo sapiens
caatccatgtatctgtatg

SEQ ID NO: 1927587 - DNA, 23 bp, Homo sapiens
caatcccaccaaccctcagagcc

SEQ ID NO: 1927588 - DNA, 10 bp, Homo sapiens
caatctaaaa

SEQ ID NO: 1927589 - DNA, 20 bp, Homo sapiens
caatctgcaagtcccaggga

SEQ ID NO: 1927590 - DNA, 14 bp, Homo sapiens
caatgccatcatct

SEQ ID NO: 1927591 - DNA, 21 bp, Homo sapiens
caatggttgggacaatggcaa

SEQ ID NO: 1927592 - DNA, 14 bp, Homo sapiens
caatgtttgcttta

SEQ ID NO: 1927593 - DNA, 13 bp, Homo sapiens
caattccacctgc

SEQ ID NO: 1927594 - DNA, 22 bp, Homo sapiens
caatttctcccgaatcctgagg

SEQ ID NO: 1927595 - DNA, 18 bp, Homo sapiens
cacaaataccagagcaca

SEQ ID NO: 1927596 - DNA, 20 bp, Homo sapiens
cacaacttgtttttggtttt

SEQ ID NO: 1927597 - DNA, 12 bp, Homo sapiens
cacaagaagtgg

SEQ ID NO: 1927598 - DNA, 14 bp, Homo sapiens
cacaagaagtggga

SEQ ID NO: 1927599 - DNA, 12 bp, Homo sapiens
cacacaagacag

SEQ ID NO: 1927600 - DNA, 16 bp, Homo sapiens
cacacaagacagcaga

SEQ ID NO: 1927601 - DNA, 15 bp, Homo sapiens
cacacacacacacgc

SEQ ID NO: 1927602 - DNA, 16 bp, Homo sapiens
cacacacacccttccc

SEQ ID NO: 1927603 - DNA, 14 bp, Homo sapiens
cacacacccttccc

SEQ ID NO: 1927604 - DNA, 15 bp, Homo sapiens
cacacacccttcccc

SEQ ID NO: 1927605 - DNA, 20 bp, Homo sapiens
cacaccagtccacgccgggt

SEQ ID NO: 1927606 - DNA, 13 bp, Homo sapiens
cacacccttcccc

SEQ ID NO: 1927607 - DNA, 18 bp, Homo sapiens
cacacctccacccgtcct

SEQ ID NO: 1927608 - DNA, 22 bp, Homo sapiens
cacacgcgcgcgcgcgcacaca

SEQ ID NO: 1927609 - DNA, 14 bp, Homo sapiens
cacactgctgggaa

SEQ ID NO: 1927610 - DNA, 13 bp, Homo sapiens
cacagaacccttg

SEQ ID NO: 1927611 - DNA, 22 bp, Homo sapiens
cacagagagggggccacctccc

SEQ ID NO: 1927612 - DNA, 17 bp, Homo sapiens
cacagaggccaggcatg

SEQ ID NO: 1927613 - DNA, 20 bp, Homo sapiens
cacagagtgccatccctgag

SEQ ID NO: 1927614 - DNA, 22 bp, Homo sapiens
cacagagtgccatccctgagag

SEQ ID NO: 1927615 - DNA, 17 bp, Homo sapiens
cacagattttttcttta

SEQ ID NO: 1927616 - DNA, 22 bp, Homo sapiens
cacagattttttctttaaataa

SEQ ID NO: 1927617 - DNA, 17 bp, Homo sapiens
cacagcctcccctgcca

SEQ ID NO: 1927618 - DNA, 20 bp, Homo sapiens
cacagcctcccctgccaggg

SEQ ID NO: 1927619 - DNA, 21 bp, Homo sapiens
cacagcctcccctgccagggc

SEQ ID NO: 1927620 - DNA, 18 bp, Homo sapiens
cacagctgcagagacaga

SEQ ID NO: 1927621 - DNA, 19 bp, Homo sapiens
cacaggacgatttcactga

SEQ ID NO: 1927622 - DNA, 18 bp, Homo sapiens
cacaggcccttcctctcc

SEQ ID NO: 1927623 - DNA, 23 bp, Homo sapiens
cacaggcccttcctctccactgc

SEQ ID NO: 1927624 - DNA, 14 bp, Homo sapiens
cacaggctgccgct

SEQ ID NO: 1927625 - DNA, 14 bp, Homo sapiens
cacataaaagaaga

SEQ ID NO: 1927626 - DNA, 12 bp, Homo sapiens
cacatctgtgtc

SEQ ID NO: 1927627 - DNA, 16 bp, Homo sapiens
cacatctgtgtcttgt

SEQ ID NO: 1927628 - DNA, 23 bp, Homo sapiens
cacatggccgctgcccacgtccc

SEQ ID NO: 1927629 - DNA, 20 bp, Homo sapiens
cacatgtcagtaccttcaaa

SEQ ID NO: 1927630 - DNA, 17 bp, Homo sapiens
cacattccctctcatcc

SEQ ID NO: 1927631 - DNA, 13 bp, Homo sapiens
cacattctacttc

SEQ ID NO: 1927632 - DNA, 15 bp, Homo sapiens
caccacacacaccct

SEQ ID NO: 1927633 - DNA, 20 bp, Homo sapiens
caccacacacacccttcccc

SEQ ID NO: 1927634 - DNA, 19 bp, Homo sapiens
caccagggaccagcccagc

SEQ ID NO: 1927635 - DNA, 23 bp, Homo sapiens
caccagggttgaccccagaggat

SEQ ID NO: 1927636 - DNA, 16 bp, Homo sapiens
caccagtccacgccgg

SEQ ID NO: 1927637 - DNA, 18 bp, Homo sapiens
caccagtccacgccgggt

SEQ ID NO: 1927638 - DNA, 18 bp, Homo sapiens
caccattaacaggtcttt

SEQ ID NO: 1927639 - DNA, 16 bp, Homo sapiens
cacccagccaggaggg

SEQ ID NO: 1927640 - DNA, 18 bp, Homo sapiens
cacccccttctccatcca

SEQ ID NO: 1927641 - DNA, 18 bp, Homo sapiens
cacccctcaagccaggag

SEQ ID NO: 1927642 - DNA, 19 bp, Homo sapiens
cacccctgaactggcccca

SEQ ID NO: 1927643 - DNA, 17 bp, Homo sapiens
cacccgtcctggggtgg

SEQ ID NO: 1927644 - DNA, 14 bp, Homo sapiens
cacccgtttccaag

SEQ ID NO: 1927645 - DNA, 16 bp, Homo sapiens
cacccgtttccaagcc

SEQ ID NO: 1927646 - DNA, 21 bp, Homo sapiens
caccctctctgtccaatctgc

SEQ ID NO: 1927647 - DNA, 19 bp, Homo sapiens
caccctctgcagggcagcc

SEQ ID NO: 1927648 - DNA, 19 bp, Homo sapiens
caccctgcacctcattcca

SEQ ID NO: 1927649 - DNA, 21 bp, Homo sapiens
caccctggattgatcggagcc

SEQ ID NO: 1927650 - DNA, 14 bp, Homo sapiens
caccctgtctgcag

SEQ ID NO: 1927651 - DNA, 15 bp, Homo sapiens
caccctgtctgcagg

SEQ ID NO: 1927652 - DNA, 13 bp, Homo sapiens
cacccttccccac

SEQ ID NO: 1927653 - DNA, 15 bp, Homo sapiens
cacccttccccactc

SEQ ID NO: 1927654 - DNA, 13 bp, Homo sapiens
caccgggcctgga

SEQ ID NO: 1927655 - DNA, 11 bp, Homo sapiens
cacctaagtga

SEQ ID NO: 1927656 - DNA, 21 bp, Homo sapiens
cacctataaatactaaatatg

SEQ ID NO: 1927657 - DNA, 18 bp, Homo sapiens
cacctccctgcagctttg

SEQ ID NO: 1927658 - DNA, 18 bp, Homo sapiens
cacctctggccaaatatg

SEQ ID NO: 1927659 - DNA, 21 bp, Homo sapiens
cacctctggccaaatatgcac

SEQ ID NO: 1927660 - DNA, 22 bp, Homo sapiens
cacctctggccaaatatgcact

SEQ ID NO: 1927661 - DNA, 15 bp, Homo sapiens
cacctgacaacttct

SEQ ID NO: 1927662 - DNA, 17 bp, Homo sapiens
cacctgacaacttctga

SEQ ID NO: 1927663 - DNA, 12 bp, Homo sapiens
cacctgccaggc

SEQ ID NO: 1927664 - DNA, 13 bp, Homo sapiens
cacctgccaggct

SEQ ID NO: 1927665 - DNA, 15 bp, Homo sapiens
cacctgccaggctgc

SEQ ID NO: 1927666 - DNA, 16 bp, Homo sapiens
cacctggttccggaat

SEQ ID NO: 1927667 - DNA, 14 bp, Homo sapiens
cacctgtacataca

SEQ ID NO: 1927668 - DNA, 19 bp, Homo sapiens
cacctgtgcttcgggccct

SEQ ID NO: 1927669 - DNA, 16 bp, Homo sapiens
cacctttatgttttaa

SEQ ID NO: 1927670 - DNA, 19 bp, Homo sapiens
cacctttatgttttaatat

SEQ ID NO: 1927671 - DNA, 13 bp, Homo sapiens
cacgaaatgttat

SEQ ID NO: 1927672 - DNA, 17 bp, Homo sapiens
cacgaaatgttattttt

SEQ ID NO: 1927673 - DNA, 20 bp, Homo sapiens
cacgagctgtttactaggga

SEQ ID NO: 1927674 - DNA, 20 bp, Homo sapiens
cacgcttagggtctgtcccg

SEQ ID NO: 1927675 - DNA, 15 bp, Homo sapiens
cacggacaggaagca

SEQ ID NO: 1927676 - DNA, 17 bp, Homo sapiens
cacggagccactcctct

SEQ ID NO: 1927677 - DNA, 19 bp, Homo sapiens
cacggagccactcctctga

SEQ ID NO: 1927678 - DNA, 23 bp, Homo sapiens
cacggagccactcctctgactca

SEQ ID NO: 1927679 - DNA, 15 bp, Homo sapiens
cacggccactgcagt

SEQ ID NO: 1927680 - DNA, 20 bp, Homo sapiens
cacgggggaggccgaggcag

SEQ ID NO: 1927681 - DNA, 21 bp, Homo sapiens
cacgggggaggccgaggcagg

SEQ ID NO: 1927682 - DNA, 22 bp, Homo sapiens
cacgggggaggccgaggcaggg

SEQ ID NO: 1927683 - DNA, 17 bp, Homo sapiens
cacgtagtagggtcagg

SEQ ID NO: 1927684 - DNA, 20 bp, Homo sapiens
cacgtagtagggtcaggcca

SEQ ID NO: 1927685 - DNA, 19 bp, Homo sapiens
cacgtcccgggcactgtca

SEQ ID NO: 1927686 - DNA, 12 bp, Homo sapiens
cacgtttagaaa

SEQ ID NO: 1927687 - DNA, 15 bp, Homo sapiens
cactacgcagaagag

SEQ ID NO: 1927688 - DNA, 16 bp, Homo sapiens
cactaggtgcccagtc

SEQ ID NO: 1927689 - DNA, 21 bp, Homo sapiens
cactaggtgcccagtcttgag

SEQ ID NO: 1927690 - DNA, 22 bp, Homo sapiens
cactatgtccatgaaaaacagc

SEQ ID NO: 1927691 - DNA, 13 bp, Homo sapiens
cactattggactt

SEQ ID NO: 1927692 - DNA, 23 bp, Homo sapiens
cactcagcatttcggtgcttccc

SEQ ID NO: 1927693 - DNA, 17 bp, Homo sapiens
cactccagacccctggc

SEQ ID NO: 1927694 - DNA, 16 bp, Homo sapiens
cactcccttgggctcc

SEQ ID NO: 1927695 - DNA, 15 bp, Homo sapiens
cactctgaccgggct

SEQ ID NO: 1927696 - DNA, 16 bp, Homo sapiens
cactctgcttgttatt

SEQ ID NO: 1927697 - DNA, 11 bp, Homo sapiens
cactctttctt

SEQ ID NO: 1927698 - DNA, 20 bp, Homo sapiens
cactctttcttctctctttg

SEQ ID NO: 1927699 - DNA, 20 bp, Homo sapiens
cactgaagtgaatacatggt

SEQ ID NO: 1927700 - DNA, 16 bp, Homo sapiens
cactgagaaggcccca

SEQ ID NO: 1927701 - DNA, 17 bp, Homo sapiens
cactgagaaggccccag

SEQ ID NO: 1927702 - DNA, 19 bp, Homo sapiens
cactgagataccagcgagg

SEQ ID NO: 1927703 - DNA, 23 bp, Homo sapiens
cactgagataccagcgaggaggc

SEQ ID NO: 1927704 - DNA, 14 bp, Homo sapiens
cactgagcaaagca

SEQ ID NO: 1927705 - DNA, 18 bp, Homo sapiens
cactgcacagtgcatctc

SEQ ID NO: 1927706 - DNA, 14 bp, Homo sapiens
cactgctggctgcc

SEQ ID NO: 1927707 - DNA, 13 bp, Homo sapiens
cactgcttgagga

SEQ ID NO: 1927708 - DNA, 16 bp, Homo sapiens
cactggaaaacataga

SEQ ID NO: 1927709 - DNA, 16 bp, Homo sapiens
cactggcatctctgga

SEQ ID NO: 1927710 - DNA, 18 bp, Homo sapiens
cactggcatctctggagt

SEQ ID NO: 1927711 - DNA, 13 bp, Homo sapiens
cactgggccggca

SEQ ID NO: 1927712 - DNA, 21 bp, Homo sapiens
cactgggccggcagcctggtt

SEQ ID NO: 1927713 - DNA, 22 bp, Homo sapiens
cactggtggcccgacagcctgg

SEQ ID NO: 1927714 - DNA, 14 bp, Homo sapiens
cactgtcatgccca

SEQ ID NO: 1927715 - DNA, 21 bp, Homo sapiens
cactgtcatgcccagcttgga

SEQ ID NO: 1927716 - DNA, 20 bp, Homo sapiens
cactgtgcacatctgtgtct

SEQ ID NO: 1927717 - DNA, 17 bp, Homo sapiens
cactgttccccctgtgc

SEQ ID NO: 1927718 - DNA, 20 bp, Homo sapiens
cacttagaaattgcatttcc

SEQ ID NO: 1927719 - DNA, 24 bp, Homo sapiens
cacttagaaattgcatttcctgac

SEQ ID NO: 1927720 - DNA, 13 bp, Homo sapiens
cacttatttctaa

SEQ ID NO: 1927721 - DNA, 21 bp, Homo sapiens
cacttcaagtgaccaccagga

SEQ ID NO: 1927722 - DNA, 23 bp, Homo sapiens
cacttccctgcaaggtgcacctg

SEQ ID NO: 1927723 - DNA, 12 bp, Homo sapiens
cactttccctag

SEQ ID NO: 1927724 - DNA, 17 bp, Homo sapiens
cactttgaaaatatttc

SEQ ID NO: 1927725 - DNA, 17 bp, Homo sapiens
cactttgcagacctggg

SEQ ID NO: 1927726 - DNA, 14 bp, Homo sapiens
cactttggccacag

SEQ ID NO: 1927727 - DNA, 17 bp, Homo sapiens
cacttttgacaaaggca

SEQ ID NO: 1927728 - DNA, 19 bp, Homo sapiens
cagaaaacggttaaaactg

SEQ ID NO: 1927729 - DNA, 17 bp, Homo sapiens
cagaaagcatctattcc

SEQ ID NO: 1927730 - DNA, 19 bp, Homo sapiens
cagaaagggcagcccctcc

SEQ ID NO: 1927731 - DNA, 22 bp, Homo sapiens
cagaaataccaaaattatttca

SEQ ID NO: 1927732 - DNA, 23 bp, Homo sapiens
cagaaataccaaaattatttcag

SEQ ID NO: 1927733 - DNA, 15 bp, Homo sapiens
cagaaatatgattga

SEQ ID NO: 1927734 - DNA, 23 bp, Homo sapiens
cagaaatgtacaactttttacct

SEQ ID NO: 1927735 - DNA, 20 bp, Homo sapiens
cagaaccaacgggtctgtgg

SEQ ID NO: 1927736 - DNA, 21 bp, Homo sapiens
cagaaccaacgggtctgtggg

SEQ ID NO: 1927737 - DNA, 22 bp, Homo sapiens
cagaacccttggagccaatgga

SEQ ID NO: 1927738 - DNA, 17 bp, Homo sapiens
cagaactaccaaaatga

SEQ ID NO: 1927739 - DNA, 18 bp, Homo sapiens
cagaagaaactcctggat

SEQ ID NO: 1927740 - DNA, 13 bp, Homo sapiens
cagaagagaaagt

SEQ ID NO: 1927741 - DNA, 14 bp, Homo sapiens
cagaaggaggagga

SEQ ID NO: 1927742 - DNA, 17 bp, Homo sapiens
cagaagttgttagtgat

SEQ ID NO: 1927743 - DNA, 23 bp, Homo sapiens
cagaagttgttagtgatttgcta

SEQ ID NO: 1927744 - DNA, 21 bp, Homo sapiens
cagaccccaccctgtctgcag

SEQ ID NO: 1927745 - DNA, 14 bp, Homo sapiens
cagacccctaccct

SEQ ID NO: 1927746 - DNA, 16 bp, Homo sapiens
cagacccctggctttt

SEQ ID NO: 1927747 - DNA, 13 bp, Homo sapiens
cagacctgggact

SEQ ID NO: 1927748 - DNA, 16 bp, Homo sapiens
cagacgcctgaggaac

SEQ ID NO: 1927749 - DNA, 16 bp, Homo sapiens
cagagagaagcacccc

SEQ ID NO: 1927750 - DNA, 18 bp, Homo sapiens
cagagaggacgtgggcgg

SEQ ID NO: 1927751 - DNA, 14 bp, Homo sapiens
cagagagtggctcc

SEQ ID NO: 1927752 - DNA, 15 bp, Homo sapiens
cagagagtggctcct

SEQ ID NO: 1927753 - DNA, 20 bp, Homo sapiens
cagagattgggggggcttgg

SEQ ID NO: 1927754 - DNA, 22 bp, Homo sapiens
cagagccacccctaaagagata

SEQ ID NO: 1927755 - DNA, 15 bp, Homo sapiens
cagagccatctgcga

SEQ ID NO: 1927756 - DNA, 14 bp, Homo sapiens
cagagcccaggaat

SEQ ID NO: 1927757 - DNA, 23 bp, Homo sapiens
cagagcccaggaattctcacagg

SEQ ID NO: 1927758 - DNA, 19 bp, Homo sapiens
cagagccgtggtcctttgg

SEQ ID NO: 1927759 - DNA, 13 bp, Homo sapiens
cagagcctgggcg

SEQ ID NO: 1927760 - DNA, 13 bp, Homo sapiens
cagagcttccctg

SEQ ID NO: 1927761 - DNA, 18 bp, Homo sapiens
cagagcttccctgactca

SEQ ID NO: 1927762 - DNA, 18 bp, Homo sapiens
cagaggaaggggccagag

SEQ ID NO: 1927763 - DNA, 21 bp, Homo sapiens
cagaggaaggggccagaggct

SEQ ID NO: 1927764 - DNA, 18 bp, Homo sapiens
cagaggcagtggcagcaa

SEQ ID NO: 1927765 - DNA, 20 bp, Homo sapiens
cagaggccctcgctgccagc

SEQ ID NO: 1927766 - DNA, 14 bp, Homo sapiens
cagagggcactctg

SEQ ID NO: 1927767 - DNA, 16 bp, Homo sapiens
cagaggggagaggaag

SEQ ID NO: 1927768 - DNA, 21 bp, Homo sapiens
cagagtaaaattacagaagaa

SEQ ID NO: 1927769 - DNA, 15 bp, Homo sapiens
cagagtcagcagaac

SEQ ID NO: 1927770 - DNA, 17 bp, Homo sapiens
cagagtgagacccagcc

SEQ ID NO: 1927771 - DNA, 20 bp, Homo sapiens
cagagtgagacccagccctc

SEQ ID NO: 1927772 - DNA, 18 bp, Homo sapiens
cagagtgccatccctgag

SEQ ID NO: 1927773 - DNA, 20 bp, Homo sapiens
cagataaaaacaatatatgt

SEQ ID NO: 1927774 - DNA, 22 bp, Homo sapiens
cagataaaaacaatatatgtaa

SEQ ID NO: 1927775 - DNA, 17 bp, Homo sapiens
cagatatgtattacttt

SEQ ID NO: 1927776 - DNA, 20 bp, Homo sapiens
cagatatgtattacttttct

SEQ ID NO: 1927777 - DNA, 14 bp, Homo sapiens
cagatgacccctcc

SEQ ID NO: 1927778 - DNA, 18 bp, Homo sapiens
cagatgcctcctctgtcc

SEQ ID NO: 1927779 - DNA, 21 bp, Homo sapiens
cagatgcctcctctgtcctca

SEQ ID NO: 1927780 - DNA, 18 bp, Homo sapiens
cagattggagaaaccctt

SEQ ID NO: 1927781 - DNA, 15 bp, Homo sapiens
cagattttttcttta

SEQ ID NO: 1927782 - DNA, 12 bp, Homo sapiens
cagcacagagag

SEQ ID NO: 1927783 - DNA, 13 bp, Homo sapiens
cagcacagagagg

SEQ ID NO: 1927784 - DNA, 20 bp, Homo sapiens
cagcacagagagggggccac

SEQ ID NO: 1927785 - DNA, 18 bp, Homo sapiens
cagcactgcttgaggaaa

SEQ ID NO: 1927786 - DNA, 18 bp, Homo sapiens
cagcagctagagctcagt

SEQ ID NO: 1927787 - DNA, 18 bp, Homo sapiens
cagcagctgaagtctctt

SEQ ID NO: 1927788 - DNA, 21 bp, Homo sapiens
cagcagggctaccctgagctg

SEQ ID NO: 1927789 - DNA, 16 bp, Homo sapiens
cagcaggggggttggg

SEQ ID NO: 1927790 - DNA, 19 bp, Homo sapiens
cagcagtgtgaggccaggg

SEQ ID NO: 1927791 - DNA, 15 bp, Homo sapiens
cagccaaattgcaga

SEQ ID NO: 1927792 - DNA, 19 bp, Homo sapiens
cagccaaattgcagaagaa

SEQ ID NO: 1927793 - DNA, 20 bp, Homo sapiens
cagccagtaaggcagctctg

SEQ ID NO: 1927794 - DNA, 17 bp, Homo sapiens
cagccattcacaacaca

SEQ ID NO: 1927795 - DNA, 20 bp, Homo sapiens
cagccattcacaacacaatc

SEQ ID NO: 1927796 - DNA, 18 bp, Homo sapiens
cagccctagggtggagag

SEQ ID NO: 1927797 - DNA, 13 bp, Homo sapiens
cagccctccctgc

SEQ ID NO: 1927798 - DNA, 18 bp, Homo sapiens
cagccctccctgcccctc

SEQ ID NO: 1927799 - DNA, 13 bp, Homo sapiens
cagccctgctttg

SEQ ID NO: 1927800 - DNA, 22 bp, Homo sapiens
cagccctgctttgggctgccct

SEQ ID NO: 1927801 - DNA, 19 bp, Homo sapiens
cagccgctgagcgaggaga

SEQ ID NO: 1927802 - DNA, 14 bp, Homo sapiens
cagccgtgccttca

SEQ ID NO: 1927803 - DNA, 20 bp, Homo sapiens
cagccgtgccttcagctcta

SEQ ID NO: 1927804 - DNA, 16 bp, Homo sapiens
cagcctcccctgccag

SEQ ID NO: 1927805 - DNA, 20 bp, Homo sapiens
cagcctccggatgacacaaa

SEQ ID NO: 1927806 - DNA, 20 bp, Homo sapiens
cagcctggcacagggcagtg

SEQ ID NO: 1927807 - DNA, 13 bp, Homo sapiens
cagcctggcccca

SEQ ID NO: 1927808 - DNA, 17 bp, Homo sapiens
cagcctggccccaagca

SEQ ID NO: 1927809 - DNA, 14 bp, Homo sapiens
cagcctggttccct

SEQ ID NO: 1927810 - DNA, 15 bp, Homo sapiens
cagcctggttccctc

SEQ ID NO: 1927811 - DNA, 17 bp, Homo sapiens
cagcgaggaggctccag

SEQ ID NO: 1927812 - DNA, 23 bp, Homo sapiens
cagcgccctctacctcctagcaa

SEQ ID NO: 1927813 - DNA, 15 bp, Homo sapiens
cagcggctcttcctg

SEQ ID NO: 1927814 - DNA, 20 bp, Homo sapiens
cagcggtcttctccatctcc

SEQ ID NO: 1927815 - DNA, 15 bp, Homo sapiens
cagcgtcctcctctg

SEQ ID NO: 1927816 - DNA, 20 bp, Homo sapiens
cagcgtctgagcggccgcct

SEQ ID NO: 1927817 - DNA, 19 bp, Homo sapiens
cagctaaagcaatatgcat

SEQ ID NO: 1927818 - DNA, 14 bp, Homo sapiens
cagctatttctcat

SEQ ID NO: 1927819 - DNA, 14 bp, Homo sapiens
cagctccttcctgg

SEQ ID NO: 1927820 - DNA, 16 bp, Homo sapiens
cagctccttcctggag

SEQ ID NO: 1927821 - DNA, 21 bp, Homo sapiens
cagctctttggtgccagctgt

SEQ ID NO: 1927822 - DNA, 11 bp, Homo sapiens
cagctgctcct

SEQ ID NO: 1927823 - DNA, 16 bp, Homo sapiens
cagctgggttggaaaa

SEQ ID NO: 1927824 - DNA, 16 bp, Homo sapiens
cagctgtactgagttc

SEQ ID NO: 1927825 - DNA, 19 bp, Homo sapiens
cagctgtttcatcaccaga

SEQ ID NO: 1927826 - DNA, 22 bp, Homo sapiens
cagcttcttaatataactgcct

SEQ ID NO: 1927827 - DNA, 22 bp, Homo sapiens
cagcttggagtgccacgtggcc

SEQ ID NO: 1927828 - DNA, 13 bp, Homo sapiens
caggaaatgaaaa

SEQ ID NO: 1927829 - DNA, 20 bp, Homo sapiens
caggaaatgaaaatgtcttg

SEQ ID NO: 1927830 - DNA, 17 bp, Homo sapiens
caggacagatcaggtca

SEQ ID NO: 1927831 - DNA, 13 bp, Homo sapiens
caggacccagagg

SEQ ID NO: 1927832 - DNA, 15 bp, Homo sapiens
caggagaaggcctgc

SEQ ID NO: 1927833 - DNA, 23 bp, Homo sapiens
caggagcatggccgcaacttccc

SEQ ID NO: 1927834 - DNA, 16 bp, Homo sapiens
caggagggtggcactt

SEQ ID NO: 1927835 - DNA, 21 bp, Homo sapiens
caggaggtactgtgaggaaga

SEQ ID NO: 1927836 - DNA, 19 bp, Homo sapiens
caggcaatagtcaaaaaca

SEQ ID NO: 1927837 - DNA, 22 bp, Homo sapiens
caggcactgagataccagcgag

SEQ ID NO: 1927838 - DNA, 12 bp, Homo sapiens
caggcagaatca

SEQ ID NO: 1927839 - DNA, 20 bp, Homo sapiens
caggcatgcgaatgagctgg

SEQ ID NO: 1927840 - DNA, 17 bp, Homo sapiens
caggcatggcccagcct

SEQ ID NO: 1927841 - DNA, 20 bp, Homo sapiens
caggcatggcccagcctgga

SEQ ID NO: 1927842 - DNA, 21 bp, Homo sapiens
caggcatggcccagcctggag

SEQ ID NO: 1927843 - DNA, 19 bp, Homo sapiens
caggcccttcctctccact

SEQ ID NO: 1927844 - DNA, 15 bp, Homo sapiens
caggccgtggctgcc

SEQ ID NO: 1927845 - DNA, 16 bp, Homo sapiens
caggcgttctcagcct

SEQ ID NO: 1927846 - DNA, 15 bp, Homo sapiens
caggctcaggctgcc

SEQ ID NO: 1927847 - DNA, 19 bp, Homo sapiens
caggctcaggctgcccagc

SEQ ID NO: 1927848 - DNA, 14 bp, Homo sapiens
caggctcttctcct

SEQ ID NO: 1927849 - DNA, 19 bp, Homo sapiens
caggctgcccagcggctct

SEQ ID NO: 1927850 - DNA, 21 bp, Homo sapiens
caggcttgggctccattccca

SEQ ID NO: 1927851 - DNA, 20 bp, Homo sapiens
cagggaaaattatttgcata

SEQ ID NO: 1927852 - DNA, 21 bp, Homo sapiens
cagggaattttcattggatgc

SEQ ID NO: 1927853 - DNA, 17 bp, Homo sapiens
cagggacagttgggtgt

SEQ ID NO: 1927854 - DNA, 20 bp, Homo sapiens
cagggaccagcccagcctgc

SEQ ID NO: 1927855 - DNA, 14 bp, Homo sapiens
cagggacgacccgg

SEQ ID NO: 1927856 - DNA, 12 bp, Homo sapiens
cagggagggaac

SEQ ID NO: 1927857 - DNA, 19 bp, Homo sapiens
cagggagggaacagacctc

SEQ ID NO: 1927858 - DNA, 13 bp, Homo sapiens
cagggcagagtga

SEQ ID NO: 1927859 - DNA, 19 bp, Homo sapiens
cagggcagagtgagaccca

SEQ ID NO: 1927860 - DNA, 18 bp, Homo sapiens
cagggcagcctgtgggag

SEQ ID NO: 1927861 - DNA, 20 bp, Homo sapiens
cagggcatggccaggtggcc

SEQ ID NO: 1927862 - DNA, 16 bp, Homo sapiens
cagggctaccctgagc

SEQ ID NO: 1927863 - DNA, 18 bp, Homo sapiens
cagggctaccctgagctg

SEQ ID NO: 1927864 - DNA, 13 bp, Homo sapiens
cagggctcctggg

SEQ ID NO: 1927865 - DNA, 16 bp, Homo sapiens
cagggctgggcgcctc

SEQ ID NO: 1927866 - DNA, 18 bp, Homo sapiens
cagggctgggcgcctctg

SEQ ID NO: 1927867 - DNA, 21 bp, Homo sapiens
cagggctgggcgcctctgtcc

SEQ ID NO: 1927868 - DNA, 14 bp, Homo sapiens
cagggcttctcttt

SEQ ID NO: 1927869 - DNA, 14 bp, Homo sapiens
caggggacactgaa

SEQ ID NO: 1927870 - DNA, 15 bp, Homo sapiens
caggggcccctcctc

SEQ ID NO: 1927871 - DNA, 18 bp, Homo sapiens
caggggcccctcctccag

SEQ ID NO: 1927872 - DNA, 16 bp, Homo sapiens
caggggctgggcagag

SEQ ID NO: 1927873 - DNA, 20 bp, Homo sapiens
caggggctgggcagagggga

SEQ ID NO: 1927874 - DNA, 13 bp, Homo sapiens
caggggggttggg

SEQ ID NO: 1927875 - DNA, 20 bp, Homo sapiens
cagggggtttgaggaccctc

SEQ ID NO: 1927876 - DNA, 20 bp, Homo sapiens
caggggttccccaggagaga

SEQ ID NO: 1927877 - DNA, 14 bp, Homo sapiens
cagggtgaggatgg

SEQ ID NO: 1927878 - DNA, 13 bp, Homo sapiens
cagggttccagac

SEQ ID NO: 1927879 - DNA, 14 bp, Homo sapiens
cagggttccagaca

SEQ ID NO: 1927880 - DNA, 21 bp, Homo sapiens
cagggttccagacagggtggg

SEQ ID NO: 1927881 - DNA, 19 bp, Homo sapiens
cagggttctagaaggggcg

SEQ ID NO: 1927882 - DNA, 13 bp, Homo sapiens
caggtcagagccc

SEQ ID NO: 1927883 - DNA, 18 bp, Homo sapiens
caggtcagagcccaggaa

SEQ ID NO: 1927884 - DNA, 18 bp, Homo sapiens
caggtcccgagccccctg

SEQ ID NO: 1927885 - DNA, 21 bp, Homo sapiens
caggtcccgagccccctgtcc

SEQ ID NO: 1927886 - DNA, 14 bp, Homo sapiens
caggtcctttcctt

SEQ ID NO: 1927887 - DNA, 16 bp, Homo sapiens
caggtcctttccttct

SEQ ID NO: 1927888 - DNA, 23 bp, Homo sapiens
caggtcctttccttctcgtcttc

SEQ ID NO: 1927889 - DNA, 21 bp, Homo sapiens
caggtctttgaaatatgcatg

SEQ ID NO: 1927890 - DNA, 23 bp, Homo sapiens
caggtctttgaaatatgcatgta

SEQ ID NO: 1927891 - DNA, 21 bp, Homo sapiens
caggtgctacacccttttcca

SEQ ID NO: 1927892 - DNA, 16 bp, Homo sapiens
caggtggccactccag

SEQ ID NO: 1927893 - DNA, 21 bp, Homo sapiens
caggtggccactccagacccc

SEQ ID NO: 1927894 - DNA, 15 bp, Homo sapiens
caggttgaggctaaa

SEQ ID NO: 1927895 - DNA, 22 bp, Homo sapiens
caggttgtctgaagtcactgca

SEQ ID NO: 1927896 - DNA, 12 bp, Homo sapiens
cagtaaggcagc

SEQ ID NO: 1927897 - DNA, 19 bp, Homo sapiens
cagtaaggcagctctgtcg

SEQ ID NO: 1927898 - DNA, 21 bp, Homo sapiens
cagtaattggtccgatctttg

SEQ ID NO: 1927899 - DNA, 23 bp, Homo sapiens
cagtaccttcaaactagggccaa

SEQ ID NO: 1927900 - DNA, 14 bp, Homo sapiens
cagtattgccacct

SEQ ID NO: 1927901 - DNA, 23 bp, Homo sapiens
cagtcaagttccgtctcctctcc

SEQ ID NO: 1927902 - DNA, 15 bp, Homo sapiens
cagtcacccctgtct

SEQ ID NO: 1927903 - DNA, 12 bp, Homo sapiens
cagtcagcccag

SEQ ID NO: 1927904 - DNA, 21 bp, Homo sapiens
cagtcaggaaaggaatcattt

SEQ ID NO: 1927905 - DNA, 18 bp, Homo sapiens
cagtcctcggcagctccg

SEQ ID NO: 1927906 - DNA, 15 bp, Homo sapiens
cagtcgatagagctg

SEQ ID NO: 1927907 - DNA, 20 bp, Homo sapiens
cagtgaacataactgtaaca

SEQ ID NO: 1927908 - DNA, 16 bp, Homo sapiens
cagtgaagcccaggag

SEQ ID NO: 1927909 - DNA, 22 bp, Homo sapiens
cagtgaagcccaggaggacctg

SEQ ID NO: 1927910 - DNA, 13 bp, Homo sapiens
cagtgagagcagg

SEQ ID NO: 1927911 - DNA, 17 bp, Homo sapiens
cagtgagagcagggctg

SEQ ID NO: 1927912 - DNA, 22 bp, Homo sapiens
cagtgagagcagggctgggcgc

SEQ ID NO: 1927913 - DNA, 17 bp, Homo sapiens
cagtgcatctcagccca

SEQ ID NO: 1927914 - DNA, 18 bp, Homo sapiens
cagtggagaggggacttg

SEQ ID NO: 1927915 - DNA, 19 bp, Homo sapiens
cagtggagaggggacttgg

SEQ ID NO: 1927916 - DNA, 11 bp, Homo sapiens
cagtgggaact

SEQ ID NO: 1927917 - DNA, 16 bp, Homo sapiens
cagtgggacagggcat

SEQ ID NO: 1927918 - DNA, 12 bp, Homo sapiens
cagtgggatctt

SEQ ID NO: 1927919 - DNA, 23 bp, Homo sapiens
cagtgtatctcgaagtcttccat

SEQ ID NO: 1927920 - DNA, 15 bp, Homo sapiens
cagtgtctaccttca

SEQ ID NO: 1927921 - DNA, 16 bp, Homo sapiens
cagtgtgaggccaggg

SEQ ID NO: 1927922 - DNA, 21 bp, Homo sapiens
cagttcaatcaaactttcagc

SEQ ID NO: 1927923 - DNA, 23 bp, Homo sapiens
cagttcatatgtaccatgtacat

SEQ ID NO: 1927924 - DNA, 21 bp, Homo sapiens
cagttccaatgtgcccagtca

SEQ ID NO: 1927925 - DNA, 14 bp, Homo sapiens
cagttctctttgta

SEQ ID NO: 1927926 - DNA, 14 bp, Homo sapiens
cagtttgctttgta

SEQ ID NO: 1927927 - DNA, 15 bp, Homo sapiens
cagttttatcatttt

SEQ ID NO: 1927928 - DNA, 20 bp, Homo sapiens
catacaggagagctgcagtt

SEQ ID NO: 1927929 - DNA, 19 bp, Homo sapiens
cataccaggggttccccag

SEQ ID NO: 1927930 - DNA, 12 bp, Homo sapiens
catacccagtgt

SEQ ID NO: 1927931 - DNA, 20 bp, Homo sapiens
catagaggatgatgtaatta

SEQ ID NO: 1927932 - DNA, 18 bp, Homo sapiens
catagtaccaatcatttt

SEQ ID NO: 1927933 - DNA, 18 bp, Homo sapiens
catagtgatggttcccct

SEQ ID NO: 1927934 - DNA, 19 bp, Homo sapiens
catagtgatggttcccctg

SEQ ID NO: 1927935 - DNA, 13 bp, Homo sapiens
catagtttctgta

SEQ ID NO: 1927936 - DNA, 16 bp, Homo sapiens
catagtttctgtaatt

SEQ ID NO: 1927937 - DNA, 15 bp, Homo sapiens
catataatgttgtta

SEQ ID NO: 1927938 - DNA, 18 bp, Homo sapiens
catataatgttgttattt

SEQ ID NO: 1927939 - DNA, 21 bp, Homo sapiens
catatattataagatttttag

SEQ ID NO: 1927940 - DNA, 20 bp, Homo sapiens
catatctgtgcaatggaata

SEQ ID NO: 1927941 - DNA, 15 bp, Homo sapiens
catatgtaccatgta

SEQ ID NO: 1927942 - DNA, 18 bp, Homo sapiens
catattttcaccatttga

SEQ ID NO: 1927943 - DNA, 20 bp, Homo sapiens
catcaaagatgagaagccaa

SEQ ID NO: 1927944 - DNA, 15 bp, Homo sapiens
catcaacaaaaattg

SEQ ID NO: 1927945 - DNA, 23 bp, Homo sapiens
catcaagcacagaaggaggagga

SEQ ID NO: 1927946 - DNA, 22 bp, Homo sapiens
catcaagttattgacaaactct

SEQ ID NO: 1927947 - DNA, 18 bp, Homo sapiens
catcactgctgtccctcc

SEQ ID NO: 1927948 - DNA, 15 bp, Homo sapiens
catcagtgctccctc

SEQ ID NO: 1927949 - DNA, 24 bp, Homo sapiens
catcagtgctccctcacatgtcag

SEQ ID NO: 1927950 - DNA, 12 bp, Homo sapiens
catcattctctg

SEQ ID NO: 1927951 - DNA, 17 bp, Homo sapiens
catcattctctgtctca

SEQ ID NO: 1927952 - DNA, 20 bp, Homo sapiens
catccaggtcctttccttct

SEQ ID NO: 1927953 - DNA, 14 bp, Homo sapiens
catccatcatcatg

SEQ ID NO: 1927954 - DNA, 17 bp, Homo sapiens
catcccgagcacctcca

SEQ ID NO: 1927955 - DNA, 15 bp, Homo sapiens
catcccttggcccct

SEQ ID NO: 1927956 - DNA, 19 bp, Homo sapiens
catcccttggcccctctct

SEQ ID NO: 1927957 - DNA, 16 bp, Homo sapiens
catcctgtacaagtgc

SEQ ID NO: 1927958 - DNA, 17 bp, Homo sapiens
catcctgtacaagtgct

SEQ ID NO: 1927959 - DNA, 18 bp, Homo sapiens
catctaacctcatcttct

SEQ ID NO: 1927960 - DNA, 19 bp, Homo sapiens
catctaacctcatcttctt

SEQ ID NO: 1927961 - DNA, 17 bp, Homo sapiens
catctcccagataatgt

SEQ ID NO: 1927962 - DNA, 18 bp, Homo sapiens
catctcccagataatgtg

SEQ ID NO: 1927963 - DNA, 22 bp, Homo sapiens
catctgcgacaccaccaacagg

SEQ ID NO: 1927964 - DNA, 23 bp, Homo sapiens
catctgcgacaccaccaacaggc

SEQ ID NO: 1927965 - DNA, 18 bp, Homo sapiens
catctgtaaatatcccag

SEQ ID NO: 1927966 - DNA, 20 bp, Homo sapiens
catctgtaaatatcccagag

SEQ ID NO: 1927967 - DNA, 22 bp, Homo sapiens
catctgtaaatatcccagagaa

SEQ ID NO: 1927968 - DNA, 16 bp, Homo sapiens
catctgtccctccggg

SEQ ID NO: 1927969 - DNA, 17 bp, Homo sapiens
catctgtggcctggggc

SEQ ID NO: 1927970 - DNA, 11 bp, Homo sapiens
catctgtgtct

SEQ ID NO: 1927971 - DNA, 13 bp, Homo sapiens
catctgtgtcttg

SEQ ID NO: 1927972 - DNA, 14 bp, Homo sapiens
catctgtgtcttgt

SEQ ID NO: 1927973 - DNA, 19 bp, Homo sapiens
catctttctaatctttttc

SEQ ID NO: 1927974 - DNA, 18 bp, Homo sapiens
catgaagattctttccca

SEQ ID NO: 1927975 - DNA, 15 bp, Homo sapiens
catgacatttctcaa

SEQ ID NO: 1927976 - DNA, 17 bp, Homo sapiens
catgacatttctcaaag

SEQ ID NO: 1927977 - DNA, 15 bp, Homo sapiens
catgattttggccac

SEQ ID NO: 1927978 - DNA, 12 bp, Homo sapiens
catgcccagctt

SEQ ID NO: 1927979 - DNA, 19 bp, Homo sapiens
catgcgaatgagctgggcc

SEQ ID NO: 1927980 - DNA, 15 bp, Homo sapiens
catgcgggctgggca

SEQ ID NO: 1927981 - DNA, 19 bp, Homo sapiens
catggaggcacacagctgc

SEQ ID NO: 1927982 - DNA, 16 bp, Homo sapiens
catggatgtttcttct

SEQ ID NO: 1927983 - DNA, 15 bp, Homo sapiens
catggccaggtggcc

SEQ ID NO: 1927984 - DNA, 15 bp, Homo sapiens
catggcccagcctgg

SEQ ID NO: 1927985 - DNA, 20 bp, Homo sapiens
catggcccagcctggagccg

SEQ ID NO: 1927986 - DNA, 15 bp, Homo sapiens
catggccgctgccca

SEQ ID NO: 1927987 - DNA, 20 bp, Homo sapiens
catgggaaatgtcaacaagt

SEQ ID NO: 1927988 - DNA, 15 bp, Homo sapiens
catgggcagagccca

SEQ ID NO: 1927989 - DNA, 19 bp, Homo sapiens
catggtcagccctagggtg

SEQ ID NO: 1927990 - DNA, 17 bp, Homo sapiens
catggtgtgccacaggc

SEQ ID NO: 1927991 - DNA, 17 bp, Homo sapiens
catggtgttcatgacaa

SEQ ID NO: 1927992 - DNA, 18 bp, Homo sapiens
catgtaagaatccaaagt

SEQ ID NO: 1927993 - DNA, 22 bp, Homo sapiens
catgtactgagccttgtaattc

SEQ ID NO: 1927994 - DNA, 21 bp, Homo sapiens
catgtagaagagggagaagga

SEQ ID NO: 1927995 - DNA, 21 bp, Homo sapiens
catgtgtgtccacgactgtct

SEQ ID NO: 1927996 - DNA, 22 bp, Homo sapiens
catgtgtgtccacgactgtctc

SEQ ID NO: 1927997 - DNA, 16 bp, Homo sapiens
catgttcttgttttgt

SEQ ID NO: 1927998 - DNA, 15 bp, Homo sapiens
cattaccttaaaatt

SEQ ID NO: 1927999 - DNA, 19 bp, Homo sapiens
cattactcaaaatgcagga

SEQ ID NO: 1928000 - DNA, 18 bp, Homo sapiens
cattagcagtttgctttg

SEQ ID NO: 1928001 - DNA, 13 bp, Homo sapiens
cattatgtttgca

SEQ ID NO: 1928002 - DNA, 21 bp, Homo sapiens
cattatttgaaaacactgctg

SEQ ID NO: 1928003 - DNA, 17 bp, Homo sapiens
cattcacaacacaatca

SEQ ID NO: 1928004 - DNA, 15 bp, Homo sapiens
cattccctctcatcc

SEQ ID NO: 1928005 - DNA, 17 bp, Homo sapiens
cattctacttcagcttt

SEQ ID NO: 1928006 - DNA, 14 bp, Homo sapiens
cattctcactccta

SEQ ID NO: 1928007 - DNA, 16 bp, Homo sapiens
cattctggggtggggc

SEQ ID NO: 1928008 - DNA, 20 bp, Homo sapiens
cattctggggtggggcttgg

SEQ ID NO: 1928009 - DNA, 17 bp, Homo sapiens
cattcttctctcccaca

SEQ ID NO: 1928010 - DNA, 16 bp, Homo sapiens
cattggacccttccat

SEQ ID NO: 1928011 - DNA, 15 bp, Homo sapiens
cattgtataggccat

SEQ ID NO: 1928012 - DNA, 22 bp, Homo sapiens
cattgtataggccatctgtaaa

SEQ ID NO: 1928013 - DNA, 21 bp, Homo sapiens
cattgtccaatcctatgtttt

SEQ ID NO: 1928014 - DNA, 21 bp, Homo sapiens
cattgtggctgtcagcaggaa

SEQ ID NO: 1928015 - DNA, 20 bp, Homo sapiens
ccaagggctccagggccagg

SEQ ID NO: 1928016 - DNA, 16 bp, Homo sapiens
ccaaggtggtcttgga

SEQ ID NO: 1928017 - DNA, 18 bp, Homo sapiens
ccaaggtggtcttggaga

SEQ ID NO: 1928018 - DNA, 13 bp, Homo sapiens
ccaagtcttcctg

SEQ ID NO: 1928019 - DNA, 14 bp, Homo sapiens
ccaagtcttcctga

SEQ ID NO: 1928020 - DNA, 14 bp, Homo sapiens
ccaatcctatgttt

SEQ ID NO: 1928021 - DNA, 18 bp, Homo sapiens
ccaatgtgcccagtcatg

SEQ ID NO: 1928022 - DNA, 23 bp, Homo sapiens
ccacaaaataaccaatcctggac

SEQ ID NO: 1928023 - DNA, 21 bp, Homo sapiens
ccacacacacccttccccact

SEQ ID NO: 1928024 - DNA, 13 bp, Homo sapiens
ccacacaccccaa

SEQ ID NO: 1928025 - DNA, 14 bp, Homo sapiens
ccacaccagtccac

SEQ ID NO: 1928026 - DNA, 18 bp, Homo sapiens
ccacagaaaccctgtttt

SEQ ID NO: 1928027 - DNA, 22 bp, Homo sapiens
ccacagagtgccatccctgaga

SEQ ID NO: 1928028 - DNA, 12 bp, Homo sapiens
ccacagccccaa

SEQ ID NO: 1928029 - DNA, 19 bp, Homo sapiens
ccacagcctcccctgccag

SEQ ID NO: 1928030 - DNA, 20 bp, Homo sapiens
ccacagcctcccctgccagg

SEQ ID NO: 1928031 - DNA, 16 bp, Homo sapiens
ccacaggcccttcctc

SEQ ID NO: 1928032 - DNA, 17 bp, Homo sapiens
ccacaggcccttcctct

SEQ ID NO: 1928033 - DNA, 14 bp, Homo sapiens
ccacaggctgcaag

SEQ ID NO: 1928034 - DNA, 21 bp, Homo sapiens
ccacatagtgatggttcccct

SEQ ID NO: 1928035 - DNA, 22 bp, Homo sapiens
ccacatagtgatggttcccctg

SEQ ID NO: 1928036 - DNA, 16 bp, Homo sapiens
ccacatgggaggctca

SEQ ID NO: 1928037 - DNA, 17 bp, Homo sapiens
ccaccaagagggacgcc

SEQ ID NO: 1928038 - DNA, 13 bp, Homo sapiens
ccacccctcaagc

SEQ ID NO: 1928039 - DNA, 17 bp, Homo sapiens
ccacccctcttccccct

SEQ ID NO: 1928040 - DNA, 20 bp, Homo sapiens
ccacccgtttccaagcctgg

SEQ ID NO: 1928041 - DNA, 11 bp, Homo sapiens
ccaccctctgc

SEQ ID NO: 1928042 - DNA, 14 bp, Homo sapiens
ccaccctctgcagg

SEQ ID NO: 1928043 - DNA, 15 bp, Homo sapiens
ccaccctgtctgcag

SEQ ID NO: 1928044 - DNA, 15 bp, Homo sapiens
ccacctgcagcgtct

SEQ ID NO: 1928045 - DNA, 12 bp, Homo sapiens
ccacctgccagg

SEQ ID NO: 1928046 - DNA, 13 bp, Homo sapiens
ccacctgccaggc

SEQ ID NO: 1928047 - DNA, 21 bp, Homo sapiens
ccacctggttccggaatcctg

SEQ ID NO: 1928048 - DNA, 12 bp, Homo sapiens
ccacggagccac

SEQ ID NO: 1928049 - DNA, 21 bp, Homo sapiens
ccacggagccactcctctgac

SEQ ID NO: 1928050 - DNA, 13 bp, Homo sapiens
ccacggccactgc

SEQ ID NO: 1928051 - DNA, 22 bp, Homo sapiens
ccacgggggaggccgaggcagg

SEQ ID NO: 1928052 - DNA, 14 bp, Homo sapiens
ccacgtcccgggca

SEQ ID NO: 1928053 - DNA, 15 bp, Homo sapiens
ccacgtcctgggtgc

SEQ ID NO: 1928054 - DNA, 14 bp, Homo sapiens
ccacgtgctggaga

SEQ ID NO: 1928055 - DNA, 18 bp, Homo sapiens
ccacgtgctggagagtag

SEQ ID NO: 1928056 - DNA, 18 bp, Homo sapiens
ccacgtggccgctgccca

SEQ ID NO: 1928057 - DNA, 19 bp, Homo sapiens
ccacgtggccgctgctgtg

SEQ ID NO: 1928058 - DNA, 23 bp, Homo sapiens
ccacgttctgctcatcattctct

SEQ ID NO: 1928059 - DNA, 17 bp, Homo sapiens
ccactccagacccctgg

SEQ ID NO: 1928060 - DNA, 17 bp, Homo sapiens
ccactcccctcatccac

SEQ ID NO: 1928061 - DNA, 16 bp, Homo sapiens
ccactcctcccaactc

SEQ ID NO: 1928062 - DNA, 22 bp, Homo sapiens
ccactcctcccaactctggcct

SEQ ID NO: 1928063 - DNA, 12 bp, Homo sapiens
ccactcctctga

SEQ ID NO: 1928064 - DNA, 13 bp, Homo sapiens
ccactcctctgac

SEQ ID NO: 1928065 - DNA, 13 bp, Homo sapiens
ccactgcagtcac

SEQ ID NO: 1928066 - DNA, 17 bp, Homo sapiens
ccactgcagtcacccct

SEQ ID NO: 1928067 - DNA, 13 bp, Homo sapiens
ccactggcatctc

SEQ ID NO: 1928068 - DNA, 20 bp, Homo sapiens
ccactggcatctctggagtg

SEQ ID NO: 1928069 - DNA, 17 bp, Homo sapiens
ccacttccctgcaaggt

SEQ ID NO: 1928070 - DNA, 17 bp, Homo sapiens
ccacttgggtcttccct

SEQ ID NO: 1928071 - DNA, 17 bp, Homo sapiens
ccactttgcagacctgg

SEQ ID NO: 1928072 - DNA, 20 bp, Homo sapiens
ccactttgcagacctgggac

SEQ ID NO: 1928073 - DNA, 18 bp, Homo sapiens
ccagaactaccaaaatga

SEQ ID NO: 1928074 - DNA, 12 bp, Homo sapiens
ccagacccctac

SEQ ID NO: 1928075 - DNA, 16 bp, Homo sapiens
ccagacccctggcttt

SEQ ID NO: 1928076 - DNA, 18 bp, Homo sapiens
ccagacccctggcttttc

SEQ ID NO: 1928077 - DNA, 24 bp, Homo sapiens
ccagacccctggcttttcactgct

SEQ ID NO: 1928078 - DNA, 21 bp, Homo sapiens
ccagagaacaatcactattct

SEQ ID NO: 1928079 - DNA, 20 bp, Homo sapiens
ccagagagaagcaccccacc

SEQ ID NO: 1928080 - DNA, 16 bp, Homo sapiens
ccagagcctgggcgca

SEQ ID NO: 1928081 - DNA, 22 bp, Homo sapiens
ccagaggaaggggccagaggct

SEQ ID NO: 1928082 - DNA, 21 bp, Homo sapiens
ccagagtaggtgggtcttgga

SEQ ID NO: 1928083 - DNA, 19 bp, Homo sapiens
ccagatgcctcctctgtcc

SEQ ID NO: 1928084 - DNA, 17 bp, Homo sapiens
ccagcaatgcctgcctg

SEQ ID NO: 1928085 - DNA, 20 bp, Homo sapiens
ccagcagtgaaacttgtgct

SEQ ID NO: 1928086 - DNA, 18 bp, Homo sapiens
ccagccacccagccagga

SEQ ID NO: 1928087 - DNA, 17 bp, Homo sapiens
ccagccaggaggggctg

SEQ ID NO: 1928088 - DNA, 16 bp, Homo sapiens
ccagccattcctgaag

SEQ ID NO: 1928089 - DNA, 15 bp, Homo sapiens
ccagcccagcctgca

SEQ ID NO: 1928090 - DNA, 12 bp, Homo sapiens
ccagcctggagc

SEQ ID NO: 1928091 - DNA, 16 bp, Homo sapiens
ccagcctggagccgtg

SEQ ID NO: 1928092 - DNA, 18 bp, Homo sapiens
ccagcgtggcctccgtga

SEQ ID NO: 1928093 - DNA, 22 bp, Homo sapiens
ccagctatgttatattgaaaaa

SEQ ID NO: 1928094 - DNA, 17 bp, Homo sapiens
ccagctcctcttcctgc

SEQ ID NO: 1928095 - DNA, 21 bp, Homo sapiens
ccagctctgtatcaggaccca

SEQ ID NO: 1928096 - DNA, 16 bp, Homo sapiens
ccagctgggttggaaa

SEQ ID NO: 1928097 - DNA, 16 bp, Homo sapiens
ccagctgtactgagtt

SEQ ID NO: 1928098 - DNA, 16 bp, Homo sapiens
ccagcttggagtgcca

SEQ ID NO: 1928099 - DNA, 15 bp, Homo sapiens
ccaggactctctttc

SEQ ID NO: 1928100 - DNA, 20 bp, Homo sapiens
ccaggagaaggccaattcct

SEQ ID NO: 1928101 - DNA, 12 bp, Homo sapiens
ccaggagaccct

SEQ ID NO: 1928102 - DNA, 16 bp, Homo sapiens
ccaggagaccctgtct

SEQ ID NO: 1928103 - DNA, 20 bp, Homo sapiens
ccaggagagaccttctctta

SEQ ID NO: 1928104 - DNA, 15 bp, Homo sapiens
ccaggagcctcctga

SEQ ID NO: 1928105 - DNA, 15 bp, Homo sapiens
ccaggcatggcccag

SEQ ID NO: 1928106 - DNA, 16 bp, Homo sapiens
ccaggcattgccaagg

SEQ ID NO: 1928107 - DNA, 20 bp, Homo sapiens
ccaggccctctctgcagtcc

SEQ ID NO: 1928108 - DNA, 14 bp, Homo sapiens
ccaggccgaggaag

SEQ ID NO: 1928109 - DNA, 17 bp, Homo sapiens
ccaggctcaggctgccc

SEQ ID NO: 1928110 - DNA, 13 bp, Homo sapiens
ccaggctgcaggg

SEQ ID NO: 1928111 - DNA, 15 bp, Homo sapiens
ccaggctgcagggac

SEQ ID NO: 1928112 - DNA, 13 bp, Homo sapiens
ccaggctgcaggt

SEQ ID NO: 1928113 - DNA, 21 bp, Homo sapiens
ccagggaccagcccagcctgc

SEQ ID NO: 1928114 - DNA, 22 bp, Homo sapiens
ccagggaccagcccagcctgca

SEQ ID NO: 1928115 - DNA, 18 bp, Homo sapiens
ccagggttaaagaaaggc

SEQ ID NO: 1928116 - DNA, 14 bp, Homo sapiens
ccagggttccagac

SEQ ID NO: 1928117 - DNA, 16 bp, Homo sapiens
ccagggttccagacag

SEQ ID NO: 1928118 - DNA, 17 bp, Homo sapiens
ccagggttccagacagg

SEQ ID NO: 1928119 - DNA, 23 bp, Homo sapiens
ccaggtcctttccttctcgtctt

SEQ ID NO: 1928120 - DNA, 13 bp, Homo sapiens
ccaggtgcacaga

SEQ ID NO: 1928121 - DNA, 16 bp, Homo sapiens
ccaggtggccactcca

SEQ ID NO: 1928122 - DNA, 23 bp, Homo sapiens
ccagtaaaagtataacagcaaat

SEQ ID NO: 1928123 - DNA, 14 bp, Homo sapiens
ccagtcaacctggg

SEQ ID NO: 1928124 - DNA, 12 bp, Homo sapiens
ccagtcctgcaa

SEQ ID NO: 1928125 - DNA, 21 bp, Homo sapiens
ccagtcttgagtgggccccct

SEQ ID NO: 1928126 - DNA, 22 bp, Homo sapiens
ccagtcttgagtgggccccctc

SEQ ID NO: 1928127 - DNA, 19 bp, Homo sapiens
ccagtgtctaccttcattt

SEQ ID NO: 1928128 - DNA, 20 bp, Homo sapiens
ccagtgttagggaagggcct

SEQ ID NO: 1928129 - DNA, 17 bp, Homo sapiens
ccagttaaaaaaaattt

SEQ ID NO: 1928130 - DNA, 14 bp, Homo sapiens
ccatatctgtgcaa

SEQ ID NO: 1928131 - DNA, 13 bp, Homo sapiens
ccatcagcagtga

SEQ ID NO: 1928132 - DNA, 15 bp, Homo sapiens
ccatcagcagtgatt

SEQ ID NO: 1928133 - DNA, 15 bp, Homo sapiens
ccatcatcatagagg

SEQ ID NO: 1928134 - DNA, 13 bp, Homo sapiens
ccatcatctcctg

SEQ ID NO: 1928135 - DNA, 17 bp, Homo sapiens
ccatccacatgggagcc

SEQ ID NO: 1928136 - DNA, 14 bp, Homo sapiens
ccatctccgctgtt

SEQ ID NO: 1928137 - DNA, 22 bp, Homo sapiens
ccatctgcgacaccaccaacag

SEQ ID NO: 1928138 - DNA, 22 bp, Homo sapiens
ccatctgtaaatatcccagaga

SEQ ID NO: 1928139 - DNA, 15 bp, Homo sapiens
ccatgcagataacag

SEQ ID NO: 1928140 - DNA, 17 bp, Homo sapiens
ccatggaggcacacagc

SEQ ID NO: 1928141 - DNA, 16 bp, Homo sapiens
ccatgtacatgaagaa

SEQ ID NO: 1928142 - DNA, 16 bp, Homo sapiens
ccatgtagaagaggga

SEQ ID NO: 1928143 - DNA, 21 bp, Homo sapiens
ccattaacaggtctttgaaat

SEQ ID NO: 1928144 - DNA, 13 bp, Homo sapiens
ccatttcttccca

SEQ ID NO: 1928145 - DNA, 18 bp, Homo sapiens
ccattttgcgatgtgttt

SEQ ID NO: 1928146 - DNA, 13 bp, Homo sapiens
cccaacacgggta

SEQ ID NO: 1928147 - DNA, 15 bp, Homo sapiens
cccaaggccagtctg

SEQ ID NO: 1928148 - DNA, 18 bp, Homo sapiens
cccaaggtggtcttggag

SEQ ID NO: 1928149 - DNA, 22 bp, Homo sapiens
cccacactacgcagaagagaaa

SEQ ID NO: 1928150 - DNA, 20 bp, Homo sapiens
cccacaggacatttctctaa

SEQ ID NO: 1928151 - DNA, 18 bp, Homo sapiens
cccacaggcccttcctct

SEQ ID NO: 1928152 - DNA, 13 bp, Homo sapiens
cctggagaactag

SEQ ID NO: 1928153 - DNA, 14 bp, Homo sapiens
cctggatccctttc

SEQ ID NO: 1928154 - DNA, 15 bp, Homo sapiens
cctggccccagtgac

SEQ ID NO: 1928155 - DNA, 13 bp, Homo sapiens
cctggcctggtcc

SEQ ID NO: 1928156 - DNA, 23 bp, Homo sapiens
cctggctcccacaggcccttcct

SEQ ID NO: 1928157 - DNA, 20 bp, Homo sapiens
cctggcttttcactgctggc

SEQ ID NO: 1928158 - DNA, 22 bp, Homo sapiens
cctggcttttcactgctggctg

SEQ ID NO: 1928159 - DNA, 24 bp, Homo sapiens
cctggcttttcactgctggctgcc

SEQ ID NO: 1928160 - DNA, 13 bp, Homo sapiens
cctgggcaaagcc

SEQ ID NO: 1928161 - DNA, 18 bp, Homo sapiens
cctgggccctctctgctc

SEQ ID NO: 1928162 - DNA, 13 bp, Homo sapiens
cctggggctgggt

SEQ ID NO: 1928163 - DNA, 14 bp, Homo sapiens
cctgggggtgccag

SEQ ID NO: 1928164 - DNA, 19 bp, Homo sapiens
cctggggtggttggaggcc

SEQ ID NO: 1928165 - DNA, 17 bp, Homo sapiens
cctgggtcctcccagct

SEQ ID NO: 1928166 - DNA, 18 bp, Homo sapiens
cctgggtgctctggctgg

SEQ ID NO: 1928167 - DNA, 16 bp, Homo sapiens
cctgggtgctgtcatg

SEQ ID NO: 1928168 - DNA, 20 bp, Homo sapiens
cctgggtgctgtcatgccca

SEQ ID NO: 1928169 - DNA, 21 bp, Homo sapiens
cctgggtgctgtcatgcccag

SEQ ID NO: 1928170 - DNA, 22 bp, Homo sapiens
cctgggtgctgtcatgcccagc

SEQ ID NO: 1928171 - DNA, 19 bp, Homo sapiens
cctgggtggggcagggcct

SEQ ID NO: 1928172 - DNA, 23 bp, Homo sapiens
cctgggtggggcagggcctggcc

SEQ ID NO: 1928173 - DNA, 19 bp, Homo sapiens
cctgggttttgtattctct

SEQ ID NO: 1928174 - DNA, 23 bp, Homo sapiens
cctgggttttgtattctctgagc

SEQ ID NO: 1928175 - DNA, 15 bp, Homo sapiens
cctggtgctgccaca

SEQ ID NO: 1928176 - DNA, 15 bp, Homo sapiens
cctggtgctgcctct

SEQ ID NO: 1928177 - DNA, 17 bp, Homo sapiens
cctggttccctctttcc

SEQ ID NO: 1928178 - DNA, 20 bp, Homo sapiens
cctggttccggaatcctgtc

SEQ ID NO: 1928179 - DNA, 21 bp, Homo sapiens
cctggttccggaatcctgtcc

SEQ ID NO: 1928180 - DNA, 16 bp, Homo sapiens
cctgtaacctcttcag

SEQ ID NO: 1928181 - DNA, 19 bp, Homo sapiens
cctgtacatacattgtata

SEQ ID NO: 1928182 - DNA, 23 bp, Homo sapiens
cctgtattgtctgacttctcagg

SEQ ID NO: 1928183 - DNA, 22 bp, Homo sapiens
cctgtccttcccacggccactg

SEQ ID NO: 1928184 - DNA, 23 bp, Homo sapiens
cctgtctccctacttagacccag

SEQ ID NO: 1928185 - DNA, 21 bp, Homo sapiens
cctgtctgcgccgctgtgctg

SEQ ID NO: 1928186 - DNA, 20 bp, Homo sapiens
cctgtgatcgtgtgttgcca

SEQ ID NO: 1928187 - DNA, 17 bp, Homo sapiens
cctgtgccaggactctc

SEQ ID NO: 1928188 - DNA, 22 bp, Homo sapiens
cctgtgcttcgggcccttccca

SEQ ID NO: 1928189 - DNA, 12 bp, Homo sapiens
cctgtgggagaa

SEQ ID NO: 1928190 - DNA, 20 bp, Homo sapiens
cctgtgtgtcgttcccttgt

SEQ ID NO: 1928191 - DNA, 17 bp, Homo sapiens
cctgtgtttgctcccat

SEQ ID NO: 1928192 - DNA, 21 bp, Homo sapiens
cctgttacctaattagagcag

SEQ ID NO: 1928193 - DNA, 18 bp, Homo sapiens
cctgttcctgccttctct

SEQ ID NO: 1928194 - DNA, 22 bp, Homo sapiens
cctgttcctgccttctcttcta

SEQ ID NO: 1928195 - DNA, 21 bp, Homo sapiens
ccttattagagtgtctttcca

SEQ ID NO: 1928196 - DNA, 15 bp, Homo sapiens
ccttcagcagctaga

SEQ ID NO: 1928197 - DNA, 16 bp, Homo sapiens
ccttcagtaaacacca

SEQ ID NO: 1928198 - DNA, 17 bp, Homo sapiens
ccttcccacggccactg

SEQ ID NO: 1928199 - DNA, 14 bp, Homo sapiens
ccttcccagctgct

SEQ ID NO: 1928200 - DNA, 13 bp, Homo sapiens
ccttcccctgcgc

SEQ ID NO: 1928201 - DNA, 17 bp, Homo sapiens
ccttcccctgcgccctc

SEQ ID NO: 1928202 - DNA, 14 bp, Homo sapiens
ccttcctctccact

SEQ ID NO: 1928203 - DNA, 20 bp, Homo sapiens
ccttcgatacaccgggcctg

SEQ ID NO: 1928204 - DNA, 22 bp, Homo sapiens
ccttcgatacaccgggcctgga

SEQ ID NO: 1928205 - DNA, 11 bp, Homo sapiens
ccttctccatc

SEQ ID NO: 1928206 - DNA, 22 bp, Homo sapiens
ccttctccatccacatgggagc

SEQ ID NO: 1928207 - DNA, 21 bp, Homo sapiens
ccttctcccctccagacccct

SEQ ID NO: 1928208 - DNA, 19 bp, Homo sapiens
ccttctcgtcttcctctct

SEQ ID NO: 1928209 - DNA, 22 bp, Homo sapiens
ccttctcgtcttcctctctctc

SEQ ID NO: 1928210 - DNA, 14 bp, Homo sapiens
ccttctgtggctca

SEQ ID NO: 1928211 - DNA, 18 bp, Homo sapiens
ccttgatgtcttgagagc

SEQ ID NO: 1928212 - DNA, 17 bp, Homo sapiens
ccttgccgctgggagag

SEQ ID NO: 1928213 - DNA, 15 bp, Homo sapiens
ccttggttcctccag

SEQ ID NO: 1928214 - DNA, 15 bp, Homo sapiens
ccttgttgatgccag

SEQ ID NO: 1928215 - DNA, 23 bp, Homo sapiens
ccttgttgatgccagctgtactg

SEQ ID NO: 1928216 - DNA, 19 bp, Homo sapiens
cctttacattttgtgcagt

SEQ ID NO: 1928217 - DNA, 16 bp, Homo sapiens
cctttcactgaagtga

SEQ ID NO: 1928218 - DNA, 19 bp, Homo sapiens
cctttccttctcgtcttcc

SEQ ID NO: 1928219 - DNA, 12 bp, Homo sapiens
cctttctttaaa

SEQ ID NO: 1928220 - DNA, 21 bp, Homo sapiens
cctttgattgagttcatcatg

SEQ ID NO: 1928221 - DNA, 15 bp, Homo sapiens
cctttgttgctgtct

SEQ ID NO: 1928222 - DNA, 19 bp, Homo sapiens
cctttgtttttttttcctg

SEQ ID NO: 1928223 - DNA, 22 bp, Homo sapiens
ccttttagtggtggtgtctcac

SEQ ID NO: 1928224 - DNA, 14 bp, Homo sapiens
cgaaatgttatttt

SEQ ID NO: 1928225 - DNA, 22 bp, Homo sapiens
cgaaatgttattttttaattat

SEQ ID NO: 1928226 - DNA, 14 bp, Homo sapiens
cgaagtcttccatc

SEQ ID NO: 1928227 - DNA, 16 bp, Homo sapiens
cgaagtcttccatcag

SEQ ID NO: 1928228 - DNA, 22 bp, Homo sapiens
cgaagtcttccatcagcagtga

SEQ ID NO: 1928229 - DNA, 22 bp, Homo sapiens
cgaatctctttttgctttcgaa

SEQ ID NO: 1928230 - DNA, 13 bp, Homo sapiens
cgacagcctggca

SEQ ID NO: 1928231 - DNA, 20 bp, Homo sapiens
cgactctctccatcagaagg

SEQ ID NO: 1928232 - DNA, 17 bp, Homo sapiens
cgactgtgaaactggaa

SEQ ID NO: 1928233 - DNA, 23 bp, Homo sapiens
cgacttgggacggaagtggcctg

SEQ ID NO: 1928234 - DNA, 20 bp, Homo sapiens
cgaggaggctccagagggca

SEQ ID NO: 1928235 - DNA, 16 bp, Homo sapiens
cgagggcgcctgggtc

SEQ ID NO: 1928236 - DNA, 17 bp, Homo sapiens
cgagtctcttctccact

SEQ ID NO: 1928237 - DNA, 18 bp, Homo sapiens
cgagtctcttctccactg

SEQ ID NO: 1928238 - DNA, 21 bp, Homo sapiens
cgagtctcttctccactggat

SEQ ID NO: 1928239 - DNA, 20 bp, Homo sapiens
cgatacaccgggcctggaga

SEQ ID NO: 1928240 - DNA, 22 bp, Homo sapiens
cgcaagcgacacaggctgccgc

SEQ ID NO: 1928241 - DNA, 11 bp, Homo sapiens
cgcacacacac

SEQ ID NO: 1928242 - DNA, 12 bp, Homo sapiens
cgcacacacact

SEQ ID NO: 1928243 - DNA, 17 bp, Homo sapiens
cgcacacacactcttca

SEQ ID NO: 1928244 - DNA, 24 bp, Homo sapiens
cgcagccctgctttgggctgccct

SEQ ID NO: 1928245 - DNA, 16 bp, Homo sapiens
cgcagtggactgtgtc

SEQ ID NO: 1928246 - DNA, 19 bp, Homo sapiens
cgcatccgcctctgagcca

SEQ ID NO: 1928247 - DNA, 13 bp, Homo sapiens
cgccccttccccc

SEQ ID NO: 1928248 - DNA, 11 bp, Homo sapiens
cgccctccctc

SEQ ID NO: 1928249 - DNA, 17 bp, Homo sapiens
cgccctccctccctcca

SEQ ID NO: 1928250 - DNA, 16 bp, Homo sapiens
cgccctctacctccta

SEQ ID NO: 1928251 - DNA, 11 bp, Homo sapiens
cgccctctgcc

SEQ ID NO: 1928252 - DNA, 14 bp, Homo sapiens
cgcctcgcttcacg

SEQ ID NO: 1928253 - DNA, 12 bp, Homo sapiens
cgcctctgagcc

SEQ ID NO: 1928254 - DNA, 13 bp, Homo sapiens
cgcctctgagcca

SEQ ID NO: 1928255 - DNA, 21 bp, Homo sapiens
cgcctctgagccaggagcctc

SEQ ID NO: 1928256 - DNA, 21 bp, Homo sapiens
cgcctctgtcctggcccggga

SEQ ID NO: 1928257 - DNA, 18 bp, Homo sapiens
cgcctgggtcctcccagc

SEQ ID NO: 1928258 - DNA, 23 bp, Homo sapiens
cgccttaggtacttattccagat

SEQ ID NO: 1928259 - DNA, 13 bp, Homo sapiens
cgcctttcccagg

SEQ ID NO: 1928260 - DNA, 12 bp, Homo sapiens
cgcgcacacaca

SEQ ID NO: 1928261 - DNA, 14 bp, Homo sapiens
cgcgcacacacact

SEQ ID NO: 1928262 - DNA, 14 bp, Homo sapiens
cgcgcgcacacaca

SEQ ID NO: 1928263 - DNA, 16 bp, Homo sapiens
cgctcagccctccctg

SEQ ID NO: 1928264 - DNA, 21 bp, Homo sapiens
cgctcagccctccctgcccct

SEQ ID NO: 1928265 - DNA, 19 bp, Homo sapiens
cgctgccagctctgtatca

SEQ ID NO: 1928266 - DNA, 12 bp, Homo sapiens
cgctgggagagc

SEQ ID NO: 1928267 - DNA, 21 bp, Homo sapiens
cgcttagggtctgtcccgggt

SEQ ID NO: 1928268 - DNA, 19 bp, Homo sapiens
cgcttttgctggtcactgc

SEQ ID NO: 1928269 - DNA, 13 bp, Homo sapiens
cggaacaggagtg

SEQ ID NO: 1928270 - DNA, 20 bp, Homo sapiens
cggaaggacacagtcagggg

SEQ ID NO: 1928271 - DNA, 21 bp, Homo sapiens
cggaagtggcctgagaagagt

SEQ ID NO: 1928272 - DNA, 21 bp, Homo sapiens
cggacaggaagcacagcaggt

SEQ ID NO: 1928273 - DNA, 20 bp, Homo sapiens
cggagatgcatctgtggcct

SEQ ID NO: 1928274 - DNA, 11 bp, Homo sapiens
cggagccactc

SEQ ID NO: 1928275 - DNA, 18 bp, Homo sapiens
cggagggaaccctgacta

SEQ ID NO: 1928276 - DNA, 15 bp, Homo sapiens
cggaggggcctggca

SEQ ID NO: 1928277 - DNA, 13 bp, Homo sapiens
cggcagagaggac

SEQ ID NO: 1928278 - DNA, 17 bp, Homo sapiens
cggcagcctggttccct

SEQ ID NO: 1928279 - DNA, 15 bp, Homo sapiens
cggcccacgtcctgg

SEQ ID NO: 1928280 - DNA, 15 bp, Homo sapiens
cggccgcctgtcctt

SEQ ID NO: 1928281 - DNA, 22 bp, Homo sapiens
cggcctgcagaccctgccaggg

SEQ ID NO: 1928282 - DNA, 15 bp, Homo sapiens
cggctcttcctggac

SEQ ID NO: 1928283 - DNA, 20 bp, Homo sapiens
cggctggacttttgcagctt

SEQ ID NO: 1928284 - DNA, 19 bp, Homo sapiens
cggctgtgtggggagggtg

SEQ ID NO: 1928285 - DNA, 17 bp, Homo sapiens
cggcttccgagggcact

SEQ ID NO: 1928286 - DNA, 16 bp, Homo sapiens
cgggagccgcaggggc

SEQ ID NO: 1928287 - DNA, 20 bp, Homo sapiens
cgggaggccacgggggaggc

SEQ ID NO: 1928288 - DNA, 21 bp, Homo sapiens
cgggcccttcccacaggacat

SEQ ID NO: 1928289 - DNA, 16 bp, Homo sapiens
cgggctgggcagctgt

SEQ ID NO: 1928290 - DNA, 18 bp, Homo sapiens
cggggtctgctcctggga

SEQ ID NO: 1928291 - DNA, 20 bp, Homo sapiens
cgggtggcagcgcccagcct

SEQ ID NO: 1928292 - DNA, 19 bp, Homo sapiens
cggtcaataattgtggaga

SEQ ID NO: 1928293 - DNA, 21 bp, Homo sapiens
cggtcaataattgtggagagg

SEQ ID NO: 1928294 - DNA, 23 bp, Homo sapiens
cggtcaataattgtggagaggag

SEQ ID NO: 1928295 - DNA, 16 bp, Homo sapiens
cgtataataaaaccaa

SEQ ID NO: 1928296 - DNA, 20 bp, Homo sapiens
cgtattgtgaaatttgttaa

SEQ ID NO: 1928297 - DNA, 20 bp, Homo sapiens
cgtccacccgtttccaagcc

SEQ ID NO: 1928298 - DNA, 22 bp, Homo sapiens
cgtccacccgtttccaagcctg

SEQ ID NO: 1928299 - DNA, 20 bp, Homo sapiens
cgtcccgagggcgcctgggt

SEQ ID NO: 1928300 - DNA, 15 bp, Homo sapiens
cgtcctcctctgtga

SEQ ID NO: 1928301 - DNA, 11 bp, Homo sapiens
cgtcctgggtg

SEQ ID NO: 1928302 - DNA, 24 bp, Homo sapiens
cgtcctgggtgctgtcatgcccag

SEQ ID NO: 1928303 - DNA, 19 bp, Homo sapiens
cgtctaagtcatgagctga

SEQ ID NO: 1928304 - DNA, 15 bp, Homo sapiens
cgtctccctggcccc

SEQ ID NO: 1928305 - DNA, 17 bp, Homo sapiens
cgtctccctggccccag

SEQ ID NO: 1928306 - DNA, 12 bp, Homo sapiens
cgtctcctctcc

SEQ ID NO: 1928307 - DNA, 19 bp, Homo sapiens
cgtgacttcagactctctc

SEQ ID NO: 1928308 - DNA, 22 bp, Homo sapiens
cgtgacttcagactctctcctc

SEQ ID NO: 1928309 - DNA, 14 bp, Homo sapiens
cgtgagagcccaat

SEQ ID NO: 1928310 - DNA, 19 bp, Homo sapiens
cgtgagagcccaatcactg

SEQ ID NO: 1928311 - DNA, 14 bp, Homo sapiens
cgtgcagcatatga

SEQ ID NO: 1928312 - DNA, 18 bp, Homo sapiens
cgtggagccacaggcaga

SEQ ID NO: 1928313 - DNA, 18 bp, Homo sapiens
cgtggatcaagcttgtgt

SEQ ID NO: 1928314 - DNA, 15 bp, Homo sapiens
cgtgggagaggagag

SEQ ID NO: 1928315 - DNA, 18 bp, Homo sapiens
cgtgggatccagagagaa

SEQ ID NO: 1928316 - DNA, 18 bp, Homo sapiens
cgtggggcagcacagaga

SEQ ID NO: 1928317 - DNA, 20 bp, Homo sapiens
cgtggggcagcacagagagg

SEQ ID NO: 1928318 - DNA, 22 bp, Homo sapiens
cgtgggtcttcagggggccagg

SEQ ID NO: 1928319 - DNA, 16 bp, Homo sapiens
cgttatctcattgcaa

SEQ ID NO: 1928320 - DNA, 20 bp, Homo sapiens
cgttcccttgtgtctgttgc

SEQ ID NO: 1928321 - DNA, 13 bp, Homo sapiens
cgtttagaaatga

SEQ ID NO: 1928322 - DNA, 14 bp, Homo sapiens
ctaaaggactggtt

SEQ ID NO: 1928323 - DNA, 17 bp, Homo sapiens
ctaaatcctttactgtt

SEQ ID NO: 1928324 - DNA, 14 bp, Homo sapiens
ctaaatgaatgttt

SEQ ID NO: 1928325 - DNA, 15 bp, Homo sapiens
ctaaatgaatgttta

SEQ ID NO: 1928326 - DNA, 16 bp, Homo sapiens
ctaagcacattatgtt

SEQ ID NO: 1928327 - DNA, 16 bp, Homo sapiens
ctaagtctttccattg

SEQ ID NO: 1928328 - DNA, 17 bp, Homo sapiens
ctaatcagcattctcac

SEQ ID NO: 1928329 - DNA, 19 bp, Homo sapiens
ctaatcagggaggtcattt

SEQ ID NO: 1928330 - DNA, 21 bp, Homo sapiens
ctaatcagggaggtcattttg

SEQ ID NO: 1928331 - DNA, 16 bp, Homo sapiens
ctaatcctctttttct

SEQ ID NO: 1928332 - DNA, 12 bp, Homo sapiens
ctaatgcattaa

SEQ ID NO: 1928333 - DNA, 22 bp, Homo sapiens
ctctggctccttcagcagctag

SEQ ID NO: 1928334 - DNA, 22 bp, Homo sapiens
ctctgtattctgcaacagcctg

SEQ ID NO: 1928335 - DNA, 23 bp, Homo sapiens
ctctgtattctgcaacagcctgt

SEQ ID NO: 1928336 - DNA, 14 bp, Homo sapiens
ctctgtctcatcca

SEQ ID NO: 1928337 - DNA, 18 bp, Homo sapiens
ctctgtgaccaatgtctt

SEQ ID NO: 1928338 - DNA, 15 bp, Homo sapiens
ctctgtttaccctcc

SEQ ID NO: 1928339 - DNA, 21 bp, Homo sapiens
ctctgtttaccctccctgtcc

SEQ ID NO: 1928340 - DNA, 14 bp, Homo sapiens
ctcttaccccgtcc

SEQ ID NO: 1928341 - DNA, 23 bp, Homo sapiens
ctcttaccccgtccctttccctg

SEQ ID NO: 1928342 - DNA, 13 bp, Homo sapiens
ctcttcagaggcc

SEQ ID NO: 1928343 - DNA, 13 bp, Homo sapiens
ctcttcccccttc

SEQ ID NO: 1928344 - DNA, 15 bp, Homo sapiens
ctcttcctccctccc

SEQ ID NO: 1928345 - DNA, 19 bp, Homo sapiens
ctcttctccactggatgga

SEQ ID NO: 1928346 - DNA, 12 bp, Homo sapiens
ctctttcctgtg

SEQ ID NO: 1928347 - DNA, 20 bp, Homo sapiens
ctctttcttccactaccctc

SEQ ID NO: 1928348 - DNA, 22 bp, Homo sapiens
ctctttcttccactaccctccc

SEQ ID NO: 1928349 - DNA, 12 bp, Homo sapiens
ctctttggtgcc

SEQ ID NO: 1928350 - DNA, 19 bp, Homo sapiens
ctctttgtaaggacttgtg

SEQ ID NO: 1928351 - DNA, 18 bp, Homo sapiens
ctcttttcaaacacacac

SEQ ID NO: 1928352 - DNA, 20 bp, Homo sapiens
ctcttttccaaacacaggca

SEQ ID NO: 1928353 - DNA, 17 bp, Homo sapiens
ctgaaaacactgtgcac

SEQ ID NO: 1928354 - DNA, 21 bp, Homo sapiens
ccgaggcaggggctgggcaga

SEQ ID NO: 1928355 - DNA, 15 bp, Homo sapiens
ccgagggcgcctggg

SEQ ID NO: 1928356 - DNA, 14 bp, Homo sapiens
ccgagtatctgtaa

SEQ ID NO: 1928357 - DNA, 22 bp, Homo sapiens
ccgagtatctgtaacccttgaa

SEQ ID NO: 1928358 - DNA, 15 bp, Homo sapiens
ccgcaacttcccagg

SEQ ID NO: 1928359 - DNA, 16 bp, Homo sapiens
ccgcaacttcccaggc

SEQ ID NO: 1928360 - DNA, 23 bp, Homo sapiens
ccgcaggggcccctcctccagag

SEQ ID NO: 1928361 - DNA, 12 bp, Homo sapiens
ccgcctgtcctt

SEQ ID NO: 1928362 - DNA, 15 bp, Homo sapiens
ccgcctgtccttggt

SEQ ID NO: 1928363 - DNA, 15 bp, Homo sapiens
ccgctcagccctccc

SEQ ID NO: 1928364 - DNA, 22 bp, Homo sapiens
ccgctcagccctccctgcccct

SEQ ID NO: 1928365 - DNA, 16 bp, Homo sapiens
ccgctgctctcccagg

SEQ ID NO: 1928366 - DNA, 18 bp, Homo sapiens
ccgctgctctcccaggtg

SEQ ID NO: 1928367 - DNA, 16 bp, Homo sapiens
ccgctggagcatgagc

SEQ ID NO: 1928368 - DNA, 21 bp, Homo sapiens
ccggagatgcatctgtggcct

SEQ ID NO: 1928369 - DNA, 22 bp, Homo sapiens
ccggagggaaccctgactacag

SEQ ID NO: 1928370 - DNA, 17 bp, Homo sapiens
ccggaggggcctggcag

SEQ ID NO: 1928371 - DNA, 21 bp, Homo sapiens
ccggaggggcctggcagccgt

SEQ ID NO: 1928372 - DNA, 19 bp, Homo sapiens
ccgggcactgtcatgccca

SEQ ID NO: 1928373 - DNA, 19 bp, Homo sapiens
ccgggcctggagaactaga

SEQ ID NO: 1928374 - DNA, 17 bp, Homo sapiens
ccgggtactcagtcagc

SEQ ID NO: 1928375 - DNA, 20 bp, Homo sapiens
ccgggtactcagtcagccca

SEQ ID NO: 1928376 - DNA, 21 bp, Homo sapiens
ccgggtactcagtcagcccag

SEQ ID NO: 1928377 - DNA, 17 bp, Homo sapiens
ccgggtggcagcgccca

SEQ ID NO: 1928378 - DNA, 23 bp, Homo sapiens
ccggtgtggccctgcaagggcgt

SEQ ID NO: 1928379 - DNA, 16 bp, Homo sapiens
ccgtccctttccctgc

SEQ ID NO: 1928380 - DNA, 16 bp, Homo sapiens
ccgtctcctctccagc

SEQ ID NO: 1928381 - DNA, 15 bp, Homo sapiens
ccgtgccttcagctc

SEQ ID NO: 1928382 - DNA, 11 bp, Homo sapiens
ccgtggcttcc

SEQ ID NO: 1928383 - DNA, 13 bp, Homo sapiens
ccgtttccaagcc

SEQ ID NO: 1928384 - DNA, 12 bp, Homo sapiens
cctaaagagata

SEQ ID NO: 1928385 - DNA, 15 bp, Homo sapiens
cctacccctgtcctg

SEQ ID NO: 1928386 - DNA, 23 bp, Homo sapiens
cctaccgagtctcttctccactg

SEQ ID NO: 1928387 - DNA, 20 bp, Homo sapiens
cctaccggcaatttccggcc

SEQ ID NO: 1928388 - DNA, 21 bp, Homo sapiens
cctaccggcaatttccggcca

SEQ ID NO: 1928389 - DNA, 16 bp, Homo sapiens
cctacttcctcctcct

SEQ ID NO: 1928390 - DNA, 23 bp, Homo sapiens
cctagaggggacaagccaggccc

SEQ ID NO: 1928391 - DNA, 18 bp, Homo sapiens
cctagcagatatgtatta

SEQ ID NO: 1928392 - DNA, 23 bp, Homo sapiens
cctagcagatatgtattactttt

SEQ ID NO: 1928393 - DNA, 17 bp, Homo sapiens
cctaggtctccacccct

SEQ ID NO: 1928394 - DNA, 18 bp, Homo sapiens
cctaggtctccacccctc

SEQ ID NO: 1928395 - DNA, 18 bp, Homo sapiens
cctagtaggagctgagct

SEQ ID NO: 1928396 - DNA, 18 bp, Homo sapiens
cctagtgaaggcttctct

SEQ ID NO: 1928397 - DNA, 23 bp, Homo sapiens
cctagtgaaggcttctctctgtg

SEQ ID NO: 1928398 - DNA, 16 bp, Homo sapiens
cctatgccacctgcag

SEQ ID NO: 1928399 - DNA, 17 bp, Homo sapiens
cctatgccacctgcagc

SEQ ID NO: 1928400 - DNA, 18 bp, Homo sapiens
cctatgccacctgcagcg

SEQ ID NO: 1928401 - DNA, 19 bp, Homo sapiens
cctcaacgttgctccccat

SEQ ID NO: 1928402 - DNA, 17 bp, Homo sapiens
cctcaagatgaaggcaa

SEQ ID NO: 1928403 - DNA, 22 bp, Homo sapiens
cctcaagccaggagaccctgtc

SEQ ID NO: 1928404 - DNA, 13 bp, Homo sapiens
cctcaatccagct

SEQ ID NO: 1928405 - DNA, 18 bp, Homo sapiens
cctcaatccagctatgtt

SEQ ID NO: 1928406 - DNA, 17 bp, Homo sapiens
cctcactccactcccct

SEQ ID NO: 1928407 - DNA, 21 bp, Homo sapiens
cctcactgagaaggccccagg

SEQ ID NO: 1928408 - DNA, 20 bp, Homo sapiens
cctcagtgagatcagtcagc

SEQ ID NO: 1928409 - DNA, 12 bp, Homo sapiens
cctcatccatgc

SEQ ID NO: 1928410 - DNA, 18 bp, Homo sapiens
cctcatcttcttcaccat

SEQ ID NO: 1928411 - DNA, 17 bp, Homo sapiens
cctccacacctccaccc

SEQ ID NO: 1928412 - DNA, 15 bp, Homo sapiens
cctccacatcctcca

SEQ ID NO: 1928413 - DNA, 16 bp, Homo sapiens
cctccacatcctccac

SEQ ID NO: 1928414 - DNA, 20 bp, Homo sapiens
cctccacatcctccacgttc

SEQ ID NO: 1928415 - DNA, 13 bp, Homo sapiens
cctccacccgtcc

SEQ ID NO: 1928416 - DNA, 12 bp, Homo sapiens
ctgggaggcagg

SEQ ID NO: 1928417 - DNA, 14 bp, Homo sapiens
ctgggaggcaggtc

SEQ ID NO: 1928418 - DNA, 22 bp, Homo sapiens
ctgggaggcaggtcccgagccc

SEQ ID NO: 1928419 - DNA, 17 bp, Homo sapiens
ctgggagggcagcaggg

SEQ ID NO: 1928420 - DNA, 19 bp, Homo sapiens
ctgggagggcagcagggct

SEQ ID NO: 1928421 - DNA, 11 bp, Homo sapiens
ctgggcagagg

SEQ ID NO: 1928422 - DNA, 15 bp, Homo sapiens
ctgggcagaggggag

SEQ ID NO: 1928423 - DNA, 18 bp, Homo sapiens
ctgggcagaggggagagg

SEQ ID NO: 1928424 - DNA, 14 bp, Homo sapiens
ctgggccactggca

SEQ ID NO: 1928425 - DNA, 23 bp, Homo sapiens
ctgggccactggcatctctggag

SEQ ID NO: 1928426 - DNA, 16 bp, Homo sapiens
ctgggccggcagcctg

SEQ ID NO: 1928427 - DNA, 18 bp, Homo sapiens
ctgggccggcagcctggt

SEQ ID NO: 1928428 - DNA, 20 bp, Homo sapiens
ctgggcgcctctgtcctggc

SEQ ID NO: 1928429 - DNA, 18 bp, Homo sapiens
ctgggctgagggagcctg

SEQ ID NO: 1928430 - DNA, 23 bp, Homo sapiens
ctgggctgagggagcctggcccc

SEQ ID NO: 1928431 - DNA, 16 bp, Homo sapiens
ctggggaggacaaagg

SEQ ID NO: 1928432 - DNA, 14 bp, Homo sapiens
ctgggggtgccagg

SEQ ID NO: 1928433 - DNA, 13 bp, Homo sapiens
ctggggtggggct

SEQ ID NO: 1928434 - DNA, 14 bp, Homo sapiens
ctggggtggggctt

SEQ ID NO: 1928435 - DNA, 23 bp, Homo sapiens
ctgggtggggcagggcctggcct

SEQ ID NO: 1928436 - DNA, 16 bp, Homo sapiens
ctgggtttgggcagtg

SEQ ID NO: 1928437 - DNA, 17 bp, Homo sapiens
ctgggtttgggcagtgg

SEQ ID NO: 1928438 - DNA, 18 bp, Homo sapiens
ctgggtttgggcagtgga

SEQ ID NO: 1928439 - DNA, 20 bp, Homo sapiens
ctgggtttgggcagtggaga

SEQ ID NO: 1928440 - DNA, 19 bp, Homo sapiens
ctggtactcccccagccct

SEQ ID NO: 1928441 - DNA, 23 bp, Homo sapiens
ctggtcagtgaagcccaggagga

SEQ ID NO: 1928442 - DNA, 18 bp, Homo sapiens
ctggtcccccatgggctg

SEQ ID NO: 1928443 - DNA, 12 bp, Homo sapiens
ctggtctggagc

SEQ ID NO: 1928444 - DNA, 16 bp, Homo sapiens
ctggtctggagcccct

SEQ ID NO: 1928445 - DNA, 17 bp, Homo sapiens
ctggtctggagccccta

SEQ ID NO: 1928446 - DNA, 12 bp, Homo sapiens
ctggtgctgcca

SEQ ID NO: 1928447 - DNA, 19 bp, Homo sapiens
ctggtgctgcctctacctg

SEQ ID NO: 1928448 - DNA, 20 bp, Homo sapiens
ctggtggcccgacagcctgg

SEQ ID NO: 1928449 - DNA, 13 bp, Homo sapiens
ctggttccctctt

SEQ ID NO: 1928450 - DNA, 18 bp, Homo sapiens
ctggttccctctttcctg

SEQ ID NO: 1928451 - DNA, 20 bp, Homo sapiens
ctggttccctctttcctgtg

SEQ ID NO: 1928452 - DNA, 17 bp, Homo sapiens
ctggttccggaatcctg

SEQ ID NO: 1928453 - DNA, 21 bp, Homo sapiens
ctggttggtgttgcagaaggt

SEQ ID NO: 1928454 - DNA, 16 bp, Homo sapiens
ctgtaaatatcccaga

SEQ ID NO: 1928455 - DNA, 21 bp, Homo sapiens
ctgtaaatatcccagagaaca

SEQ ID NO: 1928456 - DNA, 20 bp, Homo sapiens
ctgtaacctcttcagaggcc

SEQ ID NO: 1928457 - DNA, 14 bp, Homo sapiens
ctgtacaagtgctc

SEQ ID NO: 1928458 - DNA, 21 bp, Homo sapiens
ctgtacatacattgtataggc

SEQ ID NO: 1928459 - DNA, 16 bp, Homo sapiens
ctgtatcaggacccag

SEQ ID NO: 1928460 - DNA, 22 bp, Homo sapiens
ctgtatcaggacccagaggaag

SEQ ID NO: 1928461 - DNA, 12 bp, Homo sapiens
ctgtattctgca

SEQ ID NO: 1928462 - DNA, 20 bp, Homo sapiens
ctgtattttgtattgtttca

SEQ ID NO: 1928463 - DNA, 21 bp, Homo sapiens
ctgtccctccgggacctggtg

SEQ ID NO: 1928464 - DNA, 17 bp, Homo sapiens
ctgtcctcagcttctta

SEQ ID NO: 1928465 - DNA, 20 bp, Homo sapiens
ctgtcctggcccgggagccg

SEQ ID NO: 1928466 - DNA, 23 bp, Homo sapiens
ctgtccttcccacggccactgca

SEQ ID NO: 1928467 - DNA, 20 bp, Homo sapiens
ctgtctcaagagggcactgg

SEQ ID NO: 1928468 - DNA, 12 bp, Homo sapiens
ctgtctgagccc

SEQ ID NO: 1928469 - DNA, 16 bp, Homo sapiens
ctgtctgagccctgcc

SEQ ID NO: 1928470 - DNA, 17 bp, Homo sapiens
ctgtctgagccctgccc

SEQ ID NO: 1928471 - DNA, 20 bp, Homo sapiens
ctgtctgcaggccaccccca

SEQ ID NO: 1928472 - DNA, 16 bp, Homo sapiens
ctgtctgcgccgctgt

SEQ ID NO: 1928473 - DNA, 17 bp, Homo sapiens
ctgtctgcgccgctgtg

SEQ ID NO: 1928474 - DNA, 17 bp, Homo sapiens
ctgtgaccaatgtcttg

SEQ ID NO: 1928475 - DNA, 15 bp, Homo sapiens
ctgtgatgcctgaca

SEQ ID NO: 1928476 - DNA, 19 bp, Homo sapiens
ctgtgattgccatttcttc

SEQ ID NO: 1928477 - DNA, 19 bp, Homo sapiens
ctgtgcacatctgtgtctt

SEQ ID NO: 1928478 - DNA, 16 bp, Homo sapiens
ctgtgctgttgtctgc

SEQ ID NO: 1928479 - DNA, 17 bp, Homo sapiens
ctgtgctgttgtctgcc

SEQ ID NO: 1928480 - DNA, 21 bp, Homo sapiens
ctgtgcttcgggcccttccca

SEQ ID NO: 1928481 - DNA, 14 bp, Homo sapiens
ctgtggcccctcct

SEQ ID NO: 1928482 - DNA, 18 bp, Homo sapiens
ctgtggcccctccttctc

SEQ ID NO: 1928483 - DNA, 21 bp, Homo sapiens
ctgtggcccctccttctcccc

SEQ ID NO: 1928484 - DNA, 13 bp, Homo sapiens
ctgtggcctgggg

SEQ ID NO: 1928485 - DNA, 16 bp, Homo sapiens
ctgtgggactggccca

SEQ ID NO: 1928486 - DNA, 14 bp, Homo sapiens
ctgtggtgtgtccc

SEQ ID NO: 1928487 - DNA, 22 bp, Homo sapiens
ctgtggtgtgtccccctctgtc

SEQ ID NO: 1928488 - DNA, 22 bp, Homo sapiens
ctgtgtccacatctaacaaagt

SEQ ID NO: 1928489 - DNA, 13 bp, Homo sapiens
ctgtgtggggagg

SEQ ID NO: 1928490 - DNA, 18 bp, Homo sapiens
ctgttagtcatttgctga

SEQ ID NO: 1928491 - DNA, 16 bp, Homo sapiens
ctgttccccctgtgca

SEQ ID NO: 1928492 - DNA, 12 bp, Homo sapiens
ctgttcctgcct

SEQ ID NO: 1928493 - DNA, 20 bp, Homo sapiens
ctgttgtctgccgtgagagc

SEQ ID NO: 1928494 - DNA, 22 bp, Homo sapiens
ctgttgtctgccgtgagagccc

SEQ ID NO: 1928495 - DNA, 23 bp, Homo sapiens
ctgttgtctgccgtgagagccca

SEQ ID NO: 1928496 - DNA, 15 bp, Homo sapiens
ctgttgttcagaagt

SEQ ID NO: 1928497 - DNA, 19 bp, Homo sapiens
ctgtttaccctccctgtcc

SEQ ID NO: 1928498 - DNA, 22 bp, Homo sapiens
ctgtttaccctccctgtcccct

SEQ ID NO: 1928499 - DNA, 20 bp, Homo sapiens
ctgttttattgagttctgaa

SEQ ID NO: 1928500 - DNA, 15 bp, Homo sapiens
cttaaaaatatgtga

SEQ ID NO: 1928501 - DNA, 24 bp, Homo sapiens
cttaaaatgttcacttttgacaaa

SEQ ID NO: 1928502 - DNA, 21 bp, Homo sapiens
cttaaaatttttttctttcga

SEQ ID NO: 1928503 - DNA, 13 bp, Homo sapiens
cttaacacttaca

SEQ ID NO: 1928504 - DNA, 18 bp, Homo sapiens
cttaagaattttgagcag

SEQ ID NO: 1928505 - DNA, 21 bp, Homo sapiens
cttaagataatatttaaaata

SEQ ID NO: 1928506 - DNA, 22 bp, Homo sapiens
cttaagataatatttaaaatag

SEQ ID NO: 1928507 - DNA, 12 bp, Homo sapiens
cttaagcacttt

SEQ ID NO: 1928508 - DNA, 13 bp, Homo sapiens
cttaagcactttg

SEQ ID NO: 1928509 - DNA, 16 bp, Homo sapiens
cttacagtaggagccc

SEQ ID NO: 1928510 - DNA, 20 bp, Homo sapiens
cttacattagcagtttgctt

SEQ ID NO: 1928511 - DNA, 14 bp, Homo sapiens
cttacccacttccc

SEQ ID NO: 1928512 - DNA, 19 bp, Homo sapiens
cttaccccgtccctttccc

SEQ ID NO: 1928513 - DNA, 23 bp, Homo sapiens
cttaccccgtccctttccctgca

SEQ ID NO: 1928514 - DNA, 18 bp, Homo sapiens
cttactacatgtgggagc

SEQ ID NO: 1928515 - DNA, 17 bp, Homo sapiens
cttataagcaacatgaa

SEQ ID NO: 1928516 - DNA, 18 bp, Homo sapiens
cttatttaaattttcaga

SEQ ID NO: 1928517 - DNA, 19 bp, Homo sapiens
cttattttcttattttaga

SEQ ID NO: 1928518 - DNA, 15 bp, Homo sapiens
cttcaaaatcagtga

SEQ ID NO: 1928519 - DNA, 16 bp, Homo sapiens
cttcaaccattcccca

SEQ ID NO: 1928520 - DNA, 16 bp, Homo sapiens
cttcaatctacgatgt

SEQ ID NO: 1928521 - DNA, 16 bp, Homo sapiens
cttcagactctctcct

SEQ ID NO: 1928522 - DNA, 23 bp, Homo sapiens
cttcagaggccctcgctgccagc

SEQ ID NO: 1928523 - DNA, 21 bp, Homo sapiens
cttcagctttggatgtggtta

SEQ ID NO: 1928524 - DNA, 17 bp, Homo sapiens
cttcaggctcttctcct

SEQ ID NO: 1928525 - DNA, 18 bp, Homo sapiens
cttcaggctcttctcctt

SEQ ID NO: 1928526 - DNA, 23 bp, Homo sapiens
cttcagggggccaggtgcacaga

SEQ ID NO: 1928527 - DNA, 11 bp, Homo sapiens
cttcatcctct

SEQ ID NO: 1928528 - DNA, 19 bp, Homo sapiens
cttcatcgcagtggactgt

SEQ ID NO: 1928529 - DNA, 15 bp, Homo sapiens
cttcatggcagaagg

SEQ ID NO: 1928530 - DNA, 16 bp, Homo sapiens
cttccaaatcccctaa

SEQ ID NO: 1928531 - DNA, 22 bp, Homo sapiens
cttccacagcaaatgagatgta

SEQ ID NO: 1928532 - DNA, 17 bp, Homo sapiens
cttccactaccctccct

SEQ ID NO: 1928533 - DNA, 15 bp, Homo sapiens
cttccactgagggca

SEQ ID NO: 1928534 - DNA, 10 bp, Homo sapiens
cttccagatg

SEQ ID NO: 1928535 - DNA, 17 bp, Homo sapiens
cttccatcagcagtgat

SEQ ID NO: 1928536 - DNA, 20 bp, Homo sapiens
cttccatcagcagtgattga

SEQ ID NO: 1928537 - DNA, 22 bp, Homo sapiens
cttccatggtggtttcagaaag

SEQ ID NO: 1928538 - DNA, 13 bp, Homo sapiens
cttccatttgcaa

SEQ ID NO: 1928539 - DNA, 13 bp, Homo sapiens
cttccccctccat

SEQ ID NO: 1928540 - DNA, 14 bp, Homo sapiens
cttcccccttcccc

SEQ ID NO: 1928541 - DNA, 21 bp, Homo sapiens
cttcccctgcgccctccctcc

SEQ ID NO: 1928542 - DNA, 16 bp, Homo sapiens
cttcccgctcagccct

SEQ ID NO: 1928543 - DNA, 17 bp, Homo sapiens
gaccctgtctttgctgt

SEQ ID NO: 1928544 - DNA, 22 bp, Homo sapiens
gacctcggctgtgtggggaggg

SEQ ID NO: 1928545 - DNA, 22 bp, Homo sapiens
gacctggtgctgcctctacctg

SEQ ID NO: 1928546 - DNA, 14 bp, Homo sapiens
gaccttcttccaca

SEQ ID NO: 1928547 - DNA, 19 bp, Homo sapiens
gaccttgatgtcttgagag

SEQ ID NO: 1928548 - DNA, 12 bp, Homo sapiens
gacgcctggggg

SEQ ID NO: 1928549 - DNA, 20 bp, Homo sapiens
gacgggggttggggtggggc

SEQ ID NO: 1928550 - DNA, 20 bp, Homo sapiens
gacgtccacccgtttccaag

SEQ ID NO: 1928551 - DNA, 18 bp, Homo sapiens
gactaccacttatttcta

SEQ ID NO: 1928552 - DNA, 12 bp, Homo sapiens
gactcagggctc

SEQ ID NO: 1928553 - DNA, 16 bp, Homo sapiens
gactcagggctcctgg

SEQ ID NO: 1928554 - DNA, 17 bp, Homo sapiens
gactcattctgaaggag

SEQ ID NO: 1928555 - DNA, 16 bp, Homo sapiens
gactctcagtctctga

SEQ ID NO: 1928556 - DNA, 16 bp, Homo sapiens
gactctctccatcaga

SEQ ID NO: 1928557 - DNA, 18 bp, Homo sapiens
gactctctccatcagaag

SEQ ID NO: 1928558 - DNA, 15 bp, Homo sapiens
gactctctcctctct

SEQ ID NO: 1928559 - DNA, 21 bp, Homo sapiens
gactctctcctctctctccct

SEQ ID NO: 1928560 - DNA, 23 bp, Homo sapiens
gactctctttcttccactaccct

SEQ ID NO: 1928561 - DNA, 17 bp, Homo sapiens
gactctggctgccaaga

SEQ ID NO: 1928562 - DNA, 22 bp, Homo sapiens
gactcttttccaaacacaggca

SEQ ID NO: 1928563 - DNA, 23 bp, Homo sapiens
gactgaaattaaacgagcgaaga

SEQ ID NO: 1928564 - DNA, 13 bp, Homo sapiens
gactggcccaccc

SEQ ID NO: 1928565 - DNA, 14 bp, Homo sapiens
gactgggggtgcca

SEQ ID NO: 1928566 - DNA, 23 bp, Homo sapiens
gactgggggtgccaaccacctct

SEQ ID NO: 1928567 - DNA, 20 bp, Homo sapiens
gactggtcccccatgggctg

SEQ ID NO: 1928568 - DNA, 22 bp, Homo sapiens
gactggtgttatcaccgtgggc

SEQ ID NO: 1928569 - DNA, 16 bp, Homo sapiens
gactgtactcctccca

SEQ ID NO: 1928570 - DNA, 17 bp, Homo sapiens
gactgtactcctcccag

SEQ ID NO: 1928571 - DNA, 23 bp, Homo sapiens
gactgtctcaagagggcactggt

SEQ ID NO: 1928572 - DNA, 19 bp, Homo sapiens
gactgtgggtccctgcgtc

SEQ ID NO: 1928573 - DNA, 21 bp, Homo sapiens
gacttgtgcctcttgggagac

SEQ ID NO: 1928574 - DNA, 11 bp, Homo sapiens
gactttcctct

SEQ ID NO: 1928575 - DNA, 23 bp, Homo sapiens
gactttctcagcctctgaatatg

SEQ ID NO: 1928576 - DNA, 18 bp, Homo sapiens
gagaaggccccagggcag

SEQ ID NO: 1928577 - DNA, 14 bp, Homo sapiens
gagaaggcctgccc

SEQ ID NO: 1928578 - DNA, 17 bp, Homo sapiens
gagaatccacataaaag

SEQ ID NO: 1928579 - DNA, 13 bp, Homo sapiens
gagaccttctctt

SEQ ID NO: 1928580 - DNA, 16 bp, Homo sapiens
gagactactctgcctg

SEQ ID NO: 1928581 - DNA, 15 bp, Homo sapiens
gagactgcccagcta

SEQ ID NO: 1928582 - DNA, 13 bp, Homo sapiens
gagactgggctga

SEQ ID NO: 1928583 - DNA, 13 bp, Homo sapiens
gagagagagaggt

SEQ ID NO: 1928584 - DNA, 13 bp, Homo sapiens
gagagagtgtgga

SEQ ID NO: 1928585 - DNA, 16 bp, Homo sapiens
gagagccaccaagagg

SEQ ID NO: 1928586 - DNA, 23 bp, Homo sapiens
gagagccccacccctgaactggc

SEQ ID NO: 1928587 - DNA, 14 bp, Homo sapiens
gagagctggggaag

SEQ ID NO: 1928588 - DNA, 23 bp, Homo sapiens
gagaggaagccacgtgctggaga

SEQ ID NO: 1928589 - DNA, 13 bp, Homo sapiens
gagaggagagaat

SEQ ID NO: 1928590 - DNA, 15 bp, Homo sapiens
gagaggagagaatga

SEQ ID NO: 1928591 - DNA, 15 bp, Homo sapiens
gagaggaggtgtgga

SEQ ID NO: 1928592 - DNA, 23 bp, Homo sapiens
gagaggctctgaaagctgcttct

SEQ ID NO: 1928593 - DNA, 15 bp, Homo sapiens
gagaggggacttgga

SEQ ID NO: 1928594 - DNA, 22 bp, Homo sapiens
gagaggggacttggataggagc

SEQ ID NO: 1928595 - DNA, 18 bp, Homo sapiens
gagagtgcaacagtagca

SEQ ID NO: 1928596 - DNA, 13 bp, Homo sapiens
gagagtggctcct

SEQ ID NO: 1928597 - DNA, 17 bp, Homo sapiens
gagatgagaaacaacag

SEQ ID NO: 1928598 - DNA, 16 bp, Homo sapiens
gagatgtatgcccaaa

SEQ ID NO: 1928599 - DNA, 16 bp, Homo sapiens
gagcagaggggctgaa

SEQ ID NO: 1928600 - DNA, 21 bp, Homo sapiens
gagcatggccgcaacttccca

SEQ ID NO: 1928601 - DNA, 18 bp, Homo sapiens
gagcattctggggtgggg

SEQ ID NO: 1928602 - DNA, 13 bp, Homo sapiens
gagccacaggcag

SEQ ID NO: 1928603 - DNA, 21 bp, Homo sapiens
gagccaccgcgagggcctgcg

SEQ ID NO: 1928604 - DNA, 15 bp, Homo sapiens
gagccactcctctga

SEQ ID NO: 1928605 - DNA, 21 bp, Homo sapiens
gagccagcagctgaagtctct

SEQ ID NO: 1928606 - DNA, 14 bp, Homo sapiens
gagcccaagggaat

SEQ ID NO: 1928607 - DNA, 12 bp, Homo sapiens
gagcccagctct

SEQ ID NO: 1928608 - DNA, 16 bp, Homo sapiens
gagccccattcctggg

SEQ ID NO: 1928609 - DNA, 16 bp, Homo sapiens
gagcccctccctcctg

SEQ ID NO: 1928610 - DNA, 20 bp, Homo sapiens
gagcccctccctcctgtgtt

SEQ ID NO: 1928611 - DNA, 23 bp, Homo sapiens
gagccctgccctcactccactcc

SEQ ID NO: 1928612 - DNA, 24 bp, Homo sapiens
gagccctgccctcactccactccc

SEQ ID NO: 1928613 - DNA, 13 bp, Homo sapiens
gagccgcaggggc

SEQ ID NO: 1928614 - DNA, 18 bp, Homo sapiens
gagccgcaggggcccctc

SEQ ID NO: 1928615 - DNA, 21 bp, Homo sapiens
gagccgcaggggcccctcctc

SEQ ID NO: 1928616 - DNA, 21 bp, Homo sapiens
gagccgggtctgcctcttctg

SEQ ID NO: 1928617 - DNA, 22 bp, Homo sapiens
gagcctcctctctcaaactggg

SEQ ID NO: 1928618 - DNA, 17 bp, Homo sapiens
gagcctcctgaccctgt

SEQ ID NO: 1928619 - DNA, 14 bp, Homo sapiens
gagcgctggcctct

SEQ ID NO: 1928620 - DNA, 18 bp, Homo sapiens
gagcggccgcctgtcctt

SEQ ID NO: 1928621 - DNA, 15 bp, Homo sapiens
gagctcaggagaagg

SEQ ID NO: 1928622 - DNA, 17 bp, Homo sapiens
gagctcaggagaaggcc

SEQ ID NO: 1928623 - DNA, 13 bp, Homo sapiens
gagctgagcaggg

SEQ ID NO: 1928624 - DNA, 20 bp, Homo sapiens
gagctgcagttgtgaaagca

SEQ ID NO: 1928625 - DNA, 16 bp, Homo sapiens
gagctgggccctgggt

SEQ ID NO: 1928626 - DNA, 18 bp, Homo sapiens
gagctgtgcaggtgggga

SEQ ID NO: 1928627 - DNA, 19 bp, Homo sapiens
gagcttcatggcagaaggc

SEQ ID NO: 1928628 - DNA, 21 bp, Homo sapiens
gaggaaaaccaagccgtggct

SEQ ID NO: 1928629 - DNA, 21 bp, Homo sapiens
gaggaaaattaatatcacagc

SEQ ID NO: 1928630 - DNA, 15 bp, Homo sapiens
gaggacaggagaggg

SEQ ID NO: 1928631 - DNA, 15 bp, Homo sapiens
gaggagaggctgctg

SEQ ID NO: 1928632 - DNA, 17 bp, Homo sapiens
gaggaggtttaggtcaa

SEQ ID NO: 1928633 - DNA, 21 bp, Homo sapiens
gaggatgcagagtcagcagaa

SEQ ID NO: 1928634 - DNA, 15 bp, Homo sapiens
gaggatgggaaggag

SEQ ID NO: 1928635 - DNA, 24 bp, Homo sapiens
gaggcacacagctgcagagacaga

SEQ ID NO: 1928636 - DNA, 22 bp, Homo sapiens
gaggcagaatggtgggctccag

SEQ ID NO: 1928637 - DNA, 21 bp, Homo sapiens
gaggcagcagtgtgaggccag

SEQ ID NO: 1928638 - DNA, 19 bp, Homo sapiens
gaggccaggcatggcccag

SEQ ID NO: 1928639 - DNA, 18 bp, Homo sapiens
gaggccgaggcaggggct

SEQ ID NO: 1928640 - DNA, 15 bp, Homo sapiens
gaggcctggtctgga

SEQ ID NO: 1928641 - DNA, 19 bp, Homo sapiens
gaggcctggtctggagccc

SEQ ID NO: 1928642 - DNA, 19 bp, Homo sapiens
gaggctaaaacaaatctca

SEQ ID NO: 1928643 - DNA, 17 bp, Homo sapiens
gaggctccagagggcac

SEQ ID NO: 1928644 - DNA, 14 bp, Homo sapiens
gaggctgctgtcac

SEQ ID NO: 1928645 - DNA, 18 bp, Homo sapiens
gagggagaaggagaggct

SEQ ID NO: 1928646 - DNA, 20 bp, Homo sapiens
gagggcaaaccaggctgcag

SEQ ID NO: 1928647 - DNA, 12 bp, Homo sapiens
gagggcagcagg

SEQ ID NO: 1928648 - DNA, 23 bp, Homo sapiens
gagggcgcctgggtcctcccagc

SEQ ID NO: 1928649 - DNA, 13 bp, Homo sapiens
gaggggagaggaa

SEQ ID NO: 1928650 - DNA, 14 bp, Homo sapiens
gaggggagaggaag

SEQ ID NO: 1928651 - DNA, 15 bp, Homo sapiens
gaggggagaggaagc

SEQ ID NO: 1928652 - DNA, 12 bp, Homo sapiens
gaggggcctggc

SEQ ID NO: 1928653 - DNA, 14 bp, Homo sapiens
gaggggcctggcag

SEQ ID NO: 1928654 - DNA, 18 bp, Homo sapiens
gaggggcctggcagccgt

SEQ ID NO: 1928655 - DNA, 16 bp, Homo sapiens
gaggggcctggcctgg

SEQ ID NO: 1928656 - DNA, 19 bp, Homo sapiens
gaggggcctggcctgggtg

SEQ ID NO: 1928657 - DNA, 20 bp, Homo sapiens
gagggggccacctccccagg

SEQ ID NO: 1928658 - DNA, 22 bp, Homo sapiens
gagggggccacctccccaggcc

SEQ ID NO: 1928659 - DNA, 15 bp, Homo sapiens
gagggtcagagagga

SEQ ID NO: 1928660 - DNA, 22 bp, Homo sapiens
gagggtggcacttcgtggatga

SEQ ID NO: 1928661 - DNA, 13 bp, Homo sapiens
gaggtatgaggtc

SEQ ID NO: 1928662 - DNA, 12 bp, Homo sapiens
gagtaaaatcac

SEQ ID NO: 1928663 - DNA, 19 bp, Homo sapiens
gagtaaaattacagaagaa

SEQ ID NO: 1928664 - DNA, 17 bp, Homo sapiens
gagtagggttgccagtc

SEQ ID NO: 1928665 - DNA, 22 bp, Homo sapiens
gagtagggttgccagtcctgca

SEQ ID NO: 1928666 - DNA, 15 bp, Homo sapiens
gagtaggtgggtctt

SEQ ID NO: 1928667 - DNA, 22 bp, Homo sapiens
gagtccaacgtggggcagcaca

SEQ ID NO: 1928668 - DNA, 15 bp, Homo sapiens
gagtctcttctccac

SEQ ID NO: 1928669 - DNA, 16 bp, Homo sapiens
gagtctgaaggagagg

SEQ ID NO: 1928670 - DNA, 18 bp, Homo sapiens
gagtctgaaggagaggag

SEQ ID NO: 1928671 - DNA, 19 bp, Homo sapiens
gagtctgaaggagaggagt

SEQ ID NO: 1928672 - DNA, 15 bp, Homo sapiens
gatctaggtgaggat

SEQ ID NO: 1928673 - DNA, 21 bp, Homo sapiens
gatctcattggacccttccat

SEQ ID NO: 1928674 - DNA, 12 bp, Homo sapiens
gatctgaacaga

SEQ ID NO: 1928675 - DNA, 17 bp, Homo sapiens
gatctgatgcaagcaag

SEQ ID NO: 1928676 - DNA, 15 bp, Homo sapiens
gatctggagtctgaa

SEQ ID NO: 1928677 - DNA, 16 bp, Homo sapiens
gatgaaatgtaaatac

SEQ ID NO: 1928678 - DNA, 13 bp, Homo sapiens
gatgagtcctgtt

SEQ ID NO: 1928679 - DNA, 15 bp, Homo sapiens
gatgcctcctctgtc

SEQ ID NO: 1928680 - DNA, 13 bp, Homo sapiens
gatgctccttggg

SEQ ID NO: 1928681 - DNA, 21 bp, Homo sapiens
gatgctccttgggccctttga

SEQ ID NO: 1928682 - DNA, 20 bp, Homo sapiens
gatgctgactgtactcctcc

SEQ ID NO: 1928683 - DNA, 20 bp, Homo sapiens
gatggagccagctctgcatt

SEQ ID NO: 1928684 - DNA, 23 bp, Homo sapiens
gatggaggaaaaccaagccgtgg

SEQ ID NO: 1928685 - DNA, 19 bp, Homo sapiens
gatggggcggcctgcagac

SEQ ID NO: 1928686 - DNA, 23 bp, Homo sapiens
gatggggcggcctgcagaccctg

SEQ ID NO: 1928687 - DNA, 18 bp, Homo sapiens
gatgtcttgagagcgctg
